United States Patent 7,834,146 (RECOMBINANT POLYPEPTIDES ASSOCIATED WITH PLANTS) - sequence listing, part 2

SEQ ID NO: 4049 - DNA, 628 bp, Sorghum bicolor
  Clone ID: SORBI-28MAY03-CLUS70851_1
cagtgttgctgtggatgtatggatgcttgcagttccaatgtggtaccttcgaaaactcaaactgcattggaaaaagaagattggtgtcgctgccatgtttatcgtgggaacttttgtcaccgtcgtgagcatcattcgtctccagttcctcgtcgatctcggttcatctcacaacccaacgtacgaccaaaccgacatctcaatctggtcaacagttgaaatcaacgtcggcatcatctgtgcatccatgcccgctcttcgagtcattctcgtccgtgtgttcccctctcttggaggctcatcctacgattcgagcaagtacaacaactatggagaacattatggacggaaatcgcatatcatgagtcgaagtcgtgctcgggtagagttaccgtctcatacaggtgattctatacatacacctgagcatggaggtattgagttgcagaggacgttccatgtgcagtacagtgagaatgatgagcagagtcttgttaatggggagagtaagtttaacaagactcaagttacgactcagatgaggtctgaaagtccgagcgataggtcgttgtagatgatagtagttgattgatacctttagcagaactaatgaacattttctacaaaa

SEQ ID NO: 4050 - DNA, 615 bp, Sorghum bicolor
  Clone ID: SORBI-28MAY03-CLUS70869_1
tactgccaagcattggtccagagcgagacttcgaaggtattggtggctggcgtctgggtggtgacgatgaaacgtggactaccataaactcacgacttgagcttcctgacaagcaacaccatgggcgaaatcatcatcgttccccatctggtggccctacgacacctggagaaggcgggtatcttatgatgaagggtcgcaaccgaagccccggagcaaaacgcttagcatctcctaatagctctcgtacaagaacaccttctggcccacggatcgcttttacaaacaagtcatttattgacagttactttccaagtctcaaaacttctccaaaaggactgaaaaaactcccgactcagggtgtcgtcgatgcgtaagaccgactcagactcgttgcgctatcgtgtaaactattctaatgatctaatgaatgtttgtggttaaggtggaaaatggcacgaggacccaaagtgtcacagttaaatggtaatatgggggtttccattggcgtttgagcgagaatttgtcaattatctggatttacgatgatgcgaaaataagataccaatgacgtttcgaaagaaaacgacaaaggcgaattccaatctgccataa

SEQ ID NO: 4051 - DNA, 954 bp, Sorghum bicolor
  Clone ID: SORBI-28MAY03-CLUS70877_1
atttaacctaagttattaaatatcattcgcgattgctggaatggacgactgggaaaattgggaagaagctgccgaaaaggacgtcaaggaaatcaagaaagacaccaaatttgctgatgaagaaagcgaagctgtcgatatcgatgctaagaatgaaaccgccataaaatctcaacctaaaaaccctgaaaagaacgccaagaaagaaaaggcttctcaacttgctaaaaagtgggaagaaaaggaaaagcaatacgacaacgtgattggtggcgataaaaagggtcccttgaccgccgaagaaagaagaaaggctcagcaattatcagaagcatctgatgcgaaaaataccgtcgacttattcggaggattcattgaacaaactgaatctcaaaacttgaaaactgaacaagcattcattgattatgctaagaaaatcgctgaaattctcgctcaagaagatagaaagaaatacatccaagaattcatgaaggaacttttgcaacaaatatatcccaagctcacttctcttgaatatgagcaaattcactccaagtgcacaatcctcttcaaccaaaaaacaaaggaagaaaaggcaggacccggagccaagaagaaaactactcaacccaaattgaatgctgctaagggtagcaacgccgcaaaattgatggactttgacgaggacgatgacgaatatgtcccccgtggcagaaatgacctttatgacgacttcatgtaattgataggtttcaaaaaaggcaacttgctcatctttgatttgaaacattagttataaatatgcatattttccttgaataaaattatttggatgacgccattggctgtgtaatgtttatatcatatgaaatgggatagaagcataatgattatgactgtaaccgtgattgtgaccgtgacgatgaattgagtataaacttgaacaaactaaga

SEQ ID NO: 4052 - DNA, 687 bp, Sorghum bicolor
  Clone ID: SORBI-28MAY03-CLUS70550_1
gagctgcgcggcctgctgcgcgtgctccgggccaaggacgagcaccagtacctgaaagtggggaagctggtcctggccgtcaaccgcgggctcgccgtggcggggccggcgctggcgggcacggcggcggtggcggcggccttcatcggggccggtggagacggagctgcttcgacgtctgcgtgggcgtccggcgccgccgtggcgtgcggcgcgctggcggcgtgcgtgaacacggtggagcacgggggccagctggggatgctgttcgagctgctccggaactgcgccgggttctaccggaaggtgcaggaggacatcgaggcggtgctcggggaggccgacgtcgagcggagggagaacggggaggtgttccggaccaaggtggccctgctgctcggccgcgacgcggcggagctccggcagttcaggaggatggcgtccgcgtcggtgaaggacgaggatatcaaggactacgccgggaagctcttctgatgatcgtcggaagaatgtgcgtatacactatcggaaactcgggttattcattagttcataacacaaattagtgttcgtacatactactagtactctactagataggaagaggaattccattgattctttttgtaagtaacatgcaaatcgcattcattccaactgtgaaatgacaattctttgattgagatt

SEQ ID NO: 4053 - DNA, 645 bp, Sorghum bicolor
  Clone ID: SORBI-28MAY03-CLUS70587_1
acagaaggctgaagaccaatttggtgcaaaccacccaaaggttggtattatattgacctgtatagctagaatgtacaaaatgaaggcaaaatcggaaagttctacttcaattatggtccaggagggattatacaggaaggccctagaagtattgaaagctcctgctattaattctgagggtaccagcaagcaggtcgattggagagatatcatctcccttgccagaggtgagtacgcagagctgttattaattcagtctaacaggaaggcggaaggtgaacggatgaagcagtgggcagaagatgcttggaggaaccgtaggctaacgctagcacaagctctagagttttcagaaccttcaaagccgactctcgttgttgacacccggatcggcagggtcgtgtagcttcagccaacaatctcatgagacgtaccatgatgcaatgcgaggatgcacctcatgtaatatttcgaacgtgttgctcccatgtggactgcctgcgcttcgcaggcaatccgagaatgcacctcatgtagtagtttctccctgtggacttcgcctgcgctttgcgggtttgatgcgtcccactaccatgtggccatgtcccagtgtgtctgcttgtttttttttaccactttttttgg

SEQ ID NO: 4054 - DNA, 638 bp, Sorghum bicolor
  Clone ID: SORBI-28MAY03-CLUS7062_1
cccatgaacaattgaggatggtcgctcggctgcaggtgaaagaggtggcctaccgtcttgccgaaaggggtgttgccttggctgtgactgatgctgcattggacttgatcttgtcactctcttatgatccggtctatggtgccaggcccatcaggagatggcccacgcgtccggtagtgacggagttgtccaagatgttgatcaaggaagagatagatgagaactccacggtgtccatagacgcttctcccagcaaagatgaactgatttacaaggttgacatgaacggaggactggtgaatgcgcagacagggcacaagtctgacatcctgatccaggttcctaatggaggtatcaacggtggggcagcacacactgtgaagaagatgaggttgatggaggatgaccaggacgatgatgacatggaagaagagtgactaggaaattttgcgacatagttgtagacaatttagtatagatcttagatgccccgagacgaactagttgaaggtgcagaagtgccaaccccagcttgtgtagatgaaagtgaactagtttgagatgtaatcgaatcctggaccttaagattccatcacatttcattccaaaaaaaaaaaaaaagactagttctagatcgc

SEQ ID NO: 4055 - DNA, 571 bp, Sorghum bicolor
  Clone ID: SORBI-28MAY03-CLUS70636_1
caaccagcacctccaccagcagcagaggcattccgaaagcacatcacattagctaggcgttccaggttgcaggacacgcgaggaaaccgcagccatggccaacaaccgcacctacgaggagtacgagcccgccgtcgagtggagccgcaaccccgaggccgacgccgtcaagatctcgctcccagggttcaagagggaggacatccgcgtgctggtggacaaccacggccacctgcggacgcgcggcgagcggcccatcgccggcaacaggtggatccgcttccagaaggacttcgagctccccgccaactgcaacgccgacggcatccgcgccaagttcgagaacgagaggctcaccatcacgctccccaagaacacccccttgccgcccatgccggcgccgccgaagaggccgccccatatggcggcggcggttcctgagccaccggtgaggcctaccgtgccgctgcccacggtgcccgcggcgccgctggctcctgctcctcccgccgtgaagccgcccgtcgagcccaggccgtcgatgtcgaggaagacgtacgctcccgtggcg

SEQ ID NO: 4056 - DNA, 566 bp, Sorghum bicolor
  Clone ID: SORBI-28MAY03-CLUS71021_1
ctaatgaaatgaaactagccccaaatcctgtgatttgtgtccaacaattggtatctagagcctagtccattacctggggattttcccctttaccaatcctcaatccgtagccatatccaaccgttccaatcgttccccttcactctcctcccatggctccaccacctctagcggacggaacagcaggcggtcggcgactagcgctgagggtgacggcgacgcgactgctgctgcgcagatcgcgcgggaggtgcgagcggccgcgcgggaagcgcgcgcggtatgcgaggaggcggaggcgcagctgcaggcagccacaggggcggcgcgtctcgcgcggcagaggccaaagccgcgcgcgccgctgaggcagccaggcaggccacggctgctgcaagcagaggaggcggcagagcgggtcgacctagagcgggtggactcggaccacgccggacgcgacatcaacgcgcgtggggagcgggtccacgtaggcgtgcggggcgagtaggcggatgcggacgtggaccggctcgcggaagggcgtgacttcaacatgcgtggacgcg

SEQ ID NO: 4057 - DNA, 647 bp, Sorghum bicolor
  Clone ID: SORBI-28MAY03-CLUS70957_1
cccgcgctgaccgccgctgcgctccacctcgacgagccgcgggcccacgtcttcctaggcaatgggtccggcgacaagatcgacgggtggtgcctcgacaccggcgccactcaccacatgaccgagcgatgggagttcctctccaagcttgactccggcgtttgaggctccatcaagtttggggatgcctctgccgtggagttcaagggcgtcggctctgtcgtcttcactgccaagaccaatgagcactggctgctcactggtgtctactacatccccgcgctgaggaactccatcatcagcttgggatagctggatgagaatggctcgcgcatggagatcgaggacggtattctgcgaatctaggatcgccatcgtcgccttctcacaaggtgaacagaggcgccaaccgcctctacatcctccacgtacaggtggcgcagcttgcatgcagtggcggagcgtgaaccaaaatcaagggggggccgaatcacaaaagctctagcgaagaagccaatatgtgatgagaaactcctcgccgtagtggctcggtggtgtcagctagtagtatcttagtagtgattatggttgagttctcaccttaaaataaaactatctagcaaagtttactcgatttagaaattttc

SEQ ID NO: 4058 - DNA, 642 bp, Sorghum bicolor
  Clone ID: SORBI-28MAY03-CLUS71046_1
aacagctggaagccgatgggcagttgtcatgtcccgcaatgctggtttcacttctcaggtagtggagcttgatttcttatatccgagtgagggcatccacatgcgttgggacaatggctatcgcatcacggcaacagctgccacatgggaccaggcggcctttatcttgagcataccaaggagaaagcctactgatgaaacacaggaaaccctgagaacatctgcttttcctagccagcatgtgaaggacaaatggtccaagaacctgtacctagcttccatctgttatggaagatcggtgtcctaaagcctgttttctcgatttggtttggttgccgagaggtatattaatatcaaagacaggtggttttatgatatgagatggggtgttttgaagctcaaaactctgctaacctacttacctgcaactaacaaaaggtaacctatatatgaaaaaaaaagaaagcaaagtctgctgtgtttcgctaatcgataccatggagcaaagaacattctggtctgttttgtgttgttgggatgtgtataaattatccaaaggattaggttatgttgtaaagaatgtagaagcgtacctgctgaaccgttgccatgtatataaagctgaatttttacaaggtgttc

SEQ ID NO: 4059 - DNA, 504 bp, Sorghum bicolor
  Clone ID: SORBI-28MAY03-CLUS71048_1
gagcgggaacataagctttgatagcaacggagatcctgtaatattggatcctgcttgctactatggacacaacgaggcagagtttgggatgtcctggtgtgctggatttggtggggacttctataatgcctattttcaggtgatgccgaaacagccagggtttgagaagaggagggacctctatctcctctaccactacctgaatcactacaatctttttggctccgggtaccgttcatcagctatgtccataatcgaagactacttatatgtgcgggcggcttagtttcttctgtttttctcccaggaaaatagaagcaacgatgtccctgtgctgtgcataacatgtttcagtgtttcccagttacccctctcgatatgcggtggattcactccctgtgaaatctgctgtgagctccttgcgggcatgctacaccactatatcaatcactgaaaaaaatcttcatatgtgtaaataaatatctcgctgctggtccattggcc

SEQ ID NO: 4060 - DNA, 691 bp, Sorghum bicolor
  Clone ID: SORBI-28MAY03-CLUS7106_1
atcaaatgatcatggccagaatatattctgttcttgccaaatcgagggacaagcttgatctctatcaggagctgcttgcaaggctcaaggaaagccagcgctcccttggggaagctactgctgatgccgaacttcccaagagcgcttcggatagaataaaagcaatgggacaagttttatcaaaagcaagggatctattgtatgattgcaaggaaattaccgagcgtttgagagcaatgcttcagtcagcagatgagcaggtccggagcttgaagaagcagagcacctttcttagccagctggcagctaagacaatcccaaatggcatccattgtctttccatgcgcttaacaattgattattaccttctgtctccagagaaaagaaagttccccaatagtgagaatttggaaaatcctgatctttaccactatgctcttttctcggacaatgttttggcagcatcagttgtggtcaactcaaccatcatgaatgcaaaggagcctgaaaaacatgtatttcatcttgttaccgacaaactgaactttggggccatgaacatgtggtttttgctgaatccacctggggatgcaacaatccatgtggaaaatgttgatgacttcaaatggttaaactcttcttactgccctgttctgaggcagcttgagtctgcagccatgagagattacta

SEQ ID NO: 4061 - DNA, 614 bp, Sorghum bicolor
  Clone ID: SORBI-28MAY03-CLUS71081_1
gcaacaaccaacaacacaaatcctcgggcgtctgtcgcaggagaaaaaaaaaaaaggctttcttgtcccacaggccacaggaaaggagactgggagaaaagtcgattgtgattagttgatcaccgtccacaccatgagctctcgcatggccggggcagcggttctgcgccacctaggcccgcgcctgttcgccgccgagcaggcggccgtgtccgggctcaccgcgaggggcgtcatgcccgcggctgcgaggcttctccccgcgcggatggccagcaccgccgccgaggctgccagagaagatgccggcgcaaaacagcatggcggcaccgggaagcaagaggaggcagcaggcggcgggcagagcaagaaggccatcgtcagctactggggcatcgaggcgcccaagctcgtgaaggaggacggcacggagtggaagtggacgtccttccggccgtgggacgcgtacacgtcggacacgtccatcgacgtgaagaagcaccacgcgccgacgacgctgccggacaaggcggcgtacctgattgtcaagtcgctgcgggtgcccatggacctcttcttccagcgccggcacgccagccacgcgctgctgctgg

SEQ ID NO: 4062 - DNA, 556 bp, Sorghum bicolor
  unsure (1)..(556): unsure at all n locations
  Clone ID: SORBI-28MAY03-CLUS7078_1
cgccggggtagctcaagatgggattttcctcaacaaccttgaccaggagatgtttgagacgaatgtggacagtgaatctttgctagcattgtgcaagctggtggacaggtacatagctgaagttgcctctgatccaaatctgtccgtttcaagcttcgtggatttggtgacttccatgcctgaaacagccagaccaacacatgatggattgtacactgctattgacgtatttctgaagttgcatcccgggctacccaagatggagaagaggaagatctcgagcctgatggacgtaaagaagctgtccaagggggcatgcatccacgcggcgcagaacgaccgtctcccgctgagggtggtggtccaggtgctcttcttcgagcagctgcgtgccgcgggagccgccgccgccgccacgcccaacgtcagcgtggcgcggtgcatggcgcgcctggcggaggaggaagaggaggacgaccacgagcactggaaggagggccgtgcgctgccggagcccccgacccctggcgcgctgaagaggcagctggngagcctg

SEQ ID NO: 4063 - DNA, 590 bp, Sorghum bicolor
  unsure (1)..(590): unsure at all n locations
  Clone ID: SORBI-28MAY03-CLUS70790_1
gaatcgtgctgtaaatcctttaaattcgaacaaggaggaggaggaagaagaagagagcaagcccatggatcccagccagatgatgttccccatctggggggcgccccctcccgtcgccttgcagccaccctccgaggaccacgccgccgcccccagcgcgcaggcgcagcccttcctcgcccctcccaatcccaaccggggctggaagcgcaagaatcccgccgccgcctaccagccaccggccctcggcgatctccaggtgcagaaccgcgccaaggctcgccgctggttcaagaacaacaacaacggtggcggcggcggcaaccccaaccccaaccaaacccgcaagtatttcttccccaagaacaaaaacaacaaggccgccgcgccgcgcaacaccacctccttcatcatccgggccaagcgcgctggcggcattgcctccctcgtctccccgtgtcccgtcacgcccgccgtgctccccaccccgcgcctctccccttcccgcgagggtctcgctgacatggcccangcgcagtggggcgtagatgggtacggctccatgaagggcctcatccgcctccgtagct

SEQ ID NO: 4064 - DNA, 644 bp, Sorghum bicolor
  Clone ID: SORBI-28MAY03-CLUS7080_1
gaacgaaacgagcgcggggagctcgcggaccgcaaaaccctaaccccgcggcggcggcggcgcggcggagatggcagacggcggaggaggagggcctcctgcggcggcggcggcgctcaaggaccaggggaatgagcagttcaaggcggggagctacctcaaggccgctgcgctctacacgcaggccatcaagctcgaccctgacaacgccaccctctacagcaaccgagctgcagcattcctgcagttggttaagcttagcaaagcacttgctgatgcagagacaacagtcaagttgaagccacaatgggagaagggtcatttcaggaaaggttgtgttttggaggcaatggagcgctatgaagaggcaatagctgcatttcagatagctttgcagcacaattcacaaaatgcagaagtctcaagaaaaatcaagaggctttctcagttggccagggaaaagaagcgagcccttgatgtagagaacatgcgttcaaatgttgacattgcaaagaatttagaatcactgaagactgagttggctgcaaagtatggagatgcagaaacagggcagagtatcttttctttcattgtaaatgtgatagaatcagcaataaaggtttggcatgacacaggcaatgtag

SEQ ID NO: 4065 - DNA, 673 bp, Sorghum bicolor
  Clone ID: SORBI-28MAY03-CLUS70802_1
gattgctcattttaattccataacaactacaacacaacaatgtccaagttcgtcagaagctcaaagttccgtcacgttttcggaactcccggcaagaaggaggaatgctgggacggcatccaaatgtccaagaacgcctgggactccgactacttggatgttaacggcaagtacatcgctgtttgctggcaaaccgctggtggaggtgccgtcggtatcttggacgctgccaagcctggtaaattgggcaaagttggcttgctcaccggccacaagggtcccgttttggatctccagttctctcccttcaacgacaacctcgtcgccaccgtctctgaagacaccaccgttaaaatctggcaaatcccccaaggtggtttgaccgagaccaccgaagatgctgcccaaactttgtctggccacggccgtaaagttggtacttgcaacttccacccctctgccaacaacatcttggccacctctgcccttgacttctccgtcaagatttgggatattgaagccggcaaggagcagttcgccgttcctggccacactggtatcatccaatcttgcgtctggaactacgacggctctctcttggccacttactgcaaggacaagaaggtccgcgtcatcgaccctcgcagcagcaatgtcgtcagtgaggctgaag

SEQ ID NO: 4066 - DNA, 624 bp, Sorghum bicolor
  unsure (1)..(624): unsure at all n locations
  Clone ID: SORBI-28MAY03-CLUS71112_1
ctagttaacgaatggagtcatgagcttgcatacaccacangttgggatgggagttttgctctgcacttttatgcagtcttctgtcactttatttgttcatatttggcttttatcttcctggtgggctgattcaggatggtggatcgacctttttctagatgactttgtagatattgaaatccatatgctaatgcttttgtaagttttttttaaaaacaatggcctttgtaagtttgtgtcttctcactttttgcttccactgtaaattcatgtcttctaattttcatgatgttcactttcccttgaaccttccctcctacatctaccagtggttttattcattctccatgttgaacagttgaagtgttttagctttctggagaaactttaccaccaagtcaaagcaattttatgactgtaagcacgtgctcgttttctttgttatttgtgttttgaggcctaaaaagtcaagactacaagagacacaacaacgtcacagtaattacaagcaacttcagtgaagcgtattctggggcaatgaactatggcaatgttcacccgctcactcataaatctccatgcttcttattttttttgttgggaaatgttttctttttaatctct

SEQ ID NO: 4067 - DNA, 550 bp, Sorghum bicolor
  Clone ID: SORBI-28MAY03-CLUS71175_1
tgatgggccgatacgtgggcggcgccgacgagtgcgaaaggctggccgagtcagggaagctgcgggagatgatgcggtgggtcaaggcccgtggcgaggcgtgcgcggccaaggacggccgcggctgcgagggctgcggcggcgcaaggttcgtgccgtgctgggagtgcggcggcagctgcaaggtggtggcggcggacggagggacgccgaccaccaccggagaggtgcggcaagtgcaacgagaacgggctcatgatgtgccccatctgccactgattgcatttgcattgcatgctcatttagatcgtttactttgcattaattggatccgatgcaagtacagtagcatatagtatacgttttgttcaattattatttacgatcgttccattatatatatatgttgtacacgtacgatgtgtaaaatcttgtgtgttgtacggtgatacatatactgtagttgaaacttgaaagagagtgagaataaagagtgagtacatgcatgtttgttgcaatatatggttgtaatgaaggttgagaattcgtc

SEQ ID NO: 4068 - DNA, 639 bp, Sorghum bicolor
  Clone ID: SORBI-28MAY03-CLUS7121_1
cggacgcgtgggggacaaggaggcactagtcaagtttatagaggctgtttggcaaatggcaaggagctagcagtgaagatcctgaagtattctgatgaggtactgaaggagtttgtgacagagattgagattctcagttctctcaaccacaagaatgtgatatccctcgttggtttctgcttcaagaatgatgaccttctgttagtgtatgagtacttgcaaagaggcagcctcgaagagatactgcatggtgaaaaagaatgcaagagcatatttggttggactgagaggttcagcgtggctgtgggagttgctcatgctctggattatctgcatagtgataacaacagtcgcccagtgatccatagggatgtcaagtcatcaaatattctcatctcagaatgctttgaaccaaagttatcggactttggtctcgcagtctgggctgctgatgtaacttcccagatgacatgcaatgatgttgcaggaacttttggatacttagctcctgaatacttcatgcatggcaaggtgaacaacaaaattgatgtgtatgcttttggtgtttggccttctggagctcatctctggcaggaaaccgctttgcactggttgtccaaaagggcaggagagcctagt

SEQ ID NO: 4069 - DNA, 647 bp, Sorghum bicolor
  Clone ID: SORBI-28MAY03-CLUS71238_1
acgacccagtatctcgtgtgcaactgtgcataaccctcgctcacaatctcgccgcccccgccggccgccggcaatggagggcgtccacagcctcctggcccggcccaactccgcgccgttcgccttctcccagccgcccctccgcaggcaccacaggccgccaccgcctggcccctccgcctgccgcgccgccagccgctgggccgaccgcctcttcgccgacttccacctcctccctaccgccaccgccgccgccgacccgccggccgcggccccctcctcgtccccgttcgtcccgctcttccccgacgccgccgaccgcgccttgcccctcccggtcgacttctacaagattctcggtgcggagccacatttcctaggcgatggcattcggagggcatttgagtcgcggatagccaagccacctcagtacggctacagcacggaagctctcgttgggcgtcggcagatgctgcagattgcgcatgatactctcacaaaccagagctcccgtactgagtacgaccgtgcgctttctgaggatcgtgatgcggcactcaccatggatgttgcctgggataaggtaccaggtgtgctgtgtgtgcttcaggaggctggggaggcacaactggtgttagcaactggag

SEQ ID NO: 4070 - DNA, 690 bp, Sorghum bicolor
  Clone ID: SORBI-28MAY03-CLUS71250_1
gcacgaggcggcttctggccccttcctagttcctaacccccacgccaccactaccgccgtcccaaatccgcaaaccctagccctcgtcgccggcgggccatggccgagaccgtcgacgacaaggtcagctacttccaggccgtcaccggcatctccgacgcggacctctgcacggagatcctagccgcgcacaactgggacctgcagctcgcggtgtcctccatcaccgccaacccctcgccctccgcctcggcttccacctcctcacgcggggacccggccccttccgccccgctgtcggctgatgcggagttcgtcgcgcccccgcccccgccgccgatgcagctgccgctgccgccccagcagcagcagccggggatcgcgtggaggctggtgacgctccccttctacgtggtctcgggcggggtgggcctcgttgccggcaccttccgcctaggcgcctgggtcgccgggggcgtgctgtcccgctccctctccctcctcggcctcgcggggcaggccggcagcggcgaccgcctgctggagttgccgccgtcagctgccgaggcggccgacttcgtcgctgagttcgcgcgcgagttcggcgctggccgcggcccgagcttcgtggcagaggggttcgctgatgcgctgcagcgagcgcagcgggagttcaagcttctgttcgtg

SEQ ID NO: 4071 - DNA, 644 bp, Sorghum bicolor
  Clone ID: SORBI-28MAY03-CLUS71244_1
gaccgtgctcgcttcctcctccctcgaatcggctccacccccgcgccgcgataagaaaacccaccaaaccctaaccctagcagcagtgccaccaccgcccgcgtccccggctcccggccccccccggagaggaagccgagccagcaaggatgccgtccgggtcggccacgcaattccggtacacgcagacgccgtccaaggtgctgcacctgcggaacatgccgtgggaatgcaccgaggaggagctcgtcgagctctgcaaacccttcggcagggtcgtcaacaccatgtgcaacgtcggcgccaaccgcaaccaggccttcgtcgagtttgcagatcaaaaccaggcaatttcaatggtgtcctattatgcttcatcttcagaacctgctcaagttcgtggtaaaactgtatatatccaatattcaaacaggcaagaaattaccaacaataaaggcactggtgattcttctggcaatgtcctacttgtcacttttgaaggtgttcagcctaatgatgttaccatagaagtcattcatttggtattttcagcatttgggtttgttcacaagatagctacatttgagaaagcggctggtttccaggcgcttacccagtatactgatgccccaactgctcttgaa

SEQ ID NO: 4072 - DNA, 679 bp, Sorghum bicolor
  Clone ID: SORBI-28MAY03-CLUS74742_1
ggaactcgatcgctgctcactgtctacgcttccctccgcttgacgcgcgccgcgcccgtgcgggagcacgcgctcatggcgacgacgccggcgtccgcgcttcccaagtcgggggcggtatccaagggctacaacttcgcatccacttgggagcagaacgcgccgctcacggagcagcagaaggccgcgatcgccgcgctctcccacgccgtggcggagcggccattcccgcccaacctggaaaagagttcaggaaaggatggaggtgtggctgttccagagaaagaatctgctttagaggaggctggtgcaatggatgcagtcttggtgaatacacatcagttttacaagtggtttgcagaactggagtcagctatgaaatctgagactgaggaaaagtatcgactctatgagaatacattacaggagcgagtcaacacatgtgacggtatccttaagcaagttgatgatacattgaacttatttgaagaactgcagtctttgcactcgagcgttgccacgaagacaaaaactttgcatgatgcttgtgaccaacttttggttgagaaacaaaggctgattgagtttgcagaggcacttcgaagcacgctcaactactttgatgaattggaaaatgtctcaagcagcttttattctcaaaatatgaacattggaaacg

SEQ ID NO: 4073 - DNA, 630 bp, Sorghum bicolor
  Clone ID: SORBI-28MAY03-CLUS74744_1
ggatcgcgcaggcacgcgcaaccaaaaaaacacggccggactcgtctgctcccatcctcacctcgtttcaaattttcctctgttaaaccctacccaccggacgaatccctcggcagatccaaccagcttgccggaggaatacaccggtagattacatcaagcggcggggagagggaggagtaggcggctgagtgagggttagagctgggggaggccgtcgctgtcatggaggcgcaggcgacggcgacggtgaaggaggcgctcgcggcactgtaccaccacccggacgacgccatccgcaccgccgccgaccgctggcttcaggagttccagcacacgctcgacgcctggcaggtagctgacagtttacttcatgatgaaagcagtaatttggaaactctcatcttttgttctcagaccctcagaagcaaggtacaaagggactttgaagagttaccctcggaagcttttcgatcgttacaggattctttatatgtattgctgaaaaagtttaataagggaccacaaaaagttagaacacagatttgcattgcaattgctgctctggctgtgcatgtaccagtccatttcgaactctctagacgcctcctcggtcctctctgttcgccg

SEQ ID NO: 4074 - DNA, 637 bp, Sorghum bicolor
  Clone ID: SORBI-28MAY03-CLUS74762_1
atgctacaaagttaccattggtgcagagcgttttcagaaagctttggcttcatatatactgctggatgcctactcgaatgctaagactgaagacctatgggctgttcttgaggaggaatctggggagcctgttaaggatttgatgactacatggactaagcaacaaggatatcctgttatttatgcaaaaatcaatggacatgatttggaacttgaacaggcacagtttctgtctgatggatcctctggtcctggcatgtggattgttcctgtaacatcatgctgtggctcatatgatgcacagaaagagttcttattgaaagataaaacggataagataaatattaaagaatttgctgcctctcaaagtgctgatggggagaagaatcaaaacatttggatcaaattgaatatagatcaaactggattttatagagtgaagtatgatgatgaacttgcagctggacttgtaaatgcaatcaaagcgaagaagctctcattaatggataagattggtatcgtggaagattcgtatgcactctctgttgcttgcaagcaaacactgacgtcattgttgcgactgctgaatgcttataatgatgagtctgattacactgtactttcacatgtaacctct

SEQ ID NO: 4075 - DNA, 504 bp, Sorghum bicolor
  Clone ID: SORBI-28MAY03-CLUS74782_1
tggccacggccggacggtgggaggacgtggccagggtccggcggctcatggacgagcggaatgtgagcaaggaagccgggcggtcagtgatcgaggtccaaggtgaggtctgcgagttccagtgcggtggcctctgccacccccaggcggagcaggtgtatgccatggccagggacatgatgaggaagatcagggcagagggatatgtgcccgatacccgggacgtgctgcacgccattgcagaggaggagaaggagacgccattgctctaccacagtgagaagctggccatcgcctttgggctcctgcacacgaggtccggcgacacgatacggatcaccaagaatttgagggtctgtagagattgccatgaagcaacgaagttcgtgtctcacgtctttgatcgcgagattgtggtcagggacaggaaccggtttcaccatttcaaggatgggctgtgctcgtgtaaagattattggtaaaatccattgatcattatacgtt

SEQ ID NO: 4076 - DNA, 626 bp, Sorghum bicolor
  Clone ID: SORBI-28MAY03-CLUS71334_1
tccggccgctggatcagcttccaggtgggcgcggcgaccacggcgcccgcgtcgccccacctacaacctcgtccacccggccggcggcggcgcgtccgcctccaactccatggagctggacgggatggcggccgcggacatcggcggcaggggcggcggtcccgcggagttcgagttcgacaagggccgtgtcacgccgtgggaaggcgagcgcatccacgaggtcgccgccgaggagctcgagctcacgcttggcgtcggcgccaagtgaagcgaggcgacgacggcgctcgcaagcaagctcggatctttgagctcccgtactgaaatgtcgtgagcgtcgaccgtccggtactatcgcgaaaaaaaaatggctgctgtgtgagatcggcagcgaaattgtgtagtagccggctagctgcgtgaggaattgtcgacgcattcgtgctgcgattcgatcgggggaatatgtcggtgtaggtgtaggtgatgctgttgtttcattcatggactgggaaattgaggtgaatcagaacaatcgtttgttcgttcgttcgtctggattgaattattgatcacagatgtatggtgactcttttggatgtactggtagctcgttcttttcc

SEQ ID NO: 4077 - DNA, 615 bp, Sorghum bicolor
  Clone ID: SORBI-28MAY03-CLUS71483_1
gcacgagcccgataagagagctaccgagaaacagcctttcactgtcattctgcacgacgtgcccagccgtgaactctgattcttcttctccgattgctgcccacctgtaccggactgaattccagtgcgggcgcatgccaccgatgatgggctcatcctccttccgctcgctgagctgccagaggataccggcgatgaaactgaacccagcattctgtatgggttccatggacacgaacccctgcctcataaggtgctcaaaattcggatccagcctgcggcgctcagcttcccagggagaggaaaccagaagagcttggcctctaacgtttaacccaattgtcgccaccagcagttgattgatcggcttcggtaaatacatagcgcctctcagttttgtcaccgttttgaggtctgcttttgcttgccaattctttagttggtttgatatagtgttcaccgttgtgatatggtatgaactccgccggttccaagtccttgttgatatatgtcagaagcagcatgtaactactactactcccttggtatgtaagtacccttgtggtgttgtatatttccgggaagcaatgaaatgcaaaggcttcagtttttcag

SEQ ID NO: 4078 - DNA, 605 bp, Sorghum bicolor
  Clone ID: SORBI-28MAY03-CLUS71453_1
acaaggcagcggcaatcataactctactttttataattgcaattaacctggccattgggatattacctcatgctgataattttgcccacattggtggctttgcttctggatttcttcttggattcgtgctgctggcaagacctcaatttggctggatggaacgcagcgagctccctcagactaatcaccctccaaagtacaaattgtaccagtatgtcttgtgggttgctgcactcctcttgctggtagttggatttgtgattatcttggtcatgctcttcaagggtaagaacgggaacgatagctgccactggtgccattacctgaactgcgtaccaacatccagatggaagtgcgatacatagcttgctatattctgcaaagtatatgcttcttgagggagcagattttttttattttttatttttattttttttatgttggtgtgtttgtggaaatgtacgacgaaatgtgtcctcctccacctgaccatcctgcacttgtgccctaattctccctggttctttgaagtacaaatgtttcagaattgtagcccgagcttgtaactgttgatttcagcgcaattgctatatttgattctctca

SEQ ID NO: 4079 - DNA, 634 bp, Sorghum bicolor
  Clone ID: SORBI-28MAY03-CLUS71506_1
aaaacaaaagagggggaaaaaaactcgcgtcgcgtcgttgcattagccaccactcacttttcttttccaacgagcttcgactactccaacgccacttcgtcctagtgctaatcatcgcctcctcttaattgcagcaaccactacgcttggtgttctcggatcaaaaaagtggggagggagcaacaagaaacagatttggagcggcacgccagtaatacggacccggaggggtgacctggggcgtggagatttttggccgctacctgcatctccacgtcgcggtcccaatcaagatcattatttctttctccttccttgtccccgcccaaatcgcaaggcttggttcttgcaaatcgcctcttggcgtggccccaagattcgacgccccagcaccctcgctggaatcgtcggcgctgaggagggactcgaggcggccgtcgtcgcgcttgtctcgtctctcgtcaatctccctccctgtctggtctcttgttttattgcggggattcggcctgatttagaggagcgagttgctggtctcggtgccgtttagctcgctccggaccgacgatttggggcagctccaaaggcaacatcaggtctttcttgccgttagcttgagagatcatccacttcc

SEQ ID NO: 4080 - DNA, 749 bp, Sorghum bicolor
  Clone ID: SORBI-28MAY03-CLUS71538_1
gtcccgctgcccttccgacccggggctcctccgcgccctcgccgcacggcgtgcccgccgtggaggtgggcggcgtcgggctgccggctcggcgcgcggccggccgggccccgcgcgcggcggtcctcgctctcgtcggcgcccgctcatccccgcggcggctcacccacgggcgtgtccccccacgggcgtgtcccgccgcggttgattccacgcgagttaactgcctcccgagcaagcggagcccggcgcaagggtcgcggttcagaaggtgcgcgtacggctaggtggccatgctcctcggtgcccatgttcgtcggtcctctgtgaggaacttgtctttgtgaaggttggcgtcgtggctcgtccggttcagctcgtcggcttgctccccgcctcttgcctattcaggtcaggtgtgagaaactagtttttgagaaggaagacgatgtagctggtctgattgaactcattgtcttgcataaggtcactaagctaattatttcaggtgctgcagacaggcaatattcaagaaattatgcagagagctgatccatcatgcaagatttggtgtgtttgcaagggacaactaatctgtaccaggggtgaggaagaggagattgcaccatcagccacaccttttgtccctgattttgatcaccaagctctgcagttagtaccttaccagaaagaggacgacgttaagtcggagttggggttatacgatgagcttaaagaggcatgcatag

SEQ ID NO: 4081 - DNA, 605 bp, Sorghum bicolor
  Clone ID: SORBI-28MAY03-CLUS71539_1
cctactgggtattgcttgtcgtagccgtgaggagagcgttgccttcaggagatgacacttctattttttttttttgttcttctaataatagaaaagatactgttaacaatggcttcattaagtttatcacgttctattggttgctaacatgcttatttgagcttgcattttgtatgactagcgactcttaacttatccaagaggatttttcagatttaacttttcaataatttgagagagagaaatctttcgtttatatgcaagtggtaacgtggcatatcttaggtcatatatacttgcaaatcactacttattataaggctatttatttatttcatagttttgtctatgaatacaccaacaacaacaccaacaacaaagccttttagtcccaagcaagttggggtagactagagttgaaacccaacataagcccctagtcacggttcagcttcggtcgtccgctgcctctcctcgcactcctatctaaacaaagatctctaggatctccacaatgcactggtgcctcagaaggtctcctttggacatggccaaaccacctcaacctatgttgaacaagcttttcttcgattggtgctacccct

SEQ ID NO: 4082 - DNA, 588 bp, Sorghum bicolor
  unsure (1)..(588): unsure at all n locations
  Clone ID: SORBI-28MAY03-CLUS71092_1
tcacgccagcacgccgcgtgcgaccctcgacctcgagggcccgagcgtgacaccaccaccagcacgcccgcgtgcctgccaactgccatggctcccacggcgccgacgcagcggccgacgatgcgccactcctccgcgttcctcatccctccttcgcccccaccgtcctcctcgtcgcccgcgcctggtcccgatcccgatcccgacgacgacgacgccaccgtcgcgctcgtcgtcctcaaccagccgctgccccgcttcgcgcccctcctctggtcccgcgcggcggcgcgggtgtgcgcggacggcggcgccaaccgcgtcttcgacggcatgccggccctgctccccggccaggaccccgacgaggtccgcacgagttacaagccagatgtaatcaaaggggatatggactcngtaagaccggaagtgaaggaacattattctaacttgggcaccagaattgttgatgaatcacatgatcaggacaccacggatttacacaagtgcatagcttttatagcagagaattatcctgcctctaacaaatctaacttcagcatcctggtccttggagctcttggggga

SEQ ID NO: 4083 - DNA, 532 bp, Sorghum bicolor
  unsure (1)..(532): unsure at all n locations
  Clone ID: SORBI-28MAY03-CLUS71097_1
tcgccctcagtacaaccagaccgagaagaccgagtttaacaacttcactgttgacggccgttcttcccgacctcaatacacnttctgagaagactgaaatcaacaacttcactgttgacggccgctcttcccagcctcagtaccgtgataccaagacaactcaggtcaacaacttcaccgttgacacacctgttgctcgtccatctaacaagaaggacgtgagattcactgaagaaatcgtcgaaactaccaaggtcgacaacaagtccaagatgggttactacgacgacgacggtcactacaactctttccgcgccggtgctcacaagctcggtgatcgcatcgcccatggaggtcgtcgcgatattgagattgacatccacgagggtccccgtccctctgctgactgccttcccaacaccgtcagcatcccctgccaccacatccgcctgggtgacttcttgatgctccagggccgcccctgccaggtcatccgcatctcccgccgtctgtggtctcggctgctgaggag

SEQ ID NO: 4084 - DNA, 605 bp, Sorghum bicolor
  Clone ID: SORBI-28MAY03-CLUS71101_1
gctcgcccctgccccgcccgccccccgctccccgcgccctccccctcgcgccccgctccgccccggccgccgccccctcgcgggctgcccccccgcggccgccccaccgcccgtcgcgggccccccgcccgcgccgccccccgcccgtggcctgcccccccccgccgggccccccccccgccggccgccgcctgcccgacaccggccggccgccgcccggccgccgccggccacctgcccgccaccacccccccccatcccccgccgcctcaccgccgccccacgcttgccccccgcctcccccccgcctcagcgcccccgctgcccacccgccgtccacccgcctgctggtccagctccgctccagctgcccccacgcagcctccacggtgcctattcggcgcctcccctgccctccccacagcctcgaagcggtgttgagggggcgggcgcgctccagtgtggtgcttggcaggtgggaccgccgtcccctggtcgctgctgtacctcggctttgatgctcggtgtgatttgccaccgggtggagggaaagggagatctttagtgttgtgcaaggaatgttggatagctgtccctagtctctg

SEQ ID NO: 4085 - DNA, 605 bp, Sorghum bicolor
  Clone ID: SORBI-28MAY03-CLUS71108_1
ccacacctgactcggctcggctctgtgcgagcgcgacggcagccaacgtggcgctggcgctgctctcctcctgctcctgctcgccctccacttccgccgccgccgcctcctcgctcctccctagccgctgcctggcctcccgccgaagagcaggctcccgagtcaccatcatggcggctttgggccacgacccaatcagggaatggattcttacagaagggaaggccacacaaataaaagggatcaggtccattggtggtggctgcattaacaatgctcagcgctatgatactgacgcagggcccttctttgtgaagaccaatagccgcattggtccagaaatgtttgaaggggaagcgcttggtttgaaggcaatgtatgacacaaagtcaatccgtgttcctttgccatacaaggttgattctttacctaccggtggttctttcatcatcatggagtttattgaatttggtccttcaaggggagaccagtcagttttgggaaggaagcttgccgaaatgcataaggctgctaaatctgataagggatatggtttccatgttgataatactattggaagcactccacaaattaacacttggact

SEQ ID NO: 4086 - DNA, 780 bp, Sorghum bicolor
  Clone ID: SORBI-28MAY03-CLUS7167_1
tcgaggccggccgggtcaagaaaggatactgtctgctctgattcgcccgaacagctgctgtccctgcacccgtaccccgatccagcgatcgcatcgcatcgcattcgcatcatgggcctctgcctgtccgtggcactctggaaggagaagctctacggcgacagccggtcagtgcggggccgcgtcgtcgtccataaggttgccggcgtggagggtggtgactgcgagtacggcatcttgggaggcgacgccgacggcgtgctgggagtagagcagaagccgccgccggcggcggcggtggcggcggtggctccggcagcggcggccatgggcatgagaagtggcggtggagtggagggagctgccgctgccgtgtccggcggcactccggtgcggccgatatggcagaggagggtgctgatgggcgtcaagtgccagctgccgcggttcagcgggatgatactctacgacgagagcggccggccggtgtgcagtggcatcagggacagagcgcgtgaccaggagaagcatgctgcggcgatctcagtgctaagggacctgctctagtcttcatcatcggcacgtggtggcgattctattgaggggatatgcatgtttggttactctacatgtacgtctttattaatgggttgcatgttttttaaattagccagcttggtaataaaatcctttgtatttcgtgctatgggcgccagctttttgaatagactactatgtctatatgcatggtgtggaaaaaaaaaaaaaaaaaaggcccct

SEQ ID NO: 4087 - DNA, 715 bp, Sorghum bicolor
  Clone ID: SORBI-28MAY03-CLUS71690_1
aagtgggtgggtcagagtcagacaggccagcccgccacgccgtcccgacggccatggcccaacccttctcccctcacaccccgtcctcatcctgggtgactcgccgccctcctacctcgacgtcctcaccgtccgcctccaccacgagaacgagcgcctctcctattccggggtgcagaccgcgccgcagggccgtcgcgccggcggcctccctccacctcggccccggggagatcgccgaggtctcgcgcaacaaggttttgattgcggcgacggtggcgagcgcgatcgggcagctgtccaagcccttcacttcaggcaagaatgggggcgccggcgccggccttgacctcaggaccatattccgctctggagggatgccatctacccactccgcggtgaaaacatctgattactgaccccagtcccttaccaaaaccttctccttttcagtttctgcgttaccaactttggagatacctcttccacatgtttgggctgttgtgctaagttgtgatgtgaataacctagtcacagggaaaaatatttgtcttgtgtggtgaactgttatcattagtttgcacaatgaatgattgaggatggctgtgtaactagaatggattgatcatcgaggagttctgcaatgtaacgtaccccaaatggctataaaattgaattgaaacaaatgtggtggtttgtcaaacaagaagtgctg

SEQ ID NO: 4088 - DNA, 583 bp, Sorghum bicolor
  Clone ID: SORBI-28MAY03-CLUS71710_1
agagggacggccgcgagggaagccaagaaaaccacgccaacgccaaaagcagctgccgataccactgctgctgctgctgctgcacctgcctgcacaaccctcagccgccctcagcagggccgcaggtgagagcgagcgagcgagagagagagagaagcggcagcggctgcagcagccagcaaaggctggtgctcatgcagggcgagtaccggtcttccagcgaggagtcggcggccgcggccgcggcagcagcagcagcagccgcagccgctgccatggctcctcttgcggccgccgcagccgccgcggtgaagatggaggcggagcaggctgcgatggcggcggccggtgcggcggggccgcagctggggtcggcgcaccagcaccaccagcagcagatgcagccgcgtcggcagtaccgcggcgtgcgcatgcggaagtggggcaagtgggtggcggagatccgggagccgcacaagcgcacgcgcatctggctggggtcctacgccacggccgtggcggcggcgcgcgcctacgacacggccgtgttctaccttcgcggccggtcggcgcggctcaactt

SEQ ID NO: 4089 - DNA, 792 bp, Sorghum bicolor
  Clone ID: SORBI-28MAY03-CLUS71721_1
gtgcgtcttctctgctcagttgccacaaggtgctccaagaagaagaagaagggcctcaactactactgtcgtccatcagaggcaggctcagcatgtacgtgatcgaggacaagggcggcgccatcgcgctgatgctggcgtcgctgctgttcctgggcacctggccggcggtgctcacgctgctggagcgccggggccggctgccgcagcacacgtacctggactactccctcaccaacctcctcgccgccgtgctcatcgcgctcaccttcggacagctcggggacaggcaagcgcggcatgcccaacttcttcacgcagctgagccaggacaactggccgtcggtgctcttcgccatggccggaggcgtcgtgctcagcgtcgggaacctctccacgcagtatgcctgggcgtatgtgggcctctccgtcactgaggtcatcagctccagcatggtcgtggtcattggcacgacactgaactacttcctggacaaccgcatcaacagggcagagattctgttccctggtgtggcatgcttccttgtcgctgtcatccttggctctgctgtccatgcctccaatgcagctgacaatgagaagaaactcagtggctccacaaatgccaacaaacttgggacaagtggaactgtggaaccaagcaaaaaagtcctagacaaagatgctcccaaggatttggagaatggagcctctggagccaagcaagttgacagagctgaggcaggcactgcagaatacctcattgaactcgaagaacggcgatcaatcaag

SEQ ID NO: 4090 - DNA, 627 bp, Sorghum bicolor
  Clone ID: SORBI-28MAY03-CLUS71754_1
gattcctatgtttgaaagccggccaatgttctctacgactttggacgtatgacaatgggtgcaattttcttccgctatttttcccttcctctgctaaacattgtcctgcaaatgtataaaaggctttcatgcaaattgagcgatagctcaggtggtgtggctggttgtggtcgtgtccactagccggggttcgaaccccggtctcgcgcaaaaaactcccaccactagcttcagctgcagtgcgcactggccaggctgtggcgcttcgtcggcctggttacagtgttgctggcccaagtcagtttggctctctgggcatgggccagcgttcgggaggttttctgggccggttgcctggatctcctcagtgcaatgccataccggcggttctccccctattggtccagtgcagttttttttatgaaaggctttcgtgggattatcatgactgctcgctatcaaatctaaataatcaaattttcttgtaaaataatatcataagggttttgtagttggttggtgatgaaacttcgaacaacaatgtcatgttaatgcaatatgtgcaattaagaatgttgtaagattgaccaaggcttttgctttgtaaggttgacaaattgacatcgt

SEQ ID NO: 4091 - DNA, 791 bp, Sorghum bicolor
  Clone ID: SORBI-28MAY03-CLUS71752_1
tgaagaggcgagcaagattttgggagaggtaagtttatctgttatcattaagagtttctcaaagctagcataacactagtgtagattttatgcacttatgagtatgtgatagtgttgacgacatactttctagtgtcttcaaatgcttataaacaatctctatatcaggtaccactgctcagaacttttcgttggaacctgcatactaatgtgtggtttctatgacttgcttcttgcaaagaagggatactacattttcctcttccttcaaggcacggctttccttgttgctggttttgggtatgtcggaacactacctccttgcactgcataagctgtcatggacaactgatacacctgcttaccagaaactgagcaagcaaagctcctctctcttgcacatatggaactacggaattcaatgatagttgagcattattcccatcagtcttggccagacatgatccactgccaagaaggttcagatatcatcatcattctcctgtcactcttgatcagattgagacaaccattctttattgccaagaaggccattcaaatagtgtcgccatttcaaatttataataacagtgtttactgaagcatcatgacaaaaaaaaaatgattggtgcagcagcattttgttcaaatctgaacatctggtagagatgcagttcacagtcgtgaaagaattgcagctgctgtaaatggaatagcactagctgccaatttctgtagatctccgaacttgtagttttttttaatttattgatattactcagttcagatcc

SEQ ID NO: 4092 - DNA, 618 bp, Sorghum bicolor
  Clone ID: SORBI-28MAY03-CLUS7129_1
taaggcactgcacaagaacttccatgagctgaatggtaaaatggttgaggtcaagagggctgtaccaaaggagcagtctcctggacctattgcacgttcacctgtgggagggcagaactatgctatgagcagggttcataacttcctaaatggcttcaaccagggttacaacccgaacccccttggtggttatgggatgagggtggatggaaggtatggtctccttacaggtgcacggaatgggttctcttcgtttggtccaggttatggaatgggcatgaatgttgaaggtggaatgagtggatactttggtgcaagttctggttttgtcaatagttccaatgggcggcaaataggttcttacttcaatggtagttcaaacagattaggtagtccaattgggtatgttggccttaatgatgattcaggatcaatactaagttcaatgtctagaaatgtctggggtaatggaaatctgaactacacaggcaaccctacaaacacgaattcttttgctccacctggaagtggtgggggcattcctggtgatgaaattagttggggaagccttacttctgctcatgggatgggcaacatttcaagccttggatcgggaaa

SEQ ID NO: 4093 - DNA, 772 bp, Sorghum bicolor
  Clone ID: SORBI-28MAY03-CLUS71314_1
aaaccaacaagcattcgcatcaattcccaacaatgcaaatcttcgttaaaaccctcaccggtaaaaccattaccctcgaagtcgagccttccgacactatcgagcaagtcaagcagaagattcaagacaaagaaggaatcccgccagatcaacaacgacttatcttcgccggaaagcaattggaagatggccgtactctttccgactacaacattcaaaaggaatcgaccctccacttggttctcagattgcgcggtggtatgcaaatcttcgtcaagactttgaccggaaagaccatcaccttggaagtcgagccctccgacaccattgaacaagttaaacaaaagatccaggacaaggaaggtatccccccagatcaacaacgattgattttcgctggcaagcaactcgaagatggtcgcactttgtccgactacaacatccaaaaggaatctactctccacttggtgctccgtctccgcggtggtatgcagatcttcgttaagaccttgaccggcaagactatcaccctcgaggtcgagcctagcgacaccatcgaacaagtcaagcaaaagatccaagataaggaaggtattcccccagatcaacaacgcctcatttttgccggcaagcaattggaagacggtcgcaccctctctgattacaacattcagaaggagtccaccctccacttggtcttgcgtctccgtggcggtgctttctaaatcgctggattcgatgtaacggctagcgcacgaacgcgctaataaac

SEQ ID NO: 4094 - DNA, 663 bp, Sorghum bicolor
  Clone ID: SORBI-28MAY03-CLUS71320_1
gttgttgaagtgcaagtagtggttcgccgcaagcccatcatgagcaaactttcctgcttctttgggtccttgaagcttaccggcaactgcgagccaccacctggccgtttgactgaggttcgagcctgctaggtggatctgctatggtttccatcatgaggaaactgtcctgtttccttgggtccttgaagcttaccggcaactgggagccacaacctggccgtttgactgaggttcgagcctaggtggatctgctatggtgtccatcatgaggaaactctcctgcttccttgagtccttgaagctttaccggcaactgcgagccaccacctggccttttgactgaggttcgaacctgctaggtggatctgctacggtttccgcatctgtttttcgctcgttgtacatcggcagagtgtaattaccgacctgagtttgcacagccagcggaattcccccgggacagaagaccgaactgtatggtgttgcctgtgggtggcgagagagatttggctatcaggagacctgtgtattgttgtagagagagcgagaggtctgtgtgcatatctgatatcagtgttttccttgtaataaaaagatgtgctctccattaaaaaagtgtgcttcttgttttttatttttcaaaactcaagatatacaagt

SEQ ID NO: 4095 - DNA, 640 bp, Sorghum bicolor
  Clone ID: SORBI-28MAY03-CLUS71358_1
accgcggcgctcccaaaattcccccccgccttcccccgcaaaacccaccccacgaacccaaccaaaaaaatcccgcgcggccacccgaatccccccccccccgcctctccgctccccctcgcgctgcgtcgttccgtgcacccatggatccgcaggcggaggcgggcgcggcggcggtgctgggcgccgacccggcggcgctgacggcgctgctggcggaccttacttccccggccaacgaggcgcggtcgcgcgcggagcagcagttccactccctccgcgggtcccacccggacgcgctcgcgctgagcctcgcgcacctgctgctctccccggcgcacccctccgcgcccatcgccgccgtgctgctgcgccgcctcatcgccccgtcgtcccagtccttcgtctaccccgcgctgtcgcccgccacgcagtcctcgctccgcgcgctgctcctctcggccgcctccgctcctgcgctccccaggtccgtctccaggaagctctccgacgccgtcgccgagctcgcctccttcctcctgcccgccaacgcgtggccagacctactcagtttcctgtacaagtccatcgattccccgtcctccccgccggggctgcaggagtcggcgctcaacatcct

SEQ ID NO: 4096 - DNA, 538 bp, Sorghum bicolor
  Clone ID: SORBI-28MAY03-CLUS71127_1
acagcgtcccgttctgcctcctcaccatggacagcctcctggtgccgccggagctctacgtcggcgctccggaggcggcaccggcgcctgcgccggtggacgcgccacaggggtccccgcccgcggcggatgcaccgtcggtggcagcggaccacgcggaccacaagtccaagaagtctacggcgtcgtccgccgtcgtgtcgcgcccggtcgccgcgctcgccgcgacggccgtgtgttccgtcgtgctcgcgtccctcttgtgattgcgacgcaatgcaactgagagaacattttggctacctccggctgctggcagcacatccatccactgttgcttggcagctcctccgatctctacttctgcctcctccaatccaagcagataccccgtttccctgtgatctctctcctccgctctgttccggccgttggttgattgaatttgttggtgcattgccattttcccatgtaatttgagcaaaaaaaaacatgtacatttccccggcaacgtatcatatgcaactcatcttcgggc

SEQ ID NO: 4097 - DNA, 750 bp, Sorghum bicolor
  Clone ID: SORBI-28MAY03-CLUS71937_1
tgggggcggcggctggacacggcgatcggcgtggcgcgcgcgctggtgttcctgcaccacgagtgccgccccgcggtggtgcaccgggacgtggaggccagcaacgtgctgctggaccgggacgggcgcgccagggtgacggacttcgggctggcacgcgtggtccggcccggcgacacgcacgtgagcacggtggtggccgggaccgtcgggtacgtggcccccgagtacggccagacgtggcgcgccacgaccaaggggcgacgtgtacagctacggcgtgctcctgatggagctcgccacgggccggcgcgccgtggacggcgccgaggacgagtgcctggtggagtgggggcggcggatggccaaagaagggtggcggtcgtcgtcggagaaggcggcggccgtcggcaccgtgtcctgggagctcctgatgctcggcatgcggtgcacggcagacgcgccgcaggagcggcccgacatgccggacgttctcgccgcgctgctcgacgtggccgagaacagcggcgcgcacctccaatttacgtgacgagtataggtcatcgtcgtcgttgttgttgttgttgttttttcatttcgcttgtttttagcaattgttatattagttcgccattgattcatgatgtggataacagaaggaaggagagggctagatgcaattttggctgtaaagaagacacgttcgctgtacattctcatgcaaacaagaacttgtagattttccagctc

SEQ ID NO: 4098 - DNA, 619 bp, Sorghum bicolor
  Clone ID: SORBI-28MAY03-CLUS71946_1
tggcgggcggccagtgggggtgctagtcgccggtggtggcccctgtccctgccatgactgccctcccggacctccctcctgtttccgccctcattggtgctctcagcggatctctgtgcctgggctcccttcccggtccgcctccctgccggaatggccccgtagctggcgactccgcgttgcacgtccagatggtgttctaggccctggtgctgtccctgctcggtgccgcgcgtgccgcctgcgcgagccctcccgagtccttcctctctgcctctccctgccctcggctctctgctcttgtgccggctgtgggaccacctttatttcgagaacctcctcggggcgcatgtgtctccttactggtgtgtgccagcttatggggaacgggtgcttgggcagcctggatggcgcggcggccatgcggttcttcagcgtgagtgggggtgcggggggcagtcggacagtaccggagtgctgtgttgtggggccgatgcgtcgttgctaacagtggctgtatgctcctcctgttcatatagaagtggagtccgtaatttgtaaggctcatctgagttgttctccatatgctattaatgatacaggagagatgcttatttcg

SEQ ID NO: 4099 - DNA, 538 bp, Sorghum bicolor
  Clone ID: SORBI-28MAY03-CLUS7195_1
gcacgaggaccgtttattgcggcactcgtgaacaacatgtggcgatctacaactccggaggaggtccttgccatctttcttcttgaattgaaggccttggtggagatgcatcttaaacatcctgtgaggaatgctgtgcttaccataccagttgcattcagtcgatttcagcaaaccaggattgagagagcctgtgctatggctgggctgcatgtgttgaggttgatgccggaaccaactgctgtggcacttctgtatgctcagcagcagcagcagcttgtgaatgacaatatgggaagcggcattgagaaaattgctctgatatttaacatgggtgctgggtactgtgatgcagccgtggctgccacagctggaggtgtttctcagataagagcattatcaggatgcacagctggtgggaggatatacttcagaacataatgcgccatgttgtcccaattttgaccaattatatgctggccagacaatggatagaatccagtcgatgagttactgcgaatggaactcaagatgcaat

SEQ ID NO: 4100 - DNA, 748 bp, Sorghum bicolor
  Clone ID: SORBI-28MAY03-CLUS71962_1
ctaattacattgaaattgtatgcatgtaatttttcaggtcaagttccaccacatatatttaatcttactcaattaggcatcataaattttcattccaatagtttcattggtaccatccaactcagctcattcttcaaaatgcccaacctattcagattgaatctttcaaacaacaaactttctatagtagatggagcacgcggttcttcatgggcatccatccaaaactttgatactctatgtctagcatcctgtaacatgtccaagctccctaattccttgaagcacatgcattacgttgaagttcttgacctttcaaacaatcacatccatggccctgtacctcagtgggcatgggataattggatcaactcactcatcttgatgaacatatcgcacaaccaatttagcagtggtattggatatggccctaccatttctgctaatatgtttgttatcgatatcagttataacctatttgaagggcccatacctataccaggaccgcagaaccaactatttgattgctcaaacaaccaattttcatccatgccattcaattttggttcttactcaagtagtatttccctactcatggctcctagaaacaagttgtctggagaaattccacgatcaatctgtgaagcaacaagccttatgctccttgatctctccaataattatttgattggctccatcccttcttgtttaatggaggatatgagtcgcttgaatgtattaaatttga

SEQ ID NO: 4101 - DNA, 630 bp, Sorghum bicolor
  unsure (1)..(630): unsure at all n locations
  Clone ID: SORBI-28MAY03-CLUS71996_1
gtagagaggggcagcgaaaaagctcgcgcttttataccttcctagggtttcgggagtagcctccctcgcttcgcgccatctcccgcggtcccgcctccgccgccgcctatcgattcgccgcccggagcccaaattcccccggctgttcgatctgggatccgctagattcgtcggggcggtgatgaggaggtgatgggggcgatggcggaggtcgtgcaggaggggtgcgtggagaatcggcagcccctggcggcttcgagctcttccgtgtcggatggcagcagctgtggtggtggagggcgagcggggacgtcgccgcccgtgtcaagctctgggaattccatctccgttctgaggcgaacaagtggaccgataagaagagctaagggtggctggacgccggaagaggatgaaacactgcggaaggcagttgaagctttcaagggtagaaattggaaaaaaatagctgaattctttcaggacaggactgaggttcaatgtttgcatcgctggcagaaggttcttaatccggagcttatcanaggcccttggactcaagaggaagatgaaaaaatcattgaccttgtgggcaagtatggaccaacaaaatggtctatcatcgcgaaatca

SEQ ID NO: 4102 - DNA, 447 bp, Sorghum bicolor
  Clone ID: SORBI-28MAY03-CLUS7203_1
ccgaggttgatgagaaggatgtgaacctggatgctgccttcagtgtgcatgctgggattgcccacaccaggtgggccacgcacggtgtgcctgctccaaggaacagccacccccaatcgtccggtgccggtgatgagttcttggttgtccacaacggcattatcaccaactatgaggtgctgaaagagacactaactaggcatgggttcacctttgagtctgatacagacacagaagtcattcctaagctagcaaagttcgttttcgataaatctcatgatgaagaaggtgatgtaacgtttagccaagttgttatagaagtcatgaggcagcttgaaggagcctacgcacttatctttaaaagtccacactatcccaatgaattgattgcatgcaaacgaggcagccaactgatacttggtgtaatgaaatgagtggcaacagaat

SEQ ID NO: 4103 - DNA, 520 bp, Sorghum bicolor
  Clone ID: SORBI-28MAY03-CLUS7157_1
ccacaaagaatggtcgcctgtgaatattgtgagtttgaattgcctgcagttgatctccatgaacatcaggatgtatgcggaaaccgaacagaactctgccaaacatgcagaaagtatattagattgcgtgaatggatagggcatgaaatacagtgccatacgaactcaaatggttctgcagacacatccagtgccagagcaattccagagagagaactacgaccgccgccaccagtgcgacctgcacgaccagcacgtcctgctcatgcttcaccacacaagcggctcctcttcacaattgctgtcactggaatagcagttatgattggctccatactgttccaaagggacgagagtttctagctccagtagccatggacttactctgtcaagttgtattaatgtataataaccccctcgaatcagtgcataaatcgagtctgtttgagagtatagccccaggcatgggtttgttgaaaagcaaagtaaccgtgggtaaatatgttcgccttggcagtta

SEQ ID NO: 4104 - DNA, 666 bp, Sorghum bicolor
  Clone ID: SORBI-28MAY03-CLUS71590_1
taaagtaattctgttttagccttacctttacatgtaaacctttcaactccctttggtattgacccttctaagcggttccgagttctaacaaaactttcctatcttgtagagtgttgttgcagttgctacttcgcttgggctagaaagggggtttgcagactccgtatttggaatgtcagtggtgtttgcagccattgtaatgtatgatgctcagggagttagaagagaagtgggcaaccatgccagggttttgaacaagttttggatcctcaaagagaaggcacctctggagtattctgaagtggacatggcttctgagtttgtttcggttaccgaggaggcgatttcaaatgcaagcccctcgaagcacggttctagtacagaatcaccaagggtgaaggggctccatagttcagaacctgaggtaactgaggtgacagagctgaagcaggcttacatagaggaggattaccggttgagtgaatctgttggccacacagagcttcaggtcacagtcggcgccttgttaggttttgctgtaagcttagcagtatacgcgacactgtaacacagatttttttttatattactttcttaattagttacacgtttacacttttacacaaaaataacagaatcgattgattatggaattccattgataaa

SEQ ID NO: 4105 - DNA, 508 bp, Sorghum bicolor
  Clone ID: SORBI-28MAY03-CLUS71634_1
cggatacagagacgaggcacaacacgtcgccggtgaacagctgcgtggcctcgagtccactgtcagactgtgagcgcgcggcgttggaccacctgagcttcaagaggacgtcctacggcaggacccggagctgcgagcccccgccgcctggccgacggaacaaggctcaccggagctgggactcgtgccggagccagggcagctcgccggcgagggagttcggcaggacccacgccggggaccgtgacacggccagggacctcgatgtaattgatggcttggatagactgacttcgttctcgcacccgtcctcccccacgttttgctagaatgttagtaagtaggtattcttttgctgcatcaagcggctcttcgtacatcttgtatatgcgtgataatctgtccatatattatcctagtttatgtacatatataaacttgtgtcatagtctgtgattgagtgcaaatatataaagcgagatcaagtggtgttcggatcaaatagaaa

SEQ ID NO: 4106 - DNA, 1303 bp, Sorghum bicolor
  Clone ID: SORBI-28MAY03-CLUS71640_1
tgggactccatactccataccggcgaccgccgccggccgcccccgccccccggccaagccggtcgagcggctcgaggatcccccgtcggccgccgcccaccggctgctcgccccctgccgccgcctgccacctcgccaagcggttgtccggcggtggcgggcgcgccaaggagctgatcgggatagccggcggccgcccagtgccccagtccgccgtgcgctctggccccgcgctgtccaattgcagtccctgaactatcttggtttcgaatcctgggtccgccactgactccactacacggttcaacccgatgcttccggcgttgcggcctccccgccggctcccggtggcatccctccgccgccgcctctgcaccccctcctcctctggtactggcaagagcgatctccccgtcgacgcagcagcggtggctgcggccacagcaaaggcccgggcggaggcggcagccgggctcgggcggaggcgtacaaacaagtccaaaacttcgattggagcagtggcgccgactggaagaccgccgctaacatcctcttcacggtcccccccaagcgcaaggagttcgggcttgatttccaccttgtgcagctcttctttgtctgcatgccctcactagctgtctatttagtggcccaatatgcacggagggagatcaaaaggatggagggggaagcagaagagaaaagggaaaaagatgaggaacttgagaaacaaaaacagcttgaggaagaatctgccaaggaggatgctgattcaaagctttcgaaggttttagacagggtagatacactagaggctgtcgttaaggaaattgtggatgacaaaaggaaactctcttcccctgatttaccaaccaaagaggaggttgcgaagaaagataaagcatctccgggcaaggcttctgattcgaaaaacgatagtcagccagtgacagtcaagagtaaggacatcagctgtgctgcaaatgctccagcaaatactgcaaaaccaaacattaaggggatttgtgataaggcatttcctgttgagtccgagagttgataaatcgttcaattttctttttgtgtttcttagagccattactgttcttcgtttgaggtcccggtaagtgaatgaatagatgtaatttccactctggagtttccacaactgtgatatgatgggtcttagaaaaaaaatatatagcgagctaacgttttgtactacctagcacctttgatagttgaggctgtgattttggataatgaatatgacaaatccttcagcttactaggctggggtatt

SEQ ID NO: 4107 - DNA, 691 bp, Sorghum bicolor
  Clone ID: SORBI-28MAY03-CLUS72057_1
caaactcaaaaccaaaacaggaaaaaaaaaaaaaatcctccgccgacgcccgcgcggctcctcgccgccaccgcccgcgcgcgccctcgccgccgccgcgcacggctccggttgctgcgtcaccccaccgccgccacccacctcccctcctcgtaagtcggcacaccgccgccgccgcgcgcgcggctccggttgctgcctcccgccgacgacgccacccgcgccggtcgcctcctcgcgcctcggcacacagccgccgccctgcatcaccctgttgttactgcctgccgccacacacttccccgatctattgctcacactgctgttcgcaagaaaaccatggagggggctgatggcaagcaggattcagaaaccacatttatcgtcaaagttcacagagaacctgccatcattatcaacggcgttccagatttgccctctgattccacagctggttctcaatctttagtaaaaattgacacaaaacctcaggttgatcctcgttttggtggatggttagaagggaggaaagtgcagaagctttttggagacaggcattacgtcgggaaagtggccaagtatgacagtgaaagcaattggtacaacatcatttatgatgacggagaccaggaagatcttgaatggcgtgaacttgaggaaattctactgccattggacataactgttccac

SEQ ID NO: 4108 - DNA, 504 bp, Sorghum bicolor
  Clone ID: SORBI-28MAY03-CLUS72093_1
cgatgcagcaggcagcaccagcagacgaacgaggcgcggggaaaggaacaccgacgactggactggacccggcccggccgtcgccgaggacgcacacgcacaccaccgccgttccgaatcaacagcgacggacagggaacgttgaaacttgaaaaaaaaagtgaagccgtacaggcagagacagaggcgctcgcaccggcgtcccctcctcgcgacctcgcctgctccagctcaaacgcgcgcgcgcgctgaccggcaggtttggattggacgcgtgcgctgcatcctgcggggcggaaccggcgccgcggtgcggaggcccgacgactgcgggtggccgtgcgtgaccggcaaggtagcttttactaggagtgtactgtgtacccccaggcacccggcacgacctgctgtcttggggcttcgcgagacccggcagatcaacgtcggagtggacaatggacactgcttaaatagttttaaagaacatgaccaaaggttttctcc

SEQ ID NO: 4109 - DNA, 663 bp, Sorghum bicolor
  Clone ID: SORBI-28MAY03-CLUS72094_1
agccagcctacccaacatcacatcgcaggtacttcctacctgcaatcgcaaattcgcaatggctgcagtggcctcggcggcggcggcggtggacgcggtggcggctctcttctcgctgatcatggccgtggcggcgccgctgttcgactcccaggtcgtcctcccggtcagcctctacccggcgccgctggtggacatcttccggtggttcaccgccgagttcgacaactacatcgtggccgacgcgccgcctttcctccgcggcctcgtctggctcgacctcgccttcctctggccggtcagcgtcgccaacctctacggcatcctcgctcgccgacgctggtccgccaccacctccctcatggccggtgtctacatgctcacctacctgtctgcaatgtttggggagatgttgggttcagggacagcaacgccgaagctgcttgggttgtaccttctgttccttgttttcgctgtagcttcagttgcgcgtggcctctgctcctgctcaacacaggctacaccggcggcagcaggtccttcgtcgcctgcacttgctgctcggaagaaagagggtctagatccctgatcacgccatgtctggaagtcttgtattggggtccaaaacctctgaaaattgacataatgttcagaagttttgcg

SEQ ID NO: 4110 - DNA, 619 bp, Sorghum bicolor
  unsure (1)..(619): unsure at all n locations
  Clone ID: SORBI-28MAY03-CLUS72121_1
ggctgaaaacgtgccncaggatgagcatgggacactttaccaaattgcagattgtggtcccattgttgccgctcctgattatataaacacaggctattcccaagaccaaggaattccactgcatggtcagcaggaagtaatttccccttggccacaaaatccccaagatctgatggactttggttacccatttgagccggtggcaatgaacttcaacacgtatgaggactcaggtgcatcgacctctgctcaactcaactttgggccgcatcaccaccctcaacctggatcaaccagccttgctgctgcaccgccatggatggagcatgatcagggacccagctgctctggatatccatgatcaggtcaccccaacgacctccagtaagcacagaagccctggaaaatatttcctggttgtgtgaactgtttgttgtggtaccagtatgtttgtgtgtcatgtgcatagccattgtttgtaccagcttgcatggtgtacagatgtatgtttttttgtgtttggctgttcgcaattgtaggtcatgggtttgctaatctaaacaagactatgtgtattgaatgacttttttttcagtataaacgccactgagttttcccc

SEQ ID NO: 4111 - DNA, 632 bp, Sorghum bicolor
  Clone ID: SORBI-28MAY03-CLUS72128_1
tgacgccaggcactgcgagtggaggtaccatggggaatgggtgttgcctttcagacatgaaggcttctttgacagtgaactggatgcatgggttgggcttcacaaggatggtggcatttgctcctgccaagtcgtctctcacagcagcacaagtgccatgcagccggactggaagatggtcaaggacaagctgtggtgcgaagacaaggtggctcgtggccctactctgacgtacatgggtggttccagattttgcattgtggagtgtgtggtgcgtgagggactggactatgaggacgcctttggtgactgtgatggctgcatgctccatattaccatgctcggcctcaagcacaatcacaagggagagctgcaaaccattggccgcaccaccaactcctatctagtgtcaaagcatctttcatcgttttctcctgtagccttctggatgtaggaatggacctgctgtttggtttggttgtatgcaatgcatacttgtgtgaccaattaccatggatgtaagttgtgctttatggcaataaaaagtttggtttggttgtatgcaatgcatacttgtctgcccaattaccctggatgtaagttatgttttatgacaataaaaagtgtctaac

SEQ ID NO: 4112 - DNA, 814 bp, Sorghum bicolor
  Clone ID: SORBI-28MAY03-CLUS72150_1
ttggcctggaagcccatcttcctttagggagtacccgcctacggcctacacgagccgagcggggaaggcgatggtgcgctgggagagaggcgggcggcggcggcggcggcggcacgggcgcaccgcgccatcgggcacgcagggatggagggaaagttgacgacgccgtgcgactactctgtcccaggccgctagaacgctcggattcagcggagatttggccctgtcagacatcctgattgcaacgaaaaatcgaatatttcccagtaaggaacggaacggacctctgaatcaggataactcggtggaggagcacacaattgttggaggggggatgtccaagcggcggcaggagcaggaccagggccagggacaggggattggcaagaggttgcagaagcaaaaacatctctatctggtgctggatgattgggccaagggcttctcgatccataagatcgacgttgccaaccctcacctcggggaaccccccgtcctccggctggtggcacctgtgccttgttgtcccatgagttttgctgccctgggaagcaacatcttcactgtgagcaacaggcaccgtgggaccctcgtttacgacacagagacggcggcgctggccaccggcccttgcctcccggatccgttactcggcggcattaacaactttgtgtccgccgctgatacgctgtatgcattcgcatacttctttgccaaaaggcagcactcctttgaggtgatgtcgacggacagtgccaagcagggtctgtgtccatcaaccccaactttggattggtcatggcaaagtgtgcct

SEQ ID NO: 4113 - DNA, 801 bp, Sorghum bicolor
  Clone ID: SORBI-28MAY03-CLUS71783_1
ctctttccgtcaaacgcagcggtgggacacccgctgttgcgccagacaagatggtgtctcttaagctgcagaagaggctagcagcctctgtgctgaaggttggagccaggaaggtctggctcgacccaaatgagctcaatgagctgtccatggccaactcaaggcaaaacatccgcaagttcatcaaggatggcttcatcatcccgcaagcctgcgatcatccactcccggtcccgcgcccgtgcctctgctgaggccaagagcaagggtcgccacacaggctatggtaagcgccgtggtacccgcgaggcgcgcctgcccaccaaggtgctgtggatgcggcgcacccgtgtgctgcgccgcctgctgaagaagtaccgcgacagcaagaagatcgacaagcacctgtaccacgagctgtacatgaaggtgaagggtaacgtgttcaagaacaagcgcgtgctgatggaggcggtgcacaggcagaaggcggagaaggcccgcgagaagaccatcaccgaccagctggaggcccgccgtgccaagggcaaggccgcgcgcgagcgcaaggcagcgcgccgtgaggagcgcctggctgcgggtctgcacctggaggcggcggcccagcccgccaaggccactggcaagaagtagaccatgtccctcaccaccagctgcacggtggctccccaaggaggtgccgctgatcctccagcataagcgccaggcaccagcattacatttgacagttgctcctgctgacatggtggtgtcgtgcgtcagatgtaatgggggcctgtg

SEQ ID NO: 4114 - DNA, 305 bp, Sorghum bicolor
  Clone ID: SORBI-28MAY03-CLUS718_1
gcggtccggcgatgtcgcgaagacgcgagggtggcgccctgggagatgaggcgacgaacgcctccaggtggttgttgccgcgggcgatggcggcttcaacggcgtcggtgatggcatcgaccttggcattcatggaatggaagggaccggtgggatgccatggctacctttctggtgagcgcgaactccggcgatgtcccggcgaagttccggcgaacgtcccttttctctggccttttctctcggtgtctgagcgagcgttgctgataacgtgtgagagtggaaaagtgtgtgttttgataaaa

SEQ ID NO: 4115 - DNA, 684 bp, Sorghum bicolor
  Clone ID: SORBI-28MAY03-CLUS71853_1
tggctcggctcgggcgccaccaccaccactacactagcagcacgccatatgcctccgtccaagctatataacccggcgccgttgtacgccgcttcctccatctgctagctggccggccggccagtggaaacagcacacccagagctcgctcgcctctgcccctgcccctgcccgcccaagatccggcagtgccgtccgtcgcgcggtcgcgccggccaaagggagcgacccctatccatggaccccgccgcccgcggtggcggccacagcatcgcggaggaggcggcgcggctgtgggctgacttccccgtgcgcgtggactgggcggccgtggcggcgcaatgcgcgtcgctgtgggcgcacgcgcgggcgctggtgctcgtgccggcggtgcggctcctggtgttcctgtcgctggcgatgaccgtcatgatcctcctggagaagctcttcgtctgcgccgtctgcctcgccgtccgcgcgttccgcctcggcccgcaccgccggtaccgctgggagcccatcaccgccgccggcagcaacggtgccgccgccggagacgacgaggagtctggcggcggcggccacggcgaagccaagtaccccatggtgctggtgcagatccccatgtacaacgagcgggaggtgtacaagctgtcgatcggggcggcatgtgcgctggag

SEQ ID NO: 4116 - DNA, 726 bp, Sorghum bicolor
  unsure (1)..(726): unsure at all n locations
  Clone ID: SORBI-28MAY03-CLUS71888_1
aaatgcaaggtgatttgaacaagctggattttgatctgaacaatgtttatgattgtgctgctgaatggataaagaaacatgccaaaatttcagtttcttccatagatcgagtatggaacaaacttgggaatgctaactggggagacattgggacccttcaggttctcattgcaatatttcactcaatgatccaattttatggagagcctaagtattctctcgatgaactggcgacggaacatagctcaaggctacaaagtcgaagatcagaaagacatttggttgatagacaagctaatggtaatggcttatttcgattccaacagcgaagtcactctcctgaaattgttgaagttcaggaggaagcagctgtcgatgtgaaaccacatgaaaccttaaggcttgaaataggatctgttgtattgatggatgattcttacacacagaaaggttttcaaatcaatgacatcctaacagacagtgatcctcctatttatacttctactcctgtagaagaacctgcgaaaacttatttgctgtatgtaggctccagtccttctcatttggaaccagcatgggaggatatgaactcctggtaccaagtgcagaggcagaccaaagtactgacagtgatgaagcaacgatgtatttctagcagatatataccacagatggtatcttctggacggntcatccatccnnnnccatgtaacaagcctagctcaa

SEQ ID NO: 4117 - DNA, 766 bp, Sorghum bicolor
  Clone ID: SORBI-28MAY03-CLUS7191_1
gcacgaggttcaaattcaatttgttcagacaatacatcacttgatgtgcaaatttctcaggctgaacatcatagtaaagaagatttggccgcaactgttgtccagtctgcgtttcgagcgttcttggctaggcgtgctttacgagctttgaaaggaatagttctacttcaagcccttattaggggtcattctgttagaaggcaaacaacagagacacttcaatgtatgcaagcgctggtaaaagcacaagctcgtgtccgagcaagacaggttcgtgttgccttagagaatcaagtggcaaggaaaaagattcctgaacaagatgatcatgagaaccatgtccgagaagtcgagggaggctggtgtggcagtattggttccatggaggaaatgcaagctaaagcattgaaaaggcgagaagctgctgctaagcgtgagagggcaatggcatacgctttgactcatcagcggcaagctggttccaagcaacaaatttctacgagtctacaaggtcttgaacttggtgagaaccactgggggtcaaattggttagacaggtggatggctgtacgtccatgggaaaacaggttacttgactgtaatgccaaagagagtctgccaacgcatgaagataagaaggatgaggaagcaaattctcagatcacaccaaagggtaaagtgtcaacttcaaatactcctggtctgagcaagaagaaaggtgtaaccacaaaaagtcatattcagatgttagtgtacttattgcacg

SEQ ID NO: 4118 - DNA, 643 bp, Sorghum bicolor
  Clone ID: SORBI-28MAY03-CLUS72216_1
ctagcttagccgccactgccctccagccaccgccgccacagccgccgcttcgctcttctcacggccacgccgtccatcgaggcgaggtgcggcggctcggcccggccccgccggccccgtcccctcgcgcgtggatctgggtgcgcgcgccgcggcggccgcgggtctggtcctgccgcccgggccgcccgagccgggtccgtggcgtcgcgtgtggttgcccctgcgcccgccccgtcggccccgtgactgttcggtgcgccgggtgcgccctttcctcgtgctccgcgtcgcgtccgtctccccctggtgccttccccttgtgcctgtgtcgggacggtgtgtcgggtgttccgttctggcatgctccggggagcgtccctcgcgttgggtcggcccccgcgtgggctggtttagtggtgtgcggtttggcactccaggctgctgggctgggggctgggagtcccctgtcggtgcgggcccccggtaggccgtttaagttgtctgcggataagcacatcaggcagcaggtattggtgctgagagatcccttactttgtgagtgatcttaaggtcaaaaaatttaactgcagcgggtagcaatttgtgctttctcatcagctgtgttatcagttgagttttg

SEQ ID NO: 4119 - DNA, 583 bp, Sorghum bicolor
  Clone ID: SORBI-28MAY03-CLUS7226_1
ctgactttattgacaatcattggaaggtaaagaaagagattcttgacaagctaggattggattcgtcaccagtgaaatccaagaagaataaaagcatatccacgtacttctcgaagagatgtttacctccagaagaggctgtcaatgctctggctgcttctcctgagttgcggttgaaatctaaaaccaaaagtggcactgaagctcctcagatcaatctgttcccctcaaagcagtagaatttttaacaagataccctgaaagttggatcaggggtcatgaagctatgaacccagatgagcagaaagctcagcggttcatgtacaaaggctatggaagtgcaactcagttttgcatcatcatcgatggaagatgaccttagtgcaactttggtttttgacaacatggagatctggattatgtttccagtgttggacatgttgtaactttagctcgaaagtaggtttattcatgaggatattcagtaattattggcctgatggataacattgcctatgtgcgcacgcatgttgaatgccatcgcactgtgggtggacattccttgcaaacatgagtggctgtc

SEQ ID NO: 4120 - DNA, 693 bp, Sorghum bicolor
  Clone ID: SORBI-28MAY03-CLUS72393_1
tttggaaaagatacgcatcatgtgggaatcgatactgccaagatcaacttacaggaaaagtatgtgtcatgtccttgggtctgtcttctcaagaattacaagggatatgcttctgatagatgacatggcagcagaagagacattgcagcttcaaggccttatccatttggctctggaaaacctctcttcactatttctttccctggttgagaacgatgatggcagcacaaagttcttagaccatgacacttggattcaattggatggaattctaccctctttgaaaaagttccgcaagcttgcagagttgcttgatatgtcattgaagtccatcacagcatgttgggaaagtggagacctagctagatgtggtttcacatcatctgaggtgcaaaatttcatcaaagcaatattcgccgactcacctcttaggaaggagtgcctagggtggatcattaggacgccagcttagaatgcagaagcaacagcatatttgtcaccgggtcaatgatttttttttcatattcttttgaccacagcatgttaatatgccacagaagcaacatcatgttaatatgttattaatgtctggtctgagctaaatatagaagctgcatggtaatctttgtaaacaaagaactttggtgacccaaggttatgaaggatatactggacatccagaagaaaataggc

SEQ ID NO: 4121 - DNA, 627 bp, Sorghum bicolor
  Clone ID: SORBI-28MAY03-CLUS72452_1
cagagcatgcatatccctttgtcatatgcacgttttccggcggctgccgcccgtcgggcgtgcttctcccctcttcggtgccccgcttcaggtcctctcctcggtgttgtatgctgcccagggtttgaaagtcaacactctcagtcactactctgaagtttagttggagcttgcaaacaagcaggacatttaaggtgcttggcaacctacagtaacaaccaagccacctgcaaggcctaggcagcatacctgatggtgtcgacaagttaaagtgcttaccgaagctgtgttttgttttgaacctgttagagataagactatgagctcactgttaatgaaatttgagtaatgagctttaggtgttagtgagctaagcttttggttacaaggggtggatgtatgacttttggtcacatgaggtagatgtgcggatgttgatggcttgctcatgcacaaacttcatgtctgcgagcttctaatgtattttgtacatatatgatgttgaatctgaccagccatatattgggctaactcatatatgaatgaatcaatatcaatgttttatgctcatattaatcagtgtccttgtatgtatggttaatgtatatattgtattgaatgtttgtg

SEQ ID NO: 4122 - DNA, 658 bp, Sorghum bicolor
  Clone ID: SORBI-28MAY03-CLUS72413_1
tagtggagcaagtgggcttgccatattgacagttgcaaaagctggtgctattcttacttacaaacttggaactgggctggtagttgctcgaagatctgatggatcatggtctgcaccatctgctatagtttctgctggttttggatggggagcacaggttggtggtgagcttatggatttcatcatagtgcttcgtggcccagaagctgtccaaactttctgcagtcggatgcatttttcacttggagcaggtgtaagtgctgcagcaggacctgtgggcagagtactagaagcggacctgagagctggtgataaaggatcaggagtttgctatacatatagctgcagcaaaggtgcatttattggcgtctcattagaagggaatctagttgccacacggatggacgctaatctgcgcttctatggtgacccatatctgacaaccagcgacattctcacggggaatgtggaacggccaaatgctgccaaatttctttacactgcattggatgatctatactcagggctggattgttagtgtacatatatactttgtttatttcgattggacaagctgtatatatccacaaaaatgctttcgtttgtttggcagggctcaatttgtactaatgaaagagtaaagtcggtttcactcccc

SEQ ID NO: 4123 - DNA, 947 bp, Sorghum bicolor
  Clone ID: SORBI-28MAY03-CLUS72043_1
ctcttattctctgcttattacatcacctctccccgtggagaaccagaggaagagagcgcacgcgcgtgtggatgtggaggaggctgctcgccgctcggcacgtcgcccccgtcgccggtgcatccgcttcgcctcggtgtcttccatgattcgggaagcaaggccatgtatcccctgctcctcggattcctcgtcctgctcctcgtcgcaggcgaggtggtggtggcggcggtgcccaccggcgcgcagcagagcaacggcgacaaggaggtgctggtggagctcaagcgcttcctgcagaacaacaacagggtgaaccgcggcgcctatgacgcgtggcaggagtccgacgcgtcgccgtgcggttgggccggtgtgcggtgcgacaacgcgtccggccgcgtcacgtcgctggacctgtccggctccagcatctccggcccggcgttcggcaacttctcgcggctgcccgagctcgccgagctcgacctctccgacaacaccatctgcgcgcccggcgacatcgaccaatgccacggactcgtgcgactcaacctctcccacaacctcatcaacggctcgctggacctgtccggcctcaccaggctgcagacgctcgacgtgtcgtggaaccggctgtcgggcggcgtcgcggccaacttcacggcgatgtgcgccgccgacctggccgttttcaacgtctctaccaacgggctcacgggcaatgtcaccggtacgttcgacggctgcgccaggcttgagtatgtcgacctcagctccaacaacttcaccggcgagctgtggcccggcgtcgcgaggttcaggcagttcagcgccgccgagaacaatctcaccgggagcgtcccgccggccacgttcccggacggctgcaagctcgagtctttggacctgtcagcgaattacctgactggaagcttccctgactc

SEQ ID NO: 4124 - DNA, 535 bp, Sorghum bicolor
  Clone ID: SORBI-28MAY03-CLUS72050_1
gcacgaggggagtgaatcccacggcacgcgccatgtccgacgagtcgccgccgccgccagcgccgccagcgcaggcggacgagaagagccagcccgccgagcacgcggcaggcagctggggcggatggggcctctccatcttctcagagatctcccgcagcgcggtggaggttgctaagagtgccatcgctgacattcagcaaccgccggagcaggagacaggacccggtaccggtagtggcgagaaggatcaagagaaggaaccggagggggagggggaggaggaggagcgacgcaaggcggctctggacaagctagagaaggccagcgaggactcaatcctgggccaggggctgaaggcctttgatagctcggtggaaaccatcaccactggtacttggcaagctcttgggaccgcatggaagagtggctcgctatttgttcaaaaattggaaaattcagcttcaagcttggctgaaaccattcagcaaggagaactgcctgccaaagcatctgcgatagcgccaaccatttt

SEQ ID NO: 4125 - DNA, 591 bp, Sorghum bicolor
  Clone ID: SORBI-28MAY03-CLUS72055_1
tgggttcctctgttctctcgcggtctcgccatcccaagaacaggcacgcacgggcacgagaggaaggtggggagaaagaaaaccacagccgcttcaggcgggcgctcaccctgctcctccctcctcgcctggcctcgccatggaggcggcttccagcaggtggaccccggcggccgggctcctgctgctgctcctcctcctcgtcccgttcgccgccatcccgtcccgcgccgccacgccggcggcgtcgtccaccgccatcttccagctccagggcaacgtctatcccaccggccactactatgtcacgatgaacattgggaacccggcgaagccctacttcctggacgtggacactggcagtgatctcacctggctgcagtgcgacgcaccctgtcggagttgcaacaaggtgccacatcctttatatcgaccaacggcaaacagccttgtgccatgtgcaaatgcactctgcactgcacttcacagtggacatggctctaataacaaatgtccttcaccgaaacaatgtgactatcaaataaagtacactgatagtgcatcttctcaagctgtggatatgaccagcaa

SEQ ID NO: 4126 - DNA, 599 bp, Sorghum bicolor
  Clone ID: SORBI-28MAY03-CLUS72067_1
tcatagagtccctggctttgaaaatagaggaccttgctttggaagaatgagacctcaaccccaacctcaagctcaatctgaacctgagattagattcttcccttctcatggtccttttgaatttattcgttgcatgaatcctcaacaaactcaagctcaaaagcctcaagaacaaccaaatgttgagattgctcaatcccttttgaagaaatttgacgaggttgtgattgaagaaattaagccagaagaaaagaaagttgagcctgttgtgggtaaagttgaggttcttattgaagaagttaagcctgaggagcttaagaaggaaaaggaatatagccctgaaactagagaaaaggctcaaaagttgaaggagctttttagtgagttggatattgctcatttgttggactttgtgaatgaagtttctgatttgagctttgaagaattggttgagaattatagtcaattctaattgtaataaatttgaattgaattatttcatttgtgaaataaacatactttactagtgatataaaatatatatcgactgtttttattcaaaactatggtaacaaaatttttacataacaaacttttct

SEQ ID NO: 4127 - DNA, 591 bp, Sorghum bicolor
  Clone ID: SORBI-28MAY03-CLUS72600_1
agcagtataatggctttatgcgtacgatggtaccccaaagaaaggaaacaaactccaagaaagcaaaaaacccacagggcaatggatgatattaaagaaagcatcgccgaactgaagtactataaggacaacattttcaaaccacagaaatcaaagcggtagctgcatgtggaatagttgaatcaactaatagctaaccagaattgcagagggattttcaggtcaaagctgaatgccttgctttgggctatgtaaggggttacgttctgtacatccattgaccattagtgtttgggactttgggtttatggcactattacttcgtggtattctgaagccttcctgaatgcgtctcatagttgctgcatcacatacatagatagtattgattattactttggagggattgagaaacgatcccacccaagtgtgttgaactggtccgtccagcatcccatttgtttatgggaaagtctatttttgaccattcaactattttccaagtttgttttggcaatgtaactcaatagccagaaatctgtaactaacgaattatcaaataccggataaatttggtcatctatctggttc

SEQ ID NO: 4128 - DNA, 678 bp, Sorghum bicolor
  Clone ID: SORBI-28MAY03-CLUS72628_1
acacatcacttcgcctctctcgtcgcatcccaccccaccccaccccacccctctcctctccctcctccgctcgatctcccattcctcctcgtctccgccgccgcctgcccccacctccaatcaacgcacaacgcccagtattccagaaccttctcctaccagggaacctttgctcccctccccgatccggggcgcccctgatgcggtgcccgcgcggcgcgatcgcgtgacggacggccgccatggatcccccaggccccggcgacgaaggcgaggcggcgcagccgcagccgctggagtggcggttcgcccaggtcttcggcgagcgtgccgcgggcgaggacgtccaggaagttgacatcatctctgcaattgaatttgataaatctggtgatcatcttgccactggggataaaggaggacgcgtggttttatttgagaggacagatgctcgggatcagaatgccatccggagagaactggagagacaagatggtccagttactagacacccagaattccgctacaaaacagaatgtcagagtcatgaacctgagtttgactacctcaaaagtttggaaatagaggaaaagatcaacaagatcaagtggtgccagacagccaacagtgctctctcccttttgtctacaaatgataaaacaataaaatactggaagg

SEQ ID NO: 4129 - DNA, 492 bp, Sorghum bicolor
  Clone ID: SORBI-28MAY03-CLUS7267_1
gcacgaggctcctgcctcccgtccgtgtggcggcggcgccctagcttcgccgctccttgccttgagccgcgccgtcggaactccacctctccttgccttgagtcgcgccgctggaagcctggaacccgacgtcgagctccgccgctccttgccttgagccgcgccgtcggaactccacctctccttgccttgagccgcgccgctggaagcctggaacccgacatcgagctccgccgctccttgccttgaggccggtgacatcggccaagaagaagcatccccagccccacgacatcggccgagaagcatccccagtctgccaccctgcatttaacgcccgcagcaggtcagattatactactactggatggccaacagcgccatcgacccgaccactactcccacgctgagagagattcgaaaatccaactccagcagctcctccggcatccccatagcgccacgacagccgagcaccacccagatgtacac

SEQ ID NO: 4130 - DNA, 613 bp, Sorghum bicolor
  Clone ID: SORBI-28MAY03-CLUS72737_1
cccccaggggctcgctcgtcaagcggttgtccttcttccggcgcagcaggtcgcgttctcggtcgtcaagggcgtcgtcgtcgcccaaagatggcctcgtcggtaacgggatggcggcggccccggctccagcgccgccggtgggacttggacacatgaggcggttcacgagcgggcgcgccgcgtttcaggacttcgtctggcgggaggaggagaggagaagccgtgacagcgatgaggagttcgaggacgacgggttcgtagcgcattcggcgccgctggtgctcggcggcggggtggtagcctcggagccgaggaaggaggtgaacctgtggaggcgtcgccccatggctcctcccactccgcttgagcttccctaggctatagcgagctgctgcacgttcgttcatctctgtacaatgccctgctgctttctttagtttcatagtttgtatatacagctctacacagtagacggctacacgcctaagtgatgatgatacatgtttagtggacttttgcaaatgtggtgctcatcttggaaaaggaagaagtagactaaaactatgaaaaatctgtctgcctagcttggcaattttcttctataatatat

SEQ ID NO: 4131 - DNA, 482 bp, Sorghum bicolor
  Clone ID: 30163118
atgcaagattgttttggttgaaacactatctgctttgcctggttccaacctctggaagaagagcggcgccatttggtagcagcgcttgtccattagctcattgcatagacttctccaaggatagccatcagagttagctctggtctgctgcaacttgtgttgaggcctaacccagaagagcacgtcatggtggcgatgcagcagctgctacttctgttcttgctcttggtatacctccggccaagtttcagtcagacgaactcccaagatgttgctgcacttaaggctttgatggataattggaaaaatgaaccagaaagctggacaggttcaaccgatccctgcacctcctgggttggaatttcctgttccaatggtcgggtgacagaaatgagattagcaagcatgaatctgcaaggtacattaagcaatgccataggccaactatctgctttgaaatatctggacctgtctaataacca

SEQ ID NO: 4132 - DNA, 312 bp, Sorghum bicolor
  Clone ID: LIB3476-031-P1-K1-E3
aaaatttgaatatggatgaggtcaacagggcactctgtggataattctatcctacaaagatggcagcatgcttcctatatcctgatcaaatgcaaaacatcaaggcttaccatcttgggagttcgtctgactgaaacttggccggaggtataccaagagcaagaacagaagtagcagctgctgcatcgccaccatgacgtgctcttctgggttaggcctcaacacaagttgcagcagaccagagctaactctgatggctatccttggagaagtctatgcaatgagctaatggacaagcgctgctaccaaatg

SEQ ID NO: 4133 - DNA, 625 bp, Sorghum bicolor
  Clone ID: SORBI-28MAY03-CLUS72765_1
aattcccatccccccggccactccgcggaatcgtgcctagccagtcttcttcctccacggtccacggactccggccgcgcgcggcctcgctcgtcgtcgtcgtcgccggccggctccagcctctcgtctcagcctgccggccagccatgtcggcggcgttcaaggcgttcctgaacagcccagtgggccccaagacgacccacttctggggacccgtctccaactggggcatcatcctcgcgagtgtggctgatacacaaaagccccctgaaatgatatccggcaatatgacaggagttttgtgtgtgtattctgcactctttgtcaggttcgcatggatggtacgacctcagagctatttccttatggcaacccacagctgcaacgaggttgttcagctctaccagttgtctcgctgggctagggctcaaaagtttttcgggaggagagaggtaggagggcccaccataaagactgaccctaaaccatagtcactttgaacaacgatgaaactacgaactcatgcttcgaccatacaatttatgtattaccacaaggctattatgatgtgagaaactctgttatacgtgctgtaggtttatttataaatattgactttgcatcg

SEQ ID NO: 4134 - DNA, 645 bp, Sorghum bicolor
  Clone ID: SORBI-28MAY03-CLUS72165_1
gataatcatttcattcaacataacaaaaccaccaactcctcctcaactatccatgactattaaagtcgtttttaacaaccaaacccacagaatctccaagcatcctgttgactacaagactttgcttcaaaaagtcactgaaatcttcggagctcaactccctgaaagctggactcttcaatatcttgactctgatgaagacaagatcatgctcaacagtcaagaagactacaaaactttgcttgaagaagaagtcggaagcgaaaataagtctgtcaagatctttgtcttcccattggaaggtagagtgagccaaagtcaagttaagatcgaggaatccgttcctgaagctgttattgaagctgaaaagaaagaagaagaaatcattgttgaagaaaaaactgaagaattaatcaaagaaaataagcctgttgaagaagaaattgttgtctctaaagaagaagaagaaaaagttctcattgaagaacaacaaccaaaggttgaaatccaacctgaagctcccattgaacgtgaatctcaacaagaggctcaattcgaaatgcatcctcttcacagaatctttcttaatttccttcgccctcaccaagaaactcagcaaaaattcactgttgaagaacaacaaca

SEQ ID NO: 4135 - DNA, 659 bp, Sorghum bicolor
  Clone ID: SORBI-28MAY03-CLUS72173_1
tggccctccgcgccggcccgtgcccgagttcccacgcccgcgccgaccgcccgccccgggacctggtcctcccccgcccgcgctcccgccccttcccggtccgcggcccccgcccccgccggccccgccggtcccccggccccccccaggggggcccccgcccccgccgcccccccccccgggcccgggccccccctgcccttcccccctccccccaccgccgcccccccccccgccccctcccccgccgccgccgccgccgccgtggcccccgcccccgggggccccccccccgcccccccccccgtgggccgggtgccggggggccccccggccggggccgggggcccgggggcctccccccccccccaccccaaccgggggtgccgccggggcctgggggccgcccccccggcccccccccccgccgccggcccccccgcccggagcccggggatccgcccctccccggaggccgggggccccaaggcccccgttttgggccgggctaggatacttcagcagacaacacctacttttcaagaaatgcacccacatgagcacagttcaggcatggaaacatggattccacagcaaccagcagtgctgcaagggacagaagaggaaccaacatcttatgaatcagatgctactgctgg

SEQ ID NO: 4136 - DNA, 610 bp, Sorghum bicolor
  unsure (1)..(610): unsure at all n locations
  Clone ID: SORBI-28MAY03-CLUS72181_1
aagatgtctgttccaattccgaccaaataaaatgcagtaatggcattttcatcttatccttaaaaaaaaaaaaaaaaacgcagttcaagcacaaacaaacactagnccgaagcataagccattccacaagcacctggtgatatcatctcatcatcagaaaccaagagagagatttcgtgcccgttgtagtagattgtgaggagtagcaaagcgcagcagccatgaatccggacaacttcacccacaagacgaacgaggcgctggtggcggcgcacgagatggcgtcggaggccggccacgcgcagctcacgccgctgcatctggccgcggcgctggcggcggacaagggcggcatcctgcggcaggccatcacgggggcgtcggggggcgacggagcggccggggagtcgttcgagcgcgtgctgagcaacgcgctcaagaagctgccgtcgcagtccccgccgccggactccgtcccggcgtccacggcgctgatcaaggtcatccgccgcgcgcagtccgcgcagaagaagcgcggggactcgcacctcgccgtcgaccagctgctgctcggcctggtcgaggactcgcagatctccgactgcctcaa

SEQ ID NO: 4137 - DNA, 679 bp, Sorghum bicolor
  unsure (1)..(679): unsure at all n locations
  Clone ID: SORBI-28MAY03-CLUS7221_1
gtggaagcgcgaccccgccctcgacgccgccatctcccgggaccgccgcttccgccaggcgtcccgcctcgtccgcgaggtgctactctccccaggccgccgcctcctcttccgctacctcaccaagcgccgcgagcgcatcaagctccccgtccgcgtccccacgttcctcaggcgctaccccaccctcctcgccgtctccgctcccccggagcccgtcgcctcgccctccccgcacctcctcgctttcctcgacttcgcctcccgcctctacgagctccacgcccccttcctcgcctccaggctcgccaagctcatcatgatctcctgcacacgtgctctgcccgtcagcaagatcgccgccgccaagcgcgacttcggcctccccgacgacttcctggtctcgctggtcccgaggtaccccggtctctttcgcctcgtcggtgaccccgggcccgactcgtccggaaacgcgttcctcgagctggttgcttgggacgatacactcgccaagtcggtgatcgaagttcaggctgacaaggaggccgatgtcgtcggaattaggcccaggccaaacttcactgtgaaattgcccaaggggttctacctcaagaagaaaatgagggagtggatgagggattggctngagttgccatatatctcaccttatgcagatgca

SEQ ID NO: 4138 - DNA, 507 bp, Sorghum bicolor
  Clone ID: SORBI-28MAY03-CLUS72196_1
aaaaaaataaaaaaaaatattaaaaaaaaccgatgtcctctcctcttcccaacctcggtgtctcctccatctcaccccaagtccgacctcggcgtggtagcggcggcgcagcgcgggcagcactcctcccccctccctctccttctccctctgtcatgatcgcccaggcgaggccgtcccctagcgtggagaccccggcgtggtggcgcggtggctccgaggccgtccccaagcgtggagaccctcgacgtggtggtgcggcggctctgcgccccaaacgaggccgccccagcgtggtatccccggccatgggcgacctcctgctctcggccatattaaggggctctctctctctctctctctctctctctctctctctctctctccctcccctttagatgcaggtccatggtggggcctgtgcccggtgcgggtgggccctagcggcgtcgtggtcggtgcagagcagtctcgggtgcttctatttcttttgtactttgtgatttt

SEQ ID NO: 4139 - DNA, 612 bp, Sorghum bicolor
  Clone ID: SORBI-28MAY03-CLUS7287_1
aaatttgcaagcatcaaaacctgagcgatggaacattttcagggagagaactgggatttggggtaaaaatgactttgtccgaaatggatttgtggaccatattaatacaacaaaggactccactgactacctatggtacacaacaagttttagtgtggatgaaagttactcgaaagggagccatgttgtcctcaatatagactccaaaggccatggtgtccatgctttcctgaataatgagcttataggcagtgcatatggtaatggctcacaatcaagtttcagtgtgaaattgcctatcaacttgaggactgggaagaatgagcttgcccttctaagtatgactgttggtttacaaaatgcaggattctcttatgaatggataggagcgggctttacaaacgtgaacatctctggtgtgagaaatggaaccataaacttatcttcaaataattgggcatacaatattggactggaaggggaatattatagtttgttcaagcccgatcagagaaataatcaacggtggataccacaatctgagccaccgaaaaaccaacctttgacatggtataaggtaaatgttgatgttccacaaggagatgacccagt

SEQ ID NO: 4140 - DNA, 754 bp, Sorghum bicolor
  Clone ID: SORBI-28MAY03-CLUS72922_1
tgctcgataattcactgaagctatgcaattttgctaccggcaagttcttgaaggtatacagtggacatgtgaacagacaatactgcatccagtctgcgttctctgttacgaatgggaagtacattgtcagtggatcagaagacaactgcgtgtatatatgggacctccaagggagaaatattcttcagaaactagaaggccatacagacactgtcatctcggtatcctgccatccaacagagaacaagattgcttctggtggcctagataatgataggactgtaagattatgggttcaagatagttgatcaacatgctggtgtgaagtttgctcagaccagacctaaacagtgcttggctatcaatgaggaatatgtctgcttcccatggattgctcttccagatacgtttacaaccttaattacacatatcgcaaaaaagacattaaccatgaaagctttgttttaatcaaatgtgtcatcctaagttgtcaacgtggacaaatcagcatttgtcctaatgttgtgatatgttatgcccaacggttgtattccattcatattagtgcttgtagtttgcaaagttcacccctgtaagatgcaagatactctgctgttagctgtctagaaggcacgtcgcttagattacttgtttgctgatgtcaatagattggcatttctgccaaagctctagaaagtataagaggttttaacagctatttgtatctttctaaatggttcttgagtttatcgct

SEQ ID NO: 4141 - DNA, 629 bp, Sorghum bicolor
  Clone ID: SORBI-28MAY03-CLUS72927_1
gcaaagatagaaagtttctggcacaatctcgcaaacattgaaagtttctcaatctccgccagcgttccttctccagcccgccgaatctccgcccgcgttccttctgtagccggaagcgcagatcagcttcaaatccccgctcggctcacctggtgccggtagttcccgtccccacttcatcctcctcctcaaccggccgagcagcaagcagcagcagcgtcacccgccttctccgtcggcatccgtatcagcggctcccacccaccctcctccgttcctgcgttcttgcatccctgcgttccagcgccgcaagcctccacgaatcgagccctacgctgatttcctgcctccacggaaggtactctgcgacggcgccgcagcccagactcctctgcgccgacgcccttctccgtccctgcgttccagcgccgcaagcctcttccggctcgccgcctcctcggttcctacggtggatgctgtgccgtcgacgtgatctccacacacagactagagatctcggaggtgaccggagcctgcagcaaagctaattcgcatccaggatcttctggactggccttgggagttcatttggtggctgatggatcaagacgtccgtcgtcttctgctct

SEQ ID NO: 4142 - DNA, 570 bp, Sorghum bicolor
  unsure (1)..(570): unsure at all n locations
  Clone ID: SORBI-28MAY03-CLUS72946_1
atgtgcactaaatttncataaagtcatgtcatgcatgtgcatgcatgcattatacgatgatacatatggttgcctccatatcggcatgtgaagctgataaattttctcccttgcagcttttccttttttggtgttgtgctttttttttccgttcctgtctctgaagctcctcctctggcttggctggataaaccattgtctccataaagattgggggaaataaactaactattatacatcccctccaatccgaacagccctgctagtagctacttcggaagaaaattcatctacttcacagcctccaagtccaaagcaacctcgatcgatctcgagtcttattgcctgggtctctgtacgcctccaagtagtatatatatgcatccataatcatgttggaactgagatgtaacaactctattccctatatatatacgcgtactacgtacgtcctgttaattaataacctgtccgagagatgtcatgcatgggcgtgtgctccattccatggcgccgccgctccctgctgatcgaagcggatgatccgctccttgctgggcttcatcagca

SEQ ID NO: 4143 - DNA, 805 bp, Sorghum bicolor
  Clone ID: SORBI-28MAY03-CLUS7298_1
gatcctggtgttgatgcttattctgctgctgctctgagggctagtccatatgcagttcctggcttgcgcgctagtgggtttatgggcagccaggttattctgccgcttgcacataccttagagcatgaagagttcttggaggttattaggcttgagggacacagcctctgccatgatgaagttgttctgtcacgagatatgtatcttctgcagttgtgcagtggcgtggatgaaaatgcagctggtgcttgtgcacagctagtctttgcacccatcgatgaatcttttgctgatgatgcaccactgctgccctcaggcttccgtgtcattccactggatgcaaagacggatccaccatcaggcacacgcacacttgacctagcatctactcttgaggttggatctggtgggactactcgtgcttcaagtgatgcctccagcacctgcaacacaagatcagtgctgaccattgctttccagttctcatatgagaatcacctactggcaagcgtcgcagcaatggccaggcaatatgtcaggactgtggtggcatccgtgcaaatggtggccatggcaatagctcctttccgtcttggcggacagcttggaatgaggcaaactccaggatctcctgaggcgcacacgcttgcaaggtggatcggcaggagctacaggtttcacacaggagccgagctccttcgcacagacacccaatgcactgatgcttccttgaaagcactgtggcaacactcggactcgatcatgtgctgttccctgaaggctgctcctgtgttcaccttcgcca

SEQ ID NO: 4144 - DNA, 639 bp, Sorghum bicolor
  unsure (1)..(639): unsure at all n locations
  Clone ID: SORBI-28MAY03-CLUS73007_1
cccagggaaaggaaaaatcccgtccgaaatccagcgctccaaatccgttcgtcccctaggcgctcccccgaacccgtcccgaatcccgcaaatcctcgctgaaattccccaatcctccgtgctcgccccgccgccgccgccgccgccgccgccgcctcctccctgcgacccaggcccgccccgcctcctgtcgcagccgcagccgctgccgcggatttcctccaccccgagggtttcgtctcgctctcgctctctccgcgctactgccgccacagattggcgcgaccgacccgtcatccaggaccgaccttcttccgcccgcgaggccgggggggctcctcccgcggaaattcactctcgtccagaggcggcggcgccctcctattcatcgccgcccccgcccccgcgccctgctggtactcgagtggcngtggggtggagatccaccagggcgtggatcggttcctcttcgtttcttcgttcggtggtttttatcctccaggcgcggaatatcaatctatataggcgcagtaggagtttatatatatccccattttttcggggggttcaactgaacccccatgccccacgctaagtccgcccctggtggtggtggactggattggtggacgctactga

SEQ ID NO: 4145 - DNA, 598 bp, Sorghum bicolor
  unsure (1)..(598): unsure at all n locations
  Clone ID: SORBI-28MAY03-CLUS7246_1
tggcctacaacgaagcattagttgatgctagaatcacaaatggaggaattattcattcgacattcttggagtcacttatgaagcgagtgggagacatctttgcggagctgccaaacctcgaggacaacctccaccgttacttgagcatgggcacatggcctgatacccaaaacgacatcgtggtcctctcgtggtatctccattggtacaatataccacctccccatgttgtggcttctgcagttgagaaggtcaggcccagagttcctgccggtgtatctatgctccctctgcttcgcctcctgctgccaaacacgcaccttgtgggactaatggagatagagaagctccacattgtaatggaatactgaaggatgagcgtcgcaaattcaatcaacgttgggcttctgtggatgcgggttaatagtgaaaatacgtagtcatggatcaatatgaacggtagcaagcattgctgagtgctcttgtgatgaaaatctgcgagggtgttattacagctgttctgaattaagtggattagtcaaggggtatatttgtactatttgtgttgnatcnaannanaaaaaaaaaaaaataaaat

SEQ ID NO: 4146 - DNA, 725 bp, Sorghum bicolor
  Clone ID: SORBI-28MAY03-CLUS72492_1
ctctctctcctttttcctcccctcttcccggtcccgtgccgccgcacgcccggtcgcccgttgcccgcgccgccgcaccgcgcaggcggccaggcgcgcacggcgcaccgaccaccgagacctggcggcctggtccctgctgctgcatcgcggtgaagaggacgcggctgacgaggagtcgaggacgcggctgctggatcctctgccgtctgcggtctggctctgaagaggacgcaccgagccgccgccggattcgccccaagcacccaacggccaacccaaactccgaaaggggaaaatgtctactcctggcacatcttcggctgctggatctcaagtgcaagctgccgacgacgtgcgcgagctcctcctctccaccacagccgacgcctctgacccgtccacgcccctctcagcgcccgacctccgcctcctcatcgaccgcctacgcctccgctccgaccgcctgcacgcctcggccctctccttcgccgcctctaaccgcggggccctcgccaacgcgctcctccgcgcagcctctgccgccgattcctctgcctccttaaagtcttccctcgactctgcgcttgccccgctcgcctcctcgcctgacctctccgacctcagggcccttgccgaccgcctcctctctgcccgccgcgagctcgccgagcgccaggagcacctcgctgctgcctccacaattgcttcgctcgctgcccgcc

SEQ ID NO: 4147 - DNA, 461 bp, Sorghum bicolor
  Clone ID: SORBI-28MAY03-CLUS7250_1
gcacgagggttttagagtattgatgtatcgagatgtaaccatgtgtcttctctgggcttagcttcactcatagatgatcaaagatttctccgaaaaataaatgttggacacagtttgcatgagatagagacctgtcttctgagcaaattatcaacaataggagaaactttaactgttttaagactcgatggccttgaaatctttgcctcaaatcttcaggcaattggttctacctgcaagaatttggttgagattgggcttagcaaatgcaatggcattacagatgatggtatcgtttcactagttgctcattgctgtgacttaaggactattcgcgtgacatgctgtcatcttcttacaaatgatgcccttgctgcaatcgccgaggattgtagaaagtatgaatgccttcgactggaatccttgcccttttatatgtgagaagggactagaacgaatcg

SEQ ID NO: 4148 - DNA, 1376 bp, Sorghum bicolor
  Clone ID: SORBI-28MAY03-CLUS72553_1
actattctcacttccggagttccggtggtcgtcgaactcgtcgtcttccgtccatcccatcctcggcggcggcggcggagagagagcaagagatgacgtcctcggggacgggcgcgcagcagctgccgcgaacggaggcgcggtcgctgtcgggtcacgagggagcggtgctggccgtgcggttcaaccgggacggcaactactgcctgagctgcggcaaggaccgcacactccgcctctggaaccctcacactggcgcccacgtcaagacctacaagtcccacgcccgcgaggtccgcgatgtccactcttcctcggataacgcgaaactggtgtcctgcggagccgacagacagatcttctattgggacgtcgcctcgggccgcgtcatccgcaagttccgcggtcacaacagcgaggtcaattcagtgaagtttaatgagtacaacgctgttgtagtctcagctggttatgaccgtacggtgcgtgcatttgactgcaggtcacaaagcagtgaccctattcagacaattgatacttttcaagatagtgtaatgtcagttaacctaacaaagacagaaataattgctggcagtgttgatggtactgtccgggcatttgacattcgtatgggtagggagactgttgataatctggggcatcctgtgaactgtgtatcattatcaaatgacagcaattgccttttagctaactgtttagattctactgtgcggcttctagacaagtcatctggagaactgttacaggagtataagggacatacgtgcaagtccttcaagatggattcctgtctgacgaatgatgatgcatttgtcgttggtggatctgaggatggttatattttcttctgggagttagtcgatgcacctgttgttgcaagattcagggcacatagttctgtggtaactagcatcagttaccacccaacgaaggcctgcatgttgacatcttcggtggatggctctattcgtgtttggacctgaagactcttgaacggtggatgtgctattcgtactattcctccaaatcatccggttatctagctgcaaggattcaacagcatgaaagatgaatgaacctaatgggattcatgcatgccttgttgctatgacgttgagagaagaaaatgtgctactgttgggttgtgtagcacgaagctctgtggccaaaaccttttgaagctggtattctctgtcttctacatagtttgtgagccttttagatgatcgaattatacctgaagacaacttgtgagttgcatgaaaggtaacacttgttacgaagtttcactgtaagtgtcctgtctccatgttactgaagacaacttattgggctttgagaaatgcggtgatcaa

SEQ ID NO: 4149 - DNA, 729 bp, Sorghum bicolor
  Clone ID: SORBI-28MAY03-CLUS72514_1
gtcgtgtcgcgtagtcgtcctcttcctcctatccttcattcctccccccactcgtgcaccgtggtcgtcctgccgccggcaactcgactcggcccaacaagccacgcaacctttgcgcttccgcatccgcagtccagaggcgtcgacgcgcgcctgccctctccgccggcacggagcagggcggagagccgccgcctgggctcggactgactggcgtgcgctcctcttcctcgcgttcaaggtcatgtgctagacattgatcgccatgtcaacgcgtagggagattgtctcgtatcacccattgcctgcaccaggcgtgacaaacagcctcaaggatgagatccagtcaaaagttacggaaacagttagcaatgcgatcaactcatttgatccaaacgcgttgcctcggcatatagaaggggcattgggtacagctggaaacctcattaactcatttgagccgaagtggtctgggaaaaaggagtttgatttcaacggggaagctgatttccttgatggataccaatgtcctgatgaatattggggctctgcgcctgtgaaggtgcagaaaccagttaacattaagaatctgctgggcggagttattgcaataatcggtcgcaatttgggaaatactgaagttgaacagcccaaggacactaagaacagcgtctcattccttgggtcaagtgatgatggtaacacattcttgcattcctcagtctacat

SEQ ID NO: 4150 - DNA, 719 bp, Sorghum bicolor
  Clone ID: SORBI-28MAY03-CLUS73088_1
agacttgcacaagaaaggatggcaggcacggggaccaaatgtcctgttttccttttcttttcagttaatgctagtggtcagttttgtggtgtggctgagatggttggcccagtagatttcaaccggaacatgaacttctggcaacaggacaagtggaacggtttcttctcggtaaaatggcacattatcaaggatgttcccaatccacaatttcgccatataattttggagaataatgagaataaacctgtgacaaacagcagggacacgcaagaggtcaaattttcacaaggtacagagatgttgaacattttcaagaactttgcatgtaaaacatcaatactggatgactttgacttctacgaaaatcggcagaaagtaatgcaggacagaagaggcaagccgcttactacatcgtttgatcacccattgccaaaagctgaaaaaactgcagaaatcaaaaggcaaacacatgccacagtattcggtagagccaagagtaatgaggggcagggcaacaatgtttcagaagtagttgatgcagcctgtagcaacaaggagcaacccaacaaagttgcaacacaatgttgatgccatgagctagttgaactggggaatgagatagcctctggaatggacttcaacctgaatgataaatttgatgtgtacaatgtcaagaaaccatcatttgtcatcggttctcttccattttctcatgc

SEQ ID NO: 4151 - DNA, 663 bp, Sorghum bicolor
  unsure (1)..(663): unsure at all n locations
  Clone ID: SORBI-28MAY03-CLUS73099_1
attctcctggcaatcgtcatcgtcgtcttctccaatccaatcggcgctcactccgccggccggccggccggagcccctctataaatactagcctagggtggcccgaaccggccggccggctcgacgcacgcatcctccgcctgccgcacccgccaccgcaacaagaggttcgaaatactccgatggctccgcctgcacggccgccgcgtgttggggaggacatggaggagggcacaggcgagagctccccacctcctcggtcaccacgtgcgttcaaccccgacctccacggggtgcagaggaagatctgcgagcgcctccgccagacggcgcggcatgaccgtacgctcgcagaccccaccttcaacgcccgcttcgcccgccacctcgagaggttgccgcggaggtacctcctcgacctcgacctcgaagacaaggtggacgatgtcctgctgcactggaggatcctcgacgagtgcgccgaccccaacaagcgacccgtctttcacgcgcggttcctaaagtataagacagttcccatggaggatgacggcattggccatagtcaaggtcaagaggagccgtatcanaagttgttggaggagctcagtttggaaagaagaaagactgtggacagaaatgattccatgtctatctcctcta

SEQ ID NO: 4152 - DNA, 787 bp, Sorghum bicolor
  Clone ID: SORBI-28MAY03-CLUS73120_1
ctgggaagaatctctcgaaaaaggaaaataaaaacgggcaacgaaccaaacgccgaagcgacccaccccgtccccgtctcctcctccacccctcctcacctccatctcaatctccatctccaccagaaacaaacaagtgaaacagcgcaaacccttgctccgattcccctcctcctcggcctcctcgacggtagcagcagcagagcaggggcggcagcggcggcggaggaggaggcggaggccatgtggcccggctgcggcgggcggttctactgggcgccggaatcggcgccgtcggcggggcaggcgaggggcgtcgcggttctgttcgcgtgggtgtggagcgacgaggcgcagctgcggccgttcgtcgagctgtactcctcgctcgggtggcgctgcctcgtctgccatcccgacctcgtcgcgctatatctctctgagaaagcaacatcactggcaactggtgttattaatgagctggttaaggaactgagagtaaaacctgtgccaactgttcttgcttccttttctggtggctcaaagggatgcatgtacaaggttattcagttactagatggaatatgtgaaggagatgcaaccatgaaggactatcggttagtgagaaactgtatctgtgggcaaatttatgactctagccctgtagattttgtcagtgatgtgggcacccagtttctccaaaagcctgctgttggaattcatctcagtcagctatattacgttcatggatagcaaaggctctagcttctggcatggatactctctt

SEQ ID NO: 4153 - DNA, 654 bp, Sorghum bicolor
  Clone ID: SORBI-28MAY03-CLUS73123_1
aaaaaaaaccaaaaccctcctcctgcttcctcggcacaacagccttcctcctcccaaggtgcgctttgtgtgaggatccagaggcaggaggatggctctcaagaagttgctgcggctcttttgtgtcggcaagaaggattccaagaagaaaggcaaatccattgacccactctggcgagcctccgcgtccctctcctctgtgagtgtcactgcaaacaagactcatttggatccctgttcaagtgggactggcactgtatgcgtgcaaaaccatgaacctgaatgctcaagtatggtttcctcatgggcaaggacagagcatggaactgagagtactgatcatatgtcttttaaacaatttgatgttgtccaagatttctcggatcaccactatgcaaagacttcagcaggaaaggtcaccaaagattgggtgaaggcaatccaaagtgaatggagccttctacagaaaaacctacctgaatctatatatgttagagtttatgaggacaggactgatctgctcagggctgcaatagttgggccggctggaactccatatcatgatggcctgttcttcttcgatgtccgttttccttctgaatacccgaagtgcccaccaaaagtttactaccattcgggtggacttcggctaaa

SEQ ID NO: 4154 - DNA, 589 bp, Sorghum bicolor
  Clone ID: SORBI-28MAY03-CLUS73139_1
gtttcggcgtccaaaagcaagcaaaggcgatgcgcgtcgccccgccatggccgccgcgcacgccaccaaggccgcccacgccgccgacgaccacgacgcctcgcctctcccgctcccatggccacgcccggcgccgctcctcgtcatcctatccctgctcgccggggcctcctacctagccctcacgcgcgtccccgccttcgcgtcttcgggccgcctagtacccgccgcgctcctcccgatcgcgcctcctcgcccccacgactcgcgatccagggacagctgcgcggggttctacgcgggcgcggggccatcacgcgcggtcacggcgtccgtggaggagttcggggccgtgggcgacggcgccacgcccaacaccgccgcgttccggcgcgccgtcgcggagctggaggccagagccggtgcgggaggggctaggctcgaggttccccccggacgatggctcacgggcagcttcaacatcaccgggcgcttcaccctcttcctgcaccgcggcgccgtcatcctcggctcccaggatccagaagagtggcctctcattgcccctttgccatcttatgggcgtgga

SEQ ID NO: 4155 - DNA, 611 bp, Sorghum bicolor
  unsure (1)..(611): unsure at all n locations
  Clone ID: SORBI-28MAY03-CLUS7641_1
attcacgatccacaaaagaacacgtgaaaggcactgtgggcaataatggctatgctccagccagcgttagcgttacccttcctcctgctgctgctcaccgccgcggcggctgggctgcccggcggccggacgctggtcttcatcctggccgggcagtccaacatgagcggccgtggtggcgccaccaacggcacctgggacggcattgtcccgccggagtgcgcgccctcggggcgcatcctccgcctctcccccgcgctccgctgggaggaggcgcgtgagccgctgcacgacggcatcgacgtgggcaacgtcgtcggcatcgggcccgggatgcccttcgcgcacgccgtgctggccgccaccagcagcggcagcgactccgtcgtcgtcgggctcgtgccgtgcgcgcagggcggcacccccatcgccaactggacccggggaacggagctgtacgagcggatggtgacgcgcgccagggcggccgtggctgagtgcagcggacgcggngagctcgccggcgtgctctggttccagnggggaggctgacaccatgaggcgcgaggatgccgagctctaccggcggcggatggagactctcgtgcatg

SEQ ID NO: 4156 - DNA, 573 bp, Sorghum bicolor
  Clone ID: SORBI-28MAY03-CLUS76425_1
gattgcctcgccgtcgccttgcctccggccatggcgaccggtggcaagcccgctgctcctcagccacctcccgccgcgccctcctcctctgaccgcgcgctggagtcagtccacttctcctcgggaaaccctcgcatcgaggagacccgaggcgtcgtcgtcctccaccccgacccgcccgccgccgcctcctggtctcatctcccggtggggaggaagccgcgggtgtgcgtgctcgccgtgcccaatcacatgacctacgccgacttctgccgtttctgcggtgccttcgtcccccacacgctcgagatgcgcatcgtcagaactgatggagcagaggaccagtacagtgttcttataaatttcgacactcagagctccacagacagcttctataagcacttcaatgggaagcagttctcttcgctggaggtggggatgtttgccaagtccgttttgtggaagatgtgcactacactcaattgattgagcatgcacatacctcggttacaaacttggctgagcaacctacgtgcccagtatgtcttgaacgacttgaccaagatcctggag

SEQ ID NO: 4157 - DNA, 575 bp, Sorghum bicolor
  Clone ID: SORBI-28MAY03-CLUS7643_1
atcgtgccggcctacaccatgccccccgacgcgcagcacgcgacggtgctccgcgtcgtcatccgcgaggacttcagccgcaccctcgcggagcgcctggtgctcgacatcgagaaggtgctgcacgagctggacgcgctgcccgcccgcgtccccagcggcgacctcgccgcgctcgccgccgccgacccacgcgtccgggcgatggagaagcagcgggaggtgatctcgctctggaagagggccgtcctcgccaagaagaagaccaacggcgtctgctaagcagccgagccgatgcatttccggccctatgtgcgtggggggtgctgtttgctaagttgcccctattttatctgaacatctgctgaaatttgtctgagtacgtgttttttagtttttattacccctccggatgaaggctgctatgtgtcgaggttaagttttagaggacagagaattgctccggctcgatgtaatgtagcgagtgtattatatgccacccgttagtccttgcaaataatattgcgcgctgtcgctgagcaccaattacatgctggttttaacagtctgcatct

SEQ ID NO: 4158 - DNA, 701 bp, Sorghum bicolor
  unsure (1)..(701): unsure at all n locations
  Clone ID: SORBI-28MAY03-CLUS73409_1
ggcctctggctcccgattttccggccattttccccgtttcacagcggcgaatatctcccatctcctcccctttccacctcgcttcttcgctgcagcatcacctcccgcccgccccggggagaaatatcctagagcgccgacccgaacaccggattcgctcctcgtccggccgattcgtgctcctctaatcgctcgaatcgagttcttgctccgggttgcgtgccgcaatcggggcgcttggctcccgcgagccgggttcttgagcctgggctgggcggcggccatggacccttcggtggcgccgggcattgtcaaggaggagctcctggagcagcagcagccgctgcaggacggtgtgggtgaccnggccgggggtgcgccgcgcccgatggaggggctgcacgaggtgggtcccccgccgttcctcaccaagacgttcgacctggtggaggacccggccaccgacgccgtcgtctcctggagccgtgccggcaacagcttcgtcgtctgggacccgcacgtcttcgccgacacgatgctcccacgcctcttcaagcacagcaacttctccagcttcgtgcgccagctcaacacctatcgcgtcggaacgggtgacccggtcaggtgccaggtcccgattgttttgttctagaagactctactgatcaccttcacatgctataggcttcagaaaggttgat

SEQ ID NO: 4159 - DNA, 648 bp, Sorghum bicolor
  Clone ID: SORBI-28MAY03-CLUS73423_1
agactccgattttccacgaacccaacccgcatcgtgtcaatacgcccaaccatccacagcatgcctgtggcgttcgtccgctgccttccatggcctcacacctccaccgcctgctgctggtcttcctcccttcgctcctcctcttccgccgcggcccgcccccgccgccgccgactacgccctgtcccagcgccgccgtgtaccctgtcgtgctggtgccggggaacacctgcagccagctggaggcgcgcctcacggacgcgtacgaaccaccgccggagtcgccgcaatgcggcgcgcgggagcgcggccggtggttccggctgtggaggaacgccacggccatggacgaccccgccgtcaagccgtgcatcgtcgaccagttccgcgtcgtctacgaccccgccgcccgcgacttccgcaacgtgccgggcgtggagacccgcgtcattggcttcggctccaccgccgacttcctcgccgacacccaagccaacaaagacctctgcttggggacgctcgtcgaggcgctgcagcaggccgggtaccgcgacggcgagacgctcttcggcgcgccgtacgacttccggcaagctccggccgcgccggggctgccgtgccgtgccttcgcgcggttcactcggcggc

SEQ ID NO: 4160 - DNA, 679 bp, Sorghum bicolor
  Clone ID: SORBI-28MAY03-CLUS73460_1
cgcggcctctctctctcgttcacctgttccctgaccagcccgctgccccctcccactgtcccttgtggtctctggctctgatccccccgccgccccctccatgcggccgttgagctctcaggacccgatccccttggccctcccgcgttgctccccccgacctgctggtacccctgccttgtctgcttcccgagttgctccccccgtcatgctggcgggcctgcagcgtccgctgctggtagcacggattctagctgacctcctgctgcagggcccgctcggtgtggcgcacctggtgccgcatcgccggctccgtctgtcgcaactggtggcgggccctcttgttcagtccggtgcgctcccacgtcctctgtcatcggggctacccaccgggctgttgggcgcagactacctagcgcatcagttggggccccatagccatcggcaaacgtcgcatgctcgccctccccgccgccggggcccttgctcgtgggttccttggggccgatgcgtgccccgtgccgaccattgctgaggattgattgattttaagtgctctcattggttgttctgaactagggtgtggggtgtatgaaactaggtatgatatcggtgtccatgtgttcatgcctatgtgcatttgtttcttaatgcaatgatgcacagctctccttcgagg

SEQ ID NO: 4161 - DNA, 678 bp, Sorghum bicolor
  Clone ID: SORBI-28MAY03-CLUS73500_1
catcaagcttgtgtttttgttataactaagacctcctaacacttggaatatgtctgtattttgtacctttcaggctggaggtgagttggctgactacatcattgttcttaggaacacagatgccattaaaactttcagtggaaatgcacacatgtcaattggggctggtattagtgcttctgctggtcattttggacgagcagcagaggctgatttccgtgctggtgatggtggttatgctgcctgttacacatacagttgtagcaaaggtgcctttgtggcctgtgcactcaatggaagtgtggtatccactcgagactcggtaaatgcccggttttatggtggtccaatcaaggcctcagaaatccttcttggctcgctgccaaaaccgcctgctgccgcaactctatacaaagctttatctgtattatttgataagatcaacaagtgaacctcctgagtcctctctttagtttctgacatgcagtatagcctggtgaattgaattatttctgggtgattgatttgccttctttattggtgatgatgcaagtgtcacctgaccatccattgttttacatcaaacagatgtatttggaaccgcaaaccactctgtaaatgctgtaaatatggttacaattctcgtgagaaatgaaaagaaatccattgttcaagtgt

SEQ ID NO: 4162 - DNA, 875 bp, Sorghum bicolor
  Clone ID: SORBI-28MAY03-CLUS73489_1
gatttgaagtcccaagaggaaagtactacctggttgatgcaggttatgcgaacacaccatcttttcttgctccttataatgaagtcccttaccatactgaagagcaagatgagagcaatttccaaccaatggactacagagagcttttcaatgttcgtcatgcacagctgcacagacatattaagcgtactgtaggcctactgaagatgcgatttccaattctaaatgtcgcaacatcataccgaaaagacactcaactgaaaattccttcagcagcagttgttctacataacataattcagagacaaggaggtaatgaagagttgttatgtgagcaaacaatcccatttgcttcccataaaacagtggatgttcctagtggtgatgatacatatggttacgatgtttcagctttcaacagtgaatgtgacatgggcaatgctttgagaggtggtattgcactgaggatgtgggcagattatcaaagtagcatatctgcatgtatgtctgatttcagaatagaaaaggctggcctaaaagaatattgaggcaagtagaagacaggttactttcaagctgcacttcggtgttagtagttacatgctgcatatgtttgttttttttaaaggcatccagatccttgctcttgatgcatttgcagatgtgattattcaagttttgaactgtgaattaagacttgtatggcttctggatgaaaatgaaagtagttatgctttgtagcttgtacggagttgatccgcacctgtaagttggctgctgcatatcctgcatctgttaacttttttttttcaaaccggaggtaacctccatttcaaaacttgacgtcaaaaatatatgtaaatgggagaggcttg

SEQ ID NO: 4163 - DNA, 587 bp, Sorghum bicolor
  Clone ID: SORBI-28MAY03-CLUS73683_1
cggccacgagcacgcggtggggtacgtggccggcgacgagcactacggcttccacgtcaccgccgaccacccaaactgctacgacatccagggcggcgtcaacgccgtctggggtaactacttctactacggcggccccggcaggaacgtcaggtgcacctagcagaaggctagagagctcgtctcgtcttcgtcacgtgatgacgatgcagccatgcagagaggagggcattggcagcaggggaggatatcaggataccaacagacccctttttgcattgcttcttctcaagacaagaatctaccagtatctttcttggtctgattctggtcttttctttcttgttattattttctttttttttcaatcctttcccaccaaaggttaattaatttctcaaaagggagaatcatgtagttttctttttttatttttctagtttcttggtggtctgaaaaacaaaagggtcaagagttcagtgtcgtcagttaaacgtagtccagttcatcaggtagcgatgatcgatggagttgtaatgtaaaacgccccctgaacaatgtagccatgcaagctagcagtatataca

SEQ ID NO: 4164 - DNA, 588 bp, Sorghum bicolor
  Clone ID: SORBI-28MAY03-CLUS73015_1
gtattccttggcttacaatcagacgaccttcgtcagatcatgcaagacaatgctgtattcactccggaagcctcctcaagcatgagcgtgccatcctcgacgcctgcagcgcttacatgtctgggacaatcgtggggtcatctgttgggagcgcccttaaatatgcccgtgacaagtgctttgcagatttccacaagtcactgacgctctacactgaacatctcaggactgagtttgctgcaaacagaagacgcatgcttgagctggagagagaggtgtcacctgcgcaggagatcgtgcctagcagctagagttcctttgtcaaaacaaacattgctaactgggaagtgaaatggtggttaggttgttgaaagcaagcaccccagtgttgaaaaaaggcttttgtatcttgcacaagagttgctctcgtcgtcagatattagctagctagctatttatggtgatgacacatacaattcattactagtagatgttaccctcattctgtagcggatctacttcattcatgtgacttgaataacctaattcatggcaattgccccgggcccgcccgcgagatggcctaat

SEQ ID NO: 4165 - DNA, 578 bp, Sorghum bicolor
  Clone ID: SORBI-28MAY03-CLUS73030_1
atccaatgtgacgatggagaaggtcaaagtaccaataagattcagtcgaggtgcagatgaccattctgatgacaactatgaccgaaccgcactgccaaggataagccaatgtacttatcagtgacgttgtcggtgtagacctgcagcgagcaccaatgctggaggcagtgcctggtgcagtttatgaagagatctgcttcagaaactttagcttaagaggcatacggcggcaggacaggtggcattgcgagtccgtgtatggagaggcgcatgaagttttccctgcaccttgtgaagagttcaggaaaaacggatcttcgtcatggtgtggatttatttgagcaattgtacagattacagtagtcagaagttttgcgagtggatgatacaggaatacttgaaatagagggtgttcatattgttgttccatgaagcatgtgacataggtttttgagattatacagacaaactcgggattataactttagtcttctgtttttggagtggggttagaaacaccatgtatgtgcacagcaaaagtattaataaatcaattaatacattaaagaaatttcagt

SEQ ID NO: 4166 - DNA, 1303 bp, Sorghum bicolor
  Clone ID: SORBI-28MAY03-CLUS73033_1
atttctaccacacccatatatactttacaagtttacaaaccttctacaaaagttatttacttcgtgtttagtgttgtcaagtcttgttgacccttgtttagagacttatcatgctcccaagatcaagatcacgcacacgccacatatatacaagctacttctacactggaagtacgcaaaaatatgcccgtgtccacagaataagttgctccatgatctaagtggtagaatatctctcaagaaaattgtttagtaaatgagacacaaaaaaaaggctaggcaaaatacaaaaagacatatggacatgaaggtccataaaaaaaatgcttgcgctgtctcaatagaaaaatagagagaaaggtcttatcaaatagaggagcaacctagtctattataccacacacctgcacatcttggtctaggggtatgacacttctcttcaaggatccgagctttgacttcgcaataaatgcaaagtaagtatactatctccttctatccctaccttgagctccacacaagccctcataaaagtaggatgaactaggagaaggtgatcttactttgtgccttggtgagaaaatcatacaccatttgagcgacatgagagtaccatatgaggaacattaagttttcttttttaaaaaaattattgcaataatctccagtatgaaacttgcaatgaatgggaaagtagtgctcaagtttaactattttgtctattaaccactcaagataaaggaaaagccataagccccatgaagaactaaggtaatatgggtgagtttttcatagctaacttttccatgcctatgtgaaatattttgttgcatacaaggtactcttggaatatggacattgaagcaactcctgattcaccgagacaaagtttgattatttgctcaagacgagcaaaggttaagcctggaggatcctgttgactgtggatataccataaaaatccacaacaaaacaccatcaacagtattggaaacagaggaagaataccatgacatatacatatttctatcaataaatggttccacatgtactgttagtatttggatgcaggagcaatcaaattagaagaaaatgagcacctagacccacaaaggtggggtcagccgaccccactgtaacaccctaggtgttaagcatgcacttagtctcataaaccctctcataagcattctcatcaagcataagcataatcatagcatcacataagcatagtagtgtttcaagtgtgattttatgtgcttattttggatgaattaaatatgacaaaaatggtatcttgctc

SEQ ID NO: 4167 - DNA, 663 bp, Sorghum bicolor
  Clone ID: SORBI-28MAY03-CLUS73048_1
aatcggttcaataaaggggtatatggaagcaggggcatctgcagtggtcttatctgatactatttttgacaatcaattgatgaaggacaggaaattcagtgaaatttcagaacttgcaaatctagcaactttagaggcattgcaattcacgaaatgagacaaatctgacaattctacaagcattgcagatttgcagtccagaatatgagctgtgacggtgtgtatactaggtttgtggcgcaaccttggtgtggattatatgttacttctgtggaaagcgccagttcactaaatacagctatagaagctctggtgcatgcaagaagctgagaatgatggaccgaacaaggatctgatcagaggatgttgtgatgccaagaagccaaccacacatttaggcgccgcagaatcaccacaactcgcgagacaacagaggcgaatgagagggagattgctggtttgcttgtgctttgactgacctggtagatgtaacgcagattcattaggagggtagtagtaatgagagggacattgaagacgttatacttttaggcattgccatggactttgtgtagatcaatgtgcttgaacaggtgttacccgggaattctgcatgaaatgagttggtgctatggattaatagtagattttgatgcagtttct

SEQ ID NO: 4168 - DNA, 628 bp, Sorghum bicolor
  Clone ID: SORBI-28MAY03-CLUS73072_1
tcttctgctaggctatgatcaagttgtaaagatcgcagactttggtgtggcgcgacttggaagtcaggaggggcagatgactgctgaaactggaacataccgatggatggcaccagagataattaatcataagccatatgactacaaagcggatgtattcagctttgccattgttctttgggagctggcaacttcaaaggtcccatatgacaacatgacacccttgcaggctgcattaggagtaaggcagggactgcgcttggacattccagccagcgtgcacccaagattgaccaaactgattcgacagtgttgggatgaagatcctgatctgcgtccgacttttgcagagatcatgatagaactccaagatattctacactatattcaggcaccgaagggacccagtcgtcgttctagagcaaagatgcagaagaaatcagagggatgaaaaatacatatgcgtacccaaggcgaaggggtcccagttcgtttttttggggtggggtggggcgttatacacaacttatagtacaagtggttttagcaatgggagcagatatttatgtggtgccgtgctggtgtacagatgtgtcagtataggccgtttgtgcttgggcatttgcag

SEQ ID NO: 4169 - DNA, 679 bp, Sorghum bicolor
  Clone ID: SORBI-28MAY03-CLUS73646_1
tcggaagcgacggcggcgcgcggggtggtgccgctgcatgtgccgctgcagcagcggttcccggtagcggacgggaccatggacgtggtgcgtgcggggcacgccgtgaaccgttggatcccggaggcagcgctggagttcctgtggtacgacgcggaccgtgtgctgcgccccggcgggctgctctgggtggaccacttttggtgccggaggagtgacctggagggtgtctacgccaccatgctgcggaggctcggctacaagaccatcaagtgggtcgccgccgacaagagcgttgccggaggcggcaacagtggcaaggacgaggtctacctcaccgcgctgctgcagaagcccttcagttaggcagtgaacaccgtgtattggggggaaatcatggcatgggaattcatcatcaaccgagtatcttcttcgctgaagactgaagcaatgcagtgcaatctgcaatggttccagaacttgcagcaatcagcttgtattatactacgtgtacaatttctgctgcaatgtgtgcagcaatgcaagcagtagaactgatgtgcaagctaaaccttcacattttggcaaaattcaaaattagcaaccaattctactgcttccaatcgcatattctgacacccattttttaatgtcaaaatcaatatctaatttgggcctt

SEQ ID NO: 4170 - DNA, 588 bp, Sorghum bicolor
  Clone ID: SORBI-28MAY03-CLUS73653_1
acccggcggtgccgctgctggtgccgcgggagtcggtggcgccctgcacgctgggcggctacgacatcccggccaagacccgcgtcttcatcaacaccttcgccatgggccgggacccggagatctgggacagcccgctggagtacctgccggagcggttcgagaacggcggcggcgagatcgacctcaaggacccggactacaagctgctgccgttcggcggcggccggagggggtgccccgggtacaccttcgcgctggccaccgtgcaggtgtcgctggccagcctgctgcaccacttcgagtgggcgctgccgcccggcgtcgctgccgaggacgtcaacctcgacgagtgcttcggcctcgccaccaggaagaaggagccgctcctcgtcgtggtcaggaagagcgacgactacgaattcaagggggaggagcttaatgaggtttaataattataagtgcagttagattcatatgtataataagtcttggcgtcttggttccaaataaagttttaggtaatattgatgattatttatataaacttttatttattatattatagagcaagtagctaatttcact

SEQ ID NO: 4171 - DNA, 576 bp, Sorghum bicolor
  Clone ID: SORBI-28MAY03-CLUS73662_1
accgcagggttcctagcaaacaaggttgctgttcttcttgcagcattcatgcctatgctaagtgactcgaagagtgaagatggatctggggacatcaattaacaggactttaaaaataggttcgtactagtttcatatagaagctctatattcaagatctgaaggtagtctcatatagaagctctatattcaagatttgaaagcaattagctgatgtgcagagggcaaatcctagtctctgaaccagaaaactgaaccacgtcgctagatcatgatggtaactgagtccaaacttcaatcaccgcagcaggtcgcaggcatggtatctttgcaagggttcaattcacagcaagggttctagtgttgtggtacttagaagtcagaaacttgagttgtagtactcagaaatcagacactcaaatgttaagatgatctacagactacaggaacatgactacaccagtacctccagctccagaaacgagctcggaaaacatgatgattgtacgagaacaatgcccccattgttgtatgtgaatatgacatttgtgaggtaaatatacagtaacaactatc

SEQ ID NO: 4172 - DNA, 512 bp, Sorghum bicolor
  Clone ID: SORBI-28MAY03-CLUS73671_1
tcagctttgaggttcggttgcatggaggcagggaaagtgtctgtggagaactacacttttgatccagaagttgctaggaaggagcttgctgctatgatcgcactacatgagtatcctttatgcattgttgaccatgttggttttcgaaggtttgtgactgcactgcagccattattcaagatggtgactcgaaacactattaggaaggatattatggaagcatataccgaagaaaggaaaaaggccctatcctacatggcttttaccaagtttagagtgtctattactacagacttatggacctcagataaccaaagaagagggtacatggctataacagcccatttcattgatgattcatgggtacttagaaacattatcatgaggtattgcagctgctttaattatccaacgcgccaagcaaactatgcttgcgggattcctaatttctaattgctattgatgccctgatggtgaatgattgaaacgatgaatttatgtggaattgtggg

SEQ ID NO: 4173 - DNA, 651 bp, Sorghum bicolor
  Clone ID: SORBI-28MAY03-CLUS73675_1
ggccccaggaagattctttgaacatgcccgttgatatggttgttggtactcctggaaggattcttgatcatatcaaggatggtaacatggtttatggcgatattaagtatctgctcctggatgaggcagatacaatgtttgatcaaggctttggaccagacatacggaagttccttgctccattgaagaatcgtgctgcaaagcctggtgatcaaggtttccaaacagtattagtcactgccactgtgacaaaggctgtgcaaaagttgattgatgaggaatttgaaggtattgtccatttgcggacatcatcatttcaaaagagagtttcaacagcacggcatgactttatcaaactttctggagcagaaaacaaacttgaggctcttctgcaggttgtggaaactcttatttccccttccctcttgcgcacatatatctgtctttccgtacactctagtttagaacttgacagttgtatacaaaaccctcaaaactggttttatatataattatatatgcattctccacttattgttatttttttgtcagtacagtaatgtagctatgttagatggatggattgatgattcaaatttccaattgacaattgtgtgaaaatgtgaagtgaatgaaatataaccacataaa

SEQ ID NO: 4174 - DNA, 795 bp, Sorghum bicolor
  Clone ID: SORBI-28MAY03-CLUS73684_1
cgacaagatgcccatcaacgggactgaagatgaggtggccgcgctgaggaagaggatggaggaggagagggggaaggtgaaggagaagaaggagaagaaggtggggaatggcctcagtgggaataagcatgctgctaatgttgcggcagcgggggcgggggctgacaagttagagaatgggaagaagggtgacgcggcttcagcaaagcgcttcaaggcttctgaccatgcgccagcccatgccaacaaggaagtgtatgcatccatattcacatcgtccaggaagtcggatttcaaggagacatactcatgccggtcacttccattgggaaggaattgatgtcatggcaagagtggtcgcttccattgggaaggaattgatgtcacggcaagagcgattgcattgcatggaggtgatcctgtattgatttgcctcgctcatatcatggatggctcacaagtttaatgttggtcgctttatctggcggtgttatttatctttgattggcgagatcatattttgtctgttagagcagtgttaaattcatcatatgaatgatgtgtggagtttgcaactaatagttgatcttgtgttgcagcttgtgttggaataaagttgttacttgtatgcatggctaatggttccccaaaaaaatgacaaacggtggtcttcatgtcgttgttcgcttgttgccacagtacagttaatcaaagtccatatgtgatctttttatgtattgcccacaaaagatgtaatccatggaattcaacagtgaggatgtgtgtgtggacagt

SEQ ID NO: 4175 - DNA, 732 bp, Sorghum bicolor
  Clone ID: SORBI-28MAY03-CLUS73159_1
agcagtagcatttccatacacctcccaacctaatctgaccgagccctaaacaccaccgtccatccgccgccgccgccgccgccgccgcccttcccggccccccccgccggctccgtccccgccctccccgccgccggccgtccgccgccgcccccgcccccgccgccccccccccccgggggcgcctccgccgtccccttcgcccccttctcccgctccgacaagctgggccgcatcgccgactggacccgcaacccgccgggccccgcggcgttcgccgccgctcgggacgccgtcttcgacttcgcggggctcgaggactccgtcgggctcgcgtccgcggacgactcctccttccgcctcgtcgacggcaagccgccgccgcggcacccgcggttcgggccccgctggcgcttccagcagcggccccagctcccgcagcgccgcgacgaggaggtcgaggctcggcgccgcgaggccgagaaggagcgcgcccgccgcgaccgccactggcagcagaaccgccgcacgcaccaccagttcaaccgcggcgggccctcctcctcgtccgccaagccgtccgttgacatccagcccgagtggtcggtgaaggagcagatcccgttctcctccttctccaagctctccttcgccgtcgccgaccagcccgaggacctcctcgtctgtggcgcagtcgagttctacgaccggacctacgaccgcgtcaccccc

SEQ ID NO: 4176 - DNA, 678 bp, Sorghum bicolor
  Clone ID: SORBI-28MAY03-CLUS73160_1
gcaaagcagtgagctcgtgactcttatctgctcagtttgccgcccgataatgcgcgggcccccctccccgtgtcccctccccgccgcccccgcccccccccgccggcgcccgcggcccccgccccccccccccgccccgccgcctccgcccccccccgcccgcgccgccgtgccccgcccccccccgccgccgccccgcgcccacccccggggccgctcgccgcctgtccccgctcgcgcgtcggcgcgggccgccgcccgcgcggcggcgagacggcgttgcaggcggctcacgcggctgtccgcggcggcgttaccgtgttggaggttgtcatgacgactcctggagtactggaggttattgaagatctttgcaggagttatccttctttaacattcggggtatgtcaatctgacattactctgttggtaccgtcctaaatgctgctgatgcaaggaaagctatagaggctggtgcacaatttcttatgagtcctggcacagtcctggtcgtgcttcttgctcgtcatgcttcttgtgctctttgtattccaggagtgttgacaccaacagaagttttatctgcttgcagtgctggcgcaaaagttgtcaaggtgtacccagtttcagtgatgggtggagaggcgtacatgtcagctctgaagaaaccatttcctg

SEQ ID NO: 4177 - DNA, 690 bp, Sorghum bicolor
  Clone ID: SORBI-28MAY03-CLUS73230_1
tggctcgtccgcgccaccgtcggcaactacgcggcctgcctgctcggccgcgcgctcacgtgccgctaccacaagggcgacgactacctcgagatcgacgtcgacatcggcagctccgcgatcgccagcgccatcctgcatctcgcgctcggcgccgtcacgtcggtgaccatcgacatggggttccttgtcgagtcccaatccgaggaggagctgcccgagaggttgttcggcgccgtgcgcatcgcgcagatggagatgggcgcggccaagtacgtggagctgccccctgatgaggccatgcctgagacggctggcagggctggggcggggttcagggtaagctcggcgaaggtggtcaatcatagccgccaacaagaccatgccggcggcaaggtcggcaggtcgatgagttgcccagagcgagagagcggaggaaaataggcgcaaattacgcaggtgcgcaatgcagaaagaaaccatcatccatgggtgggagagtgatggcaagaaccggaagacgaaggctgggcaacccccaacacataaaacgctgaagctggtgccatgaccacgacctcgaccacgaatggccccttcatcattcataaagtcctgacttcatttgcttgtgatgatgagaacttaaaacctgatgatggatgcgaaatcaattaatagcagcctatt

SEQ ID NO: 4178 - DNA, 643 bp, Sorghum bicolor
  Clone ID: SORBI-28MAY03-CLUS73254_1
ccgaaaccgaagtccagcgccccccagctcctccattcgcgcaaagaacgccaagcccacccaacgaaatctctccccaatctacccctcgccggcgcccggcgatgtgcccgacgaagcccgatcgccctggccaggccgccaccgccgccggctccgtcgagaagagctggcgggaggaggccgtggccgccggctccctgcggctggtcgacctggaccgcggcgccaacggctgggcctcgccgccgggggacctcttccacctgcgcgcgcgcggctacttcaacagcggcggcgggaagcgcggcaaggcgccgtccgccgcggactggctgctccgtcccgccggcgtcgactggctccgctcccatgcccgcctcgaccacgtgctcgcccgcgacgacaacagcgtcgccgccgccttccgccgcgcccgcctcaggaaggaccccaccgcgcacttcctcctcgccgtcaatctccaggtgccggggcggccggacgcgtacagcgccgtgttctacttcgcggcggaggcgcccatcccgccggactcgctgctcggccgcttcatccacggcgacgacgcgtaccgcaacgcgcgcttcaagatcgccaaccgcatcgtcaagggcccctg

SEQ ID NO: 4179 - DNA, 650 bp, Sorghum bicolor
  Clone ID: SORBI-28MAY03-CLUS73316_1
gatacgtcgcgccgagaatcaaatcaaatccctgaccggagccggaggcatcggccaccggcagccacagcagtcgcttccctgatctgccaagccgccagcaatggagacggactccacctccacgacgacgcctctgttcctcctctgcgctactaccgtcaccatcgcgctcgtctccctctcgctggtcctcctcgtccgcggccgcaagaaccgcaaggccgacgccggccgcctcccgccgggtccaccggcgctgctcttcctcgtcaagttcctggcgctgcggcgctccatcttcgacttggctccgctgctccgcgacctgcacgcgcgctacggccccgtcatctcgctccgcctcttccgcaccctcgtcttcgtcgccgaccgccgcctcgcgcaccgggtcctcgtgcagggcggcgccaccttcgcggaccgcccgccgcccgtcgacccgaacagcctcttcaccaccggcggacacgacgtcagctcctcaccctacggcgcctactggcgcctcgtgcgccgcaacctcgcggccgaggcgctgcagcccgcccgtgtcgccctcttcgctccggccaggcggtgggcgtgcgacggcctcgtcgacaggctatgcgacgctggcgctgccg

SEQ ID NO: 4180 - DNA, 622 bp, Sorghum bicolor
  Clone ID: SORBI-28MAY03-CLUS73335_1
gtgctttgccagctacagcgaggtattcagttcctggatgcacttttgtgctgtgcgtgtctttgtagagagcattcttagatatggtctgccgccgtcattcctgtctgctgttcttacaccatctacaaagagtgagaagaaagtaaggagcatcttagaggagctctgtggcaatgcccatagtctttattggaaatccgaagacgatgtaggcattgctggtctgggaggtgaaactgaggcgcacccttacgtctctttcaccataaattttctctgagaccagtatgttgtaagccgtatgtggcccgggcaatatttcgaagcagctattgaaaccaagcgaaatgatcgtgtatattacttgcgattcgccaattctttgttgatttatcggttcatgtggtcctgtaattcatatcagagagataagccgatcaataacgtagtttttgaggaccctatggaatggctgaagaagggcggctccgctctctggacatgtttccctgcagtattgcaccttgggagtgccttgtaaaaagccttcgtggataacctgtgtctgtagcagttggctactggatttatttatttacaataaaagccatatagaaat

SEQ ID NO: 4181 - DNA, 761 bp, Sorghum bicolor
  Clone ID: SORBI-28MAY03-CLUS73758_1
aggatgcttgcttccttccctttttcttctcttcccttcccttcccttcctcgccgccgttcctccatttcgtccgcgaacctgcaactgcaattcctctccatagatcgatcggccttctacctctgccacgcactcccactcaatggatccttcctgggtagtgcttgaccgctccgtgagcctcatcgccaggaccggcgagaaaacaactcgcggcgcgggcaccagcgagttcgacaccgaaacatgggatgtgatcgaggacgaagaagccggcgtcgtcttggacaacgcaatcgaagagaaaaaaccgatgggcgtggtagattgggtgcaggatggcttggtccgtttcgtccctgaactcaccaaagcccccaagatctccaccatatcgcttcttctgccggccacaccccgcgagatcagggctcagctggagagcgtcactgtagcatgtgccgacaagaacctccttgtcctcttcaccgcccccgattccccctatcacgcttcctctgggcgctacctggtctacgatgctgaagctgacaccttcatcgccccccctcggatcgacctggaacagttcagagaggtatttgggtacgttccagccatcgtacacctgggccaaggcggcaatttcaccctggccgtggtggtacagtcccatctttccagtcagtattctggtgttgttgtggtcgccctccactgatcaagagcggtgggtacagaggaatgtgaacttcccc

SEQ ID NO: 4182 - DNA, 632 bp, Sorghum bicolor
  unsure (1)..(632): unsure at all n locations
  Clone ID: SORBI-28MAY03-CLUS73780_1
gcaacacgacatgatatcacctgccattaaactcgatctgtgatcactcccctaggctctagattaagggcagtggaaaaacatggcgacatgaccagagaaattgattgcagcatgttgttactggtggccatctgcagtcatgataggatgtacacatgcattgtcgatgggcagcaggagttatagaccatgtacgaacgagtggccagtcaactccgacccctcctgctcccatggcgccaacctagcaccagaggagcttatgggattgttgtaaggctcatgtccatgtcacggtgtcgaatggtcgatatccatcagccaggtttaggggaggtggtcaggagcattttcatttaattgcttaaggtgaagcaactgtcggtcattagagggtcgggagaagagagggatatgttagttttgttttttctctttcagagatgaaatggtaatacaatttggcgtgaattgttggaaccccaatatttatgatcccaattaaggctgcttagctgccataaattgtacagtgattttgtggaataaaactttgacagagctacaaanactatgtgtaatcagcctgcanaagtgtattgcaatctttcacaatgcatttattgggg

SEQ ID NO: 4183 - DNA, 475 bp, Sorghum bicolor
  unsure (1)..(475): unsure at all n locations
  Clone ID: SORBI-28MAY03-CLUS7381_1
tactgggttcatcccattattcgagatccagatctctcggcttctcgctaccaaccacaggaagaaacgggcagaatgcccaaactgtcgtgccgggtgctctgcgcggctcttctcatcgcttcgctagccgctctgctcgtccggttcccgatccataggctcctcagtccccacgccgccatggaccccgactccgagctcgagttcgagatgcccggcgtcttgcgcgtgtacaagacaggccgcgtcgagcgcttcgacggcaccgagaccgtcccgccgtcccccgacggcgaccccgccaacggcgtcgcgtccaaggacgtcgtcctcgacgccgccgctggcatctccgcgcgcctctacctccccgccggagtggatcccgggaagaagctccccgtcgtcgtgttcttccaacggcgggcgttcatggtccacaccgncgcctncccgctctaccacatctact

SEQ ID NO: 4184 - DNA, 760 bp, Sorghum bicolor
  Clone ID: SORBI-28MAY03-CLUS7384_1
gccggccgggtcgggatccacccaacgcagaagcaaaacccccccaatctctgcgccgccgccgccgtcgttccctgtcgttcttcgccctcctccgccgttgcagtcgcggcctcatcgtcgcctaccgatctccaccgcccccactgccaccgatcccaccagaggtgtcgccatgtctcagaacaacccctcccagctcctcccctcagagctgatcgaccggtgcatcgggtccaagatctgggtgatcatgaagggggacaaggagctcgttggcaccctctgcggctttgatgtctacgtcaatatggtgctggaggacgtcactgagtatgaatacactgctgaagggcgccgcattacaaaactcgaccagatcctcctgaacggcaacaacatagccattttggttcctggtggttcaccacctgatgtgtaatgagcttttgcttcccagagtaaccattctgggtgaaggaatcccctttaactttgcaccttattttgggtaatcattgggtgtttctcatctcggatgtggtcccctgttcgtgattgtaccgaagtttattgtttactctgtgtcagcatggaagctctcttctgtattgaacttactgacctgaagtagtgtgcctgcatagctgtggttatatgattggctatgctaattctgtgtatctctgctcatcatcattgtactgcaatgtgaatggtaatggattatgaagtaaaaaaaaaaaaaaaaaggccccta

SEQ ID NO: 4185 - DNA, 684 bp, Sorghum bicolor
  Clone ID: SORBI-28MAY03-CLUS73845_1
agctcgattgctcgaacaagtccagaagcccaccgcaccacgaaggaatcctctctaccccccgcctggcgcctgccctgaaaggctgaaaccaatccaccgccgctcctcgccgccacgccggcggccacccgtgtggcacgacgactgacagcttcccgctctcctcatattcaccttcgcctcacggccccgcgcttatcagagaggcaacagccgccgcctcccgcctcgtcgcggagctatacggcgaggccggcatccccggcggccgccgcccgtccccaagatacccagcgcggattgattgatttctgtaatctctgaggcggagaagaccaccccaaggcccaaatagtccgggaaccgattggggtgccgcccggccggccgacgatgtcgtcgagcaggttctcgcctgtgctgcaggcgtccgatctcaacgacttcatcgccccatcgcaggactgcatcatctccctcaataagaacacctcctcctctcgccgccttcagaacaaacagaaagaaactacagtgagctcaaaacctccagaggaagcagtcaagatttcactaaaagactgtctggcatgcagtggttgtataacatccgcagagacggttatgctggagaagcaaagcttgggtgacttcattgatcgcataaactctgataaagct

SEQ ID NO: 4186 - DNA, 584 bp, Sorghum bicolor
  Clone ID: SORBI-28MAY03-CLUS73536_1
cgctccctccccgccccgcgcccacgcatccagcctggccgccccccacccccccccccccccccccgctcccggcccccggccccccctccaggccgcggccgccctccccccctccccctgcgcccgccccctccgcggccccccccccgcccccgccacctccccgccgccggccccctcgcgcccctcctccgccgccgccgccgccccgcccccccctgccccccccgcctcctcccccccccgcccccgcgcctcgcgccggcccgccgccggggcctccccctcctcctcctccccccccgccgccccgccgccggcgccggcccccaccggccgcccggccccggccgccagcccccccccccccgcccccccgcgctcccccgcctccgccccggccccgccgccctcctcccccgccccgcgcgccctcccccccgccagggcgtccactcccccgccccccccccccccgcccccccgggctcccggccccgcgaccccggcgccccgccccacgccccccccccgcgccgccgccccgccgtcaaggcgttcaatgccagggccttcttccg

SEQ ID NO: 4187 - DNA, 550 bp, Sorghum bicolor
  Clone ID: SORBI-28MAY03-CLUS73590_1
ggtcgatccgccgcagcagcagcagcagccatggcgacctccaccaccaccaccactccactcgtcgtctccttctcccgcagctgccgctgcccctatccacaccgccactcccccggcaagcccaagcccaagctgccccctctccgctccctctccctctccctctccctccgtaccggccccctcgccgtcctaccgcggcgccggcgcgacgtgtcggcggcgtacggcgatggcgacatggacgacgacttcggcgacttcgacccggacgacgcggacggggtcagcgaggacgacgacgtcgacaacgagcaggactacgacgtcgactacgaccgcctcctcgcccccgtcgtcaagccgccgttggggccagcggcggcagaggagggcgacatcgccatggtcaccgccgacagcttcgtctccacccgggaatccgcgtccgataccgttgttgactacactgtggatgaggacgagttccacaagattaggctgctccactgtgacttccttatccgcaaggtgcctgaccccgacg

SEQ ID NO: 4188 - DNA, 772 bp, Sorghum bicolor
  unsure (1)..(772): unsure at all n locations
  Clone ID: SORBI-28MAY03-CLUS73592_1
gcacgagggatgctgctgctgctgctgctgctgctgcgcttcattcgttcgtcctcctctcgtcttggttggaagacggcaaaggcttgcgccgcgtgccgtgccgccgttcggctcgtcgccggcgtggaggcctctgccttccccgtacgtgtcgatccctttccttcggcgaagactcggtgggaggtctccacttcatctcaccttcgcttcctcccggaaaaggcggcttcggtcggccctctcactatctcagtacttttttagaagatggatccagaagactctagtgagtttgaggaggacaacgacgatnaagaagaagaagatgatgacttgatgctattaatcttgccagcggtatatctagcatctactggaattggaactctggatcaaacatcaatggttactgatgctactgcaattgaaactccaagtcaagtatcaaagtttaatgatgcagaatggatttgtaaagtgcttgaagatgaccgaggccaaggctatgataaacttcgtgtggagcctcatattctcctagaactttcgcgctatctgaggtcaaatgatcttttgagaaataccagaggtgtttctgtagaagggaaaattggcatgtttatttacatgctatctcgaaatgctagttttcagaaactaaatgacagattcaagtacagtacagaaactattcacagacatatcanagcatgctttgatgcagtcacaccaatgactgctgaattcgtcaagccacctttaactc

SEQ ID NO: 4189 - DNA, 651 bp, Sorghum bicolor
  Clone ID: SORBI-28MAY03-CLUS73642_1
attacactgaagctctcaggagaaaccccaaagacccaagggtatacagcaatagggctgcctgttacaccaagctgggggcgcttcctgaaggtttgaaagatgctgagaagtgcattgagctagattccacattctccaagggatacacaaggaaaggtgctatccaatttttcatgaaagaatatgacaaagcgctggaaacttatcaagctggcttaaagcatgacccgaaaaaccaggagttacttgatggtgtaaggaggtgtgttgaacagatcaacaaggcgagcaggggcgaactcagcgaggaggaactgaaagagagacagaacaaagccatgcaggaccctgaaatccagaacatccttactgatccgatcatgcggcaggttttgactgatttgcaggagaaccctcgggctgcccaggcgcacctcaagaaccccggagtgatgcaaaagatccagaagctcgtcagcgcagggatagttcagatgaagtagaagtagacagtggctggaatgtccgggttcagaactgggatctgtgctggaaatgctatgaacctgatcatcattgtttcgcattttggaaactgaatcggtttgtgtggtcatggctgttaattatccatatggtttacaagag

SEQ ID NO: 4190 - DNA, 788 bp, Sorghum bicolor
  Clone ID: SORBI-28MAY03-CLUS74065_1
tccagaattatttcctggcatagagctactagagttaacacttggtggcagcagctgtctaccaactccttcagaggaatatggaagcagcaggaggtggaagcataatatatgaaccctctattggccttggtggttggttaggttcaatatgcggggctgctgcactttgtggacgtggggggattccaagaccttgagatctattgttctttgataatactacataagaactgcccatcctgcttgcacccatagtactgccctgaacagcagatgcatgcataccggagtcagctccgacgacaacaagcgcgccgtggcactccttacacctgctttgcagcggagacgggtccaccgcgccgcccttgccaccggtcggacgcttcatctcgccgggcagacgctcttgactagctagaatcctcgctgaaccgtaacagcatcgcgtttcgcggactccgaagctgctttgtatcagctattctcgccacgagtggagtcgactcggaggaggtgacgggcgggcgatggcgaccaggactccaccgcaggagggaccccgaggaagacgctgacggaaccggacggatacgcacggcgccgcaaatagcatcattcaatgacatgtgggacccaaaacggaaagatttcggggcccacgtgccggtgggttggaggacggtatcgtcctcgtgccttctccgttataagggggaaagtctctggtaaggctttctctctttcatcgtctctcgcttcgccaacgccggcgagagctaggg

SEQ ID NO: 4191 - DNA, 603 bp, Sorghum bicolor
  Clone ID: SORBI-28MAY03-CLUS74067_1
ctccgtctcttttctctctcgcgcactcctcctccgtcgtcaaacaaaaccctaggccagaccagagctcctgcgcccgagcgggcggcagctcgccgggcgtcgactccatcgccgcccagccaacccccccccccccggcctccgcacgacctggatctgacgcgcctgcccctgtccctgccgccctcctccgcctcgtacctcctcgcggcggccgccgtgctcgcgctcctcggcggcctcctactctatatgcttccccggaagcggggggtcgacgccggcgaggtccaggacttgcacaacaaggccccccgcgccgccgccccagctcaggacagggacaaggaggtggttgcggagatggctgccagggcgcccgagatcgatgaggacctccacagccgccagctcgccgtctatgggcgcgagaccatgaagcgcctcttcggctccaacgtcctcgtctctggactccagggactaggcgctgagatcgcaaaaaaccttgcccttgccggtgtcaagtctgtaaccttgcatgatgatggcaaagtcgagctatgggacctgtcaagcaacttcttcctctcggagaag

SEQ ID NO: 4192 - DNA, 388 bp, Sorghum bicolor
  Clone ID: SORBI-28MAY03-CLUS7407_1
gcacgatcccttcgtccacgctccccgcagccgccgcccaaaccctagcaacccgtcctccgccatggccgacgaccactactcctccaagcggaagtacgacgacccctcgccgccgccgcggcgcacgggcttctcctctggcccgccgcctgcctcgccgcccgctggcggcgccccttcgtacaacagcgtgccgccgccacccgatgagatccagctcgcgaagcagcgcgcgcaggagatcgccgcgcggatctttaacgccgcagaggccaagcgccctcgcgtcgacaacggcgacgatgacgtaggcggctacgggggaggggcaccctgggcggcagcggtggcggtgggcgtggccgcatcggcggcggaggactcg

SEQ ID NO: 4193 - DNA, 652 bp, Sorghum bicolor
  Clone ID: SORBI-28MAY03-CLUS74121_1
tgcagcggaatgacacaggttccatttttggagcaatcaaatgaccttattttaatctgcaattgatggttactatgcttaaagatcgttcggcagctaaaattttcaggttatgctagtgcctcaagaacagtgcagctaagcatattatgatattgtcacttctgctcatagtctcacactctcactgctactgaatgttcataagctgttccaacaccaagatttgcaagtagctgtgggggtctggcactggcagtggcaggcaagggaagtttgtccaccagttttgtgtctttcgacaggcactaaatccttcttccatattaaaattcagacgattccttcaaagcagagttgatggaagtctttgttactttacaaggcagatatccatattgttttgttcaccaaactgtgcttccaactacaattgacctcagccagaagatgtttacaaatcctgaacggactggggcaaaggaagaaaaacttgggtactggggctacacgctaaaggtcgttttgcctggtgatcgagtcgagttgcttttcaacatttcttggcaagcatataatgattcatgtcaggcttataagattaaatacattatctcttattactgaaacgtttgcaactgctgaacatgca

SEQ ID NO: 4194 - DNA, 597 bp, Sorghum bicolor
  Clone ID: SORBI-28MAY03-CLUS74139_1
ctcactacccagagaaacgcaaacaaatcacagctcccaccacggcgccgccgccacctctgccccaccgccacggcggccggtgcaactcccttcgtcgcgaccattgcgcgcgcagccgccctcctccccgcagctcggcttttcctgcgcgggcgcatggcttcctcttctgccgccgccgccgccgccttcgtcgtccttcccttcccctccccatcgtcctccgacgactccgacgacgccgataccctccctcccccgcccgtggcggagccggaagcagcctctccgcaccatcctccgcctccacagctgcaccagctggagcgcgactgcaacttggcaatgaaggggctggcgcgcgcgggggacgtcgaccaggtcgtccacctcttctccgacctcatgctctccgccacaagcgccggcgtcccgcccagcgtgctctgctacaacacgctcctcaacgcgctcgcggaggacggccgcgcggtggaggcccgcatggtgttcgacggaatgctcgcggcgggcgtggcgcccaacgcgtcatccttcaacatccttgtcaagctgtacgcgtggcggaccgcc

SEQ ID NO: 4195 - DNA, 514 bp, Sorghum bicolor
  Clone ID: SORBI-28MAY03-CLUS7415_1
tgctatcgagtttattgtctcgacattctatggtcaagttgtaatgctatccactcatccatatggttgtcgagttattcagagggttctagagcattgtgatgatcctaagacacagcaaataatgatggatgagattctccagtctgtttgcttgctagctcaggaccagtatggcaactatgttgttcagcatgttctggaacatggcaaaccacatgagagatcggctattattgagaagctaattggccaaattgtgcaaatgagccagcaaaagtttgcctcaaatgtcatcgagaagtgcttagcctttggaaatcctgtagagcgtcaggttctgattggtgagatgcttggatccactagtgaaagcgaacctcttgaggtaatgatgaaagaccagtttgcaaactatgtggtgcagaaggtgttagaaacttgtgatgatcagcagagagagatgatcctaacaaggataaagacacacctgaacaccctcaagaagtacaca

SEQ ID NO: 4196 - DNA, 707 bp, Sorghum bicolor
  Clone ID: SORBI-28MAY03-CLUS73691_1
atctgttttcctccagccgccactttcaccttcacggtctcctccctcgccggctggccgccagccgccgccggccccgcctccgccgtccccctcgcccgccgcccgtgggcccgtgccgcccccccgttcgcgggtcgcggcctcgcgccgtcgcgttcgtcggtcaccggcgtcgccctggagggaagctgaggagcggcaatggacaatgggaagccggaggcgcagcactccggagtccggccaccaccccccatggcttcaccttcaccctctgtaagcttggacgaagatgaagcaaggcgcgccattgttttggatggcgcaccgcatgctttgcctacgactggatccgccgacgtgcggcctggatctgccgccgtgcggcctggatctgccgccgtgcggcctgctgctactgctttaggttctggtcggcctccaaagccaattctgaaaaagacctgccgtcttgcaactccaggagctcctgctccaactactccagaagcatcaaccgagggtggcgtccggccgctaaaatcaattggattcactataaaactcactccagccagcgggagcagcagtaggcaagaatcacttgcacatgaatctgttaacgattctgatcccataccaatttctgatggtgaggaggatgaggacactgactttggcacaaagaagaagcttacttctgt

SEQ ID NO: 4197 - DNA, 673 bp, Sorghum bicolor
  Clone ID: SORBI-28MAY03-CLUS73742_1
aaatggtccgggacgaacaccgccagccgattcgaatccgacgatcccgatcgatccaccttcccgatcgcacgccaatcagcacccgccgccgccgcgatggcggacgaggcgaaggcgaagggcaacgcggcgtccgcggccggccgcttcgaggaggctgtccagcacttcagcgacgccatcgtgctcgcgcccgacaaccacgtcctctactccaaccgctcggcggcgtacgcgtcgctcgggcgctacgcggaggcgctaggcgacgccgagcggaccgtggcgctgaagccggactgggccaagggctactcccgcctcggcgccgcgcacctgggcctcggcgacgcgcccaaggccgtcgaggcgtacgagaaagggctcgcgctcgagccgtccaatgaggcgctcaagtccggcctcgcccaggcgcgccaggccgcgtcggcgccgagacgtccggtgggctccggggcggacgccgtcggcaagatgttccagggccctgagctatggaccaaggtcgccgcggatcccaccacgcgtggctacctcgaccagccggacctcgttcagatgctgcgggaggtgcagcggaaccccagcagcctgaacagctacctttctgaccaacgaatggttcaggtgctcaccctcatgctgggca

SEQ ID NO: 4198 - DNA, 741 bp, Sorghum bicolor
  Clone ID: SORBI-28MAY03-CLUS73747_1
aacaccagtgtctcactcagctcactgcagtagcagtcttccccctagatcccgccgacattctccaacccaatcgtgccagcgatggggaggacgggggtggcctccgcctccagtggtggaggagcaggatggccgtgcggtggtggcctcaacctcggcgtgaagctgaacgtgctgctgctgctgtcggtggtggccaccaacctggtgtccctgtaccacctctccctccgcgccgcgaccgtgccgccgctccttctccagcaccagcagcagcaacgggacggcgacgaggacctggtcctcatccggcagctggacgccatccgcgcgggcgtatcgcagctgaaccacctccgctcgtcgtcccctcccccgccgcctcccccggcggagctggtcctctactcccgcctcgcccccgtcgcgtccgcctgctccgcgcacccggacctcctccaccgctacatgtcctacacccccttcgcgccctgccccgacgacgccctctccctcgccgagcccctcctcctccgcggatgccatccgctgccgcgccgcaggtgcttctccccgaccgcttccgcatcagcatccaaactcctccccaccgaccccttctccccgcttcccgacgccgccgtccgatggcccaaggagggcaagtgcaaatccttctcctgcctgccgccgtcgctgggcttcgacgtggcgcgcacggaggccgcacggttcctc

SEQ ID NO: 4199 - DNA, 528 bp, Sorghum bicolor
  Clone ID: SORBI-28MAY03-CLUS73755_1
aacacaagccagccaagctagcacacaaaatgcaagccaaacttgaccgaagccgccactgatggacgccatggagctcaacctcctcctcctcttggtggcgctctccgccgcgtatgtctactacacgacgaggcgccggcggtcgccgcagcggttgcctccggcgccgccggggtggcccgtcatcgggcacctccacctgctttccgagatgccccaccacactatggcggagctggcacgggccatgaaggcgcctctgctccgcctccggctgggcagcgttcctgccgtggtgatctccaagccggagctggctcgcgccgcgctgaccaccaacgacccggcgctggcgtcgcggccgcacctcctgtcgggccacttcctgtccttcgggtgctccgacgtgaccttcgcgccggcgggtccctaccaccgcgtggcgcggcgggtggtggtctccgagctgctctccgcgcgccgcgtcgccacctacggcgccgtccgggtcaaggagctccgccg

SEQ ID NO: 4200 - DNA, 544 bp, Sorghum bicolor
  Clone ID: SORBI-28MAY03-CLUS74395_1
caccagcaggcacgccgacgccaccttcgtcaccgtcctcctgcaggacggcacgggcggcctgcaggtgctcctcgaccgcggcggctgggtggacgtcccttcccctccccggcgctctcatcgtcaacatcggcgactttcttcagcttgtcagcaacggccggttcaggagcgtggagcaccgggtcctggcgaacaagagcagggacacgccgagggtctcggtggcgtgcttcttcaacgcggacgccaagagatctacgaggctttacggacccatcacggatggcggcagtgcgccgctctacaagagcgtcacggctagggagttcgtcgcgtactcgtacagcaaaggtctcggcggtcgcccgcttgggcacttccggttgggggcagaagactagagcatactcctagaacagctgcgtagtgccgtagtcagtgatgcaagtcctgcattccaaattgtaaattattccctaaatcttgaagtaagtttgaccgaatttatatgataaaataataattattataataccaa

SEQ ID NO: 4201 - DNA, 657 bp, Sorghum bicolor
  Clone ID: SORBI-28MAY03-CLUS74426_1
aagtgaaggttgaacggtctgatgcgatagatagaggaagcagtagtagagtagatagatacgccgcagctgccggcgccccttgcctgcgacgactctgctcttgctctgtttagtttgcgtggccgggtacgcagggcaggggagctggggagggttggttcggttcggttcggtctttgcatgcgcgggcgacgacgttgatgtgcttcgagctggcggaccagcagcgcggaggcggcggcggcggcgcggggtggccggcgaagcggcgtgcaggagcaggaggcggtcaggacgagggcgcggggatggcaatggcggccgccggcaccggggaggtgatgtccgagtactaccaggcgcaggagctgtcaacgatggtgtcggcgctgacccaggtcgtagcgggcgggccgtgggccgggtccgccgccggcgccgcgccgagggggagcgccccggagcagcagccaatgcacggcggctacgcgcaggagatcggcgcgccatcgccggagctcgcagggtcccagccggcctcgcccaccccgcgcgcggctgcccccgccagcgtggcgcgcccccccgccgcggctccccgcttaccgccaagcgcttgcacgctttcctttaatctttgctttgttactacct

SEQ ID NO: 4202 - DNA, 260 bp, Sorghum bicolor
  Clone ID: SORBI-28MAY03-CLUS74430_1
aaaccgcgagtcctctttctcccccacggcagaattccgtttccggccgcctcctatacataggcagccagcctttcattcaccctctcccctccccccaggcaccccccacacagcccagcaagccgcgcgcggaggtggggcgatcgcacacctcgccgcgcgtccttcgcctacctccgttgcgcccgccaacggtcgcgcgtttccggggggcagagagagagagagagagagggagggaggaggaagggagagga

SEQ ID NO: 4203 - DNA, 849 bp, Sorghum bicolor
  unsure (1)..(849): unsure at all n locations
  Clone ID: SORBI-28MAY03-CLUS7447_1
gcacgagggcttcatccacggcaacggcctccgcgacgtcgccattacaggtgacaagggagtgatcgatggccaaggtgaggtgtggtggaacatgtggaggcgaaggactcttgagcacaccaggccgaaccttgtggagttcatgcattccaccggcattcacatctagcaacatcgtcctcaagaactcaccgttctggaacatccaccctgtttactgcgacaatgtggttgtaaccaacatgatgatcttggcgccacatgactccccaaacacagacggaatcgatccagattctagctccaacgtgtgcatcgaggactcgtacatatccaccggcgacgacctggtggcgatcaagagcgggtgggacgagtacgggatcgcgtacggccggccgagctccggcatcacgatccggcgggtgaggggctcgtcgccgttcagcggcatcgccatcggcagcgaggcctccggcggggtgcgcgacgtcctggtggaggactgcagcatcttcgacagcggctacggcatccacatcaagaccaacgtcgggcgcggaggctacatccggaacgtcactgnnnnntacgtgcgcatgagcggcgtgcgcatcagcggcgtccgcatcgccggcgacgtcggcgaccaccccgacgcgcacttcagccagctcgccgtgccgctggtggacgccgtgcgcatcagcaacgtgtggggcgtcaacgtccagcacccggggtcgctggagggcatcaggagctcgcccttcacgcggatctgcctctccaacgtcaagctcttcgggtggcggaagaacgacccggcctggaggtgcaaggacg

SEQ ID NO: 4204 - DNA, 658 bp, Sorghum bicolor
  Clone ID: SORBI-28MAY03-CLUS74458_1
ccctcggctcccccccccgcgctcccccccgccccccgcccctggcgccgcccccgccccctcccccctctccccccgcccccccccccccccccccccccccccccccccccccccccccctcccccccgcgccccccccccgtcccccccgcgccccgcgcgcgcccccgccccgctcggccccccccccgcctccgcgcgcgcgccccctcggggtggcgcgcgtgcgcgggcgccgcgcgcgccccctcggggtggcgcgggtgcgcgggcgccccctcgggggggggccccccccccccgcccgccccggcctgcgggccgcgcggcccccgccgccgctccgaccgcgggcgcccccgccgccgcgcgtcccggtcccccggccgccggggcggccccgccagctgcgcgacgcccgcgtccaccccgccggcaggcccctcggcggccgcgcctaccggttcctcggcgaccgccgggtccgcgcctgcttcgcttgcgccaaggacatcgggccggtcgggccgtgcgccgtgtctcctcctgggttgtcggggaggtccggcttggctgctgacacacgggcgccatcgacggccggtctggcgggctgttctccgtttagcaacagccgatgcattgtttcttggggg

SEQ ID NO: 4205 - DNA, 748 bp, Sorghum bicolor
  unsure (1)..(748): unsure at all n locations
  Clone ID: SORBI-28MAY03-CLUS73867_1
gcctattggaaggaatattttgctattgagtaaacggaagacagagccgacctctgttccttcctcgtccgcgatatcctcctcgtctctcacgtctccggcgatcgccggcggccacgggtgttacatcccccgtcccctccgcccacgacgtgccccctcagatcccgtcggcagcggcacctcatccacgacgtgccccctcagatctcgtcggcagcaggcaggagtgggatgaggagcgagcagatcggcaagcctccagctgagccacggacatcatcggccgccgcggcactgggctcggtcaccatgtcgctcggtggcagcttcgcctcacacctgggcaagtctttctgctgcacgcttggctccctggccgggtatagcgagccctggagtccaagttctcccctggctccgtcacggcgagtagtatcccaccgtgtatgctttccctgcttccagggcacttcgcgggttctgcgctggcagcccctcgtgcctctgagtctcctcccgccgtgtactcgcggctatgcgtggccggccccaccccccccggcacccggtggccttcggctgcccccccccatgcctcccctgtgtgtgctcctcaacactgctggcagatcatggtgtcccctcctctagatccccttccccatctcggcatttgcaccatctcctactcctcanccttcttcttgattcgttttgatgatttgagtgcatgatgtattcccta

SEQ ID NO: 4206 - DNA, 593 bp, Sorghum bicolor
  Clone ID: SORBI-28MAY03-CLUS73905_1
aactcgtcacgcttcttcagcgccggctctcctctccatccctctcctacactgaccttctcctccacatctcccgcaaccgcaagcaaccactgatccagcccgctccgcctcccggcgaatggtgacgaaccaggacgcggaggcggcatcggcggcagcgccgggggcaggggcgacggtggacgcgatgcggctagcgtcgcggtggcgatcccaggcggagtgggcctgcgcggcggcggagctggagtctgagccggcgccgtccgagctcaacaccgtcaacagctccggactcttctccgtcgtctctaccgacaagttgtccgtgaaatacctcggcagccatcaccacggccacgacgtaggtgtcgtgcaggccgaccgccccgcgcccacgcgccgggccgtgtactacttcgagatgagccgccggcccgcgggggactcgggccggtctgccttccgcggcgccgacggccgcctctacgtggggcgacggccgggtcgggcgtctggcccttgtggcacatctggtgacataattggcgctggcatcaactacttgtcacaagaatttttcttcacga

SEQ ID NO: 4207 - DNA, 732 bp, Sorghum bicolor
  Clone ID: SORBI-28MAY03-CLUS73911_1
ttgctgctcgtccgcggcggcctgctcgccggcgccgtcctcggcgccgtgtggctggcgccccctccgccggcggtgcctccgccgcttcctccgcccccggcccctccccgccgccctgcgggaggccgccgccccccccggggcgccgccggcctgggcgccgcctccggcgccttccccccctccgccggtccccggcccgccggccccgccgcctccccgggcctcggtctctgctccctcgcgttccgcccactccgccctgtcgccgcgccatgcctcaggggcctggactcctctggtcccctcccgccggacttcgcggacctcccggatctccgcccgctggttcgatgctcgcgcttcttccgccgtggggggccgggcccgcgggcccgggtctcggctccaggcctgtcccgcatggcggacgggctgtctgccccgcttcccgcggcccgcacggcggccactaccctcactttcgtgtgcattgcctcctctgtctcctctgcgccatgccctcctctccccggccgccgagtccgtgttctggcgctctcattctccaccgcggggccctcggcgccccgccctccggctcggtcggtcctccggggtcttccccgcctgcgccggtcccgctcccgtcgtccccggcggctcccgggtgctcggggactgctccttctctaacggcacagtctgccatgtcaccgagatattcct

SEQ ID NO: 4208 - DNA, 506 bp, Sorghum bicolor
  Clone ID: SORBI-28MAY03-CLUS7392_1
ctcccacgctatttgactgtgcctcctccagatagtgcacaacaagttaaaaagattgatgaggaaactctccgtgaggttataggtatggggtatgacaagaacttgttagtggaatcaatccaaaacaggctgcaaaatgaggcgactgttgcttattacttactgttggacaataggcttcgcacaaccagtggctatcttggagctgaatgtcaagaagctatggactcctcattttcaaacatagcatcatatgaaacaccaagttcagcacgtggtaatcgacaacagatatttatggagtctccagttggcttgagaccgcatttcccagctgagaggaaatgggctcttgggcttcagtcacgagcacatccaagagaaataatgactgaagtgctgaaagctctgcaagaattgaatgtttactggaaaaagattggtcactataacatgaagggcagatggagtcctggctttcctggtcaaattcataacaatca

SEQ ID NO: 4209 - DNA, 525 bp, Sorghum bicolor
  unsure (1)..(525): unsure at all n locations
  Clone ID: SORBI-28MAY03-CLUS7395_1
gcacgaggccagcttctcttttttgtgtactccgtccgctgtgtgtgtgcggtggcaacgtgcgacagccgctgataggcagcagagagaagagagagatgacgaagcaagtggtggtggtggacaccgcgctggtggcgccaagcgaggagacgccgcggcagcctctgtggctgtccaacctcgacctggccgtgccgcggacgcacacgccgctcgtctactactacccggcaccggcgcagggcggcgccgccctgggcacgggctccttcgcgccggaccggctgagggccgcgctggccgtcgctctggtgccattctacccactcgccggccggctcggggttggcccggacggccggctgcagatcgagtgcaacagcaacggcgcgctctttgtcgtcgccaacgcggaccttaccgnggngccgacgttttgacgactatcgagccgtcgggcggaggtcaggaaccacttttgtggccggtagcggacttccggcgatgcgaccaagcacccca

SEQ ID NO: 4210 - DNA, 653 bp, Sorghum bicolor
  Clone ID: SORBI-28MAY03-CLUS74653_1
agggatcacctgctggttcctcgagagaggaagaatgctttcttgtggaagaaggtcgaagaactgatactagaagattctcgaatagatcaatatccaaaggtgattaagggggagtcaaaggttgtttatgagtggcaagcaagtggctcacttagtgcaaagattaaaaaggtgcaaggtgcaagggtcaagtcaaggactggtggaggtgcgataaaatttgcagaagaaatgggtgcttgcttggttgaggtgagggagcaggggtcatgtgatttaatacgtgaagaaagaagtaaggcgaagctcacgagcagtgattaggctatttatctatacgcctctggtctctggagtgagatagaagtgtttctcaaactagtctatgcgaaggcaggaggtactgatatttgtatatatgataggagtaacaggtaccgcggatctccgtcacagtgtgtgctagcctgctgaccgctgttaggaatccggtgtttgtcttttggcgaattgtgttattgcaactagaacggacaaatagtcctagtcatgagattgatatgtcatttaacttgggattcgaattgaagatacccatcatataattttgtatgcaggagcttcattcgttgaaataaacatatatatgg

SEQ ID NO: 4211 - DNA, 617 bp, Sorghum bicolor
  Clone ID: SORBI-28MAY03-CLUS74696_1
aagaagctgtcgtaccgagtagtgtaccccttggagcttaagctcagcagcagctccagtgatgccgttgctgactgtgagtactccctctttgccgtggtggtccacctgggtagcggccccaaccaggggcactacgtagccaagatcaagagccatgaccattggctgtcgttcgatgatgacaatgtcgagatgatcccggagtccaccctacagacgttctatggctcttctcgtgaatattcgggcaacacggatcatggctacatcttgttctacgagcgcattggtgggaatggagatgagaagaccgactcttccgatggagtgtgaccatggcgtggacatgagatcctgggtggtttgatgtccatgcgatttgctttccgtactgataaggtagatttacattttcaacatgaaagtttcttttttcggaagaaagtgggaaagaaacatataaaaatttagtttgttgttagatgcagttacttgtaaaggattagtcggcaggtcaatatatcattttattttgttttcatgattctaacttgacaataggaccgcatttcctcatattgtgccttagttttatgtgaaaaagttagtctgct

SEQ ID NO: 4212 - DNA, 595 bp, Sorghum bicolor
  Clone ID: SORBI-28MAY03-CLUS74701_1
gcacgaggctggtattcacagggatgtgctcctactatcaaagccacagatttttatcacagattacttcttcaaagcaaccttggatgataatttcagtttagctgatattgaggtcgacgtggagattgactcacacaagaaagaccgggagcatgtcccaactttgtctattgaagcaacactctttgataactctggactatctatcagtatagatgctggtctttcatatgctaatgcagtcaatttgaaaccgaagccaaacccaactggaagcccttgtcgtggttttcatggttatgttcttggtggaaaaatagaaaatccaaaactttggtctagtgagcatcccggcttatacactcttgttgttctccttaaagatgccaatgggaagcttattgattgtgagtcatgccaagtgggcattcgtaatgtggtcctggcacacaagcaaatgcttgtcaatggatgtcctgttgtactaagaggtgtcaacagacatgagcaccatccacgccttggaaagacaaatttagaagcatgcatgattgaggatgtgattttgatgaagcaaaacaatatcaatgct

SEQ ID NO: 4213 - DNA, 673 bp, Sorghum bicolor
  Clone ID: SORBI-28MAY03-CLUS7472_1
atgcggaagtagaaaagctgagtcaaactgtgagagagctggaagaggatgttctgcaaggtggtgcaactgccaatgttgttagagattaccaacggaaagttcaagaaatgaatgaagaaaagaaaattcgtgatcgtgaacttgctcgagcaaaagttactgcaaatagggttgctgttgtggtcgcaaatgagtggaaagatgctaatgacaaagtaatgcctgttaaacagtggcttgaagagcgaaggttcctgcagggtgagatgcatcaacttcgggacaaacttgctattgccgagagaactgctcgatcggaagctcaattaaaggaaaagcttcagttgcgcttaaaagttttagaagaaggtttgaggggccctccaagtggttctagtcgtcctcctatggaaggaaagagtttaagtaatggacctccccgtcgactttcactaggtggtgttgacagtatctccaaaatctctccgaacggtgtgttaatgaggaggtctccgtctttcaattcaagatcctccctctctaccagcagttgtttggtcctgaagcatgcaaaaggaacttcaaagtcattcgatggtggtaccagatcattagaccgaggaaaagttctcgggagtgggcctcattcactcaatagatctacggatgc

SEQ ID NO: 4214 - DNA, 540 bp, Sorghum bicolor
  unsure (1)..(540): unsure at all n locations
  Clone ID: SORBI-28MAY03-CLUS74735_1
gatcctcgcgtgctcgcaaacaagcgtccggctccggggcgtggncggcccgtttttgcatgttgcgtttgcatgccgtagcggctctgctgccggtgttcctccccttccgaacccttggccaccacctctcggccgtctcgtgattcgaatcactgctcccattgcgaacgagccgccacagctgttgccaggctcaaggagggctcgggctcccacacgcgccgggggcgatcgatcgatcggagaggcggcgactcgggatcgggccggggcacggcggggagtcgcggcggcgcatgagctctgacgccgcggggggacagcgcagcatcagcaactccgcgaggggcgacgcggcggcggcgatgccaacctcatcgccctttgtcgtcggcgacagcagcggcggcgcgggctccccgatccgcgtcgaccgaatggtccgggagcacggccgccgctacgacatcttcgcgtcggacgcgatggataccgacggcgccgagccggcgtcggcttacgcggggcccttcgccg

SEQ ID NO: 4215 - DNA, 660 bp, Sorghum bicolor
  Clone ID: SORBI-28MAY03-CLUS74153_1
gcttgcaccaataaccatatacataccccctggcagtatacatcctcaaagtctcaaacacagctagcaaagcacactagtcctagtccagcactctagcctctagcacgagcagcggcggtacaaggcgtgtccggcggtgccaagaagataagctccagaacagaagcgatggcgcagttgccgccgagggcgccgagcgccttgccgcaggaccactggtcggcagcgggggcggagttcctgggcttcgccgcggcgaggcggggcgcgcaccgccgctcggcgagcgactcggccgcgttcctcgaggtcgtgcctatggacgacgtcatcggcggcggcggcagcggcagcgccggcgacgacttcgaccgcctcgacgacgagcagctcatgtccatgttctctgacgtcgacgcgccggccgtctccgacggcgccggggagagggccggggacgcggcgcagctcatggacgtcggggacgcggaggacggaatggccgcctcgtcgccggccggtgcgcgggcggctgcggacggcgtcgctgaccccaaaagggtcaagaggatattggcaaacaggcagtcagctcagaggtcacgagttaggaagctgcagtacatctcggagcttgaacggagtgtcactagcctc

SEQ ID NO: 4216 - DNA, 685 bp, Sorghum bicolor
  Clone ID: SORBI-28MAY03-CLUS74224_1
agttggaattgtatttcagtttcttgagaggtatttcttagcagatactgtacttgaagaagttacttttgggtggccgaggcaaaaggcagacctccgattaaaagaacagctcgctttaaatcttcaaaatgcctttaactcggttggtctgacaaccatctcattagatgaagatccacaagctctaagtggtggatttaagaggcgacttgctttagcaattcaactggttcaaactcctgatttgttgctgcttgatgagcctcttgctggtctagattggaaggctcgggctgatgttgtgaatctcttaaaggacctgaagaaagaacatacgatactggttgtaagtcacgatctaagggaactatatccactagttgattactcatggcgaatggaaatggggggaagtttgaaggaggaaggtttgcctgtgtaaacatgttcttgtcggtatagctgtcagacatggtggcatgtgcatatggtcatctgaatctagtaagatcaactacttttaaacttagattttgccagctcggaaatttcttgaagatacaatggagtcagaggtgcatatgaatgagttttttggtaatacatggtgacttgtgcatgttgagaatcggcagatgaaaaatgctagaaaagttcaatagatggatcatgaatgttagtt

SEQ ID NO: 4217 - DNA, 616 bp, Sorghum bicolor
  Clone ID: SORBI-28MAY03-CLUS7430_1
aagcgcttgtaccaacagatgcattggaagctcagatctttaaatgaaaatttaggtgatatgactcaacctggaaatatatataatcccaatcatcagcaagtaaccctatcaagaaatgagccttccccatcttataataatatggattcaaataggaatgctcttcaacagtatgctcaaggtccaagtgaccgtcatattgagcaaatgtaccatggatccaatttccagcaggataccacgcgtccgactccttctaattattttgaagaaggaagagtagatggtgactcacagttataccagcctgatggtgatgctttacctggtattgaggggtttcaaattgctggtgaacctagaccaggatttcaactaacagcatgtggtttccctacaaatggtactaccctttgcaatttccagtgggttcgccatcttgaaaatggtaccaggcaatctatcgaaggtgccacgatgtatgactatgtggtcactgcggatgatgttggcacccttcttgctgtagactgtacgcctatggatgataatggccgccagggtgatttggtgacagaatttgctaacaatgggaataagataacctgtgatc

SEQ ID NO: 4218 - DNA, 898 bp, Sorghum bicolor
  Clone ID: SORBI-28MAY03-CLUS7428_1
ctacattattcattatgcagagcacacttgatcctcttctagcactggttgctcttgcttttagctggtggttatgctctttgttgactgcaaagaaagttcagaagacaatgacccagaaacaaaagcaatcaaaggttctttctgagcaaatgcttactcaaggattgcccaacagtcctaaaatccagttcttaagtccatctaagataggctttggaagaaccacatctagaagttccgccacacagtacggtcggagcaatttggctaatggaggtctgatctgctcagcacttacaaagcgcgtagtacccaacgaagacgacgaagatcactactccaccttccacaacatccagccacggaaatattccaaggaggaatgggaggacttcacccagaaatcaactaggaaggcgcttgcggagtgcacagcaaccccagagtttgcgcagtgggttgctgacaatgctcgtcgtctgcaagtagggaaagaggaagacaacttctcagaggaagagacaatcgagggctccaactcggaagaaactggggacgaagccgatggagctccaggtctgatcaggctgtggggctaagcatgctgattgaactaagcatgttcctgcccatttcacgtgtaaagagtagcaagcgcccatttaaactagtttaggagcagggtagggtggtagcagtggattgtttccagttgttgccacggtaggttcgttctgtccggtggcagtagttggctagccatctcaggtcaattgatgctaggtttagctagctgttggttatcagtggattcgtagttctttagaactgatgataggtgaaatggtttataaacaatctgatttatgattggaatcagcattggttgaactgg

SEQ ID NO: 4219 - DNA, 400 bp, Sorghum bicolor
  unsure (1)..(400): unsure at all n locations
  Clone ID: SORBI-28MAY03-CLUS7427_1
ggcggcccctccccggcgcccgcgcccgcgcgctgccaggtcgacggctgcaacgtggacctcaccgacgtcaagccctactactgccgccacaaggtctgcaaaatgcactccaaggagccccgcgtcgtcgtcaacggcctcgagcagcgcttctgccagcagtgcagcaggttccaccagctgcctgaatttgaccaactaaaaaaaagctgccgcagacgtctcgcaggccacaatgaacgccggaggaggccacctcctggacctcttgcaacacgatatggtcgccttgctgcatcattcggtgaagagcccggcaggttccgaagctttatgttggatttctcatacccaagggttccaaccgccatgagggatgggttncagagttcgacct

SEQ ID NO: 4220 - DNA, 754 bp, Sorghum bicolor
  Clone ID: SORBI-28MAY03-CLUS74797_1
tactggacgccctccccgcggaataaaaacttttttttttctctcgcattcctcccttggaatccatccatccatccatctctcgccctctcccttccaattcgatgcctttgtagcgctgctgcctcgccctgcgtcgcgccgcgtcgtcgtcgtcgccgccgcggggtccccggttccgcttgctgctgctgcgccagcgcttccaacatcatcatggacgggggatccggcaatgcctccggcggcggcggcggcggcagcggcggcgcgtcgacgtgctgctactacgcgctcctcggcatccgcaagaacgcctccgccaccgacatacgcaccgcgtaccggaggctcgcgatgacccgctcatatgttccgatctcttgccgtgggcgcgcagaagtggcacccggaccggtgggccagcgacccaggcgccgccggtgaggccaagcggcggttccagcggatccaggaggcgtactccggtaaggcctagtacctgtttggttatgcttggctttcacgagatttgatcgaattgcttgtttggtttgttggcgcaaacctaaaccaaacaagcattccaatcctctcacccgccgccgtcgtcagctacgtagttagcttttctttttctgtcgatgacacgccccgccgatccagatccagatcccaccagcatctggcggcgccgtggacatgtcccgccgcgagagagagcgagcgagcgagcgccaccggcgacccaaac

SEQ ID NO: 4221 - DNA, 732 bp, Sorghum bicolor
  Clone ID: SORBI-28MAY03-CLUS74807_1
tcccaaggctgtttttggtttactagcagatgataggcaaattatttcaagaaccaaatcataagctatcagttctgaaagttggcgtgatgcctggggatgagacgctaatatattgcaatttattgtccgtctttgccatcatacaagatcttgacaattttcagtttgccattcgtagtacatttcattctaaattgtaaaatttttggtatttgcacacgagtccatggttatgggttatgatacgtgatttttctcttggttaccctgcaaattgtgaaattatttgatggtctaatgtaattcaacaatgagccagaaaggtagatttagatgtaatgttacagcttgatagaaagatgaatagaattatctcgtattgacaaaggatatattcacaaagaatattatatatgaagaggttcaagctccataaataaggatacttccaacacatctaggagaactgcaagtgactacatgattgccgttgcctgccacgtcaatacccttatgatgttgttaagaagatatgctattatgtttatcagatgtacactcgggataaaattaatctcttagtttcgcccaatggtctccctgcttctatgtacacacatctacaattttatttgtttttgttgttgattcgctcgtgcaatatgatattttggacatcacctttgcaatgtctttttgggataacagtataatacatattcatactaa

SEQ ID NO: 4222 - DNA, 722 bp, Sorghum bicolor
  Clone ID: SORBI-28MAY03-CLUS7482_1
atggtgcaccgtcctttcattcgcaaagcagtgagcaacatattctaccagtttgtctttgagactgatcggcacaatgggatcgcagagctgctggaggtctttggcagtgtcattagtggttttgcattgcctctgaaagaagaacacaagatctttctttggagggttttggttcccctacacaaaccgaaatctgttggtgtgtatcttcagcagctgacctactgtgtaacacagtttatagaaaaggacccaaagcttgcaagctcagtgataattggtttgttaagatattggccaataacaaattgtcagaaggaagtgatgtttctcagtgagattgaagagattttggagtctaccagccaggcagaattccagaaatgtatggtaccattgtttcggagaatcactcattgtatcaccagttctcacttccaggttgctgaaagagcgctcttcgtatggaataatgatcacattatcagcttgattgcacaaaaccgccaagtgatcatgcctcttgttgttccagcactagagcagaatattcagaatcactggaaccaagcagtcctgaatctgactgtgaatgtcaagaaaatgttttctgagatggacgatgatctcttctcatcatgcctggccaagtacaaggaggaagaagaaaaacgtgtgtcgctagaagcgaagcgtaagcttacctgggagaagcttga

SEQ ID NO: 4223 - DNA, 846 bp, Sorghum bicolor
  Clone ID: SORBI-28MAY03-CLUS74820_1
tcacttcattgcatctaacaatgactgtggggtaagagagtatgatatggaaagataccagttgtttaagcatttccgatttgattggccagtgaatcacacatcattgagccctgatggaaagcttgttattattgttggtgatgacacagatgctttgcttattgatgctaattcaggaaagactattaattccgtgaaaggtcacttggattactcctttgcatcggcttggagcccagatggtctgacattcgccactggtaaccaagacaaaacttgccggatttgggatgccagaaatctctcccagtctgtccatgtcttgagaggcaacgttggagcaataagatctattcgttttacatctgatgggcagttcttggcgatggcagaggcagcagactttgtccacatctttgacatcaaaagtgactacaataagcgacaggagctggatttctttggtgaggtatccggtatgtctttcagccccgacacggacacactttacgttggaatctcggataggacatatggcagcttacttcagtttggccgcctctataactattcatacctcgactcactactatgatggtcaaagaaaatgcgttggccgtcttgtgtttccctctctgataatcaacccagattaggcatcccaaatcaaatttaatttagcttggtattcccttaaagaatcctgtaccctgctgtatgtgtacataaagaagtgtattttatagacaccaatagtctgctactctgctttgagataggtataaggtgtcaggattcaaatcataagttagatttcaattcgttatgcgcgagatgaatcca

SEQ ID NO: 4224 - DNA, 696 bp, Sorghum bicolor
  Clone ID: SORBI-28MAY03-CLUS74845_1
ttctattttacttcaaagttctttggacttaagaagtcgtcatcactatctgattttatgtttgctggagaacaatcttgcaatcaggatttgtccactcttagaaaaaagtatcctaataggtctgatgaagatttttcacggtattgcttctcgatggcatatattgtggctctactgcatgacagtcttggtgtaccactggatgataagaggattgagtattcaaaccaggttggagacgttcaggttgaatgggctctaggagctttcatcacattgatgcaaaatacaagtttaaagccattgcacaccgccgcagaaccaatccatagcaatagaccattgtttgctgtgctgggaatgtttcttttatgtggagtactttttgtatcaagatggaggaagcccaagacgaaaatcatatatgacttagagaaaggccgatacatcataacacgcatcagctgatgctgacccttgtgcagaagaactatatttatacgacaggagtagatgttgttgtgttgtacaacaatgtacgagttcaattctttgtgttttatcttaggtagcagagttgggtgggtggagcatggaagatagcacattttgtgcgtatagaagaatgtgtaggacaatttgtcatgtgttaattgaattattttgatgaataaatatagtttttttgtttca

SEQ ID NO: 4225 - DNA, 627 bp, Sorghum bicolor
  Clone ID: SORBI-28MAY03-CLUS74864_1
aaaccatatatttaaataaaaaataatggaaaggctcgacgcctcgacgtcgtcgtcacctctctcgccgtccaccagtcacggcgagcgggcggcgtcggccgtcagcggcggccgggggttcaccaccatgcctgaccccaccgccaaacccccctcgccacggccccgccgccgccgcaggctctgcggcctctgcctcggcaccgcgctcctcgcgctcctcgtctccgcgctcgtccacgccgtcgcctcgccgccgcgtcgtcccgcccccggcccggcctccgcgcgcttctccgtcgtcatagacggaggcagcacgggcacgcgggcccacgtcttcgccacggggcacgacggccgcccggatctggcgcgctccaccgtgatgcgcgtctcaccgggcctctcgtccttcgccgccgacccggcgcgggccggggagtctctgaagtcgctgatagatttcgcgagggatgagattgtcggctcgggaggcgccgctcgggaggcggaggtgcggctcatggctaccgcagggctgcgcctgctcgaggagcgcgcccaggaggcgatcttagcgtcctgcagggacgtactacgagcctctgggttccgattcga

SEQ ID NO: 4226 - DNA, 666 bp, Sorghum bicolor
  Clone ID: SORBI-28MAY03-CLUS74480_1
acagttaccacgtcaatcatggcagcaagaacaccaacaatggtgcaccttcttgtaacccttgtttgcttcctcatatccagcgcaagaacatcgtcttcttcagcttccagttctgatgtggatgcattcctcagctgcctctccgcggacgttccgccttccatcatctacaccccagcaaacaacaacttctcttcggtccttgtgtcgtctgtccggaacctccgctactacgactacgacgtcacgccaggcccaggcaccaccaccatcgtcagccggccgctcgcgatcgttgccgccaccgagcccgcccatgtccagaccaccgtagtctgtggccgccgccatagcgtccacatccgcacgcgcagcggcggccatgactacgagggcctctcctacgcctctatcgatgtcgacccccaccgccggcatttcgctgtgctcgacctcgctgcgctccgcgcgatccacgtcgacgcctcgagagccgaggcgtgggtcgagtcaggcgccacgctcggcgagcgcttcggcgccgccgccgccgccaacgccccgctcgtgcccgtgacggagaccgtcaccgtgttcagcatccgccgcctgaggaacgagtccgccgtcgacctcataaccaaatggcaagcgatcgcgccg

SEQ ID NO: 4227 - DNA, 665 bp, Sorghum bicolor
  Clone ID: SORBI-28MAY03-CLUS74488_1
cagagccccaccaccaagtacaccatcgatgtctgccaccgaaccggcagccggcctggcctccgatggctatgaccgccggcgcgagctgctgcaagcgttcgacgacaccaaggcgggcgtgaaggggctcgtcgacgccggcgtcacggccatcccagccatcttccgccaccccccggagtcactcgaggcgacctcgtccccaccgcccaccgacgtcgtggccagcgccggcaccatcccggtcatcgacctcgcagctgcagcaccgcgaggagaggtggccagccaggtgaagcgcgcggccgagaccgtggggttcttccaggtgaccaaccatggcgtgccgcgggagctcatggccggcgtgctcgccggggtgaggcggttcaacgagcagcaaccggaggtgaaacgccggttctacaccagggacactgcgcgcaaggcgaggttctgctccaattacgacctcttccagtcggccgccgccaactggcgcgacaccctcttctgcgagctcgcgccggacccgccgcggccagaggagctcccggaggctgtcaggtatgaacacacacgcaggcacactaatccccggagtatgcactactgaatctctgtctgatccatggcgaacaaaaaggggcgtgatgctggag

SEQ ID NO: 4228 - DNA, 602 bp, Sorghum bicolor
  Clone ID: SORBI-28MAY03-CLUS74494_1
gcctactgatcctgattcttcttctcggcctccaaaccagtagtgcgccccaatgcgaggcaagcagctgcggctgctggtgttgcgaggcatgggctacagcctacagcttccggcagcctacgagcaagttgattggcgcctccactggttcttgctttgattgctttttatttgtttggtatttgggaatacccaatcaggtgaaggaggagacggatccatggcaccatgccgttaaaacggatccgcggcaccatgccaaggtgctatatgctctgctagctcccacccatcgacgagcttcgatctgtaattcatgttcgtttttgtttcaaattagtcctattttgctcgtgcggtggtcttgatttggtcttagtttgtctggttttggccttgacttggtcttagtttgtatggttttttttatttggtgtccatctaattctggtgacttcagtttggtcccattgcacctcgctatggtccaggcctgatttgattcaagcggatgacgaggacatccttctcagcttgctgtggagtcctcaatttattgtgatagaacaaattaaggaagaggaagcaaatttatttat

SEQ ID NO: 4229 - DNA, 543 bp, Sorghum bicolor
  Clone ID: SORBI-28MAY03-CLUS74574_1
cactcacccggccagagaagcggcaaaacagagagccgccgacgacgagaacgacggggaggagctttagtttggcgcgcgcgcgatggtgttcgcgtccgggtccggcgccgccggcggcccgcaggtgctgacggcgcggttcgtgcggcacgtggtgctgggccgttggttcatggggttcgcatgcctgctcatcctgtcggcgtccggggcgacgtacatcttcagcatctactccaaggtgctcaagtcgtcgctggggtacgaccagcgcacgctcaacacgctctccttcttcaaggacctgggcgccaacgtgggcgtcatctcgggcctcatcaacgaggtcacgccgccgtgggtggtgctcgccatgggcgccgccatgaaccttgtgggctacctcatgatctacctcgccatcgacgggcgcaccgccaggccacccgtctggctcatgtgcatctacatctgcgttggggccaactcccagtctttcgccaacaccggcgcgctcgtcacctgcgtcaagaacttccc

SEQ ID NO: 4230 - DNA, 789 bp, Sorghum bicolor
  Clone ID: SORBI-28MAY03-CLUS74550_1
gcacgaggccccatcggcgcctacgtgctcaacgtccgcgtcgcgggggcgctctacgacgtcgaggccgccaagcagcacggcgggtccctggtgggcgccggcgacaagacctgcatcggcgtggagtgcttccgcaagtcgttcctcatcatcaccgccgccacggtcgccggcgcgctcgtgtcgctggtgctggtgtggcggacatggaacttctacaagggcgacatctacgccaagttcagggaaagcgcggacgccgccgaggcggaggcggaggatctgaagcggcccaaggagacggcggaggcggagaccgaggttaacgggaggaagcagtaggcgcatagggcaccgcgccgcgccgcacgcaggcgctggtgtccatggcggccgccggccgggggcctggcgcttgcgttgactcggtcgaggtcgaggaagccacactcacactgtcgtcacacagtgagctaacgctcggttttgacttggtatacgtgtcaagatctccgtcatcttccaatcgttgctgttcttgctctggagctcaagttggatggcaatgggcagtgaagtgaagggcgccgcagcagcagtctgatgagtctctgagtgagagcagctgtcactgctaactgcaggtgattaggtgcacggttactgtgtaatcttttagcagggaaagaaaaaactagtggtgcttgactgtagtataaagtacccctgcttctttttccctgttgtatggatatgtacttttgtaactgctactgctcttaggcc

SEQ ID NO: 4231 - DNA, 210 bp, Sorghum bicolor
  unsure (1)..(210): unsure at all n locations
  Clone ID: SORBI-28MAY03-CLUS74624_1
gcctactgcccgatgcgctggatgtgagtcagtgacacccgccgcgccgccgccctcgcagctgccgatccggtccccggtccgccgagaaaccctcgccgggtcacgcgccaataatgccccgtcacgcccaccacgacccggccccgcccgcctgctgctcctgctgctgcggatgcgcgggcgcngnnccgtgctactactacccgc

SEQ ID NO: 4232 - DNA, 638 bp, Sorghum bicolor
  Clone ID: SORBI-28MAY03-CLUS74917_1
ttatgtctcatttgattagcatttatggctaccatgtatgtatggtagatttgcatccgtaagtcggtaagtgtgagctggtgtagctgctctaagattgaaaagagttgtgggctcttgttttgatgtttgcattcgtcttacgaattaaaaacatatgaactcaaatctgcagcagcattacagctggtctgagctctggagtctgaagtgacgacgcactcagacctcggccttgtgctcgggccggtgcgtgaactcgaagtcgacatggacgaaggcgcgctcgacctcgggcagctgctccagcttctcctgcagcgactcgccgatgtcgtgcgcctggctgagcggcatgtcgcccgggagcacgatgtccacctccacgaagtagtgcgtgccgaaggtgtaggctcgcaccgtgtcgatgtgctggatctcctcgtggtggttccagatcaggtacgtcagcttcgtcaggtactccgccggcgccgacttgccgatcagcgtgcccacgttctccagcaccgtccgcgcccacgtcgtgatcgtgtacaacgcgatcagtatggcgccaactgggtccatccaccatttgtaccggacggcgagcagcgccgcgaccaggccgaccg

SEQ ID NO: 4233 - DNA, 658 bp, Sorghum bicolor
  Clone ID: SORBI-28MAY03-CLUS74950_1
atcgttgtttatcttgaccctgtttgtgtgtgtagatgtctcactgcccactatatttttgttgagaaacatcaatgtccatcatctgggagtaggggatctgatgcaggtcgcttccgatccagtgatttctctgttcatgcgctaatcttgtctaactgttatatttgctcgctatttttttcactatctttgacatagcactaatctaatgccccctcatgctttgtcctgtttatgcagccaggaaccagcagaaagagagcagtacctgagcgttgctcgctgttttttcactatctttggcatacctaagttttcttttatcccggttcttttgacaggtgttggcagccattagaggggcgagagaagagtgggatgtattagttttgtttttttctttctgataataaaataatatagtttggcctttgagttggttgaactcagtattcgtgatcccaattaaggttatttagctgccataaattgtatgtgattttatggaataactcagacagagacaaaaccatgtgtattcaaactgcaaagtgtattttaatcttctttggtgattcatttaccttaaaaattatgttcttgaaaactttttctgttgctcatttatttcaatataaaataaaatctaccttct

SEQ ID NO: 4234 - DNA, 659 bp, Sorghum bicolor
  Clone ID: SORBI-28MAY03-CLUS75003_1
cctccggggtcccctccgcgtccccccgtctcctcccctccccccgccccccccccccccgcctccgccccccccgccgcctctgccccccccccgtccgcccccccccctcgggccgggccccttccctccccccctcgccggggttggctcccgcccgccgcccctccccgcaggtctcccccgaccccgggcagtccctccaccgccacccccgtccccctcggctcctccgccgccagcgtcggcgcccccctctcccccgtcgcctccctctcgccgtcgccgtcccggggttttgccctctcgccgccgccggccaggggttcccccctcctggcgccgccgcggccgcgcccccccctcccatcgtcccctccgcctctccgcccttccggtggctactgccgcccttcgctgttcgcgctcccgctccgcgtcgcctccccggcgccgtcggccgctgcggcccggcgctgtccgcttgcccgctgccggacggcccgcccccgtggtcgggcgcttcgtggcggccctacccggcggccgaagggccggcgggctggccctgtgttcgtgccgtttgtgggtggcctgccctgcgaacaaagaatctgggaggtttcaatattttcaaacctattgattgaagcatgaag

SEQ ID NO: 4235 - DNA, 670 bp, Sorghum bicolor
  Clone ID: SORBI-28MAY03-CLUS74982_1
ccgccatggtgggttcgtcgtggtggtgctggtttgtgggcaacagaggtggcccctcgatctggcgcctcaccggcaacgccttgcacggccccggcgccgtggttccccaccgctggggcagcggtgcttggctggcgcgtcccacccgcaaggcgcggctccaccctccagcccacttcgcttggcccggcctcggccgctcgcggaatccttgccacggccgcccgcgtgggcttcgatcacttccacagcacacgccgcgtgggcctcctgtgtgtgcttggacccctccaccgctacgcggcatcctccgggctgcaggtcctccgtggtcccgtggggtggcggctgagcacctagctggtgattctcctcaggccgcctcccccccttcttatcaactgccaggaggttggcagcaacctgctcggcgcggtggtggcccccctcttccttgagggtttggcttgtgtccgggggcggggggctggcttttggcattgtgttctctgtcctgctttacgcttctcttggctggcgggcggcatgcgccgcgggctcatggaatctttgcccagttctccccttttctccttgttgtatccttatccccgtcccccctcccttgctgttctgtagtgctgctatgctttaaattttttctctt

SEQ ID NO: 4236 - DNA, 554 bp, Sorghum bicolor
  unsure (1)..(554): unsure at all n locations
  Clone ID: SORBI-28MAY03-CLUS7501_1
ggccgccgccctggccgcgcgcaccgtgcggctcacctgggcggagacgctcggcaagtgggccctcggggagctcgccttcgggatcaagtactacatgcggcaacagggtaatctgcagcatgagtatgctggaagtgattctgtactactggatgggcctgaggtaaggcaggagctgatttcactactcggatatctgaaccaatgcatgtatttctcgaagaagccatacaacgtgtttttggagtatggtggttatggccagaatgatgtgcttataaagaaatctaaggcgagggtgcctcctgaagcctgctttcacaattgttcgtgacagaagtagccaatgctttctccttttcattaggggggctatcagtgttaaggagcggttgacagcagcaactggtgcagaggttccatttcatcacgttgtggtccaggaaggtcatgtttccaacctagtgttgggctatgcccactgtggaatggtgtggcagctcgatggatngcaaaacaagccattccttgcctgagtaaacaatggagca

SEQ ID NO: 4237 - DNA, 720 bp, Sorghum bicolor
  Clone ID: SORBI-28MAY03-CLUS75017_1
attccactcgcaactggcttgatcacccaatccggctactccctttgtctcaggaaaaagaaatcgaggcaattccccacttctcacacgacctcccgattaaacgctaaatcgcgccaaatttactcttggtctcccccaaaccagccgccgtctttcatcctgctgttgcaatttcatccaaaacttatccccgtcggaactgggaagccatcgccatggccgcggaggcgggcagccggcgtggggcggcagcgcggagggaggcgcaggaggcggctgtgggcgccgccgcgagggttcttttctacccgacgctgctgtacaacgttgtgcggagcaaggtccaggccgagttccggtggtgggacgaggtcgatcaggtcgttttgcttggagcagttccattccgcagagatgtaacacgcttgcagaagcttggggtacatggcgtgataaccctaaatgaaccatttgagactttggtaccatcatctatgtataaggcaagtggcttgtaagttattttcccttttcatggtaaaaggtttatgtcattttgtagatccttaatccttcaaagtttcattaaaccttgcatatgccactgggaacataactgctgacccaatctatttccaatcagaaatacactgtgacataaatgctcctctgctgaaatttacagtcacgtgggattgatcaccttggtattcctac

SEQ ID NO: 4238 - DNA, 675 bp, Sorghum bicolor
  Clone ID: SORBI-28MAY03-CLUS78060_1
ccacagtcagccccgccgaggcgctcctcctgccgcgcggtcagcaaccggggcctctcgcctgagcgggacagccacggcggcagcggcgacgagagcagctcgcccgccgccgcggatcatcccccgtggcggccgtccccgtcccccatgcggcggacaccctgccggcgccgccagacgaacagcatgccgtcgggtttcgccgtctgcctcagcccgctcgtgcggcccagccccggccgccgccaccgccacgtccagccgccggaccccggctccttctcctgcgagctccggccgtcgccgctccacagcctctcgtccgccgcctccgttactcgctgtcgatccaggaagctcgccgactgcggtcgcttccggtgatctctgcttccattttcctcctttcattccatggttcccaccaccacctaatccagattactagtccactttttagaatttctttttctttttggatttattacattttgtctgtccgtgaggaagaatctgtaagattggcacacccaaaccaagtccaaaccacccccgttgacatataaaactgcgtactactaggtcactactgcttgtcggcccaacattttgtggcaatgtaacgagctgcttgtactactatcaagtagaaaaactacatgttcatgttgt

SEQ ID NO: 4239 - DNA, 476 bp, Sorghum bicolor
  Clone ID: SORBI-28MAY03-CLUS78086_1
ttgggctgacctggggcttgcaagtatgataacttgatgtttgcaaagaagctcgagtgcgggagatcttagttgttggtgaatggtgaatggcacataaaaccaaggtctgattttgtgggtgttgtaatcaccctgaattcgtgtaggtaattaaccccttcatgcttttttttttttttttttgcaaaaaaactgtgatgattctgcttgtacacaccccttgttttctttttctgttcccatcctgtgatttctgttgacaagctaagctctgagcgctctggtcaaaaaaaaaaaaaaaagctctgagcgctaagatgctgtgggaatgaatagcctcggcagtttttatgcactgttgaatgtcgtccgactgaatgtgttcagcatcagtttggcattttttctttgtcatttgttggagtttgccaactcttaaaagcaaatgggaatgagaaaaacaagacatctct

SEQ ID NO: 4240 - DNA, 670 bp, Sorghum bicolor
  unsure (1)..(670): unsure at all n locations
  Clone ID: SORBI-28MAY03-CLUS78133_1
acccagatgctgccgacaaccgccacggcctccgcgccaccgccgccgcccgcggccggccccgcctcctcctcctcctcctcatccccgnnggcgagccgcacnngccgcgctcctcctggccctngggctacnnatgcggctggncgcgagctgctggcctnngcgcgcgcgcgtgccgcagcctnccgcgaggccgtcngcgggggacccgcntcctctggctacgcctcngtcgtggagtccccgctcagccaccggatcacggacgaggcgctcctcgcgttgacggacagggcgcgggggaggctccggtcactccacctcctcgggtgcccccgcgtatccgacgccggcctgctgcgcgtcgtcgagcgcaaccccaacgtcaccgagctctttgtgcccagatgcacaggattaacagctgatggtctggtgaaaattattcattttctgcatgggcacaaaggaaatctaagtcgtgttcgactacatggtatctgcaagatgactaaccaccatctcgatgttatcaagtctctcgtgtgcagaggtagccaacagcaagatgctcaagcactttactacaaccatagagtccatgaagtgctgaacacggacgacggtcgccctattgatgtagatgtgtgccctttgtgcagaaatg

SEQ ID NO: 4241 - DNA, 772 bp, Sorghum bicolor
  Clone ID: SORBI-28MAY03-CLUS78137_1
ttttgctttcattagttgtggtgtttgttatgcttgcatcaccggtgctactcactttgttggtgcccccattttgagtcatgtcttgctgtcaacaacgtcgtacagttgtatttaggttgttagcagcagcacttaactcgatcttacatcttaatgagcctagactatatacttggacttcagcagttgttcgaattttttttatagcaaatggtagtttgattgtcttcatacaaggaacctaattgtgagatgtgatgtataagctaaagccttatcaatttttctgtctccaggggtactgcccttgatcatctatgcagcttaggtatcctattccaatcttaggaagttcaaaacatatattcctttttttcgtttcaagaaaacatatctttcttttatattttgtgtcattatcccagctccattctgaaaaaataatcacaaaagtctgtacaagacttacttgctagttgaatctgaaacggattgcatggtagtggaggttgacaacgatggctgtgaactatcaactttttatgaagtgtaagctttaattaactagtagaaagtttatcttagcagcttagaacaggttacgtcaccatcagtctttacctcctagcctaatatgtaccatctcgtacagcccactagctttttggaagcaaacatatttttttgtactttgtgatgattgaagtgaacggcagagcttggtggattagttgttctaaatctcaattcatggcaaggggtattgcat

SEQ ID NO: 4242 - DNA, 571 bp, Sorghum bicolor
  Clone ID: SORBI-28MAY03-CLUS75244_1
aggtcaaacgcctgacgtcgttctactgacagaggcgagcatcgccggaggaacctcccgcgcgatgccagcctcgtccctgaaagaagtgtggatagccgcagcacgtgatcatggcattgagtgtgtggacatcggtggcgtcagtggcgctgaagccccagagcacattggtgatctgttgggcagtccatcgtcgagctccggaagaaagccgcccatggtgatcgggtgccaagacgaggggccgttctcctcgaacctgatcattgctgcctcccggctcctggagaagagcagaggcagggctcatccaggcctcatctgcgtgaccggctccctgcatctcgtcggggccgtactgcaacagctggaacggcattagaggaaccaaccatatttcatcttttcatgccatgtactacactggatgagtgtgtgcgtgtgtgtgtgtgtgtgtgtgtggctacactacactgatctcggagtggtgggtgctgttgcttaagctgtaccggctcctgatcgagaaattcgagattggggaaaaataatctcgaatgcccttttt

SEQ ID NO: 4243 - DNA, 633 bp, Sorghum bicolor
  Clone ID: SORBI-28MAY03-CLUS7527_1
gtcgaggtagccgacattaaaaggctgaacggcctctcaactgacctccagatgtttgcacacaagacactgcggattccactcccggggaggcaccctccgtcgtcttaccaggagaatggttcatatgagagtgacgacagggaatgtactccacgccgcattcacgaagatatcttggattcaattttgaaaacaccaaagcccaaagtttcgccagctatgagtcttctgcagggatactatggccttgcaccacctccaaagagagatcaaacaagtgaaggcactgaaatggcagtttacagtaaaggcaaatctgcttttttggatgttgagccgtggctggagccaccaaattccgacccattccctcttcagaataggaaaaccagaagcttgatgataggttcttctcttgacggtgatactgatgagaatggtgacagtgaaaggttcataaggcggcgccagaaagctgatggtgagctgtaccgagggaggaaaatggtggtgactttctggcaagcgctggaaaaggcttggcactgaggccaaagtctagcaatcgaccagacatgaacaagagccagcagaatctttttgcgatggcggagcctttgtttgtcaatg

SEQ ID NO: 4244 - DNA, 676 bp, Sorghum bicolor
  unsure (1)..(676): unsure at all n locations
  Clone ID: SORBI-28MAY03-CLUS7536_1
aaaccgacgaaaagagaagaggacgcctccgccctccgccctccctcctccgtcctctgcttctgctcctcccctatttaacccgtctccatcggccattgcccgctcttcctcccgaagtcgccgggagccacacgcattcccctgcctcgcgctcccatcgctgtcctcacccccccccctccccgcctatttaccgcccgtgtcgccccccgccgcacgccttccgagcccccgtgcctgcctgctctctgacgccggggggcccccacgacgacccgcccccgcccccgcgcggtgacagcaagccgggacatggcgcgcggcggcggcggcagcctcgcccacctgctcgccacgctcctcctcttcctcctgctcgccacgccactcgccgtcggagcttccgaggcagaggtggacctcgcgccggcagagggcgtgtccgaggcggtggcgccagacgcggacgcgcagcagcagcacctcctgccgcggccgctcgtcatcgagctcccgtcggcgagggccgcggagcccgacgccgacgccgtgcccgacgccgtgccgacggccatccgctgcgccagctggcggctcacaacctcgcgccaatgaaagggggccgnccgaatgcggccgacgtgcgggactacgtacggcgccgctacccgtc

SEQ ID NO: 4245 - DNA, 685 bp, Sorghum bicolor
  Clone ID: SORBI-28MAY03-CLUS75420_1
aaacccggacgggatcagatgtgtaaaggagacgcttccgtatcagaactacagccagcccctagacctgtaccatgacatgcggatgtatgaccttgtggtaaaggtggccagctccatggagaaggttccagtgacagtgatcaacatcacgaagatgtcagattaccggaaggatgcccacacgtcactgtactccatccggcaagggaagctgctgacgccgaagcagaaggcggacccagagaagttcgcggactgcatccactggtgccttcccggcgtgccggacgtgtggaaccaaattctctacacaaagatcctttccaaaccatcttggcagtctaatcttagcccccctccatcccagtctctgcctcttcctccccagtgagaatcacaagcagggagcttggagttttttttaccacaacctaggaaaatgtatgatgtatgattagtcattatttttctcttccttttagggtagatcgagtaaaggttagagcaaaggggaagtggacggggggtttactaatggcatgtaagatctttgatgaggtgtaaatgagtgggcatgtaagatctttgaagtgtaaatgagctgtgagtttgccaattgagcaaaccgtagcttttaaacagttgcgctatgcatatatatactagtactgtttccagacaa

SEQ ID NO: 4246 - DNA, 631 bp, Sorghum bicolor
  Clone ID: SORBI-28MAY03-CLUS75362_1
gaggtagtattctcaaagaatgcaaccgtgaggctaattgttgcctactgggcacatttcatcccaaacactgaaaagtacctgaagagccttctatactccaacatcctctgcgcatcttcgacatataaccattgcggtggcaaggtcgagatcaaatactacatggttcctgggtacaacgagaccggacctgcattgtcccaaggtggcactatgacggggaaccgttatcctggcttcaccagggtgaaccatggcaagtacgctgtcagcgacgtgagggcgaacatcggcaccagcaacctcatttgggattacttctacaccacggctggagtcagcttcggaacatacaaccccaacattgttacacagctgcaggatatctttgatgcagattggtattctccttataccgtgcttgttgaaccgctggatgagtctgtgtaggatcacagcttagtccaatccttttttgccccccaccacacacacacacacagccaagcatcattgtgttgggaaattgttttcttctgagactaagccatctcactggcaattgattcccaaatctataactgtaaatactttccactgaaatttaaaactatagtcactttggggg

SEQ ID NO: 4247 - DNA, 652 bp, Sorghum bicolor
  Clone ID: SORBI-28MAY03-CLUS75438_1
ctgcttcgtgttcgtggctatcccctcctcacaccagagagctccgggccccttgtcgccatggcggcggccgactcccccgtcgccatgcgcgagcagctcacggcggtgctagcatcctctacctaggccacggacggtctcctccctcctgtcccggcgtcgccactcactgcttgcccgcagctcaccagcctgggcggggcattgcgccaccagcccaccacaccaacacaccccctcccttccgcagcagccatggccaagccaccgccgcacacctccagctctacctccgcctccgacctcccactaccgctacccaccaccaccaccaccggggggctcggcctcctgggttccctcaccacctccgcttactccctcctcgccgcggcgcgccgctccccggtcaccacgctggtggcggccttcttcctgctcgcgctcttcatgtacggcgaggacgtgcgcaccatcgccgagctctccatcgacgactacctctacccggacgccgacttctacaacgtctcgggcctcccgccgctggccctaccgccgcccgcctgcgacctctcccgcggacgctgggtcttcgacaacgtctccctcccggcgtaccgcgagaaggactgcaccttcctcacca

SEQ ID NO: 4248 - DNA, 649 bp, Sorghum bicolor
  Clone ID: SORBI-28MAY03-CLUS74871_1
agatgagatgccgcaaggtgctctgctcacgtccatgtcggctccgtccccgaccctcatcccgctgacctccatcgcggagctgcggcaacaccactcgcagctcatccgtctcggcgtcgcctcccacccggcccacgcgcgccgcctcctctccttccttgcccgcgaccccgactcccacttcccgtacgcgagccgcctcctggcgcaccacccggccccgcacccggcgctcttcaacccgctcttctccgcgctcccgacgcgccacgccgcgcggctgctggccctcatgctctccctgcccctgcacccggaccacttcaccttcccgcgcatcctcccaggcgcccagccgctccacctggtcgcccagctccacgcgctgctcctcaagctcggcttccacgcccacacgcagtcgctcaacgcgctgctcgccgcctacctcgccaacgccagacccgacctcgcctcccgcgtcttccgcggcggcggcggcgacgctctcgacgtcgtgtcgtggaccaccttggtcggcgggctcgtcaagctggggcgggtcgacgacgcgcgggagctgttcgacgggatgccggagcggaacctcgtgtcgtggaatgcgatgatgtccgggtacgtcaag

SEQ ID NO: 4249 - DNA, 634 bp, Sorghum bicolor
  Clone ID: SORBI-28MAY03-CLUS74873_1
tactgggatactgttatcccaaatcgccctctccaatctgctccgagcaccatggcgaggatcaggggcccgcgcctcgccgtcctgctcgctctcgccgtcctcgccgccgtggccgtggccgcggtcgccgcggcggcggcggcagaggagcgcgcgcagtccacctacatcatccacctgtcaccaggccacccggcgctgtccgccgcgcgcgccaacggcggcggcgaggcggtgctccgccgcctcctcccgcgccgcctgcgggcgccgaggccgcgcgtgctctactcctaccagcacgctgccacgggcatcgccgcgcggctgacgcccgagcaggctgcgcacgccgcggctggggagggcgtcctggccgtgtaccccgacaaggtgcggcagctgcacaccactcacaccccgtcgttcctaggcctgaccgagaccgccgggctcctcccagccgcggcgggaggcgcgtcgtctgccgtcgtcggcgttctcgacaccggcctctaccccatcggccggggctcgttcgcggcaactgctgggctcggcccgccgcccgcgtccttctccggcggatgcgtctccgcggcctccttcaacgcgtccgcctactgcaaca

SEQ ID NO: 4250 - DNA, 907 bp, Sorghum bicolor
  Clone ID: SORBI-28MAY03-CLUS74905_1
gaacctggaagattgaattgatccacgcgctacaacctaattgacgtgtcaaattaaataaagctagtagctttctacacgcaggagactagactgaaagaggcacggctgcaggtgccaaaacggcgcacgtctgccagcagagaagctgcctgaaactgacgctagcggccatagcatagaaatccttggcctcctcaatccgcagactcttcttcgttcggcagcgaccgcgccgccctgtccctaccctgtgcctgcgcgacgactccatcatcttctctctcgccaagtccttataaccccggcccgacgcaagagtgagacaaatgccggccacaacgacctagctacctcatcccattcgatcgcgtccgttccattccaaaccaaccggccggcggagcgcggcatggcggcctccgcgaaactgcccgtctcgaagggcatcgccggcatggacaacgacgtcgtcgcggcgggcggcggcaagaaggcgggaaggtgggggttcgtgcagttcttcttcgtgctcgccgtcgtcctctgcgtgctcctctacgcaccgcgtgtcctcgtgctcagcccgtacgggtacagcatcgacgtcgggctcctcgcgcccacgacgacctcttccccttcgtcgtcggtgccggcgccgcagcagcagcagcgcgtttctggcggcggcaatgcaggaggaggcgacggcggacacggccgtgatgatgaggtggtccttgacaacgaggtgcactccccgtgctcgtccatgcgcgacaacaccatctgctgcgaccgctcgagcgtacacacggacgtgtgcttcatgtccggcgacgtgcgcacggacgccgcgtcgctgtcgctcctgctgttcccgccgcaacagcaccggcatgat

SEQ ID NO: 4251 - DNA, 940 bp, Sorghum bicolor
  Clone ID: SORBI-28MAY03-CLUS74912_1
agaaagaaacgaaatgacatttttttatttctttttacagaaccacgtgtaaatcgttacagaatcacaagaccaatgccactttacccttccggtgtacaactggactcagctcaaaaaaagggagaaaaaaagcatccctgcaaagttcccacaaatcctaagtttaccgtagcaactcttgcaaatatctgaattccgcatcagcactcttattatacattcttatttaaaaaaaaagcatctagaaagatcaccgatatttgttggatggagaaagcattgtcttctactctcctcaacagctgtacccccgcgatccttgctacttccgtggtcacaagcagctcatccatcacagaacaccaaccccgcatcaactccacttggttcagtccggtctgaaatcaccacctctgtattcatctgatgctctcacagttcaccaaattcaccattaatcctcaattagcctgatgttcagctgattctcgaaccggagccaagactcagctcgcatttccgtgttcatcatatcactctctggtgcgggatagtagtcctcccttagctgcatgtccctcaaatttggcaccttcaagaagaaggtcaggaaatgctcatgtgtggtgccatggacgaagagcttcctgagcccaacgcagccctggagcagtcccacagcgggcagtgtcaggctacactggttcacttccttgtcttggggaggccaataatccagctcatacagagtcattagtgaatctataccttgcaaataaaatcgctcccacagagagagatccatctggcctgctggtgcagtaagagcatacccaaccgcctcactcagatccaatttcatcttagcaagtactggggagcctgcaagatacctcaggccaaaaaatgggccagggcgtgcacggcaatcaccctc

SEQ ID NO: 4252 - DNA, 658 bp, Sorghum bicolor
  Clone ID: SORBI-28MAY03-CLUS7550_1
ccgccaccaggagcgaccgcgacggcgatgggcacgagcggcgcgccgtggccgccctcctcctcctcctcctcctccgtatgaggaaggggtcattagttgctgcttgctcggttttgaagctattgttgttctctcttctatgcatatgtaatggtagcaccttgccaatagccggtttggttgctacaaacaaaaaggggatgttcttaagaagttggaggcctctgtgttggtgctcagccagtggatgccatctccttgttgctagctaaactggaattctttagcctttgattcaaaggccacctatgcaatatttaattgagttcctaccagtttgatagccattttcaccaggattgttagatttcctttcaggttcctaattctacctacactaatgtgttcacacattgatgcaccgacataatactctctatctttccttccaattacgtggatcagcataacagacttggcatcctatcattaaggtgacaacggcaaaaaaggccaacaaagtcatcatacaaataggctcccattaacgtgcaagcctaagtgattccaggtagagcataaccagtcaactcaacaacaagatgatgatatcttctctgagcctcatcaagtgcactgcttacaaagtgttatc

SEQ ID NO: 4253 - DNA, 595 bp, Sorghum bicolor
  Clone ID: SORBI-28MAY03-CLUS75516_1
tagagaggatgaggttagatgaagaggtgcttatggatttcttcagggaacacatcaacgtgacaaaagttgaaagcagagtgcggattctggcagatatgagggagctagcttcagctgagagtttggatagctttactctcatttacacaaatatactggaacatcaacctgattgcccgcctgaggttgttgagaagcttgtggcaatgcgggaaggcattccaagaaaggaagctaaggaggttgtacaagaatgcaaagagatatacgagaattcgctcgtggatggcaaccctcagaagtccggttttgtgtttggcaaattgaagtgcttgacagcaaagaaaggcatatggaggaaacttgggcagtaagtggtgacatgcagcagagtggacagacaccaaggaaagactgtacatttcatttctaaatgatcattcttttgttcttttgtcgatgctactgttgggtttcacgtttatactatccagtgtgtacgcagcttcaggagcaaaaggtgtatattccattttacttagctacaggagaattttggtgtaaaaaccatgtaatctattcaataaaatga

SEQ ID NO: 4254 - DNA, 901 bp, Sorghum bicolor
  Clone ID: SORBI-28MAY03-CLUS7553_1
cggacgcgtgggcttctgaagcacttgcattgcgtgagcaagcagaatcattaagatcattggtagctaaaaagattgaggaacacaagaagatatccgataaatacaactcacaagtaattgagatcaagtccctcaaggcattggtcgaggagttggagcaggaaaagcaggagctggagtttattgcagatatgtacgctaaagaaagttccttgtcaaggacacttgctgatattgaagaatcagaaacccgagctcgcaatcaagctgaatatttgaggagcaatctagaggagcatagtcttgagcttcgggttaaagcagcaaatgaagctgaagctgcatgccagcaaaggctttcctttgctgaagtggaactagaagagttaaggaccaaagtagatgcatcggaaagagatgttgtggaacttaaggaggcaataagaataaaagaggctgaaggagatgcctatatttccgatattgagacaattggtccagcatatgaagacatgcaaacacaaaatcagcatcttcttcaacagcttactgatagagatgactttaacataaagctagtatcagatagtgtgaagatgaaacaagcttgtagttcccttctctctgacaagcttatgctagagaagcaactccagcaagttaacacttcactggagtcatctaaactgaaaattgcccgtggtgaagagcagatgaacacttgtgtagcacaagctataaaaacttcagctgaaaacaggcatcttactattagcctggaaaggattgcggtggaggtatctaacacagataaggaactcaagtggcttcggtcctctgttggatcctctgagaaagaatatgagcaaactcagcaaaagatatctgagctgagagc

SEQ ID NO: 4255 - DNA, 524 bp, Sorghum bicolor
  Clone ID: SORBI-28MAY03-CLUS75600_1
cccttccccctcctcctccacccaacccgcagccgccgccaaaccactccgcggtgctctgcagcgccggccggactcgctcgccctcactctctcgtcccgcgacttgcggactcatctgacgcgaacgcggcggggggcggcggtccttagcccgcgatggagaagacgaagctgcagctgccactgccgctggtgcacagcgagcggctgtgggcgcggccgtggcggtgggcgaagacggccttcttcatcgtggcgatgctggcgtcgctgctgctcgtgtgcgcgccgccgctgctggtcgtgctgctggacctcctcctcccgcccgcgctgctctccaacttccttcgcgcccaggcgcacgcccctcctgtttcctccgcctccgccgccggcgtctccttcgccgccgcgctctccggccaggccagggcgttccgcttcggctcgtcgctcgtcgacctccccgcggtctccgccgcgcgctccctcctcatcctctgcgcctacaccgctgg

SEQ ID NO: 4256 - DNA, 543 bp, Sorghum bicolor
  Clone ID: SORBI-28MAY03-CLUS7562_1
gcacgaggggaaagcccaggaattgttcctgctgggcggcttcccagatacaaggaagtaatacttctgaatgatctgattgactgtgctcgtccaggagaggaaattgaggtcactgggatatacacaaataattttgacttgtctttgaatacaaagaatggtttccctgtttttgccacagtggttgaggcaaactatgtggcaaaaaagcaggatctgttttctgcatacaaattaactgatgaggataagacagagattgagaagttgtcgaaggatccaaggattggagaaaggattgtcaagtcaattgcaccatccatttacggccatgaagatatcaagactgccattgcacttgctatgtttggtggacaagagaagaatgtgaggggaaagcatcgcctaagaggcgatatcaatgtcctcctcctgggtgatccaggcactgcaaaatcacagtttctcaagtatgtggagaaaacaggacacagagcagtatatacaactggagaaggagcctctgcttgtggtcttact

SEQ ID NO: 4257 - DNA, 984 bp, Sorghum bicolor
  Clone ID: SORBI-28MAY03-CLUS75624_1
cagctccaacaaaattctgaatcgtcagacaatgaagctcatgttactcattgactgaaacgaaaggcctgatccagtaaactgatcacttatgggaacaaaccagttggcatgttgctccgtcaacaactttcagcgtgttcagacttcacagccgaaagccccgctaggggaatcgagagagaagcagatccagtttgtgtgccatagctacaaactcagaaaaggtcctatgataacgttcgctaacggtgaagttattttggatgttgtaatccgacgtgaagcattagcgccacgtccttatgctgaaatcaagactataggggatgctttaaagatgccgcttgcttggccatttaatcggtcgaaggcctgctgtcagcaaccaagatcacagggggttgttggttcttctcagagatcttctcaaggtgctgcaggatcatcttagagacgctaagtggtgctagcttgttggcaggaagggtgctaggagtaaacttgaatgcttttagactacatgctatcttatggtgaactagatgctatctttaaatgtttttagactacaacctggtagttttagtttttggacttgaacatgatggtcataatgttagatcacttttagacaatgttttcctaaacgctaaacgctaaacagtcggacacctgtcgtttacccattattcgggctaaacagtccattaaacgggctaaacggtcaattaaacggactaaacagataattaaacggaaacggtgtaccattgtgtagcgtttacacggcgtttaaacggtctgaacggccgtttaggcgaacagtgcttttagatgatgacttagctagattatgcatttagctactatatatatgcatgcttgtatgttggctttatgtcaagaagcttaagctagtgacatgattatatatgtactcattgatatggatgaatgagagtatgatttatctgcccattt

SEQ ID NO: 4258 - DNA, 671 bp, Sorghum bicolor
  Clone ID: SORBI-28MAY03-CLUS75018_1
aatcagcgttcagcagcctcagccgagcaagctaccaaatggcagctcatcaggttctttccacttagcgacgacggcctcgaacgccctgcgcgacggcccgtccgccggcgcccatgccttcgccgcggtcttctggagctcacgcgccttctcccgcgccgcggcgccctccttctcccccgcaatcagctcccttgccacggccgctacctcctcccgcggcactaccccgtcgtccccgtccccgatgccaccgccctggcccggccccagcgccacccccgccccctccgacagcatcaccgcgttcgtcctctgctcggcgtaccgcggccacgccagcgtcggcacgcccgcggccacggcctccagcgtcgagttccacccgcagtgcgacaggaacccgccgacggccccgtggctcaggatctccacctgcggcgcccatagcggcacgcagagcccgacgcctctggtcctctcgaggaaccccgccggcaggtacctcagggggtcgtcgtcgccgtgctccgccgccgtcccaaagtagctcgcgctgcagtccttgtcgctcgggaaccgcaccaccatcagaaacctctgcccgctcgcctcgagaccgggcgccagctcggtcgtctgcttgttggacagcgtgccgccgctgc

SEQ ID NO: 4259 - DNA, 797 bp, Sorghum bicolor
  Clone ID: SORBI-28MAY03-CLUS75042_1
agatcgtgggctggtccgggcggtctcgtcgcttgcgccccggctcgtcccccccgccgccgcgcgtccccccctccccgccgccccccccgcccctcgccccctgcccccccccgccccccccgcccccggcgcgccgcctccccccgccgccgccgccgccgccgtcggcccctcccccccccgcccctccccagcctgcccgcgcgcccggcgcccccgcgtcccaccctcgccgccggccccgccccctcgggtgccaccgtcggcggcctccccccccccacgcggggctgccccggtcgctgccacgcccctccccggcggttccggccgtggccctcctgctcccctcacccgtggccgctgccgccgccgcttcctccccccgctccgccccccccgccccgccccctcccctgccccgacggccggcgttccggcgctggggcccgcctgccccgtcgccccccctgcgctcgacgcccgatggcgttccccccccgctccccccctgcctcctcggcctctccccttcccctctggcggctgcagggagggaagccacccgctctggggctgggggtctggttggctgtgcgggggctcccctccccccgctcgcgtccgtgggtgttcgcctgactggctatcttccacgggccctctgcttccggatggaacactcgttgcaagtagagtttattctaatccaatttattttgatgcacaacagatcgatattttcttactggcaattctcaatattttcttctgtctaccattttactactgca

SEQ ID NO: 4260 - DNA, 626 bp, Sorghum bicolor
  Clone ID: SORBI-28MAY03-CLUS75059_1
cctcctgggtcgtccgcgcgcccctctcccgcctcaccgcccgcgccgccccgccgctccctccccgtcctccgccgccctcccgccccgcccgcccccccccccctccgcgccgcgcgggccggcgacggcgccccccgcgcccgtctgccccccccccggagccgactcccgcccccgcccccttcgttcccccggccgcccccccgcccccccgcccgccgccccccccgccgccccccccgccgcccccgtggggcctcctcctcctctcccttccgagggctcctcgggccgcctgtcccccggggcccccctggcctcccccccccgccgccgcccggtgcgtgggcggggccccccgcggccgcccccccgtccgcgtcttgccgcgccccccgccggcgtccgcccccccttccttcgcggccccttggcgtcccggcccccgcccgcggggccgggcggcccccggcccccgccgcgctccgacgcccttgtttcctcagatagtcctccgaggtttccgagaggtacctcatcctcctctgcgaaccgagagctcctagggccgcaagtcctccttctctttccgaggccctgaacgtgagcggtgctgccggcgg

SEQ ID NO: 4261 - DNA, 629 bp, Sorghum bicolor
  Clone ID: SORBI-28MAY03-CLUS75118_1
ggtcggggaggtggtgggcaaccccgtggggtacgcggcgcggcgcgcgctggcggcgacgagccagggggacgactacgcgcggtcgctggtggactacctcgaaggcgtggacgccatgaacctgccccggagcggcatctcgcgcgcgcacctgcgggccatcagctggatggggatgtcgctgcacgactcggacttcgggtggggagcgcccgtcttcatggggccggcgctcatgtactacagtgggttcgtgtacgtgatgcaggcgcccgggaaggaaggcgccgtcgcgctcgcgctgtcgctggagcccgagagcatgccggagttcaggaaggtgttcgccgacgaggtcgcgaggctgcggacgatatgaggatgaggatgaagattgcacgcctacgtaaccgtgcatccgtcgtactccgactacgtacgtactagtactgttgtaaatgctgaggggttggtgggaggtgtatgtgtgtagtagttgtgtgcacacctgcctgaccagctggcagcagacacctaccgtaccaccgttgtatctattaattagttactcatcaggtgacttgttgatcgtgggttggtgcagagagtaattatcataagctcaa

SEQ ID NO: 4262 - DNA, 689 bp, Sorghum bicolor
  Clone ID: SORBI-28MAY03-CLUS75217_1
cccacagcgcacctagcggagcgccggcacgccagcaacgccgactcgcgctcacccgccgcagctaccgcgcgcgcgctggggcagacaatccaccgtcgtcgtcagggcacgcaacagccaacagcccccagggtagcaccggatggcaacggtggagctgttgtcgacggagctggtcgtcccggccgaggagacgccggcgggcgccgtctggctgtccaacctcgacctggccgcgcgccgcgggtacacgccgacggtctacttctaccgaacgaacaacaagccggagttcttcgaggccgacgccgtcaaggacagcctcgcccgggcgctggtcgcgttctacccgctggccggccgcctcggcctcgacgccgccaccgggcgcgtccagatcgactgcacgggcgagggcgccgtgttcgtgacggcgcggtcggagtacgcgctggacgagctgctgaacgagttcgtgccgtgcgacgagatgcggcacctgctggtacccgccacgcccgcgcccaacccgccgtgcccgctgctgttcgcgcaggtcacccgcctgcgctgcggcggcgtcgtgctcggtctcgccctgcaccactccgtcgtggacgccaggagcgccgcgcacttcgtggagacgtgggccagcatcgcccgcggcggcggcggaggcggag

SEQ ID NO: 4263 - DNA, 517 bp, Sorghum bicolor
  unsure (1)..(517): unsure at all n locations
  Clone ID: SORBI-28MAY03-CLUS7571_1
gacctgctgtgggccatggccacgttggggtttgaggactacattgaaccactcaaggtgtacctgcagaagtacagagagatggagggtgatagtaagttaactgcaaaaaccggcgatggctcaattaaaaaggatgtccttggtcatgtgggaggaagtagctcagctgcacaagggatgggccaacaaggagcatacaaccaaggaatgggttatatgcaacctcagtaccataatggggatatctcaaactaatgaagatctggaccttttctgcgacagctgctcttccctgaggtgcatatttggtcatagttatttactgagacaccttgcggtgaccattaaagagtaaccagtcacccccgataggtccaagaactgatgaaggtccaagaactgatgaggcagctttgctaggtgtaaattgcttaccctgggaaatagtttacggttgtgagctagcgccgttgttgtatgtatattattaagaataactntatgattggtcttt

SEQ ID NO: 4264 - DNA, 889 bp, Sorghum bicolor
  unsure (1)..(889): unsure at all n locations
  Clone ID: SORBI-28MAY03-CLUS75712_1
cattctaatcgctgtcagaatgctgctgactttcaaatacacctctgccacctgctagctacgtcaagagaaattacgtcaaaattctgcttgggggagagcacccccatttatctcgataagtatttctatctatctttatacttatattattttggaatataaatacacataaactatggaaaaccaaataaagattttatgcttatatatatatatatgtattttgcttagtgtgtttaataaataaataaagtagctatgctaatctatatctaaataaaacttaagcatggatatgataaatagttgctctacctaatttgcaaattttaagttctctctcaagtttagatataactgttataatttaaagcttgctctagacctaaacttgtgggatgaaaacttgatctgaagtctaagttgttaacggatacgatatgggaaggttgagctgctgcttatctgttcctagagatgccagaattctggagaattttatctttgaggggcgttaaaatgttgcatgatgagttcctgtatgatgagagtttaaattcctaccacagccatatatacatgcttgctagactttgagccacacatttactatttactgcttatgagcattgagtgtggtcaagctgtgtagacccttagaagcttgtcatgtggttaaatcaagattcacttgcacgttcactcatatatatgctacttctactcctaaagtaccatccacatatatccatccatttccatctccagaatcacctaaaaatattctactcctaattcaggagagaatagccnaaaacatctatgtttttcccttgtgaaataaatgctcaagttatcttgctactaccacttgctatattatctc

SEQ ID NO: 4265 - DNA, 467 bp, Sorghum bicolor
  Clone ID: SORBI-28MAY03-CLUS7576_1
gcacgaggtgaagatgctccagggcttctgcagattcttttaaacagaggaataggggttgaagaaatcaaactttatggtgctgaagaagataatgaaatgatagaagattctacagaaagtaactttgaagatcttgaaaacgtcattgcaaatatatttccaaagaagggaaaaggctatttactatcagtatctagatacgaaaggggggaaaaggctatttactgcctatcctgtttaatttctcttattgagcagtcacgataccttcagttccgtgactgtcctgtggaatggggatggtgcagggatctgcaatcctttatttttgtatttacaagccataataggatagttcttgagcgtcctgaatatggttatgcaacatacttctttgaggtggtccaatcaactccaatagaatggcagatccgtaggctggttgttgcaatgaagcttagtgg

SEQ ID NO: 4266 - DNA, 428 bp, Sorghum bicolor
  Clone ID: SORBI-28MAY03-CLUS7577_1
cgcaatcctatcgaaagctcgctctccaacctcgcctcctggttcctgccctgcacctagcaaccacctccggtgcttcgcatcttgcacgcacagccttcgccctggcgcgctgctgctcgcgtgccgggcttgcgcgcgcactcacattttctttggcccttccctgctgatgaatcaggtagcgttgcacagcggagaagcccaccagtgcatgccacattgaagagcggatctctggcttaggcctcagggaatcgctgttgcctggatctgaagcccaccagtaactccccatcagtgcaccggatctctggctacggtcgcagggaacaggtcaaggctggagatttgacggggatgtaactcggcatcagtgcaatgacagcctcacccccctcgccggtggcaatctaatccgacacgag

SEQ ID NO: 4267 - DNA, 602 bp, Sorghum bicolor
  Clone ID: SORBI-28MAY03-CLUS75810_1
ctactggacgcctgctccctcccggctccagcacgcacgcgcacggcgcatcccggacgcggacggcggagcggagtcgccagcgaagcagcgtctagcgacgaccgcgagcggtggcggcaagggcgcaccgcgcactggcactgcgcagcggcaggccgtaggttgccactgcagtcgggatccggcgaccggccggcggcagcggcagccggtagggccgggggcagggacggccgaggccgggcgtcggccggcagccagcagcaacgaggtctccaaaatcctagtcccgccactgagtccgtggacatggatgccatggagccgagcagcggtgccgatgccggccgccgcgtggtgctattcccgttaccttaccagggccacctaaacccaatgctgcgcctagccgctgcccttcaccgtcggggcctcgctattatcgttctccataccgatcttcagccgctggatccggccaaccacccgacggagtaccgcttcgagtccttgtctgccgatgtaccggcggagcttatggcgtccaaggacatcgcgagagttgtcatggatctgaacgccagtttcgcggcgccttt

SEQ ID NO: 4268 - DNA, 649 bp, Sorghum bicolor
  Clone ID: SORBI-28MAY03-CLUS75823_1
atgctgtgggcacaagggaggaaggaatggatgccgctctcgtcgatccccgagttacactctatagccacagcatcaaaggatcagtctacacaagctgctgctccggatgtcgacgatgatttcgcgaaattccaaaaggaggttaccgcacccgggaaggaagtgaaaggcagcgctgaagtcggtgatgtggaccggcaggatgatgagcggccggcaaccccgccggatggagaggaggaatttactgatgatgatggcaccatttacaagtgggactgtactctcagggcatgggttcctcaaaatgatgtatcaggtaaaaaggacggttatgctgttgaagagatgacatttgcacttgaggaagaagtattccaggcaccagatatccctggtccatctgcattagaagaaatcaacactccagcggaagttaaaaacaaagaatctgataaagcagaaaagagaggagaaaagaaacagaaatcttctcagaagccagctgaaaaaaaaagaagctaacaaaccgccggacagttggtttgatctgaaagtcaatacacatgtctatgtaaatggtttgcctgatgatgtcacagtggaggagattgtggaggtattttccaagtgtggaataataaag

SEQ ID NO: 4269 - DNA, 697 bp, Sorghum bicolor
  Clone ID: SORBI-28MAY03-CLUS75454_1
acagctctgctctgctgcttcacttcacttcacttcacttccttctcctctcctctcctctcctctccagtggttgcagcagtgtcttcaattcatagaggcgcgcggcgcgaccatctatctattttattatatatacatcgatcgatcgaccggccggccggtgagcaaccaaagcaaaggcggcaagaagaaatgtggcccgtcgtgttgatggtggtgctcatcttgttcggcggccccgttaccagtgcatcatcagccgcaggtggtggcaacaacaacgccacgagagcagcaggcaacaatggtggtggcaataagccgcagcaccagaagaagccgctggcgcctgcgctgatcgttttcggcgactccatcgtggaccccggcaacaacaacgacatccgcaccatcgtgaaggccaacttcccgccctacggcaacgacttccagaaccaccgacccacgggcaggttctgcaacggcaggatacccaccgacttcatcgcctcccgcctgggcatcaaggacctgctgccgccctacctctccgctcagccgctcgacaagcacgacctcctcaccggcgtcagcttcgcgtccggcggcaccggcttcgacccgctcaccccgcagcttgcctccgtcatctcgctccccgaccagctcaccatgttccacgactacctggcca

SEQ ID NO: 4270 - DNA, 692 bp, Sorghum bicolor
  Clone ID: SORBI-28MAY03-CLUS75455_1
cctactggaaaaagcggtgctgaattctgaaccgcgccggaaatcctgcccctttgccgccattttgcgccgcatccgtgcaaccgtccatgcacgcctagctagagctagctcgcgcgcggcgtgatcgatggccctgctcacctccccgtcgaggccaaggaagcagcgctgcccctccccgacgatgctctccctctcgccgtccctcctctccctcatcctgctcctccccttccgctccctcctcctcctccaccgctcctccttcccgggctcctcttgctccccggccctgccgggggccgcttcgcgccggggaagcgcggccggcttccagggggacctgcgcgacatcgagttctcgtggaaccacctgccgttctcggcgtccaggccgccccccgccaagctcaagatcgccgtcttctcccggaagtggcccgtggcctcagcgcctggaggcatggagcggcacgcgcacacgctgcacacggcgctggccgcgcgaggccaccgcgtgcacgtgttcacctccccgccgccgcacaccgaggcggcgccctcggcccccgccgagggtcctcagctccacttcctggacggcgagccggggcaatggcgctgcgacgaggcgtggaagctctacgaggccgagggcgagaacgaccccttcgacgtcatccactccg

SEQ ID NO: 4271 - DNA, 796 bp, Sorghum bicolor
  Clone ID: SORBI-28MAY03-CLUS7547_1
cggacgcgtgggatcgaggctaagaaaaggtttgaatttttggaggctgttagtgggacaatggatgctcatcttcgttatttcaaacaaggatatgaactactacatcagatggaaccgtatatcaatcaagttcttgcatttgcacaacaatcaagagaaaggtctaactatgagcaggctgctcttcttgagaggatgcaagatttcaaacggcaaattgatcgtgaaagtcggtggtcaccaaatggaatgaatgattcccctaatggtgatggtatacaaacaattggtagaagttcgcataagatgattgaggaagcaatgcaatcagcttcaaagggcaaggttcagaccattcggcaaggctatctctctaagagatcttcaaacttgagaggtgattggaaaaggaggttctttgtcctcgacagtcgaggaatgttatactattatcgcaagcagaacagtaggccatctagtggttataaccaaaggactagcattccctcagaacatggttctgggttgctcagcagatggttctcttctcattatcatggaggcgtgcatgatgagaaatcggttgcacgccatactgtaaacttgctaacatcgaccattaaagttgatgcagaccaatcagatctgcggttctgcttcagaataatttctcccacaaagaactatacattgcatgcagagagtgcaatggatcagatggattggattgaaaaaattactggcgtcattgcttctttgctgagctcccagtcccctgaacgacgtcttctat

SEQ ID NO: 4272 - DNA, 724 bp, Sorghum bicolor
  Clone ID: SORBI-28MAY03-CLUS75494_1
tggactgagcccccctgctggtggtggggtcaatgttgccgaggatgctatgggtactggagggaagcagccagccacaccctcatcagaggataacaagttgcttaagagactgagcattggtccaaaaatgcgcgatgcattgctcttcagacgttcaggagagaaggatgaagaacaagaccgggatgggttttttaagaggcttcttagggacagcagagacaaggatgatgatgatggggacagagaaggatttttcagccggctgcttaaggatagcagggagaaggataatgaggaggaagaaggtgatagagatggtttcttccgcagattgctcagggatagcaaggaggaggacatggaactgacaccaagctcagatggtctgttgaagagactcttccgtgataaggaggacaagcaaggtgaggatgatgagaaggaagggttttttcgcaggatgttcaaggataagaatgaggagaggagagatagcatccatgcaagacatggggatgaggaaagagtgggcaagagtgtggaagatgatgacaaagaaggtttcttccgcaaaattttcaaagataagaatgaggagaggaaagatgaagggcatcaaaagccggatgagagggaaaaggttggtgcgaatatagaagaggataagagagatgggtctttcaggcaactctttaaggataaaaatgatgagaaaaag

SEQ ID NO: 4273 - DNA, 730 bp, Sorghum bicolor
  Clone ID: SORBI-28MAY03-CLUS75927_1
ttagaagaatgtttcagactacagctaaaataattttttatagaaaatagattttgatcccactacatcgagtaagcaactgtgacataaaaaaggtttaattggccatgctttctgttcaaatcatttggatcaaccatatcaaggtttttatagtctcagaataatttcaatttccgttgatggttaggttaaatctcagtatttgtgttaaaataaccgttgtagatcaatttttgcaatctcattatttgtgctaaagtaactgttgtagatcagtttttgtagtctcagagtatcaaggtttatcagcaaaatggagtacacctgtagtacattcgtagttcccctgatatacttcaagcttcagaatcatgggttaatgcagtttatttgagaatgcttgatcacaggaaaaggcttgcagatccttcctgagagagccaaccatgatttcgtgctcgtttaatttttttcatttggccatacacacttggaaagaaaactatgatgttagtgatattgtcatggggcctgcatcagagactagggcagaggctttgaaacatagtgaaactttcagtagtcccttggtaggtcctaataatttgttagtagcttggctcttcagtcgtaggcactttactatttttttttggtagcttggcatatattatgatttggaacatatgagataattgatgccttgaaatgtccttttgatttagta

SEQ ID NO: 4274 - DNA, 616 bp, Sorghum bicolor
  Clone ID: SORBI-28MAY03-CLUS75928_1
aggaggattggcaggcggctgtagtgcatacttgacaacccccttggatgtgatcaagacaagactgcaagtacaaggaccaacgtttaggtacaatgggtggctggatgctataacaaagacgtgggcttccgaaggggtgcacggcttgttcaagggaagtgttccaagaataatatggtatattccggcatcagcattcacattcatggcagtggaattcctaagggaccatttcaacggcaaggttgatgcagatgcccatgaactaacctccctgtcaatcgacacaagatcagaagttgagaaatcagcttaatgttccttttcctatgagcgacctgatattcctgcctggtggaatttatccggcgggatctttttgtctttggcagcaaagtaggtttcagtcatgtaaatgcggaggacgttcattgtgagctaggcgaaaacgtttttgtgtaccacagagaggaaggaactgataacatcatgatttatatcagggcacagtttttttttttttttgagttagaaactggtgggtggatggaatgagagaagtgaacatgtaatttctgcaaagaccaatgcagcaggagtactgggccttcga

SEQ ID NO: 4275 - DNA, 487 bp, Sorghum bicolor
  Clone ID: SORBI-28MAY03-CLUS7594_1
ctactggctacctcctccgtatgaggcagctcgtgctcgttcgagactgagaggcacccccgcagccgcctcgcaccgcgcagatctcgccgccgacgagatgctccgccgcggcgtgctcctccaggcggccgtccacctcctcctcctcctcgccgtcgcacgctcgcccctcgcgtacgcctcggaggccgaccacaagtataaaacagaagaaccagttaagctatgggtaaacaaggttgggccttacaataaccctcaagagacttacaactattacagtctcccattttgtcaaccatctgaaaacccttcacataaatggggtggtctcggagaggtccttggtggaaatgagctgattgatagtcagagcgatataaagttcataaaaaatgtggacaagggggccatttgcacaattgaacttgatgctcaaaaggttgagcaatttgctaatgccattgaaaactcatattggttt

SEQ ID NO: 4276 - DNA, 733 bp, Sorghum bicolor
  Clone ID: SORBI-28MAY03-CLUS75943_1
cccgacggctcgcgcgaactaggctggttgcctagcgcgccgcactagaagcagtatccatggcgcgctgttctaaaccctaaagtaacccctggccctgctttactaaacctcatcgagaatcgcacgcgtcggcgaccatggcggcgtctccgtcttctccccctgccgccgctggagttggtggccagagcgtgatccccttacccttagcgccgtctccccatctcaccaacttcttcgtgtggagggaatttgtctggggaggaattgcaggcgcatttggggaaggcatgatgcatccagttgacactctgaaaacaaggcttcagagtcaggctataatgacaggggctaaggctcagaagaatatattccagatggtcaggacagtttgggcttcagatggtctcagaggtttttacagaggaatcagcccaggtgttactggatctcttgcgactggcgctacatatttcggtgttattgaatcgactaagacatggctggagattgctaatcctaatctaagtggacactggtcacattttattgctggagcgattggtgatacacttggatcctttgtctatgtgccttgcggagtcatgaaacaaagaatgcaagtccaaggcacccaaaaatcttgggcatcagctgcagctaaaggaagtatttctcaaactcatgggactcagatgtatgggtactacaatggaatcttccatgctgg

SEQ ID NO: 4277 - DNA, 578 bp, Sorghum bicolor
  Clone ID: SORBI-28MAY03-CLUS75998_1
ctaaaagctgcgcgtcggagcagcgcacgcaacgggcagcaggagacggagatcgccgaatccttatctgctcgccgcgccatggccgccgccgccgccgccgcggtagcccacctctccgtccacggccgcctccgccgctctccggagcatcgcccgtccacctcctcttcctccgcacccgcgcaccggccgtccctgctgcggtgccgcgcgttcaagcaggagaccgacggcggcggtggcgaccgcgacagcgacccgtccgagcccgacgcgcggaagcgcaggaagggcccgctgtacaagctcaaggcggcgatccagggcctcgcgggctcccgctccgccgccgcggaggtctacgggggagagcaccagtaccagcgcgccgtcgagaaggcggaggagatcttcttctcggttgctactcagctaggcagatatgctatcactatgatgagcagtggtgttgtacttggggttggatttcagctgtcaggtggagacagccaaatgaacgaactaatttggtatagctggcttggtggggtgattatcggtacaatgataggtgc

SEQ ID NO: 4278 - DNA, 584 bp, Sorghum bicolor
  Clone ID: SORBI-28MAY03-CLUS76022_1
gtcatggtggagggaggtatgaggaagatgatgagtacaagaagcccagtggtggcggatatggttatggggcttccagtggtggaggccatggaggaaggtacgaagaagaggactacaagaagaagcctagtggacactcagggggacgctatgaggaagaggaggggtacaagaaggctagtggtcatagtggagggaagtatggcaaggaggaagatgacaagaagaagaagcatggtgaggatgagtcagagggtggcggtattggtgattacctgaagttggcacagggtttcatgaagaaacaggatggggaaggggagagtgggggcggcatgggagactacttaaagcttgctgaaggtttcttgaagaagcgctgattaatcttccatgtcatgtttcaggaaggacttgttgtgtttggttagtcctgtttattgtcaccaagtagtgaaattttcaaggtttccatcataggatgtaatacaagtgcattgctcatactgtctgtgtgtggtgacatgaatgcttaatgtgctgcttacgctgctggggtaataaaagctttgatgctctgc

SEQ ID NO: 4279 - DNA, 637 bp, Sorghum bicolor
  Clone ID: SORBI-28MAY03-CLUS76228_1
tcacagaacaggagcactctgattgttcatgccctctctgttgctctcaagatacagttgggctgagatgctaccccttccaggctcctcatcaccaggtattgcccgaggatgcgggtggcagcacttgggcgcctatgtcaacctaggctcgttctatctcgtcgggattccaacagctctcttcctcggctttgttctgaagatggaagcgaaagggctttggatgggcatttcctgcggctccatagtgcagttcttacttcttgccatcataacattcttcagcaactggcagaagatgtctgagaaggcaagggagagagttttcagcgatgagccgtcagataaggaacctttggaatcggatggatcgaatttgttctgattttagcacgagtcatctgatcccttgtagagaagcagcggtcaagatcttgtagagaaagaagcccctcttggaataggtttatgatgccttgctttctggtctctgaactgaatgtacagggaactcgctgaactctgaccagtgttctgtgtctgtgcttgcctgtttgttgaagcaatgggacaattgtatcagaaacataagacatgacgataatatgatagagatagtaacaacagtttgcaa

SEQ ID NO: 4280 - DNA, 416 bp, Sorghum bicolor
  Clone ID: SORBI-28MAY03-CLUS7565_1
cgtgacaccccgcgcggcacctccgcctccccaccctcgctccctctcaccgcccgccaccgccgagatggtctgctcccagctcaccgccgcgggggcctcctccctcgccgccgcagcggttcgttcccgggcgcattccccagccgccgccttcgcgcaactacggtcgacgcctcgcattgcgagcgctggcttgtcggttaagggaaacagggcggctcttccgttggtcgccgccgcggggccggccgcggcggcgccggtggccgacctggacggccccccggccacggagaagcagcccatcattgtcatcgataactacgacagcttcacctacaacctctgccagtatatgggggagcttggattgaactttgagtataccgaatgatgactgccctagagatgta

SEQ ID NO: 4281 - DNA, 653 bp, Sorghum bicolor
  Clone ID: SORBI-28MAY03-CLUS75654_1
tcggcaaagactgcaccgagtcagcttcatgcttcgccggatcatacgggtacatcgctccagagtgtgcttactccctgaaggcgacggagaggagcgacgtctacagcatgggcatcgtgctgatggagctcgtcaccgggctcttgccgaccgacaagacctttggcggcgacatggacatggtgaggtgggtgcagtcgagaatggacgcgccgttgccggcccgggagcaggtgttcgatcctgctctgaagccgctggccccgcgtgaggagtcgtcaatggcggaggtgctggaggtggcgctccggtgcacgagggcggccccgggggagaggccgactgcgcggcaggtctccgatctgctgctccacgtttcactcgattactatcgcgcctgcgagaagcgttaggatttcgaaactgggatgatcttgtcctagcagctgctttctctgagtcgtgcttcagctagcctatcttttttcattcatgaaactagagggaaaaaaaagaagcttgtggtttttagggtttgcaattgaatcaagtcaaagattccccctcaaagttggatttcaaattttgaaatgcttgtacaagcatttggaaatgttcggtaacgaggcacaccaaagcagtatggctga

SEQ ID NO: 4282 - DNA, 676 bp, Sorghum bicolor
  Clone ID: SORBI-28MAY03-CLUS75671_1
acgactccatctctctcctcggccttgctctgctctactcactcccccaactgccagccgaagcctccctctctctctcctctgtttagcgagctcagccgagcagctccgccattccccaagcacaacaactccttccagaggcggacgcagtcggtgccattcaatgccccgacggccggctgcccggcccatgcactgagacacagggcgcctctgctgtctgctctctctctctttctctctgagacacgacgcagtcaccgccacctcttttaactcccctgcctcgtcgcttcccgacgctgactcgctcgggaacccgtgcgcccatgcacgcgcccgccgcatacgtgcgcctccctacttgccccctgccctcctgctcatgtacccaccacaatcttgcacctaggaggaggctacgagctcaagctctgggctagctgtggcgagcggcgagcattgagttgaggggcaccgagaagatggcaatggcgcggccgttcttggagccgctgatgatagtggcgctggttcttctttcacgcatggcagcggcggcggcggcggcggacgacggcgacgtgctgctgcaggtgaagagctcgttcgtcgacgatccccagggtgtcttggcgggctggaacgccagcgccgacgcgtcggcgttctg

SEQ ID NO: 4283 - DNA, 513 bp, Sorghum bicolor
  Clone ID: SORBI-28MAY03-CLUS75702_1
tgcgcctccacgagccacctccgcatctcgccgcccgcccgcctgcccccgctgctcgcccatcccccaccggacgaccggccctcgccgcccgccggccctcggacctcggcacccaccgcgtgcccccggatgttcgcaaccaccgaccgcgcggccgctcaccggacatcgccgccttctgcgaaccttcccacgatgagctccccggccgccgcggcggaggcgccgcgaacggtggcctcagcggtgctgcgcatccagatggcgctgctggtcggcgccgcggcgtcaaacgaggcgctcctccacgcggccgcctccgcgcttctctcccgcgccgactacgacgacgtcgtcaccgagcgcaccatcgccgacgcctgcggcaaccccgcgtgccccgaccctctcccctcctccggcgccgccgccgccgccacggggccacgcttccacatcgccctctgcgcgcacctcgtctacgacctcctggtggcgcgcaagttctgc

SEQ ID NO: 4284 - DNA, 626 bp, Sorghum bicolor
  unsure (1)..(626): unsure at all n locations
  Clone ID: SORBI-28MAY03-CLUS75688_1
tctctctcctcgctaaggctcgcgactctcactgcacgcgagtagccaccatcgagctggcgatggtgcagacgatggccgcacggcaaagggagcggaggtgccactggcacggggccactcgccggcctgcgcacgcagaggaggctgcacgtgcctcttcacggcggcggtggccacctcaagcggtcacgacagcgacaagattcctcatctgtggcgagcccctgatgcggcgacggcggtggcgtgacttcctcatgcgcggcatgcccctgatgcggcatcggcggagcggctccctgattcgttgcggtggcgcagcggaaccggcgcgcgggctgctgaatcctgatctgtgacagtagcagcagttcggccactcagcacacctgaaggcaacgacgacgccggccaaggtgcggtggtccatatacatgttggatccaattggattggtttctgcccgtctacnattatcagctggttgatatcacgaaagacaggaggcaagattgcttccaatgagcacacattgcccatgggggttcattggagttcccaaagtttgttgctcttcatcaggtttgaagcagggttttattagaaatttttggttctgagca

SEQ ID NO: 4285 - DNA, 660 bp, Sorghum bicolor
  Clone ID: SORBI-28MAY03-CLUS76132_1
ctcgacctggtcctctatctcctcctccaccctccttccattgcctgcctcttcctccgtatctccctcccttcctctatctctttctctccctccctctctcctgatgcggcgacgtgcacgacgtgagggcgcacccacatcggccggggctccgccgctggtcgggcctgatcctcctatctctcccccatcctacatacgggctccttaacgcctcctcctgccagggaccgactgccttggtcctccatgaaaccctaggttgatccatggagttgttagcaaagataaccccttttccctcgctaactaacccttaaaaccagcgtacatggagtttttctttctcaccagcaacttctacctcggacatattatctcacttgattcagacaggcgtacatggacctggatgcattgcatctgcatgcagcactcatatggcagttaagtggcctcgatcaattaatgatcattccaaggaaaatattaaagcgtttgaacgctgttgaggctgacactggtccaagaagacaagaagcactggatacggtaagctattgagcctacacccaaatcatcgcatttttttatgtaacatgcacatcacttgcaaacaaaatgtggatctttttttaaaattacagattgttcttg

SEQ ID NO: 4286 - DNA, 537 bp, Sorghum bicolor
  Clone ID: SORBI-28MAY03-CLUS76152_1
atccctcggctcctaaacccccaacgccgacgagacgtgccaaagccgacgcgcccccccggcacgcaccggaaagcgacgcgcctccaccgcccccgcttgccgcctcccttccataccggttaccacctcctcctcgggacgcggagcgcccaaccgcgggcatctggcggtggcggcgtccgcgccaccttgaacttgaatcaagcaagcgccagtgcgactgggcgggcatttggaaaggcggaagcgatggtggcggcggcggcgctggacgcaatggcggggacgcgttgggggcgggggctggggctggtgacggcggtgtgggtgcagtgcatctccggcaacaactacaccttctccaactactcgcacgcgctcaagacgctcatgggcctgacgcagctgcagctcaacggcctctccgtcgccaaggacgtgggcaaggcgttcgggctcctcgcggggctcgcctccgaccgcgtcccgacctggctcctcctcgccatcggctccctcgagggcctcctcggc

SEQ ID NO: 4287 - DNA, 484 bp, Sorghum bicolor
  Clone ID: SORBI-28MAY03-CLUS7617_1
gcacgagggtggcttcatggagctatgcatcagcgtggtgttttcagctgggaaaatcgcatgaaggttgtaacaggcactgcaaaagcgcttgcttacctccatgaagctatagagccaaaagttgtacatcgtgatataaaatcaagcaacatattgattgatgatgaatttaatggcaaggtatctgactttggattggctaaactcttgggatctgacaaaagccacattactactagagtgatgggaacatttggatatgttgcacctgaatatgctaatactggaatgttaaatgaaaagagcgacgtttatagttttggtgttctcttgttggaaactgtgacaggaaggaatcctgttgactacagccgatcttccaatgaggtcaatcttgttgaatggctcaaaacaatggtggctaaccggagggcagaggaagtggctgatccaagcttagaggttagacccagtattaggg

SEQ ID NO: 4288 - DNA, 481 bp, Sorghum bicolor
  Clone ID: SORBI-28MAY03-CLUS76171_1
cgtcgcccccgtgcgcgtcatctcgccggagcgggccatcaagttcgcgcccatcgggctcgccaacatgctcaacaccgccggcgccgtgcaggcgttcgaggccaggaaggacgcgggcggcgtcacggcagaggtgtccgtgaagggcgacggggagctggtggcgtactcgtcggcgaggcccaggctctgcaaggtgaacggcgaggaggccgagttcgcgtacaaggacggcatggtcaccgtcgacgtgccgtggtcgggggcgtcctcgaagctgtgtcgcgtcgagtacgtctactgagctggacaggcggatgactcttctgctgcaccattgccctgcttaggccgcaataatcaaatgtttagagcttaccaagttttacagctctaaatagcttaattttgcttgtttgcttttttgcccccttttttgtaagaattcttatggtgtgaattaatgaggttttcttct

SEQ ID NO: 4289 - DNA, 658 bp, Sorghum bicolor
  Clone ID: SORBI-28MAY03-CLUS76174_1
gccattgctttctcgcgccctggatacaggcgatttgggtgggttggttgaccccaggcttgagatgaagtggttgaatgaggtggagatgttccgcatgatcgaggctgctgcggcctgcattcggcactcggcatcaaggaggcccagaatgagccaggtggtgcgggttcttgagagctcagcggagatagacctaacaaatggcgttcagcctgggcgaagccagctcttcaacgtggccaacacggcggagataaggatgttccggcggatggtggccggcgcacaagatgacgatagctccgacttgacacaatacgattggagcagaggtagtgacgccgccccgagttcaaggattgctttctgactctattctgcctgtagagactttacttgtgttggttagggaattcagttcaggtggctgtatccagtgaaagttggttttttttttattctttctttctctgtacgtatgaaggaagaagaggtttggcagttgatgcagattttttaggcagtcaaggtcaaggacatggaaattgaagcatcactttgttgaacgagacacgtgacttccaacctgtctctctgtttctgtagccaaagaagacacgaaaatgaactgttgaacctcctgcctgacattttc

SEQ ID NO: 4290 - DNA, 683 bp, Sorghum bicolor
  Clone ID: SORBI-28MAY03-CLUS76220_1
ctggaaacaagggttgcaaagttgtttgcgaagatgttcggctatctacttgtaaaatcaagaaggctgggattggtgggccgcttattaatcttgatggaagttttgttggcatgaacttctacgatggaagtggtgtaactcctttcttaccaagggacaagattgttgatgttctaagtggagtgaattctttaccatcagaatgtggatataaccatcctatgcctatcaatgttattagtggggcaagaaagggaatcaagaaaaacaagtggccggtgcccaagccatattggtatcatggcggacttgaggcgagtgttcatgatctaggcaatcataagcacattgggcggcgtcttaattagagatcacattgctggagtatctaattgcccttgttctgctcatctagctagtatctaacaaactttggtgctgttgccgccactgctgccgtttatctagcttacttgggttcccccgccccgttttggtttcatgcaagttagacttgtgttattgttgggttatttatgtgacttcgactcttgtaacttacaagttggttcaaggctctcatggaccttgttatgctcatctaagagacctatggtgctgtcgctgtacgtactgtttatcatacttcgattgttgtaacttacaagttggctcgagag

SEQ ID NO: 4291 - DNA, 643 bp, Sorghum bicolor
  Clone ID: SORBI-28MAY03-CLUS75854_1
ctactgggcggtgcatcgatcgagagccactggtttctctcgctctccaaaccacatctgctcagctcgcctcccacacacgccctttccaccatggcttccctctacgtcgtccaccacacctcgctaccactctccccgccccaccagctgacggcccccgagccccctcgcgcgccgcccccttcctcgcgcctccccgctgtgccgtcctcctctcaccatgtcagcgccctccctcgacccgcggcggctccctccgccttcgcgcgccactgcaaagcgccggtccgggaccacgacgccaagctcctccgcgctctacagtccaacggcaacggcaccctccacggagacgcagcaccgtcgcaagtcctcggttcccgctccgacggaccgggcggcgacggcaggagcaagaggtcgcgtttctgcgcccgggattgcgcgaagcggatcatggagctgcccgtggaggagcgggtgaaggtgctcgacctcctgccgcgcgacgacgacgcgctcaccgtctccgactacaacgacatcctctcggcgctggctcgcgcgggggaccacgccacgggcgtcgcgctgttccgcgccatgcccgtcgcccccgacgcccagtccttcgccaccg

SEQ ID NO: 4292 - DNA, 661 bp, Sorghum bicolor
  Clone ID: SORBI-28MAY03-CLUS75872_1
ctgggtttcagagctttgctctctcgtcagactctggcgcgacggccggagccggctactccggcggaaatcgcctcccgaatcacctccgtggacgggagtggccagaaccatctttttccactcctgccttttcctctcccgactactttgcttgcgcgcggggggcgctctcgtggcgcaactaggcgaccgcggccggctgctctgcgccacgtgcttgggtctatcctcatcggttccttcgcgttcaggcccttcgccggcgaccaatacccactagtttactggaggggtggaaccacttctgatgctgtctttgtaaatattgatggagctagctgagtagaaatggactgtagtcaagattcccaagaagaaagccatcaaagaagggagaatggtgaagaagctgaaaaggcggctgactatggaaatgctttgagccgtaaggaggcaacagaagagcttcttggttgtgttgttcatagtgaggaagaggcatacaggctgtactgtgattatgggcatcgaatcggtttcagcgtgcggaagggcaaacagtcttacttcattggtaccaagaatattcgaacaaaggattactactgctcaaaggaagggcttaaatatgatgagcctgttacagaagcaaatttta

SEQ ID NO: 4293 - DNA, 337 bp, Sorghum bicolor
  unsure (1)..(337): unsure at all n locations
  Clone ID: SORBI-28MAY03-CLUS7591_1
tctgtcgataacatcgacatggcactgagagaaataaagcgagtcttaaagcccgacggtctctatgtgttcattgaacatgttgcggcaccagatggtacgttgctccaatttgttcaaggcgcgcttgatcccttgcagcaatttgtagccgacggaggccacctcacgaggaaaaccgngacaaagcatcagggatgttgggttctcgagcctgagcctggatagtgtccggctgtcaaatgcctacatcattagccctcatgtttatggcgtagcctgcaagtgaagttatacaccatctttcgaaacctttgtaaatgatgccctcccttat

SEQ ID NO: 4294 - DNA, 660 bp, Sorghum bicolor
  Clone ID: SORBI-28MAY03-CLUS75925_1
cagcagtgccccccctgaaccgtgtcttgttgtccatgtccggctagctcgccctgcttgtcctgctggctcctccgctcctctgccatcatctcggctctctctcctctgctccttgcctgcttctctctcgctcgtttcgcaggcttgtccagggtctctagctcctccggtccctgaaggtcctgtagcggcacgctcgtaacctcgtatcctgcttctgtcgccctctgcttccgtggctgtcttccactgggtgtattctgcaactggtagcggtatgtccccatgacccccccggcccggcactgttccatctatgcctgctctagttcactgactcgatgtttgtactgcacgctttctcttcattccgctggcttcgagcccttcatcggtgcgcctctcagccggcacactgcctgttcccagtccagggcttggactgcctctggtgtcgttccgggaggagcggagtcgggtgggtcacatccttaaagcgccatcatggccaggtgccttttgtaggacagccctgggtgggcgaggtgtgggcctatcaaacacccccgtccgcagcatgccatctccgtcgccccaagtaactagaccctgaacgtcctgcagatttagtgtggagtttaaagcagcctcctgaaa

SEQ ID NO: 4295 - DNA, 628 bp, Sorghum bicolor
  Clone ID: SORBI-28MAY03-CLUS76322_1
cagcatacgtggatttcctcgttgagcaggcttgcgtctccctgcggcaactgtaccagcaaggggccaggaggatcgcgatcctggggatgccgccggtcgggtgcgtgccgttgcggcggaccctcgccggcggcctcgccagggactgcgacccggctcgcaaccacgcggcgcagctgtacaactccaggctgaaggaggagatcgcgcggctccaggaggagctgcagtgccagaagatcggctacgtcgacatctacgacatcctgcaggacatgatcacgaacccctgcaaatacggcttcgaggtgtcgacgagaggatgctgcggcaccggggagttcgaggtgtcgctgctgtgcaaccaggtgacggcgacgacgtgccccgacgaccggaagtatgtcttctgggacagcttccatcctaccgagagagcatacgagattatcgtggactacctgttcccaagatacatagagagcctgctatgattgttcctgcttggcatcgcttatttcatttgtttcttgtcctagttatatggtgtatgtttaaactcaactggctctggcatttttgttccaactgctggttatctacatttgtttctgtatgagggagg

SEQ ID NO: 4296 - DNA, 443 bp, Sorghum bicolor
  Clone ID: SORBI-28MAY03-CLUS76328_1
tgcacgagcgcggcgcacccggcaaacctcttgcccaccctggcgccgctcccctcgcacaccaggcacaggaactgccccttgtcccgctccgcctcgtagaacccctcagcgccctcgtcgctcccgtcgtgcacgcaggctggtgcccttcccgtcgttcctgctccggcagatccggcagcaggcggtcgtcgttagcacaagacgtagattgattaaccgtgattgacctggtctggttatggtagagattagtgggccgaattagtgggctgcggtggagatgagtttattggggcgtgagtttgtgtggtctaacggcccaagaagttttcaattatagtggagatatgacataggaggtcaattactagattttgttcagactaaagatggaaaaggccaacaatgattttccctaaaaaaaaacaaaaaaaaaa

SEQ ID NO: 4297 - DNA, 670 bp, Sorghum bicolor
  Clone ID: SORBI-28MAY03-CLUS76332_1
aaaaaattgatgctgtaaaatatatagaattgcttgaagcagaaatcgatgagctgagccgtcaagttgctaggaaatcgtcgcaaggaagtaatgagctgttggaatatctgaagagtttggagcctcagaatttaaaggaactcacgagtactgctggggaagatgttgtgtttgccatgaatgcgttcataaagcgtctcttggcggtctctgacccagagcagatgaagacaacagtctcggaaacaagtgcaaatcagctggcgaacctgctgttctggttgatgatcgttgggtacagcatgcgcaacattgaggtgcggtttgacatggagcgagtgctgggtgctcccccaaagttggcagagctaccacctggtcctggagagagcatatagttagagagggatgcctgaagattgtagatgtagccatgtaggagaggagaggctctgaaagattgtttgatttgaatcaactattggctggtggcattccattgctttgctttgtactctatagtagtaatatagtaacacatgcatgcttcttcattgagggagaagcatatacaatacaaagatgatgatatccatagttgattgacttgtcatggttgaggaggcacatatcctacacatcaaagatgcatccttgaattgaattg

SEQ ID NO: 4298 - DNA, 856 bp, Sorghum bicolor
  Clone ID: SORBI-28MAY03-CLUS76335_1
gcagaggattcactcccacccagtcatcagagaaaccatcaggtcctcatttaaaccctcctccagttgaggacattatacatgtcataagccacagcagtttccgtgtcaatggtgagcaggcagcaaaagaaaccagatcagagagcattgatgttgacaagcgtcttaacatggtaagagaagagataggtgtaagaagtatcgagccaaatctgataccttctggacctatagattctgctacagtgaatccaaatgtagcagaagctaatactacctttcagaaaccagccagtacagatacgataaaattgccgaccataccggaagggaactttagtactatggagacaaacaatgggtttaagcaggaagcagctccagctaaggaaatactagatgtgacatccttcaggcagcgagctgaggctcttgaagggctcttagagctttctgcagagttattggaacacagcaggctggaggagcttgcgattgttctaaagccatttgggaaggccaaggtgtcccctcgagaaacagcaatatggttggctaaaagtttcaaaggcacgatgaatgacgaagcaagccgcagttcaacgtgaggacacatagcctttgtgccacccgttttgttttggttgatttccgattgtgctctgaatatgcaatggttgtcttgtccatatttggcttcttggtatcgtgtgtcccctgtttccatttcgatagttgttcattgtttacagcacatgttgtaaatagcccagatttgtgaacagaaaataagacatgccagaaatagtgttaaaatttacacgattgaagtaatagaaagactaatttgatc

SEQ ID NO: 4299 - DNA, 659 bp, Sorghum bicolor
  Clone ID: SORBI-28MAY03-CLUS76367_1
atcgcagatcttctgctccttcccccactcgcgctcaggctcggttccaaggatcggatcttccgcgcgtcggcggctccccccctctgctgttcccgtgggagcccggtcagctgcccagggtggccgggccttggctccgccggtaagatagattaagaatggctgcgcggagcagttcttcgccccccgaggatgactacgagactgaacaaaagaagcaagctgctgcagatgttctttttcactattcacaatttgttatggtctgcattggtgaggatgttcgccctactgatctcaggttgcatcttatgaaggaagtttcaggaatgcccacttctctgaaggagcctcaacaggctgcttcctcaccggcttctagtggcgaaccgtcttcctctggaatgatgaaaggcgacaagaatgaaatctcctaagcttcataaatcattatccaactcaggtcttctgctgttccttatgcgctgagaagattgtatcgttcggaacttcagatgatgaggcctacttgcattacaggaatgtaaatatgttaggaacactgttcatagctgtctgctgttctgctgctttagcttctttcgtgacagcctgcttcatgtttgaatccatttttattcagggggcagtaacgt

SEQ ID NO: 4300 - DNA, 732 bp, Sorghum bicolor
  Clone ID: SORBI-28MAY03-CLUS7639_1
ggctacaggccttctcttcgttgttatgcagcctcctattaagctatcatgggtataccggtcggattttatcacagcagcacatttatctgatgatgacatttcaatatatgggtttgtagcatctaagcccacatggccgtcatggctgcttattgcaactgtggtacttacactagcagcagttacatccatcatcccagtgaagtatgttgttgagctgagggctttgtatgcagtggcagttgggattactctaggcatctacatatctgttcagtacttcttccaggcagttgttctgtatcctcttcttgttgcaacaattgtctctgcggcagtctttgtcgtattcacacatcttccttctgaatctagcacaagggttttgccatgggtgttctctttcttggtagctttgttcccagtcacctatctgcttgaaggacacttaagatccaaaagttttgcagatgaggatgaagcagagaagttcaccaacatgttggctatagaaggggctagaatgtcacttttgggtctctatgctgctatcttcatgattattgcattagaaatcaagtttgagctggctttgctattgcgtgaaaaggctgcagacagaggtatgcatggtccatctagtcggagttctgccttcccacccaaagcaaggctgctccagcaacaaagagctcatgctgcaccaaccttcaccatcaagaggttggc

SEQ ID NO: 4301 - DNA, 573 bp, Sorghum bicolor
  Clone ID: SORBI-28MAY03-CLUS76406_1
gcccccccccccgacccgggcccacccaccccccccccccgccgccccccatggccgcccccgccgcccccgggccgccccccccccccccccccgggcccctccgcctcccgggccgccccggcctccccccccaggtccccccggccatgccggtgccccccgccggccccccctcccgccccccccgtggccggcccccccggggccaggccccccccctccgcccccgaatccgcctcccccccgccccccgcccccgccccctccgggccccccctgggggccccggccggggggcccgggtcccccccccccccccccggcccccccggccccgggcccccgcccgcccccccccgggccagcccccgcccccccgggagcccccccccccccgccccccccggccccgccgccgtccgcgccgccggcggcgccgccggcggccagcccatggactcctccaggtggacccccggcccgcgccccgccttgatgccgggggtcgtctccgtcatggtggccggcgctgccgcctgtctggtacccagctggcgcgcctcttgcttg

SEQ ID NO: 4302 - DNA, 785 bp, Sorghum bicolor
  Clone ID: SORBI-28MAY03-CLUS76057_1
gatggccgtcggctacatcgtgatggcgctggcgatgccaggctccctcttcatcggctcggtggtcgtcggcatctgctacggcgtccggctggcggtcaccgtgcctacggcgtcagagctcttcggcctcaagtactacggtctcatctacaacatcctcatcctcaacctgccgctcggctccttcctcttctcgggcctgctggcgggcctcctatacgacgcggaagccaccgcggtgcccggcggcggcaacacctgcgtcggcgcacactgctaccgcctcgtgttcctgatcatggcgctcgcctgcgtcgtcgggttcggcctcgacgtcctgctctgcgtccggacgaagcgggtgtacgccaagatccacgagagcaagcggttgagtaggtccgccgtggcgcagagggttggttagctagttgctacgcacgcagctctgtggaagctcaagaaaatagctcgcatcaacaacgttggaactctgaagaagcacctccgcaattttgtgtgcgaatatctttgaaaagaatttttgtgtgtgaattaaggggccattcatgtctcttattctttggaaaaagatggatgcatatcaatttgattggtttccactgagtattgattgagagggttgcaggcttaattggtagaaccccttgagttcagtgtggtgtttattctgtagtgtacatagcgtttccgtaagattgtacggtgtaagtgtaatggcctatacgtgtaccagctgttaccaatttctctaaaaaaaa

SEQ ID NO: 4303 - DNA, 617 bp, Sorghum bicolor
  Clone ID: SORBI-28MAY03-CLUS7608_1
tactggaacgaactgcctttcccgtcagcagcagctgcagctgctgttcgtcttcatcctccccatcctgactgatttcctctccccaattcgcaaacttccccctcacttcgctgcatctcatcaccacgggcctcatcgcgaggacagggccagcgctctctccctcgctccgcctttactgctgacggcgacgactggacgagctctgcctccgcccctacgccaacgtcaggtgcccaggtcttcgtcgggcccttcgccaggtcttcctcgggcacttcacccgcgacgagcacccatcaggagtaaaatggatgagactgttcctgctttggttaccggccaagcttcaactgatgccgtgacggagcagcctgtgaatgtgtacatatgggacatggatgagacactaattttgctcaagtcacttctggatggctcatatgctggggcttttgatggcctcaaggatcgtgagaaaagtactgaaatagggaagcgatgggagaacctcattcttgaactctgtgatgagcacttcttttatgaggagattgagaactacaatgaaccctatctcaatgctttgaatgaatatgatgatgggagagact

SEQ ID NO: 4304 - DNA, 603 bp, Sorghum bicolor
  Clone ID: SORBI-28MAY03-CLUS76092_1
gcccgtcgcgtttgtgcccccagctccttccccctcccgcgcgccgcccccggccccgccgccgccgcgctccgtgctcccgggtccgagcagcctgctgctgggaaccccctgctgcgcttgcctggcgccgcctgtctggggcggacaagaactgcctaggaaggactgccacgggctgctgtccccgagcttctggccctcctcccccccccgtcccgccccccacggtggagtgcacgccggcgacgcgcccctagcggccgcgcctctgcggcagagcgcgcccgtgcccaccggctccctcccctgggcctcggccccccggacggtgcccttcggggcatccgctttggttggcccccctcccgttcccagcggtcgccctggacgccggtggggtcgctcgtctcgtgtgcgcccgcgctcttctgatgcttcctggcatccgctcacctccgggggggtgtccaccgttgctagctgcccgaccctggcccgtgtatgtgcctgggagcccggctccccaatgattttcaacactgatgcaagaggccatgaactgtttccaacagtttatgcgctttggaaggtcccccatct

SEQ ID NO: 4305 - DNA, 474 bp, Sorghum bicolor
  Clone ID: SORBI-28MAY03-CLUS76101_1
gcaatccccaattcggccgcctcgacgaattttgatttcttccagcttgggcttctgatcgctcgcgcgcctctgtttgctttgcattctagaacctagcatttgatttgattccgccgcttggtccggctccgaggaggacgaggaggatgaggaggcgagggagtggtgaaaggtcgcgcgaccatggtgggtttgtctccggcggcgatggaggcctggtgggacgacgtgaacaactccacgctgtggtaggaccgcaccttccacgccctcgccgcgctctacggcgtcgttgcagtcgtagccctagtaagccctatccccccgcgcgatttcaccctcgtcctgcttggcttgagaaaatgactcttataggactataatcgtttggcttctccgaaataggattcctaacgttgatttctccaaagtaagactccaaacgttaataataagctgcaatgacatttt

SEQ ID NO: 4306 - DNA, 662 bp, Sorghum bicolor
  Clone ID: SORBI-28MAY03-CLUS76440_1
agaacccgcccatttttattagatgcaccagtattcctgctcggaggcaaggagtagcaagtccaagccgtcaacacactggggggtagcgagctcacaataaggtcatggcagagcatccaaggagtccatgtcggcctacccatagtcctcttttggaacttccaagtgttccaattgttcctccaagtcatctggaagatcttcagagaaaaacaggcaattcacgagcaaaatctgctccacctagggctttagcaaccaaggaagacagcagtgcttgctccagttcgacgattggttatgctgaaactaccaaccagtctgaaccgtctgaacctgactcaccaacctatttggtcccatcctgcaaatgtttgatacctgacactatcatacaaaagcatgacatagaaaataaagcaagttcagaggtcaacacaaccaattgtgagaaaaaaattactagtaatggtgctattagtctaagcgcagccatggtgcaatcttctgatactactgaactagagtttatttgcaaggatggaataccctcaagtcaagtgggccagtgcagtgacacagtcactgtactaagtgatgaagacaagttcacagtgcaggaactgctttcatcagtaccagatctttcttccctttgt

SEQ ID NO: 4307 - DNA, 734 bp, Sorghum bicolor
  Clone ID: SORBI-28MAY03-CLUS76508_1
cgccgagaggccaagtgtatgaccccaagatcgaccggtgggaggtgatgccggttggaatgcgtgaagggtggacggggctaagtgtcgtcatcgagggacgcctgtttgtcatttcagagtatgagaggatgaaggttaaagtgtatgatgcagaggcggattcatgggactcagtcagcggccctccgatgcctgaaaggattatgaagcccttctcggtcagttgtctcgacagcaagatcgtcgtcgtcggacgaggtctccatgtcgcgattggccatgttcagaaggaacctgctggtgatcctgatagcaggagttcaggctactccatttgctggcaagatgtggatgctcctaaggaattcagcgacctgacaccttcaagcagccagattctgcatgcttagctgctcgttgagtgagcgagaaccattggtaatccgcagaatgaccgcagctgccaagtcttccttgccaagttcagaactgttgttgaatgcacaagtgttccttgctttgttgacaagctgatagcttaagtttgtatttgtaacttttcttcctttgtgcattgcatgactcttattgatatgtgatataagaagtaagctgttctgtcattctgcaagtgcaacgcttcgcatttcctcacacagagtggcaacagtttcctgaaaactttgagcttgcaaaatttctttttgtatgtactgtagtatctattcaga

SEQ ID NO: 4308 - DNA, 568 bp, Sorghum bicolor
  Clone ID: SORBI-28MAY03-CLUS76560_1
ggttgcatttgcatatgtactgaaagagagatcagtcatatatatcatagcaaataagcttgaatcaaattcaagcatggcgtaccgggagttggagctgacgctcctgtcagcacaggatctgaagagcgtgaacctgatcacgcgcatggacgtgtacgcggtggtgagcatctccggcgacccactcacacggcagtgcacgccgccggacacctacggcggccggaacccatgctgggacgcgacgttccggttcgccgtcccaccgacgtccaccgccgcggccggcgcgtcggcgtcgctccacgttctgctccgcgccgagcggttcctcggcgaccgcgacgtcggcgaggtcgtcgtcccgctcgccgagatcctcgccggcgccaccggcgtcggccctcagccacccaaggtggcgtcgtaccaggtccggaagctccaccggtgggaaccccgcggcgtgctcaacgtgtcctaccgtctcggccccgtcgtcgcgccggtggtagagtggccgaccccggcggagaagccggcggccgtcaccgccgtctatgcg

SEQ ID NO: 4309 - DNA, 922 bp, Sorghum bicolor
  Clone ID: SORBI-28MAY03-CLUS7657_1
gttgtctcctggtgctgtgaactgtggctcgacgcatgacactggaaatatgtttccactcaacacacctgaaaatttaggagtgtgtagcgaacaaactggtgtatgcccaaaggaaagctcatttgttgcattaagagaaggttttggtgacctgggattgtccttttgggaatgtcctaggagtccccgagatgatcctacttcccagatacttgataccagtacaaaggcaacagataatccaggtgaagtggaaaactaccctgccaatgatcaacctaagcaaggcccagtttctggggcggtagaagcaaacccggtgccagtggaagatgaacatgatagcgcattgcatccttgtccatcaaatgaaagagatagtgccatgggtcttgctaacctgggagcagacactgaaacatgtgttgatgtccattccgacaaatggacagatgtcagcattagtggctctggtgaagatttcactagtgccaaaattgcatctaagaaaaggaacaatcctggagacagaataacagctttagatggttcacttgtcggaagtgcaaatgacgatgagagcgcccgagagagagatggtcctttctcaccaccacagcagcgttcagttcggccaagagtgatactagacattgcctcagattctgattagcatagatagatttgtgttggctgattcccgttatagaatctgtagcggtctcctacctgcctgcgtggcttggagaaaaggaaggggtagagtgtgaatggatgtaatgtaatggtgtctaaggcattaggtcagcgagctggcaagcagtgagaggcagaggcatctcctgtatttggagatcccagctctgttaggtggtagaatgtgatgacaggagcatatatatatatatatataccagtc

SEQ ID NO: 4310 - DNA, 688 bp, Sorghum bicolor
  Clone ID: SORBI-28MAY03-CLUS76572_1
ctactggtattcagagccacaagaaattgtacatgggttggtgagctatgggtccattatttgttgtctttggagcgtatccgtgcttccgaagaagagctgcagcatgtatttgaacgggcaatacaatgttccttttcaaccatacaagagtatctcaatatttatcttactcgagttcatggtttaagacgaaggatttctgatgggttggattttcaactgattaggcagacattaacggatgctgcagaatttctctcacctcaactgggtatcaacgagttactgcgcttatatgcttattgggccaaactagagcatagtcttggcaaagatctttctgcagctcgtggagtttgggaaaacgcaatcaagaaaagtgggtctgtttttgaagtttgggtgcagtacatttcaatggagatagaaatgggccatgtacatgaggcgagatccctttataagcgttgttatagcaaaagatttgctggttctggatcagaggagatatgtcactcatggataagatttgaagaggagaatggcaccttggatgattatgaccttgctgttaagaaggttacccctcggctaaaggagcttatgacgttcaagtctcaagaggaggctaaagttgaggcataccctaaccccaatgataattctaatgcaaatgattcctctc

SEQ ID NO: 4311 - DNA, 505 bp, Sorghum bicolor
  Clone ID: SORBI-28MAY03-CLUS76591_1
taaacgcctccctcttcctctccccctgtgggagctccggccgtttcaaaaccccccaccccccgcccggtgccacgcggccgcgtctccgcagcctcggtccccggcccgcgtcgcgtcacgccggacgccgcgcttctgatttccgaccgttcctacttggcgcccgccggattcccctagtccttgactccttgtcgtgcgggaaggtgcggtttcctggcgcggatgtgagggaaggccgggaggggcagggaaggaatgcagaggtcgcggagggcccttctgcggaggacggcggcggcgcaggagcagagcgcggtggcggaggcggaggctgccgctaacgggaggaagaggcggctgtatggcttctccgcctccctcgtcgtcgcctcctgggtcgccgtgctcctcctccactccctcgtcggacacggcgacagtcaacgagatggaggaggctgtgctgtcgatcttactgttgttgagcctgccttgaatg

SEQ ID NO: 4312 - DNA, 453 bp, Sorghum bicolor
  Clone ID: SORBI-28MAY03-CLUS7624_1
cttccgcagattgttgaacttgctgatattgcacgatgcatagcgaatactcctctggatgaagaaagtgcattatcccaaatggttacctgcatagaagatcttcaagaaattgttaaccgcaggaagcatgaggctctcacagtgcagacatttggaacacgtatcgaaaaactacacagggagaagtatctgcagctctgtgactcagtcgatatggacaaggttgattcagcaagcaccataatggatgaggaagacgacgttgttcgtagcttgcgcgcaagtcctgtccatccagtcaaggatcgcacttcaattgatgactttgaaatcatgaaacctattagccgtggagcatttggacgtgttttcttggccaagaaaagaactacaggagatctttttgctataaaggttcttaggaaggcaaatatgattcggaaaaatgct

SEQ ID NO: 4313 - DNA, 1128 bp, Sorghum bicolor
  Clone ID: SORBI-28MAY03-CLUS76242_1
acaagcatccaatgccttccctccccgcctccctcccttcttaatccccaccctaatgcccctcactaaccactcccgccaccactaaaccaccttccccaaccccgccggccgcttaccacagcctccggagcttattaaagcccggagtgccccccggccagccgcgtgcctcaacctcaaggaacaggagcaagggcacggtgccgccgggatggacctcgcgtcgttcatcacgtccgtgctgacgtcgttcgtcatcttcgtggcgctggtgctggtgttcacctggctgtcgcgccgccccgggaacgcgcccgtgtactaccccaacctcctcctccgcggggtcgacccgtgggagggccgcgggcgcggcacgcggagccccgtcgggtggatccgcgacgccatctccgcgtcggagcctgacgtcgtcgccgccggcggggtcgacgccgccgtcgacctcgtcttcctctcctctgtgctgtcgatcttggtgtactctgggattgtgctgcttccagttctcctcccagttgctgcaactggtggtgccctagttggcatccctcccaatcccaacaattcatctgaatcgactcaggacttctcggcgattgaaaggctaggagtgggcaatgttcctgaaggaagtatgaggctgtgggcatttcttttgtcagtctattgggtttcctttgtcacctatttcgtcctatggaaatcctacaagcatgtgtcaaatttgagagctactgcaaggtcaacaccagatgttaaaccagaggagtttgcggtgttggtgagagatatccctagatcatctccagatgaaactataaaagactttgttgactcatatttccgagcacttcacccaaatactttctacagatcaatggttgtgacagatcacacaaaggctgataaaatataccaagagatcgaaggtcacaagcagaaaattgctcgtgctgaagccatatatgcaaactcaaaaactgaaagtaatcctgagggcacaaagcctactcataggactggattccttggtcttattggtaaaaaggctgacacaattgaatactgtagtgagcagattaagggattactgccgaaact

SEQ ID NO: 4314 - DNA, 641 bp, Sorghum bicolor
  Clone ID: SORBI-28MAY03-CLUS76254_1
accatccagacactcctatcccagacacgaacgactcctcgggaggggagaagaagcggaggagagagagaagcgcgcgacgagtcgacgccatggaagagagggtgccgcttctgccgcagtacacgttgcggaacgacgacggacgggaggagaagtgcggcggcggcggcggcgtgaggtggtggagggagctgctggcgcgggaggccggcaaggtcggttgcgtggccctgccgatggcggccgtgagcgtgtcgcagtacgcggtgcaggtggcgtccaacatgatggtcggccacctccccggcgtcctcccgctctccgcctccgccatcgccacttccctcgccactgtctccggtttcggcctcctaattgggatggcaagtggattggaaactctatgtggtcaagcctatggcgcaaaacagtatgacaaactggggatgcacacctatagagctatagtcacactcattgttgtgagcattccaatctcacttctgtgggcattcataggccaactcctgatgctcataggtcaggaccccttgatctcaaaggaagcggggagatacatagcctggttgattccagatactcgaattcttgtaaggagacccgctcacctcctacag

SEQ ID NO: 4315 - DNA, 716 bp, Sorghum bicolor
  Clone ID: SORBI-28MAY03-CLUS76260_1
aagcaagctcccatttttctctacccattcctattcctatactagcagtagcagtatccatcggattgccatgtccggcgacaccgccgccgccacgacggcgcccggcaccgccatgccctgccgcctccgccctcgctcgagcgcctgcctgttccttcccctccgcccccaccaccgccggggcccgggccgcctcttccccatcaccggcgtcctcgcggcccactgccacaccggccgacaccgctgccacgccaccggccgcgcccccgcccctcacctctcccccacccgccgctcctccaccctcctcccacttgcagccgcctgggcctcctcgacatacggctcctcctcctccaaggccaccgctgctctcgccccctccaacgtccccgacgccatctgccgctccgacgccctcgctctctccgccagcgtccccggcccctgcatccaacgctcctccgccatcagcaccaccacccactagacacaggccattgcctacgcctgccattgcagttgacccgacccactccggcgccggcaagaacccaagttccaacaagtcgtccagctccagcccaggtgcgccgtccaggaacccatccgccccctttggaagccttggtactggtgtcgtcatagccatcgctgctggggtggtcgccctgcttctacttagcctcctagtcacagcagtttggttc

SEQ ID NO: 4316 - DNA, 786 bp, Sorghum bicolor
  Clone ID: SORBI-28MAY03-CLUS76700_1
ctggctttcccctgctctgccacagtccggcggattctctccagctaagctacgagcaatgcttcgcgggctagagaagcaccagcgcaacaacggcgacgacacgtcgccggaggccaacaactccggcgagcttgacgaccggaggagcttggaatgctccacctccaccgaggcgccgggcaacagcggccacaggtcaagaaaccgagccccggacgacgacagcttcgactcggagagcagctcatcggggccgccgacggtcaagaggtcgaccgcggtcgccgcgttactgccgcccttctctcggccaaccccgtccaagtgggacgacgccgagaagtggatttccagcccgacgtcaaaccgtactggccgtgcggggcctaccgccggaactgtgccaaagaagtctgcattggcattccctgaacatggaggccgtccaccagccgttgctaaggtggtcacggatgtgcctaccaacactggaccattggttaagaattcagatggtcttgccgatcctgatttacttaaacctgcacacaatgcttcaatagttgacgaaccagcacctgcagttaggtctgtctctatgagagacatgggaacagaaatgactccaattgccagccaggagccttcccggaccgcgactcctataattgcatctagtccaacttcttctcggacaccaactccacaacgcaccacagaactcagtgtgagtaatatagattctaacaaaatggagatgtctgaagaggagctacaaataag

SEQ ID NO: 4317 - DNA, 801 bp, Sorghum bicolor
  Clone ID: SORBI-28MAY03-CLUS76704_1
atgcatttatgaactaggaacataacagaggtagaaaagaaaaggatgatgccaattggtgtactttgcgtggtggcatatattgaatgtatttcgtcctctttgtcggaaatgtgtttggaatattaactccctttacaaatttccttttcttgttgtttacactcgcttttctttaaccatacagtcagcagagggtttttgctgttcaagtattcgagctgcataggttgatcaaagtgagtctgcggcaaataaataacttcttcaggctcatgcttatgggcaggttaacttacgggtgttttaatttgaaatttgatttaaccattgtttatgttgacttgcaagcaggtgcagaagctcgtggctgcatctccacatctacttattgagggggatccttgccttggcaaatccttggcagcaagtaagaaaaagctggctggagatgtggaaaaacagcttcaatcggctaaaaacaatgatgaggtgcaaccaacacagcagcagcagctagagcactcaaaagagaacactgaagcgaaccagccttcaccatctcaagatgatgcagctggagtccaacataacaatcaagctgcaataaatggtgctgttagcagtaatcctccctcgatgcctaccccttctgacaacaaacagaacagctggtgcattcctccacctccgagtcagtggttggtacctgttatgtccccgtctgaaggacttgtctacaaaccttatagtgggcactgccctccggcggggagtttcatggcgcccccgttttttgcc

SEQ ID NO: 4318 - DNA, 660 bp, Sorghum bicolor
  unsure (1)..(660): unsure at all n locations
  Clone ID: SORBI-28MAY03-CLUS76701_1
aaaaaaaaaaaaaaaaaaattcgaggcaaccacctatccgattcccggagcccctccccggactcatctcgacgcggtagcgccacgccggcgtcgccgcgatgctcctcctcccggggcgtccagtcctcccctctccggcgctgccatactgcccctcgccgtctccatcccgtttccgtcccctcccctgcaccagcaacgcccccacctctgcttccaccgccgcgtccgccgacgccaccgcctcctcgtccttctccgtcgaagaatacctcgtgaacaggtgcaacctctaccccaacgtggccgcgcgcgtggctccggagctctccgccatcaggtctccctcgaagcccgacgccgtgcttgccttcctcgccgacgcgctcgagctctccccgccgctcattgccgtcgcagtggcccgcgacccgacgatactcacctgcagcgtgccaaggacgctcgcgccgcgcgcggacgagctccgcgcgctcgggttcaccacgtaccagatgggccttatcgtcgtgcgctgcggcgcggccgcgttccgctcacgcgcgctcgtctccagtgtccagttctggctcccgtacctgcgtggtcgcgtcgacaagctcgtcgccgcgctcaagggcaacccgggcctnctca

SEQ ID NO: 4319 - DNA, 685 bp, Sorghum bicolor
  Clone ID: SORBI-28MAY03-CLUS76710_1
gctcctcctcctcccttccccgtgcttcggcttcggctccctttcctccgcatgcggccgccccgggccactgccaggtaggccacaccatggagcagccgccgcccgcctcctcgtcggcgccggcgccggcgccgcagtcgctcgtgtcccgcgcgcgcaccgcgatccactccgccgccgcccgcgtgctcaccgacatcaaggccgacctccgagatgccgaaggattcggcgggcgtagcagggcgccgtcgccgaggacgtccctggatcgggaggccgaagtgagcgccacggggcgggagccggacgtgaagccgccgccgtcgccgcgtgatgaggtcctagaagtaagcccctcagggaacgaggattgctcaaacatcccaactgaattaacttgttcaacaaagctgacctttcctccagcttcagtagttaaacaactggtgtctgccattgaaaatgggaaaagtttcaagtcaatgagtgatatgaggtatactggagaccaattgctgaaagataagggaggtttgagcttatctgttgttaaatcacttgttcgacgcgacaaggaagaaagatcaagctccgaattttttggtgatgaagaaactcaatctttgatgtactccttgttcaaattagaggaacaattttcactagaaggaagtcaatg

SEQ ID NO: 4320 - DNA, 261 bp, Sorghum bicolor
  Clone ID: SORBI-28MAY03-CLUS76727_1
cctactggctaccttcactgcgccacggcccccgagcccggagccccggatgaccacatcagctgccgacgatggcagttctttggcgcctaccgtgacggagggagaaaccacagccgaggccggggctggggcagttgttgaagagtgcgccgagggcaaggagacgaaggtgggggctgcggctgcagttgaggagccggatgaggaggcgcgggaggaggatgctgatgcggtggtggtggaggaggaggaagaaga

SEQ ID NO: 4321 - DNA, 680 bp, Sorghum bicolor
  Clone ID: SORBI-28MAY03-CLUS7674_1
attagtgcttcaactgtagattttcatccatcaagggagggtgtttcggcaatagaatttgatagaaagggaatataccttgcatcagtgacgctctcagggtgtctgacagtgcatgactttgagaccttgtactgctctaaatacagcccatcatgcagtatgccagatgaatcatcaaattatgtgatccatatatctaaccgaattcccctaaattctgtgcgatggaatccaggaaaccaagacgagattgcttgcacatcaagtcaaagtgacaaagttttcctctttgatattggctatgtctcatcagcaccaactgaagttttgcataaaggaaaatccaaattccctgcgctctactctgaatcatgcaagagtctgactgatataacttttacttcagatgataagtcacggatgtttgcgtgtggccttgatggggcagtgtacatgtgggacaggcggtcaagtaagacacactgtcttgagcttatggcatctccagaatctcagttcaacactgtcaagctaacagtggataatcggactgtgtttggtgcactaaaaatggacaatccatgtttgggatctccgtggaggagggcatcagctgcttttaaagccacaatgagggtcaacaattgctatccgtgaagctatcaacgttgttgggc

SEQ ID NO: 4322 - DNA, 711 bp, Sorghum bicolor
  Clone ID: SORBI-28MAY03-CLUS80252_1
gtgtcgcggtacagggagaagcggcgcacgcggctgttcgccaagaagatccggtacgaggtgcgcaaggtcaacgccgagaagcggccgcggatgaagggccggttcgtgaagcgcaccacgcttccgccgctgccgaggccgccgccgcagcagcagcagaagcagctgccacgggcactgccacacgtgggcatggtgctcgcgccacctccgggagcgaacgggcgcttccagttttgagaccacgcatgcaagcatgaagaaacgtatgtgcatgatgatgcaccgatgcatctatatctagctcgtagcatgttctttctactctactacttttaattggggatgaacgtacgtacgtacgtacgtacctagcgttagttttttatcagacacccgtgcgtgcgaattagggctccccacaagatgctccctacttacgactgaaatatatctgtatatgtacatgtgcagaatttcatgtgcaaattagttaaggaagagtatacttatagctaggttggttgtttttctttttctagtttttgtaaagaaggatccactaattacaaaggggtgtagattttgatgccgccatgcatcggttggaaacattggagcatgtgtaaaggtctggaactctgagcttagactgtataagattgaagtgatgatatactacgttgtttttattatggtttctcagtg

SEQ ID NO: 4323 - DNA, 853 bp, Sorghum bicolor
  Clone ID: SORBI-28MAY03-CLUS80273_1
tgacctttttgcgaaagcaagaaagtcttctcgaaccaatccatttatcggggctgacaaggacagtagcaccgcctttgcgcaaccgactgttctccgaggacatgcaatgtacaactttttggtgaggatgctgacagtgatgtccatgttagactcgcgggccgaaattcgggaaaacactataaagttcttcatggaaacagagttctgcgagttctctccggaattggaagaccatttcgagatctttgagcacatccgaggtttcaatgtgaccatcgttacttcagccgatacaaaggatgagacctcactactgtggagtggcttcacgcttaatgatgagggagagactaagtaaggggctgaaggctgttgatgctgtcacaatgattttggagttcggtggttcatgctcaaggagtgcaatgcagcatccttctgttttgtagactgaatgagattacgtgactgtttttcatagcgctgtgtggagctcgtgtttgataactacatctagcactatatatgaacacaataatctaggctctaataagcatcgttttgcttatttctgtggttcctgctgtagtaacatggaatgcccgtttctgccgacaaaaaccattgcaaaatagggcgacgtaacggagctcctcatctttactcgtccttgatctattgatctctggctcctgtagttggaaaggttgccttctcgaagacattgtaagagggcatatatgcctgtgttgtgtgtgatcctgatcatttttctctttgatgtcacattgaatcgttgttccaagatgtagaaattattgaataaatgcttgtaaaaacttttttt

SEQ ID NO: 4324 - DNA, 573 bp, Sorghum bicolor
  unsure (1)..(573): unsure at all n locations
  Clone ID: SORBI-28MAY03-CLUS80338_1
ttctggctctcagttctcacacggcgctctctgntgaagatgaagaggcgcgtgctgcgccatgaagaaccagctgcagctggcggctgcctctcgtgttggagatcctggtgttgtttgccgctcttcttggcagtgcgcaatgccagagctcccagggcggcgatggtggtggtggtggcgccgccgctaacctcacggtggtgggcgccgtcttctgtgacgcctgctcctccagttccttctcctaaagcagctacttcttgccaggtgttaaagttcgactggactgcatgatcaaagtgaactcgaattccaaggaggagatcaagatcacggccgagaaggtgaccaacagctacggcgcctaccagctggacatcccggcgatcgacggcttcgagtgcgccgcgcccggtgcgaccgccgcggagtccttctgccgggcggccgtgctggacaactcgtccgcgctgtgcaacgtgccggccgtgaccaccaccgtcggccacatctccttcccgagccacgagcccaacgcctgtttctacagcctcaactcgctctactacc

SEQ ID NO: 4325 - DNA, 1264 bp, Sorghum bicolor
  unsure (1)..(1264): unsure at all n locations
  Clone ID: SORBI-28MAY03-CLUS80345_1
ngaatccgccatttttttttttttgacaaatgcaagagaatttattacccgcagcaagaatttatccgccatggccaccatcactgccgccgctcgctggagctctcctactcgcctccagctcctcaacagccgccgcctccgcttctccgcctccgccgctccgcccacttccacagcggggtttggctgggccgacgccctccgcgtcgacgtggacagcgggcatggcgacgagtccgacctctccgggtacttccggaaggtcaagacctgcaaccgcggaatggacaagaaggggcagttcgtcgagttctctgtggaagatcaggtcgtggggtacatccacaagagatttatcgaacacatcagagacttccatgatgtttttaccattgtcttgggcaacaatggcagcaatagtgtggagcatgtgtctctccactcgtcgttaaggactccagaagacagaacacatgctattggaagtgttgttaaaatgcttggagaaatgattccaggtattcgagatgagctctacccagtaacatcatcttatggcatgcctgtgtacttttctctggaacgcgctgctgctccctactttggtataaaggcttacggagttcatatgaatgggtatgttaataaggaaggtcagaaatttctttggattgggaagcgaagtgatgtgaagcaaacatatccaggaatgcttgatcatctcgttgctggtggcctgccatatggaatatcgtgcaaagagaatatcataaaggaatgtgaggaggaagctggaatcccaagatccatatctacaaatgctacttctgttggagcggtttcttacatcgatattgaaggctttagatacaaaagggatgttctcttctgctatgacctcgaacttccttctgactttgttcctaataatgaagatggtgaggttgatagcttcagattagtccctattccacatgctgcaagcattatacggaggacagaatttttcaagccaaattgcaaccttgtgattatcgacttcctcttccgccatgggtacataaacccagattctcgtggctacctagagctgatgcaaaccttgaggagcggtgattgttcttagttgccttttgctgttcaagtttctaatgatagttcaatttgatgaaaccaaagtgtcacggaatagtcttgtgagataatgattataatcaaaattatgcttgggactcatttcagtatgagcagagggttctct

SEQ ID NO: 4326 - DNA, 371 bp, Sorghum bicolor
  unsure (1)..(371): unsure at all n locations
  Clone ID: SORBI-28MAY03-CLUS8050_1
ttatcctagtgacccacgcgtccgacaaacttggtcagtttggatttgtacctgaacaacttcactggttcgataccagattcattggggaagctattgaagctgcggtgtcttgcgtcttaacaacaacagccttactggttcaattccaaaatcattaactgctatcactgcactccaagttctggatctgtcaaataacaatttgtctggagaagttccatcaactggttccttttcattattcacccctatcagttttgcgaacaaccctaatttatgtggtcctggcactacaaaacctngtcctggtgctcctnccttttcttcacctnctccatacaaccctacaacccctgcgcaatcaccag

SEQ ID NO: 4327 - DNA, 729 bp, Sorghum bicolor
  Clone ID: SORBI-28MAY03-CLUS76832_1
aaaaagatactcagctgttggagaccgtctgagtccgtgaccgtagtttgactctcagccaacgtcagggaaccgggggttccaaacagttgctgcagcctagcacgcgccgcgcgactgccggaggcgatggaggcgccggcaccatggagagtgctcgagttctacagcggcatcggcggcatgaggtactcgctgatggcgtcgggcgtgcgggcggaggtggtggaagccttcgacatcaacgacgtcgcaaatgacgtctatgagcacaacttcggccaccgcccctgccaggggaacattcaaacgctcactgctagtgacttagacaaatacaaggcacatgcatggcttctttctcctccatgccagccatacacacggcaaggacttcagaagcactcagctgatgctcgtgcattttcattcatcaagattctcaacctcatgcaagacatgagctatcctccacaaatgttatttgtggaaaatgtagttggattcgaggtgtctgatacacatgatcaattgctggaggtcctttcaagtctcaattttaacacacaagaattcatcctgagccctttacagtttggtgtcccatattctagacctcgctacttctgtttggcaaaacgagaacctatgcggtttcgaaacgcatcggtcaacaataagttgctccagacacctatgtgcctaagcatgacactgaacagtacatca

SEQ ID NO: 4328 - DNA, 959 bp, Sorghum bicolor
  Clone ID: SORBI-28MAY03-CLUS7689_1
cataactgaaaaacaagctaaaatggggctagtttgtcgtgttcactcaaacgataagagcaaattcaagttgctttattttgagcttgaagaaaatggtgggcttagtcttgcactacaggaagacagtgtgaaggttgggaaagttactgctgcagggatgtatttccttggttttcctgtgtaccgttttgaacaaaataacctggcagctgctgcaaaggattctgatggtgcattctttaaaagattggatagctttcagccatgtgacatacatgaactgaaacctggaacccacttctttgctgtctatggtgacaatttctttaagaccgcaagttatactatagaggttgtatgtggtgaatcttttcctgccgaaaaggagatgctacgaaatgtggaggcaaagatactcacaaaacgagctgaactttccaaatttgagtcagagtatagggaggttttggcaaagttcactgaaatgaccagcaaatacacacaagaaatgcaagcgattgatgatcttctgaaggaaaggaatgagatccatgcttcctataccaacaatccacctctaaaacggagttccagcaggaataaaggcaagtcaccttcgaaagtggccaaaaccgatacagaaaaacaacctcagaaggaaaagaaagtgaaggatcactgcatggcgggatatggaagtgacagtgataactcaaaaagtgaaaagaaatcaaaagagcggttcccaaggaagaaatggttgaacattccattcaaacttgacaggagaaagacatgctgagcaatgaagtccctctcggcccaacactagattgatatacagagcattttcactgtggcctcccaaaccaagccctctcccactgttaccacttttcttcgttgtacccgaattatttcatgtaaagatcacatgtgagcataagaattgaaac

SEQ ID NO: 4329 - DNA, 711 bp, Sorghum bicolor
  Clone ID: SORBI-28MAY03-CLUS76844_1
accaccatctccaccaccttcctctccttcctcctccttcgccgcgcgcccgcctacctcctgctcctgctcctgctcctgctcctgctcctcctcttacaaatacccaccaccaccacagtgacgccgccgccccgccccgccccgtcgtcccggtcgaagccaccacacaacaccagcagcgacgctttgcgttgcgtagctatagcctatagcactggagaccgccgccgccgccggacacgccgcgccagagcagtcttctatacaggaccttgattctgccgttagtgataccatggatgtgtcttatgagaagtttgctgatccatcaaactcggacctgcctagcgctgttgatgttgagcaatctgaaaatggcagctctgaacatttgggatctgcagttgtcaagggagctactggaaatgaaggttattcaggcatcgaaagttctgagcagaccgatgatgagttggctggagatgaaggctctcttgttaatgttgaaaatagtgctgataaacaagagaaccaggaaacggttccaatggaagaaacagcaatgagtgatggcacttcgatcacatcgatggaagatgcactggaaccgaataatgatctcccgccagagcctgaagatatgagcaaccacactcctgatccatcaaatggtaaatctgtcaatggaaatcgtaatgtattccaaag

SEQ ID NO: 4330 - DNA, 785 bp, Sorghum bicolor
  Clone ID: SORBI-28MAY03-CLUS7691_1
gttgtgaggcctggagcaagagagacaccgcttaaaggctacacctctagtcagcaggaatcaccatataccatgcaacgtgttgattcaaaaccaacagtccatggttgtgaggatgatgctcggagtaccttgacgtcaaacagatccatgacagatgatctgacaaggacgtgcaggtcagagactaactactcaaagggtgtaagtgagcacggccactttgatagcatccaggaaccggacctacagccgaattgcttctcgcgaacactcaagcttcaaaagaagctattgtcttctggcgcagcacacacaatctgtttgaggatccagccacataacaagatggacttcctgcctaagaaagaattcgatacatacttctgcgcatacgaaccttacgagcagtgttcaagatcaaattcaagagctacttacagttcaagagatgatgacttgtggagcaagaattcacgctttggttcgaatctactctgctggagggccccaaaacaatccatgtaaccgaggaaaggatgagcatactagatggaagacagcaattctgctatgacatttgccaattttgcccgaagctgtaaacatgaacaccacctgcggggacaatttttcaaggaaagtccaggagtggtctgtgttattcttgttctgagaaactgtttagtgatattttcttggtaatgcaggtcctttataatgctagtgggcagttgtacagcgcgccaatgatgaaaccctgtgtatactgaatagttctgtta

SEQ ID NO: 4331 - DNA, 636 bp, Sorghum bicolor
  Clone ID: SORBI-28MAY03-CLUS76922_1
aaaaaaaaaagcatctctctatctctgttttttaattaaaattttgtgcactggtagggatctcccccaccagtattttttgtaaaaaaaaaataaataaatcaggtggaaatgctctaagtatctgatcaaaggggacgtgtggggtcgttgtttcgtatccgttttcaaggcgcatgatgaaatggtttggtttcattttgttttcaaggcacgagtaaacataccttatatctaggtgagatccactcattcccttatggccttgtttaattccaaagactttgtaagatttctcgtcacatcgaatcttgcggcacatgcatgatgcattccaaaaactagcgcgagacgaatctttaaagcctagttattccatgattgaacaatattttgttaaataaaaacaaaaatgctacagtgtcaaaatttaaaattttttgcgaaccggaacatagtctcttacgcaagccttgtagtcatctgaaatcaaatcaattcagtcgtcgaaacgtgagcgaacaactgaggatagatgctggccttagaaaattaacatattggtcccagcaaatctagtctagaatagtagtgtgtgagatacactaggtgtaatttatgagtgcttaattaaaa

SEQ ID NO: 4332 - DNA, 751 bp, Sorghum bicolor
  Clone ID: SORBI-28MAY03-CLUS76931_1
ccccatcatactggatgtttgggcacaacacattgctgacccgttcatcagcattgatgctgtcgaagtgttagagtttttaggccatcaagaattctcctggatgcttacagccacttgtttctcgaatcctcccaacaattggatccattttagcgaaacccaaggtccagccagatggactggttgcaggttcactggaccttttgacgatggtactcaaaaatgctccagctgctgtggttaaagcagtcttcgacacatgctttgtttctactgttcaaattgttcttgaaagtgatgaccatggagagatgcaggtacatgctaaaacacggttcatttgtgtaagacataatctgctgccccctctctctcttcttcctgtccaggacaaaggcatcgtagtggttcagatcagctcatggctggccaagtccttggtcctgtagagtatatggcaataggccatactatgtactagtagaggtacaccagctgtatggctggtactagtgtagttgttggctgttttcagccttgtaccctaggtgtatgtagttggtagttctgtaccttagaaggtacatgtattggtgtatataaaccagcccaatgcaatggaagcagccgcttcttctgcccccccttcagtccctgtttcagtctgaaaccgtgtgtgctgtactgctgtgtgtgtgctgtgggagctcagggctcttcttctaccttggagcaggggagagggaga

SEQ ID NO: 4333 - DNA, 660 bp, Sorghum bicolor
  Clone ID: SORBI-28MAY03-CLUS77164_1
aaactcgagctcccccacactgcgagtccgcccaaaactccaaaagctctgcgctttctgccccccctcctctcctctcctctccccgagatcccatccatggtggcggccgccgcgcgtcgcctccggatctgagccccttccataccagccaccgcgggatattttccctagcgcttccgcttcgctggtccggccgccgcacgggttctttgccgtgcaagattcgccgctcagttttcgtggagtcggtagcgggtggtcggtagttgtccgtggctcggccgggcatgggttcctgaaaccggggtctttgatgctagcggtgggcgccgccggtctcctgccgtcatgtggaagcagtttcttggcaagatctcgcggaagtcccccaaatccagcggggccgggggcgggggctcgccgccggcgaagtccccgtcgtcgcgtggcgccgccaatggggcggaggcggagctgagcgcttcgtcgccggcggccttccccgcgccgtccggggcggagaccagggaggacgtgttcctccgcaagctcaacgtctgctgcgtggtgttcgacttcgccgccgagcgggggagggactcgccggaggtggagaggaagcggcaggtgctcgtgtccctcgtcgactgcgtctct

SEQ ID NO: 4334 - DNA, 743 bp, Sorghum bicolor
  Clone ID: SORBI-28MAY03-CLUS766_1
gcgttcggctgtctgggcaatctacgtgtggggcggggggactgatgagctaatggacggtcctaacgcatcttacatcacgccaactgctcttgatcgctgggagaagcgattggaggatctcttcgaaggccgcccgtatgatatgtacgatgccgccctctcagacacggtctcaaagttccggggggggatccagccgttcaaagacatgattgaaggaatgaggctggacttgtggaagtcgaggtacatgacctttgatgagctctacctctactgctactacgtcgctggcacggttggcctcatgacagttcctgtcatgggcattgcccctgactcaaaggcctcaacagagagcgtgtacaatgctgcactggctcttggcattgctaaccagctgacgaatattctcagagatgtacgctaagatgcgaggagggggagaatataccttcccttggacgagcttgcacaggcaggtcttacagaagaagacatattcagagggaaagtgacagataagtggaggaggttcatcgagggccagattcagcgtgccagattgttctttgatgaggctgagaagggcgtcgcccatctagactctgctagcagatggccggttcttgcgtctctttggctgtacaggcagatccttgatgccattgaggcagacgactacaacaacttcaccaagcgtgcgtacgtcggcaaggccaagaagctgctgtcattac

SEQ ID NO: 4335 - DNA, 555 bp, Sorghum bicolor
  Clone ID: SORBI-28MAY03-CLUS76603_1
gttcttcggccggttgggtgcccgccccttccatcctctctgctctgctgcccgctggcctggtctggcgttgcggcggccttgctgccggcgctggcggtggtttgagttggagcaaccgcatcatcagctgctggcgtctggcgaggccggatcgaaatcaatggcggcgaggtgacctcgtctttcccccgcttcagtagtccggcggccgcgtcctcctcctcgcctccgatcctccgtcccccctgtgcggtgcgcgtgccagcgaccaccgcccggattagggggagaagagaaggcgtccccgaggaagagtccgctctttccggcagccgtttctccagcaggcaggagggctgttcaactccagtgattgattgaattccttcgcgaggccacgaaattggggggatttcttcatttcctcactggcctaaccggcaggaaagcagcttttttcgcgaggttctcggcttgatttcctcgtgcggagggccggccggtgcttgtacctctacctcggagcatgcgtcgcgtccgggtgtcctccca

SEQ ID NO: 4336 - DNA, 633 bp, Sorghum bicolor
  Clone ID: SORBI-28MAY03-CLUS7660_1
cccacgcgtccgggctcttccccctgtgcttctttgcgccggtgttttctcttccttcctgccgcggcgatggcgtcgggtgacaacagcaagcagaggagcgaggaggagtggcgcgccgtgctctcccccgagcagttccgcatcatccgccagaagggcaccgagttacctgggacaggagagtacaacaaattctatggcgacggggtttataactgtgctggctgcgggactcccctgtacaagtccaccacaaaatttgattctggctgcggctggcctgcattctttgaggggcttccaggagccataaaccgaacaccggatcctgatggtaggaggacagagattacatgtgcagcttgtggtgggcatctgggccatgtgttcaagggagaaggcttcaagacacctactgatgagcgccactgcgtgaacagtgtttctatcaagttcagtcctagctcctagctagatcatcttccccctggatgagattctcgtgcctggaactgtgggggagcacagcgaaacgatgaataagatctattcagcacatgtgttatctgattgagagatggatctattaccataatcagttgttactctacgtgatttgtcatttacatc

SEQ ID NO: 4337 - DNA, 679 bp, Sorghum bicolor
  Clone ID: SORBI-28MAY03-CLUS76622_1
aatttggaccaaaggcggttgagctcatgactttcggacagccccggataggcaatcctgcttttgctgtatactttggtgaacaagtcccaagaacaatccgtgtgacccatcagaatgatattgtgccgcatttacctccgtattattattacctaggtgaatggacataccaccactttgctagagaggtttggcttcatgagagcatagatggaaatgtagttactagaaatgagacggtatgtgatgattctggtgaggacccaacctgtagcaggtcggtctatgggatgagcgtagcagatcatcttgagtactacggtgtcacactacatgctgattcaaggggaacctgtcaatttgtgattggtgcagccaactcagtttacagctacgttcgtgaagttgatggatccatcatcttgtcaagatatccagaagaaccacaagctctagaatctatgtgactttgtctgccacgaaatacacccctgtacagtatttttattttcattttgtgtacagctcatgaaatactgagcgctcccggagctctccagaggataaggagaggctcaccttttaaatgtgccccctttgctcaagtgagaattgtacatgtaagctccataagattgtccgcacaattcaattcgtatatataaataataccata

SEQ ID NO: 4338 - DNA, 736 bp, Sorghum bicolor
  Clone ID: SORBI-28MAY03-CLUS76691_1
ggcaaccgcagcggatcccccatatcctgagactgagtcctgacggacgcccacgtcgcacctcgtctccctgtctatacagcccgggccgcgctcataccgcccgggttgcgcctcctccacacgcttcccgtcggtctccctcccaccgcttccatcgtcttcctcctccccctcctcctcgatctctctgctagcgacatctctagctgcgcatgcatgcgctctctctgtgacattcattcctccctgcgtactgctgccgtctgattcttctccaagctctgatatactgtattcgaggaggggttacggccggattattagctgcagcctgcagaagatgatggacgtggtctaccatgaggagtacgtgaggaacccgaggggcgtgcagctcttcacctgcggctggctgccgccggcatcctcctccccacccaaagcgctcgtcttcctctgccatggctacgggatggagtgcagcgacttcatgagagcatgtgggatcaagttggccacagcagggtatggtgtgtttggcatcgattatgagggccacggcaagtccatgggcgccaggtgctacatccagaagtttgaaaacctcgtggctgactgcgacaggttcttcaagtccatctgtgatatggaggaatacagaaataaaagccggtttctgtacggcgagtccatggggggagccgtggctctactactgcacgggaaggatgcg

SEQ ID NO: 4339 - DNA, 656 bp, Sorghum bicolor
  Clone ID: SORBI-28MAY03-CLUS77035_1
tttgcaaacattcttctttgctgctgccttttcctctctccttcatatctctcgttttatttcctactacttttttccttagagatcgctcgatctttgtgatctttttcttcccaattcgattttgcaaacttgatcatcttctttattgcgtagtagacgcgttgacagtttcttaaatcctcttttaagttgcgtggtttatgcacagcattggcagcttctctcttctgtttgggttgtgcatctcgtcggcgcagaagccatgtccacggtcgggagcggcagccttagcccgccggccgcggcggcgtcgtcgccgccggcggtggtggaggacacgagcagccactgggcgccgcacgggccggtgctgacggcctgcgtcgtgggcatcaacgtgctcatgatcctcctcatcttcttcttcttctggcgctacttctccgggaaacggcggggaccgtcgtccgcgtcatccggcgacgacgacggcgcgtcgtcatccgcgtcgctgcccgtggcctccccatgggcatgggcggcgtcccgccaccagcggcgcagcagcaaggaccacggcccgcagcccgggggacgacgtggcgtcggcgctgcccgtgtacgtgtactccagcagcgccggcggtggcggc

SEQ ID NO: 4340 - DNA, 550 bp, Sorghum bicolor
  Clone ID: SORBI-28MAY03-CLUS7702_1
gcacgagggcaaaccagatgatctagactccttctttggtatgggtgcccgagctaatagcgctccgaggcaaagggctccgtgaacgagcggtatgttgctacactaattaaaatagtcatttctatggatacatctatgttcctggatactaccttcaacagcatgtgtctaaaatgttttgttgttgttgatgatgttgtggatgccatcatgttcctggttaaatttagttgtaagcattatttttaggataaggaaattgcaatgcttgttttttattagttccctgtaccgacaggcaaaggctttggctgagaagaatgaactagacatgcagcaacaaagagagcaggctgaaagacataggcttgcggaaacactgtactttgagattaagcgctgggctgctggaaaagaaggcaatttgcgtgcattgttatcaactttacaatatgttctttggccaaaatgcggatggcagcctgtatccctcactgatttgatcactgctgctgctgttaataaagtgacaaaaaagcaacatttt

SEQ ID NO: 4341 - DNA, 746 bp, Sorghum bicolor
  Clone ID: SORBI-28MAY03-CLUS77044_1
cacaccctgaaacctcctcctttcttcccgcaacgccgccactccccacctcatgatgccttcctcccgtctccccttcgcctcccctcacgccaccacgcggggatgctcggcggtgccagcccagcccttgcacggacacctggcatctccaggccagcatgatcggcgggacaagcagcggcaggcctcgatataccaaaccctagaggtcatggggatcggccttggcttggacgaggtccgatcccaacggcgccgccctggtgcaggtgagcgtcgtccctagccgtcgggggcgcggtcgacgctgcccccccccgggcgggcgtggcccgccgccccttcgcggcgcctctggggtcgcgccgtcgcggcggtggtgcgctgcgtgtcggcggggcacaacggcggggcgcaggggcgatgtcactctgcgtatccgggcccagggtcaggcggcctcgcggcctgggtcggcccgggcgccgttccgtggcagcgggggtggctgggccgtgtgtgctctgacccccgcccgtggttcgggggcgcaaggggcgggcttcttgctaccgcaggtgttgtggcccgctctctggtgaccttgtgctcctttgctttaatgccattctaaaaggtagggaacattaaattagtgccttgcacattcagtgttgggtaaagtttaacatgttgtaggtaagaattatccttttttggttttgtttttaattttccctctc

SEQ ID NO: 4342 - DNA, 500 bp, Sorghum bicolor
  Clone ID: SORBI-28MAY03-CLUS77093_1
ttgaaataccagagcgatgaagctgcacaatgctatatttgccttgttgaatatgaagagggagattgtctccgtatacttccatgccatcatgaatttcatctaacatgtgtagataaatggctaaaggagattcacagggtttgtccactttgtcgtggcgatgtctgcagatctgatgcaccgagtagaaaggtcagctgattctgtctcttgagaatgcagctcttacagagaaaagtggagctcctggcatggttctttgatccaattccgataaaacctgcaaaacttctgcagatgttattttcatttcccccatctcttctggtcagaacagcgcaggatgctcctgtattctatggaaaattcccatcgcagtcatcctcattgtgaaactgatgacatgctatggtgaatttaggattctgtatggggcgagtttgttgatattggattgttggcttccgtttccttataccgatgtgatcatgtgacgt

SEQ ID NO: 4343 - DNA, 489 bp, Sorghum bicolor
  unsure (1)..(489): unsure at all n locations
  Clone ID: SORBI-28MAY03-CLUS7711_1
cttctctctctcgccgccccaaaatccttcctcagagatactcccggccgacaactcccgcgcgtgccgatccctggcgaaatagcgagcgcaaccgccaccgagaggtcgtcccttctcttccagtccgcgtcctccttgctgctgcgtcccggagcggagttgagtcgagatacaaccggccgattgatttctctcctgcgctgtcaggttttaattgaggtagagaaagatacctttctgtccggtcatggctttgccagctgcagcagctgtttttcttgatgagaacatgcagatacataaagaaaacagggttgatgcaccaagtgccaaaccactgaaatcatcagcaaaacctgagaggaaggctcttcaggatgtgtctaacattcgtaaaggcactgctttaaagaacagatccaccatcaaagagaggtccaccttgaaagaaaggcctgcacttnacgatgtgtttaacaaccttaa

SEQ ID NO: 4344 - DNA, 589 bp, Sorghum bicolor
  Clone ID: SORBI-28MAY03-CLUS76750_1
cgtgctgccgcgccagccgcgacggcctcgacagcaactgcaaatgcagcggcgctagcagaagcaaggccgggcccaagaaacagcagcagcagccgaagcaccgcgcccacaagatcgccgccggcgagggcgccatcaacatcgccgtgcactagccgcgagtttctttccggtgatggcgatggcgtgcaaattttcttctaagttatgagagtgctttgacggcttgtggattttgtgtagataataataagttatggtgacgatgaacgaacgaacaggggctcgatctgctgccacgagtgaattgaagccggtcactcagtcagacagaggtggttgtgtttattgtttgtgttgtttatttatgctaatcttatttaagttgctgttgaggatggccatggcctgcacattgtcgctgtgcagtgctgtttgttttcttaatgtaatttattatggggagtggtaagaaagattgagtgttggatgtaacttgtacaaacgaaaacaagggtttgttggtggtgatggcagtactatttatctgaatgaatgaactatgctcactcgctgcacttctgtg

SEQ ID NO: 4345 - DNA, 871 bp, Sorghum bicolor
  Clone ID: SORBI-28MAY03-CLUS76781_1
tgtgaaaacgtcgagcacgatttgctacccatattaacatgattgtactaaaatatacggctgtattgttgctgttgttttgcttccgagatagtgcttgcaacaatttcgatccgtgttcaaatccagccaaccaaaacctgaccgttccctttagggaggtagctatcagttatacaagtctagatgctgcctaccgacagaacatttatctgtacgacgcaaccaactgttacctgcttaacgcacaatactacagcgtataccaaaacgaaacggccactccaatgacgttttcattgtaccttttgggctcattacaaaacgtgtgcaacaacagaacgatcctcggaacaatcgatcttaccagcacctttccgacgagcaaatcgctgattacgtactccaagaactttgtcaacgcaacagtagcttcgtttagtgttgtcggaacgttctcgaacggaactgtttcatcgccagttaatgcaacctttggcgaagtattgtttagttcaaataggacgcgtccttatgatcagtctcaaacggatgagctcgtcacctacgataattcaccgtgcactattcgcacagggaccgacagccaacttgtggttcctctttattcacatagtgcacccgtagatcttcaatttgcaaacggtactgtaatgcacttcatttttccaaccaacttgatatgcacttcacgccacgatcaaatgaagcagtactaccagcaatgtacttgtcgggcaggaacccaaactcagtccgcagaggaaactagaattagtctgttaaatactgttgaggcagctgattgctgaattcaacaccataattaaataaacgttcgtttcgggtg

SEQ ID NO: 4346 - DNA, 674 bp, Sorghum bicolor
  Clone ID: SORBI-28MAY03-CLUS76813_1
ggttcctgcagtgatgcttcttgtttcctccctgtaggcgttgggcctgcgattgtgctccccccgtgggcttcccgcttgccattccttcccctcaagcttcgccgtcccgctgctcctctgcctccggctaccgtttgctgtgcggggcaggcgcctgggtggcgtcgtcgggggtcctctgctgggttcccgctctgctgcggcctgtggcttcccggaggccggtcggccttcgtgacttcaccccgccacaggcacgcgccgctggctgccggtccgtgtccagccgttgtgggtcccttgctttgggggccctcggctgggccctgtggcgtggacaccgcctggccgcctgcgcgccatttacctggcaccaacgctggccccttcctgccggaacctgtccctgcgctgacttcccccccgccctcgcgtcctcggtttggcctggtggtggggtctccgtgttggcacatgcgccccattgatgcggcatcaggcgggtgccattcttgtgggtcgctgcttctgcgcactcggccccccctcccccgcatgcttatattgtcatggtgaatgaattttggaattgtgacatgtgacccattgatgcgggatgaggctgttgtaataattgttgatctgagctttaaggaacttggaacctactt

SEQ ID NO: 4347 - DNA, 594 bp, Sorghum bicolor
  Clone ID: SORBI-28MAY03-CLUS76818_1
cgggcggccccgtcggggtggtcgagctgccccgccccgcgctcggcgcggcccgcccccccgcgctgcgcgcgccccgcgccgcccccgccgccggccaccgcctcccccgccgccgcccgcggcctctccgtggctcgagagcagggggctcggctgccccgcccgctggggcgagccgccggggctgccgttgttggagatcgcgggcccggtgcgcccactgtgcagagcagagaagagcgtgttgttgcctgagagattgccgccgcgctcgtgcccgaggagcgggggcggcccgcgcgcttgggcgaactgcttgtgctgccgttgtttgagatcggggtgccagtactcctactgagcagagtagagaagagcaaataataaccaaatagaaagagggcgcgcaggtgccagaggagaggaggcgagaagatgcgagttgctggctgtctatggcgccatgagcccatgatatagccccccaatgtaactttttactccttgttacggcgcgtgtgtccgaattaccgccaggcctgggccctgccaccagcggggaggtcaaggacgcaaggtctcaaaccaaat

SEQ ID NO: 4348 - DNA, 619 bp, Sorghum bicolor
  Clone ID: SORBI-28MAY03-CLUS774_1
ttttagaggacgaatattgcaagagcatttacatgtttcaaattttcacatgatgcgttcacaaaggctatgcatctctacctaatagtacatcatcacaacttgtacctaatagtagtactaatacatcatcacaacttgtatttcatgcccggcctggccactaggcactaggcagggaactccatctggtcatcagccttgtcactgcccagctgctgcgatgtgttgatgacttgacttcacattgcgaggaaaaaactgacatgtatggacataggaaattcctacctcacctactctctccaaataacccaacacaatgctgtgtgtgtatattaatgtagtgttcctatgcgtacaagaggagtcggtggtatgcaatattcacattacacagcaccgtgtacatggataattcctagtgcacctcacaggtcactggctcactgatgagatcaggtgttcttctccaggaccgagagcgccggcgccaggtagttgttggccttgtctggcagatgagccacaagttcatatagctcgctcccttgctctgaacccacgtcatcgcggacgtcgaagctcttgttcctcgcggtcgaatcgtgcaacgctt

SEQ ID NO: 4349 - DNA, 729 bp, Sorghum bicolor
  Clone ID: SORBI-28MAY03-CLUS77342_1
tcatgtactgcatacttgatgcaactgataatgaacagtgcataccaatagccaagcgcccagatcttaaactgtttcatggacctcatcgttattgtggccaagtttcatacacacattgtacctgttaggctgttacacaatgctccagcctgctaaaatattgttatttttatataaatttatcattcatctagcattatggtgtcatcctatgaatgtgcccgacaaatttgtgcttttcattttctatcccattgctgatttgaattcatgttatgctcaggagagaactgaagctaaaaaaatattgttctccttgttgggagcttgatggagacttatcaaggtttcttttatagcatgggcagaacaccaaaatcttgtcctccttgaaggtcacaaggtacaaaattcatttatctttgagtgcagcttgagatataaaacaattcttctctatttctttcatttgtttagtgagttgggtctctgctttcatgaaacaagtgaaggcagacaaaagaattttttttgctttgtcatttggcgatctttatggtatacatgtcaagcgcactactttgtgcctctttttcttaggctctgtacttctgttttgtatatatcactgtccataatcaattctccgcgagaaatatttatggtgccagaacatgcccaagaatgtggaccatctgttttcagttttggttgtaagtgatggag

SEQ ID NO: 4350 - DNA, 918 bp, Sorghum bicolor
  Clone ID: SORBI-28MAY03-CLUS77425_1
accctgacacgcctcacgcgagcgagcgcgagacacagcaccccagctcaccgtccccaccgagtcatcacagaggccagccacctcgagccccctcctgctccgcacctgccgccatctgcgctgctctgcggccccagcccggccagagccggcgcgcccccgcccccgccccccgccccgttgacggaccccccaccgttctcttctccccgcgctgcgcggcggctggccaggaggtcagttaatgcgcccgtgacaggcggcggcgagcgagtccttggcgggcggttggcggtgtcggcttaactaaaccccgccgtctctccaggcggcgcccgcggaggatcaggcgggaggccgaggaacgggggaggcgggtttccggggcgcgggccatggggggcgccaaggcggaggacaagcccgccgccgctgccgccgccgccgcagctgcagacgactggtgctaccagtttggaaacaagaatgcatttgacttgaaggccccgaaaaagtcaccactcccattgagaatggttgtctttgctatgactatgttatgtgggatatctatttgctcaatgtgtatgaagcaactagggagtgatggctggtcaagaattgtcaagattgaagttgcggaacaaccatgtaacaagtccactgttcctccttctgaggttcaatttgtgcattatcctcaaccaataacttacagcagggaggaatgcaagtgcaatgctgtccgattctttgcaattatatcatcacagcgatctggaagtggctggtttgaaacccttcttaacagccacatgaatgttagctccaatggtgaaattttctctagaaaagaaggagaagtaacatttcctctataataaataccttggataaaatatacaacttggattg

SEQ ID NO: 4351 - DNA, 1098 bp, Sorghum bicolor
  Clone ID: SORBI-28MAY03-CLUS77432_1
aaggcggcagcaccatcagcccccgtcggtgcctatcccccagcgctgcagcgaccctcctcctctccaccatcctctatgcaggctcctctctccctctcgctctctaatctccggtttcgctccttctctcactctcctcgcgcgagttgggcgaccatgacggcggcggtggtccgtgcggtggcggctggtggccggcacggagggtgccgccctccctgggcgggcgggcagggcgacggcagcagcggccggccctcgccgtggcgacggccgccttcctcctcctccctccgcaaggcatggcgctctttctccctctctcttaacgcaggcagggcaatgcgcgatggtggccaggccttggcatggcggcggtcgtcctcctcctccctccttagtgtgccacgagcggcatggcagacacccctaccgggtgtggccccagcacgacgggtgccctctccctggacaggccatggaccctgcgtccgccccgtccatggccgtccacagccacggcgccgcgacaacagtcaccgagtgccccccgacgcttcatgtggcgttgctcctttgcacgatttgtgcgctggatgtcagatttggaggggatgaatcttggtcaaacgatgcacatgcacaaggcaaggtcagattcaccctagacctattgttcttcccttttcttttaccattctatatctatatggttactactactatttttatttttggtgttcagtaggtatggcccgctcggttcgagtggagcttcagagcaggcaattattgtgccatacatctgagcatatgaccatgtcaatgatatttgtttgatttcttattgatttacacccatgatggttcctggtctaagcattggtcgggttcccttagcctatcgtatccacgttagcataattaatttgtgtcgtttgatctcttgtcagcggttcatgttctttccaccatccatttactgttctccatgtgttgatctgtgatgggctcaggggaaaaatatcattgtcatcttctcaccttctccgcatcacctctgtgatatgggttggtgctctattgtttggatct

SEQ ID NO: 4352 - DNA, 732 bp, Sorghum bicolor
  Clone ID: SORBI-28MAY03-CLUS77456_1
ctactgcaccacccccctgctcctcctcgcagtcctagtctagatctccaccgcgcgcgcgcagatccgccacacctccatggcggatctcgccgccgccgcggcggcccctccgccggccacggacctcttcggtgagccgatcgaggcgcaccctccctggttcaagcccgacgccttcctccgcgccggcttcgacccggacgcctacgtcgccgagctccgctcctacgtcccgctcgagagcctcgccgccgagctccgcgcccacctcgccgcgctccgcgccgagctcgtcggcctcatcaaccgcgactacgccgactttgtcggactcagcgcccgcctcaagggcgtcgacgccgccgccgcaaggatgcgcgccccgctcgccgacctcagggacaaggtcgccgccttccgcgccggggcatccgccgcgctcgccgcgctacgggcggggctcgagcagcgggccgccgcaaccgccgcgcgcgagctgctcgagctcctgctcgacacctcccacgtcgtctccaaggttgagaaattgatcaaggaactaccaactgcaccatcagattcatcgaatgccgaagttcctaacaatgacactggaacgccaaatgtggaggctgggacaggtgtcagagaaacacaaagcattctcttagaaagaattgccagtgagatgaaccggcttaaattctacatcagtcatgcacagaacat

SEQ ID NO: 4353 - DNA, 580 bp, Sorghum bicolor
  Clone ID: SORBI-28MAY03-CLUS77486_1
gatgcaaagcgaactgcaagaggagctcctggacccctgtatgactatgctttcagactagaacaagatatgaacaagagcatggagacagcgaaagaggagaattatcgtgtatatctttttcgcattccggctgccgaatcattggcctctctaccagcagcttcactcgtccgttctgcatccttgagtgagatcttggatccgaagacagaaagtagcactcaatctccataaatggatgcttctgattatggtaaaattatggaatggtacgcccatagtagtatttgcatgtaaagatttccctctatagcagaatttgtagggttgataatgttcattatattcttatttggttgttctgacggagtctaaataggtgcacattcaggtggtgatatttgcggggatataactaaatatctgcgttgatgcgtttgagatatatgttatgctgcccttggatgggaagttttgcgtctaggtagtttcgattcatcagttctacagacctatcctgttggggttttaagtaaaatgagatatgcgaactctattctctgtgtaataaatatca

SEQ ID NO: 4354 - DNA, 622 bp, Sorghum bicolor
  Clone ID: SORBI-28MAY03-CLUS77482_1
ctctttctcctctctcccctccgccgcggaaaaatggaggccaccgcgcccgcgctctcgctctcgctcgcgctccactcgtccccggccgtcgcccgccgctcggcagggaagccaatcttcgcctacctccaccgtggcgggccttccacggcctcctccgtccacctccgcgcgtcccggacccccgccagctctccggtatggagaagacggaggagggggagcgggctggttgtgcgcgcggagatgttcggccaactcaccaccgggctcgagtccgcctggaacaagctgcgcggcgttgacgtgctaacaaaggaaaatatcgccgaaccaatgcgggacattaggcgagcacttctggaagcagatgttagtttgcccgttgtgagacgatttgtttcatctgttagtgataaggctctaggtgcaaatgctatcagaggagtccggccagaccagcaattagtgaagattgtgcatgacgaacttgtacaactgatgggtggagaagtatcagatctggtattttcaaaaagtggcccgacagttatcttgctcgcaggtctacagggtgttgggaagactactgtttgcgcaaagcttgcattctatttga

SEQ ID NO: 4355 - DNA, 586 bp, Sorghum bicolor
  Clone ID: SORBI-28MAY03-CLUS76935_1
gcggccaccggttccacgccgactgcgtcggcgcgtggctgcggctccacgccacgtgcccgctttgccgcgccagcgtcgtgccgccacccagagcggcggcggcggcggctgacgatgagtccatggacgacgccaaggacgacggcggcagcggcggcggcgcggattgtccggtgtgaggcgctgtgacggcgctgactgctctggcagtgccaggcaaggcaagcaggcggagcacgtaagcggcggatggtgatggtggcaggcatctttcggcgttggtgtccttgtctgcgctcgatagcagcagcagcatatgctgatgagtgatgagtgtgtgcatgcatgctccaggtgaccgaccagcagctggaaattattactagtaaaaggacaggtaggtggagacgttcgtcgcggttcctccccgttctgttgtgttaattaagtttcttataattgtcagggattattacggaatataggtatatggagtcatataaaagtacatgtatgtgagatgcttatatgattattggattttgtgatgagatacaagtatgtttttttttttacaacgaga

SEQ ID NO: 4356 - DNA, 599 bp, Sorghum bicolor
  Clone ID: SORBI-28MAY03-CLUS76943_1
ataagctggtgccggggtcgcggtgtttgaatggcctggtgtggcggcggcgcattggtacgtcagttccaacgttgagttgacgatggaggtcgcacggagtcgtcgcactgatgatggaggttgattgatggtggagcggggggcccacggaggagggtcggtggtggcggaggcggcttgatgatggcggcttggcgatggccccttggaggtcgcactgatcatgggggcgcacgtcgtggtcccgtgcgagagcggagtggagtgctaggtgacggcggcttggaggtctgtgtgagagcggagtggagtacgcgtgattttgtttggcatacgtgttttttttgtttctttttggagccaagacttccgtgcgtagagatcatgaatagcccagagctgatggtttgaactcctccagtttgaactcctctaactttgtagtccaaagtagaagtgggtgctttctttatcaccattctttacttttcagcaactacgtgtcactcgaaatcagagattgctaggaaccttgcttgttggttgttgctactgtcactcaaaatcaattgttgtatattggaaattccagtttt

SEQ ID NO: 4357 - DNA, 853 bp, Sorghum bicolor
  Clone ID: SORBI-28MAY03-CLUS76968_1
acaggaggaacaggaacaagcaagtgtggaccgagtcagctaagatggtcactgcagtttaaggaggtcaagatcgtcgacttaagtcaccattcctaaccaaaaaggactacccagctccagatggcagatcagacactccgaaaggttaaaggttattgacatgggagaagacgaatacgatccacccgtcatccttggaagaccgtttctcagcaccgttaaagcaatcatctgcattgaaaccggagaagtccacatgcacttcccctctgagaaggtacgctgctattttactgaccctaaccatatagttgaagactctaagcaggtcaggacaagaagatgacgacgcaaccgcagccagaggaggcaaatcatcaaggacggatgggcagactacgaaggagaagtggtaaggtctgaaggcatactgcttgaacagaactgtcctgaggagaccgtagcaccgagtcaggtgtggagagagaagatagttatacacgaagaggaggcgccgccggaaccaccgactacgccatccagcgaatcccaggacgaccgaggaaacggagagtcccgttcggaggacttaaaaacaccgaacgccttgccaagaggtccacttggctgtgttccctttccgtgctgctcttttttcatagttggcttgctgacgcaggtcctcctcaccgctgtcaggatgctgccgacattcaaatacacctacgccacctgctagctacatcagaagaaattgcgtcaaaatctagcttgggggagagcacccctatttattcagctaagtgttctactcatgtttatacttttactcaaataataaaaagatgca

SEQ ID NO: 4358 - DNA, 647 bp, Sorghum bicolor
  Clone ID: SORBI-28MAY03-CLUS76992_1
actttagctcttctcttccctcggcctgtgccttttcctccatcatgcatggttgcccctactcaccttgtgctctcctatggtggccgttcctgtggagctcctcctttggcgccctccttcttcatccccgttgtggccaaatctggcgagggtgcaccaatggagatgagtacctttgcttcttcgtgccgtcagattctcctccgtatgctcatcgtacctccttgatcccgacggccaagctcacctctatcctctacaccgtccaattcctcctccccacacaccttgttgagcttcggtagctataccatctcgtgcctccccaaggtcccgggtggcctaagggagtgcgtctagtgctctaattttttttttttttttttttgtgctttgtgcttaataagacaaccttttgtcccttattttgtacgagtcaacttggtagttgagcatctccattggatatcgtatccaatctcctatacctgaacatagtattttacaagatgaaggtacgtggcacaatagatctcttatcttatctcctttgctataatctttaagtggtatcctaaaaaaaaaaagcatctctctatctctgttttttaattaaaattttgtgcactggtagggatctcccc

SEQ ID NO: 4359 - DNA, 750 bp, Sorghum bicolor
  Clone ID: SORBI-28MAY03-CLUS77001_1
ctactgggctgtggaacagtggaaaagccgagccgaggaagggcaggcagggaagggaagcgaacccctcgtgaccggcggcggcggcggggggcggtgccgccggggaggacccgagccgaggagctgtgggaacgcgaggtcggcagcctcccacccaagcgcttcgccaactccgtcatggcctccaaggagtatgtgcagtctctcaacatccagaagcggctacggaagcacaggggctgcgtcaacacgataagcttcagcgccgacgggagcctgctcctctccgggtccgatgaccggaccctcgtgctctgggactggcaggaggcggcacccaccttgtcgttccacaccgggcacagaaacaacgtgtaccacgcgctgttcatgcccgtctcggatgatcggagcatcgtctcgtgcgctgctgatggggaggtgatccattcgcagatagaggaagggggtcgcgtgattacagacaaactcgttgagttggagtttgcggtacacaggttggctgttgagccggcaagtcctcacacgttctactgctgctgtcaagatagctccgtgtggcattttgatctcagggagggaaatgccatggaactatttaaatgtagagctgcagcctattaccctggtgaaaacaccgcgctctatgctattgccttagacccaaggaagccctgttgttttgcagttgctggatcagatcagtatgtaaggatatatgatacc

SEQ ID NO: 4360 - DNA, 592 bp, Sorghum bicolor
  Clone ID: SORBI-28MAY03-CLUS77536_1
ggacgcagccatgagtcacgcggcgctgggcggccccggctccgtccacccggcgtggactgggcgccggcacgagccgtgccgtgccgtgcgacgccgcctaacttgcttgacccgccatttgtttgtccggccccgaaagcggcgggcccgacgtggacgccgccgcctgcccgccgtcgaccacctcgaatacatatatttttcttttctctaccgtgaagccgttcccgtccgtccagaagcaggccgtgcccgcgatcgacgtcgcgcatttatcggcgcagcaggaagccgaattcccacggctctgccgtgctctgctctccaccagcggctccggcgagagccctatttacttctgctgctggcgagtgggacaaagcgccacgacgacgagctaaggccttgtttagtttgcaaaatttttactttttgacaactgtagcactttcgtttttatttgacaaacattattcaatcacgaagtaacaaggctcaaaagattcatctcacaaattacagataaactatgcaattagtttttatttttatctatatttaatgctccatgcatacgactaaagattcg

SEQ ID NO: 4361 - DNA, 644 bp, Sorghum bicolor
  Clone ID: SORBI-28MAY03-CLUS77570_1
aggcgtggagagccccgaacgcggttttgagtacacaagcgagcgaaaaaagaggaagagagagagaaaagaaaaggagaggcccgcgactgtagtggggagatgtctcggcatgctgccccggcggcgccgccgccgctaccggagcgcggcgagatggacgaggtggtagaggcggacccggatgcggaggcggaggatcaggaggagaggtgggcgaggcttctgccggagctgctctccgacgtggtgcagcgcgtcgaggcgtccggcggcgagcggtggccggcgcggaaggacgtcgtctcatgcgcctgcgtgtgccgccggtggagggaggccgccgtcgctgtcgtgcgcccgccggcggagtccggcaagatcaccttcccctcatcgctcaagcagccagggccaagggagagcccaatgcagtgctttatcaagcggaataagaagaactctacattctacctctaccttggcttcacaagttcacctgtggataaagggaagtttctcatggctgctagaagatttaggcgtggtccccatactgagtacattatatctcttgattcagaggacttatcacaagggagcaatgcatacatgggggaaactgagatctgatttctggggga

SEQ ID NO: 4362 - DNA, 534 bp, Sorghum bicolor
  Clone ID: SORBI-28MAY03-CLUS77581_1
aacagtccacctccacgagtccgttcgtggcgtcaggccaatcatgtcgcggccgccgtcgccgatgctctcggtcccggagaagaagaccgccgccgccgagctcttccgcgaccgccacttcttcggcgccgcctccttctccgaaatccgcgacgcccgcgccgtcgtcgccgtcccgaacccgcaggcgcagccaccggcctcccgccgcgccctcctcctccgctaccaccggctcctcttctccgcgcgcgacgacccctgcgccttcgacgagacgctgtccttcgcctggcacgacgccttccgcccccaccttaagcacgccgccgcctccctccgcttcgagaaggccgccctcgtgttcaacgtcggcgcggccgcctcgaggatcgcggcggccgtgagccgcgccacggaggaaggggtgagggcggcgtgcggagagttccagcgcgccgcgggggcgttccgcgcggtgggggagatgatggaagaggaagaggcgacgacggtggatatgagttctca

SEQ ID NO: 4363 - DNA, 694 bp, Sorghum bicolor
  Clone ID: SORBI-28MAY03-CLUS77594_1
acggccacaccgctcaatccagcctccgcctcgccgccgccgccgcctgtgccgctccgggcgcgccgcgtccatcagccatggcccccctcgcccgcactctccggagcctcagccaggcggcggccgcgcgggagggccctctcctcgcgtggctcttctcctcgaggtcggccgccttctcctcctccgcgccgccggagtacgacatgccgtcggtgacgtggggcgtgatccaggggcgcaaggagcgcctcgtctctcgcgtactggcgctcgacttcctccgctccgcgggcgtctccgaccctgccggcgagctcgaggcggtcgagctcccctcctccctcgaggtgctccaggagcgccttgacttcctcctccgcctcggcctctccactgacgacctctccaactacccgctcctcctcgcctgctccctccggaagaacgtcatccccgtcctctcctacctcgagaagctcggcgtcacgcgcgcccgcctcgccgctttcgtccgcgcctacccggcctgcctccacgcctctgtcgccgtcgacctcgctcccatggtcaaggcgctccgtggcctggacgtcgatcgccaggacctcccccgcgtgctcgagcggtaccccgacgtcctggggctcaagcccgacggcacaatcagcacctccgtcgcttacctcgt

SEQ ID NO: 4364 - DNA, 511 bp, Sorghum bicolor
  unsure (1)..(511): unsure at all n locations
  Clone ID: SORBI-28MAY03-CLUS7755_1
agagtacaatttattttgttataaaattntaaagcacttcagtcgtcctcctaccttacacatcactttttgaaacatctaccttacacattatcatcaagtgttaatttctcattctcatcaggtacttgaagtaccacgacctacacggaggtgaacaagaatcgaggaaatcaaattacactgatttggtgaataagtactatgatcttgccactggcttctacgaatatggatggggcgactcattccattttgctggcagatatccaggtgagactttccgtgaagccatcaagcggcatgagcattttattgcactacaattggggctcaagaaggggatgaaggttctggatgtgggatgtggaattgggggacctttaatagaaattgccagattcagctcagcaatgataactggattgaactacaacgactaccagattctaaggggcaagggttttattttaacctttctttttggaataaaaaacctttttggcatttt

SEQ ID NO: 4365 - DNA, 680 bp, Sorghum bicolor
  Clone ID: SORBI-28MAY03-CLUS77630_1
aagtctctcctctgcacagaggaagaggactctgaccagtgggactaggctgcccccatcgcctactcctgcctgcaggactccgtctcgccgccgccctgctctcgccctccctcccagttctcggcgtctcggaggaagtgacgaacgcggactcgcgctcgcgccgtcggagggagggagatccactcggagcatgcgggccgccgcgcgctagatgaaactgaggaacacagcaataacacgagcaaattcggcctgttttccaatgggggatcgtgttggtgtgaagtacaacagcgtcaatgagggtgaagagcgtaagggagggcatggcatccccaaggtttccatggtacccctcatattcctcatattctatgaagtttcagggggtccctttgggattgaggatagtgtcaaggctgctgggccactactagcaatcgtgggcttccttctgtttgcgctcatatggagcattccagaagctctaatcactgctgagatgggcacaatgttcccagagaacggtggttatgttgtctgggtttcttcagctcttggtccgttctggggttttcagcaaggatgggcaaagtggctcagtggtgtcatagataatgccctctatccagttctttttctggactatgtcaagtccagtgttccggctcttg

SEQ ID NO: 4366 - DNA, 676 bp, Sorghum bicolor
  Clone ID: SORBI-28MAY03-CLUS77198_1
acccctcccgtcctctttctcgatccctctcgaaataatgccggtcctctctcgctcttctccttccctctctccttgtgcaggcagggcgacggcagctttacctccattcttccctcccccaccgcacgcgtcgcacgggcagtgcaccggcgatgcccgcccggtcgctccctcccgaagcgagccgcggctccctctctcccccacgcaagcggcggtgatgatgaccttgggatgcagcgcccctacggtgggtgtccccgtccccggccatggagcgacgcgaccaggccccggcggtgccacacggcacggcttccccttggtgctgcctctgcccccgcctcgcgtatgctcggtgaaaccctagctgctcttcttcgccggccatgagtgtggctccgctcggcggccgcaaccggtggccgcgccccccgcgacggcagcagcggccgtcgtccccacgggctcccccgcgctgtggcgccaccggcacccaccaattgcaggtaaacccagatttggagatggagctaaactcgcaaggatgatctaggacatttcaacgatagtcagtaagatgtttgggaactggagtaaaaaatttgacgatgcttggacgagtctatgctaccattctctaatttgattcgatttgcaattctgcaggacg

SEQ ID NO: 4367 - DNA, 800 bp, Sorghum bicolor
  Clone ID: SORBI-28MAY03-CLUS77222_1
gcgcccccgagtactgccacgccaactttaccaagtacttcaccggccggttctggtcggaccagcggttcgccggaacgttcgtggggcggcgcccgtgctacttcaacacgggcgtcatggtgcttgacctggagcggtggcggcaagcgggctacacgcagcgcatcgagcgctggatggagatacagaagtcgccgccggggcgcatctacgagctgggttcgctgccgcccttcctgctcgtgttcgcggggcacgtggcgccgatcgagcaccggtggaaccagcacggcctcggcggcgacaatgtcctgggcagctgccgcgacctacacccgggacccgtgagcctgctgcattggtccgggtccggcaagccatgggcgcggctgggcgccgggcggccgtgcccgctcgatgcgctctgggcacccttcgacctgtacggccccgccggcgccggcgagtcccggtaaccgcaacactcgaaaaagaaagattcttttccttcttttgccaaccccgtacaaattctgagcttctaaaatttcttggtctccccattacctgttcaaacctactcatatatgttttttcatcccttttttttccttttttaccccctgggcagttggattaaatgttttgtgttagattgttcatgtttgttcttagtgatcccttcctccattcctttttgatcgttaaaatcatttgtatcctacactacagagctgcaggcttgcagcctcatcaccataaataaaaagaaacagagaaatagactttgcagttgc

SEQ ID NO: 4368 - DNA, 967 bp, Sorghum bicolor
  Clone ID: SORBI-28MAY03-CLUS7727_1
cccacgcgtccgaccgagtcaagaaatcatgacagtgagcacagacatttgagtaatcttcctgtatcaggaattcctgaatattctatgactgcatttggtataggagtaccaagatatgacagtggcagtcaacagagattgagatcatatgcacatcatcaccccctaatccataggccaacacctcgcagtggaagcaacttggtggcaccattagggtcagttccagctgtagtggcagagactagaggccatggtcatggtgcaagaggccatatgtaccaacagtcaatgcactcatctgtgcagggcagcccgttccctcctaccactagaagggttaggccgagagctttgacaattacatctttcattgcggcgacttcctcaggtgagattggagggcctcgtgcccatggattttccgctcctggagctgtgaacaggagcgtttctgatgctgagggcatctctagacccatcgaccgaccatatacatggggtcgggagggctttgctccgttcccctggatccctgctgaaggcgagtctcactggtggggcaccttcaatcctatgcagaaccatgcacatggaagttttaccagaaggcctgctggggagcggatgccacagagtcacccagagaacggctatcggcctgtgcccccttcacagaggatgcctccgttcttgtgattgtgattgtgattggatgaggctgttcctccaattgttgtgtataaacattatttgattcgagacttgagagagaacaatgagcgaaggtcgactgcactgcagcattgaaactggtcagttatgagacctgtatgatgtttatgccgctggtattttagagttctcggtccaccagcactcaggtttcattgagcgctgtagtttgtcctaactgatatggtgttgcattgagaaggactatttggaaacatgagttaaactc

SEQ ID NO: 4369 - DNA, 656 bp, Sorghum bicolor
  Clone ID: SORBI-28MAY03-CLUS77300_1
aaaaatcaacaaatcatagcggcagatacaataagcagctgcagcagactccaccgtcacgccaccgcgccgagagagaaaagccgagcggtggcaggcgaggcgaggcgaggggacggacgaaagggggaaatcgcctgcctgcctgccgcggtgggttggtgggtgccgcctccgcatcctgctgctgctctgttccgcagtccacccccatttacctcgcctgacctcgcatggattcccgctcgcttctcctccactccacgcaccgatccgccagctgccaggagagcgcgacgcgatccaattgaggtccaagagcgcgggggctgccttgcccgctgtctgtgtgctcccctctgtttccgcctccaaaagcctggccgcgccgccgctggaggccatcgcgcgcctgcacggcgtcttggtggggtggtcgaagcagcagcagcggccgccgccgccgcgcgggagacccggcgcgaggaagcggtggccgagccgggggagcgcgatgctgtgggtggcgcgcctgtccggcttcttatccgccgccatggtgatgggtggtgctgtcgccgtcgctccagtccttcccgcccgccgagggcatccggtcgtcgcagttcgacggcagcgtccgcttcccgggccag

SEQ ID NO: 4370 - DNA, 562 bp, Sorghum bicolor
  Clone ID: SORBI-28MAY03-CLUS77708_1
agccactttgcttgtactctgattctgcttcccccccgagtccctctgcccctgcccggccgccgcccccgtcgtcgtgcgtcgcccctgggacgccgtcccccccggggccgctcctcggatcccgccgtctctcttcctgcccgcagaggcgtctctgctcctggccgcattcgcccgtacgaggcctgagcctgccgtccgctccgtctctgtcgccgtcgtcgattggctccgagccagcggccgctacctcaaggcgcaccggcgtcgaggtcgtcccctgctgctggccgtcgtccccggcgtttgcccccctgccgccggccgtccctcccgccggcccctccccgaagtccccgtgcgctggcccctccccgaagtccccgttctggatgtggccaggccttgcgccggcccctgccccaatctccttgccatccgtgagaaggtgctcagataatttagttttagtatgccatacttaggaacctatttttaatacgttttttactttggttgttggattgaaaatatatttgtgtcgagcacatgacatagt

SEQ ID NO: 4371 - DNA, 646 bp, Sorghum bicolor
  Clone ID: SORBI-28MAY03-CLUS77687_1
gtaaatgacattgtcaaagaactggaacaactagaatctaagatcaaggaaatcttactctcttctgatcagtcaaaaaacctaattggccagcaacagatcaggagccctgctgactccaacattcttgccgtcgatccgaccctggagctgcgctttgcattcgagccaaaaaaggacatatcgtgctgtctgcagttgacaaacctaactgaagcctccattgcatttaacataaagactaacagaaccaagtactacacagagcccagcaaagggattatgccaccatgttccaaacgctatgtcttggtgacgttgccagcacaggaggaggtaccgccgtccaacgacatgcaatgccatgacatgttccttgtgcagagtgttcatgtcagcaaggaactaacatctgatgacgagatccccggagacttgtttgaagaagccatgacggagaaggtggtggatgtggtcaaactgccgattgtttatgttgcacgagctcagtttacccagtaataatattataatcccataattttaacacggccggccgggtgagatgtgcgtgtgtacgtgccacacatcggcacacatctaagagcttatgtactttttatttactgaaagaaaactatattat

SEQ ID NO: 4372 - DNA, 700 bp, Sorghum bicolor
  unsure (1)..(700): unsure at all n locations
  Clone ID: SORBI-28MAY03-CLUS77709_1
agtggcatatcgaaattcactcttgcctaatcttcagcatgcatatcgtcttccctaaggcaggaaaccaaaggtcagtggtatacttatgaataggattaactcaagtgatgaatagtctttttttttgtcccctgcaggaaccagatccaagatgagcctcgtgggtaaggacatggacattgaactcgagttgcttgcaaaaaattacaaacaagtttgtcagaggaccaaaaagttggcagtggtgcggtatgngagatgtttaccgggcgcgtgtataatgggggaagtgattgctcgtgaagaagcttcacccgctccaagggctagatgataaatcgtttgagagggaattccgtaaccttagggggattgaccatgaaaatgtcgtgaggctacttggctactgctatgcattaaaaatgaagtttgttacgcacaacggagagttagtccgtgctaaagaaatggagcgcgttctctgctttgaatatatgcaaggtggaagccttgataaacatatttcagggggttcttgccacctggactcgccgacgtgggtcttatttcgttgagggtcctcgggggccgcttgccacccgcattccgcacggggatggccggttttccagccggcccccgctcctgctatttgcctcccggaccggttgttgacgccaaaaatcggagatctcgg

SEQ ID NO: 4373 - DNA, 644 bp, Sorghum bicolor
  Clone ID: SORBI-28MAY03-CLUS77721_1
gcctactgaaaaaaaaaaaaaaaaaacaaaacgagcttccacggctcagcgtcggcgcgcagccatgactgctcctactccgagggcgctatcccagcacaccgcgcggcgcgtgggcgtggcgagcagcccccagcgccccccctcccgccccgcccctgcgccgccgcgccgccatctccgcccccaccccgagcgcccgggccccgcgccccccgcggcgcccgggcggggcgtccgccccccggggcccccccgcccctccctcccctcccccgccccgcccccccccccccccgcccccctcgccgcaggcgccgcggcggccgccctcgccctcctctgcctcatcgtctgcctctgccgccgctgcagccggcgtcgccgcacacctcgcctcgccccgtgcccgcaccgccccggcgccatcaagtccctcaagcaccgcgtgcatgcgcaccatcaacatgaagcagtgccaatgccgccgccggccaacaaggacgtcgaggaggcgaccgccgctcggtggcgcccccgccccgcttcgttcgaacagccgccgatcgaggccatcagggcggagcagaaggcgccgctgatcctcgcggagcatttcgcgaggacgagcggcgaggagacgg

SEQ ID NO: 4374 - DNA, 736 bp, Sorghum bicolor
  Clone ID: SORBI-28MAY03-CLUS77755_1
gcacgaggcgggtacagcgcccgcggcccgcgcccgcggcgcccgccccgcgatccccccccccgtccgccctctccctcggctctgtgccgtttccgtgcacaggattcgtgctctggtgtcttggtattgtggttcccctgtggggttcccctcagtcttctcgtactttgcacttggcttctgttgcctctcctggcgctcccgaggccctggccgcattcgttgcacgccagccgtgccccgcccgtcctcgcgacgcgggcaccgggcgcccttgcccccgggacgccctgcccaggggctgtcggcgaaccacgcccgccgctcgtcccccgcacttgctggtcactcggcgagcggtggcccttgctcctggaacatctcctccgtgcgcgcttctgccgcatgttgttgctattgctcctggttcactgcgtgtgtgtcgtgtcccgtctttcacgagatggtggaatcgattgtggcctttcggttcgctcccttggtgtgtttcaaagaatcaatagtgccatgttttcctgcttgcattcatgcctagctccttatctttttcatagtttttgggttaaacaagcctgacaaaaacactgtgacattgctacttctctaactaactctgattctcatgtattgttgtgtacttatgttttggaactactttgttaagctccgcctattgttgcagttacagtgagtgaagttgaagcactacatg

SEQ ID NO: 4375 - DNA, 664 bp, Sorghum bicolor
  Clone ID: SORBI-28MAY03-CLUS77761_1
aatcccacaatcctgcagacccgcaccactggcgccccctgcggcatcacatcacgcctccgccgcctgcggccgccctgcgcacccacgaccaccctacgcactgcccgccgccgcccgctctcggatccccctcctgagatcgctcgcccccgtgcggccgtgtctctcgcccccctcgcaagatccctcgcccccgtgtggtcgtgcccctcgccgtgcgctaccgcgtgcctctccccgcggtcacccatgctggcacctcttctccctcaccgtcgttccccttgcggagtggatgagcccccgcgaccgcgatcccaaagcgccgccatccggagaagccaagcctgaatgtcgtcgcgtcctctccctccctatcgcatccgatccgtgccattgtcgcccttgccgttgccctcgccgaacggatgagctccgtcactgccccaagcactggcggacatgcctccattggttgcatctcaagctctgccccatccccagccgatgccacctagattgagatgctgctctcatgaagcgggaggaggagcccgtgacgtggatctaaagtttgtgatgccagagctgcttgtgaaatcactgctctctctctctctatatatatatatatatatatcttctcctatttttgtttccc

SEQ ID NO: 4376 - DNA, 686 bp, Sorghum bicolor
  Clone ID: SORBI-28MAY03-CLUS77488_1
tcagggatgccgagctcagggtgaagatcgtggaggagagggctcgtttcgacagggatccaaagacgttccgtgagtcgtacaatgaggagcaggagaagctccagcagcagatatcatctgcacggagtaaccttggcgctgtgcagattgaccatgacctccgtgtcaagatatctaaggtgtgctctgagctgaatgttgatggactcagaggtgacattgtgactaacagggctgccaaggctctggctgcgttgaaaggaagggacagcgtcactgtggaggatattgctactgtcattccaaactgcttgaggcatcggctccggaaggatccgcttgaatccattgactcgggtttgcttgtcattgagaagttttatgaagtctttagctagattgttcttgaggtaaacgttccttagtcacaaattttggcgggaaccctcttgttctgctgatctcataatgttctgctattctagtaatatctggagcttgaatttggtatcaattttgtgcacctagcatcatgataatgtagaatccattcccttccatctggaatgcatgctatgagcatcataatgctctttgcatttcagtcttccttgtaaatcaatgttacagcattggatgctaataatgtattatcttgtgcatcagtttgaatttctaagtat

SEQ ID NO: 4377 - DNA, 648 bp, Sorghum bicolor
  Clone ID: SORBI-28MAY03-CLUS77502_1
tccaaatgaggaagagaaccttgacatacttggtgatgatgatggcaatgcttcacccaataacttggcctcaggacaaggggcatctcttcgtggttttgacatcaacgtaccaaatcaggacaatatggatgatgaaattgctgatgtagatgtaaatgatgaggcggatgaagggctcaatgcagctgatgcgctgcgagctcaggtgaacgcagaggggcagcaggagcaggacagctcaagctctagtgggagcagcagtagcagcagcagcggaagtgggagcggcagtggaagtgggagcagcagcagtgatagcgatggtagcgatgctgattcggcaagctctggaggtgatgttgatatatgatcttgatagatgcgttgacacatcccttgctccacaatttttcgtccccaagggaggtgtagggtatgtatatgtttggctatattgctccactcagtgcattaaatttccgcaagtcatggtgggcttggtccgttttatgtttgctagacctggcctggatgaatagaatctgtaaacatatctgtacaactatgtgcttatgggacattgctgttgttaccatgaatgttacaattgttcggttgaaatgacaaaaaggtataaagaggaga

SEQ ID NO: 4378 - DNA, 632 bp, Sorghum bicolor
  Clone ID: SORBI-28MAY03-CLUS77508_1
cagcctctggtttgatagctgggcgagtgtgcagttccgccgcgaggcgcgccagcttcttgggggctcgtcctctttccctgtttacatagcagggctacttggcctctctgctgccacgatgcccccccgcctgcccgttcttcccgttctcgtcctcgctgtcggtcgcgacacggccgctccgccggcgcggccccgccccattccggctcagcgagtccgatgacatggagaacaacctcaaccgcaccttctcactgctgaaggccaggggtatggtgcagtccggagacctggtgatcgcgctctcagacatgctgcagtccatccaagtgatgaatgtgccctaggaataggatcccatacccagctggttccttgaccagaaatggaacgtacaataggagcttttttgtttgtataattttaagtatatcgcgtcggcaacagtttttagcatgtttctgcctcatgtcgatactctttgtatgtcgatattgatttgcatcggtgtggttcaggtgtgttccgggtccggcctggttttttggaaattccaaccggaccgggcccttctctgtgtgtctctttctggatgattttcttaaagtaaagcaatagctgcagca

SEQ ID NO: 4379 - DNA, 670 bp, Sorghum bicolor
  Clone ID: SORBI-28MAY03-CLUS77890_1
cccctcctccccttccccctaccggccattgcctaggagtctaggacaggaccacctggtgcgcaaaccttatccgaatcgccgtcgcatggaggccgtgcgcgcgtcggcggcgtgggtcgccagtcgctcctcccatgtcacggttgacctgcaagaaattgagaaggtagtggaccaaatcaagggagatgttccaaaagttgagtgggatttcgaaggaatccactactttgacaatgggacacttacagtccagtaccttttcgtcttggatgcacttaacttctgcttctggccagataaggacttgagctatgaccatttggcttctggactgaagttagccttggagaaagacaaaaatgcccttgattcagatcgtcttcagaattacactggcccccagctccgccaacttctgaactggccacgaccactgccaatcgaggaggaaagagtacgccttctccatgaggttggactggaacttgaaagaagccttggaggccaggctgctaatctagtgaagtctgctggaaactctgctgcaactcttatcgaactgattactcgacattttcctggtttccgggatcattccctttacaagggacaccaggtttttttgtacaagagagctcagatctttgttgctgatttgtggggc

SEQ ID NO: 4380 - DNA, 877 bp, Sorghum bicolor
  unsure (1)..(877): unsure at all n locations
  Clone ID: SORBI-28MAY03-CLUS77908_1
ctactgggttcccacctgctggatctttccctgcgtctcatctgatgcagttctcatctcatttttaaaatatactattatgctcatgtagtcttggcagatgcataccaaagcgtcagttcgacagttgacggcttcacactccaaacttcagagctgagaacagacacgggccatggctccttccccgcaccgccggcggctcctcctcatcctccccgtactcgtcgctgccgccgtgctatggggggcgctggcagcggacgccggcgcggacacctgcaaggcgtggttggtgcagtccatccccaccgacatgccgcacctgcgccgcgtccccggggtcctctccaccggagatgtacttcagtggctctcggggaatgcaacgaatagtctggacatccttgcacagtactggcagttcttagctcagccaaacaatccgaaatctggggattatggattctccgagagtgacatgaagagatttggggctgacgagggccgcctggtttacaaggcattggaaaatgctgcagatcgtaagatcaaaatcaggattgtccaacactctggattcgctcctgattttgacaaagagagcgccgatctggctgcaggaagaccaaatgttgagaatgcaaccgttctttttgaggattggtnggggatctggtgttgtgcatgcaaaggtctggatatcagataaaaaggatgtgtacatagggtcagcaaacaacgattggaaatcccttactcaggtcaaggagcttgggatttattttgctaattgcccacagatagcnaaaactgtggaagtatattttcaaaatctatggacgctttcaaaccctcactcaacttcttacaccaa

SEQ ID NO: 4381 - DNA, 899 bp, Sorghum bicolor
  Clone ID: SORBI-28MAY03-CLUS77984_1
gtctgggaggactcctctcttctctggagtaacgcacactccactccccgtccccgaccgacacacacccgcgctccggcgcctcgaaccccaccttcgcttcccccgcgcgggccgcgatcgcgacgccccaccgcaccgcgacaccgatctcccgccctcctcctcctcctcctcctccgcgctgtccggcccccccccccccacccaccgtctccctccccagccaagccaaccaccccaaatctcgcgccttccctccgaaatcccccagccgataccaacaacacaccacaccgcgcacgcgctcccccccagatccgctccactctgccccgcccgaggccgaggcgagatgctcgtccaggaccgcgtgtccccgcacgcggccgccgccgccgccgccgcgggccagaaccagaagccgtcctcgtccccgcgcggcgcgccgggggcggaccgccggcacccgcggcctttcgccaagaacctcgacttcgccacgtgggcgtccgagcactcctccaagctcctcctcctcctcttcgcggtcgcctccgccgccgccgtcttcctcctgcgcggcgcggcgccagacgccgccgcgctgctctgcctcgaccgctccgcccgctcgggctcgggcggccccgccaagctcccgtacccggacgtcgcctggtccaaggtcccgccgctcgcgatcgcggccggtagccccttcgcgtcgttccgggccgagcggtggatcgtggtcgccgtctcgtccccgcccaccgccgcgctggccgcgctcgcgcgcgtcaagggctggcagctcctcgccgtcggcgattcccgcacgcccgcggggtgggagctcaagggcgccatcttcctctccctcgagctgcaggcgc

SEQ ID NO: 4382 - DNA, 867 bp, Sorghum bicolor
  unsure (1)..(867): unsure at all n locations
  Clone ID: SORBI-28MAY03-CLUS780_1
gcttccggtngataccgcgcacgtaaggaggcccgannggggcagtgaacaaaganaagaacggaataggaagcaacgtgaatatcgtgcaatgataagagctgcaacagtggcaaatacacctggtcagggtgataataaaaaaccacacctggtctgcgatgtagaacctatatccggtgccagtgaggggcagatgaccgaagcagtgcattcgaccttggcaccgtctctgtcaccatatctcttaggagaaaagtcaccacaagaaactggtgtttcagccatttgccagccatcaatacatcttggacaagaaaatattgatcttactgattctatggactggctgcataggaatgatcagtacgttagaaaacaaagaccaccattggcgcctttgcagactgaaagttcaaacggcaccgtaattaatccaggtgccacttcagacaatatcaaactgcttagaagtcggagttggtacataaatatggatgccacaaagaaggcaaaattgctgcaacagagacgagactataaaagagcaagagcagttgatagcagcaaccgatcgtgccctactcttccggatgaacaaaatgatagccgcatgcttcagacacatgtaaagccgatgtgtacagacgccaattaaaatgtgcattggagcatgatagaaaccttgaccgaggcaagtggaagaatctagatgtctcaacatggagtattattgagaagatccaagagccaatgcaaaaagatgggtaattaatgcgatgcaacctgtaaatgcaacctgtaaatgccacgagacttgtattagtttgatatttttaattattaatgtaaaaaaaaaaaaaaaaa

SEQ ID NO: 4383 - DNA, 409 bp, Sorghum bicolor
  Clone ID: SORBI-28MAY03-CLUS7792_1
cttcacagcacctcgccgagatgggtccataacttctacctcgccgcactcgcctcattctatgccaagaaggtggaggctggactgaagaaatacaagccagacatcataattagcgtccatcctctcatgcaacacattcctctgtgggttctcaaatggcaaggcctacagaacagagtagtctttgtaactgtgatcacggacctcaacacatgccaccctacatggttccatgctgatgtgaacagatgttactgcccctcagaagaagttgccaagcgggcagcactggatgatctacaaccttctcaaattcgcgtgttcggtcttccaattcgaccatcattctgccgtgcagttcttgttaaggatgatttgaggagggagcttgaattggatcctgagc

SEQ ID NO: 4384 - DNA, 534 bp, Sorghum bicolor
  Clone ID: SORBI-28MAY03-CLUS7802_1
cccacgcgtccgcactcgcccactcacccccgcgccgtctttgctctgcctcaccgcgccgcagcagagcatggcgtccctacgccgcctccccgtcgccgtcctcctcgccgtggcggttccgctcctctttctttgtccggcagaggcggggacggtgggcgtgaactacggccgcgtggcgaacaacctgccgaatccggcggcggtggtgcagctgctgaagcagcagggcgtcgggcaggtgaagctgtacgacgccgaccccaccgtgctgcgcgcgctggccaacaccggaatcaaggtggtggttgcgctgcccaacgagcagctcgccgcggcggcgtcgcgcgcgtcgtacgcgctcctgtgggtgcgccgcaacgtggcggcctactacccggcgacgcagatccacggcatcgccgtgggcaacgaggtgttcgcgtccgccaagaacgtcacggcgcagctggtccccgccatgacaaacgtgcacgccgcgctggcaaggctcggcctcgacacgccgtc

SEQ ID NO: 4385 - DNA, 516 bp, Sorghum bicolor
  Clone ID: SORBI-28MAY03-CLUS77631_1
agacgacacgcctccagcaccaaccatcatccggcgagatggagaccccgccgccgcgccggtggccgccgggcttccgcttcagccccaccgacgaggagcttgttctctacttcctcaagcgccggatcgtctccggccgcccctctccctacgtcgccgacgtcgaagtgtacaagtcacacccttcccacctccccgagaggtcggcgctgcagacgggggacaggcagtggttcttcttcagccggatggaccgcaagtaccccaacggctcgcgcgccagccgcaccactggcgacggatactggaaggccacggggaaggaccgcttcatctgcggcggcggccgggcggtgggcaacaagaagacgctggtgtaccaccacggccgggccccgcgcggggagcgcacggactgggtcatgcacgagtataccctactcgccgacgcgctcccgccggccgcgcaggggagggagtcctacgcgctgtacaagctcttccagaagagcg

SEQ ID NO: 4386 - DNA, 619 bp, Sorghum bicolor
  Clone ID: SORBI-28MAY03-CLUS77644_1
gtgaagaactggatcagtgaagggagaaagcctgtgtatggttcacaagccgtgttggttcagaagttgattctgtttattgagtaccgtgctgtatgaacttggctccatgtctctcagatccttacccatcagatcatacttggatggaagtgtttggtttttagaacttggttcaaggaccgttgctttccaccagaacctatgaagatggatcctaaattaacagtttctcaagatgaactttgacttatgtattcctgtggactgctgcactgctgaaggcacccccgctctcggagtggataaccattatccactcaggccttgcttctattctggttatccactcaggccttgtttctattctgaaattgtagcctgaaagttgaatagacccccctgtatgttgtatcatgaagaggaaatctgaaagacatgcgattttttatatcgacttatcagatttatgacacgaactgttagtactcaggttttagctgcaacttcaaacgagaggcacattcaaggttttcctttatttggtgggattagtattgccaggtttctggtttgtatgctcaaaaggtttgaacaggttccagtttttttcccagtt

SEQ ID NO: 4387 - DNA, 715 bp, Sorghum bicolor
  Clone ID: SORBI-28MAY03-CLUS77674_1
gaagctgcccatgcatacgatgaggcggcaaaggccatgtatggccccaaggcacgtgtcaacttctcggataactctgctgacgccaactctggctgcacgtcggcgctttcgttgctggcatctagtgtaccggttgccacgttgcaacggtctgatgagaaagtggagactgaggtggaatctgtggagactgaggtccatgaggtgaaaactgaagggaatgatgacttgggaagtgtccacgttgcctgcaagaccgtggacgtcattcaatctgagaagagtgtgttacacaaagcaggggaagtaagttatgattacttcaacgttgaagaggtggttgagatgataattatagaattgaatgctgataaaaaaattgaagcacatgaagaataccatgatggagatgacgggtttagcctttttgcatattagaagcatggttatggggagaagtaggaataacttcattctagatgttaggaaaacgcttcaacctgaagcgttgtagtcattcgtggttttcatcttactgagacatagctttatactatgagccaaccggtacaagaagttgtcctgtgtgttgagttcctgtactatagtaggaaatgagtccgtgtttaatgagttctcttggttgttaatattgcacatttgctcggctgaactcaagttagctcaagaaaaggaatggtaagtacaccga

SEQ ID NO: 4388 - DNA, 703 bp, Sorghum bicolor
  Clone ID: SORBI-28MAY03-CLUS77676_1
tcaggcagaggtacctgattggactgggcaaccttcagggaaagagctttcacgttacaggagtgatcctgtggcgtcgcggtgggcagcgactgggtggcgccctcctgcgggtggtgcctgttatgccgccattgtcgctgtgggccggggtggccccggatcttgctgctgccccctccctggatccgtcttcggccgaccgctccgcgttcctgatgcgaggggtctgctgcccgcgcagcctgggcctgctggtacttggtggcggcgtggttctagggggggggggggtgcttggtggtcgacccgcggggtccagctctcttcagaggactcaagatgtccaggatttgaagaaggtgccatgattgtgctgacaacaatctgacatgcttctttgcatgccttttgttcaagtttatgccgagacacattgcatcaagtgatgcaccattgctccgagtgatcgcaagtctaatttttgcacatttttggttaagggctccattcactttggttcagccaactctgtgaacagaaactaaatcgagtgttaaatcatccccgtgcgtctctctaggcaagcaaatcaatacttcaagctcatctgagccaaattgttttccgttgtacaggaaaatggtaaaaaaacagagggggaaaaaaactgaggcttttaacaagtcattatctcatccgc

SEQ ID NO: 4389 - DNA, 619 bp, Sorghum bicolor
  Clone ID: SORBI-28MAY03-CLUS77679_1
aaactggatgatcttatggaacaaacgtcacatcttgcatcactagtcaattcttccgtagatacattgacatgtctacatggtctggagcaatcgctagccagattctccgaacctccgcaattttcaggagtagtactcacatctaacaatgataggaaaaggttgtcagtcatatttgagggccttgcttctgacctactttcatatgacgagagaagagggatgcgcgggattgattactggtcgctgaaacatggggatcctgcagaggtgcgatttgttctgggtaaagtgatcatggacaccatgtacgacaagctaccatgtgaatctactgaggacgaggacgctgctgcaacggtagagccagctgcagatcttgctggtggaagaagcctacctccactgtcctcattgttctaatcatagtgaagcagaggttgtcactcgaaacaaactaggcagacttttctgggtttagtcagtgctgcaaagcaatcgacttgtttagatttttttttttcttgtgttgcaaaatgaccacaacggctgctgtagacgtacttcagaatttttattgaggaactcagatgtgcagttgtagctggacttccca

SEQ ID NO: 4390 - DNA, 779 bp, Sorghum bicolor
  Clone ID: SORBI-28MAY03-CLUS7816_1
gcacgaggggacggcggtgaccgcgctaccgctgaggcggtcgctgtctccggcgccgagcagcagtggaggaagaccaggctcatctccctcatggaggacgtttgcaggcgatacaagcagtactaccagcagctgcaatctgtgatctcctcgtttgagactgttgcggggctgagcaacgccgccccctttgcttccatggctcttcggacaatgtcgaagcatttcaagtgtctcaaggaaatgataatgagccaattaaggaacacaagcaaggttgtcgccaatgatggtattggcaaagacgatatggctaactttgcgcttatgggtggtggagcaggcctcctgaggggaaacaatgtgaacgcattcggccagcctcacaacatttggaggcctcaaagagggcttcctgagcgtgcagtgtctgtgcttcgctcgtggctgttcgagcacttcttacatccgtatccaactgatagtgacaagcagatgctggctaaacagacaggcttaacaaggaaccaggtgtcaaattggtttatcaatgcaagggtgcggctctggaagcccatggtggaagaaatccacaacctggagatgcggcaggtgcagaagaacacatcggtggacaagaatcaacttggcatgcagcagattcagcactcgacggacagcagtgggaagctttctgacccttcaaactctcagcgtgggcaaagcagcggcatgacaaggaacctcagctcttcggcatcacgccatattcaaga

SEQ ID NO: 4391 - DNA, 798 bp, Sorghum bicolor
  Clone ID: SORBI-28MAY03-CLUS782_1
cccgaattcccggggcggaccaacccgtccggccaggtccggcaaccatgggcgccgcggcggccgacctcgaggcgcgtcagctccgcatcctcggccgtattgccgacctcgagctcgccgtgcagcagcaccgcctcggggcgctctccgtctccgccgcgccctcggagaacggcgaggccgacgcgggggccaccgaggcgcggctctcggccctcctggccacgcgcggcgtgcgggacttcgccttccgtcgcgttcccgccgactactacgaccgctccctcgaggagcgccgcagcctgctccgagccgactcagtcgcccagctctgcaagagcatcgtcatggtgaacacccaagctgctgcagatgttgttgattgcagcgtccgaaagaattcaaaatactatgtcattgttgtgcagtataatgcacgccttaatgctgaaaacatcaagaacttcctgtatgaactaaatgagaagcaaatacccaaaaagagatttaacatgaggttggcaccagaagaggagtcgcacaaacttactgggtttgtgcataacgctgtcacttgcattgggatggaaacaaacataccggttatcatagacgaagctatcaccaaattggatgaggatttcttctggctgggcggtggagaagttgacctcaagctcgggatgcgaacctcacaattcttaagtgcctttagtccattcgtggtgaaatgcagctgaatctggtgatagtcggacaacctaagagaagcttctgattcattttatttctacc

SEQ ID NO: 4392 - DNA, 628 bp, Sorghum bicolor
  Clone ID: SORBI-28MAY03-CLUS78261_1
gtagcatttctattggtggtggcctcccatggagtcaatcccgaccccacaccgagtacacgtcacgagaccctccgcgacacgcccaccgcgtccccatccacctgcccctcctcccttttcctcccgagtctctcaacgcaggcacgcagcacgggcagcacctctgccgacgtttccgtccgattgaatttctccattcccttcctcctgcccaaatccgaacccgacccgagacgagagaccctccagccagatcgaggcgggcgcggggcagggtgcccagcaaggatctcgccggggcccagccatggccgaggtcgccgacgcgcgcccagccccccaccccctgcgaccaccggcggcggagaccgcaagcggggctgcgcctcgcccgtgctcccgccgccaccgcccggctcgcacaagcggcgtagagaggacggcggtggcggcttcgaccggcgccggccggttcggcgcccagtcggcggtggaggacacgagcaggacgacaggaggtatggaaatggtcttggtgtcgtaggaggaagaggtggcgatggtcgatacatgaatcatgcaccagattggtcggattctggacgtggtggatggaaggagggac

SEQ ID NO: 4393 - DNA, 974 bp, Sorghum bicolor
  Clone ID: SORBI-28MAY03-CLUS78309_1
acctcggcggctcgtcctcgacgccgatggcggagcccagtcctaacccgaccgtggtgctgcacgcctgcctcggcgtgggccacctgatccccatggtggagctcgccaagcagctcctccgccgcggcctcgctgtcatcatcgccgtgcccaccccaccagcctccaccgccgacttcttcgcctcctccgcatccgccgtcgccgcgcttgcggccgccaaccctgccgtctccttccaccacctcccgcccccagactaccctgtcccggactcagaccccttcctccagatgctcgacgcgctccgcctcacagtcccgtccctcaccgccttcctccgctcccttccctccgtcgccgggctcgtgctcgacctcttctgcggcgacgcgctcgacgcggccgcagccaccggcatcccggcctacttctactacacctcctgcgctggcgacctcgccgcgtgcccctgccttccccactacttcgccacgacggagggcggccccagcttcaaagacatgggcaaggcgctcctccacttccccggcatcccgccgatcccggcttcggacatgcctcacactgtcgtcgaccgcacgagtcggacctgcgcctcgcggatcgtgcactacggccgcgtcccagaggcgcggggcgtgctgatcaacacctacgagtggctggaggcgcgggccgtcagggcactcagggacggcgtctgcgtccccggccgccccacgccgccggtgtaccccatcggcccgctcatcgtcaagggcgaggaggcggcggaggaagtggagcggcacgcgtgcctgtcgtggctggacgcacagccggagcggagcgtggtgttcctctgcttcggcagcctgggcgccgtctccgcggcgcagattaaggagatcgctcgcgggctggagagttccgggcatcggttcctgtgggtcgtgcggagcccgccg

SEQ ID NO: 4394 - DNA, 603 bp, Sorghum bicolor
  Clone ID: 30975871
tttttgttttatcaatcatgtgcttgtgctcaatctcttcaagttcacaacgtactaatttttccatagtattaggctattagcatcagaatggttgtaacaaaaaaaaacatattttctcccacttaattcccatgcaggcaaatttcagacagacatgggaaaagcatgggcagcggagattgcatcgagaagaaaaactaagtgatcaaaatatcaaatgacactcattttggcacgttggtttgaagacaacttgctggcacagcatttctgttgaactttgcttttactagacgatacttcaaggtggcactgagacgtaggcttaccttgggaaaaatgaacttcaccacatttcttggttctgctctgatcctgaggcatattgggcttgcgataccactgtaccagggctccagataagccacttgggtaaggagttatattggttgtagcctgtaggtgctcctgtcacgagcaattagctggatccaacgtgaatcagcaccatctcgtggtgatgtaaaatcctacttcttgaatcactgtaccattaccgtttcctcttgttaatccagtttcatggtttcggccattttt

SEQ ID NO: 4395 - DNA, 434 bp, Sorghum bicolor
  Clone ID: LIB3476-039-P1-K1-H3
gaaggagcaagaacgagaccttgaagaattcttccaatcaacagcaggcaaatttcagacagacatgggaaaagcatgggcagcggagattgcatcgagaagaaaaactaagtgatcaaaatatcaaatgacactcattttggcacgttggtttgaagacaacttgctggcacagcatttctgttgaactttgcttttactagacgatacttcaaggtggcactgagacgtaggcttaccttgggaaaaatgaacttcaccacatttcttggttctgctctgatcctgaggcatattgggctagcgataccactgtaccagggctccagataagccacttgggtaaggagttatattggttgtagcctgtaggtgctcctgtcacgagcaattagctggatccaacgtgaatcagcaccattttgtggggatgt

SEQ ID NO: 4396 - DNA, 615 bp, Sorghum bicolor
  Clone ID: SORBI-28MAY03-CLUS78320_1
gcacgaggcgcccgcgcccccgcccccgccgcgcctggccacccctccgcgccgccccgccgccacgcactcccgctcccgctgccgcccccccggcgccgtgggcggggccgcgcgcccgccgttcccgccccccgcccccccccgccgtctagccccggcgggttctggttgcttctcctgcccggtgccccctcatgccgccgcgcctgtgccccgcgccgccggcgcgccgccaccgccccggcccttccggtgcgcccctgcgcgccccccggccccctcggcgcccccccccggcccccgctcctcccccgcccccgcgccctcccggacctcgcccccgcctccggcgccccgccccccggcccgcgccccccccccccccacccccggggccgtcggccccgcctccaccgcctcccccgccgcccccggccccgcctccgccgccccgccccccggcgcgggcccgccctcctccgccgccagctcgcacgcctcgccgacgagtccggatgcttctccgtcaacgaggtcgaggcgctcttcgagctctacaagaagatcagctgctccatcatcaacgacgggctcatccacaaggaagaactc

SEQ ID NO: 4397 - DNA, 672 bp, Sorghum bicolor
  Clone ID: SORBI-28MAY03-CLUS78312_1
gcacgaggcactggtgtaaacacgcgcctgcagcacccccaagcaagaacaactttggtcagtttaactgccgcatctattgttcccattgcccttagcagagcttcctcttcctcactgtggtggcctggtgggggatccgcgcctcccccatcgccggcgagctcatggcccccccgccgccggaggatctccaatgcgccgtgaacggcaactgcgccgccccgccggggaagcccctggcggcgctggccgccagggatggcgagctccggtggctgcggcggtgcgtggaggcagcagcgaagggcttcgccatcggcgggggcctcaagggcggcctcgcgctcttctccgtcctcgtccgcatccgcagccgccgctcccccagatcgaggaaggccggagctatgacgaacgacgaggccgtggtgctcgcggtcaaggagactgtgaggtacggcttgttcttggggacctttgccggcagctacgtctctgtcgacgagtacatcgccgccgtctggggacgtaagagaacagcaaggtggagatcattattagctgggttgattgctggtccttctatgctcctgacaggaccaggaactcagcatacgagcttggctatatacattctgatgcgtgcagcagggcttgcatcccgttgtg

SEQ ID NO: 4398 - DNA, 688 bp, Sorghum bicolor
  Clone ID: SORBI-28MAY03-CLUS77782_1
actagacatccagataaagcaccagccaattggaagctctaaggccaccatctgagagatagtcgagcttgaaaacctgaagccttcttgttgcctaggcatgtgctcctgtttggagatgtatttctctatgcatatctttctggctactggattgttgttgaaggtgtagtactggagtacttttgttttgggggtcacttttctattgctgggtgcaatactagagtggtttttactaaagtagttaattgtgtttagtagtaaaattgttgctaggacttgcaatatcttctttgagccttctcagtgttggattgcagagctggcctgtgtgaccaggtgcaagcaaggcttgctgatgtttgatgttgaaaaatatttaaatattatctcaatctatgtttgattactaaaagatatttgttggttgcttgttttgcattgatagatgttgtcgcagcgttagcacggataatatattatatcactacagcactggtcacaagtatttgatctctgaaactattgcccttcagactgcaaatggaaggcacaagtagtgaggtcctgggatcatgcgactgggaggtcatatagcttaaggattttgtgcaatatgtactgtaataagatgcacaagacatgtcttcaatttatctataagcatttcttcatcacattaact

SEQ ID NO: 4399 - DNA, 676 bp, Sorghum bicolor
  Clone ID: SORBI-28MAY03-CLUS77797_1
taaaaaattggatcagagcccgaaagctggtactcgtcaggttacatcatcaactcctcgtcctgctattgaatcctcagagagcattgttagggctgcttctttgcccccggctatggaatcagagtctcctagaatagaggcatctaaggttgtgcgctcatctacaatcatgtcagcatcgggacttagtttgctagctggaactacaataccacctaaaagagatcaaccgggtgctttcagcagagcaagttcaatgaaggaaggaccctctgaattatcgagtggtgtgcaaaattcagcagaaccaagccccaggagatctggcgcttcaaccctgtttggagggcttgggtttctaaggagctacaccagctgagacgtacgtgctcagataggtgactttttttttatccgaagagaccatcagcttgagctgtatatgtaggcatagtagaaaacagggcagttgccaaaaggacggctcccttttcctattgggaattgcgaatttttgtaggaactaatactttgcagagcaatgcctcgatgccaagatgcacactttaaattatactgctaagttagatgctggaagagaaacatcctgcccggggaagggttgtatattgcagtggattgtactactagaatacatgttgggaaggaacag

SEQ ID NO: 4400 - DNA, 630 bp, Sorghum bicolor
  Clone ID: SORBI-28MAY03-CLUS77825_1
gggtacgaggacgtgccggcgaccgatgagcaggcgttggttaaggccctcgctcaccagcccctcagcgtcgccatcgaggcgtccggcaggcacttccagttctacagcgggggcgtgttcaatggcccgtgcgggtcggagctggaccatggagtggcggcggtggggtatggcagcagcaaggggcaggactacatcatcgtgaagaactcgtggggaagccattggggggagaagggctacatccgcatgaagaggggcaccggcaagccggagggtctctgcggcatcaacaagatggcgtcctacccaaccaaggatcagtagtagtcatctctacagatcgatggcacgcatgcctgccaatggccatggatggtggatggatcattcatatatctctcatcagactgtttcgatttcgatcgtttcctctctttttttttctgaatgtttttttacagtatatgattattaagtatttctcaatcggcatggcccgatatatcgaggaagaacgacaaacatgcatgcactcaagcagagctttgtttgtttctgtttcagcttcatttgatgcgttgaaatgatggatggaataaagtggtttttttttttgcagcgaaa

SEQ ID NO: 4401 - DNA, 634 bp, Sorghum bicolor
  Clone ID: SORBI-28MAY03-CLUS77846_1
atctcatcccaatctgcaactgcaaacagcagcctctcttttctctgcttcctacgccatggcttcgtcctctgctcgtccggtcgttgctgccgtgctcctgctgtgcctgctgtgcggcggcagcgcgtggctgcaggcggcggcggaggctcgcccgccgcaccacatggacagcgacagcgacgacttcttctccatcgttgggtactcgccggaggacctggttcaccacgaccgcctcatcaagctgttcgaggagtgggtggccaagtaccgcaaggcgtacgcgagcttcgaggagaagctccaccgcttcgaggtgttcaaggacaacctgcaccacatcgacgaggccaacaagaaggtcaccacctactggctcggcctcaacgccttcgccgacctcacccacgacgagttcaaggccacctacctcggcctccgacagccggagacgaagaagacgacagacagtcgtttcaggtacggtggcgtggccgacgacgatgtgccggcgtcggtggactggcggaagaaaggcgcggtgacggacgtgaagaaccaggggcagtgcggcagctgctgggccttctcaacggtggccgccgtggaggggatcaaccagatcgtg

SEQ ID NO: 4402 - DNA, 604 bp, Sorghum bicolor
  Clone ID: SORBI-28MAY03-CLUS78510_1
caagggtaagggcttcgagggtgttactacccgttggggtacccgccgtttgccccgcaagacccacaagggtttgcgcaaggtcggatgtatcggtgcttggcatcctgcccgtgtctcttggtcagtgccccgcgctggtcaaaacggttaccaccaccgtaccatcatcaacaagaaggtctaccgcattggcaaggctggtcgcgacgacactggttccactgagttcgacttgaccaagaagaccatcaaccccgtcggtggattccctcactacggtgtggtcactgaagacttcttgatgctcaagggtggtgtcactggtactcgcaagagagccatcactttgagaaagtccctcgttcctcaaacccgtcgtcttgctttggagaagatccaactcaagtttatcgatactgcctccaagttcggtcacggtcgcttccaaaccctcgacgaaaagaagaagttcatgggcttgcgcaagaaggaccgcactgtctaagtcgatgcaataataacaataaaacaattaaaaatcgaacagctctttgttaaatcggtgcgactggttcacctggaccaaaaataaaaccggttt

SEQ ID NO: 4403 - DNA, 722 bp, Sorghum bicolor
  Clone ID: SORBI-28MAY03-CLUS78522_1
agttggcttgtagctactacgacagtcacttccacaatagggtatggtgtgaagtactaccggatcaaaccaaggagttggtgactgttgctgtaggcagttcatggattaatttgctgctgctgctgctgctgatgatgatgatgatgatgatgactgacatgtatcaggcatgccactgtgtctcttaagctttgtgaacttcccaatttgcgactgcacaactataggccttgttgcccccttcagcctcatggatttccttaatggcaaaaaaacttgggcaagattggaaaaagaagtgaagaaccgcctcatgaatgtaatcggtgcatgatttgtgcagtaggcctagttaagttgtgatacttttgcctagtttcggcctagagtgttcatcaaattatcagagggcaaactagccgaacctttgcttttttgctttggccaaacacactagctatgctcccggtgtacatacatacgtgcttcagaatacttgaactgatttagaagaactttggcaaatggtgatcgctaggtgatgtcgtgcttcgagatgtctgcaggttaaatacatttacaactatgtccatgtatcaatgcaactgtttggctgagcttttttttaaccaccggaagaacggaaatgtgttgtgctccaccgtatggattgaatgggtatgtactgagatccaacaattcagttgatggttgaacgt

SEQ ID NO: 4404 - DNA, 596 bp, Sorghum bicolor
  Clone ID: SORBI-28MAY03-CLUS78569_1
gctgctgcgtgcctgcggggacactccatccctcctccacgatcccgccttccttccccacacctctcgccgagtcgccggcggaggacgatccgccggcagcagagcgagcgccgcgcgggcctcagatcgcccctttggttccttggagccgaaaagcggggggccggcatgaagcccccggccggcggcagcggcaagggcggcgcggtggacccttccctgccgcggttcaggtgccaggagtgccgccgcgccctcgtcgtcgtcggggtcgattcctacgccgacaggctgcccgcacatgccgcgcccggtaatcatgcatcttctgttcagggcagtgttatgggtgcaagcaagatggacaactcttacgttgtgttatccaggcagaacaaatctcagggtcctagaattcccccacgcccaccaagtgcagcaccggtgcatactgatcccagccaatcaacaagagcgatagaggggtcatatatagtgcttccacctcctgccgcttccatatacaagacacctgcctctgaaggaggtggtgcacagctcacagcaccaggtgtaaactccagtagcccctc

SEQ ID NO: 4405 - DNA, 628 bp, Sorghum bicolor
  Clone ID: SORBI-28MAY03-CLUS78591_1
ctggacaagcaaacccaccaccacaaggaaagggaagcgtatcaccagtcaccaccctcggatccttcgccttaattgcccgcgtcgtccatctcacgctcgctctcccaaaaacttcccattttcacaccccaagcgcacgaccccggccccggcctggtataaaacaccagggcgaaaccgcgccacgactcgatcggcacggcagtcggcgcagcagccagagggctcgggagagcgagcgcgcggttgctagctagctactgtacgagctcggtgctgccgtgtgcgaggcgaggcgatggggaggaggctggacgtgctgctggggcggacgacgaagcagacggcgcggctcaagtcgctgctggggctggcggtgacgcgcctcggcgtggtgcggggccaccgccaggtgcggtgcgggcaggcgcgcggggacgtggagcagctgctccgcctcggccacacggaccgcgcgctggcgcgcgccgagcacgtcgtccgggagcagaacgcgctcgacgtgctcgccgagctcgaggcctactgcgccctcatcgtcgagagggccgcgctcgtcgacgcgcacagggagtgtcccgaggagctgcgggaggcggcggcg

SEQ ID NO: 4406 - DNA, 904 bp, Sorghum bicolor
  Clone ID: SORBI-28MAY03-CLUS7859_1
tattgataaatggagaaatggaaggaaacatcttttttcaaaataaagaagtgtctttgaacgggaggtctgaaacctccgttcagagttcaacaggagataacaaggttgacaagaatgatgctaataatggaaggaacaataagtccaatgtggtcgtgcagaatggttgtctacctagaggggcaactgataaaacaaaccaaagagagtatcatggtgacatggtacgcaaaacagcaaggtcattcctttatgaactatgtgctgcaaactattggaaacctcctgaatttgagttatgcaaagatgaaggaccaagccgggggccgggttagcgtttttttggaacattgtctaaaataactctgttcatgcagttttctatattagcaaagctgaaatatatctatcattgtacgttttggactatattgcttggccaactattctaagtatgggaaacaatgtcggtgtcgagtgacctatgatttatgtctttttacatgcaggttcacttgtaaggtccttattcagatcacgggaacttcagcgacccttttggagtgctatagcgatcctaagctacaaaagaaagcagcgcatgagcatgcagcagagggagctctgtggtatcttaagcaacttggatacctaccaaaagatgattatcgtgtctagcgacattttaggtttgtggccttcagtgggaagagttttgttattgtaaataggcctcagatggaagagttttgttattgtaaataggcctcagatggaagagtttttttattgtaaacatgcattttgttcagagatatattgacacatacgaagctcacataaaataagaaactagcaaatactttctctatctcaaaaaaaaaaaaaaaaaaggccccta

SEQ ID NO: 4407 - DNA, 501 bp, Sorghum bicolor
  Clone ID: SORBI-28MAY03-CLUS82803_1
tgagatgaagcttctgaagtatttgctgaatattgaagagcctgaggagagatttggtgctcttgcaactgctttctttcctggagatgagcatgaagccaaggatgaagatgctctttacacaactcccaaagaactccacaaatggatcaaaatgctgctcgattcataccatctcaacaaggaggagacggattttatggatgggagaaagatgagcgacccggtgatcatccaaaggttaactttgctgaaggcgacgatcgaggaagaatacatgaagcagtatatacatcctgaggaggaatccatggacgacaactagctccagaagggtgaacgagcctgtctgtatgtgtaagccgacttggaacgatgctgacgatccataagtagatagcggatgccctgctgcttttatttatctacgagtgatggattgtaaattgtagcatgccaatggcattatcataagaagggactttctgttacaagtgtaaa

SEQ ID NO: 4408 - DNA, 630 bp, Sorghum bicolor
  Clone ID: SORBI-28MAY03-CLUS82806_1
cgagtggttccgcggcgtgatgaacgaggtggcggagcgggacgcccgcggcgacgtggtggagctccacaaccactgcaccagcgtgtacgaggaaggcgacgcgcggtcggcgctgctggtgatgctgcaggcgctgcaccacgccaagagcggcgtcgacgtggtgtcagggacgcgggtgcgcacgcacttcgcgcggcccaactggcgggacgtcttcaagcgggtggcctgcaaccaccagggccagcgcgtcggcgtcttctactgcggcgaccagaaggtcacgccggagctccgccggctgtcgcaggacttctcccacaagaccaccaccaagttcgtcttccacaaggagaacttctgatgaaccggccggcaaagcagcggcatgcatggccggcgtcgcgtcatgcaccaccattcgtggaatgaaacaaagttatttatggggtatatatatatatatacactatattgctggtgtgttttagggtaggacaaaaatacttgacatacttatttatagataatgtatctacagtagtaattaagcagattttgtttatccttttgcattatattgaggatatggataagagtgtacagtatagcattgctcgttta

SEQ ID NO: 4409 - DNA, 542 bp, Sorghum bicolor
  unsure (1)..(542): unsure at all n locations
  Clone ID: SORBI-28MAY03-CLUS82827_1
ctggacttcaagactaggcaggttcagagggttcgagggattattcacagtggcttctgtcntagggtaggccaatatattggttacccaccatcactttcattacctactatatgaaatgggcttaatctgcatgtttcagctccttttgtgtcatgctactacttgcatgcgctaccagtgccagatggatgtcacactaggttcagtgcatggccagatggatgtcacactaggttcagtgcatggccagatggatgtcgtgctagacactgcatcgactagttgctagaaatgcttcagtctttgtactgataaaatatgtatcaagctagtagtttgattagcttttagatgatgtgatgccactggcatgtaatctgggtagttaaaccagttatctgcacctgaactgatgtctggtgaccctttggttaggtatctgcagaaactcggtgcttgcttgcacgcaacgggctcgccacgtgaccatccgtcgccgacgcctgtgttgacgctgcggtcttcgggggtgcaattta

SEQ ID NO: 4410 - DNA, 629 bp, Sorghum bicolor
  Clone ID: SORBI-28MAY03-CLUS82907_1
atcagattcattcagggcatcacacaactaccactcctccctcctagtcctgcactccaccgtttcatcgccaccgatctccggcgctcgatcgcctcaaccaactcctcctctgctcctgttccatcggacccacttctctgctctttaatcctcgccatcttcttctcctgcctggtgggataaatggcggtgatgaccgacatgccggcggcggtcccggcggcggcaggcagcgacaaggacgcggagaagctgaggttcatcgaggagatgacctcggacgtggacgccgtgcaggagcgcgtcctggccgagatcctcgcccggaacgccggcaccgagtacctcgcccgctgcggcctcgcgggcgccaccggccgcgacgcgttccgcgccagggtgcccgtcgtcacctacgaggacctgcagccggacatccagcggatcgccaacggcgaccgctcgcccatcctctccgcgcaccccatctccgagttcctcaccagctccgggacctcggccggcgagcgcaagctcttgccaaccatcaaggaagagctcgaccggcgccagctgctctacagcctcctcatgcccgtcatgaaccagtacgtgccggggctgga

SEQ ID NO: 4411 - DNA, 679 bp, Sorghum bicolor
  Clone ID: 30161143
atcttgactgtgcgcatcaagagccacccatcgcctccaacaccgggaaaaccactcggaaaagacccccaccaagtccaagacacccgggaccgagcgagcgatcatgaaggccgggcctccgccgcacgttgccacgctagcgacgccggggatgggtcacctgatcccgctggcggagctggcgaagcgcctggcgtcgcggcacggcgcgacggcgacgctcatcaccttcgcgtccacggcgtcggcaacgcagcgcgcgctcctggcctcgctgccgcccgcggtgtcgtcgctctccctcccgcccgtcgacctctccgacctgccacggggcgccgccatcgagacgcgcatgtccgaggagtgcgcgcggtcgctccccgcgctcacgcgcctcctctccgagctcggggagaccatggccaccgccaccggcacccgcctcgtcgcgttcgtcgccgaccagttcgggacggactcattcgacgccgcgcgcgacgccggcgtgcggacgcgctgcctcttcatacccatgaacctccacgcgctctcgctcgtcctcgacctccctgacctcgcggcgtccgtccccggcgagttccgggacctcgccgagccggtgcgcctgcccggctgcgtgcccatcccggggtccgacgtaccctcgccgctg

SEQ ID NO: 4412 - DNA, 426 bp, Sorghum bicolor
  Clone ID: LIB3476-040-P1-K1-E12
gccgcttctcactcactcagatcaggcgtctcaccgtgcccgccgatttagcaccaccgccgcaaccgcgccccctgcccccgcccaaaaatggagaacggcaccagcaacggctccaccggcggcgccgcctgctgcaacggcaacggcgccgtccgcgggccgcacgtggcgatgctggcgacgccggggatgggtcacctgatcccgctcgcggagctagcgaagcggctggcgtcgcggcacggcgccacggcgacgctcatcacgttcgcgtccacggcgtcggcgacgcagcgcgcgttcctggcgtcgctcccgcccgcggtgacctcgctctcgctcccgcccgtcgacctctccgacctgccccgcggcgccgccatcgagacgctcatgttccgagagtgcgcgcgctctgtcccg

SEQ ID NO: 4413 - DNA, 707 bp, Sorghum bicolor
  Clone ID: SORBI-28MAY03-CLUS78747_1
cgtatcgtgggcttgctctccttccgcgggctcgcccgccggccccgcggtcgccgcccgcgcctccgctagccccccgccccccccccgcccctcctcccccccctcccccccccgcccctccgtcccggccccgccgcccggcgccggccgctgccgccgccgcagcccgctcccccgccccgtgcgcagtcgtcggccccgtgcgcaaggttcgggcccgcgccgatgtctccagcccgctccagtgccttctgccggtgtttgtgcttttgacaggggtgtacgggtctgaggctgttcagctcgtcagttgcctttcgcggcttctcttgccaatcgcggctgctcgcgcccacctcgattcccggcgcactcagcgtctcgctgtcatcttggttggtcgtggtccgcttctgctcccatgccttggtgtgccgcctggtgcttgcttggctctcggcttcccggctcgtgtgcggcgcctgctcgctggccggcctgtgccccgtgggggtgacaggcgtctgggccccccgcctctgtcgctgtgcgtcggtggcggtcggccggctgcctgtgcgggggagaggctcgttgctcctgcgcgtccgccagaggggctgtctcggggtctgcgtgctcgctggggaccaacaggtctaggttcaagaatggatgatatctgtgggcgggattgggtacct

SEQ ID NO: 4414 - DNA, 563 bp, Sorghum bicolor
  Clone ID: SORBI-28MAY03-CLUS7880_1
aagagaagaaaggttttgaagacacgcatagatgagaggggaagggaagttaccgaggttgtctgggagggtgaagcttctgcagacccacgcgtccggaagaatgtcaacactactgctgcaactgcaagcggggcgactctcccaagcaaaccaaagccagcagcaaacactgacaaaagcaaagctccaagcaaagcagcagcaggcaacaagaaacctgcgaaggctggaaccaagcaagggagcattatgtcattcttcaagaaagtatgagccagcgcggtgtgcaccaaaatgagacaggaccttttgctcagcaaactgtctgctgccgcgcttagtgaacccaggtctccaaccaggggcagctctacgtgaatatcgtcaggccggcaagtaagaagggcttcgagcagggaggcgtccgttagctatatcattttgttgtagcaagcgtagtgacgcttgagtgaagcagagaccacgtctcttagttcagagattatcttgctgtagctgtacatataattgtactgaggatactcaacctatttgcactt

SEQ ID NO: 4415 - DNA, 770 bp, Sorghum bicolor
  Clone ID: SORBI-28MAY03-CLUS78809_1
gactagtttgcatcatgaagttttaaagttgtgactagtttgcatcatgaagttttaaagctatggctagttagcatcatgctgttgttggaatcttgagatgttttactgtgatccatacccttaatgactaggaagttttttttgtagtatatttagttcctttgccctacaacgacaattatcatactgttgaactgctggttgcacatcagttttctgttcattccatccattgaagtcagatcatattaaattacgggttcacatataaaagctgcatgtttgatcaaactgttaattttgcttgtcaaggagtggatgcccctagattagacaaattgatccttatgcatgtagtcagtacagagcaacgaaattcatgttttgtaaaggaactgcaatgaacttggtgaaactgattttgaatgaatgcccatgtgactgattaaatatgttggtgactcattgagatgtgaggattgataactttggggtattccatgacataatattatctcctgttctggatgcatcgtttgcccgttcatcatgggcaggaggcattgaggtaagctggttgagtccccatgtacatggtgaaggaaggcactgcgctccgcattgctttattggggtgcttagtagttttttttttaaaatttatataagcatgtatatccagtaatgttgaatagatatgttaatttgagcgttcagagtaactgattttattagactgtgccccataagtaaaatcctaccctttg

SEQ ID NO: 4416 - DNA, 653 bp, Sorghum bicolor
  Clone ID: SORBI-28MAY03-CLUS78820_1
tgaggttgcattcagtgcccttgaaggtctcaacaaacagtcctttttgactgagctgggaaatcgcatgcataaggggctgcttaatcattggcagaagttcacatttagtcccagtggtggcctacggttgaaacgtgacataactgaatatggggactttgttcgtagcttcaatgccccctccatagatgagaagttcgaactattgggaattgtggcgaatgtctttattgtcgctccagaaagtttagcatccctatttgaaggaacccccagcatccgaaaggatgccttgaggttcattcagctccgggatgattataagacagcgaaaatcgcttcgatgctcaacaatatcatgtctgagtaaagagtgaagtggactggtagaccgtgatgtttgagtggttgctgctgcatatctagcagactagcccctgtctccatggtactcccaggtggactttgatgctgtttgtatagctgagtttcgaaattatgtttattcttggttacaatttattggtttcctatcctttttttttttggggggggggggggggcttgctcaatttgagctgtacatgtggttcaggccttttagacctctgcacttgcataaatgctatgagaaactattttgggctgct

SEQ ID NO: 4417 - DNA, 1325 bp, Sorghum bicolor
  Clone ID: SORBI-28MAY03-CLUS78367_1
ctttcttagtgttttggttcggtttttaggatgtgagaacagcctatgtgttgataataaaagcgagactgcttggtggtctggagttgtggtgctttatgtaatgcacctgatcacatatttcaccaatatcattggtgtggtgaccattgctctcatctccgtagtctccatcttgggtctaatttgcctctgccgctcagtgtacttccaactgtggatcaaaagaagaggctaccagcgccttagctacttcaacgggccatggctgactcggataacattgatgctggttgcattctggtggggtattggcgaggtagtcaggctcacctttgtgaacggggagggaaggctaatctctaaccggacatggcaagtgaacgtgtgcaaattctacatcatctcaaatctggggtttgcagaaccaggattgttcctcttgctctctttccttcttagtgcagctttgcagaagcaagaacttggtaccttgaataggaaatggaaccggaagactatacgtgcagtattcattctctgctcgccttgtttgatctgggaagcttgtgttgttttcgttggtggtcatgtttcctcagatgacggtcagcgatcaaaggtttcaaagtactggtattctgcctctgcaagccacaacggcaacattacatgcacgtatccactgttgagcagcgtatttattggggcgttttacatcattttgactgtctatgtcatgtttgtcggacgtcaaatgctgtctttggtgatcaacaagggactccggcgaaggatatatatgctcatttttgccaccggaatattacttccccgagcaacacttcttgggttatcggttcttccttggcctggtgaagtaatccatgaggctcttgtgtttgtttccttccttgtgttgatgcttgctgccatggtgggtattgttattctggtttattttccagtcgctgatacctttgccataggtgaccaggagcatatagagatgcaagcaagtcgtgaaatgatcctgtgatagccttttgatttgatgttccgctttttgttcaaggactaactgagggggatctcgtgctacttaccctggctctagccatatttagtcttgcaaactccggctgtcactgtatctccaaagttttgtgaagatagaacaggttagggataacattctcgtgtttacttttcccccttcatcttaactcatgtagtcatgtggcatgagaagtcctgtaaaatagttccttagacagtgaaaactttactttgtacattgaggtaaagcttcaaatatcagcctt

SEQ ID NO: 4418 - DNA, 601 bp, Sorghum bicolor
  Clone ID: SORBI-28MAY03-CLUS78405_1
cgctggctcggctccgcccccctccgcgttggtcccccccccccgcccgcttcctccgctccgccccgctccgccctccccccctccccccgccctctgcctccgctctgctgcgtccgggcctcccccgcggccgctgccctctcccccggctcggcggcggcggccgccccgcctgccgcgccgccggtgccgcgggggggcggccccgccgtcccgctcgcgccgccggccctcccggcgccgccccccccccgcctccctccccgggccgccctccggctcgccgcggcggccccgcccggccctctcccccccgcccccctcgtgccgcccggcgtcccccccccgaggccccggcccacggggtgccccgggcgccccaggtacggccccgggggcccgccgcgacgccccgcgccagtgcctgcccctgtaggtgccgtcagggccccggtcgaccgaggcgacgcccccctgccgtgcctgccgcagccgggtccgtccactcgctggccgcccggggagcacccccccttccgctgctgccgggtccgggactgcgcgcgtccatgccgctcggggatcacgactccttcag

SEQ ID NO: 4419 - DNA, 735 bp, Sorghum bicolor
  Clone ID: SORBI-28MAY03-CLUS78409_1
atcccctcctccgccatcccctcgctctccctctcccctcaacccagtgccccccctaccccgccgccgctagggtttctcctcccctccccgcccacccccaaatcatccccgaagcttccagtgcctcgcgccgcagccatgagcgacggcaaggacgccctcgacctctccgctatcggcgccgccctccccaactcggccgagctcagcgcggaggacaaggctcaccttgtggcgtcgatcaagaacacgctcgagggattggcgtcgcggcataccgacgtgctcgagaacctcgagcccaaggtcaggaagcgcgtcgagaagctcagggagatccagggccaacacgatgagcttgaggcaaagttttttgaggagagagcagctctagaagctaagtatcagaagttgtatgaaccactttactcaaagcgttacgaaattgtcaatggtgtggtcgaggttgagggtgtcacagaagaaagtgcagctgaaactcctgcagagcaaaagggtggagatgagacctctgctgagccaaaagaagaaaaaggtgtaccagctttctggcttaatgcaatgaagaatcatgaaattctagctgaggagatccaggagagggatgaggaagctctcaagtaccctcaaggacatcaagtggtacaggatcagtgagccgaagggctttaagcttgaatttcactttgatacaaatccgttcttcaagaa

SEQ ID NO: 4420 - DNA, 697 bp, Sorghum bicolor
  Clone ID: SORBI-28MAY03-CLUS78455_1
atcggcctgcctcccccgcccgcccccccccgccccccgcccccccccccccgcccccccgccccccccccccccccccccccccccacgcccggcccgccccagcagctcccggccgcctccccgcgcccgcctcgccccccgcgccgcgcccgccgccctccgctccctcccgccctcgccggccgccccccgcctcgcgcccccccgctccggccccgccctcccccccccccgctcgcccccgccccctcgccgccgcgccaccgggtgcccgccacccctgcccagccacgccgccccgcgcggtgcccgccccgccccctcccccgcgtcctcgcccccccgcggccccgctcggcgccgcgccgccccagcgccgtgggtccccgcgtggccacggggcggccccgggcctccggcccgcggggggccgcgtcgagcggggccgccctcgctgccggcgcgccgcgccggctcctcgctccctgtcctcccctttcccccaggccttcgtgcgctccggtgtggcagcagggtcgggggtccctgcgtgtggcggggtcgtcctcgtccttgcgtcacgcgaggggcctccggaagctgtggccccccgctgtccgctgtgccttagcccgccctgccggcttgttcttcccctcctggctggcttccgtgctccctttttcctggcact

SEQ ID NO: 4421 - DNA, 614 bp, Sorghum bicolor
  Clone ID: SORBI-28MAY03-CLUS78489_1
ctggcgaagacccgggaattggaggatgaatatggtaaggtgaagactgaaaatgataagcttcagttggaggttgagaggttcatgatggaattaggtgcatcggtggaggagaaagatgcagctgcaaaggcatttgatggtgggaaggatgaaatcttgacggaattggaggactctaagatcatgaaggtggaggtaactcaagacaataagaatttgataaagactaaaaatgataagcttcagtgggatgcatttgatagctgagcttaagcaggaaatatagcttgctggaaagcaggggctgagatgctcaacatgtaattagattcttcattgcctcaagagaaggatgttgaaatgatgaggcaataaggatgcctcaaggggaaccggaggagttccaagtccccaagggtttggtgaaggggtgcaaagtttggttagaggttttaatagcagagcataatctcataccctgtgaagctgaggttgagagggttaagaagaatatttagccccttgaaaacattcacatcctctttttagaagaaaaatggtgttcgaaatgggtttccattcataactaaacaaaaattgtgagattgctt

SEQ ID NO: 4422 - DNA, 614 bp, Sorghum bicolor
  Clone ID: SORBI-28MAY03-CLUS79065_1
cctactggctacctatgatgctctgactaggaaatcatttgatcttcatgctgcagttatatggtgcattcatgactatccagcattgagcacactttcaggcagaatcgctagaggttactatgcctgtgttcgttgtgacaaaaacaatgagatgcacttggctaagggctgcgagacaagtgtccaccacgagtgaacctgatttgtccgcaaaccagaatcagggcgacaccagcaatactgaacaagccaatctcactgcaagtgtagaagtgcaaactgctatagaattgaacaatactgaacaaggcaacctcactttaagtacagaagtggagtcaatgggattgaacactactgaacaaggaacctgtactggtactatacaagtgcggccaaggggggagaccatgggcaaagagattgattccataagtcatggtttagggtgtccgataccaatcattatcaagaaagggaaaagaaggccagaggctcctatgcaagctgcaaagctggcctcagagagtgggaccataatgagaaagaatataaaaatatatccaaattggacaaagtactacaagaacaatggtgagcagcttgagaac

SEQ ID NO: 4423 - DNA, 587 bp, Sorghum bicolor
  Clone ID: SORBI-28MAY03-CLUS79064_1
tactggctccctcttccgttcgcctcggcttctccgccagcccgcgcccgggagctcgactcggtcgtcgccgccactctactgctactcgctgctgctgccctggtcttcatcggaccctttgccggcgacgagcacccaccgcaccagagcagagcgtagcgagggatccaatggcggcgacggaggggcagtggctgctcatggcaacggggcggacgccgaccaacattgcggtgatcaagtactgggggaagcgggacgaggcgctcatcctccccgtcaacgacagcgtcagcgtcacgctcgaccctgaccacctctccgccaccaccaccggcgccgtcagcccctcattcccctccgaccgcatgtggctcaacggcaaggagatctcgctgttaggaggaaggtttcagagctgcctcagagagatcagaaagcgtgctcgtgacttcgaggatgaggagaagggcgtcaagatcaagaaagaggactgggggaagttgcatgttcacatagcctcgtacaacaacttccccactgctgctggtttggcctcttcggctgctggccttgcttgtttc

SEQ ID NO: 4424 - DNA, 647 bp, Sorghum bicolor
  Clone ID: SORBI-28MAY03-CLUS79086_1
cgcagtacaaggagcggtggaggcacgacgacgacgacggcggccgtttcgggcggagcaactcgcggatggaggagcggtggaggcacaaggatggcaacgacggcgacaaggagaatctgatacagagcccggagccgacgccacgggtcgcgcgggaagtggaggcggaggtggaggagctgcaccaccaccacccgttccacgggttcgggcaacagcggccggaggcgatgctgctcctgagccagtgatgggatcagccggttcgtgtcatgagggtgtgaaaagaaccgtgtgctcgactagcttttctcccttcctcttcctcgaaggctgcagggtcagtattttactgacactgctatgttgggtgcatcatgcatgaggacttcgatgttctcatggtttctgttcgccatgcgccatgaatggctgcttggccttgtaaatttctatcctttcagttctgaattctgataccaggatgtacaacgagagacaacatacaggcaagtctcaaggttccagcaaagctctggaaaccacgtattctaggagtgagagaatgagatcctcctgcccaagtgcatctgggcaaatcttttagtctgaaccatatactgaaataaagcaaaaggcagaag

SEQ ID NO: 4425 - DNA, 656 bp, Sorghum bicolor
  Clone ID: SORBI-28MAY03-CLUS79089_1
gcacgagggaacgaagtcggcctgccaggatatagccctgtaggaatccagggaactggtggttcaaggagcatgaacttggaagcctttccaccaggatatgtgacctgagagaaaaccatcttggtggtgcttcagggagtgtcataaacccccaagctcggtctcaagagagtgtagaattttcagacgagactagaagaaaggctatacagcgggagctgagacggcggcagaagttcaggtgatgccgtgatgtgaacttttgatcctccgcatcgaattttgactacggattactttaagactacatatccagtcttgatggctgaatgagtgacgaccttagttgtcgagaagcaaaaaccctttgttgttgtagcagctgcgtatgtgtttcttttagagacttgcttggcttgtcaataatttcttatgtgaacctcttgaacctgaagtattcaacgtgcttgtgaatttgtgcagttgcctttcttctgcatgagagcccatgttatctgggttgcacacttgcacggcatgcgatttgacattgctagaagggtcagataatactgacccagggaccttaccttgctttgtgctttgtgtgcgataaagtttgatgatcccttgaaggggagtggttatcatat

SEQ ID NO: 4426 - DNA, 454 bp, Sorghum bicolor
  Clone ID: SORBI-28MAY03-CLUS79098_1
cctactgggaaatggagaggacacaaatgaggtcctgtcagctaacttagggaacttgaaactggatggttcttctgaaaactatgatgaaaccagagactcaaaggaggacaatgtggaaaacactgacacagctgattttgtcattgttgacaaagctactaaggaggcgagctcaaccgatgaacaattcaatgcagaaaactgaaatggagctgcttatattgtttgcgtctctgctgtagaaattctaagaacagcgataagttagttcctgtataagaaaatgagtccatgctttgcgatggctcagtcgggttggttatggaatgcttttggggcctgtgaggcctaaggatccaaatgtcctctggagttgtggtgacagttgtttaaacaattgaaagttatggtatggtatcatgtgccacttgctcaaaaaaaaaaaaaaaaa

SEQ ID NO: 4427 - DNA, 509 bp, Sorghum bicolor
  Clone ID: SORBI-28MAY03-CLUS79122_1
agaccagtcattttgagatatccttacaaaagatttaatccagcatgggagtccatgtcaggggcacgtcatgtatttctgctcctctgtcaatttgtaaattatctagaggtggtccatttacctgtttactatccttctgagcaagaaaagggatgatcctaagctttatgcaaataatgtacggaaattgatggcagtggagggaaacttgattctttcagcccttgggctggcggagaagcgagtgtaccatgccgcactgaatggtaatagtctacctcgtgctttacatcagaaagatgattgaaatgccatgctgtcgtgcttccataatactgacagttgagtggcttgcttgtaactgtgtaatgtgcattatcatggttgagaggaaatgctgtgaatatcctatcgccaataaagcgtgtaaaacaaaaattaccaacgtgtcatagttcaaattatgttggttatacttttacatggctgggcatctgcgcatttga

SEQ ID NO: 4428 - DNA, 620 bp, Sorghum bicolor
  unsure (1)..(620): unsure at all n locations
  Clone ID: SORBI-28MAY03-CLUS78610_1
aaaaaaaaaaaaaaaaaaaaaaaaaaaatctggttgcgttacgagggtagtcaacatgtccgcaccngtaaatttggaagcccctcgaacgtggtntctcttgggattcaccccaagaaaagagatcgaaagagacatcgtgggaagagtctggaaagttccccaaggacgatgctacgcaagaagccccacttgactgctttcatcggctacaaggctggtatgactcacattgtccgtgaggtcgagaagcctggctccagattgcacaagaaggaagtcgtcgagcccgtcaccatcgttgaagccccccctatggtcatcatcggtgttgttggttacgtcgaaacccccaagggtctccgcactttgtccaccgtgtgggctgctcacttgggtgaggaagtcttgagacgcttctacaagaactggtaccgctccaagcaaaaggccttcaccaagtacgccaagaaggtcgctgaggataaggccaacaccgtcactcgcgagttggaccgcatccgcaagtactgcactgttgtccgtgtcatcgcccacactcaaatcagacaactcaagctccgccaaaagaaggctcacatcatggaaatccaaatcaa

SEQ ID NO: 4429 - DNA, 749 bp, Sorghum bicolor
  Clone ID: SORBI-28MAY03-CLUS78616_1
ataataccgcgcgtctgccccgcgccgcggcactcagaaaaggaagcacgcgcaagaagcgctcgtcgagaagggaagggaagagagagagaggacgacgacggccttgggacctgcggaccgcatcgctcgccggtagctgacgtcactcggccccgtggatttttcaagctctggtggtggctcgtctgtctgatccgcgctctgctgctttttctccgcccgccgcactgtatcacagccataatacctgttcacaggtctaggcatttatcctaccagtacatatagaattatagatagactaatagtacctaatatgtatccagcaaaccactacatggatccataccactcgcactacagaaatcatgctccttacccatactatcctcctcctagatgggaaatcccatccggtcacccacgggcaatggactcatcttattattatcggccaccaagctgtggaacttggccatacaatcatgatatgcatcactcacatccttctgagctccattgttgctgcaaccaaacatatcctcctggttactacagtttcagacccccattccctcaagaacttccaccccctcgtttatattatcatgggccatttccacagcatccaaatgcatggccttcttactttgtcccatcacatccctaccctgttgatcatacaccatatggttatgacaagttcaaggggccattgttgtggatgtccaaatcatgtgtgccct

SEQ ID NO: 4430 - DNA, 645 bp, Sorghum bicolor
  Clone ID: SORBI-28MAY03-CLUS78641_1
gggccctgagccctgctgggctctctgtcgggaaccggcgtgctcccccacgtgggtgtcgcggacatcattgcctttgcgcgatacgtggggatgcagcggcccgcagtttgggggttgggcctagggctgggtcctcgctggcttctgggagctgcagtggctcgcactttgggggagcgctctctggagcgttccgcgttcgcatgcgggggcgcagatgccgcgccctgggggtgagccctgtcggtggccctctgctttgaggggtcctcgttgtctgcgcttccgccgtgtggccggctggtggcgggcgggtggctggcgttccgctgccgggtcgggacctgccggcgggctcccgtccagttccagttcgcgaagaggttgctcggagccggctgccagccggtggcctgtgggtgcctcgtgggtgccgcggtggccgtgcagtcgccactcatgctgggctgtagctgtgagctgaatcaggtcgcgtgtgctgcgtcctccgggcccctccgaaaattagggtaggctgcttcatgcagcctccttcgtgctcctgtggtcgccgtccgcggttcctctgtatgtaccggtcgtttgcttcatgcggcctgccccgttctctatgccgtgttc

SEQ ID NO: 4431 - DNA, 987 bp, Sorghum bicolor
  Clone ID: SORBI-28MAY03-CLUS78698_1
atcgctagctcgctgcttgccttttgatccctcgctccaaattgcccattattccgacatacacacagcaccagccgccaccgccgccgccgccgcggctgctgttctcctcctactctctccatattatctctcatctgatcttcactcatcacctagctatatatactagatcctgctagctaggtcctccatagctctatccaaatctcgatatcgcaagcaaattcctgatctcatcagtccctatagctcccatgtctgccatctacatgagccagctctccactgctctccctctcatggagggagatcaccaccaccaccaccaccaccaccaaggccacttccaagccttcacgctgccaaaggatcccccaatccttttcccctttgtgatcagcaatagtagcgccagcgaaagcagtctgagctatggatcggcagatcatcacttgttgaggcagcatcgtcaaactatgctcgagccccaacatatgattggtggatcgtcatcagctgcgagtagtgtctttgcgacgccgttcccgactgtggagagcatccgtgacgacatgatcgagcctgcctcgtacgatccatacgatatggggaagctgcaccaggtggtcggtggcgggtcgtcgatggatgcttgcagctggacgccgccggcggccaagatgaggatcacgaggaaggccactgccgccgatcccagtggtgccgggaagaagccgaggagaagggcgcatcaggcagcagggtacgacgccgacatcaacatgagcggccaaccaaatttgggtgttattagggtgtgctccgactgcaacaccaccaagacgcccttgtggaggagtggtccttgcggccccaagtcgctctgcaacgcgtgcggtatcaggcagcggaaggcacgtcgggcgatgatggccgccgcgtctgcctccgggctaccagcagtgcccgccaccgacagcggta

SEQ ID NO: 4432 - DNA, 668 bp, Sorghum bicolor
  Clone ID: SORBI-28MAY03-CLUS78743_1
cggtcgctatcgcacccaccccgacccccaccgccctcctcccccccccccgccccccccccccctccccccctccccttcgcccccgccgcccccgccccggctgccggcgccggcgcgcagcccgcgcgcgcgccctcgccctcccgcccgccctgccccgcgggccgccacccccggccggcccgccgccgccgccccccgccgccccgtgccgtggctgtcgcctatccctcccccgccgctgagcgcccaccaggtccggctacgcgggccgccccggggccagccccccggggcccccgccggcgcctgcccccccccccccctccgccttcccccccaggcgccccccccgcgccgcccgccgccgcctgcctcccccccctccccccccgcctccggcgctacccggtgcgcgtagccgttgcgtccgctttggttggcagcgcctgcagccgcgtggctccccgcggcgccctcaggtgcgcgctcaggagtggcgccctgcggtggccgtcgttggccgcgccgtggcctccgccgaccccctctcctgcgatgtcgcgtcccggggtcgccggcggctctggtggggctgccttgcgtccacgcggaagccctttccgggggggtcgcagcgcgatgcggcgggcgcttactgaaac

SEQ ID NO: 4433 - DNA, 759 bp, Sorghum bicolor
  Clone ID: SORBI-28MAY03-CLUS8293_1
ggagctggagtccatgacaatgcctaccattggacatcctccatatattatggaagagatagcaaggagctgcaagaatttcacagaacttaagatcatgggctcatttgatcaacaatttgcctcggcaattctgcagttccttccaaagttgaaagtgctgagccttcgttgctctaaagtgtccatggatgcactccagtgcttgctgaactctatggaatatcttgaggttctgaatatttcgcactgcctgctattggtcattgcggcaaatgggcggaagcaagtggttcatgaactggacagccaaattttcgagagagcttcacggctgcgtgaattccactactgccagagtaggttgtgcgtcgcatgccagcggatggtggtggacgaaggcatcatgcgctggtacaggtacgaggattggttttggcgtccagacgaggtgaggtcccttgatttgcaagattatgggaagctgtttgatgctggttgcgagaggttgacgtctgtggagtagatgctaatagtaataggggaacaaaacccgcctcctcagtgtagaaacttgttcactggcattcataaaacatagcaagcgacgatcgagttgtgacaatagataaataataatatcgacaacaatgtgcgtgaatggggtgcgcgtgtgtttagctagtgttgtaaatccatgaatagttcgtcttgtttggagtttgtgatagcagcccagtatggtgacaagagtgcccg

SEQ ID NO: 4434 - DNA, 700 bp, Sorghum bicolor
  Clone ID: SORBI-28MAY03-CLUS7928_1
gacaactgctctatgcaacttgtttcaaagccagaacaatttgatgtcatggttacacctaatctttatggcaatttggtggctaacacggctgcaggtattgttggagggacaggcatcatgcctggaggcaatgtgggtcaggactatgctgtctttgagcaaggtgcttctgcaggaaatgttggaaatgagaacatcgtggagcagaagaaagcaaaccctgtcgcgctgcttctgtcatctgctatgatgttgaggcatttgcagttcccatcatttgctgaccgtctggaaacggcggtgaagcgcgttgttgcagaaggcacgcacagaacaaaggatttgggcggtaccagcaccacccaggaagttaccgacgctgtgattgccagtctggattagatttctggtgcacacctgaaaaaaaaggtaattctttggggtgactagttggctagtcttgactcctgagtgataattactttcttacatagatttagattgcttcacattttcgggggattgtaaggtttcccttgtttcagattttgtttagaaataattattgaggaacccacgatgattgttgttcatgtgatactttgtacttatcaaggtagaagaccttgagttgtgaaaggcaaagggaatggatgacagtctcaaaataacatgaattgagagttgactctcagat

SEQ ID NO: 4435 - DNA, 619 bp, Sorghum bicolor
  Clone ID: SORBI-28MAY03-CLUS79297_1
acaccagtaaccactttcttcttctcttccagaagcgcaggggcaccatccctcccaccagtgcgtgcgccgtcgacttcttcgcaccttctccgctcgtcgagaacgactccgcaccgcgccagcgcggcgacagccagcacgcgaagagaacaaaaaagtagaagaagaggaggagcaggggagagcgattggattcggtccaatccagccggcgcgccggccgcctcgtcgctcccgcgcgcggccgcggcgcgacccaccagccgatcccgagggcgccggccgagtcgatctgcgggggggcgcgcgggcccatgaggggggccgccgccggggatcacggtcgccgcggggggatgtgtatgagggagggcgtccggcccgcgaatcttctggattggccgtaacccgatcgcgtcggtggggctgcggcagtgaccgcgggcgggacgcgggggagtgagaagcggcaagtagcatttcgaggcgagcgagcgagcgggcgggcgcgatggtgagcggccacatcttccactgccggaagaactcgtggccggcggaggagtacgtcggccggaccgcgctgcagctgttggatttcgatggcggggcgccg

SEQ ID NO: 4436 - DNA, 646 bp, Sorghum bicolor
  Clone ID: SORBI-28MAY03-CLUS79299_1
aaccgacccaaagattcccgcttcccgctctttcccgttccccccgtctccggcctcccattctcaagtctccaccatccgacatccgcctacctgctattctaaccttctcgagccttccagaacctcctcggggacttgcgcccgagatctccaccatggcctcctccccaccctcctccggcgtcctgccgccctcgtatccgctgcgcctccgggaacccccgctcacgctccgtaaccctaggtccatcctccccgtggccgacttggcggcgctgctccttcgcgccgcttacgatggcgacgttccccaattaaagacgctggtgaagcggctgaggaaggcagggaagagcgtggatgaggcgatgacggaaatcagggcctcgtggtacaagggtcaaggaccgctgcacatggcagcattgtcagggaagacggctgtgtgcaaattgctcattaaggatctcaggctcgctgtcctcgcggctgcctccgctgccgtgacaccgctccgtcttgctcttcttgctgctccgtccgcagccgcctctgggcggcgtcctccgctccatcctgctccgacccgagctgcctttgatgggtgtacaccgctccatctagcagcaactcgagatgccta

SEQ ID NO: 4437 - DNA, 570 bp, Sorghum bicolor
  Clone ID: SORBI-28MAY03-CLUS7933_1
ccggggtcccggacggatccatctgtctcctgtcgtcacaagtcagtctcgcggcggcggcaacaaggggacgagacgacgaggcaggcagagcgggcggcgactacagcggcggcagcagcagatctcgcgggatggcggcgaaggcgatctcgagccccgtgccggtggagtggtacccgacgctggccgtcctcatggtgtccgtaggcctcatgttcaccgcctccttcttcatttatgaagcaacttcatccaggcggagccgtagcctggcaaaggagatcgcaacagcagcagttgcttctgtttttctgggctttgggtctctgttcgtgctccttgcaagtggtgtttatgtctgacgactggctatggatcatgtgcttgtgttctgcagctctagttgtagtcttgtaggattgcaagatcctcaaagtttgtgttgtcctaaaaaaatatggagcctttgaacttattctagaccaatgtatgagagcaaccgaacaatgctcagacttttttctccaggtcacaattatatcgtcaatctaaatccctttctccctg

SEQ ID NO: 4438 - DNA, 687 bp, Sorghum bicolor
  Clone ID: SORBI-28MAY03-CLUS79337_1
agccttgttcctcccgaacccctccaagaaaaggcggctccaacaaccagagcgctcatcagcaaaatctgtacaagatccgccctcgatttgggtagcgcgagtgaacgtgaggccgggccgtggagtgaaacaagattcgacatggggcggaaaaggaacgagtccggctatctgacggcggctctagaggagcgagaagaggccgaggaacagactgaggaaggcgacgaggaagagggggaggaacagacggaggaggggtcttgtggggaggatcaggccgaggctgaggcggagacgctggcacaggaagccgtggagccgccgaagctggccgagggcttctacgagattgaggccatccgccgccgccgtctccgcaggggccagcttcagtacctcgtcaagtggcgtgggtggccggagagtgcgaacacatgggaaccccttgaaaacctgaaggcctgttctggcattgttgatgctttcaataagcggtcaaggtcgcccaggtcctctcgaaagcgaaagcgtaagactgcaacaactccaacatccgatcctaacccttctcgtggcaaacgtggtcgaccacctcggtcggaggcccggagcatgcaagggatacatgcctcagaagtgaagaaactgccctgcagaacaagtagtaggagagcaaataat

SEQ ID NO: 4439 - DNA, 634 bp, Sorghum bicolor
  Clone ID: SORBI-28MAY03-CLUS78924_1
agatcgaacaacagaacggacaccgccggcattccattccgacgcgacgccctccttcccctccgacaagagaagggaagggaaccctccagatctccgcccgccccgccagccgccatgccgacggccgccgaccccgccgccgcgctgcccctcaccctcgacctcgaggacttcaagggagacttctcgttcgacgccctgtttgggggactggtggacgagctgctcccggagtaccgcggggaggacgacgctgcgcccgcgccaccgccgccgccgcccgtgctcggggcggccccgccagttttccccgctgtcgacgagcttcttgggctgttcaagcactcgtgcaaggagctcgtcgacctccgcaggcagattgataagcggctccagaatcttaagaaggaggtggctgtgcaggatgccaagcatcgcaagacgctaggggagcttgagaagggtgtggatggactatttgatagctttgctaggttggattcccgcatatcaagtgttggtcaaacagctgcgaaaatcggagatcatttacagagcgcagaatcccagagggaaactgctagtcagacgatagatctcatcaagtatctcatggagttcaacagcacac

SEQ ID NO: 4440 - DNA, 877 bp, Sorghum bicolor
  Clone ID: SORBI-28MAY03-CLUS789_1
ccacgcgtccggattgttatattttttagatgtttttcttcccttcgtaaacgttataagagagagagagacagagagagagagagagagagagagagagggggggggggggctttgggtaatatatgattgaacctatgccatctcttgattcatgtttcttgaaaatccattgatacagttgatttgaatatttagttctatttttcctgcagtatgaacgctagctaactattttttcccgttgcaggtttattttctgtcgagcagtgctcttctatttccactcagatgagcacgatcatctaccgacctgcctacccagtcttccagagtcagtctctccaaatgcagaagccatcagaactcctatcctttcgctcgcagaaaaccttgtcgtcagcgaccgatttaacttccgagactccacacgcaacaagaaatgatgatcagcagcaataaccataactcatgcctcctgtagatacctctgtggtaaatatagcccagcaatttgttgattgttttgcatttatacagccaacggaacaatgactcagcatcaactggatggggtgaattgaatggccatatgaagaattttgacctgctgcttcatctccgttgagcgtctgtacaagtttggttaggtgttctctaatttgctttaggcattgtaggcatgtaggccttgtcttcggtttttcttttttgttgtcttggagaggtcggtttgtaagctggaagaggcgttttttaagtactctggaaggcatattgttttgtagagtttggttagctctagctcagcatattttacggcagtttacgatatccaactttcattgcgttacgtttgcctcgtgctccaactttg

SEQ ID NO: 4441 - DNA, 846 bp, Sorghum bicolor
  Clone ID: SORBI-28MAY03-CLUS7896_1
gcacgaggggaatgtcttggccatgtcgtttgcgccaagagattcacacgaggcacaagtgcagtttgctctggagagaggtgtcccagctgttattggtgtccttggtacaataaaacttccctatccatcgagggcctttgacatggcccattgttccaggtgcttgattccatggggagcaaacgatggaatgtacatgatggaagttgatagggttctaaggcctggtggctactgggtgctgtctggtcctccaattaattggaaggtgaactacaagggttggcaacgcacaaagaaggatcttgaagcagagcagaacagaatagaggaaattgctgatcttctatgttgggaaaaggtctcagagaagggtgagatggcaatatggaggaaaagggtgaatactgagtcttgcccttctaggcaagaagaatcaactgtgcagatgtgtgaatcaacaaacccagatgatgtctggtacaagaagatgaaggcctgtgtgacaccccttccagatgtaaaagatgaaagtgaagtagctggaggagcaatcaaacccttcccagccaggctcaatgcagttcctccaagaattgctaatggttagatcccaggggtttcgtctcaggcctttcagaaagacaataaaatgtggaagaagcatgtgaaggcttacagcagtgtgaacaaatatctgcttactggtagatacaggaatattatggacatgaatgcaggattcgggggattcgctgcagcaatagagtccccaaaatcttgggtgatgaatgttgtgccgaccatcgcaaagatgcccaccctgggggctgtgtatgagcg

SEQ ID NO: 4442 - DNA, 780 bp, Sorghum bicolor
  Clone ID: SORBI-28MAY03-CLUS78961_1
gggacacagccctccacggtgctgcagtttagaaggagcagtcccagtcaataagatacacacacatgaaacatgttgctggagattggaccaaacagtttggattgataggtgtgccctcctatttttgccttgcttcagttggagccttgtctctatcctttgcggcaatggtgtattcgaatcggcgccatgatgctttcttacagtgtcttcctcgtgcctgccttcgcctcctcggtgcacctcggttttgtgttcggggccgccaatcgttttttcactctgctgcccagggaattttggaacatcctgaagacgatatagttagttatttgaaaaaaggatgtccccatgatatttctattcagggggaacacattgtgcaggcttatatctttgttggccaacgactatgacaaagatgcaaagcagttgaatggaactcaaaagtctcgtgttcactcaaaagaagaggtgcaagacttcctcagagtcccggtgaggaggctgataagcaggctagtgaaaattcacatgagacctcttcctgatcttatcaagaactgggagaaagttagcagcaaactaaacgggacaaagtttgcccactttcttaacggtttgagttatgtcaagtgatggaggacatgttattggcatttagagttgtgttctcaaacatgcgttagaattctttttgtacacataagtgttagatggcatacaacatgtgccgatggaattatagaaaaatttccaagttttctcctttttggt

SEQ ID NO: 4443 - DNA, 422 bp, Sorghum bicolor
  Clone ID: SORBI-28MAY03-CLUS7899_1
cccacgcgtccgctccctcgcagcgccgcttccctcactcgcgctcaggctcggtcccaaggatcggatcttccgcgcgtcggcggctccccctcggcggcgtccaacgacggaggggcagtcccaggctccgcggcggcgtcggcggctccccccaccttctgtcgccagtcgcctcgcgccctcgcctgcgtcctccgcgcaccggctgacgaccctgctttagatgattccactggtacagcgggtgtgaagttctcaagggcacagggttttcattgtagccaatggagtggtccaattcaactagttcccaagggcatcatgtaaatggaaagcggaatcaagtgcaaaccattgatcctcctggtcctactcctaccattgttgaaatgggaccaaggcactgcccattgactttc

SEQ ID NO: 4444 - DNA, 659 bp, Sorghum bicolor
  Clone ID: SORBI-28MAY03-CLUS7942_1
gttggactttcagagcagataaggcgggagatcacaaccatgcggttggtggctcataagaacattgttgagcttcatgaggttatggcaacacgaaacaagatctactttgtcatggaatatgtgaaaggtggcgagctctttgacaagattgagaagagtggcaagctcacagaggctgttgcacacaagtacttccagcagctcattagtgctgtggattactgccacagccaaggtgtgtatcaccgggacttgaagcctgagaacctgctgttggatgagaatgagaacctgaaggctcagattttggactgagcgcactttcagagtctaagaggcaggatggcttgctccacaccacctgtggaactccagcatatgtagctccagaggtgatcagcaagacaggctatgatggtgcaaagtcagacatctggtcttgtggggttgttctatttgtacttgttgctggttatctcccttttcaaggcccaaacttgatggagatgtatcgtaagatacagaatggtaatttcaggtgccccagttggttttcacacaaactcaagaagctattgtacaagatcctggaccccaacccaaacacaagaatttcagtccagaagataaaagagtctacctggttccgaaaggtc

SEQ ID NO: 4445 - DNA, 773 bp, Sorghum bicolor
  Clone ID: SORBI-28MAY03-CLUS79420_1
cgccacggacgtcgaggagcagaagccgcagcaggaccaggcgccgccagacgccgtcgaggccgccagcagcagcgtcgtgctcccggtcaggctcggccggttcaagaacgtcgacgacgacgccgagtccagctccagcaccggcgccaccagccgaatcgaccggcggaggtgctactccatgggttcgtaccagtacgtgctagccgacgagcacctgctggtctccgtgcacctgcggcacggcaatgcgggcggcggcgccggcaccgcgtgcggcactagcagcagcgccgcagtaaccgcggcgagcagtagcgacgagcagcaccagggcaagaaggtgttcgcgcgcggcgacagcttctccgtgtccaagatctggcagtggcgcggcagcaagcggctgcccggcggcctctgcgccgacgacggcctgccgtgggcgccggcggccaaggacgatcatgccagcgcgaacacgaggcaacacagcgacacttgatcatccagtagtagacaggcaaccgacacacgcgcatacacacatgtatgcctagcttccccttgttgactagctagcggcttggtagaattttgctggtgaaatcattctacgaacgaccagtcatgcaaaaatccaaaaaaaaaatatttttgggtgattttcatctggatcattttgtgccatattactgtatttcaatttcatgactgacgttaatcccagcaggctggctggcagtgcagaacccccacataaagccctt

SEQ ID NO: 4446 - DNA, 565 bp, Sorghum bicolor
  Clone ID: SORBI-28MAY03-CLUS7944_1
tctccaaggtcctcctccccaaggagatgttcacccgcacagcaagcgccggcggaggcggcgacgactcctccatggttgccgccaccgccgccgcgtcgtcgcccccgccagccgcgacagccccggaggcctccgagagcgcgcggacgccgccgacaaagctctcctccccgcccgcgctccgcggcggcggcgggcaagactacgacacggcgtcggcgcgagggatcggaatcgggtggtggtggtgtatagcattggtgtatctacttccacatctggtatgagatccgggacgacttggtcagtccatctccattgccattcctcttgtgctcaatttttgccttttttctttttctttttgtttttgtttttgtttttctcttgtctttttttttcttttcttatttgggttttgctagaatgtgtacactgggagggagatgaagtgaggtgaggggagagaagattgagctgcgaaaacaaaagaaaaatgcagcaaagcaactctttttaaggtatagaagaaaacaagaattggttatttggccccttcatc

SEQ ID NO: 4447 - DNA, 741 bp, Sorghum bicolor
  Clone ID: SORBI-28MAY03-CLUS7945_1
gcacgaggaaaacaggatggtggttctggtggaaataagaaagttgattggttcaaggaagtggctagttgtgatatgttccatgggaattgggttagggatgactcataccctctctaccctgagggatcatgtccgcacattgatgagccctttgactgctatctcaacggtcggcgagatctagtttaccagaagctccgctggcaacccagtggatgcagtatcccaagattgaacccaaccgatatgttggagaggctgagaggaaaaagacttgttttcgttggtgattcactcaataggaacatgtgggaatcccttgtgtgtattttgaggaattccgtcaaagacaagaggaaggtttttgaggcatctggcaggcgtgagtttaagacggaaggctcatactctttcctattcacggactataactgcagcgtggagttcttccgctccccattcctagtccaggaatgggagatgaaagtgagcagtggaaagaaaaaggaaactctcaggcttgatctggtcgagcaatcgtcattgaagtacaaggatgcagactttctcattttcaatactgggcattggtggacacatgagaaaacttctcttgggaaggactactatcaggaaggtgaccatgtgtataatgagctaaacgtcatggatgcctttcataaagctcttctcacctcggccaagtggattgatgccaatgttaaccccacaaaaact

SEQ ID NO: 4448 - DNA, 513 bp, Sorghum bicolor
  Clone ID: SORBI-28MAY03-CLUS79465_1
gagacacgtgaaagttccggccgccgtcatcgcgccctcttccttcgaagtcgccgcatcgcgccatcttcctcggatccctgctgtcatcgcaatccgcacaagacccgtcgtccaggtattcatcgaactccgccgtacgtggtgaacaaccttgccgaccaggtgctccatcggatctacagattcattgagatggatcatcaaggagaagatttcttgtccgggattcttttgaatagagatgctgcccatgtttctggtttggacgacaatggaattccgctgactgcacaggaaacccagagtagtccagaggtggaagctgttgctagtcatggtaacaagggaacgaagaggtccaaaaattttagtgtggatgaagatgaacttgtttgtgaaggatggttgattgctagcaaagatcccttccacggggccaatcaaaatcgtacctcgttttggggtaaggttcatgcttactttgagaagcacaataaaggtacaactcca

SEQ ID NO: 4449 - DNA, 527 bp, Sorghum bicolor
  Clone ID: SORBI-28MAY03-CLUS7955_1
gcacgaggcgcagcttgcactggagatcgaatagatagagattggagtgagatcaagcgcccatctggactggtggcgaccatgaggtccggactcctctcactatgtttccacttagccctagccattacactggctacaagtgttcctggccttgttcatagtagggtgattgatctaaagctacaacccaaaccaataccgcaacctgaaccaaagcctgcaccacaaccagacccaaagccagaacccaagccaacaccgcagcctgacccaaaacccacaccacaaccagacccaaagccagaacccaagccggcaccacagcctgaaccaaagcccgcaccacaaccagatccaaagccagaacctaaaccgacaccgcaaccaaaaccaaaacctacaccacaaccagacccacaaccagaaccaaaacccacaccacaaccaaacccaaaaccggaacctaaacccacaccacaaccagattcaaagcccgagccaaaaccaacaccacaggcaccctt

SEQ ID NO: 4450 - DNA, 620 bp, Sorghum bicolor
  Clone ID: SORBI-28MAY03-CLUS79158_1
gcgcctggcttctccttcccctctcctcccgccccccgcttcccgccgcccgccgcgccccgtcccccctccgccccctccgcccccccctccgtccccgcgctcgcccgcgccgtcgccgcgccccgccgtccccgccgcggccccccccggcgtcgcccccgccggcctccgggccgccctctcccgtcctggggcggcgcccccccgtccgggcgtgtcgcccctgccgcgggccccatccggcgccgcggccggcgctgtcctcgtcggcgcccgcgctcggcccgcgccgcgcggccccccccccacccgcccccccgctcggctcccccccctccctccctcccgcccgccctccccccccccctcccgtccgccctccctcccccccgctccgattgcgccgtaggcgtggtggctggttccttttctccctccatgcggcgcttggtttctgtgctccctccttgctactcacccctagaatacccgtggagctcttccagagaaccactggccgtctcctcagaagttttcagcactttgattcactatcctgtggttcataaatgttgtagctgattgagatgattctgtcacgatacctgctcctgtga

SEQ ID NO: 4451 - DNA, 602 bp, Sorghum bicolor
  Clone ID: SORBI-28MAY03-CLUS79163_1
ctacggcgcaaatacagagaggcagagggcagggcaccatctccctccctccatcttcatccacaaggctcggtgtgcctcacaagtcctcctctcctgtcatctctcctctcctctgcctctcctctcccatctgctgtgtgcaagaagcttccttggacaagatgggagtgcagaggtacaggttcttctgctgcgggtgtggcgccaatgcggcggccggcgacagggaaggcgacgacgatggtgatttcggggtgttcgacgacaaggctcaggctgagaagggggtcgaggccgggccgcggggcctgtcgttggcgcaggtgaaggcgatgacgggcggcttcacctcggctgtggtcggcgagggcgggttcagcaccgtgtacctcgcccgcctctccggcgcgctcgccgccgtcaaggttcaccgcagcagcgaacgcctccaccgcgtgttccgccaggagctcgacacgctccagcgcgtccggcacccgcacatcgtccgcctcctcgccttctgcgaccagcaagaggaaggcgtgctggtgctcgagttcgcggcgaacgggaacctgcacgagcggctccacggc

SEQ ID NO: 4452 - DNA, 751 bp, Sorghum bicolor
  unsure (1)..(751): unsure at all n locations
  Clone ID: SORBI-28MAY03-CLUS79188_1
attttgttgttgtggagaccattgaatttgcggatgatgagtatgaggggcttcctgtgccacttacattggaggagttgaagcgccagaagaggatggagaacttgggagagggggaagcgatggatttggctgaacctgctaaggaggttgagatggaaatggatgaagaagagatgcaacttgtcgaggaaggaatgcgggcagcaccgcgtggggagaatgatggaggagcgcaagttaacgtggctggtgatgacgacgcgcctatgaggattgtcaagaactacaagaggcctgaggagaggattcctgcggagagagacccaaccaaatttgttgtctcgccgataactggggagctcattcccatcagcgagatggaggaacacatgcgcatctcactcattgaccctaagtacaaggaacagaaagagaggatgttggccaagatcaaggagactacacttgcacctgatgatgaaatttcacggaacattgttggccttgctcgcactcgccctgatatttttgggaccactgaggaggaggtgtctaacgccgtcaaggcagaaattgagaagaaaaaggatgagcagccaaagcaggttatttgggatggtcattctggtagcattggtcgcactgctactcatgcattatctcagcctcagggtggcgaggaacagtttgatgcttcaaatgttcctggtccagctccacttgtncgacctggcatgccattgccccg

SEQ ID NO: 4453 - DNA, 511 bp, Sorghum bicolor
  unsure (1)..(511): unsure at all n locations
  Clone ID: SORBI-28MAY03-CLUS792_1
gaaacttttaccctggagtccgagcagctcatgaggtgggagttctggatggtcaaggattctcagttaatataccttggagccgtggtggtgttggagacaatgactacatctttgcttttcagactgtggtgcttccaatagctgcagagtttgccgcagacatcactataatatctgcaggattcgatgcagctagaggtgaccctctaggtggttgtgatgtcactccagttggatactcttggatgacatccctgctagctgattgctcaaatggaagattgttggtgatacttgagggaggatacaatctccagtcgatatcctcatcagctactgaagttgttaaggtcctacttggggatggtccaaatcgtgcttcatttgtaggttcaccatcaagagaggccttgaagactgtttctcaagtcctgaagattcaacaacgattntggccagttntaggtccaacatatgcatcactacaggcacagcangggtcggtttc

SEQ ID NO: 4454 - DNA, 765 bp, Sorghum bicolor
  Clone ID: SORBI-28MAY03-CLUS79717_1
tccctcctcgattctcgtgcgccggcggcgtcccctcccctgctcgctgtcgctggattcaaaaattttgaacctttcctccgcgctctatcgaccccagctccgtcgccgtcgactctgctgctcttgctcgccaccgaccgcgacgtctgtggccagccccaatccgcagcgtctcaccggcccgattccagcagcttcccttcgtccccaccacctccttcttctcggagccgctggagctccgagcctccgacccaaaattccactagcgttctctcttgccaacaaggttactccgttactgtgcggcggcgcgggccggaaatcgccctgtcaccagccccaagggcggcggctcgcattgcggcctgatggcggcgaggctcgccgcggcgtcggcggcgcttgcgctggcgctggtagggatgtgctgcgcggcggggccggcgacagcgctggggatgaactggggcacgcaggcgacgcacccgctgccgcccaaggccgtggtgcaggtgctgcaagacaacggcatcaagaaggtgaagctcttcgacaccgacccggccgccatgagcgcgctcgccggcaccggcatcgaggtcatggtcgccatccccaacaacatgctcgccgacctcgccgacgacgcgggaaaggctaaggactgggtcaagcgcaacgtccggcgctacgacttcgacggcggcgtcaccatcaagtatgtggccgtgggcaacgagccgttcctggagtcataca

SEQ ID NO: 4455 - DNA, 598 bp, Sorghum bicolor
  Clone ID: SORBI-28MAY03-CLUS79722_1
cgccgcggcccccccccgcggcgccccgcggccgccgcccaaccgctggagccagcggccgccgtggcccgccgccgcgccgccgtcctcgccctcctccgcgccgccgcgcgcccccccccgccccgtccagcccctcgcccccggcggcgccgcccgccgcgaagtcgaggccgtcgcggccccgccccgccccgcccccgcgcggcggcttcggcgccgcgggtcggagccccggcggccgcggcccagggccgtccggcggctctggctctgcgccgggtcgccggaggccgccggcagccccccccagggcgactccgccggccacgactccgtgggcgtggtcgagcctgctggtattgctgggcttggatttcgtgctgttgtcccccgccctgctgcgatgtgggtgcgtgctgttcgcgaccccccggttgcgatctgcccgcatattccccgcgacacatggcacagcgtcccccctgctccgcccagattcaagcctcccggcgatcctccttctccgtcaagattcaagccatctgatgatgcttttgtgatggaagatgaacttattagtgagtctgatagtgga

SEQ ID NO: 4456 - DNA, 699 bp, Sorghum bicolor
  Clone ID: SORBI-28MAY03-CLUS79726_1
aaacgcaggtccactaatcctaggagtacaccacagggagagccggagagcaaccgttacagactttgggaggttggagacacgaacccaataccgcggccctgccagcgacggcctcgttgacgttggcgccaccggaggtggagatggagccggagtccgatgccatggccctcgcgtcggacgccgcggcgcctgagctcccgtcgccgcagctcgatttttttcaagacaagagttcgattattatgtgatagcaacatgggagattttgatgcttgggtatcattaataaatgctgcagagggaacatcagcagatgacatagacgtcataagcttggtgtaccatagcttcttgttggaatttcctttgtgctatggttactggatcaagtatgcagctcacaaggcacggctatgcacaaccagatatgtagtggatgtttacgaacaagctgtccacgctgtacctcattctgttgatatttgggtcagttactgtgggtttggtatatctgcatttgaagaacctgctcatatcagaagtttattcgagagggctttatctcttgttggaaaggactatttgtgttatcacctgtgggacaagtatatagaatttgaaacctctcagaagcagctgattcagcttgccaccatttatatcaacacactgaaatttcccacaaagaagttg

SEQ ID NO: 4457 - DNA, 671 bp, Sorghum bicolor
  Clone ID: SORBI-28MAY03-CLUS7974_1
aagacggctccagtggacaaagatagggtgtctgtgattttagaaccttctacagaaaatatggcacaccaagagactcataattcaattggtgagagacttgtaacactggaaaatgctaaggaatgccatgatactgataaatgtcttgagcttcctacaagtggagcctccacaaagctggatgtcttcaaggacgtgtcaggttcattaccagaggcttgctcaccagtaaatgccagtgatcttagtggccatggtaatattagtccaaatttaagtccattagcaggaacatcacaagaggacagaaacagtaaactggcaccagaagtatttagggatagcaggatgcaacacacttttctgagtaatgaaaagttacaggaatcctcagatgtgtctaatgttgctatttcccagggaagtaacattaaatcattgattttagaagaacttaaagaatctgatgtatgtgatgctttcacgaggggacctaatagaattgagcaggaagctgaaacttatggaagagaaaaattcagctttagtgatggatcgctcttgctgccatcacacttccataacaaaggtgccaagataaatttagtctctgaaaaagtacagaaagtcgaaattgataagaaagttggtccatgtgcacaccctga

SEQ ID NO: 4458 - DNA, 639 bp, Sorghum bicolor
  Clone ID: SORBI-28MAY03-CLUS79758_1
cgttggctgccggatcgattagttggttgattttattaacttactacagctgttgagaggtttgattcgagtgcatcatcagccggcctgcgagatgcatggatgcagcatggtcgtcatcgtcgtcgtcatcgtggtgtagaggaattggaatgaagtccggccggccgcgctgattggcatggacgaggtctgatcgatcaagatgtctccagacctcgccggcgcggtggtctctcgtagctccaggttggtggtgattggttggctaatcttcattagctagctagctatagatatacatatgtagagcctatagctactgattaggcgctagaacagcagcagtgtgtgttcgtaaccgcgtctagtgttggtcgatcgatcggtagaatcatgtgtgtacatatatagtcaccatctgtcagctgattagctagtagtataggagtcgtagttgagtgatgagaatgaaatgaagcatgttgttgattgattgattgattattactgtctgatggttgtgtgctgaggtggctcgatcgcatcgcatcgacgacggagtgatcgagctgcttaactctgtaaattactgtactcctccttgcatcaatctaatgaattgatcagttccccttc

SEQ ID NO: 4459 - DNA, 716 bp, Sorghum bicolor
  Clone ID: SORBI-28MAY03-CLUS79341_1
acagggcagtggagagtacgggacgagacgagacccccaccagcagaggcagaggcgacagccgcagccggccaccaccaccagcagcgcattggactgtccgtcccgccccccgcccggcgccaccatccatggccgtggggggccttctgcggggcctcgtttcgccggcgcggggagccgccgcctggctgccctgccacgagcccttcgcctcctggcacccctggctcccctcgctcccgcgcctccgcccgcccgcatccgacggcttcaagcttctcttcgtgctcctgctcttctccgccgctctggccgaggtccgctacatcgcctcctcctccatggcgcccacgctccgcccaggcgaccgagccgtcgccgagaaggttacatacttgttccggaggccatctattggggatatagtgtttttcaaagtgccttccgccgcgcagaattatggtgtcaataaggatgttgtctttattaagagagtattggcaacacctggagatttcattgaggttcgacaagggcagcttattgtaaatggtattgcactgaaggagcattacacagcaacccatgcgttgtacacaacggaagcaatggtccgggcgtgcttctcttctctgtgcgcatgggctccctgacgtgacgagagaatttccattctccacaagaagatgaccaaaagtggactggctgctcca

SEQ ID NO: 4460 - DNA, 681 bp, Sorghum bicolor
  Clone ID: SORBI-28MAY03-CLUS7936_1
cccacgcgtccggcttaacacctttgccaattgtactggcctgaaggtaaactatagaaaatccatgatgttaccagtcaacttgtctgaggaaagacttgatcacttatctagaacttttggctgctccaaggggactttaccattcacttatttgggtttgcctttgggtttaaccacctctggtcagtaaatgtgagagaagattgttaagtgtatccaattttctaactcaggctgggaggttagagctaacaaatgcagttttttcagctctacccacattctacatgtgctcgttggaactcccaaaaacagtaatcaagcaaattgataaatatagaaaaaattgcctttggaggggatcagacatcaatggaagagggaagccaaaagcagcttgggaaatggtctgtattggaaaacaggaaggaggactaggagtaatagacattgagaaacaaaacaaagcacttctaatgaaaaatctgcataaatttttcaataaggaagacataccttgggtacagattgtttgggagaagcactatccaaatggcaaattaccaggtgtttccaagaaaggatcatttttgtggagagacaaccagaagaacttacagcattacaaataggtggttcaaattcaagtaaactccggtgagacatgtctgttctggg

SEQ ID NO: 4461 - DNA, 640 bp, Sorghum bicolor
  Clone ID: SORBI-28MAY03-CLUS79375_1
atacttaaggaggaggacaagtggaaagccaagaggattgaacttctagagctggagaaacaagcaggcacaggaaaaaagaccaaaaagaattccaccaaagtcgccaggccaagggaagacaacaatgaccatgagaaagaggccaccgatgctactgctgctgcagaaaccggaggaaggaaaaggtctgatggggtaaagaaggttacagaaaatcttaggcgaggaggtggcgaagcttgcttggaggccctcgacaagatgtgggcaaagaaggaggtggccgtcaacgaaaaagagaaggcaaagcaggagaggttcctgacggcactagagctagacaaggaagcacttgaggtagagaaaaagcgtctagtaactgaggaaaaaagagctcaagcggaggacaaacgagctgaagccgacttgatgaagcaggaaaaagaaattatgttcgccgacacgaactctctcaacccgctgcagcgtcaatggcttgagatgatgcagaaggagatcgtgagtcggcgttgtggaaattcaatttagaatatttttatcagctcaatacttgtttccattaggcaaaaactttgtttaatcatatgcagaacctttttttccactatgcaaaaaa

SEQ ID NO: 4462 - DNA, 559 bp, Sorghum bicolor
  Clone ID: SORBI-28MAY03-CLUS79383_1
gaagaccggcatcaaagttgacagagccaaggagatgctcggcacgtttagcccccagctggagccctacacgtacgtgacgccagaggacaccaccccgtcaggaatgtttgcccgggggtcctactctgccaggaccaagttcctcgacgacgaccggaagtgctacctggagatcaactacaccttcgacatccgccgggagtggccgtcgacgagctgatgatcggcctttgctccgggccgggggccctgagcagatcaaccgtttcgtttcttctgtgcttttgcttttctgtgttggctcgtcctgtcctgtccgtaggtttcgttcaccatgttgctgcgtgcgtcgatgtgtgttcgtgtgtccgtgtgtgtgtgtgtgaatatccctggagttgaatggcttctcgacaccgttcgtagacagtgcatgtcaggtcggtctaccgctctgtgcgtgcgtgggcgtgttgaacttttgtctggtttcttgtttttcgaactgcctgttcccctgttgagtccagagcaatgaagctgccttttgcgtaaa

SEQ ID NO: 4463 - DNA, 1061 bp, Sorghum bicolor
  Clone ID: SORBI-28MAY03-CLUS79406_1
ctttaaccaatttcttttggattggatgattgtttgattgtacatccactttttatgcattttcccatttggagtattagccgtgttgaacgggagtgagttggaccattgtaaatcatatttaggagttacgaaaacccgtttttgtgttacatttattttttattgagaaattgtacagtgggctggtggctgtgagcttatttggttgaatggtacttctccttggtcaatcattgtagcgatagtgttaaaaaaacaatgctcatttgtttattggttggtttccaggctcaatttcactacataggacacaggaggtcagttactagtttttgttcatactaaagatggaaaagaccaacaatgattttcctataactggtgatgaaaagactggtttctggcattggaatcagacggcaggagatttcagattgcatgttgaaattatatatttactgtttattgctgatctgccctttctgatgatttttttctctctaactctcattattctgaaaatagcctcaattggcgcttctgaataaatagcaaattgtgtttcttgtaaatcctatatatactatatagtgtatggaaaagcaattgtcctttggggtcactatgccttcagtgatttcctacacgctactactgttatatcatacgacataattcttgtaattttgtttcttgtaaatcatatagtcagcaattgaggattaataactatttccaatgtttccaggatagcacatttagtgttgaggagtgggaagctatcttggaactactgtcagttgtaatcgagctgatttggagaagcgagattgtctcaatttttaactatgtcagattcaattcgaaagatctcttttcctgtaacatgttcctgattgtgaatgaaacatttctaacaactacagaagtgatttggtacccattttgtgattgtaattgagctattctcctgtacaaagtggagctaattgacaatgtttattctcgtaactatctcatagtaaatgaattcgacattatagtaactagttatattg

SEQ ID NO: 4464 - DNA, 619 bp, Sorghum bicolor
  Clone ID: SORBI-28MAY03-CLUS79225_1
accatgcctaaccggcgtcagcgctagcgcgagggttccctcttcgccttcatcgccatggctcctaacgaagccgctaacatcaccaccccgtccgagccggagagcgtgggcggcagtgagatgagcagcgaagacacggctgccgccaggccgctgctctcgtcgtcctccccctccccctccctctccccctccgcggcctctgcagccccggtgctggagagcatagaggagctggaccggaggtacgcgccgtacgcgcggcgggacgcgtacgggccgatggggctcggccccctgagcgccgcggaggcggcgcggctggcgtttgccgcggtcgtgctggtcccgctccgcgtcatggcaggcgtgctcgtactcgtggtctactaccttgtgtgccgcgtgtgcacgctgcgggtggaggaggagcgggaaggcggcgaaggggatgggtacgcgcggctggacggatggagacgggcgggggttgtgcgatgcggccgcgcactcgctcgcgccatgttgttcgtcttcggattctactggatccgagagtacgactgccgcttccccaatgccgaggatgacgatgtggaccagtctaaagaaaccg

SEQ ID NO: 4465 - DNA, 559 bp, Sorghum bicolor
  Clone ID: SORBI-28MAY03-CLUS79902_1
ccatacctcttgctttgtgcgccttgtttgtcctttgcttgcctgcttcatttctccgctgctgccctctggcgagcccctctcttgggctgccgcgcacgggaggcctggtcatgccgggacggctcccgccctgctctctaacagttctctccctctggtccttccttgtcgggctcttggccttggcctgggttggtccccctttccacctcccctgcttgctggcatcctgggtctcttttcggggttgcgctggcccagcggccccataactatgttctttgctgcctggggttgccttcccgggttctcctcttccccccgccgcgaacctaggaggtgttcccccgtctggtagggacccagaagcagctatgggtttgtggccaggttcccgcggttgtcgcgaaaatggccctcgcagcgggtcgccacttgtgggaccgcgggcctaactccctctaataaaagtgctaagcggcctggggctgcggtccaggtttcttctcttccacaagcctggaaacaagaaggtgttagcccatcattaaggacc

SEQ ID NO: 4466 - DNA, 580 bp, Sorghum bicolor
  Clone ID: SORBI-28MAY03-CLUS80039_1
cctggcctcccccctccccggccccgggccccgttgccccatccccccgcccagcgcgcggggcccgccgccttcccccccccccgcccaccggccccccgcccccctgctcccctcaccccgccgccgcccgccgccgcgcgtcgcccatggccgcgcgccccccgcccccccccccccccgccgccgcgcccgcgcccccgcgctcgcccttgccgccggtggcgccgccgtcgcggctgcgggggcgccgggcgcccgcggcccgggggcggcaggccggctgcggcccccgcgcgggcgtcctgctcctgctgctcgcgccgtcccggccggtgcaggccgtgcgggcgcgcctccccccccgggcccgctccccccgccagtccgcccacctcgtccgcgccctcgccgccgcgctcgggacggctgcacttggttctgccctcctcaccacctggtcccgggacatcagctggcccctgcggccaggccggctgctgcccctgttctggcttcctgctctagctgctctcatctactcgaccattacaagccttggcgaaatgcttgacaacag

SEQ ID NO: 4467 - DNA, 733 bp, Sorghum bicolor
  Clone ID: SORBI-28MAY03-CLUS80101_1
caaagtacaggacctagcaacgcagaatacctcaagagtcttgtatttggaagtggagaagagaggtcccggagggaagaaatcaaactgcaagatatccaaaggagatgggttgcatcaaaccgatgggctgaagctgcccagtttgcacttgctagaagcctcacatcatcacatagtgacctccttgcactagaagctgccgagggaaataatattctgaggagaacaaaggatgctgtaatcactctgcaaagcgtactagaagggaagcacaatactgaaatcgatgaatctctaactctgtatcaggtcccagctgatcgatggtggccgtcactttacaaagtggtcgaaggcctcgccacgatgagcagattgggccgcaaccgtctgcagcaacctgcttataattttgagaacaacggttctattgactgggaccaaatgtagatgtagaattctggagcacagcagcattgtggagtaggctggaggtgcagttatttctggcggatttgattcctgcggtgtgtagatgatgctgcagcaacacataacgtgcgagctttaagtagtagattcatggtcctgattcctcttctgaaaatgaataacgagctagttttgtcacagcaggacgattcctgtaccgtcgtccgcaagggttgtagtttttcacggacagttacgagacgattgtatgtcaggttttggtaattcgtgcaatgca

SEQ ID NO: 4468 - DNA, 640 bp, Sorghum bicolor
  Clone ID: SORBI-28MAY03-CLUS80127_1
ctggcctcacctctagccatttcccaaaccagaccaaaatcccatcccccgcacactccaatccgcccttcttcatccctctcccttcctagggtttcgcgaaccctcctacctggtcagacgacctctcttcgcaccgccgtcgggccggccatggcgaccacgaccttccccacctcgaccccattcttcgcggcgcaccaccagggcccccgccggagccagccctccatctccgccgcggtctacggcggccgcggccgccggtggcgcccgctgcgggtagcgtgcgagaaggtggtgggcatcgacctggggaccaccaactccgcggtggccgctatggagggcggcaagcccacgatcgtgaccaacgccgagggggcgcggaccacgccctcggtggtggcgtacaccaagtccggcgaccgcctcgttggccagatcgccaagcgccaggccgtggtcaacccggagaacaccttcttctccgtcaagcgcttcatcggccgcaagatgaacgaggtcgacgaggagtccaagcaggtctcgtatcgcgtcatgagggacgacaacggcaacgtcaagctcgattgcccggcgattggcaagcagttcgcagctgaggagatctccgcgc

SEQ ID NO: 4469 - DNA, 571 bp, Sorghum bicolor
  Clone ID: SORBI-28MAY03-CLUS80194_1
gctgctcctctccttccatctcacacaccgcagccccagcgagatcgcgagaaggccatggccaagcccaagccttcctccgccggcgccaagtcggcagcggctgccgccgcccctgcgccgcctgccacagtgcactcagcgctggtcacctacacctccatgctcgcgctcctctccctctgcccgcccttcgttatcctcctgtggtacacgatggtgcacgcggacggatcggtggtgcggacttacgagcacctcagggagcacggcgtgctcgaggggctcaaggccatctggcccatgcccaccctcgtcgcatggaagatcatcttcggcttcggactcttcgaggccgtcctgcagctgctgctccctgggaagcgcttcgaagggcccatctcgcctgccgggaacgtgccggtctacaaggcaaatggcttacaagcatatgcagtgaccttgataacttacctcggtttgtggtggttcggtatatttaaccctgcaatagtgtatgatcacttgggggagatatactctgctcttgtctttggaagctttgtgttct

SEQ ID NO: 4470 - DNA, 568 bp, Sorghum bicolor
  Clone ID: SORBI-28MAY03-CLUS80225_1
ctgctattaatgtgggtatttcagtttccagagtgggatccgcagctcaaattaaagccatgaaacaagtagctggcaaattaaaattggaactagctcaattcgcagaattacaagcctttgcacaattcgcctctgctctggataaaacaagtcagaatcaattggcaaggggtcgacgattacgggaattgcttaaacaatcccaatcaaaccctctcccagtggaagagcaggtagctactatttataccggaacgagaggatatcttgattcgttagaaattgaacaggtaaagaaatttctggatgagttacgtaaacacctaaaagatactaaacctcaattccaagaaattatatcttctagtaagacattcaccgagcaagcagaaacccttttgaaggaagctattcaggaacagcttgaacggttttcccttcaggaacaaacataaatatagcatgtctactcttattagtataacttgtgttagtagaagaggaatcgttgagaaagatttttcgtttgaatcatgcaaatttttttttagtttttagtttagtt

SEQ ID NO: 4471 - DNA, 603 bp, Sorghum bicolor
  Clone ID: SORBI-28MAY03-CLUS79668_1
gcacgaggcaataacactctttgcgccagcagagcggatcggcgatggcttatcgggggtttagtagctaacacgaaatcaatctctctccgcctctcccgtccgtccacacatccgtgatgacatcggcggcggtgcggcgcgagccggcggcgggccaccgccggtactggcggtggagcaaggccgactttttcccggagccttccttccagagctggcgcgcgtacggcggcgcgctcctgtccactggcccgcgactgcgggaccgcgtcaccagccgctcatccgaggccgtcgaggcggggacgctgctcgcccagagcgagaacccgctccgccggtgcctctcctgggtggatctcgccttcctcgggttcggctccgtcgtcggctcgggcgtcttcgtgctcaccggccaggaggcgcgcttcgacgccggcccggccatcccgcttgcctacgccgccgcgggcttctccgcgctgctctcgtccttctgctacgccgagctcgccaccgagatcccgtccgccggtggctctttctcgtacctgcgcgtcgagcttggggacctggccgcgttcatcgccgcggggaaca

SEQ ID NO: 4472 - DNA, 343 bp, Sorghum bicolor
  Clone ID: LIB3476-042-P1-K1-B3
ggtcgcatgactgtcacgcagctcgccgccgccggctcggcaggcgggccgtctggtggggccgctggtagtggcggtgctcctgtggctgatgtggcgctccggaagatcttcgttgggaacgtcccggcagacatgccgtccgagcgtctccttgcgcactttgcctcctatgtatcccaacgtaccgccttatttctaaggtgtgtgacaactgttgggagcatatcctttgaaatggttgtgctgaattcagaagtgttgtctgcttacatggatgcttgcatattctggctacttctgatgtggaatgtggaatgagtttgcactctcaattttcgat

SEQ ID NO: 4473 - DNA, 415 bp, Sorghum bicolor
  unsure (1)..(415): unsure at all n locations
  Clone ID: LIB3478-018-P1-K1-E5
cgacggtcgcatgactgtcacgcagctcgccgccgccggcttcggcaggggccgtctggtggggccgctggtagtggcggtgctcctgtggctgatgtggcgctccggaagatcttcgttgggaacgtcccggcagacatgccgtccgagcgtctccttgcgcactttgcctcctatggcgagattgaggaggggccgctgggatttgacaagcagacgggcaagttccggggctttgcacttttcgtatacaagacacctgagggtgcgcaggcctccctagtggacacggccgcctgggcgaagccacggcagctgagctcgcagctctggatgccgtcgttcccgggtgcgggcctgctccgcgcgtncgacgacggaccggcggcgggcgcggtgacttgagaggccccca

SEQ ID NO: 4474 - DNA, 649 bp, Sorghum bicolor
  Clone ID: SORBI-28MAY03-CLUS79677_1
tctggacgccgctgcgcccctccgggcggccgcgccagtccactccaccccaccgcttctctcgcttctccggcgtcccccgcacttctcagacgaaaacctcgcttcgtgtgcttgcttccggcccgcaacgccaccttccgccgcgccgccacttctcctgcccgggagctcgtccttgcacgaagaatctcagatcttcgggccgtcctccgcgtgaaactccgttccaagcgttgtgccgtttgtgcaccagcgtcgcaggtgttcccgctgtaatccgctagagctcgaaggaatttgagggattgcttggggaactcctctagttcgagcgagttatatgaagagcggagtgcgttgtttctcaaattaaattccgtgcaattagatcttgccatggttggttgttccacaaggaaatggcacattttgtggatataagctgctgcggatgcggtatttggtctgctccagtaaccgtaaacgcgtctgcgcgctctttgcggataagagcacatgctgtctctttggattatcccagtaggactgagcagaagaatgagactaagctagcggtggtacgaccagaccgaagattgcgggatgtttttgtcgatgcaagtgcagaccatggaagtggcagagc

SEQ ID NO: 4475 - DNA, 624 bp, Sorghum bicolor
  Clone ID: SORBI-28MAY03-CLUS79679_1
ttgagttctcctccactgttctgacttgtacagaagcataggcaagcaagaggcaaccaatggcgtcgtcgccgtcggtctccttcctcgagctctgtctctccttcctctgcttcgtggtcttctactacttccacatcaggtccaagcggaagaaccctgtcatcccgctggactggccgttggtgggcatgctcccggccctcctcggcaacctccaccacctccacgactggatcacctccctcgtggtcgccagcccactcaacttcctcttcacaggcccgccgcgctccggcatgcagttcttcgtcaccgccgaccctgccaacgtccgccacgtcttcacctccaacttcgccaactaccccaagggccccgagttcgaggagatcttcgacatcctcggcggcggcatcttcaccgccgacggcgagtcgtggcgccgccagcgcgccaaggcgcagctgctcatgtccagcgccccgttccgcgccttcgtgtcccggtacagccgcgccaaggtggacaccgcgctgctcccgctgctctcccacttcgccgccaccggagacgcgttcgacctccaggacgtgttcctccggctgacgttcgacaccacga

SEQ ID NO: 4476 - DNA, 808 bp, Sorghum bicolor
  Clone ID: SORBI-28MAY03-CLUS7970_1
gtgaaatgctcattggtttatatggactttgaaggtcgctctgatgggcgttctgtaaaatcagttattgctcatgtggctccactgaaacttgttctggtgcatggatcagcggaagcaactgaacatttgaaaatgcattgcacaaagaatttagaccttcatgttcatgctcctcagattgaggaaacaattgatgtaacatcggatttatgtgcttataaggtccaactttcagagaagttaatgagtaacatcatttctaagaagttgggtgagcatgaaattgcttgggtggatgcagaagttggaaaagaagatgagaagcttattttgctccccccatcatcaacaccgccaccccacaagccagttcttgtgggtgatttaaaattgtccgattttaaacagtttttggaaaataaaggctggcaggttgaatttgccggaggtgctctgcggtgtggtgaatacatcatggtgcgcaagattggagattctagccaaaagggcagcacagggtctcagcagatcgtcattgagggcccactctgcgaggactattacaagatcagggagcttctgtactcgcagttctacttgttgtgagacaactgcatctctcgtggtacatttaacccagtcgtgttgtgcaagtgatgagtgcataggcaagagagggacccgggagctgttttggtggtaggaattaggatgtattggacccggctgctctcgagaatgtactgggcagtgggcataccaagattacatttggataatgtcagaaaacctttaatcttgctgc

SEQ ID NO: 4477 - DNA, 1054 bp, Sorghum bicolor
  Clone ID: SORBI-28MAY03-CLUS80693_1
tttagtatactcttgtcattcaacagatcaggggacacaagatctgcctttctctttcttacttcctgctaaatattgataatagagagccttcaggtttcattgaaatcgatgtgatggtaggtttttttattgctaaattgaatggtttggttgtgcaaaataaggatctgcagagatctatatgtatctaactcccttttcattcagatttcatggaattctctcgcgaatctatagttgcttgcattgtgactctattctatcctttaaaacttcattttgatgttagctatatattctatcttgtagtaccaggtagaatgaatatgagacctgtatgcagaaaaaggtttttttccttgctaaattgaatggtttggttgtgcaaaatcaggttctgctgagtgctgcttgtctttcgtgcccttggggcggatcatgaccagctatgcggacacactagcggtttcatcccagtaggcagtgattgttgagatggtattttttttgttcaagcacaacattatgatcaattatggctagagttggtgaccctgtcatgccatctgccctccccgtgaacctgagcaccttgtcgattcctaggtgtttagaaagattgcaattgtaaccacaaatcatatgttttaatctaattcatggcattgcaagttaattctggatttatgctagcctgcaaattacacagtcaggtatgtggttatggcactcaaattccaactagattctcttataaaatcaatttattaactagcagtgcttctgggatatttgtggttaaatttatttttgtttaattcatgtatacgaagactaactgatgtgctgctatgatactaggctgcttggaaattaggggttaaatttattcttgtttaattcatgtatatgaaaactaactgatgtgttggtaaggtaccaagctgagagagacaagatcagtaaaccaacaaactccattaatgaaacatggggcaatgactgtacctgtcaaaataaaataatactatgagaccacttatattttgat

SEQ ID NO: 4478 - DNA, 694 bp, Sorghum bicolor
  Clone ID: SORBI-28MAY03-CLUS80686_1
cgaggaggccctagcgctgttcgcggccatgcggcgagccggcggcgtgcggccgaacggcgtggtgctcctcggcgtcctctccgcgtgctgccacgccgggctcgtcgacgagggcctccgtcacctcggcgccatggaggatgcctacggcgtggcgcccggcgtcgagcactacgggtgcgctgtcgacatgctaggccgcgcggggaggctggacgaggctgaggcgctcgtcgccgcgatgcccgtgccgcccgacgcgctcgtccggggctccctcctggcggcctgccgagcgtgcggcgacgtcgagagagcagagcgggtgatgcggtggatggcggctgtggaccgcgacggcgaggccggcgaccacgtgctcatgtcgaacatgtacgcgtccgagggacggcatgtcagggcgctgcagctgaggaagcagatgaggaaaagcaagatcgtcaaggatcccggctgcagctccatcgagatcgacggcgtcgtgcatgagttccgagcggttccggccaatgccattgcatgatgtgaaacagatcgtcttctactcaaatatatgaatgggatttgtttcgaaacattctgtgatgatgtaacaatataatagtcaatcagttaatgcctactgcagggaaaaacgccataaggcttatactgaagttaagtattgaac

SEQ ID NO: 4479 - DNA, 733 bp, Sorghum bicolor
  unsure (1)..(733): unsure at all n locations
  Clone ID: SORBI-28MAY03-CLUS80719_1
gcagcagccacttccaccaccatctgacaccgctgctggcggaccaccacggcgcggccgccggcggctcccttaacgacttccccggcttggcgctgctgcaacacaacaacggcatgttcgacccccacgtcgtccagcctcaccttcacgacagtgtcgtccttgctgggccgccggctgctgcagcggcggcggggtcaacaagggacggcggcgagcagtgtggcagcggggtgctcatggacctaggactcgacgagcactacacctacaacagctacaacagcctgctgcagatgtgaaagtatatatggatatatcagtgtgctgcaagctagctagctggctgcgttacgttgctaatgaccatgcagcttcgatctcgtcatctgattttattattcatcgttcgtgatctctctgtgcagatcgattctctgtttgtgcatgtgtgctgcactcgtacgtgtagttaatctacatatcagtagtgctgtcaattgtagtgtttgatttaaattgctggattgatcgatcattataggccgtggttgagggtgctgtgactaatgtacatacatatattggtgggtgcatcagtttcagttgctgggaaaggttggaacctttttgttgttgtttttacatatcagtaagtatatgttattgccctgtaaaccatatatataattcagaattaacactgtatatactactttttnccattagt

SEQ ID NO: 4480 - DNA, 695 bp, Sorghum bicolor
  Clone ID: SORBI-28MAY03-CLUS80738_1
aagaccatagaaaagccaaggcccattgatcgatcccgttctgcaataatgccgcttctctctgcgcaaccccgtctccgccccgacgctcaccaccaccaccaccgcgccctcctcccgccgtcggccgcagcgtccttattgccatcgccgtcttgctccgggattcgatcacggaggcggccggcgagaacgggactgcgagtcgtctctcccgagacctccagcaccgttgccaccgacgctgcgacaacggccggcgcgccgccagaacccacgcgcgggcgggcagataagagcaagtgggcagagttcgcggcgcgggtgtccggcgagtgggacggcttcggcgcggacttcacggcgtccggcgaccccgtggagctgccggagaacgtggtcccggaggcgtaccgcgagtggggcgtgcaagtggtggactggcagacgcagtgcccgacgctggcggacccggcaacgccgtgcgcgctgcactaccgcctggtccgcctgctccccacggtggggtgcgaggccgacgccgccaccgtgcacacctcccaccagcgccacgccgcctccgccgccgccttcgcgtacgccggcgcggggtcctacgtcgccgcgtggcccaggggccccgcgcccgtgctcgaggtggagcactgcgtcgtgcgcccgggcgcgcccgccga

SEQ ID NO: 4481 - DNA, 538 bp, Sorghum bicolor
  Clone ID: SORBI-28MAY03-CLUS8073_1
acaaaagtcacgcaccatccactacttttgcagattctctcagaggaaatcggttgtgactcagatgaaataatcggtatggagttgaatgtatgtgatacccagcctagttgccttggtgggggaaacaatgagttcatctattctggaagactggataatcttgcttcatgttattgtgctctcagatctctgatggactcttccaagatggcagaacaattatccaatgagaaggccataagaatggtagctatgttcgataatgaggaggtggctccagattcaatgcaaggggctggtgcaccaaccatgttccaggctatgagacgaatcattgattccttgatgcatcagtcgatgggggagggagctctggaacgtgcaatacattcttcattccttggttcggcagacatggctcacgctctgcacccaaactatgccgaaaagcatgaagagtgccacagaccagaactacagaaaggacttgtcatcaagcacaatgctaaccaacgttatgccacaagtgctgtta

SEQ ID NO: 4482 - DNA, 565 bp, Sorghum bicolor
  Clone ID: SORBI-28MAY03-CLUS79778_1
taaggcagcttgtgctgctcatttgtttggaccagaattcccatatgtcaaagcagttgggagctatattgcaaagcaagaagctctggatgaaatcagtatcctagtcagaaataagcagaactctgtcaggctattagaaactttggagaaactaacatgatgattcgtcttgatccggcatttcaccattgcttggtgttggtaattagcataatgttgacaaatttttgtagacccctctcagggggcaaaattttgtaggatcaatagcatgcccccaatgtagtagtgttgtaggcagaaccttggtgctggtgatgccatatgtagcagcaaaaacagcagacatcagaaacatggaaatagaagccatctagttttttgctcccttgttttttgtgaaatgtaaatacaagggcgagaaagatcctgaaaactatacttcgttatactctgagggcctttttggcaactttagaaatgaaattttaagctccgggtatcccttgtaattgtttctcttgtaatttgctgtttggatgaacaaagtccactgcagctc

SEQ ID NO: 4483 - DNA, 641 bp, Sorghum bicolor
  Clone ID: SORBI-28MAY03-CLUS79838_1
gcacgaggagatagaagaagcaggaagggaggagcatcggttcttggttgtgctggtgggaatcgcggtcgggggagtccgatcttggcgacgcggggaggtcttcctcttcccacggagccccggcggggaccggcggcgaccacggccacggcgatggccgacgggctggatcggtggcgcgacttcttccgtggcgccggcgccggcatctgcgacgtgatcgagaacgccatcctcgtggcggcggccgacgcgccgcgggagctcctgcaccgccgcgaccgcatcgccgagaggctcttcaccacgctccgccgcgacgcggcgccgccgtccttcggcagcgccgcggcgtccaccaccccggccactcccgttgaggaggacaagggcagcgtgcgacgcgtcgccgagaaggagtgcaaggtcgacagcagcagcaacggtgcccacggcggtggcggccatggccacggcgatgaggacgatgactctgactctgacgacgagcgcctccgccgcgccgcggcgagcaactacggccacagttacgatgatgatgacgaagatgacgaccaacagcaggaagatgagcagcagcacgccgcggatgatacagaagaagggaaagaagaaga

SEQ ID NO: 4484 - DNA, 607 bp, Sorghum bicolor
  Clone ID: SORBI-28MAY03-CLUS79854_1
ctactgggtcgcctcctcctatccccgtgtctccccttcctctctccctcttcctccccctctccctcccaaagtggcatcgctgctctccctccctccctctctctctctcgaactggcagcgctgcagcgcgccggcggcctcctccccctttgcctccttaccctgtacctcctccccctctgcagggtttagggtttaggggcacgccggcggataggacgaggcagcgacgcacctgctggctagaggcgtgggtgggtcggcggcacacggatccagggcctccaccgacggtgacctccccatgcccgctccataccgcctccccgcgccagccacggtggatccagcggatccaaacctagccatggcggatccaaccccagccgtggtgggttgggccccagccatggcggatcctatggatttggcccagccatggcgcgtgcgacgacttgctgcccgcgcctccaggtaccccgccgcgtcttcgaccgcctggcgccacctctgtctcatccactcctccatggattatttgtcccgtaggacgctgcttgcgtcgattcgattcccatgggccgttcctcgtgatgctctgct

SEQ ID NO: 4485 - DNA, 749 bp, Sorghum bicolor
  Clone ID: SORBI-28MAY03-CLUS79861_1
cgtgtgacgttgaaataacaatatctcagccctattacatccgagtattatgaagctgacaattaccacaacattcccgcttcttcttgtcgttggcaggtaaaagacaaatttcaacatgcaccgatgtcttccattttctacacagtgctatgcctttgcaaattattttgttcaaccacctctctcttgctggagttcccagtcaaactgaccaaacctatggtaattatgcatagatgaatatatcaactatatgtgtgcacaaacataggaaacacaaaacagccctcagctattaaatagtcgtgggtttccaatcgctgtcgaacttccggtgctctgagattggcattcgagttctcacagcctcaacttttgataaatcaagatctgcaactgcaaatccagtcgagagccgatctggaagtcgagctatcactgttccccatggatcaataattatagaatcaccatagctttctcttttttcattgtgctttccagcttgggcagcagcaataacataacattgtgtctcaattgcacgagcgcggaggagaatttcccagtgtgcctccccggtcccctctcggctcccccccgcgtcgtctcgtccctgcgcgtgccgctctttgcgcctgcctcgcggcggcccgggcgttctcgagccagggcggtggccatggctcgctgccgccgccacctcctcctccttgctctctttctcgccttggctgctgctgctc

SEQ ID NO: 4486 - DNA, 499 bp, Sorghum bicolor
  Clone ID: SORBI-28MAY03-CLUS7988_1
cggacgcgtgggcggacgcgtgggatactgtgctcctggatgcaataagttggaggattcctttggtcagtgacataccaactattatatttggtgcggatgtaacacatcctgaaactggggaggactcaagtccatcaattgctgccgttgttgcttctcaagattggccagaagttacaaagtatgctggattggtttgtgctcaggcacaccggcaagagctcattcaggacctttacaaaacatggcatgatcctcagagaggcactgtaacaggcggcatgatcagggagctcttaatatccttcaggaaggccactgggcagaagccattgagaataatattctacagggacggtgttagtgaaggccagttctaccaagttctcctttacgagttagatgccatccgtaaggcatgtgcatccctagaaccaaattaccagcctcctgtaacatttgtggtagttcaaaaacgtcattataccagaatttt

SEQ ID NO: 4487 - DNA, 629 bp, Sorghum bicolor
  Clone ID: SORBI-28MAY03-CLUS80848_1
gtttgtccaggattgactcatgcacagaaacttgggatatcatactctgatggagaggataactttatagagcagacttctgaaagtcgtgagcatcatggtgaatctgcagtagaatctagcatccaagaccaatcaagttctattatattaatctctcacccagtcacaagccgacaggatgaggctttggagagtgggtctggaagtcaagatcatggaaacattgttgtaacttctgattctgattctgattctgattccacaagccgtgataatattgttggagcgaacactgaagaacttatggaggacattgagggcacctctggacaggacaaaagatgaagaggttgctcagagtgttgagtcgaagatatcaactgaccctttgttcatgtagcgacccatttctgtggaatctccagggtcaatagcttgctgaatgcagagcaagttagcaagcaagcaaatggctggtagacgcttcagtatcttgtccgattctcaacatctgaaaggagttcttgagatgattgggcgccatattgttgcgttgaggactgactttgaacgtgggaaattgatatttactttcagatagtagtatattacagggtgggcattca

SEQ ID NO: 4488 - DNA, 576 bp, Sorghum bicolor
  Clone ID: SORBI-28MAY03-CLUS8099_1
ggctgcagtaccttgcggtttccgggaacgaactctccggcaagataccgcccgagctggggaacctcaccagcctcagggagctctacattggctactacaacagttacaccggtggtcttccgccggagctggggaacctgaccgagctcgtccgcctcgacgccgccaactgtgggctctccggcgaaatcccaccggagctcgggaggctgcagaatctggatacactcttcttgcaggtgaacggcctcaccggcagcataccgtcggagctgggctacctcaagagcctcagttctttggacctgtcgaacaacgcgctcaccggtgagataccggcgagtttctccgagctcaagaacctgacgctgctcaacctgttccggaacaagctgcgcggtgacatccccgacttcgtcggcgaccttcccagcctcgaggtcctgcagctgtgggagaacaacttcaccggcggtggggcacgaaggcttgggcggaacgggcggcttcaggtggttgaacttttgttcaacaaggttaacgggacccttgcggcggaggttttggccgggg

SEQ ID NO: 4489 - DNA, 663 bp, Sorghum bicolor
  Clone ID: SORBI-28MAY03-CLUS81069_1
actccctccccccgctgcccccctgccctccgccggcccgcccccgccctcgcccacgcgctctcgcctcccgcgccctctccgccggcggcccgcccccgcccggggccccccccccgtctccccccgtcccttcgccggcgccgagctcccccccgtcacccttgcctgcgcccttcgagctttttgtctgtcctcccctctgcgatggtttgcctgggttcatccggtggccgtgcccactccctggtcccgtctcgggctccgcccctgcctgtgtccgcccccctcgcccgcaggagtgcgcgcgtctcgaaggccgtccgtcccttcctctggctctgactgcttggggccggcctgtcgcgggtcccttcccttggtcgacactgaagccgccgtttccgcactggctgcggtcagccaccgctggagtgcgccacgtccgtcggccgtgcgaccctgcctcaggctcttacttcttggtgcgggggagccagggagctcgcccatgtggaaccagatcccgctccttttcctttctcgcctggttgtcgcggggctggagagctactcgccggtcttcctggcgggcgggtttccccctcgctaagcatgctacgcgtgcagggtgtttgtatgcgggggctagagccagccatt

SEQ ID NO: 4490 - DNA, 1300 bp, Sorghum bicolor
  Clone ID: SORBI-28MAY03-CLUS81123_1
ggggggatagctcgccgccgccggtccactcgcccaccgtctactccacctcgcctatcatgtctgccgccacagctgcagctgccgctcggtgcgtcccgctccgggcgtccccgccggagaccgcgaagtctcccgcttccgtgcccacctcctcggccgcctctgcatctgctcccctccgcgccgccgccgtcgccgcgggacctggcggccggctcccggtgccgccgctccggtgctcctcctcgtcgccggagaactctgccccgccggatcttggcttgcttctggaggtggaaggagttcttgcagatgtctaccgtttcggcaatcgccaagctttcaatgtagcatttcgaagcctcgggctggattgtgcaaattggacagagccaatatatgctgatttggtgaggaaagctcgtggtgatgaggaaaggatgttggcaatattctttgacaggattggctggcctgcatctttgccaactagtgaaaaagggacatttataaaaagtgttcttcgtgagaagttgaaagctttggaagagttctcaggttctgatagcataccactacggcctggagtcgaaaagttcattgacgatgtacttggtgagggtatccctttggccatattggcaacatatgggagaaatggggaaaagatttcaagatctatagctatgaaattaggccctgaaagaatctcgaaaataaagattgttggaaaagttgaggttgaagaaagcttctatgggcaacttgttcttggtaaaggagtcacatctggtttggatgagcaacttgtcagggaagcccaaaagtctgcttctgcagagaagcagaggattgcagaagaagttgcatcgatcctaaaacttagtgttgacatcacagcatccgaaagctctgataaggtaatagcagctctccgagctggttcagaatatgttgggtgtgacgtgcaaaattgcgttcttgttgcgggcagccaatctggtgtgcttgcagctgaacgcattaatatgccatgcatagttgttcgaagcagttttactgcaagagcagaatttcactctgcaaaggcagttatggatggattcggagacacagacttaaccgtttcaaaactactgagcaaaaggtggtcttaattatgtgtcacttgtgaacacaaatgtttggattggaggctgttataaagttgtaattgattgagtgctaaccggaccaaagctttatgtaaacatgacacttgaggtgttgctgatgaaagctgctgagtaataaaatg

SEQ ID NO: 4491 - DNA, 624 bp, Sorghum bicolor
  Clone ID: SORBI-28MAY03-CLUS81164_1
tggcgcatcagatattttctgcgcaccagttctgtcttctgtgggctatccccccacccatcgctttccacgccgccggccgccggccgccgcgctgccaatccggacagacatggactcggaacccgacttcgagctccgaggcctcgacatcgacgtcgaactcgacccggaggaccttcagccgtcggtgcccctcaagaaggtccccggcggcgacctcttcgaagcggcgcgggccggggattgcgatcgcctcgccctcctcctcgaggccggcgccaacgtcaatgcgcgcgaccgctgggactctgtcgcgctctattacgcctgcctggcgggacacgccgaggccgcgcggatgctgctcgaggccggcgccgtctgcgccgagcgcaccttcgacggcgaccgttgccactatgcggccctcaacctgcgcctacgttggctgctcaagccgttcgaggccaggccgccaccgctcgcgccgctccccgccgcgctgcgggcgacgttccttgcctgccccgccaaccgcaccgctttcctcgagatgctccaggggagcgccggcgccgaatctgccgccctcgccgcggccgccggattcgggccaaagga

SEQ ID NO: 4492 - DNA, 640 bp, Sorghum bicolor
  Clone ID: SORBI-28MAY03-CLUS84726_1
gcgctcgcctcccttctcagttctcctccacaccccctctctcccttctagatccactcctccccgtgctcacggctcatctgcgagcagattgagcggggagccgggaggggcaggccgaggagccgcgagggggagctagattgagccatggctctcctccacttgcgctcttgccctggttcttgcgctgtcggtcggtgcaagcgtggcgcgtggctccgagccctggtggaacgagacgcaggtgtacaccaccaccgccaactccggtggcagcaacggcgtcttcgtcggcctcaccctcatccagtcggcggcggccaagggagcggtgtgcttggatggaagcttaccaggttaccacctgcacagagggtttggatcaggagcgaacagttggcttgtcaatctcgagggtggaggctggtgcaatgatgtcagcagctgtgtgttccgcaagggtagtcgtcgtggatcatcaaatcacatggagcggcaactccagtttacagggataatgagtaacagacctgatgagaatcctgatttctacaactggaatagagtgaaggtccggtactgtgacggtggatccttcactggtgatggctctgatgcggctgcaggcctttatttc

SEQ ID NO: 4493 - DNA, 644 bp, Sorghum bicolor
  unsure (1)..(644): unsure at all n locations
  Clone ID: SORBI-28MAY03-CLUS847_1
gggggaggggcggcgtacaaccctaacacacacgcctgcaacccgtgcgccgccgctgaccagagatctggtgcgccgccaccgccggcccacaccgccccgtccaaaaaagctcggattgcccccctgcggccctgcccccgccgtccctgatcgagtgatcgaccgaggccctgaccggcctgaggcctccgtcacctctgctcgccgccggccggggctgccgcctgccagatcgagaacatctcctgcgtcaatcgagggcacgacttcattcactgaccggtacgtgtgtccaattcgtttccctgtaacttcattcactgggcgtttccttcgtgatttcatctgtgatgtgtgttccatccgttcatcattttattttttgtttatttattagcgaaatctagctagctaattcgccccccgtgtagttcatgctatctaccatcatctcaacaaaactatatttacaggcaggggagcagctcgacctccgacgtccccatacggcctcgtcaggccagctccgtgcagcagatagctgcgatgcaagtaggacnagctgcatgaggcttatcggcnagagcttgcggccagagaccagggccatcggccccacatggaggcacatcanaagcaca

SEQ ID NO: 4494 - DNA, 669 bp, Sorghum bicolor
  Clone ID: SORBI-28MAY03-CLUS84804_1
tatgctgggttcctggtgctagccgcggccctgttgaccggtggtccgtccatcctcctggtggcgtcaccacccttgtgggctggtccttgtgcactaggcgcctgttcttgtcaggtcctcttttccccagcggccgcctccggctctcgtgagtcgtcggttcgccttgccgtctctctgctccccgccttcttcagccatgcctgggctgcgtggcagtggattggtggcccgactatacccctggattcgtcaccacccttgtgttccctgcgctctcttaccctggctgcattgtgctgttgcgattctgatggccccccgtgtctgtgttgacggtcaggtcctgcgcctctcctacttcggctcgagcctgctggcccgcgcttgacggccctccctggctgtggggttgggctgcagctgcccttcccctccgtccttacctgccgacttgccgtcgcgtgtcaggagattctcgctgatggatgcggcttcaggtgccttcgccttccctgcttgccgggtctctcggagtcgcgttcgtcgggactctcgttgctgccagccccttgaggttggtactgaataccatcttgcagaatcttacagagttgcaatcttctgtacactagttacagccatgccaattgaattcttgaggtt

SEQ ID NO: 4495 - DNA, 679 bp, Sorghum bicolor
  Clone ID: SORBI-28MAY03-CLUS84946_1
actgagtcagcgctaaagggctcccacttcattgaattgtgtgctcagcggcatattcctttgattttccttcaaaacattactgggttcatggtcgggtcgaagtctgaagctagtggaattgccaaagctggagcaaagatggtcatggcagtttcctgtgctaaggttcctaaaattacaataattgttggtggaagttttggtgctgggaactatggaatgtgcgggcgtgcatatagcccaaactttttatttctttggccaactgctaggatatctgttatgggtggcatccaggcagctggtgtcctcgctcaaattgaaaagacccacaaaaagagccaaggagtggagtggagcaaggacgaggaagaagccttcaaggcaaaagtggtggaggcttacgacagagaaggaagcccgtactattcccctgctagactatgggacgacggggtcatcgaccctgctgacaccaggcgggttctcagcctctgcctctctgcttccgccaagccggttccggaagatacaagatacggtgtattccggatgtaaataaacgtgtatgaataacgcaaccgtattttaataaaaacggcttccatgcgcccaatgtgcgcgctggactttgccttttgcacaaataaaattttgcccgggttttttgttgttg

SEQ ID NO: 4496 - DNA, 704 bp, Sorghum bicolor
  Clone ID: SORBI-28MAY03-CLUS81239_1
acagcaaatgcattggttctctttattgatagctaacacgtctttgctttcgtgcacttccttttgagaggcaatgaggtggaccgtagaatggagatgtgatagaagatggcctttgaatctctctcccaaacttccaggtccagtggcgtcagagcatgctcccctgccaactgatcacctctgaccgtctctggtggtgtatccactgtcgggtttgtgccccgctgccacaattatgattgtcccaaataagctactctgcgtgaacagtcccacaggctgtctcctgcatccggcagcaacgctgcggcacttcgcctgacggccctacctccactggaccgattcctaagccaggagcacaccaaaacctcggcatttctgaaactacagcgacaatgatggtggctgccgaatgctggcttgaagacgttgcctccggtatccgtagctgacttagtgcctcccttagtcccttttacatagcacatggccaacaagaaccacaacgtaactataaagccttgtatattcagaagttctcttgagttattgtaaactctttgcattgcctgtatatatgtgtttggcacgacatgccagcaaccaccttgtttattgaggtgaaacccctcttctgtagtgtttggcttgttttaaggacaatatccttgtattaaactaatgtggtaaaattttcc

SEQ ID NO: 4497 - DNA, 657 bp, Sorghum bicolor
  Clone ID: SORBI-28MAY03-CLUS81241_1
acggcgcagccgttctcctcgctcgccccgacaggccgccacaccgcccacagtcgtcgtgcgcgcgctcccgaaccttgctccactcctacaccagccgccgccgctgcgcggatggcggcctccggtcctccccctaactcccccttcgcaccttgctccactcctacaccagccgccgccgccgctgcgccgatggcggcctccggcccgccgctcgaagactgcctccgcctgctccgcggcgagcgcgacgagcagaagctggcgggcctgctcgtcgccaccaacctctgccgcgcgggcgacagcgacgccgtctccaaggtctaccgtgccgttgggccccgcttcctccgacgcctcctcaacaccgggttagggaaagtggagggcgggaaagaggaggagcgagaggcatacctgcggctcgccgtcaccgtgctcgcagggctcgcgcgcgtcccggaggttgcggccgacgagggggtcgtttccactgtgcccctagtcgccgaggttatcacgaaatcgactgatccagcaatcactgaagaatgctttgaacttctgtcacttgttgcaatagcctctgaagatggggcatataagttttgtgagcctggtgtagtagacatgatatccttcaaatcttaa

SEQ ID NO: 4498 - DNA, 408 bp, Sorghum bicolor
  Clone ID: SORBI-28MAY03-CLUS8125_1
gtgactttcatggatattgtggcttacttgaagcccaagtatgttctcatggaaaatgttgtagacatactcaaatttgctgatggctacctaggaaaatatgctttgagctgcctagttgctatgaagtaccaagcacgccttggaatgatggtggcaggctgctatggtctgccacagttcaggatgcgtgtgttcctctggggtgctctttcttccatggtgctccctaagtatcctctgcctacatatgatgttgtagtacgtggaaacaccccaaatgccttttcgcaatgtatggttgcatatgatgagaaacaaaaaccacacctgaagaaagctttgcttcttggtgatgcaatttcagatttaccaaaggttgaaaaccatcaacctaaataggttatg

SEQ ID NO: 4499 - DNA, 815 bp, Sorghum bicolor
  unsure (1)..(815): unsure at all n locations
  Clone ID: SORBI-28MAY03-CLUS81338_1
gaggcgcaagctccacaactgtttttccttctcccgttcagcccgcgtgcgctgtgtcactctcccagcgcgacgactggcgaccgccggccccaccctacgccaggtgacgagggcttcgccgggcccttcgccgctcgccggcgacgagcacccaccagggtttaaaccttttcgggaggacggacgcacgcactccgcctccgctccccttcgtctcgaccgcatctgagcactccgccgcaggtccgcctccgcagccaccgccatgtcgaagcccgcggaccagcagccatcggacatgcaggtcgactcctcctccgccgtcgaggaaaagccggccatcagattctccatcaacgtgcttgagctcatgagggaggcgcagatgcagcatggtctccgccagagcgactacacgcggtaccggcgatactgttctgcacgactcagaaggctgtacaagtctctcaagtttttgcatggccgaggtaaatacaccagaaggaatataaccgagtcaacagtcacggatgtgaggtttctccatgtagtattttacatggctgagcgagcatggagccatgccatggagaagaaaactgctggtacaaacgcacaacagcgtatctacatgttgggtcgatttaggaaagcggttaaatgggcatcacttttttcgcaattatgttctgtaaaaggagattccaggacatctctagaagctgaggcatatgcttcatatatgaaaggtgctttgttttttgagcaagacaagaatatanatgccgcaatgataaatttcaagaatacga

SEQ ID NO: 4500 - DNA, 538 bp, Sorghum bicolor
  Clone ID: SORBI-28MAY03-CLUS8131_1
gcacgaggacttgctacagttaatcaaaagatcttaccacttcctggtgatgtggatgtcatatgtggaggaccaccatgccaaggaattagtggctacaaccgcaatagagaatttgatgcaccattcaactgtgagagaaataagcagatcattgtcttcatggatgtaatgcaatttttgaagcccaaatacatttacatggaaaatgtccttgatatactgaagtttgctgatgcaacacttgcaagatatgctctaagtcggctagtttctatgcattatcaagcaaaactaggggtcatggctgctggatgttatggcctcccacaattccgaatgcgtgtcttttttggtgggctgtcatccaaaggaggcaagtaatagttcccctgtattatgaagtcactttcttctgttttccccttatttctatacctctaccctgtagaaattacccccgtttcctctacctactcatgaggcaattgtgaagaatggttgcccccttgccttttgagcgtaaatttaattggat

SEQ ID NO: 4501 - DNA, 681 bp, Sorghum bicolor
  Clone ID: SORBI-28MAY03-CLUS81628_1
aaccaccagggcaccacacaactaccaccacccccgtctggccgtctcgccacgctcgtccgaccgtctcctaccgggctccgtcccgccgcccgcatcacccacggggaagtacagccgcgcccccaccccgcgttccccgctgcgcgacctgatcgtacggccgggggaggctgccgcgcctcccgacctcgcttccgcctcgtctccccgaccggacaagcggcctccgtctgaagatgcagggcggcgtctccggattccagaacgcgccggtgacgcgggcggtcgtcctcgcgagcggcctcctgtccgtcgtcttcagcgcgcagcgccgcgcccgcgcccttggcatctcataccaggacactataacgaatttccgtttatggaagatattcccatctgtatttgcttttcagtcaacaccggagttaatgtttggactgtaccttctgtattacttccgtgtgtttgagaggcagataggctctaacaaatactcggttttttgtctgttcactatcacagcatcatcactcctcgagatcctgtcattggttatcctgaaagatacaaactacatcagtacgcttgcatcagggccttatggtctaatatttgcctcttttgttccattctttcttgacattccggtcacatcacggttccgtatttttg

SEQ ID NO: 4502 - DNA, 563 bp, Sorghum bicolor
  Clone ID: SORBI-28MAY03-CLUS80767_1
cggggccgccgcgcgccgccatgtcgactccccccgccgccccccgccccgccgccgcccgccgccgccacgtcggctcccgccgccgccgcccccgccgccgccccgcccccgccgcccccccccgtccgctcccgcccccccggccccaccgcggcctccgccgccgccgccccggccctccccccccccgcgtcccgcgccccctcccgcgccccggcccccccccctcccccctcccccctcccgcccccccccccgcccccccccccccccccccccccgccccccccgccggctccccccccctcccgcccgccccctccccccccgcccccgcccccccccgccccgacctccccgcccccgccctccgcctcctcctccgtccccgccatctgccccccacccggcccgccgccccccgccgcggcccccgcccgcgccccccccgccgcacgggcacccccgagaacgagccggagcccttcgatccggtcatgttcttccagaattacatccacagcctcatggaggggggcgccaacatccaggtcctcctc

SEQ ID NO: 4503 - DNA, 639 bp, Sorghum bicolor
  Clone ID: SORBI-28MAY03-CLUS80772_1
agggtgcactgtgcacgctccacggccatccatggcgatggcgccctatccagtattgcagcagcagatccacctcggacacgccagcaagcccacggctacagcttcagttcaccatcacgggcatggaaaccccaacgccgacgcagtggcgccgtcgctccggcgaagcttcccggccgacgcgcgcggcctccgggcgctcatcaaggtgctgcccacgtcctccgcttcggcggcggtggcagtgcacgcccacgcaacaaagctcgggctggaccgcgagcgcaccgtccgcaacggcctcatcgcgctctacctcgcgtgcggcgagcgcgcggccgcgacggcgctcttcgacgcgttcccgggcgacggcccggacgtggtttcctggacggccatggtgaccgggcacgggaggctgggcttcacccgcgacgccgtggctctgttcttcgcgatgctcgatctggacgacggcgtctccgtcgacgcggtggccgccgccgcggggttcgcggcctgcgcggaggcgagggacctcgcgctctcccgggaggcgcaccggcgcgtcgcggcggcgagggtcgcgctcgatgtcgtggcgtggaacgcgctcgtggacatgtacgccaa

SEQ ID NO: 4504 - DNA, 651 bp, Sorghum bicolor
  Clone ID: SORBI-28MAY03-CLUS80777_1
gatctcatcctgttgtcatctattcatctcgttggacacgaatacgaccgatagcagagcttagcaattatatggttatgggtgcgctgttcccatggctggcatggttgctcctctccctcgccggcagcatatacctcctcggccatctcgtgcacgaccgtcgtcgtcgccgtggtctaccgccgggaccccacccactgcccgtcatcggcagcctccacctgctcggtaaccagccgcaccgctccttggccaggctcgccaagacgcacggcccgctcatgtccctccgcctgggcgcggtgaccacggtggtggcctcctccccggccgccgcccgggagatcctgcagcggcacgacgccgtcttcagcaacaggcggtccgtgccggacgcccccggcgcccacgccaggaactcgacggtctggctgcccaacgcgccgcgctggcgcgcgctgcgcaagatcatgggcaccgagctgttcgcgccgcacaggctggacgcgctccagcacctccggcgcgacaaggcgcaggagctcgtggaccacgtcggccggctggcgcgaaacggggaggccgtgaccgtcggccgcgtcgcgttcaccaccagcctgaacctcgtcgcgcgcaccgtcttctccc

SEQ ID NO: 4505 - DNA, 1231 bp, Sorghum bicolor
  Clone ID: SORBI-28MAY03-CLUS80806_1
taccggtgttgaattctaccccattggatccgtccgacgcacagatccgcaccaccatgggccgacgcgcccacgagctccggcgactcgccgccgccgccgcctcctccgcagccggagaacggttccatctcctccatggtcgcctcctctgccgcctccgcggcggccgcggccgcagacttcacccgctgggcggagaccttcggcaccgagaaggccgacgccgccaaggctgccctagcctccgccaccaccttggccacctcatccgcctccgcggcggcttctgcttcctccacggctgcgtcctccgcctacgcggccgcctccgacctcaccctcatcgcgaaggaagagctggaatgggtgaagaaggagtactctgctcacgagcagattgtgtttagcaagatcaaagagggcgttgtcatggcgataatgaatccaggcattgctgcaggttctgcaacccttgcagggattgtccttttcaaaaggccaaggagctaccttattcaacgagtacagcgcatgtttgttagcaaggagaccctactttctggcgtacaagctgaagtgaatcacatgcggcagactgtgaatcttgtatccaatgaacgtcaaaaactgttggatagagcagcaaccgcagagaaaagatttcagaaaggatggaatacactcagggaagaagggcgttccattcaacatgagctgagtgagattagagatattggaaaccatgcagtaggtctgaagggaattattgatcagcttcccagagcacatgcatctgaatttcgatcggagatatctggcctagcttcccaggttaagaaggagaagcgagtgcttaatgccgccctcacgaagattgtgaattacggtgtccccatctgactgcccctccagccagttgttctgagggtccattgtatcagatttttgtgaaggaaggcaggttctatggtgaacgctatactgcccacttggtttcgagaaaaatgagaaaagaataagttttgtcacccgtgcagatttgtaattgtgctgctgctgctgctgcctaatgtcgcagaagcaacatcattgaaaccagagtaacagatgacattttgcaatttttttttgtttgcctattgacatgttcaccgccatcagctggcatatgttatttccaactgcttgttgccatctctaatgtatgacagagaaaaaaaaaagctta

SEQ ID NO: 4506 - DNA, 739 bp, Sorghum bicolor
  unsure (1)..(739): unsure at all n locations
  Clone ID: SORBI-28MAY03-CLUS8084_1
gttgctttgaacttaccaccaccacctccacttccgacagaaccacaccgttctgctacattaccatctcaaggtggacacagtttgcccacacagataaatcaccaactttatcagccagagcattattatgtgcctcaaagcaactatggtccattagctccagctagccattctaaccttcaaatcagcaacactaacaaccccacccctgccattccacaagtgaaccctggacctccaacaaatcagattgggaatttggcccagctccagcattctatgccactgcatgttgatagagcaagtcaggatttctcttctcagttgcaacagcaaaatcttggtcctggtgctgcacaagcccctgaggaggataaaagcaagaagtaccaggcgacactccagttagctcaaaacctactgcttcagatacagcagcgcggatctggaaatcaatcctgagactaattatttcttcaggtaccgtcaattctcatgtcagccgccggtttcagacaaggatgcagcgcacaaacgaagcggcccatggtgtcagtccgttagcctacaccgacgtacccctgtcctgcctttttttttatttaaagacagacattaccagaaaacaatttcttttctcccttgtttttttttgccnnatgtatttgaagaaataacccggcctggattttgtactcgtatgttggcatggccttcgtgttatattattattatt

SEQ ID NO: 4507 - DNA, 1108 bp, Sorghum bicolor
  Clone ID: SORBI-28MAY03-CLUS80934_1
acgcccgcgtgcgcactctccagctgagcgactgccgccgccgccctatgcctggtgcccaggtcttcgccggtccctgcgccagatcttcgccggccccttcgctaggtcttcgccggcgacgagcactcgccagattttgctgagaaatttcactttgaagatggttaagctctttttgcaagtgccggcagaatgtgatagtgttaatacagctgccgtcgaagagaggaaaactctttttcgcaatgttgagtccataatcaagtcagttacaagatcagcaggcaggtatgaagctcggttgtggctctgcgccactgtctcattggtccattcgctcagttaccgtggccagagggacctgtttcttgatctcttagagatgaagaattccaggcgtgatgtcgctgctcgcttgctgcggatgattttcgataagaaacccaaagtggtcgggtctattctagcaagaaaaggccatatgctggaggaggcccgccgaggaaacccaaagaggataatgcagtggtttggccactctgctgttactggggaatccacacataaaaagggagctaaggcactttctcagtttgcatttgtaaaccgtgacatgtgctgggaagaacttgagtggaaaggcaagcatgggcaatctccggctgtagttgccaccaagcctcactattttcgtgatcttgatgttctccagacagtagagaatttcttggagtatgtcccagatttctggtcttctgatgagctttgctaattctattaaagatggtgaaatactgcaaatcgatgcagaatattttgtagatcaatttttgtacttgatgtatgaggagaattccaaagatgcatggcatgcggttgaagattttttgatggacgagcagttctcctctctttgccagcatcttcttatccatctggatgagcataggcttcttgatttcttaaagtctttaggcaagctcatcaatcctactttgcagtgcaaggaattggcattcccatgttgttggcttgaggttcttttatcaggacactgtgatcacatatcttttgatgatcttgtcttattgaactgtgtcattgc

SEQ ID NO: 4508 - DNA, 648 bp, Sorghum bicolor
  Clone ID: SORBI-28MAY03-CLUS81561_1
cggctcgaacccggagtacttcgccgtgctcattaagtacgtgaacggcgacggcgacctctccgccgtcgacctcatgcagaccggggccggggcgtcctgggcgtccatgcagccatcgtggggcgccgtctggaagttgaacgccgggtcggcattgcaggcgcccttgtccatccgcctgacgtccagctccggcaagcagctcgtcgccagcaacgtcatccccgccggctggacgcccggcgccacctaccagtcctctgtcaactactaaatccagaattataaatactgcaaagtatgcaagcatgcaaatctgatcaatgcgcagcgcagcatgcatatatacacatatataagttgatacgtcgtctcgtgtgtgatagctttttactgtatgtttgtgtgtgtggactctcgctagtcacaacacagtgcgtggcgaaggtgcaacaagctgcaataatggcagaggcagagcaggaggaggcgcagtatacgagtatagttctcccctgatcttcgccgctagtcaatgcatatatatgtttactatactgagatgtaagatgtgctgtcgttaataacgttgtgtatcagtgaacgcagcttggcgtcactgcataatggagtactgattatgtg

SEQ ID NO: 4509 - DNA, 593 bp, Sorghum bicolor
  Clone ID: SORBI-28MAY03-CLUS81486_1
atttgagggaggccagccaaagctaagagcaatcgagagcgtcacggcgccagccagcctgccctgccctgccctgccatgctcaatcatctgctggtgctggtgctggtgctggtgctggtgctggtgctgtggtgtctcaacaaaagcgagtgagccgagctgagagctgaggcacgttgcccacaaccaacccacacttgccactgcccaccgccctccccccccctctctgcccttatctcttcttcctctcttcctcgtgcaccaaaaaccagcaacaaaggtggcagggcagatcagagctgatatctttgctcaagcgtccatagcagccagcacaagatgtcgacggttgtgatgagagtggatcttgagtgcgaaaagtgctacaagaagatcaggaaggtcctctgcaaggtccaagacaaagtgagcatcaggaccatctcctacgacgagaagaacaacacggtgacggtgtccgggcccttcgacgccgaggaggtcgccgacaggctcacctccgacgccggcaaggtcatcaccgacatacacgtcgtcgggggattcggcggcttcgccttgggcgg

SEQ ID NO: 4510 - DNA, 619 bp, Sorghum bicolor
  Clone ID: SORBI-28MAY03-CLUS81577_1
gcatacaaattagtatactcgagcgaaaagaacttcactcgatcgcatggacttctggtgctgtgctcccttttgttggattcgcagtagcaatgttcctgttctactcaactgtaccaataattttaaagatatgtggcgcaaccatgctgaacctctcgctcctgacttcagacatgtgggctgttctgatccgcatctttgcttaccatgagaaggtcgattggatctacttcgttgctttcgccgccacggcgggcggcatcgtcttatactcatacaagggctccaatgaagtggaggagacgccccaggtcgccggggccagcgacgagcatggcaaggacagggacgaggaggctggaacgcggaacccagtgtgaagctctggtgccagcaatggctgccagacatccaggaggctactagattagctgtgatgagtagttgcatggcttggaaggcgatcgagcgcatatagccctaggataataggaagagcttgggagttcaggcttggactgcttgagagcggcaatattttcagagaatttgatgaagtgtagcaggacttacttgagacttgacggaaatagtgatattatactcctatttacga

SEQ ID NO: 4511 - DNA, 668 bp, Sorghum bicolor
  Clone ID: SORBI-28MAY03-CLUS81599_1
tatgattttgtgattcctgggctgatccagggactgagggtctatggcctttacaacagctaccaatacccatgcagagtttgctgcacttccgaagaattaatcaccggaaaatcctgatcaagtgaatcaacttctctaaaatgttgtagactgatatcaaggttggaggggaggctcatgttaatgaactaaggctaacttacataaaagaatggagattttctcttcttgtcagccaacgggacaggttgatgaaaaatgagggatatcgtaatgagaaaaatactgggggtcattctgtaacgaggagacactgtaatggtgaaaatgtcaacagttccactcactttgatggacatgatgcaatgatcagtgccagttccttggtattccaggctccaatgccagtacaatattgattaagaactgctgcagactgcagtttacttaaacagacaatttttaaggctgtaactcgtgtacatcagaaattgtcatgatattttgtgcttggtacttctgggtttcatagtatatgtattgtaggaacagaattcttgtaaattgtaaacagttgtttttttagcaggttgtgaacctttcatagctgaaagaataatcttaattctgggtgtgttatgattcttcgagagtccatttatttt

SEQ ID NO: 4512 - DNA, 657 bp, Sorghum bicolor
  Clone ID: SORBI-28MAY03-CLUS81601_1
ggcacgccgcctgtacggctacaacaggtactaccgcggcggcgggatcacgctgacggcgacgccgcggtgcgcgtacccggaccagcggctgcagggggcgctggcgacggagctcttcggccgcgtccatgtccggctgttcggcggcgacctgcagtgcgagtggggccagttcgagtcctgggacaagtgggccaaggcgtacccggggagctgggtgttcgtcggcgtggtggcgtcgccggaggccgacggtgacgcctacatgtcgcagaaggacctctactatggcatcctgcggttcgcgcacaaggagcccaactatggaggactcatgatctgggacaggtactacgacgtgaagaaccattacatggtctgaattctgatgaataatgacaacggccacctctccaaacacacgacgtcagccacttgaatcttagataatctcggagattatttgtttgtataaacacatatatatttgcaacaatataagtatcaacaaataaaagcgtgaagccataatattctgtgtgccatgcgtgtaattgatgtaagttttttttagaataatgtaataactgatgtaagttattccgacatctctagatatttctctagatacctagcaataaatataaattagtc

SEQ ID NO: 4513 - DNA, 684 bp, Sorghum bicolor
  Clone ID: SORBI-28MAY03-CLUS81161_1
ccccggggcctgctccctgctcccccctgctcccagcggcctcgggtcgcgggccgcgggcgccgcggcccccgccgcccgcctccccccccctccccgcccgcccccgccccgcgcccccacctccctggccgccgccgtctcgccccccctcctccctccccgccgccgtccctccgcctcgcctcccccccccacgctgaccctcggcgcggcctcctcgtcaccccgccgcgcggatcgcggcgccgtacgccgcccgccgcgcggctccgcgcccggctcgccggccgactcgcggcgcccccccgcgccctgccccccgtgcaggggggcctccccctccttggcccgcgggcgcgcggcctcccccggcctggggtcgggggcgcgctgcagcccgacggctgggggggtgatggcgctccccctcttcttctctggccggaaagcgccccgccgcgcgcgcccctggccggaaagcaccccttctctcgcgcccctcctcttaaagcgtgggccagtgctcgcggctggcgcgctgggcccgtggccgaagacgggaacattaccaatggaatatggatatatttggtgtgcctaaagttcgggctgaggcagagcttcttcatgcaattgttctcttatttcaacgtcttggaattacatcttctgatgtgggga

SEQ ID NO: 4514 - DNA, 692 bp, Sorghum bicolor
  Clone ID: SORBI-28MAY03-CLUS81210_1
agcagcattctatgccgaaaagcggaaaaactaaacaaaacgaatcaagccgctaaaaccctagctccccctaccgaatggtcgccgtccctcctccgcgcgccaccatggctgctccgccgcctcctccactcctcccgccacatccagcacggcctccggaccgtgactccggccacctccgccgcctcctcatcctcctcctactccccctttccatttcgctgcctcccggacctcctcccctcgcgtgtcctctccccgcggctcctctccacctccggccgcgacgacgaccgcaacaagccgtggagcttcgcggcggattcgggcgatccggaccccttcgccaatgaagacgccgccgccgctggcgctgtcgaggggccgacggtaagatcgacgcgcgccgccgacgagccctgggcggcggggttcggcggggaggacggtgacaatggcgacgtgttcgaggggatctacaaggaggctgcttcggcggcgcccgcgcgcggagtggcggctccggccggcaatgacgagcaatggacgctgagtggggacgacgaggagaaggatccttttgccgcggccgtgcttggggaggggatttgaggggatccaaagtgagggtgctgggctcgatgacctcgatgctggggaggaccctgatgatgagctgaagcggcagc

SEQ ID NO: 4515 - DNA, 796 bp, Sorghum bicolor
  Clone ID: SORBI-28MAY03-CLUS81224_1
agctagggtttcggactcggcctttcctcaatcagcctcccaagtcgtttcccggacgggcataccccgagccccgacgctccaggcggctagctccacctccacctccacctcccagcgcccctcgccgtcagccgccccgccctcgcccccgtcgcccccaccgctgcttcatcacctagtcctgctgccgctacccgtcgctcacagcgttgctccctacaaccgtctgcagtcccagcggcgcgcctctcctccttccgctgctccagatccgaggcaggtcaccgctggggacgcagcacgagcgccagagctctcactggagctaataggattttgagaagaggaatataatcatggatatcatgcagactagtgactcttcacatcatggaattgtagaaaatagcccgtacagaattccatatgacagacatgcagaaggtggtcaacttggtgcttcatggtattttagtagaaaagaaatagaggagaattccctatcgaggagagatggcattgatctgaagaaagagtcttatcttcgcaagtcatattgcacatttctgcaggatttggggatgaggcttaaagtgcctcaagtgacaattgctactgctatagtgttctgtcatcggttttttcttcgtcaatctcatgcgaaaaatgatagacggacaattgcaacagtatgtatgttcttggcgggaaaagttgaagaaacacccaggcctctgaaggatgtcatactcctttcatatgagatcatccacaaaaaggatcctgctgcagt

SEQ ID NO: 4516 - DNA, 772 bp, Sorghum bicolor
  Clone ID: SORBI-28MAY03-CLUS81234_1
atctggatcaccagtctactcgccgggcagcccggagtacactcccctgacgccgccgaagcgatccgggtctccagcttacacgccggccgccgcgaactacacgccccggagtccttcaagctcgtctttatccgacttcttccacgactttgatcgccactgcacttcgccgggctccgcctgctcatcgcgcgccgtctcgccggagtacacgcccgccagtgcttccggctgctgttcaccaccggactacttcttctgctacactccgccgccgtctgctgggtactcgccgcgcgacgcgtcgccggagtacacgccttcgattcccctcatcagccttccccggcgtgctgcttctccggactacaccccgagctccccttcggtggtgtcagacgccgcttcacgcacgtctccaccgagccaccgccggttccacccgtaccagaggagccggaccagctgctgccagagtcgccgttcctcctcccagcatggatactgaacgccttcagtagtttgtaagaagaggacaatcttggttgaggcagatcaatgcctgaattctatgtatgcataattaatcgaatatttttcctttggcgaatgttttgtttagaataagtagaatgcttgtaataggggatattctgtatgaaaatcatcagtaggggagatattctgtatgaaaatcatcagtcaaatgtttgtaataggggatattctgtatgaaaatcatcaatagtttttgctgcagatttgatcg

SEQ ID NO: 4517 - DNA, 659 bp, Sorghum bicolor
  Clone ID: SORBI-28MAY03-CLUS81238_1
aggggagcacagagcgggcaggcgacagcatgtgcacgcgtccgcggtaggcggtagaactgtagcaggacggatggctggctgacgtgtgggcccggggtggcaggtggtgatctggcttggctgaccactagttaggcccagcccaactccgatgttcgatcgcatcaacgcccccaaagcagcctcctggtgtagcttagggttttcgtctccgcggcttgctctaatcctctccaggcacgcgagggccgcagcgttgatggcggcggcaccggcaccggcggacgcgaaggcggaggccgccaagatggacctcctcgaggacgacgacgagttcgaagagttcgagatcgaccaagaatgggatgacaacgaagaaggcaatgaagccgtccagcagtgggaggatgattgggatgacgacgacgtgaatgacgatttctcactgcagctgaggaaagagctggagggaaataacgcccagaagagctgaagtagtatttctctagtttatagatgataaatgattgttatatgccagctactttcggaaccgtgatgtgctatggatgggttgatatggttgtgctatgtgaacggcagaaagtttacggacatcagtcggcaatgtgacagcactgtacctgttccggggg

SEQ ID NO: 4518 - DNA, 691 bp, Sorghum bicolor
  Clone ID: SORBI-28MAY03-CLUS81708_1
aatttctcctccactccggtcaatcctccataatctcgccgccgtcgtcgtctccgtctccggcggttaaatcaggggcgtaggctacttcctcctcgcccgtctccggcctctgcgatacacgatgcgtcttctgtggctccggtttctcgcctccagcgagctccccagcttgctctgttaaccctctccgccctgccgccgcgatgccgtgcgcccgtggcagactggcagaggtgttcggaccgcacgtcgcctgcgaggctcgggctcgtttctcgcgtcgcggccatactgtgctgctgctcatttgattcgcagctcgtgaaccgctgatccgctccgtggacgctgcggtgtcgtccaatggggctcccgtacatgggcgtggccccgcatgcgccccggcggcaactccgacaggctgagcgaggtatactctcttgctctgcctagacagccgctccactacactctactgatagtgataaattgtggaggttagtttctggctcactgctgtctttgggatgcaatgtgtcttctattctcaatggttccaaacttccatggaaatcgttcgaaaggtgctttatgtttttctttgggggttggtgctgcctactggggcacggcgtgggcttgtttcctccggggatcaggaagcatgaaggtttgtctatgtatgatt

SEQ ID NO: 4519 - DNA, 1064 bp, Sorghum bicolor
  Clone ID: SORBI-28MAY03-CLUS81745_1
gttacaccaccatcacaaatatctatcttatctacgcatgaataggtaggaagcacctgcattaatgcatcttttgttcagaagatcttgttagaagctgttgcgttgatcgagcaagcaaccgtaggagcctcagcatcgtgagggaagatgaagtttggcaagaggctcaagaagcaggtggaggagagcctcccagagtggagagacaagttcctggcgtacaagcgcctcaagaggctcgtccgcctcgtctcggctgctggttcttcctcgccccgccgccgccgcaggggcagcgccgccgaggaggccgccttcgtgcgcctgctcgacgccgaggtcgaccggttcaacgccttcttcctggagcgggaggaggacttcgtcatacggcacagggagctgaaggagacggccaagaaggtggcagaggacgcgtggcggcggcggcggccgccgtcggcagcggagacgacgagtgtgcgcaaggagatcgtggacctgcacggggagatggtactgctgctcaactacagcgccatcaactacacagggctggccaagatcctcaagaagtacgacaagcgcaccgggcggctcctacggctgcccttcatcgacaaggtgctcgggcagcccttcttcgccacggagctcatctccaggctcgtccgcgagtgcgaggccaccatggaggccgcgttcgaggccagcagaggcacgtcggccaggacgacccccgtggccgccgccgggcagggcatcttccggaacaccgtggcggcgctggtgaccatgggcgagctccgcagcgggagctccacatacggacacttctcgctgccaccgatggccccgccggagtccgacctcctgcggtgcgtgtgcgtccaggtcgccgccggtccagcgtccatctgactatctcggattttctgctgaactcttcgacggccagttactggtgctagcgagatgagaaatgcaggtgcctatcgcatagtagctcagcgtgcagacatgtactacgctttcctaatacaaatttacagcacttcccc

SEQ ID NO: 4520 - DNA, 642 bp, Sorghum bicolor
  Clone ID: SORBI-28MAY03-CLUS81794_1
cacacgacacgcacactaaacacagggtcgatcaccaagcagcagcagttctcagctcacaagtttattttagaaggggctctcagatcacaagtttcgcggcgcagtttagcgagtcgtcattagcaatggcttcccttgtgctggttgtggcgatggtactgagcctgtcgcaactctccgtggggagcaggaggctgatggagctgtacattcctccgccgagcgatcagctcaccgaccaccacggcggcgtgctcagcggcgacatccgggtgaccacgctctggtacggcagcttcacgtcggcgcagaagtcgatcgtctacgacttcctcctctcgctcaccgcggcgccgagcgcgacggccacgccctcggtcggccagtggtggggcaccatcgaccagctgtacctgtccagcgccgccgcgtcggggacgcgcgtgctcctcgacgcgcggacgcaggtgtccgacgaggcctactcgctggggaagtcgctcacgctagcccagctcgagcagctcgccgcgcgcgccggcgccaagaagggtggcatcgcgctggtcttcaccgacgagaacgtggccgtggagggcttctgcagcagccggtgcggcaagcacggctctgccgccc

SEQ ID NO: 4521 - DNA, 555 bp, Sorghum bicolor
  Clone ID: SORBI-28MAY03-CLUS81877_1
tagacgatgctgatgtggatgactggctacctcgctttgttgttctacaagggcagtgtttgtactattatctgaaatctacagatctgagcccacaagaatctacactgttatgtgatgttgttgaagtagggcagcttccaaactttgtgccagaggacgaaaagccaagatatgcgttttatctgttgacccgtcaaggattgaagtttgaatgctccagtacctccgaaatacaggttgattcatgggtaagagcactgtcaagtgactgcaaattgcgagatggtgctggtgatgatgataagatgaagacgccgagtagccaagtagaagctgggtcatggtaggggatccaacatgtgttccgattgccaggcaagacgaatgccctgcgtctttgcattgaccccagccagatgtatgtgcagagtacagtaatcagctccagttggttcttttttcttttaatttgttagaccagtcgataatgtggcatttgtatacaatagccaatgtacatacatgcatactttagggtgcaaatgaagcagc

SEQ ID NO: 4522 - DNA, 830 bp, Sorghum bicolor
  Clone ID: SORBI-28MAY03-CLUS81943_1
tggctccccagtctcctctctctcctcgcgtggctagggttttgactcctacaccagctccgccccacgccgccatgatgcagccgccgccgccacagcagcagcagcaatgggcaatggcgccgccgcccccgccgcagtactaccaggcgggacaccccccgccgccgcccccgcagttctaccaggcgggccctccgcctcctgctatgtggggccagccgccgccgcaagcggccccggccccggcgccggcaccgtccggcggtggggcgggggacgaggccaggaccctctggatcggggacctgcagtactggatggacgagaactacctctacagctgcttctcccaggccggcgaggttatttctgtgaagataattcgaaacaagcagactgggcaacctgagggttatggttttattgaattcggcaaccatgctttagctgaacaagttctgcagaattataatggtcaaatgatgcctaatgttaatcaacctttcaaattgaattgggctaccagtggggctggtgagaaacgtggagatgatggttcagattatactatatttgttggggacttggcctcggatgttacagatttcattctacaagatacattcaagagtcgttatccatcagttaagagtgcaaaagttgtcttcgacagaactacaggccgctcgaaaggctatggttttgttaagtttgcagatttggatgaacagacacgggcaatgactgaaatgaatggacaatactgttctagcaggcccatgcgccttggaccagcatccaacaagaagaatactggtggacaacca

SEQ ID NO: 4523 - DNA, 709 bp, Sorghum bicolor
  Clone ID: SORBI-28MAY03-CLUS81391_1
gggctagagatgctctccaaactctttcttctttctgtagcttgtctgtagtaacatctcggcaggatgtgattaagaatcacacattggaatggattgagaagtattatccaggcttatttgagcagatccatttcgggaatcatttcgctttggaaggtcgatcaagaccaaaatcagagatttgcaggtcttttggcgctcaggttcttatcgatgacaacccgagatatgctctagagtgtgctaatgatggcatgagggtccttctattcgattatgataactcgtatccttggtgcaaaactggagttgacgaattgcatccgttggtgacaaaggttcacaactgggaagaagttgaggagaaacttctttcttgggtagtacctgagagctgacattcttcaatcttgtattaagtttgagattattaaatgttcccttttggctgatttctaaagaaacatgatagggtgaagactgctttgttcctagagcttgattctcaatacagatgtcaacgtaaactaggatattccatatcgtagtaacggactggaaaccagttagtatccgactgtccgaggtcagtctgagctgtagtctcttctgctctcagagatcagattcttaattcatccttttgctgtagcgggtgtactatgtatatatcgacgttgccatatggctaagatggtattatgaa

SEQ ID NO: 4524 - DNA, 690 bp, Sorghum bicolor
  Clone ID: SORBI-28MAY03-CLUS81336_1
gcgcgccacgcgagcgcgggcactatttaccgcctcaaccgatcccatccgcgctccatccaccgccgccgccgccaccaccacctcaacccgctcctcgtcttcccgagcgccagcgctccgccgcgagatggcgatggcgttcgcctcttgcgcttccaccagatctgccgccggcgacgctttctcctacgacgacgtggggtcgtcgcgcggttaccgcctggtgacggcgcgcggaagaagcttcgtggagctggagggcattgtcttcgactcggaaaggttctgctaccggcggacatcgtccctgctcgactcgccgccgcgatctggatctccagattacacgcctggatcgctggattgttcgtcgcagcggtctggatcgccggattattcgccggccaccccggacccggccacaccgtcgtcgcagcgatctggatcgccagtctactcgccggccagcccggagtacactccattattgaagccgtcgtcgcggcgttttggatcgccagattactcaccggccaccccggagtacactcccctgacaacgtcgtcgcagcgatctggatcgccagtctactcgccggccagcccggagtacactccattattgacgccgtcgtcgcggcgttttggatcgccagattactcaccggccagcccggagtacactcc

SEQ ID NO: 4525 - DNA, 650 bp, Sorghum bicolor
  Clone ID: SORBI-28MAY03-CLUS81421_1
tggcgcgacgaggacgacgacagctcctcccccgtgcgtcctgcccccggcgcgacgaggacgaccacagctcctccccggtggtggtcggctccgaggggaggcccatgacccgccctgctcaccaatgatcatgatccccttgatgatgataaaaagtcaagtggttttgattgattgcactgactgaagagtttggctggtttgttggggggagcttttgacgccgccggttttcaatgttcaaagtgccctgaaaggcaaaggaagcgctgccaaaagcaggacatctgctatgctttcggacatgatcgacgatccagcaaagacgacgacgcccgggaataaagacggtctgaaatgcatcgtagaaatgtactgaatttcgtgcgcttttgcaaacagtaggcacgcagccactgagagctacccacaagctcacagtggaatggtgttgcgaaaaagagaagagcaaaggttttgcagggttgacaaagctgagacgggacgagacgaccagaataaaggcagtgatgatggggatgatgaggcgttgatgacacaatgcaaggcgtgaactagctagctatagatagctgcgtactagtttgctttgttctgtaatttccgaccaatttccatttgtatgt

SEQ ID NO: 4526 - DNA, 682 bp, Sorghum bicolor
  Clone ID: SORBI-28MAY03-CLUS81459_1
cgcggctggaggcgccccgcacgggcccggcgatgtcgatggccaccgcggcgcccgtgaggatgccgatgccggcgatggggccaatgccgcagcagcatgggcaccatgcccaaggcatgggcgtgccgtccatctggccgccggcggccgcccccggccccgagtggggctacagcacgcagccgtacggcagctacagcggcccgcctgccggagggtactacggcggcgcgtacggccccgccgccgggcactggccgtacggcggcggctacggccggaacccgtacgcgcagcagcagtactacgaggaagagcccagcgctgggtgcagcgtcatgtgatgtcatcgatcggctccgctccgcgacatcgtgtcggacatgcgctgctcgtgtccaccgtacgtaaaattactcctagtgccactgtgttagtatatatgtatatgtatattatgctgtaatttggtttttgctttggttacgacgtacgcactattttgtttgtgtgtttttggagaggttattataaagtttgtcatgagtgactatggtaggggtgagtttagtaggaggacgaagctccctctcctgtgtaaatctgggaagaatacgtatgctactcttatgatcttgtactgtacttgtttatatatatgatggaacttttgatgcga

SEQ ID NO: 4527 - DNA, 958 bp, Sorghum bicolor
  Clone ID: SORBI-28MAY03-CLUS81482_1
gtagaaccgcctggcttgttcaggggacgtggagaacatccaaagatgggaaaactaaagcgacgcattcaaccaagcgatatcacgataaatattggaaaaggagctccagtccctgagtgcccgatacctggagaaagttggaaagaaatcaaacatgacaatactgttacatggttggctttttggaatgatccaattagccaaaaggatttcaagtatgttttcctggcagcaagcagctcactgaaagggcaaagtgacaaagagaagtatgagaagtccagaaagttgaagggtcacatacaaagaattcgtgagaattatacaaaagatttcaaaaacaaagatgtgacgaggaggcaaattgctgtggctacataccttatagataaactagcccttagggcaggcaatgaaaaggatgatgacgaagctgatactgttggttgctgtacgcttaaggttgataatgttacgtgtatgcccccaaataagattcagtttgactttctggggaaagattcgataagatactttaacaccgtagaggtcgaagagcttgtgtacaaggcaattgagggtttccgtgctggaaagaagccgggagaaggtctctttgacaagattgatacaactaggctaaatgctcatttgaaggatctaatgcctgggcttactgcaaaagtgttccgtacatataatgcttccatcacattggacggaattttgcatgaagaaacagaagatagaactcttctagaaaaaattgctgtctatcaacgagcaaacaaagaggttgccataatctgtaaccatcagcgtagtgtctcaaaatcacatgaatcccagatgattaaactgaatgaaaagattgatgaattgaagtcccaaatggaggagctgaaagcagacttgagcaaagcaaagaaagggaagcctctaggatatgataaag

SEQ ID NO: 4528 - DNA, 668 bp, Sorghum bicolor
  Clone ID: SORBI-28MAY03-CLUS82059_1
ccgagagttctcccctgtgcaacagagtgccaatggagggcctattgggtatcgttacagaccagatgatcatgaccgtagggaagtagacaggttccagataaatctgcagaacttgaacatgagaagttctagttcccccaataaccaagtcgacgcagagtggatagaacagtatgagccaggagtatacctaactctagtttctctctgtgatggaaccaaagagctgaaacgagtacggttcagccgaaggagatttggtgaacaccaagcagaatcatggtggaatgacaaccgtgaaaaagtgtatgagaagtacaatgtctgcggaacagatcgtctctcttcagtaacgacagcctaatgtaagcctgcatgaagcaagatatccaaactggagcatataccctggggcaatgccaagtgtggtctgtagcatgcatatctccatcattggaaaacggagatatccagcttgtttttggaatgtgcttaatctacttgtgttattttctgttacctacttcgccactcgtcgttgtatagaggagataatgtgtaacatgatggaagcaagcagttgttgcttctttgaccgagatacatagctgtatgtatattttgggcgtaatggatgggaggaagctcatcgctgcctgagattc

SEQ ID NO: 4529 - DNA, 768 bp, Sorghum bicolor
  Clone ID: SORBI-28MAY03-CLUS82066_1
cctgttggcctccggatcccagttcaccgctccactccacaaccgccgccaccccccacaacacaaaaccccaccccggccgcaggggagggagagcgggaggaagcgagaccgagcaacccaccggcggagatgcagatcttcgtgaagacgctgacggggaagaccgtcacgctggaggtcgagagcagcgacactatcgccaacgtcaaggccaagatccaggacaaggaaggcatcccgccggaccagcagcggctcatcttcgccgggaagcagctggatgacgaccgcaccctggccgactacaacatccagaaggagtccacgctgcacctggtgctccgcctccgcggcggcggcaggggcggctaccccatcatgagcgtcccgtgggacctcatcaaccttgcccgcaagcacaatgagaccaagatgatctgccgccagtgctatgcgcgccttccccccaggtccaaaaactgccgcaagaagaagtgtggccgcagcaacgagctgaggtcaaagaagaagttcatctccgagtttaacatctgagctttggaaagcgacattctggagtgccatgcgaaagtgtcatgtatcagttgaatcaccttgtctaaacatttctatcacgggtgctagttgtcctagtttaagtttctatctgcgtgctgaaccttaaatactctttcaaatatcccatgctgtttccacgcgtgcagtggtatgcctaagaaatgctagtgaaagttctttggctgg

SEQ ID NO: 4530 - DNA, 592 bp, Sorghum bicolor
  Clone ID: SORBI-28MAY03-CLUS82069_1
gccgccatggccaagagcaagcagctgctccagggccgcaccggcactgcggccacgctcgtcgtctcctacttcgcggtctgcggcgtcacctcgttgctattccgtgctgccgtcgttaaggggcgcgccgaggaggggagctttggcctggccttgcccggtcgcctgcttgtcggcgccgtgctggtgtgcgttcttgtctgtgtcaatttgctgggactgctcgtgcagagcgtcttctactacgcctgcaaggccttccacaaccagcagattgaccggactgcattgtatgagcaccttggagggtatcttggggagtacgtgccactcaagagcaatatccagatggagagcctttgagattggagcatagggcaagggtaagctgctcacctcattgcttcatactagctgtttcctgtggatctttctcaaaacatgagtatggtttccaaggagtctatctggtcttgttatttctagtcccctgtagtagtttataatctgtataagttaaaatgcccagtatggacccaatctatatggaatggaacagagatgcatgaacaaggttgcctttagcccc

SEQ ID NO: 4531 - DNA, 655 bp, Sorghum bicolor
  Clone ID: SORBI-28MAY03-CLUS82090_1
gcaaattagcaaatccgcacgcatttcacatacacaaaatatacagctcctcagctccacattgatcatttggccgttatatccagcgcggataaattaatccttgtcttcatcgctccatcgtcgtcgtctgaccgccgcccgccgtcgccgtgaccatcaacaatcaggctagctatagctcctgctgcggcctctgcatcgatcgccggcgccgcgactgccgggggagccgcgcgcggatcgtcgtcgatcggagccacacaagtacgcacagacatggctaagctcaaggcggcgcgcgccaccgacgtcccgtccgccttgccgccggagccggacatcgccgcggacctcgacggcctagcagccgccgcgtcctcgtgctcgtgcatcagagcgggcgcggcggaggcgacgacgacggcagccgagggacggccgctggtggtgatagggcaccgcggcaaggggatgaacacgctggtgtcgccggacccgcggctgcgcggggacgtcagggagaacaccctccgcgccttcaacgacgccgccgccagccaccccgccgtcgcctacgtcgagttcgacgtccaggtgaccaaggacggctgccctgtcatcttccacgacaacttcatctacacccaacaag

SEQ ID NO: 4532 - DNA, 669 bp, Sorghum bicolor
  Clone ID: SORBI-28MAY03-CLUS82206_1
tttatttgttgcaaagagcacactaacttcatgaaagaccagcgcaagtgcaaacagacgtgtttctccagacagctacttgaaaaaatggatgggtgttttctgttgaacaatcgtgttaatttgtgcggagaaagctcttcaagaacatgtgtttttcatttacctgcaatatctgcctctgtgataagcctcgcgggtgctggcgattgcttggttggtggtgtcctttcagctctatgtgcaggcttcgatatcatccagagcgttgcaattggggttgctatagcaaaggcatctgtggaatctggagccaacatacctgatgacatttctgctgcgagtattgcagatgatgcacaatgtgttttgcattctgctaaggtagtttggtgcaaatgaagaataaaaaaactaccatcctggtgtaagctggtattgttgaagctatcgaactctgatactgttcctatgacacaaggtggatagtaatgatgaaatcattataactgatggatttttggttgtaagatcggaaggattgcaaatcagaaattccttctactctgaagcatatattttccatacacattgaagggtggaagtttgatccagtgagcaacttctgttgtaattggaagttattatatactagcacaaggcattgcc

SEQ ID NO: 4533 - DNA, 987 bp, Sorghum bicolor
  unsure (1)..(987): unsure at all n locations
  Clone ID: SORBI-28MAY03-CLUS821_1
tccgcaaaaatcccactcgcttccaccgcttccccgtgctcgcggcggtgccgtgtcgcgccgtgccatggcgcccgcctcgctcccgctctccgtctcgtgcgcgcccggatcctcgtgcccgctggccgtcaccagccccggctccagcgtcgccgccgcctcgtcctcccaacttcccgcgtcgtcgcggagcagcgagcgcaggagagtgccaggcctcgcactccccgcggcaccgggtgtcggcggtaggaagggcggcggcaggtggagagcaggcatatcgtccttctcctccttcctgccgccgttcttcacagggaataagggggagaaggacgctgagaaggcggcgaggctcaaggaggagctcctcgacgccatcgcgccgctggagcgtggcgccgaggccacgcccgaggacaaggagcgcgtcgagcagattgttcagcagctggaggcggtgaaccaagtgaaggagccgctcaagtccgatctcctcaacggcaaatgggagcttctctataccacctccacaagtatactgcaaccacagagaccaaagtatctgaggccgtttgggaaaatttaccaagcaatcaacgccgacactttgagagcccaaaatatggaaacgtatccttactttaatcaggttactgccaacttggttcctctgaatgctagaagagtggcagttaaatttgattacttcaagatatttagtttgtttctctgattagataccgatcaaagcancccgaagtggtaaaggtgaacttgaaattacttatcttgatgaagagctcagggtttcgagaggcgacaagggaaacttgttcgtactgaagatggtcgacccaacatacagggttccattataataatgttctgataacattttaggtgtcagctatctgtaacatccttcttcctccactgaggactgaggcaatgtaaggggtgtaaatattaatatcccat

SEQ ID NO: 4534 - DNA, 1057 bp, Sorghum bicolor
  Clone ID: SORBI-28MAY03-CLUS81620_1
ctggttggaagaacctatttgcataggaaggcatgcttttggtgaccagtatcgagctactgatatgattattaatggtccaggaaagctaaagatggtatttgtgcctgatggagctgacccgatggagctggacgtttatgattttaaaggacctggtgtggcattatcaatgtacaatgtggatgagtctattagggcttttgctgagtcgtctatggctatggcactttcgaaaaagtggcctctctatctcagcaccaaaaatacaatcctgaagaagtatgacggcaggttcaaagacatcttccaggaggtatatgaagaacaatggaaggagaagtttgaagcaaactcaatatggtatgagcacaggttgattgatgacatggtggcctatgctgtgaaaagtgatggtgggtatgtttgggcatgcaaaaactatgacggagacgtacagagcgattttcttgcccaaggttttggttctctgggtttgatgacgtctgtgctgttgtcttctgatgggaaaacattagaggctgaggctgctcatgggactgtcactagacatttcaggctacatcagaaaggacaggagacaagttccaacagtattgcctctatattcgcttggacccgtggactagaacacagggcaaagctggataaaaatgatagtctgttggatttcatacacaaacttgaatctgcatgtgtggaaacggtggaatttgggaaaatgactaaggaccttgcactttttatccatggccccaaggtaacaagggagttttacctgagcaccgaagagttcatcgatgcagtcgcacagcagctgcgaggaaagattcaattaccaactatggtgtaatcttgaacctgaagcctgaaactgaatgaactaggttcattgtgcattcagcgcacattttgatagagatggcgagatggatcagatttcaattttttttttgtttcaactaaagttgggtatataatggcctgttgatcaacgaattcagggcgatattgagtttaatacattactgttcag

SEQ ID NO: 4535 - DNA, 718 bp, Sorghum bicolor
  Clone ID: SORBI-28MAY03-CLUS81634_1
caaactcacacacacacacacacacacacacacacacacacacacagttgtcctcgcgccgacctgccgcccccctctgtcctcccccgctccccttgcccctccttctcccgctgctccctcccgcccggccgcccgccatggcagcagccgacgcggccctgccctgggcggcgcagtgcgcgggcgcggccctgttcgccgccgcgctcctgcgtgccggcgctggccctcgtgctctcgctcctccgccgctggccctggtgcagctgccacgtctgccgggcgtacctcacggggtcgtgggcgcgggacttcaccaacctcggcgactggtacgcgcacctcctccgggactccccctccggcaccgtccacgtccacgtcctcggctgcaccgtcaccgccaacccggccaacgtcgagtacatgctccggaccaacttcgacaacttccccaagggcaaggccttcgccgcgctcctcggggacctcctcggcggcggcatcttcaacgtcgacggccacgcctggcgccaccagcgcaagatggccagcctcgagctcggcagcgtcgccgtccgctcctacgccttccggatcgtcgcccaggaggtggagttccgcctcgtcccggtcctcgccgccgccgccgacgccggcgcggtcgtcgacctgcaggacgtgttccgccgcttcgcgttcgacaccatctgca

SEQ ID NO: 4536 - DNA, 646 bp, Sorghum bicolor
  Clone ID: SORBI-28MAY03-CLUS81636_1
agcccgcaaccaaagccaagcacaccaccaccattctctctactcctcagagaggaaacaaagggaagcatcttgagcgagtgttcggagccaatggagaagtcgtcgtccgagaatgccaccccgctgaagctgttcgggtcgtgggcgagctcgtacacgcaccgcgtgcagctggcgctgcggctcaagggccttgagttcgactacgtggaggaggacctggggaacaagagcgacgagctgctccgccacaaccccgtccacaagaaggtccccgtcctcgtccacggcggccgcgccctcccggagtccgtcatcatcctccagtacctcgacgacgcctggcccgagacccgcccgctcctccccgccgacgccttcgaccgcgcgctcgcgcggttctggtgccacttcgccgacgacaagctcgggccggcggtgggcgcggtgttcgcgtcgacgggggaggaccaggaggcggcggtgcggcaggtgcacgagaacctggcgctgctcgagaccgagctccgcgacggcgcgttcaggggccgtcgcttcttcggcggcgccgaggtgggcctcctggacgtcgtcctgggctgcggctcctactggctcgccgtgttcgaggacgtcaccgggc

SEQ ID NO: 4537 - DNA, 949 bp, Sorghum bicolor
  Clone ID: SORBI-28MAY03-CLUS8165_1
gcacgaggctcaaacaaacaaccaagtttgcagtcggtggatgttaaaatggtgggtgctcctgtagttaaagtgatgtatcttttacttagtttatgctctatctttccattttttccaaacaattgttcttcatgttgctctgcctcaagatagatctggtaacgcctactactccaattaccaaggccatggcccatgagttcagactggagctctggacatttcgagaggtacctgcaccttccaacaaactaattgaatatgtacgtttttagtgaaactattcagacaggcagagtaaccttgctcaataagttgccatctcaacatatacaatacatggagagtgagtctctgggtaagattcttatctgagcctcaaaatccagtatgtattggtggtgatttctcttctcctttttttttcaaaatatgttgtcgttgtgtagatcatttccctgtattatgcttgggtccatactgtcggcagcaaagaagatgatggcattcactgctggatatagtttagacagttcttagaataatcgatctgacaacataatccattatgattacttgaaaattgttttcccctttgaataggctcatggtttgtcctttctccatccccaacactatttagaatatccaaggcaaccattttttgatttttagttaagcttcaagttttatttctttttctgcttgcatttttctcagaattgttcgttcaaccaatgacaaccctagatcataacttatattagttgaatgatgttgttatggaacttgattatgcatgacatagttatatacatattttcagtacaatgtgaagcatgagaataataattgcttgatgacagtgacatgacttgtgagaataccaagctctgtactaatcttgcaggaactagacatagtggcagggaaatattgtgttgga

SEQ ID NO: 4538 - DNA, 662 bp, Sorghum bicolor
  Clone ID: SORBI-28MAY03-CLUS81664_1
aactggatcacccacacagctcacagtctcacaccacttctcatctacttaagccctctcccccaatcctatagcagcaagctagccacaggagtgtgcaacaacggcggctatggcttccaagtcccagctcctgtccttcattgcgattgcggctctagcctcgatcatcatccacccttgtgcatccgtcgagtttcaccgcaagctctccagctggtccagcggcggcgcgacgtggtacggcgccgctactggggctggaagtgatggtggtgcatgcgggtaccaaggtgccgtcgaccaggcgcccttttcgtccatgatcgccgcgggaagcccttccatctacaactccggcaagggctgcggctcttgcttccaggtcaaatgcaccggcaatggcgcgtgctccggcaacccagtgaccgtcgtcatcaccgatgaatgccctggcggtgcgtgcctcaacgagccgggccacttcgacatgagcggaacggcattcggcgccatggcgaaccccggccaggccgacaagctgcgcaacgccggcgtcctccaaatccagtacacccgcgtgccgtgcaactggcctggcgtaaagcttaccttcgtggtcgacgccggctcgaacccggagtacttcgccgtgctcatta

SEQ ID NO: 4539 - DNA, 915 bp, Sorghum bicolor
  Clone ID: SORBI-28MAY03-CLUS82319_1
aggcaagctgcactagcgcactaaaaactcgagagttcggtggtgaccacgcaccgtgcaccgacgggtgacacctgctaagtgctgaccaaccgtgagccagccagcgaccgacgacactagctagcattaggaaccagcaatggctccgcgtgatctccttctcctcctgctcgccgccgtgctgctcccatcgtcgtccacggcggcggacccggacgcggtgcaggactactgcgtgccagaaacgggcgcgggggcgcgggatcgtgccgtgccggtggatctgtccctcctcccgtcctacccgtgccggagccccgcgaacctgacggcggccgacttcgcctccgcggccgtgcgcgccgcgggcaacttctccgccgacaccgggttcgcgggggtgtcggtcacccccgcgacgttcccggcgctgcacaccctgggcatgtccttcgcgcgcgccgacctgtcggcggcgggcggcgtgaacccgccgcactaccacccgcgcgccacggagacggcgctcgtcctgagcggccgcgtctacgcgggcttcgtcgacacgggcgggcgcgtcttcgccaaggtgctcgagaagggggaggtcatggtgttcccgcgcgccatggtgcatttccagatgaacgtcggcgacgagccggccacggtgtacgggagcttcaacagcgagaaccccggcatcgtgcgcatcccggccaccgtgttcgggtccgggatcaaggagggtgtgctcgagagggcgttcgggctctcgccggaggagcttcgccggctcgagaagaggttcgggcctcccaagaccaagacggcggagatggatgattaatctgtagatcaggcatgatttaattaattatctaagagcagaagacttgtgatctggaatgt

SEQ ID NO: 4540 - DNA, 640 bp, Sorghum bicolor
  Clone ID: SORBI-28MAY03-CLUS82321_1
tggttcatcgatttgcatcggtttctcatcccaaggtcacgaggcttctgagcttgggttagaagccgggcactgcaaggtatttatggaatcagaggatgttggtcgcaccattgacttgtctgtctttggttcatacgaagagctgtatggtcagttagctgacatgtttggaattgagaaggcagaaataatgagccccctttgttaccgtgatgctgctggtgctgtcaagcatactggtgaagagccattcagtgacttcatgaaagtagcacggaggctccccataatagagagccccgaggggagactgcagaaacctctcatcgaatacatgatggagcgggcttgattgcatgactggttcaataaggcaatctgaagcttgtgagaagactgagcttagagcgaagtaactgctgtgtttgcatttgtgtttgtctgccgtgaagcagaatcgtgatgtttgtctggtcttgtggaaaacctttgtgtacggaccttcatcagtcgtgacttgggtcgttagaactctgtcgtgatcagttgtgttgtgcttggtcgaagttgataaataacctctttgacgaattattagcttggaataaagttcgagttggcctaaggaatgccagtg

SEQ ID NO: 4541 - DNA, 868 bp, Sorghum bicolor
  Clone ID: SORBI-28MAY03-CLUS82363_1
acgcccggtacgccaagcctggcggttggaacgaccctgacatgctggaggttgggaacggagggatggcgtacggcgagtacgtcgtgcacttcagcctctgggccatcgccaaggctcccctggtaatcggctgcgacttgacgagagtttccaaggagacgctggggatcctctccaacgcagaggtcatcgcgattaaccaagatcggatgggtgtccaggggaagaaagtgaagaagtatggcaacgatctcgaggtgtgggctgggcagctctcccgccacaggaaggcggtgctgctgctcaaccgggggacgacgagctccgcgtccatcacggcggcatggccggacgtcggcatccgccgcggcgtcaccgtcgaggccagggacgtctggaagcacgagacgctccagggcaggttcaccggcagcctcacggcggtggtcgggccgcactcgtgcaagctcttcgtcctcacgcccgttcctcgctgacgacggcgccgctggagagatccatccgtcgatgtggccgtggatgtggatcctgctagaagctaaacgtgtatgattgcagattcttatcgtgttgtgactgctccgacaacaagagcccaccagcatctgtcggtgattgggtagtgaatagtgatttgacatggtgcaagtgcaacgctcagattggagatcgaatccaacatgccgaataaattagaccaacaacttccctaccctacccatatacatgcagttgctcgccaccatcgaaagaacagagcaattcaaacctgttagcgccgtttcaaaaaaaaaaacttttaacttagaacgctaaaatcttaagtttttcaaggtgcgactta

SEQ ID NO: 4542 - DNA, 636 bp, Sorghum bicolor
  Clone ID: SORBI-28MAY03-CLUS82395_1
gtgcgtgtggaagtcgaactccacacggaagtcacgaacgcgcgacaaagaagaaagaaagaaaaacccgagaaatatctctgcggccctgcagagctctgctcgtctggtcccccgagccgagccggcgagatggcggggatctctcgcgcgatccgggcctgcgccgccgcgtcccggcgggcgctggccgctgcttcgggggcggcgctgccgaaggaggaagcggcggcggcgggggcgggggtgagagcggcggcgaccgggcgcacggggcgggatcaggaggacgggaggcgcgtgcagtgggtgttcctcgggtgccccggggtgggcaagggcacctacgccagtcgcctctcgcagctgctcggcgtcccgcacatcgccaccggcgacctcgtccgcgacgccctggccacccccggccccttctcgaagaagcttgctgagatcgtgaatcatggaaagctggtgtctgatgagatcatcataaatctgctgtcaagacgcctggaagagggagaagaaaagggtgaattggggttcatccttgatggctttcctcgaaccataagacaagcggagatacttgaaggagtgacagatattgatttggtgatcaatctcaagctc

SEQ ID NO: 4543 - DNA, 920 bp, Sorghum bicolor
  Clone ID: SORBI-28MAY03-CLUS82406_1
tatgttcagggttcaattacattccatgatgtcattgacaatgcccatgatggtggagtggctcaaataaggttagaaggagtgtacatatggccttttagacaactccgcatggtagcgaacagtggtgcagatggtgaacctcttcaggaagaggattactttttgtcaaatccataccatttgctgcggattttctcctctcaagtgttccaagaatcttctgaagagaagaaccaaaggaagaattctctcacatatgacatggagaaacattgcaacacagaactagctgctaaggttgttcgtgtgtcatctaacccaaatgatggagaacacgagaagtaccgtttggagggtttggtggagagtccagctgttgatgatgacggggaatgcttctctcctatcttattgaatgcaacttctttgaatgttgaagtttattacaacaaagcagtcaactacacactgatggtcacttttatctctttccttcaagttttgctgctgattagacaaatggagcatagcaacactcaatccggagctgctaaggtttctattttaatgattggccaacaagctatcatggatgcatatctctgtctacttcacctgactgctgggatattggttgagtcactctttaatgccttcgcaacggctgcattcttcaaatttgttgtattttctatttttgaaatgaggtaccttcttgccatatggaaagcaagtaggcctttaaacagtggagaaggttgggagataatgaggcgagagctgtcggttctttacagccgcttttatggcattcttttgggaggaatccttctaatgtatgagctgcacaattttttacgcccacttcttctcctgatgtactccttttgggtacctcaaattatcacaaatgtcat

SEQ ID NO: 4544 - DNA, 666 bp, Sorghum bicolor
  Clone ID: SORBI-28MAY03-CLUS81910_1
caaatttacttatggatgagatgaaggaacaactaaaatctgctaattcggattttccgaaaacagatttgattcagttcatcaagtatcttttaccaacgcttgagagagatgcttaccctctttttaggacacttcgacagaagtataaaacaagtacagatcgtgaccctgtgtttcaggagttactggacgaaatagctgcaaaattttacaatatacagcgccagaaccctttagaaggacttttcagtgaaatgttcaagataatgcacgagaaaagaattttgtgtcgatgctttcgtctaaaccattggctgggataatacaattgctgccacggcagctcatgatcaacaaaggtgcttgctcaactatgaatgtccaaggccatatagttgggatcatactgcatgaagatatatacttaactctgcagcaaaatggtcaattagtctcagattgttactgagcatgtgtaactaattttgttttctattacttgtttgtctttgttgtccttgccctcgattgttactgagcatgtgtaactgattttttttcttctattacttgtttcaccttgttgtccttgccctgttcacttttggagatgtgtcttttgtaacccactgatcaaaatgataacctatatattcattattt

SEQ ID NO: 4545 - DNA, 646 bp, Sorghum bicolor
  Clone ID: SORBI-28MAY03-CLUS81950_1
tgttcccgcaccaacctttccccaaccgccgcctcgccggacccttccgactcgccgccgtcgtccgcccatctgctttcttccgaataagaaaaaggaaaacaaaaggaagagagtaaaagggtcctgcgctgccctgcgccccacgaactaaacaaggcccaattcttttcttcagttgccagttgccatagtatgcacttctagcatttccatatttggatggatgatgtacatggacggatagaggtcttcccccaatactttgtgccatcaaaagaagctatggagactcctgatggtctatcaacaagtaagaataacctggatagtccaccaagttcacgtcggcgttcctggactccaagacgagttaagggagctgcatccattttgaatttattgtccattccccgcataagatggtctatgagcaatgaggatgatgacaagattgaattatctagagctgaagtagagactttacgaaccgaaattgcagaggctgaggaaagggaatctcactttaaagctcggttggaaaatatcgatgaagttctgagatttgcacgtctttctggctatctctacattcgaagtcgatggtcccaactccctggagaaccacctatattagacgatgctg

SEQ ID NO: 4546 - DNA, 573 bp, Sorghum bicolor
  Clone ID: SORBI-28MAY03-CLUS82039_1
gcgccagtcatcgagtacgtgcggagcgcggaggaggaggacgacgacgaggcggaggaaaccgacgacgacgcggagctggagctcacgctcgccgtgggcggagccggggccaagaagaggtacggcgagtacccgtccggtggggagagcctcttgtcgtcgtccacggaatccgacgtgctcaccgtctccggccgtgagtggcgccaggcgcgcggcacgccgtatcacaagaggaggccggcgcccgggctggacgtggttcaggtggaggacggcgtcggggtgcagcccccgccgccgctgctgttccactggctcaccctcaagatggcatgacgcgatgagaggaagcaagagcccattgcatgtgttagttgctgcttgtagtgtcagggtgttgacttgctactgttcttcagttgaatgctttctgtgtgttcaggtttagaggtggatcaagtctagaaatcaataattgactggttgttcaggagaatatgtaggagagtcttccaacgcataaggagaatgcgggggcttttcagatggagctgtgtactgtgtgtg

SEQ ID NO: 4547 - DNA, 644 bp, Sorghum bicolor
  Clone ID: SORBI-28MAY03-CLUS82045_1
gatctcaaagatatccccaagaaagcctgtgaccgtcggatcaatgaatttgttaaacgtgctagagctgccaagatccatgcttatataataggccatctgaagaaggagatgcctacaatgatgggcaaagcaaaagcccaacaacgactcatagacagtctgcccgatgagtttgcaaaggtgcaacgggaataccaccttccgtcgggagattttccttatgtggagcacttcaaagaagtcttgagtgggtatagctttgacaagtttgagaaggtcaagcccaagatgatacaggccgtggatgatatgcttggatatgacattccagaacttctcaagaacttcagaaacccatacgagtgaacccatacaggcagctgaaagatgacttcgatctgcaccaggatgagggattgagtggggcatggattgatgctgcattccataactttggaattgtctggcaacgtgaatcatcgcagtgaaggtcgtggggcgttcattgtcatccatgcttcaccattatataactgtatgcataagaatcgtagatccattgctcaagctttcaccagacatctggtcatgtaaaatcgactaaacagtgatattagtgttaaagagtatactattatctc

SEQ ID NO: 4548 - DNA, 584 bp, Sorghum bicolor
  Clone ID: SORBI-28MAY03-CLUS82053_1
gagcctgctttgctcttctcgtgttgccaacatcgacaacaatggcaatagcccaatacagcagcacgatgaaggcatcctgtgtagtacttgtttcaatccttcttctagccactcttgcagctgcagatgcttcttcatcctctcctccgtcttccctcggcaggcatccagcgctggttctaggtcgcaaaggcagagaactcggccagtcatcagggtaccattaccagcatcagagcaagcacatgcagatgctgcagcctgaggaagtggctatggaggtgaagaagcccaaggaggaggaggccaaggcgggttggacggcggatcagggcgaggacgcggaggcagggctcatctacagcgcggactacagcggcgtggccatgcatgctggctctccgccgacagcgaagcccaagcacaggcaccccaccaaaccataggacactgtccttaatccttgtgtagtcaattatgttgttagtcgtgtgttttcatcgctggattttagttacaagcacccctgccgtctttgtaaaatatatatgcttctgttgctctaaaaaaaaaaaaaaaaa

SEQ ID NO: 4549 - DNA, 877 bp, Sorghum bicolor
  Clone ID: SORBI-28MAY03-CLUS8253_1
gcgcgccccctcgcccgcctcccgcggacctcgccctcgtccgccgtcgcccgcctcctccggacctcgcccttgcgctcccgcggacctcgcccgcctcctacctcggcgcggatcaggtcgcgcggatccgcgcgacgcagacctcgcccgcctcctcctccacgcagatcctatcccgtccggcatcgacggccatggcggcggaggaggaagcaagtttgcacaacctccctttgccctgttcgctcccactccgccttcgcctccacctcccgcgcctacaatctgcacgcgccctcgcacaagtgcgcccaatctatgcaccctgtcccccgatgtcacacccctaccctgctctacaccaccgtcgccgcagatgggactgagctctgccacagtcccacacggcccatccttcgtcatcccggcctccagcacccctccccccatctgctacaccctgtcacaacgcggccaaaagtggctgtgggtggtgcggccatgatcccaggccagatctgggcgtcgcgatggaggatgccagctacgaaggcgtcgctgccgcaaaaaacaggatcgtacgagggctacatcatcgtcaaggcggcctccacggatggggagggagacctagccttcttcgtaggagatcttggggatcttgccgcccctgctgaggacgacactgtgccgatgggttcgaggtgccaatgatctatcactgctcctaatagcataaatacatgtaaaactgacacggaaggatgatagcttgaaagatccaacctcttggaaatatcaaagttcagatatgagatgcaaatatattttctcagcctgattcgtgggaggtgagcaaggcttctgatagatt

SEQ ID NO: 4550 - DNA, 652 bp, Sorghum bicolor
  Clone ID: SORBI-28MAY03-CLUS82603_1
ctgctggcccggggcaggtggctcgccctcgccggctcgcccgaagcgtccaccaggcaccagagctctgttccggcgggccgtctccgccctccgtccggccgccgcgcgttccgccgcagctggcaactccgctctgacggacctaggaggagaaggtcgagggggaagtctccctcacgagaggcgaggatgtcggggttcggcgatgggtacgtggggacggcgcaggacgcggtgaagatccggcggctggagaagcagcgcgaggcggagcgccgcaagatcgaggagctcaagaacaagtccgcggacgggcagcccggcctcctccagttcggctccagcacctccgagattcttgagactgcatttaagaaggaaacagttggtctcgtcaccagggagcagtatgtcgagaagagggttaacattcgaaccaagatcgaggaggaagagaaagagaaacttcaaaagctgcaacaagaagaagaagaattgcaaatgcagaaaaggaaaaagaggagagtgaagggtgatccacgcttatctttttttgacgacattgagaatggaagtgatgaagatgattttgagaaacaagaaaccaagaaaaatggccctgtcaaacttggaaaggatccaactgtcg

SEQ ID NO: 4551 - DNA, 664 bp, Sorghum bicolor
  Clone ID: SORBI-28MAY03-CLUS82606_1
aagaaccggcacacacacacacacagaaacagccatggcggtcggcggcgagggggcgcggcagcggcagcgcgggtgctcgtgcaccaaggcggacttcttcccggaggagtcgttctcgagctggtcggcgtacgggcgggcgctgcggagcacggtgtcccggctggctgaccgcgtgacgtcgcggtccctggagacgacggagctgcacgaggtgcgcgcccgcagcggcgccgacatgaagcgcgacctcacgtggtgggacctcgcgtggttcggcgtcggcgccgtcatcggcgccgggatcttcgtgctcacgggccaggaggccagggaggacgtcggccccgccgtcgtcatctcctacgtcgtctccggcgtctccgccatgctctccgtcttctgctacaccgagttcgccgttgagatccccgtcgcaggtggatcgttcgcctacttgcgcgtggagctgggcgacttcatggcgttcgtggcggcaggcaacatcctgctggagtactgcatcggcggcgcggccgtggcgcgcgcctggacgtcctacttcgccacgctgctgaaccaccagcccagcgacttccgcatccacgcgtcggggctggacgccaactactcggagctggaccccatcgccgtggtcgtc

SEQ ID NO: 4552 - DNA, 710 bp, Sorghum bicolor
  Clone ID: SORBI-28MAY03-CLUS82654_1
agcagttaatggatcaaggcaatcaactaatggatgaaactgatcaagctattgcacgatctaaacagactgtccatgaaaccatcaatgtgggcacagaaactgcagctgctctgaaagcacagacagaacaaatgagcagagttgttaatgagctggattccattcatttctccatcaaaaaggcatctcaattggtgaaagaaatcggtagacaggttgcaactgatcgatgcatcatggccatgctttttctcattgttgctggagtcatagctataataattgttaagattgtgaacccacacaacaaggacatccgcgacatccctgggctggcaccacccgtcagcaggcggctgttgcgatagaggacatgtgaattccatacttcgtgtaactagaaattgatgtggcgccttggcaggcccagatgtatctacatcttgtaaaacgctgctccaatcatgtggcatgtttgttgtaactcttatctcaagggatccactccttggctacacagtgcatgtatcttcttccagctggtcttcctgttttgcaaaacccagctctgaaccgtgttcagtttgaaccatgaggtgtacacaagctatcgatgatcacggagtgagaatagtaaccacaacatatacatacatcatacaatacatacttgaaccgcaacttttgaatgcatatacttattactg

SEQ ID NO: 4553 - DNA, 574 bp, Sorghum bicolor
  Clone ID: SORBI-28MAY03-CLUS82657_1
aatggtttggttccagatgttgtgacctaccgcgtagttgcagaaaatcttatagaagaaggatcgctagaagagtttgacactctgttttcagcaatggaaaagaatggtactgctccaaactcacaaatgttaaatgctctagttaggaggctgttgcatagaggtgacataagcagggctggggcttacctctccaaacttgatgagaggaatttctcagttgaggcttccactacttcaatgcttatatcaattttctccagtgatgaatatcagcaccatgccaagtctctgcctaaaaagtatcgtatcctaaatgaagccaatagttcagcattgataaaaaagtgaattcggttctcaactatgttgatacatcttcatgtggcatcttatttacctaccctgctctgctgactcctttgtttgaagaaacactcttgagaaatgttgtcctgttaatgcactttgagctcgaatgatacatgatgcatatagccttttccaacaaatgttaatgaagggacttacacctgatgttgtgacttataatactatattgaatggattg

SEQ ID NO: 4554 - DNA, 648 bp, Sorghum bicolor
  Clone ID: SORBI-28MAY03-CLUS82229_1
tgcccgccctccccccattcctctcagcctcccctgcgcccccccccccccgcctcgcgcagcccgtttccccccctcgcggtggtcccgcccccccccgcgcccatcggcgcggcggtccccggtagcctccccgccccctccctgccccctccccccggccccgcggtccccggccggccgccgcccccccctgctgccgtcgcccccgccgctgcgccctgctccgctaagctgccgccccgacccggcgccctgcccggcgttcgtcggcgggtggctgctggcttgccgtgccttgccctccgtgccgcctcatcctcgctcctctgcccctgggttggttgccttcttcactgctggtcttgcacgctatttggccgactccgcggcagggctcggccctctacccttctggaggtcggctggtggacgtgctgtggcagggctcctccctcttgatgtcgcgacccccgctggatcacgtgcagttggtggtcggcgggctgttgttgctgcagccccaggtgttccagctgttgttgatgttattactccgagctggatatatcgcttccgtcatcatatcactaatgcaccacttgtaatgcttgatgcgaatttacctcctgaatcacttaaagcagc

SEQ ID NO: 4555 - DNA, 679 bp, Sorghum bicolor
  Clone ID: SORBI-28MAY03-CLUS82243_1
gcacgagggccccccttcctctccctccctccctccctccccgagctgcctgacgtaggaaggggaaggaaaaaataataattcggcgcgcaaatctccgcccccattcgcacgccgcgattctcgtgcgcgatgatgatcccgtggggcggcgtggggtgttgcctcagcgctgcggcgctgtatctcctcggcaggagcagcggaagggatgcggaggtgctgcggtcggtggcgagggctggcagcatgaaggatttagctgctatcttggacactgcaagtaaagtcctaccacttgtagttgctgtctctgggagagttagttcagacacaccacttatatgccaacaaagcggcatgagaggtgtaatcgttgaggaaacggcagaacaacacttcttgaagcacaacgatgctggatcctggattcaagattctgcagtgatgctttctgttagcaaagaggttccatggtatctggatgatggaactggacgtgtatatgtggtcggtgctcgttctgcagctggtttaattttaactgttgctagtgaggtttttgaggagtcggggagaacacttgtacgtggaactctagattatttacaagggttgaagatgctgggagtaaagcgaactgaaagggttcttccaactggaacctcgctgacggttg

SEQ ID NO: 4556 - DNA, 650 bp, Sorghum bicolor
  Clone ID: SORBI-28MAY03-CLUS82290_1
agcagttcacagtaacagatagtcttctcaattcccatccatcgatctctcgccgtcgccgagctcgatatctcagtccatcgatcgccatgcgtccaccgcgctccgctgtgccggccatggcgctggcgcttgcgctggtcgtggcactactggcactggccaccacggcggtggcccgccactcctacaccaccaccatcgttccggcgccggcggagcgggcggacgaggaggtgcggcgtatgtacgaggcgtggaagtccaagcacggccggccgcgcggcaactgcgacatggccggcgacgaggaccggctgcggcttgaggtgttccgcgacaacctgcggtacatcgacgcgcacaacgcggaggcggacgccgggctgcacaccttccgcctcggcctcacccccttcgccgacctcaccctcgaggagtaccgcggccgcgccctcggcttccgcgcccgccaccgcggcggcccgagcgcgcgcgcggcagccagcagggtcgggagcggcggcacccgctctcaccaccgtcgtccccgtccccgcccccgctgcggcgacctccccgacgccatcgactggcgccagcttggcgccgtcaccgacgtgaagaaccaagaacaatgcggtgggtgc

SEQ ID NO: 4557 - DNA, 517 bp, Sorghum bicolor
  Clone ID: SORBI-28MAY03-CLUS82317_1
ataactctccacctacataccagtattcaccacctccatataactacctgtcttcaccgccacctgcccagtattccccaccattacctccaaatgctccaaaacatctacatccaaatgccccccctgcaaaatctccaccagcatctccacaacctctttaccagtacaacaccccaccacctccaaatgacgtcatgccatcgacaatgccacctctgcactcctaccaatccccaccgccaacgaaccagctatcttgagcatcggtaccagttctatgcaagtgaccaggcacgagcaaattaacgaaacaagctgaagcccatgttgattctcaagaggaaggagtgtcatagctggagccttcagcttccatcagtattctatatgtagagtttgtccattgcattatctagagttgttgcagccttcatttcttgcctatagctatttcagcaatgtaatcataagttaaatgagctttcttaatagctctatcaatccaatatatggt

SEQ ID NO: 4558 - DNA, 531 bp, Sorghum bicolor
  Clone ID: SORBI-28MAY03-CLUS82318_1
agtgtgaatcgaagctaatacccagagcagatgatactgaagaagtggtaaaagagcggctacgtgtgtaccatgatttgactgaaccagtggaggaattctacagaacacgtgggaaactcttagagttcaatctacctggtggaatacccgaatcatggccaaagttattgcaacccttgaacatagaagcccctgacaataagagatctgcagcagcatgattttttgtttgtttgttttaggaatgcccattaaattaaacatcggtagcttatctcaaagttattcaattgatgaccattccatatatctttagaaagtgtagtccatcgggggtccaggttattttggcgtaccactcaattgtatagtagattgattatcgatgggcaagatcgatgggatatgctgattgttatcttcgaacgccaaggtctgtaaaaggcaagaaaataattgtttgacgtcgaagacattcatttgtagcctgtagcatacatgtgctcgttgaaagagggtgcatcccag

SEQ ID NO: 4559 - DNA, 926 bp, Sorghum bicolor
  Clone ID: SORBI-28MAY03-CLUS82950_1
tactgggagcagacggcagcgcccgccgcgagacctttcctcgtcaggctccgatggcgctctcacacctctcccgccgcctcctgagcccaacggctgcggccgccgccgcgcacctccccacccataagacattcgcccacggccgcgaccccttcgtcctcctgaatccgggccgccgcttcttctccgcgtcctcaaaccccagccccaacccctcctccacgccgtcagagtccagccagggcgccccatccgcgcccgtgtcgccggatgagatgcggcaccaggagatcgagggccccacggtggagcgcgacacgtcgccgctggccgacgagacgcggcgggagctcgacgcgctccgccgcaccgtgcagcgcctcagcggctcgctcgcgctcctcggaggggcgcacctcgccgccggcgcgtggatcgcctacggtgcccctccgctcggtgtcggttcccccgcggcggtccagggcgtggcggcgttcgcgttccccttcgcggtccccctggtgctgcgccgcgccatcaagcccatcgccttcttccaaaagatggaggccaacgcgaggctgcaggtgctcactctgtccctccaggctacgaagaacgttaccctcatgctgctccggacgcgggtgatggccatcgcttgcgctcttggggtgtctgtcgcgtcagttgctgcggtgttgatgcgatgattttaagttcagatctctgcgggaatgatatttagttttcaggatctgaggaataaaaaagcgctggtcatattcaagtagactaggaagaactatgccattttggagcttttggatgtttggatcgggcttagttttggtgattgtccacgagagagattccaatgtgattgcatggtatatttctattccaatgatattctcttc

SEQ ID NO: 4560 - DNA, 579 bp, Sorghum bicolor
  Clone ID: SORBI-28MAY03-CLUS8298_1
ctggaaacctttttttccccctctcctctccttctccctactccctccccccacccctacccctagcctagccccctccccgcccgtcaaagcgagagcgccgtatcaccggcctttccctccaccgccgcctcgatccgcgcccaaagatacctttcccccccttcctcgcgccgccgccgccgccgccgccagccgttttgctgcgaccatggcggcggagggggagggaaagaacccggcgggcggtggcggaggggataacccccagcaccagcaggcagtgcaggctgccccggcgccggcggcacagggggaagcggcgcaggaggctggaggacaggggacgggactggagccggagggggagaaagcggatcgagagggggagggcggcggcgccggggagaaggacgacgccgcgtgcagagatctggtcctcgtcgaggatccggaggtggtcgccgtcgaggatccggaggaagctgcagcaaccgcagcacttcaggaagaaatgaaagcgcttgtggcatcgatccctgatggtgctggggcagcattcacagccatgcagcttca

SEQ ID NO: 4561 - DNA, 483 bp, Sorghum bicolor
  Clone ID: SORBI-28MAY03-CLUS82994_1
acacaaccacgccccacgcacacacagagccaggcattgcacttgccttgcacaagccccggaggagccccacacccagcggcggacggaatgcggctgcgcctgggactgcctcagtgcgcctcccgctctccccgcctcccccctcccttccccccgctccgttcctctgactgtctccggggacccccgcccccggtccgcccggctctgctggacgcccgctcgggctgtttcggtcccccgttccctcgcctggctcccccctgacccctgcaacctgcagactgcactaggctttgcgccggctgcgcccctcttcttccctcccacattcgccagctcattgcccccccgattcgagcgccaacattagcctccgcttgttgaaatctttgtccggtgtggtggactcggtcgttgaaacccgtcacctgattacttgggttgtttcccttgctgttgagctttgtgatgtgaagc

SEQ ID NO: 4562 - DNA, 493 bp, Sorghum bicolor
  Clone ID: SORBI-28MAY03-CLUS83049_1
cctgtgccgttacgactggatgcgcgaggcgctgtcggcgctgctggaccccctcatcacggagacggagcccaagcccgccgccgcggaggggctcggcgaccacaacgccggcgtgtgcatgatgatggtcaaggccgccgcggatcgagcggtggcgctttgctagctcaccaatgccaatgctaatgtcaatgccacgcggcagtcataaaaccgaccatttgaaggctcgctttttgctccttgcaactagagactggtcccctcaggcacggctgttccttggaatgaactttttggtgtcggttggcttcgttggaaatgctctctggcttcaacaaatgcagtgttgcaaacttgtccggtcaaccccctgggcctgtaaatgagtttggtttggccccggattaaatcaaatgaatacaactgtcagagtgtcagtgcgtagagtttccttgactttgtcaagtcataagctttccacgttttt

SEQ ID NO: 4563 - DNA, 683 bp, Sorghum bicolor
  Clone ID: SORBI-28MAY03-CLUS83070_1
tgactctcttcgggtgacccttgggccgccttctgccagttttcccgcgcgtggcttttgggctcctgtggccttttccttcggtggttgtctgtccgattcggtggtctcttgagggtcctacagcctgctgggctgcccacgtccacaggccgaggttggtcccctcctgccctggttccctccctggagtgggggtcgcgtgatagctgaccatccggcccggcacccccgcggcggcggccggtggtgccgttgccccgccgccccggtctgcgcctgggctatgctgtgccacgtcgtcctgcgattgcgcagggaccctgcccgggggcgctggaacgtcccggctcgtggacccaacggtccgggattgtgtgttgttgtttgtgcggcctgcctgcctacgtggtttgttggtggggggggggggcggcgggtggggttgccgggcgacccgctcgtactgcctggatggatgctgggcgccgtgccgtcgttccggccccctacggctgtgtttgggccgcgcgttatgctgccctgccctcgggccgcgccctggccctctggtccagtctgtgtgtgcctcttgcccgcccgctcgcggcaccgtcgcattctctaggtccccactgtgaacatgcactctagattatcttaatctcaagaacctcttattt

SEQ ID NO: 4564 - DNA, 635 bp, Sorghum bicolor
  Clone ID: SORBI-28MAY03-CLUS82420_1
tactggatcccatcctctcctgctctcacttggcaaagcactactagctgtgagaatgagcatgacaggccagctcaagggtcacctatggctggtcttcaccatgttgttcgtcacttctgcaatgcatagcgagggagcgagcagcttcgcaccaccgtctctctccatatcaccaacatacgatccagttattaaggtgatagggaaggtgtactgctacagatgcttcaatgaggcacacccagatgaatcacatgggaagaagcacctggaaggagccatggtcaaggtcacttgtcaggcaaatgtccaagcactagtggcatttggctacaccaaaagcaatggcaaatacagtgtgatccttaagggcttgccaattagcaacaactatggggctgactcgtgtaaggttgagcttcatggagcaccaggaggatcagactgcaatgtgccaattgagttaaatttgtctgggctcagtgtttactccaaatcaagcgaggaggtggtttttaaagcaaaccagataatggcatttgcatcaaagaatacatttggttgttccaaaccacagacgcaaccaccgatccatccctacagttccccaccactcccttaccagtatccct

SEQ ID NO: 4565 - DNA, 311 bp, Sorghum bicolor
  Clone ID: SORBI-28MAY03-CLUS8243_1
atactgctattcctctcttgttcggctaccccggccgggaagggaaggcagccgtcctctccgcacctcccctgctctcctcgacctccgacgcaccccagacaccgcagagatgcagaaccctagcggccaccaccccgcgacggccgccccgtcgtcggcgccgtccaagggcaagtcgtcggcgccgaaccctagcggccaccacgccgcgacgccggcgccgtcggggacgccgtcgaagggcaaatcagcggcggcgcaggccgcggtcttcgggccaggggctcctcttcccaccaccacactgc

SEQ ID NO: 4566 - DNA, 797 bp, Sorghum bicolor
  Clone ID: SORBI-28MAY03-CLUS82471_1
atctcaagctccaccacggcaatggcgccaatgaaggtgtatgggtgggccgtgtcgccgtggatggcgcgcgccctggtgtgcctggaggaggccggcgtggagtacgaggttgtcccgatgagcaggtgcggcggcgaccaccgccgcccagagcacctcgccagaaacccgttcggtgaaatccctgttctagaggacggtgatctgacgctctaccaatcacgcgccattgcacggtacgttcttcgcaagtacaagccagagcttgtcaaggaaggcgacctggagggatcagcaatggtggacgtatggatggaggtggaagccaacaacatcgagccgaccctgtggcccatcgtccggcactgcatcatcggccagtacgtcgggcgcgaccgcgaccaggccgtcattgacgagaacctcgagaagctgaggaagctgctgccggtgtatgaggctaggttgtcagtctgcaagtacctagcgggggacgacatcactgccgccgacctctgccacttcggtttcatgcgctacttcatggccacggagtacgccggcgtggtggacgcgttcccgcacgtcaaggcgtggtgggatgcgctgctggcgaggccgtcggtgcagaaggtgatggccggcatgccgccggattttgggtatgccagcggcaacattccgtagtgctggtgtgggcgtggtacgtgactctggtgtagtgaatctggtctggtcacacccaacccgtgtgtcttatttccgtctacaaataaagtcgtccaatctatcgc

SEQ ID NO: 4567 - DNA, 683 bp, Sorghum bicolor
  Clone ID: SORBI-28MAY03-CLUS82501_1
cggggagaccacgaccgccaaccggaacaagctggcggcgtgcatcgccgccatcctcgccccgtcgacggcgacggcgacgtgctggggcgtcgacgtcaacgggtgggtgccgtacgcggtgacggtgaccgcgtggttcgtgtccacggtgtgcctgtgggcgttcgtgccgcaggccagggcgcccaagctgtggggcgtgccgctggtgccgtggctgccgtcggcgtccatcgccatcaacgtcttcctcctgggctccatcgactccaagtcgttcatgcgcttcgggtactggacggccgcgctgctggtttactacctcttcgtcggcctgcacgcgtcctacgacacggccaaggcgctcgccgccgagtctgccatcgccaaggtggagaacggcgacgacaagccggcacgaggccccgtccataacggcgtgtaatgaagggagatgtaatcgtgaatataaagtgctacactatggttgttagtcgctgacaggcgaacataagtttgtacaaatcttcagacttattcgtgttgagttactaggtccgtacaatgtatattggacaatgtatttttttttcgtctcctggtgaccaccccccgttgttgagacgtagagtgtgctcaaggtgtggttaaccgttaagcctaatgcattcattttcacc

SEQ ID NO: 4568 - DNA, 694 bp, Sorghum bicolor
  Clone ID: SORBI-28MAY03-CLUS82507_1
cactcctcactctgacatcagacacacacgacacaagccacacggctctccagtccccagactcccgtgccttcgtgagcaagaacccacccgcagcgacgatggagcggcagcagcagcaagaggcggcgaggcggaccataccgcggcgcgggcagatcaaggtgcgcatcttcgcgagcctgttccggtgcatcgtccccaaggcaccagcccgcaaggaaggcggcaagaacaaagatggcagcagccaccgccgcgttttccccggtggctgatgcggtttgaccgaggcgagataacaaggagaatcaagatgcggggttgccacgatccccgttgagaaatgctgcagcctgcagcggcggtccttgaacctgccgagaatcctcgggggtgggaccgggggggtgggggggtgtgcacttcgggtaagctgtgtataatggtatgggattcagaattcagaccttggctgtgaatgaatgaactgaattcggaagctttctgtgaatggagtatctgaagtctgaactccgacttcagtgtcttagtacatgggcaaaaaggctctttccttttgaggtcaccactgtcctgtggatattatgtactagtggtgatgaatttctgttctgctctgcatcacggttctgtactctgtttctttcacttgaacaagcattactctttt

SEQ ID NO: 4569 - DNA, 657 bp, Sorghum bicolor
  Clone ID: SORBI-28MAY03-CLUS84956_1
atatgcactaccaagtggggctggtgctgttttgaagccagctcgagctgcttttgagaaggagatagagggcctacctaccacacgttctgttggtgatcttccaccagagctacgctgcccattgtgcaaagaagtaatgaaggatgctgttctaactagtaaatgctgctttaggagtttctgcgataaatgcatcagggattacctaattaataagtcaatgtgtgtctgtggtgccacaagcatattagccgatgatcttctccctaacaaaactctaagagaaaccatcaaccgcatattagaggcaccaccaactagcagtacggaaaatgtgggaagcatggtgcaagtacaggacacggagtcagctctacctgtgcaacctaagcttaggtctcctgctgtttctgctgcttcaaaggaagaggctaaagcatccacacctgtagaagagtctccagatgctgagagcctcaatggagcaaaagctacaaatatcgatgcgagttcttcagataagaaagccacaacagttccggatattgctgaagggacgatggattctaagaaggcgaaagaagataaaccagtggaaacaactccagtggcaaaagattctcaagaaaagtttcctgcaggggaacaagcgtg

SEQ ID NO: 4570 - DNA, 650 bp, Sorghum bicolor
  Clone ID: SORBI-28MAY03-CLUS83179_1
aacagagccacagaggaaacgaacccgatatggccgccgccgtccccacgccatccccattcctcgcttcaacccgccgcttcggcttcgcccctcgcctccgctccctcctccccgccgctgccatgtcttccgccgcggtatccgcctccgccccaagccccagctccggcactggggaagaggcgcaggcggccccgctcccgcactcgaccctcgagatcgcgggggcgcgccggggcctcctctccggcttcagcagcctccgcgccccgtaccgtgccttccccgtactcgcgtccaaccgacacgtcgagaccatcttcgctgcgttcacgcggtcgctccccgccgttaagctgcggcgcgagtgcctccgcgcccctgacgacggagccatcgcgctcgactgggtctctggcgacgaccgcgcgcttccgatggatgctccggtgcttatactcttgcctggtcttacaggtggaagtgatgatacatatgtaaggcatatgcttttgagagctcgaagcaagggatggcgtgttgtggtgtttaatagccgtggatgtgcagacagtcctgtgactacacccaagttctattctgcttcatttacaggggatctccgccaagttattggtcatatttta

SEQ ID NO: 4571 - DNA, 675 bp, Sorghum bicolor
  Clone ID: SORBI-28MAY03-CLUS83181_1
atctccgccggctcaacgcggggggcacgaccaccaccacctccacggccaacctcttcttgtatagtcaaaccgctcccctcctcatcctccttccttgtaaccttcgcaagaggaggaccagcaaggccccagctttttcccgtgttcttctacttctttccccgcctcgccttcgttccgcccgccaccaaatctctcgaggcagcggagtcccgggacgccgttctttttcgttgtgctttcttgggctattgctgccggcggccggcgatattcgcgaggtccgtttgggcggcaggtaggtagaggcggtttttttcttggcggctggtgggatggatagccacgccgccgggtcgagctccggcggatccggggatggcgccgcgcaggctaggaggaactccaggaagcccaagtattccaagtttacacagcaggagcttccagcttgcaagccgattcttactccaaaatgggttatttcagtatttgttcttgttggtgtgatttttgtcccaattggtattgtttcgctgcgatcttcacgacaagttgtcgagatcgttgatcggtatgatgatgcatgtgtccctgctggtgtgactgacaagcttgcctacatccggaatgagagtataccaaaagcctgcacaaggaatctgacgatta

SEQ ID NO: 4572 - DNA, 652 bp, Sorghum bicolor
  Clone ID: SORBI-28MAY03-CLUS8319_1
ggcccacgcgtccgcccacgcgtccccccaaatccccaatccccaaaccctaggcgagcttcgtcgcggcggcgatggcggcggcgggcctgcggaaggggaacgcgcgcctccctccggaggtgaaccgggtgctgtacgtgcggaacctgacgttcaacatctcgagcgaggagatgtacgacatcttcggcaagtacggcgcgatccggcagatccggctgggcaacgccaaggacacgcgaggcaccgcctacgttgtctacgaggacatctacgacgccaagaacgccgtcgaccacctctccggcttcaacgtcgccaaccgctacctcatcgtgctctactaccagccagcgaagatgtccaagaagtcggatgtcaagaagaaggaggacgagatcaccaggctccaggagaagtacggaatagggtccaagacacccggccctggctccagcgactgagcggccaggttattgcccctgcagcctcttgtatgctgaagagtagagggaacaaattggtagcgctgtgctgtgtttatccagtgttgctaattactctgtgttgttattcggtcaattgaatagatatgtgcttaccatgaaccattaatatgctacaatgcctgttcctttcatgcttttct

SEQ ID NO: 4573 - DNA, 739 bp, Sorghum bicolor
  Clone ID: SORBI-28MAY03-CLUS83208_1
gcctactgaagcacacgccacaccaggagccacgcacctcacgctcacggcacactatctcgtggcgtcgtgggtgtggtcgtgtggccaagcctgctcgcgccactcgacacaggtgcgcagcaatgtggcagacgcgcggcttgctactcgtcgcggtggtcgctgccgccgccgccctgccagacggagcgtgggccgccgctgccgggcggtgcacgacgtccacgcccatcaagacgtacgacaagtgcatcgccctgccgacgcagggcgccacgctggcgtggacctacgacgcgcggaacgcgacgctggacgcggcgttcacgggctccttcatctcgccgtcgggctgggtggcctggggcgtgaacgcggacgcgccggcgatgacgggggcgcgcgtgctcgccgccttctccgacccgtccacgggcgcgctcctggcgctcccgttcgtcctctccccggacgtgaagctgcaggcgtcgccgctcgtgtcccggccgctggacatcccgctgctggcgtcctcggcgtcgctcgcctcccccgcgcgcaccgtccgcgtcggcgccagggtgaccgtggcggccaccatccggctgtccccgaaccgcaccaggggccacttcgtctggaaccggggcctgtacgtgcagggctactccccgaccatccaccccatggacgcctccgacctggcgtcgcacgccaccgtggacatcctcaccac

SEQ ID NO: 4574 - DNA, 674 bp, Sorghum bicolor
  Clone ID: SORBI-28MAY03-CLUS83229_1
tatggtcgatcctggtggaatagctaactggtcggtgactcatgttgattggtctgagggaaaatggcatccaaggtcatatagagctgcagatgttaactatcaactcttaaagaacataacgtctgtcaatgagaatttccacattacaagtgatgataagaaagttatgacacggactccatgtatgtggaatggaacaaaaagaccatgctacctttttgctagaaagttttacccagaatctctgaacaacctgctgaagctattctccagttacacataggcttgagttctacatgatttttttccccatttggcctaggtgattcccctaggatttcttttttctgctttatgtaaattgtgaaattgatacttagagccctaacacacagttacagatccagggccagtgatgtaattctgagtcccttggtagggctgaggtgctgtttgtttagtatttacgctgccctcactgtcattcgtggtgccctctgtatgactgtatgcttctgttagcccttcacttctctctctctgctctctcattcttagattcctagctcccatttcctgagtaacaggggttttgtcagttcctactgttattataagattaatctttttcagacacgaagagattatgaaatcagttacactttatagtt

SEQ ID NO: 4575 - DNA, 514 bp, Sorghum bicolor
  unsure (1)..(514): unsure at all n locations
  Clone ID: SORBI-28MAY03-CLUS8324_1
ttttcggacccctattccctcgcatcaccacacgttacaccactacagctcccgcccagcatcatggccttccattccccgatctagggttgcgagctccccgccaccgccggccatgcccgacacggacgtcgacaccgagatgcgcgaagccgccgctgccgcggccggggccccagccggcgacgacgacggcgagggagacaccgaggaggaagaggaggaggacgaggacgacgaggatgaggtcgatgaggacgatgaggaggagttgcccgccgcggcgccggcgccgaccgaagagcaacccgccccagcgcccatctcggccttgccggggaacccgaaccagctgacgctggtcttccagggcgaggtttacgttttcgaatccgtcacccccgagaaggttcaagctgtgctgctactgttgggacgcggngaactaccacctgggttagcaggcatggttctacctaatcaaaatgagaacaaaggctatgatgatatactt

SEQ ID NO: 4576 - DNA, 426 bp, Sorghum bicolor
  Clone ID: SORBI-28MAY03-CLUS86812_1
agtcattgtcaataaatcccacacctgatgtagttgtgccacctacattaatcgacccagctcagagcccagcaacatacccatgcccactgcgaacccgccgtcgggttggccggccaaaagagaagcgtgctgatcctcgcattgcaatcaagagggcagtgcgctgcagcaggtgcaagggttatggccacaacaaggcaacctgcaaagttcctgtcagcacatagtatttactcatcggatcagttctgcaatgtacattagggtggagagttgttcgtgctattgttctctgcaatgctagtgcggatgtttcgttggatagtctgtgatacatgctagggttgatcttagctgtgaattgatccgtattttcaccgttgcttagacttactgtattagtctgtgagtaaaacactgtag

SEQ ID NO: 4577 - DNA, 636 bp, Sorghum bicolor
  Clone ID: SORBI-28MAY03-CLUS86824_1
acgacgacgagcagtgcaagccaagcattcttctcacgctagctgttctctctgcttctttgccatcatctctctcggcgagttcgtcgtcgatcggtgttgcatatccacaccaccggcgagcaatttctttctgtgatcgaccgcgtcgtcggcgagcggccagctagcgcccagcagcatggagatgatcgacgcggagctgcgtcttggtccgcctgggagcaacagcgacgtcgtcgtcaccgtcgtgcagccgacgaggacgccggcgtcggcggcggcgaaacggcggccggagtcgtcggtggtgaagagcgaggcgtccgggacggacgaccatgacgacgcggcaccggcctccaaggtgcagggggtggggtggccgccggtgagagcgtaccggaagaacgcgttccacgcggcggcggaggcgaggagggcgacaaagggcggcgagcagcaaggatctggcctgtacgtgaaggtgagcatggacggggcgccctacctccggaaggtcgacctgcggacctacggcggctaccgggagctgagagacgcgctggacacgctcttcggttgcttctcctcctctgccgccgccgacggcggctgccagttcgccatcgccta

SEQ ID NO: 4578 - DNA, 635 bp, Sorghum bicolor
  Clone ID: SORBI-28MAY03-CLUS8694_1
gcacgaggccagtatcttggtatgcaaccgttgcattggagacgatgaagaaatatggaggtatatatttaactccattttcacaccgtttggcagaagatattgatgatccggaactccagagattgagatgcagggtgaattaccatgcactacgattcaagccacatatcatgaaaacaagcagtgagatagtgaacaagctccgctcagaaggccatttcatgtcaattcatcttcggtttgagttggatatgcttgcatttgcagggtgcattgacatattcaaacctcaagagcaaaaaattatgttgaagtacaggaaagaacattttgcagaaaaggaacttatccccatggaaaggaggcgcatggggaagtgccctttaactccagaagaggtaggtcttattctaagtgctatgggatttgacaatagaacacgcatttaccttgcttctggtgagctctttggtgggaaacgtttcatgaagccattcaagactatgtttccacgcgttgagaaccacagcacagttggacctggaaagctggaagagaatacccaagggctagcacgatcagcagttgattacatgtgttgtctcctgtctgacattttcatacccacatat

SEQ ID NO: 4579 - DNA, 641 bp, Sorghum bicolor
  unsure (1)..(641): unsure at all n locations
  Clone ID: SORBI-28MAY03-CLUS87008_1
tcggcacgaggcaccttcgctcccgtcgtccccttcgctggcacgagcaacaagcaactcgttcgatcgttttcaaactcagtccatcagctgatcgccgccatggggcacggcaaggaggcgaagacgagaccagaccccaaggtggagatccaggagaagggcgagatcttcttcttctaccgccccaaggtggacaaggacgaggcgcacagccccgacgacgtgcagcgcatgtacatcgtcctgcgccccgagtccaccggcggccgcggcgtcgaggagaagcaggcgtcggactccggcaaggagggccgcaagcgccaccaacaaggcgacgccgccggccaggaaggaagcgagcagaaaggcgcggaaggcggccacggcaaggaggaggtgaacatcgaggagcagccgttgctccgactggtcgtgatggggaagaagagcttgccggacccagcgaagcacagccgcccgtactggggttacgtcgagctcgtcaccaccaaggtcgaggacatcaaggacgcgctcaaggaagaggagtacagcacggcgacgcgaggtaagcgtcacaggccggcngcgcgggcgctgggggagggcgtgtaccgcatcctgaagcacgagtcgtc

SEQ ID NO: 4580 - DNA, 675 bp, Sorghum bicolor
  Clone ID: SORBI-28MAY03-CLUS83401_1
gtggtggtggttctgatggcccagaggacgaatcttttaagcaatcattatatgagatgatccagattttgatagcaactgttgcgttcatacttgtgtatatccacataataagaggggaggaattataccgccttgctagggactacaccagatatatggttactgggaagagaacagctcgactgaaacgtgcaatgctaaactggcgccagttttctgagagcatcaccaagaaggatgatgcgcaagaagactactacggaagatacacttctgaatccacgtggtggcaacagccccaacagcttgctcgtcgtatggaggaggtctgcagaggctatttgcgcccgcacgcgcaggaatcgtagttcggaggtcgtactgtttggtcggcctgagttttcccgttgcgttgatgcgtagatgagttcgcccggggctgtggaatactgtacgtatgtgttctctcttttcgcaaccagaaaagatggttgatttgtcacttatcaagaatcaagacccggctgctgtacctgtgatggtctgtcggccaatgagatgccggtggcaacttgaatgctacgtctgacggatcataactacatactagaatgtaccagtaccaaaagacatttgtaactgctaccctgcaagcattgaacttttgggcac

SEQ ID NO: 4581 - DNA, 582 bp, Sorghum bicolor
  Clone ID: SORBI-28MAY03-CLUS83406_1
gactttacagtgtgctctggggtaagagcaaggaaacaaaggttgcgtgtggcaaggtgaatagtgcagcggatgatgttgacgaggagaataataatcatcataaccctcaagagaaggtggagacaacatcagcatcaatagttgcccatgtgtgacggattattggtcgatcaattcttaattcagagtttagcaggcctgggcctggcccttaacttccttggctgctgattcctcaaaaaaaaaatcctcggctgctatttatcaaaatgcaatctttatggcccttggctgctatttatcaatacaatctttatggataaagcagatggccatattaatagggacaactataatttctttagtcatatattttaaaaagcagtgaggtcccaactcttaaatgttgttactgatatgaagtatgaactagattagtcatgctcagcagaccaaacgctagaagtgttgtactggtgtagtatgtgtttggaatgtaagaccagccaagatgtaaaattttgcagcatccttgttatacaaaatgttgcctctactctatctaaatggatacttttt

SEQ ID NO: 4582 - DNA, 1141 bp, Sorghum bicolor
  Clone ID: SORBI-28MAY03-CLUS83425_1
aggggagatatgttcaaagctgaggtgggcacagaggtttcacatcatcaaaggcgtggcatcagggttgctctatctccatgagaggtgggagaaggtggtagtccacagagatatcaaggcaagcaacgtgctgctggacgcagacatgaatgcgcagctcggtgactttggcctggcaaggctttacgaccatggcacggactcgcaaaccacacacgtggttggcaccgtgggatacctatcccccgagctgctacgcacaggcaaggcgtcccctctcacagatgtgttcgccttcgggatattcctcatggagctcacctgcggccagaaacccatcaaggagaacgagcaaggcggcggcggcggcggcggcggccatgtgatgctggtcgactgggtgctccagcactggcgcaacgggtcgctcgtggcaaccgtggacgcggggcttcgcggcgagtacgacgtcggcgaagccgaattggttttgaaactagggatcctgtgctcgcacccgttcgccaacgcacggccaggcatggggcaggtcatgcgctatctcgacggcgtgacgccactcccagagctgacaccgacggattccagcttcgatgtgctagcgatgatgatgcagggcgaagactttggcatgtcctccttttcacatccagatacggtggccagtttcggcacgatctccaacctatcaggaggaagataataacaaaagtatgtaaaaaacgttcatggctccgcaactgcaggttagtcacttggtgcagataggctgcattggtacaagttatacgcttcatctaattaaaaacgtaacagttgaggggtttggagcagttaacagcatttgtgtgttccgtgcagagtagaacatgccgtgtgtagtgagaagatatcaatacgagctgtacacttgtactatctagtctcctctcggcggacggtcgcatagttgagggcacgaggccctgttttctgtattgattgatgctttcgtgactttgttcttcatcagctgagcctagttgtggagttgtgggtcgtcaattatgtatgagtattatagtacagtactgctttcggaaaaatgcccctactagaaataagacaacttgagatt

SEQ ID NO: 4583 - DNA, 1187 bp, Sorghum bicolor
  Clone ID: SORBI-28MAY03-CLUS83437_1
tgtgccctgtcgtcctcgcgaacggcgacctgtcaacgacaggaggtcacgctcactccaccatgctgttcgttcgatcgggttgcgtatgcgcgcgaggcttagtagcttacatacatgatgtggttctcttgaagcattggtgtcccggaagacggaggaggaggcgtccatttctgcgcatgcaccggctccggcttaggtccctggataatggtccggagcggcgacacggccggcgcctgccggacagcctgccgcaccgacgtcaccttgccgcccttggagacgacgtacacggtgcagaagtccggcgcggcctttgagatgctgctgcagatttccgccttgaaccttcatgcacaaaccaaaccaggattgatttcgtgctgtctttgttcaccgagttcacagtgctggatcaggatgaggaatggcgcgatggatcggacgcgtaggcatcagcacagaacggccagtgactcgctcacctgacgaagctgctcctggtggtggcgccgacgacgagcttctcgatggcggcgtgcgcggcgaactcgacgaccgacttggccacgtcgtggtcgtccagcaccacgtccttgcactggatctgcagcaaacaatacaatacagggcacgtattgcattacaccagacaccgtgaaatcgcaccgtgtcacactgccgctaccgtgctactacgtttgatgtgcgcagtgcatgtgtttgcgtacgtctttgcgcgtgcagaagcagcggaacgggaggaagaggtccttcatctgcgggtccgtcggctgcttgtacccggcgacgtcctccaccccacctgcacgccgtggtcgtcagaaacacggcaaggaagctgacgaggaaaatttggtcacgtcgtggcatggagacgaaggatgatgctcgcctgaggtgcccttggtgttgacgtggacgaggacgatggtctggcccttgtgggcgagcgtctcggtggcgtacttgagggcgttctggctgttcttgtccttgtcgatgcacacggccaccagcgggtagccggcggcgccgccggcctcgccgctgtccttaccgccgtcgctgtacttgcccattgtgcttctgtcgcttctcctgcttataatgtatgcagagcactatttggaatggaggattttggcctcctataattt

SEQ ID NO: 4584 - DNA, 506 bp, Sorghum bicolor
  Clone ID: SORBI-28MAY03-CLUS8344_1
gcacgaggctcacccagattcaagctagatcaataccacatctgttgcccacgcgtccggtgatgggcgcagccaagactggctctgggaagactcttgcattccttataccagctattgagctgctctatcacctgcgtttctcatcgaggaatgggactggtgttattgtggtttgcccgacacgggagcttgctatccagacacacaatgttgccaaggagttaatgaaatatcactcgcaaactcttggatatgttattggtggtaataatcgaagaagtgaggctgatcagcttgcaaagggggtcaatttattagttgctaccccaggcaggcttttggaccatctacaaaataccaagagtttcatatacaaaaggctaaagtgccttgtaattgatgaagccgaccgcatacttgagcaaaattttgaggaagatatgaaacaaatatttaaacgccttccccagaataggcagactgttcttttttctgctacgcag

SEQ ID NO: 4585 - DNA, 698 bp, Sorghum bicolor
  Clone ID: SORBI-28MAY03-CLUS83448_1
aaattatttgaatctcgtttttttctcctctcaacccgagagcagcgagatccaaacatgctcacccacccacctctccacgacggtgtctcccggtcagcggcgtccctcctccagcgaagcttcaaagcaggaggctctgtgcacacgacctgtgtcatagcaggacgctcggcaacggcgacggcgtggccaccggatgcggcagatatggcagcggcgtgcccggcccgtacggcgctcctctgctcgacagtgagcaatccctccgccccagcagatcgacaaggactcgacgacatggactcggtgcgggcggtgcacacctactcgtcggcggatggttcctggaccgacaaggcgggtgcggacggtgcacacctactttgcctgccccgagcatctgcacagctagaacctactgctgctctgttgtctcctgtctattgatgtcggccactgcaggatgctacagctgtgcagcacatgcagattctgcagggcggaggtgcctgtccatggcgtcacaatggcaggagcttgagcaccaggcgccatgtcccttcccttccccgacacgacatttttattattttgtttatagatttttaagttattatgcttcagtgcataagtttctatgcatggctaaactataacacacttttatacagttatatacatagttagagcacctt

SEQ ID NO: 4586 - DNA, 329 bp, Sorghum bicolor
  Clone ID: LIB3476-047-P1-K1-C2
gaaattgcagcagaattcacttatgcaaccgcatattcagcagcagcaaactttgttgcagtcaacacagatgcaatcttcacagcagtccatgatgcaaatgtcatctggccttcagcctgggcagaccaccattccacaaactcagtccatggcgatgcagtcagctacacagagcggtattcagataaaccactctccaacttatcttcgctcactagtgcggggcaagcacataagcaaacattccttgcacctcagacacaatctatagccgttaacacaccaggtatatcagcgtcacccttgcttgcagaatttacaagtgc

SEQ ID NO: 4587 - DNA, 553 bp, Sorghum bicolor
  Clone ID: SORBI-28MAY03-CLUS83071_1
tcttcccccccaacaccaccacggacatggacctcatcacgcccgccgtgctcgacaacaagtactacgtggggctcaccaacaacctcgggctcttcacgtcggaccaggcgctgctcaccaacgccacgctcaagaagtccgtcgatgagttcgtcaagagcgacagcaagtggaagagcaagttcgccaagtccatggtcaagatgggcaacatcgaggtgctcacgggcacgcagggggagatcaggctcagctgcagggtcatcaacaacggcgccggcagcagcagcagcagcgctggattattcgagcttcaaatgacaaccgacaactctgctcaggaggaatcagcagccaactagcaggtaggtagtaccagctatctgtagaggatctagtgatccactactactgctgctgctgtctgcatagccagtgacgatgttcttcagcactgcgatgatgagttctaccatgtcacctactgctcttgacctgcagaaatgaaataaacatcttctgaacacataaatttaaaacatggggcaag

SEQ ID NO: 4588 - DNA, 550 bp, Sorghum bicolor
  Clone ID: SORBI-28MAY03-CLUS83099_1
tcggggtggtcaacgtcttccagggcttcgaggtcatggggctcggcgcatcctactggaagctcggctactgcctggcgctcgccacgctgatgggcgcctgcgtcgcgctggaggtgaacgcgtgggtggtcttctgccggaagcagcaggaggagaagctcatgaggagggaggtggaggacgtcgtcgtcaaggacagggcagccgccttctagctagtgcttgccttgccgccttgctaccctccggcgatccggcctcagctccgctgccaggacatgctgcattgtatttgttggccgacggggagccggggccggtgggagcgatgtctcgaggatgcgatcgcagtgagggtggatttactggcaagacgaagtggcacggcgtgctctattttgtcgcatgataagagtggtttttttgtttcagatccttctcagtcaatatatatacatactacaagtagatcgaaattcttgtacatgtaacatgattgacttccaccagtttacccaacgaaatatatatggtaatgctgtatgtg

SEQ ID NO: 4589 - DNA, 510 bp, Sorghum bicolor
  Clone ID: SORBI-28MAY03-CLUS8314_1
ggcgactggagctaagcgtgacctcgcgttgcctttgcttgtgtcgagaggtcagaggagaagcagagcagcggggtacggtggtgcacctgcacgtagccgctccgaccatgtcggatcaccagaggatccaccctgtggacctggaggccggcagcaaccggccgacggcgccgctggtgccgggaggctcgtcgttccggtcagacaagggcgaccctgcggcaacgcggagcgccaaccaccaccaacaacaacgcgcctacgtcccgggcggcccgctgcctccgccgccgcgccgcgtcgcgccagcggcgccgctacctccgccgccgtcgaggaagcggcgcggccgtggttgctgctgccggctcctctgctgcgtggtgatcaccgcggtcgtgctggcggtgctcgccgcggcggccgtaggcgcgctgtacctagctctcgaccccaaggcgccgcggtactcggtggaccgcctctccgtgtccgcgttccaggtcg

SEQ ID NO: 4590 - DNA, 580 bp, Sorghum bicolor
  Clone ID: SORBI-28MAY03-CLUS83151_1
attgcatttgtatatgtaaatactggccgcaattcttttctttagtatcctgttccctctcctccagagcagagcaatagtagtccggctggccggtgctggtgcgttaatggcggtcgttgacctcttcaacctaggctcgcgcctttaaatcgggcgggaagctagcgtctcctacgtcgcctcacctccctctttctccatctccgaccctgatcaaaatcaaacccatctctgatcctttcttgagctctgcaattccattccattccatctcccccgttctctgctctgtcttgctctccaacgtacaaccacctgaccggccgtcacttcatagttggcagcagcagcagcagcagcaagcaagccgactaaaaatggcgtcaggagagaagaagaagacgacgacgatcctggtggcgaggaagggccggctgcggcagcgctacgacggcgagtaccgcctggtggccggctgcgtgccgtaccgcgtcggcgcggacggccagccccagctgctcatggtctccacgcccaacagggacgacctcgtcttccccaagggcgggtgggagga

SEQ ID NO: 4591 - DNA, 686 bp, Sorghum bicolor
  Clone ID: SORBI-28MAY03-CLUS83557_1
tcatgcagggagaggaagacgtgcgagcggcgggggccgccggtgacggcgcactacaggcacagcgccgcgccgtggtcaaccaccagctggagcgcggccgcggcggcgaggaggggaagagcgtgaagctgttcggcgtactcctcaaggacgccgccgcaaggaagaggggaccgtgcgaggaggcggtggcgagcgagcggcccatcaagatgatcagggtcggcgagccgtgggtcggcgtgccgtcgtcgggcccggggcggtgcggcggcgagaattaaggtaatggttggaactgatcaatgcgccatcgctggccgtgacatgcatgcttttgtgcgtgtttgcatttatcgtccaaggaggtgaggttgatggcaaggataattccatcgatcaagcaagtagccgaagccagtgctgtggtaaaactgtgaagacagaacacaggacgcaggagataggcgtaacgcatgttaaaaattaattatgggggtgctttggaggtaggaagattaaaagtagagttgagtaaaacgggctagaaggagcccatgtgttcagaatggaacataaccgttttccaagtgttttttataagaacttgtatgctgtttgcatctccggttgattctggtgacagaaaaatgaaagggtgtgttacttttaccaccctagct

SEQ ID NO: 4592 - DNA, 699 bp, Sorghum bicolor
  Clone ID: SORBI-28MAY03-CLUS8356_1
ggcagagatctaaagtgtacaaaaaaaatatccctggacacaatatggacacaagggccacaaaaaaactgagaacagagacaactggcaggacttcggttccactgtccaaatatcatgcaaacagcagcaattgttctgaagctaatttatcaggccacaacaacaaaggaaaaggaattagcattgatatcttggatagtgatcagattggagaagctgacttgaggggggttgatcttagtactgctggaacttgtgtaaacaaaaacagttctgatataaacacagagcaaggttggacaacaacacacaaccacatacctaaattacccatttcgtttatgggtaacacaactactagttccagacgagaacctggatcttccacgcgatctaatcaaaaccatggatctgctggaggcaatcatacctcagttagtggagcaaccatgatggttcctgataggttggggaataaaacaataatgaatcataaaggatggagaaaagaaacctcaacttcttgtcatactggtgaaagctctagtgctgttgacgaacctagaggttctcttcaatcatcaaaaatatcagccggcagaaatcataccagtcatcagcataatattcctgtaataaccatagatgacatatcccctgaagctagacctagttcgagtggattcactaatggaa

SEQ ID NO: 4593 - DNA, 442 bp, Sorghum bicolor
  Clone ID: SORBI-28MAY03-CLUS8358_1
gcacgaggccgaaagcgaaatatcccatcaattccgatgacgccgtcgcaaaacccctgcaagcgccgccatccaactccacctccaccctcggcggcctcacccgccgcgcccgtggcgctctcgctgccgggcttcgtcgccgaccgcgccgaggccgcggtgcgcgtggagcgcctcctgcggtaccagttctgcgaccgcgcccttctcgaggaggcgctaacccaccaatccttctcggatggcgcgttctcttaccagcggctcgagttcgtcggggatgccgctcttggcctagccttctccaacttcctctacctcaccaaccccacccttgggcccggggcgctctccacgctccgtgccgccaacatctctactgagaagctcgcgcgcgtcgccgtccggcacgacctctacccgcttctccggagaaagt

SEQ ID NO: 4594 - DNA, 654 bp, Sorghum bicolor
  Clone ID: SORBI-28MAY03-CLUS83647_1
aaggagcagcaggcagcagctgtgatcttctcttcatgcatttctgccgctagctagctatacttctgctgctagtttggttattgctcgctccatcagatcgttgcagagatctgctagctgctgctatcagtaatggggatggagtcaaagaagccttacgtgatcgccatcgtcgtccagctcatctacaccggcatgttcgtcgtctccaaggcggccttcaaccatggcatgaacacctacgtcttcatcttctaccgccaggccgccgcgtcgctcctcctccttcctatcgcacttgttctcgaaaggaaaaatgtgacaaccttgtcgccttggctgcttctgaggctcttcttcttagccttaatcgggatcacattcagcctaaacctgtacaacgtcagtctcaagttcacgtcggcaaccgtggcgtctgcggcgaccaacgccatgccagtcgtcaccttctgcttcgcgctgctactgaagatggaggcggtgaagctgaggagctcatcgggcctagccaagctcgccggcgtgtcgctctgcctcgccggagtcttcaccatcgccttctacgtcgggcccgcgctgagccccgtgaaccgccaccgcgccttcgccgcctccgccagtccagctccg

SEQ ID NO: 4595 - DNA, 606 bp, Sorghum bicolor
  Clone ID: SORBI-28MAY03-CLUS83653_1
tccccttcctcaattctccgcttcttgagctcttggctctctcgctgcccccccgcttcctcctctctgactgtccgaggtggctctcccttcacccttcttccagatttgtaggaggcggagcacgagctcgggcagtagcggcggcagccactgggccctccggaggaagttgtggagcaaggcggtgatggagcgcagcaactggacataggtgtggtgcatgtcggcgagcatgtagcgctggtgaatggccagcatctggagctcggagcgcacccggcagtggcgcaccgcatactcctccatcttggactggtcgtaccccatggcgacccgaccgaccagagcagccggctgcctgccgcctacaagaaccactttttattcctccctctcctcacagcagaagagcccagtcacagcagcaacaggtggggcgaatctagatggggagcagctagcgagtgggcaggcactgaggcgagcagatctggagtggctatcacctcctaccggctacaacagggagtgggatcagagaaggtatacattgatgacactaagtggtgatagagatcagaactcaattagatcatgcctctc

SEQ ID NO: 4596 - DNA, 673 bp, Sorghum bicolor
  Clone ID: SORBI-28MAY03-CLUS8367_1
aaccctgcaaacacctgatgaatacctgttacaataggttgcggccatgagttttgcaccaaatgtgcactctacttgtgctccaccactagcagctcaacatccatccgcggagttcctggctccatatcctgccctttgtgtcggcatgccattgtctccttcatgaggctcaccagtactaccccaataaaggagcttccatggacaagtgcatcgctagctctatgtgcagcaggcgcaagcactggtcctgatcatggcaggtccttgcagcgacggagtgatatgcgtcggttgcgctcgtcctcagttcagctgggatgctcttcttttagatccattggctctgggaagctgtcatccataaagctgaactgcacaggagctgaagaggcagtcccttgcctcgtcagctgcctgaggcctgatgtgcagcgttcatcgtcatacagggaaagaattaggagatattcggagttttgaaaggatcccttgttggttttgtgccgctcttcctgtgagtttttagggtttgggaatttaaacttgtgcagtgtatgttcaaggttctcttggtttgtttccttgttatgtaatatgatgcagttcttgttgtgaagatctgtttgtgtacatggcccatgttcattacttatatgtgaagtatata

SEQ ID NO: 4597 - DNA, 690 bp, Sorghum bicolor
  Clone ID: SORBI-28MAY03-CLUS83246_1
gcaaaaggttgacaggaaatttgattccaaaatgggttaatcgacttgctagaatgggtgctgtttgcaactgcattctaccagtgcccctgaagatcagtgcagcccgtcatgacccaggttgtcaagctgaagatagtgagagaaaaatgctgacaggttccttcagttgcttctcttcaatctctctatgccaaagacatttctcaacatcttcgctctccctacgttcccccacgaaaggcacttcttgggatgccaaccagtcaaattctacccgattgaagaagagctgccaattgaggtcccttgtattatcatatttagcaaatgaagcccaaggatcaatttttttttcatcaatctgttctacaacagtcttcagagaaggataaaaaggtattggtaaggtgttttgcatacttgggcgttggatccagctgtgcttgaacatctgtatagagaatgtgtagagattattcttccatttgactatttgagtttgaaatacagtgagctgggggcaagctcccccctaaacttctaggaaaaacaaactccaaaaaatatttcaatttatgggtgctccctatgaggtgatatttcggctgtggtagtttgcaaactgggccatttttatattgttccctagaaagcagaatgtttatccaagtggtggtattgttcgtc

SEQ ID NO: 4598 - DNA, 1054 bp, Sorghum bicolor
  Clone ID: SORBI-28MAY03-CLUS83278_1
ggcgaacccctggccagaaatccgatccccagccgccgcggctcgcgctctcgtcttttcccctctgctcgagcacgcgcggctactcccggcgtcaggcggcggcgatgagcgcggtgaacatcaccaacgtggcggtgctggacaaccccaccgccttcctcaaccccttccagttcgagatctcctacgagtgcctcgtgcccctcgacgacgatctggagtggaagcttatatatgttggatcagctgaagatgaaaactacgaccaacagcttgagagcgtgcttgttggccctgtcaatgttgggacctaccgtttcgtcctccaggctgacccaccggatccctcaaagatccgtgaggaagacataattggtgtgactgtgctgctactgacgtgctcttacatgggccaggagttcatgagagtaggttactacgtgaacaatgattatgatgatgagcaattgagggaagagcctccagcaaaggtgctaattgaccgggtgcagagaaatatcttggctgacaagccccgagtcaccaagttccctatcaacttccatcctgaacccagtactggcacgggacagcagcagcaggaaccccaggcagcctcgccagaaaaccacacaggcaatggccatggcaatggcgatggaagcaagcctgaagctgaccaatgaacacagttggcttcaaatattttgatgcgcgccacttacaggttgtgctgtaatattacaaacgggattagtggttatgcattgccctgggatcctggttctagcacatggtggttgtttagaactctttgttctgtaccttgagatgcaaatgctgggtacctgtatgtttccttagtacaagagtatttcagcctgttctcctgcaattgctgtatgcttctttagagtttagagtagtgttttacctcaaaactactcattggctagtcttggttaccagctttggtcttcgcagtatagcttctaactggaatccttttgttcacttaacgcaaatggtgaaatgaaatgatttgtgatgt

SEQ ID NO: 4599 - DNA, 609 bp, Sorghum bicolor
  Clone ID: SORBI-28MAY03-CLUS8328_1
gtattcattctttgttccttcacataacaaaaaagcaaggaactagtacgtatgtgtgttagccagaagaacagtgctagtgagtggcagctactgcatgcttgtctccaaggattacattacattacattacattacaggctccaaatgccatggaaaatgctcctcagcctgctcccgccaagcctcttcacgatccgtttggcgtccgggacatcggtctccgcaagcttctcgagattcctgacgtgctccgacgacatgatcttcctccggccggagctgctgtccgtgagatgcatcaccgtcgacagcaggaaccgcttcgccggcgtgggcttctcctcgtcggggcccagcagctgcagcacccgcgccacgtcgcggtcctcctggacgaaccgcttccggttgcggtgcacggacaccagggcgcagagcgactcggccgccatctcccgcgcctcgtgggacttggacgcgccgaggatgctcaccagctccggcatgaacccggcgtcgcccatcgccttcttggtctcctccgacacctggcacaggcggtgcgccgccttcagggcgcagtgctgcagcgtggtttcgccgttg

SEQ ID NO: 4600 - DNA, 722 bp, Sorghum bicolor
  Clone ID: SORBI-28MAY03-CLUS83335_1
gccccacgcccaccacctccacctcgtctcccaccaccgccgcgcgcgagccctagcccgatctcgccggcggcaggcgccagatcccgccgcccgtcgcgccccgggacgcgccccgccggattcaccgctcctcgcgctgcagcacgcctgggccaggacaagagggcaactctgggggcacaaagtaattcaccttggttacaggttactgcgtggcatgtagtattgtattattggtggaggctgtcaccacaaggcatatgttgtgatttgtcgatggcgaggagatgaaacaagtgtgggggcggagcagcaaggacatgacagccatgccccctctgcgccaccgaggcgctgctaagaagcccatgtggatcatagttctattgtcattggtttgtgttgcccttatgggggcctatgtatacccaccacggcgctactccgcatgctacttctttgcttcgagtgtctgtactccgttcaaggattggctacctgctgttgctcgggagcgaaccgatgaagagatagtttcatccgtggttattagggatcttctttcgatgcctatggctgtgtcaaagaacccaaagattgcctttatgttcctgacaccaggtacattgccttttgagaagttgtgggagaaatttttacaggtgtggtccttaaccttaatatacccatcatctaattttggagttcataaatatgaa

SEQ ID NO: 4601 - DNA, 703 bp, Sorghum bicolor
  Clone ID: SORBI-28MAY03-CLUS83154_1
atactacatcctcaccaccatcattgcagcaagcactgaagcaaaaaaagcccaaaccaatcaagccgaatagggcactcggcaaaggctccgtttacactagtgctaggtgcagagcagtgtgcttgatatacagctagctttcgtactgatcagcaccaagcaagcaagctagctagctgttgaggaggtgtgtgaggtcggtcgtcgtcgatcgagatgaagaagggctcaatgatggccttgttggtccctctggctgttgcgcccctcttgtcaggtccatcgtcgttggcaacggcggcatccggcggcggcggccctgtggagtgggggaagctgggcccgcacttctacgaccagtcgtgccctcacgcgcagcacatcctggcgtccatcgtggggaaggcgcattaccaggacccgcgcatggccgcctccctcctccgcctccacttccacgactgcttcgtcaagggctgcgacgcgtcgctgctgctggacagcagcgggtccatcgtgagcgagaagcggtccaaccccaacaaggactccccctgcgcctgcgtccgcctccgcctgttcaaccccgcgcgcgacgcccccccccccggcaccctcgccgccgccgacgccctcgcgcttgctgcccgcgactccacagtcatgactggcgggcctggttggatcgtgccgctggggc

SEQ ID NO: 4602 - DNA, 597 bp, Sorghum bicolor
  Clone ID: SORBI-28MAY03-CLUS83918_1
gcacgaggatccccatgatgtcagtggcaaagatgatcacatgcatatcatgaacttaacagatatccgagtgcggcttttgaatggtgtgcaagctgcttactggggaatgcttgaagaaggacgaataactcaagctacagcaaatattctgatgagatccgttgatgaagctatggatcttgtttccgaacaaaaattatgtgattggaaaggtttaaagtctaatgtccagttcccaaattactataggttccttcagatgagtaggttaccacgaaagcttgtcacatacttcacagtcgaaagattagagtctggatgttacatctgtgctgcatttcttcgtgctcacagaattgcaaggcgacagctacatgattttcttggcgatagtgaggttgcaagaactgttattgatgaaagtaacgctgagggagaggaagctagagaattcttggaagatgttcgagttacattcccgcaggtgctacgagtgctaaagacacgacaagtcacatattctgtgctgacacacttgagtgagtatattcgaaacctccagaagactgggctgctggaagagaaggaaatggt

SEQ ID NO: 4603 - DNA, 628 bp, Sorghum bicolor
  Clone ID: SORBI-28MAY03-CLUS83921_1
cttccgtctccatcctctcgtcatttcctctcgcttctgctcggttgcagcccagcgtagatcttattcttggccgagaatcctcaagctctccaatttctgttcttgcgccgcttagcaattccgccccgaaattcttttgcggcgcagtcttcacccgaatcttgggtcgtaggttcgtagctaagaagatgaacaaggacaaggctccgatgccgggagatggcggccccagcgacggcttgccgccgcagtccacgcgccgtgccggggcgccgccctcgtcgtcaaccccaccaccggagtacgacatcagccgcatgccggacttcccaacccggagcaccggccaccggcgtgcgcactccgagatcctgggcctccccgacgacctcgacctcagcgctcccggaggcggcgacggaccatcgctgtcggacgagaacgacgaggagctcttctccatgttccttgatgtggacaagctgaactcatcgtgcggggcgtcgtcggaggccgaggctgagtcctcgtccgccgcgggtggcggcggtgagggggctgagctgggccacgcgcccaggccaaggcatcagcatagccagtccatggatgagtccatgtcgat

SEQ ID NO: 4604 - DNA, 656 bp, Sorghum bicolor
  Clone ID: SORBI-28MAY03-CLUS83943_1
agagaaagtcccctcccgcgccaccacaccagtaactaggcagtgcactctacctctagctcaccagggggaagaggcactcggacttccggtggtcatgttgtcgtgcaaggcgagcggcggcggcggcggcggccatggcttccctccgcaccctcccgctcccggtgctcgtgcccctcgtcgtctcagcgctggtcttcctgggcaccgtgctccggcgcctgctgaggcgtcagcggccggtgtacctcctgaactacagctgccacctcccggacgcggagcggcaggtgaacctggaggtgtgcgagtacttcggcctcaagtgccgccgctactccgacgacatcgccgacttcatgcgcctcgtgtacagcaagtccggcctgggccaggagaccttcgcgccgcccttcatctactcgggcaagttcgagaagacgctggccttcgccatccaggaggccgaggaaggcctgttcgccgtggtggagcagctcctgtccaagtcggacgtgagtcccggcgacatcagcgtcctggtggtggcctgctccatgttctccccgatgccgtcgctggcgtccatgatcgtgcgccggttcaagatgcgtcccgacgtcaagtcctacagcgtcgccgggatgggctgc

SEQ ID NO: 4605 - DNA, 669 bp, Sorghum bicolor
  Clone ID: SORBI-28MAY03-CLUS83951_1
gtcctcctctcgtcgccctcgcctcgcgcgccgctcgcaaaacctctcctgccccaacgcccgcccagaactctagccccgacagcgcggcagctcgtggctatgtctgcgccggcgccggccccgtcggcgggtggggcggggacgatgagccgggacgcgttccgcgtggccgtgaccaacacgctggagcgccggctcttcttcgtgccctccttcaagatctacggcggcgtcgcggggctctacgactacgggcccccaggttgtgccgtcaaggctaacgtcctcgctttctggcgccagcattctggcggcgaggaacgggtgcctcaggtggactgtccatgtgtgacaccagaagttgtcttgaaagcctctggacatgttgataaatttacagacttaatggttaaagatgaaaagacaggcaactgctaccgtgcggatcatttgctgaaggacttctgtaaggataagcttgagaaggatcacacattgtcaccagagatggtacaagaatacaatagagttcttgctatcctggatgatctctctgcagaacaattgggtgctaagattaaggagtatgggattgttgctccggacaccaagaacccattatcagatccgtaccctttcaatctcatgtttcaaacttccattggg

SEQ ID NO: 4606 - DNA, 623 bp, Sorghum bicolor
  Clone ID: SORBI-28MAY03-CLUS83965_1
cgcaggagcagcacaggacgacagcaggggagcccaggtccggcgaaggcggccaacccacctcatatggtcgcgatggttcgccgtcacctgtgtccgcacctcgacctccacctccgctcgatctagtggggagcagcaccatgctgcccacacagccatggagcaggggagggagaagcacaggagggctttgttgaggagctcgccgcgtcgatttggagaagacctgagcgcctggtctacgacagtggtggagcgaagcagcgggatacaggatgtagagtgcggatggcggcagcgtgaaggggcaggagaaaatcccgtccttttacgaaaaagaagtaaatagggtgaaggatgggaatcgaacctgtgcgggattgttgtgtcgtgcgagagaatgacatgggaggtgggatggcatgggtggcagacggacggacgaaagacaatgttgcactaaaagttgttcactctttagtctttttagttgtaggagatgtggagcatttcaaagtgtcccaaacagacacatattcacatatgctctcggaattgaagaggtcgatgttttattttccctaactccctctcattttcaatggaggggacaaaattgt

SEQ ID NO: 4607 - DNA, 947 bp, Sorghum bicolor
  Clone ID: SORBI-28MAY03-CLUS83480_1
ccctttttaacggacgcgggatccatcgtcgatcccaagttccagcccgcggacccgccgcacgatcgccaaagcccccaagcaaacatggcgttgcgaccagcgaccatccgcctctcccctgctgccgccggcgtgatttcccgacccaccacgcgtaggggcgccgccagtgccctccgcttggtcccggatggctcttgcaggcgagcaaggaagctgcgattgtgctgtgctccggaggacgacgagtggtgggcgacgccggtgcggccggaggatctggtggagccgacggggcatggcgcggaggaggtgatcgctatacgagacgctctggtcggggaccctctccgacccgtctcgctcgccttccaggagatcgtggccaccggcggaaacatcttccgctgccgttgcttccacgccggcgtaatgtcaggtaccttgcttcttgtggccggtatttgtcagctctacaaagtggctccaaaccttttcatggacatcgttcttgcatatatgttctacaaattgagcgttttagcagcagagctgaaaagaaacgggaaagctaacaacatatgtgctcggattcagtgtgttctcatggctattttgttctacaaatataacaatcctaccaaggactcttactaccacttcactgagtttatctggggcattactatccttgtgtattcatgcacggtgtactatgaatgcattggcctcaagcatccaagacatcatctggaagcaatgttcaagacaattctaacaaccaaaggtggtttgataaaggtgctgaagcgtttgtactgggagttgataaattagagagtattcactttctcaagacaatgacaagaagtaatttttgtatgcacacttgtacttcattaacgagaacatattttcagtgaagtatctcctaaagatttcgg

SEQ ID NO: 4608 - DNA, 976 bp, Sorghum bicolor
  Clone ID: SORBI-28MAY03-CLUS83501_1
cgccagggcgcgcggagagcaagtgtagccggagcccaagcagcagagacccgagcggggggccgcggcggcggcgcaggcgcttacatgggagtagaggcggccgggtgcgggcggagggcggtcgtcaccgggttctacgtctggggctgggagttcctcaccgccctcctgctcttctcggccgccgccttcgccgccgcagcagcagcctcctcctcctcctcctagcttagcttgctgctaccttctttagatagctcagccgtacacacaacccaccagtgatcattcatcagttactagtcactagtaggctagacaacacatactatatttttatatactagcttgtgagtccgtgtaattaagcaaccagtcgccgagagatggaagaagccggcgtggccgtggtggcgtcgtcgaagcagagcggcggcggggtcaggggaggcggcgggccggcgccgttcctgaccgagacgcaccacatggtggaggagcgggcgacggacgaggtgatctcgtgggcggagcagggccggtccttcgtggtgtggaagcccgtggagctggcgcgcgacctcctcccgctccacttcaagcactgcaacttctcctccttcgtccgacagctcaacacctacggtttccggaaggtggtgccggaccggtgggagttcgcgaacgacaacttccgtcgaggcgagcaaggcctcctgtcgggcatccgtcgccgcaagccaaccacgccgcagtcatccaacaagtccggcggcagcggcggcgtgaacgtggcgttccctccgccgttaccccctcccccggcgcctcccgcgtcgggcacccgttctggggggtggcggcaacgagcgcagctcctcgtcggcgtcgtcgccgccacgggccgaccagctgaccagcgagaacgagcagctcaagaaggacaaccacacgctgtccaccgagctggcgc

SEQ ID NO: 4609 - DNA, 675 bp, Sorghum bicolor
  Clone ID: SORBI-28MAY03-CLUS83534_1
tccacaaaggacttccttgagagtggtttagtgcaacttgacaagagcatggaagaaagagtcaaagcagcagcatcgagaggaaacgttcttcgctacgtagctgagattgaaagcacagggtgccaagtaggccttaaagagctcccaaaggattctgcactgggtagattgaggggaagtgacaatgtggtggagatatacagcagatgttaccagagctcccctctggtgatccagggcgcaggagctggcaatgacaccactgccgccggcgtccttgctgatataattgacctccaagacctgttccagacaacggcatgatcgtagatcggcatccaacaccatcttgattcttgcaaggcaccagggctttttggtactctgatcggtggtgctactgtgtgtccgtcaggcagggactcagcgtgcgcttttgcttgttcacttcagtcgtgtactcctgtgtgcatttggttccttcagccgctccactgagacgcgtctgacattagaataggatttgaattttgagcagccatgtgggggctctttacagttcacatagaggaaaactttgtttcagtgaaataatgtcgcgggtctctacattaagcagtcagactgatgttgctgctagatgatagtgaaagagtaaacttgatttcgagc

SEQ ID NO: 4610 - DNA, 664 bp, Sorghum bicolor
  Clone ID: SORBI-28MAY03-CLUS83502_1
tccaccacctctccctctccgtcgcgtcacaggccacggcgagcggcggcggaggggctcttgccggattcgacggccagtggaggtgccccggtttcagccgtccctagattgaccctgctttcctccccaacgaatccaagttgcgcaaatgccgacgccggtgaagtcggtgcttcccgtggtgctcctcggctgcggcggcgtcggccgctacctcctccgccacatcgtctcctgccgccccctccacgccaaccagggcgtggccatcccggtggtgggcgtcgccgatagctcctccttgctcgtcgccgaagatgtccactccaacggcctcgacgacgcgctcctcacccagctctgcgccgccaagtccgccggctctcccctctcctccctgcttgcccaagggcactgtcagctgttcaagaatcctgaggctaggggcaaagtcatagacgccgctaccacacttggaagaacaactggtctggtgctagttgactgttctgcaacttatgacactgttagtctgctgaatgatgctgtgggtcatggatgctgtattgtattggcaaacaagaaacctcttaccggtgcttatgaggattttcagaagttggtctccaacttccgtcggataagattcgaatctactgtt

SEQ ID NO: 4611 - DNA, 622 bp, Sorghum bicolor
  Clone ID: SORBI-28MAY03-CLUS84108_1
cctactggtaatgcatcaaactctggacaggctactcaatcagctacttctcccactccagtctctccaattcagaagagaaacaaaagaatctgttcaaagaaatcacttgtttggaaatattttagtacaggttttaggggtcaggatccaatagcaacatgcaatcattgtgggcagatttattcgtgcgaccaatcaactcatggaacaagcaccttatggtaccatttaaggaacttatgccctgaagatccactcaaaggaccatacagcagtcaacgacagaaccggaggctgcaaggtgacggtgtaggcatgcaggaccggagagcacatgatgaagggagacggtcgaggaagccatgccatccacggagctggttgcatgccgtccagctcaacagaatgcacgcatgcattgcacgtaactgccgcatgtcgaactcagctgcatgcagggcccaccatggattaatcgaagggagaggccctcgacgggccatgtagaccgggcgtaggccacgctgagacagcgggctcagggagccgcatccagcagcatcgcgaactcggccggatccgcgcatggtggagcgtcgtagatgtcgccgtcattgcc

SEQ ID NO: 4612 - DNA, 927 bp, Sorghum bicolor
  Clone ID: SORBI-28MAY03-CLUS84131_1
gacgtccgcctgctggaaaacctcaggcacatcaggactgtgggtgcgtggccagtagcgacggtatgggagcaggagaagagggtggccgtggaagggcccgtcgtctgcaccaccgccggcacagggacagggacagggacagcagcagcatggttctcctcatccggatccgtctcaccaacaccccctgtgctgaccgacgactccgtccacggctttgccttcgccagcgacctcctctgggaccctgctaggtgggaccgcttccccacctccgagcccgaccagtcgcaggattccatcaagtttgtgcaaaggttggtggtggcagactacaacaaaacaaggcccatccctgattactccaactgttcccaaatcatggtctggcgtgtcgacacgacgctgctctagaggcccattccatcgtcacacctacacatgcatgcatccagctattacagtagcttgttcaattcgtccatgcatgaatcatgatcatgcacatcccttagcctcttgcacgcatgcgtgccaagcgctcacatgaaatgcatgcataaaacatagtaatatatactcctactaaggcattataatgaactaatttcatagcttagctagtagaagctcaacgatgaagaaaggcaacaaagttattcaaattaagagtttgtttggcatggctcaacttgttttttaagaaaatagctttataagcaattttataggtgatgttgagctattttgaaaaaaaatatttggtaaaatagcttcatcaactactttatgcatagatgagagagagaaatggggggagatagttgcaataagctactgtttccagcttcatctcaactcatgtcttcgtgagaggagaaaaaaaaacagtttcaccatgaagctattttagaaacttgagtt

SEQ ID NO: 4613 - DNA, 1146 bp, Sorghum bicolor
  Clone ID: SORBI-28MAY03-CLUS84147_1
ttggccggccctctctacctctgcataccaacgctgtcgaccccaagcgccgccgccgccagcgcccgaccccaggacccaacaccgcgccgccgcgacggcgaggaagccggcatgagcgtgttcggcggcgacagctgggcgcgtgacgcgcagcagcggaagcggcgcctcgacgacctcttgctgccctccacggcgtcctcgtctccctcgacgcctgattccttcaggaagctccccaacggcaagctcgcctgcctcgtctgcccccaccgccccgtcctcgacacccccctcatgctctccatgcataataaaggtgcacggcacatcgctgcagaatctaggctgagggagaaagaattatctaagaagcatgaaattaacaagagactggctctctcttcagatgcttcccattcaaattctggcaatctgcgcaccggtattaggcctaccaatatcaaagaaaagccattaatcgaggagacccggagggcaattctggaggcacagtcaagcagattcaatgatttcaaaggcaagaaggcatctcatgattcgaaatggacggcaaatacttcatcctttgactccaatgttgctccttctgatgttcccatggaactatccactggaaatgctggatcgcgagaatggaactgtaaaggagaaacttccgctggaaatcagactcaagacaagttattttctgataggcaaacagaagtccgaaaacgccaggagctagaacttcggttcactgcttcaggctggaaacgggatggccatggaagatggtacagagatgaaaatgttgaatttgactcagatgaagatgatcctaacatctgtctctcctgatcatttgaaaatgcattctgaattgaactaccaatggcccaactgggaatatggaatccatcataatgcaatatgaagtgccgtttctccctacaaaaatggtcgaatcatattttagtcagcctgtcagattttctgataaatggaaatgtcagattatgttcctgttcagcttgaatctgttactttgtgagccaaacctgtataatgatagttgaaaaaataaagtctgtagttatgttgttaaaacatattgagagatcagagaatttgtttttc

SEQ ID NO: 4614 - DNA, 720 bp, Sorghum bicolor
  Clone ID: SORBI-28MAY03-CLUS84176_1
gctgatcatatatacttccattgttgtttggtttgtcggaggcctcacagtgtttcatctctatctaatcggtactaatcagacaacatatgaaaactttagataccattatgacaaaaaggacaatccctaccggaagagcattgcagcaaacttcgcagaagtgttctttaccaagataccacctccaatgaacaattttcgttcatgggtaggtgagggcgcacttgaagctggattctacactccatacattgggctggatgtgacaattccaagggaaaagattgatctagacatggaaagcaaagaagtacttgttgggggtatgcagattccaacggtacttcagaacatagactatggttcctttgaagagggttcagatgacaagaacagaaatgctggcaaaaaatcagtgcattttcctacagcttgggcacaaggaaatggaaatgctggaacatctgcaggagctgccacggcaccccccggccaggctggcgaggtggaggtgactgtggttggcggtccgcggacgtctaccaccctcgcgtctgcggacgctttcccgcacccgcccggtcgggttgtgtagatggaagtcacactgcgttgggtggtgccgtggtgtaacccactctagatattgtacgaattacagcacaggagcaattgatttttgtagaaggaattcatacatcgttgaatgatatcatt

SEQ ID NO: 4615 - DNA, 629 bp, Sorghum bicolor
  unsure (1)..(629): unsure at all n locations
  Clone ID: SORBI-28MAY03-CLUS842_1
cgtccgggactcgtttttgttgcaatgggtgactacacaatccatatcagcaccaagctcatcgaccagcttgctggcgatgatgagaaggtgaaacggaaagccaggaancccaagcctaagaagaagcccatcgtgcagccacatgaagagcccccggaattcccaagcgaacccaagacgagcagccctgctcctgctcctgctcctgggtggcctctgcagcctcccccaatgtttctgcctgtgacccctgcgcccccgccacccccggccacaatgccggaggtggaagccatccgctccatcctgaaagaaagcgagtccgttctcgagaagctggagaagcaggaagctggggcacgccaagagctcagcaagagagcaaaggagctgcacgacaaggagttcaagctgccgtaccagaaccccatgccctgcacccaggagagggcaggctgccttgagtgttacaaggccaacgcaaaggacccgctcaagtgtgctgaagcagtcaagagatttgaggcgtgcgctctcatggccgtcaaggctgctgctgccgcaacagctgattagtaagtagcccgtcaagctttgtgagttggggtgagcggatacgcggactc

SEQ ID NO: 4616 - DNA, 590 bp, Sorghum bicolor
  Clone ID: SORBI-28MAY03-CLUS83712_1
ttccattggaaagtgccggtgcagcttttccattttgtgaccaaggggatcttttccagaactttggttcgggtgctatggaggatcagtgctctctaagtctgttagacacggctctaccccacacggccaacccacagtttgcttttcaaaagcagcaaagggacttctgggaggatggcctacagaatgctttgcctaccggtagtgagcaaagacaggaggatgggcttttagtaccgaactttgatggtcagttacaagctgatcaggcaaagattgagttctagtccctggtgatctccaaggttgatatttttgtatataggcggtacgaagaagacctgtggcaagcaaagctctcctaagctgaccatcattagagtttaggcctccaaactgattcattctgtgatatgctggatgtttggcaactcgattcttcccatagagaccttgtgatcgatctcgcaaaattgaagtagattgtgtactagatatggtgcaaatattacatgccccatcttctaaagttctactaatatgtaagagcgctggctggtattgggacgatgccgtgttactgtttg

SEQ ID NO: 4617 - DNA, 496 bp, Sorghum bicolor
  Clone ID: SORBI-28MAY03-CLUS8372_1
cgagatacagcgggttgacttaatgcttcattaaattgatcagcccttgcatgatgctttgtgcaatgttaagaaaaccctgcaattgaatacggtgacaactttttcaaagatgtgagctatattattattattagtattgacgttgtatgtgttgagcccttctatgcttgaaaaaaagaagccatgaagcatggaggcaaacataattgcaaatcgatttgagctgtctaaatttgagtttgagtattgggagagctgaatgctttttcaattttagagttcacttagcttacatgctgcaccaagtcaccctcaaacagtcctgggctccgacacgtaagcagaagttgatttatttggtctacactcaacttactgcaatttcaattctttttaccgttggaggtgaaccaggaatcatttaaaaatgattttacctgcggcagttggttgagttgagaacaccatttaattagcaaactattttttaatg

SEQ ID NO: 4618 - DNA, 497 bp, Sorghum bicolor
  Clone ID: SORBI-28MAY03-CLUS83774_1
gatgcgatcgcccgtggccctcctgctccaaagacaagtactcgctgccaaccgggccacccccttcgcctaccttcccctgccggcgctcagatccgccgccccgcaccacacccggcagcaaccacgacaaggcggcccggcgcgcggcaagctcccttcccacccttcccaccatgccgggtctggtcgcctactcgggcgccgggctgggcctcctggccctcgccgcgctcgagtccctgcccctccgcgtcccgccgctccggttcctcccgcgccgcctctccacgccgctgcacctccgccacctcgtcgccgcggccctctccgcgctctgcctcgtctccgctctcgtctccgcgcaccacctctcgctccccacgctcgccgcctcggcgctcttcctcctctactccctcgcgcccttcgtgccgctcgccgcgccgctgccgttcccgctcctcgacctcctcctcgccgcggccttcgcgcag

SEQ ID NO: 4619 - DNA, 428 bp, Sorghum bicolor
  Clone ID: SORBI-28MAY03-CLUS83807_1
ctactggaccgcgcgcgcgcccgccgccctcgcacagtcgcacgcactcgtccagtcaaaagtcctcgggacaggccaggcagggagagcagagcactagagcagcagcaacacaacacatcacgattcacgagcgatcgcccgcctactcgcggcagcagccagccatgaacctgaaccgcctgacgccggcgcaccacggggcgatgcgtccgccctccgtgcaggggcaagggctggcgcggtacggctccgcgccgggctcgctcctggccgccatcgccgagtccgtgacccgcggcgaccccgcgccgccgccgccgcccgtgagccggtcctactccgccgagtcatcggggctcacctcctgcgagtccagctgccgcaccgacggcggcggcggcggacgtccgcctccgctcgagcgg

SEQ ID NO: 4620 - DNA, 655 bp, Sorghum bicolor
  Clone ID: SORBI-28MAY03-CLUS83866_1
gggctggcaagacagaggatgagcagttaaacgtattccgttttccccctcttgttgctccaataaagtgcactgtctttccattggtcaagcttgagaaatttgaggttgttgccaagaaaatttcaaaggccttgacagcagcagggatttcacatattatcgacatgacaggtaatacaataggaaaacggtatgcaaggacggacgagattggtgttcccctggcgatcacagtcgataacactataagcgtgacggtgcgcgatcgtgacagcaaggaccagatccgcgttgaggtggacgaggtggcctcggtggtgaaggaagtgacggacgggcagagcacctgggcagacatcatgtggaggtacccggcgcataccacctcggccgccgacgaggaagacgcggagccctgaagacagcgctggcacaacaccacccaacgatcgttggtccctgatacatttcctcgcttgcttaacagagccagactgcgttgtcgtgtaagcctacagtagtcagatattagcttattttgttatgttggtctcgtaacttctgctgcttcataccatctcgtaaattccttgttttacagtagccagattcctgcacattttgatttccacaaacgaaatagcagcttctt

SEQ ID NO: 4621 - DNA, 658 bp, Sorghum bicolor
  Clone ID: SORBI-28MAY03-CLUS84330_1
gacgaggaagctatctgagcgagctgaccctagaaatcggcagctcttgcaaaaacggcagttcttccattctcacagagcgcagccaatggcactggaacaagtgttctcggaccgtgatagtgaagatgaagttgatgatgatattgctgactttgaggatagaagaatgcttgatgattttgttgatgttacaaaagatgaaaaacttattatgcatatgtggaattcatttgttcgaaaacaaagagtgctagcggatggtcatataccttgggcctgtgaggcattctctcagttgcatggacgacaacttgtacagaaccctgctcaactgtggggctggcgtttcttcatgattaaactttggaaccccaacattttagatgcccgtaccatgaacacgtgcaacacagtccttcaaagtttccaagaagaaagcacaggtctaaagtaatttcgatgcgtcagacgaaagatttaagggaacaagattttatagtttccaagaagaaagtaactttttaatgatcgtttcattcaaaactgctgtcgattgtattaattcttgttgaaaagagacgtagccggtttaatttcctaactctaatattctggataatacttgaatttgacgaatatttaatgttatttcatt

SEQ ID NO: 4622 - DNA, 658 bp, Sorghum bicolor
  Clone ID: SORBI-28MAY03-CLUS84418_1
gcacacctctagctacccatcccggcatcccccccgtctccccggtcgaggctgctgctgctgctgctgctacccgcagtcccactccccacaccaccggccgcgccaccgcaacagcaaccgccggggccgcgttgaccgccgttgacctcggcccgcccggctggttgccatggacccgcgcttcccgccgccagcgccgtcgtcctgctttcggcgggggaggggggctgctcccagcgcgggggcaccaccggcgggcgcactcggagacgttcatccggctgcccgacgatgacctgctgctggacgcggacgccgacttcggcttctccgacatcgacttcccctcgctctccgacgactcgcccgcggcgtccgacccgacgccgcagccccagccccaggcgccgccgccacagcagccgatgccgcagcagcaggcggcttcctcggcgccgccgaggccgccgagcggggcgcacatgcggagcctctccctcgacgccgccttcttcgacggcctctcgctgcagggaggaggaggaggtggggggcgtggtggggcacaagaggagcgggtccatggacgggtccacctcgtcgttcgagggcgagtccgcgccgacgtcgtccgtgctgccggactacgccaaga

SEQ ID NO: 4623 - DNA, 487 bp, Sorghum bicolor
  Clone ID: SORBI-28MAY03-CLUS8443_1
gcacgaggcaaaaaggcgctcacagttgcctgaaccaatagaaaaggagaaaggagttagcctttggtcaatgatcaaagacaatgttggaaaggatctaacaagagtctgccttcctgtttactttaatgagcctttatcttctctccagaagtgctttgaagagttggagtactcttatttgttggaccgtgcatatgaatgtggtttaagggggaatggtctgatgagaattctttatgttgctgcatttgcggtatctggatatgcgtccacagattctcgcccatgcaaaccttttaatccattgcttggggaaacttacgaagctgattaccctgaaaaggggatccgtttcttctctgagaaggtcagtcatcatcctatggtcgtggcatgtcactgtgaggggaaaggatggaaattttgggagacagcaatctaaagagcaaattctggggacaatccattcaactggatcctaatg

SEQ ID NO: 4624 - DNA, 1146 bp, Sorghum bicolor
  Clone ID: SORBI-28MAY03-CLUS84443_1
gctccgcgctctgcctcagccttcgattcgagcggtcagtactcagcaccctctcccgccgccgccgccgcggcgccaacatgaaggccatagggaacggcggggagtggtggtggaacctcccgtctctccgccgcaagtccgactcccgccgccgcggccgccgcaacacggacccccgcggccgccgccgcggtcccccacgggagccgctctcgtcgtcctcctcctcctcggagtccatcgagcagggccgcggctggcccatcgaattccccttcaggcaggctgtcacggcggcctctctcaccttcaccggcgacaccatcgcgcaagtccgcagccgcatcgtcgaccgccgaagatgctgtgccgattccgacactaaggaactcataccagacatattgctgaaccatgattggattcgtgcacttcgtatggcttcctatggatttcttctttatggtccaggttcatacgcatggtatcagctccttgatcggtgcatgcccaagcagacgtttgtaaatttgtctgctaaggtcatcttgaaccagatcgtgcttggtccttgtgttattgctgtaatttttgcttggaacaacttgtggttggggaaactttcagaactcccagccaaatatcaaaatgatgcccttcctacgcttctatatgggtttaagttttggattcctgtatcaattgtcaacttttgggtgattcctttgcctgctcgtgtcgccttcatgtcctcttgttccattttttggaacttttatctgtcgaccacgatgagcaaatgaaacctccagttgtcagagctgcctacctatctggaactttccgctgaacaatctgacatggaccctgatactcatactctgataggggtgcaaaatttatgaaattttgctcaggttggatggattcgctaaacagaggagcatctgaatgagttagttcatcaggcacaacagtgttgtaaggtctgtccttggacagtcctagtggtgtagtgacattaaactgtgaggccttactcagatgttgttgaccataaggtcaatggagggtgtgcggttttgtctaatcgtgaatggagcatttggctccaatttgacttcgaaaatggagttgagttgt

SEQ ID NO: 4625 - DNA, 1180 bp, Sorghum bicolor
  Clone ID: SORBI-28MAY03-CLUS84452_1
agaaacgctcggtagtttggactttggagcagcatatccatggcgggagaggaggccgggaggaggggggttccctctctcctcaacccgccgtccgcttccagcgaagggcagcaggaacacatcgcctctgatgtcactcagctcatcgggtggacacctctgatcgagctcaagcgaattgccgacaaggaaggggtagatgcccggatcgtcggcaaggtcgaggcgtaccagcctctctgctccgtcaaggatcgcagcgctttgagaatgattgaagatgcagaggagagggggttgatttcacccggtgtgacgacacttgtcgagctgacaagcggcaacttagggttaggattagtactcattgctcttcgcaaaggttacaggttcgttgcagttatgccaggtcaatactcgctcgataagcagatcctgttgaggtacatgggtgcagagttgtatttaacagatccagcccttggtttcccgggcatagatgcgaaggttgaggagctcaaaaaagaattgcccaatgtacatgttcttgatcaattcaagaacaaagcaaatcctgaagcacatattagatggactggacctgagatttggaaggacactgctggcaaggtggacatatttgtagctggttcaggctcaggaggtacggtgtctggtgttgggaagtatctgaagacgcaaaaccccagtatcaagatcatctgtgttgagcctgcagagagtccagttgtttcaggtggcgaaccaggcaaacacaaaatccagggaataggaccaggatttctacctgaagtactggacaccacagttattgatgaagctgtcacagtgaccactgatgaagcgatggtgcacgctaggaggttggccagggaagagggtcttcttgtgggcatatcttctggagcaaacttggcagcttgcttgaaggtcgcatcaagagaagaaaataaggggaagatgattgtcaccatgtttccaagtgggggcgagagatacatgaattctgacctttttgctgctgctagagaggagtgtattgccatgacattttgatcccacatccagaagagggctatggactattttccatgtaacggtcggcatgtgttgcatgtagttgatatttggtcagaccacaatgaattgcatgatt

SEQ ID NO: 4626 - DNA, 671 bp, Sorghum bicolor
  Clone ID: SORBI-28MAY03-CLUS83996_1
ccactacgtggtgtactgggagctgatggtgcgggacggcggcgcgtcgcccgagccggacgtgttcgagcgctgctgcctggagatggaggaggcgctgaacgcggtgtacaggcagggccggaacggggacgccatcgggccactggagatccgggtggtgcgaggcggcacgttcgaggaggtgatggactacgccatctcgcggggggcgtccatcaaccagtacaaggcgcccaggtgcgtgtcgttcgggcccatcatcgagctgctcaactccagggtggtgtccaggcacttcagcccggcgtgccccacgtacagcccgcacaagaagtgatccacaggccggtcggattcggtgacggcccaggatgagctacagttctgctagtaggtagtactactagtgctttgcttgttgctcttacagtgcgtgtgtttcggttcctctcgtgtacgaggcagaggagtgaattagtcacggctcctagctgctttgcttgcttcctgccagctgctgcctggctctgtggtaactccaatgctagtatcgtaccgtagttatattacatacttgtgggtgatgtcgtcatttctggagtggagatgacgagtgttaatttgtacttgtataagacggtatcatggtaacgtcattctggcccaat

SEQ ID NO: 4627 - DNA, 263 bp, Sorghum bicolor
  unsure (1)..(263): unsure at all n locations
  Clone ID: SORBI-28MAY03-CLUS840_1
agctgctggaccgcaaancnccngncnncctgaagggatcagnaggcatacctgcacatgtgactgcatgtagctgttttgaggaaaataactgcatgtagcttgcttagttgctttattaatccaagcaagagattcgagaacggtgctaattgtcctctatagcattgtaaaatacagagtatttacctgtatagagacatccctgtttggaaactgctatcatcaggcatgatgtttacggccccttaaaatagaatttt

SEQ ID NO: 4628 - DNA, 663 bp, Sorghum bicolor
  Clone ID: SORBI-28MAY03-CLUS84033_1
caagtaaatggtgaactggatacacagaatttcatgaagttcccggatttaaaccctgctccagcaagagcaagttctggggcttcaaggaagatgatgcttacttctaaagatcttagctttgtggggtatacatacaagaattttgatgctgtgaaaggtttgcatcagtctgcagatcttcagagaagctcctcgtttacaaggcactctactggctccccatctgatacggcagacatggactcatcgatggaacctaacgggacagacacccacatgcgcactggttcatgtggcgatcctatggcgccatgatctgccctgttgctttcctgaagtaccctgccctacaccggcatcatgcatgcacctcgacgacatggctacatctgaagagacctggttgcggacttgcatttattcaggtctcgtgcccttctaatcgttggcgagcaccttggtagttgtacaaaccagaggtattgtgcagtatgtttcaggtgagacaagatgggcaggtctggccctgggtatttacttcttgacgctggttgcccaggttggcatagtattaggtcgtcgccttccttgtggcagctctttgcccgtttatttaataataacatatataaaatatatatgatcatgaggaaaggagag

SEQ ID NO: 4629 - DNA, 666 bp, Sorghum bicolor
  unsure (1)..(666): unsure at all n locations
  Clone ID: SORBI-28MAY03-CLUS84046_1
gagcaacaaacacttctccgttcctttcttcctccgcactccaccttcgtcggcgtcaccatggacgccgacctcgtgcagcgctgccccgaggccggcggccgcgatttcctcctccatcatacctcctcccctccctctccgtcctccggctccgccgctgcatcctcctccatcctccaatccctccccctccacgtgtccttcgaccgcgggtactacctcctcgtgaaggcgatccaggagctgcgtgcgcgcaaggacggtcacgtcgttaccgtcggcatcggcggacccaccggctccggcaagaccagcttggctgagaaggtggcgtcggttctagggtgcgtcgtgatcgtctccatggaggactaccgcacagtagctggtggcgacgacggcagcagcgacgtcgacgccatcgatttcgactcacttgctcgcaacctccaggatcttgtgaagggtaaagatacaatggtgccactagttgattttcaagagaagaaacacactggatggagacaactgaggatttcttcatctggagtggtgattgtcgatggtgcttatgctctgcattcaacactacgatcattgcttgacatccgggttgctgntggttggtggtgttcattttagcctgctttctaaagttcagca

SEQ ID NO: 4630 - DNA, 660 bp, Sorghum bicolor
  Clone ID: SORBI-28MAY03-CLUS84058_1
ctactgggtaatctattgaattccctacttttgtgctggtcagatgtattttgcacgttgctcttgctggttggcgattgcttcaacgtttctgcttcagtctgtatgtgcgtttgcatgtccgccgtgccacgtttttgcttgttccagtttatttatgataagcacacaggtgtttgcctgcagcgtgaattttcgtactaaaaggttcacgagtattcttaccgagtggtttctgaactgctgaattcggagtccttggtgtctgtttcgacaacaagcatgcagcagcattctatagacgagacttcaatttgttacaatcatcgctcttggatttagcttgggcccagtggggtcccttcatatttctgacgctgcgctcagtcgctcactagacactcccatacaacacggccccaggtagcttggtttcaagctatgctataattttcgcacgagacatttgaatttcacttttaataaagcgcactaacggtaccctgtgctcatttgagtagtatgaagaattgcttatgtaattgtttataccgttggcctaccattttagatacgctttcaattatgaaggtgaggactgaagagtaaatgggcgatctctaattagttcttgagttcttaggtccctgaacttcgaaa

SEQ ID NO: 4631 - DNA, 642 bp, Sorghum bicolor
  Clone ID: SORBI-28MAY03-CLUS84054_1
tactggactggaccgtccccgcccgtcccctcccccccgccgccgccgccgccgccgccgccatggcgtccctcgcgcgggctctccgccagtccaactcgcgcctatcgtcgcgctgccccgccgtggcagcgtcctgccgctggatctccccgaccgccgccgcgggatcgccggaggccggcgcggcggtggcgccggccgacccggagctgcctccgccgcgggagcccgttggcggcgcccgcgtggagcttcctcccaacccggaggacgcgctcgaggtgttcgtggacggccacgcggtgcggatccccaaggggttcaccgtgctccaggcctgcgaggtcgccggcgtcgacatcccgcgcttctgctaccatagccgactctccatcgctgggaactgccgcatgtgcctcgtcgaggtcgagaagtcgcccaagcccgtcgcttcctgtgccatgcccgcgcttccagggatgaagattaagacaaacaccccagtggcgaagaaggcaagggagggtgtcatggagttcttgctaatgaatcatccactggactgcccaatctgtgatcagggtggggagtgtgacctccaggatcagtctatggcatttggtgctgaccgtggtcggt

SEQ ID NO: 4632 - DNA, 1016 bp, Sorghum bicolor
  Clone ID: SORBI-28MAY03-CLUS84612_1
atgcttttgtttctctctcatcttttccttgcttttttttttcacctttttatttgcctttaccctcttctctttaatctcactttgtatccatttgcttggttctttgttgcaccccactgcacttgcaccttaagaatccaaagacccaccactaccctctgctatgttgctattcatctcttcattgttctccaattactacatgttcttcttgcttcgtaggagtagttgttattagttagcttaacattcatcattcagggttgcagtagcagcagctgtcgttgtgctgtatctctcccccccccgggggcacggccagcgaagcccctggggctggtgctccccgcgggggacgcgctgccggcccccaacccgggccccccgccgccggccccggccgcccccggcccccacccgccggccccgccgcctgccggcgccccgcccgcgcctggcgcgcccgcggccccgcggccagccgcggcgggcaccgagcggcgggcgcggccgcagaaggagaaggcgctcaactgcccgcggtgcaactccaccaacaccaagttctgctactacaacaactacagcctccagcagccgcgctacttctgcaagacgtgccgccgctactggaccgagggcggctccctccgcaacgtccccgtgggcggcggctcccgcaagaacaagcgctcctcgtcgtcggcgtccgcgtccgcctccacctccgcctcggtcacgagctcgtccatggccagcgcggagggggcggcggcgtccaagaacccgaagctggcgcacgagggcgcgcacgacctcaacctagcgttcccgcaccacggtggcctgcacgcccccgagttcgcggcgttcccgagcctggagagcagcaacgtgtgcaacccgggcggcgggatgacgagcaacggccggggcggcggcgcggggccccgcggtcggcgcgctctcggcaatggagctcttgcggagctccggctgctacatgccgctgc

SEQ ID NO: 4633 - DNA, 667 bp, Sorghum bicolor
  Clone ID: SORBI-28MAY03-CLUS84614_1
ctgccggcctctgcctccgctccccctccccctcccccgggcctccgccccgcctccggcccccgcagctccagccccccctcacctggcccggcgccgcgccccgcgccctccctgctccgtcgcccgcaccgcgcgcgcccgcgccccctcgcacctgccccccccgtgctcgccgcgcccgcgctgctccggcctccgcctcgcccgccgcgtccccgcctccacccccccccccgcctgctccccggcctcgccctcccacggcctcggcctcggcggccgcgccccctccgcctcctccgccctcaccggccgccgcgcgtgcccggcgcagctcctcggcctaaggttcggctgcgcggcggcgccgcggcgccgcccgggggcctcccggcgggcggcgcccggccgccgccggtccgccgccggcgcctccccgcccgcggcgcgcccgcggggcggctgcgccggggccgcgccggggccggccgccggcgcggccgccgccgcgcgctccgcctcgccggctcccccgccgggtcgtcccccccggcccgccccccgctcccgcgcgcgcgcgcgcccgccggcgccaccggcgcccccctcggccccccgctccacctcgccggccagcccctcgcccaccccctctccgccgtcg

SEQ ID NO: 4634 - DNA, 671 bp, Sorghum bicolor
  Clone ID: SORBI-28MAY03-CLUS84649_1
gatgggttcacaaatgaagagaacaattttcgacgagcagacagcaaaggccctgaagaaatggcacaaggccgtggtgaagaagaagcaccacaacaagggttcatctcacgactcctccgagacccctagcacggacacagcaacaccggcgagggaggcgggcgagtggcagcggctgcacgacgtgccggtccggcacctccaccggtacaagaccatcgcgcacgtcggcggcgcgaggagcccgctgtcggactcggactacagcgacacggacgacaccgagccgctgtcgtcgtcgcagacgaggcacctgataccgccggcgaagcagcggagcctcgacaccgagcgcgcggaggtgcgcgtggacgtcgtagagacggtggcggcggtggcgccacgcgacgtcctgcaagacagcttctcgtttccaaggctgcttccccctcgccatgtgccggacaagtgaagtgaacaccggcctgcttagaactaagactgtcttatatatagggataattcaatagtagtttcaaagtataagtgcttttggtttttctgtgctacgtctatgtagcaaaggttatgaatttagaaaagccaaaaggatttattagtttgaaatggagtaataataatagtatagtagactagtagtcgaagct

SEQ ID NO: 4635 - DNA, 546 bp, Sorghum bicolor
  Clone ID: SORBI-28MAY03-CLUS84672_1
tgcgcctgcctgcaggtgatggcggtgctggcgaggccggccaaggagaccaaggcgaggaggtactggaactggtaccaccacagcgtgggcagggcggccgtcgtgctcggcgtcgccaacgtcttctacggcctctcgttggccaacgaacggcaggagtggagctacgtgtatggcgttttcatcggggtcttcgcggtggtttgtcttgtgctcgaggaatggagacgtaggcattgatccgtcccgcgcggtacatggagagaggatggacttcacgctgcagctacaccttttcctttccgttgcacttgcaccgttgcacgcatggacgcatatggttgccatacggtctgtgattagcattcacttgtattatttcttctcgtggcattatttgttctgtacgtacgtgtagtgagctgcctctgtatgtgacagttgtatgattgatgtatatggcattcgtttcattggcatatatacagcctttttttgtgaaacgcttgtgtatatataaaccgtggtatatagtaaaacatt

SEQ ID NO: 4636 - DNA, 740 bp, Sorghum bicolor
  Clone ID: SORBI-28MAY03-CLUS84701_1
tcaccttcccggctaacatccggcgtagggtgaggccgcccctcccggaccgctacttcggcaacgcgttggtcaggctgggtgtcactggtgcagtgcgggatgttgcctccgaggatttggcatccgtcgccgggcgcatcaaaggcgccatcgatcggatggacgatgagctcgtgcgctctgcagtcgactactgggagatgaccgagctggacagccggcctgcgaagggcaccttgctagagacggacctgcagattatcagctggctcggtatgccaatgtacgatgcagatttcggatgggggaagccaggggtgatgtcgcgggcggagtccatccgtggcggatttgtgtacctgatgagcgacgggccagcagacgacgccggggccggaggcgtccgcgtgctcatgtgcatggaagctgcaaatatcaacgagctggagcggctgctttacgaaaaactttagcacctagacctgcttggtgcttagtgtgaaaccaatggccggagatggtaggactggctgtaagcctctacctgcacggtgctcgcaggaaatcagtgaccagtggtctactctttaagatttaaatttttttgtttgtctcagctgatctatatgatggagaagatcgatcaaatacggttggtgaagttttttttttttttttgaaagatccggcaatgccgacattgattaataagaagagcaagagaatatcaacgtttt

SEQ ID NO: 4637 - DNA, 666 bp, Sorghum bicolor
  Clone ID: SORBI-28MAY03-CLUS84232_1
aatcctaatcctcactgcttcatcaatctccactaaataaaccattttttttacgctccaattccttttcacagtttcattcactttcacctctcctccagcccgcttctgcatactccagtagctgggtggtggttcggttaggtacggtgccctcacccacatccctcgtcaacgtcgccagcaccagcaccagcaaaaccagcaagatgatgagcttcaggagcaccacccacgatgggttcgtcggccacgccgccgtcaatggagccggagcgccggtgccgtggtgggcgggggccccgatgctgtgcggcgagccgttgggtctggggaggccggtggtggcggccttctcgccggaggaccactgccgggacggccgcttccaggtcctccagggaccgccgctggatcctctcgtgccgtcgctcaaggctcctgtcgcacaccagcagcagactgagaaggggctctctgctgagctcctcaacctctccgtggctcatcaaggtaaagggaagaaaggttctgagcactctgccactgttgctttgcaatcaccattcgcaatatacaatggtcgttttgagctgggccttggtcaatcaatgatttccgctgataactcttatgctgaccaacactatggcctgatttctcctt

SEQ ID NO: 4638 - DNA, 615 bp, Sorghum bicolor
  Clone ID: SORBI-28MAY03-CLUS84237_1
tctgggcaccagttcctgctgtcgagcgcggtgcggacgctggaccccgaggaggccgactggttctacacgcccgtgtacacgacctgcgacctgacgccgcagggcttcccgctgccgttccgcgcgccgcggatcatgcggggcgcgatccggtacgtggcgacgacgtggccgttctggaaccggacggacggcgcggaccacttcttcctcaccccgcacgacttcggcgcgtgcttccactaccaggaggagcgcgccatggagcgcggcatcctgccgctgctccgtcgcgccacgctggtgcagacgttcgggcagcggaaccacgtgtgcctccaggacgggtccatcacggtgccaccctacgccgacccgcacaagatgcaggcgcacctcatcagccccggcacgccgcgctccatcttcgtctacttccgcggcctcttctacgacatgggcaacgaccccgaaggcgggtactacgccaggggcgcgcgcgcgtcggtgtgggagaacttcaaggacaacccgctgttcgacatctcgacggagcacccctacacgtactacgaggacatgcagcgggccatcttctgcctgtgcccgctg

SEQ ID NO: 4639 - DNA, 519 bp, Sorghum bicolor
  Clone ID: SORBI-28MAY03-CLUS8425_1
acttgactcgagtgagcgcgctgttctcccgtgaccttgtctctgccaaggaccaacaccagcgaaaaggaagctatgggcgctgccgcggcggaggtcgtggcgccaccgaggccgacgtcggccaaaaggaggtcgaccacgctcaagttcctgttcgagctcgagaagccggacggcgtggtccccggcacggccaagctgccaccgccgtcgccggagcccgaggcggacagcctcatcgacaagatcgcctcgtgcaaccgcgtgttcacgttcgccgacgacgcggccgacgagtgcgaggaggagcgcgacgcgaagcgggagcggctcgtcgaggtgctgggcgccgtccggtcgagcgggagcgcgggcaacaagcagcagcagcagcagcagccgctggaccaccgcgtgatggtggcgctgctgaagatggtcggcgccaacctgttcagggcaatgccgccgtcggcgtacccggcgctgctgccccccgacggcgtcgacgaggag

SEQ ID NO: 4640 - DNA, 739 bp, Sorghum bicolor
  Clone ID: SORBI-28MAY03-CLUS84283_1
ccagttattggcctgcagtacatgtacagcttgacctgtgagcaagcaaagcaaaccgtgccaatgctgggcgctgctcctacggcctcgaccatgcctctgctctggaccatcatccgttgaaagcaaggcaggcacagatgtccatctcgccatcaccatggcgtgactagtgagagaatcacaacaagcatcatgccgcagcaggagcaggagcaggagcaggagcagcaccagcaccagcaccagcaccagctgccaggactagagagtgtcatcgtcatgaagccatcagagcctcctgaggatgagcagccacaggagcaggaggccaagcccaggaggatctaccaggcgtggaaaggaaacaatatattcctgtgtggcgggcggctgatgttcggacccgatgcaccgtccctcctgctcacgacgttcctcatcgtcgccccaaccatcatcttctgctaccagaagaaatccagattctacggctctggtgagcagcagcaactgcatcaagcagcagcactggtagtcaccatcacaacaatcatggaccttgtcttcctatccatgacatccgccagagacccaggaatcgtgccaaggaactcgagagtgcctcctgaagctgacgagttcctcggctccaacacgccatctgtggactggagtggcgggagaaccccacggatgaggttccgtcggaccaaagacgtcatcattaatggcttca

SEQ ID NO: 4641 - DNA, 742 bp, Sorghum bicolor
  Clone ID: SORBI-28MAY03-CLUS8432_1
cggacgcgtgggcaaaggcagaaaatatgatagcccataaggatgagatatactcacggccaaagagaacctggtttgctactgaacgggaaaagaagcttttggcagcagctgctaaagaatctttggatcaaggtaagagtacctctggagttattagtgctaagcaggctgaagacctccgtctgaaggagaaaaagagacgagagcatgagaaaaatctaccaaggaagaaacgccgaagattagaggcccagcgagagatgttggaagatgaggatgaagatgacgaggaagcaaaggaaaatgatagagggaagaaaccaaagaaaggccaatctctagtggatgctgcttaccgaaaggcaaaatcattgaaggcagccagcaaacggggtcctggtgcaggcaaaggaaagaatgagaagaatgcaagacaacattctgagaagactccgagcaggcatgaagagatgcgtgagctgttcgagaatgatatgagtgaatggaaacagggacgctcctcaaagaaaaacaacaatttcgcgcacaaaaaatcaaagaacgcttttaagagcaaagcaaggtacaagcgcaggaagtagaagactgggccatctccgggcttgtattacattcccttgtctcaattttgactgactgatcctgatgtttccactcacattgcgtttgctttttgtaaacttctcatatcatgtaaactcaccgttttctgataagt

SEQ ID NO: 4642 - DNA, 1054 bp, Sorghum bicolor
  Clone ID: SORBI-28MAY03-CLUS84971_1
gtgccgaccgaacaccaccgtccaccggtcttccccgccgggcacacgcctaacgcctccatttctagatccggggggcggccatcctctcttgtctccgtggcaactggcaaccgtgcctctcctccttcctggcagcgtttccccgcggggacggcgcgtggagctgatcccgtcatttgtcgtgttatgttttttgtccagcggcacacttgttcaactaaagagtgaagaacagaatttgtagcgccatggctgtggaaagagatgtatttggaatttcagggccaacatatctgaaaccaatcgattggaactgtgagcataatcggagatctgtggctgcaagcttagttcaggctgtatatgtgttggagagagaccgacaactgagtcgtctatctgttgaagccttggcacctgcttggtgggaattcttccattttgagctgattcgcaagctgattgatgatgctgatatgtccatatttggtgcaatatttgaattcaatcctccttcaagtgaagaagcttctgttgcaaatgctccaagatttgtcatcgctttcagagtacattgggtacttccagcaccggaagaacatggaagatcttggtgctggatttattgagaagcttgcgacccagaattcaattggagacctgttcttcaaggcattaggatgggaatcagaaccactgcaccttcttccatctgctgatttaatcgtcaacgtgagcccttcatctgatttcaaatacgctcatggcatcagccagtggtggcaacctgagctgaatttgcagagcagtaaatatcggtactcatagttatatcttaaaaacttagttatcctttctatatccctttagtttattcatgtggttcattctatttgggtagtattggtttcccagatgtggtagactatttcagacatattgactgcattttcctgacctgcaaaatctgttgattatgtggagtaaagttctgacatccatcatgtatctgccctgtacaatatatttatacattgattaattaatgatg

SEQ ID NO: 4643 - DNA, 858 bp, Sorghum bicolor
  Clone ID: SORBI-28MAY03-CLUS84975_1
agatgctttccttagcttcgaaggctcgaactctgacctaggacagagcttatatatacaggactagctaggagtctctcctcaacctctcctggttctacagcttgctagcgcctccacctcgtcggcccggagccagggtccggcgccggcgccggcgggagagggctctgcatcctcagcccatgacgtgccctccacgcgtctcgcgtggatcgggatcggatcgacttccacttcatcttctgctgcgtcgccggccggccgccttcgtcgtcgatcgatgggctacttcctcgactctgatccgatgctccgtcgtgaccgcgcgattgaaccagcagcaccggtgagtcgacgacggacgacctcgtgctgctccgatcggatccctacctgtcggccactccgctccggcacgcgccgccggcgacctgccgcctatatatgtgttaggcattccaatggttttagttgtggctatgatggtgatgactattgaagggttctacaacagtacatcccagtggtgcttgttggtgacaaacaaagataggaggggctagcagggtgggtgggggatgaccatgtcagcatgttaagcctgattgcactcactcataatggtggttgacaaataatttggatatgaagaaaatggtgtgcttagtgtcccttgtagcaaggccaatttatttgaccagatggtcaatgttatgatatgcaaaactacgagcttgtcgattgagctagtgtgtatatatagtaggtagagattgtgttattattcattgttggttactttatttatgtcacatagatattttatttaaaatagagttgtcgtagctttatcct

SEQ ID NO: 4644 - DNA, 681 bp, Sorghum bicolor
  unsure (1)..(681): unsure at all n locations
  Clone ID: SORBI-28MAY03-CLUS85006_1
gcagaatcaagcaggcccatgcccatcccggcgcaccggagggtgcagagcatgagcatcagcagcaggtccgtgcggcagccgtttgcgcgacaagcgagcaagaattcagtcaccttcaagctgcggtccaggagcaccagagcagcagcaccggcagtcgtgccaccggaggaggaggagaagaagaagccggcgaggctgaggtccaggagaggcgaggatgcttcttcggccgccaccgggagaggcatccatctcaggatcaggaccctccggaggcgcggcgtcggtgggtccggtggcgcgggcaccggcggcggcttcgtcgtgccggcggtggcgctcaggcatcagaagacgctggagaagaagaggagccagaggctgtacaacagccacatcgaggagacggcgggcaagctcgtcaagacgaggaagagccagggtcaaggctctggttggggcatttgagtcncgtcatctccaagtattgcaanagtaggtgtaggaggagtagtaggccgtatgtattgctccatgttattgaaccagtttgtctccgcaatttttggttgctctcggaatgagtgcttgcccctgatgtagctcttgatggaaaatgtttgtatcggtattttgtagtttaatcgacacacatcttggtaattccaaggcgtc

SEQ ID NO: 4645 - DNA, 685 bp, Sorghum bicolor
  Clone ID: SORBI-28MAY03-CLUS85030_1
atatgcaggcgagatcagtcctgccaggaaccagccgccaagaagataccgctaggtaccaagctacctacctaccttgctctggtttcattctcgagttgttgggtagtactccggcgagctctgctaggcagtcaagctcgcgcatggcgcgcggctagtgaagtgaatcggcgcagctccggtgcctgctgccgatttactctacttgtaattcttgacggaatcaagcaaagatctcgactccactgcctggtccggaccagagatggaggtacagatggccgcacaaggccccaaaccaacgggacgcggcagcacgccgtcgccctctgactctcaccacggcggcggcgccaccgccaagcccgtccccggctacctcaggccgtcggccggctcgtgccaccacgtgtgcaagtacggcggcacgcacacgttcgaggatcacaaggaggcgcacagcaggccgcagcagccgaggccgcctcggaagcaaccgccgccgccggctccagctccggctccggcggagagccacaaccacagcagggtgctcgtcaaggtgcgctccgtgttccgcaggcgtgtcggggactccaccaccactgctactactcagaagccttccaaggcggcggccgccggcaaggccaaggccggcaaggagggcgtgagcgtggag

SEQ ID NO: 4646 - DNA, 693 bp, Sorghum bicolor
  Clone ID: SORBI-28MAY03-CLUS85041_1
cgcggagccatttccaccctccaaaccgaaaacagatcgcaatcctaggggctagggttaccctccacccccatccccatcgtccgatccgatccgatccctcaccgcccccatccatgtcccaccacgacggaagcaagccgtaccagccgcgccgggggcccgagcggcacccgcagccggcggacgggatggccgccccgcctcccgccgccgttggcccgtcggtggagcacctcgtggcggccgccgccgaggcggaggcgttgaaccgcttcgccgtggaaccacaggtgcacgagcaggaggttggggaggaagaagaggaggacgaggaggaagacgagatggaggaggaggaggacgagcaggaaggccagcacggtggcatcggtggggagcacgttcccatggacgcggatgctgctgccgcggcggctgcggccgccggcgcgcagatggacccgcactcggcgatggtgcctgggaccgtgccacccatggcgaccaaccagctcaccctgtcgttccagggcgaggtctatgtgttcgactccgtctcccctgataaggtccaagccgtgcttttgctgcttggagggagggagctgagcagcctgggcggagcgtcatcctctgcaccttatagtaagaggttgaattttccacatcgggtggcgtcactaatgagat

SEQ ID NO: 4647 - DNA, 725 bp, Sorghum bicolor
  Clone ID: SORBI-28MAY03-CLUS8447_1
gcacgagggtcatcaccatggtcgcctctctggactaacatccacgatcacctcatcaccccggtagtcaaccttcccttgccagctaaagtatcagatttgtgggtgcagggaaccaaaacatgggatcatcagctcctatcaactactttctcccaccaagcggtacagatcattgaagagaccacggtagtgctctctgatcatgaggatattctgaggtggacccctaccactgatggccgatgcaccaccagatctgcttacagatacctagctactcaagagcctcacattcttcccacccaaggaccaaggagtataaattctgaagccaacaatatcctgcataaggtatggaaaagtaaaacaatccctcccctccttaaaaccttcgcttggaggttgattagaagggctctagccacgggagagagagcagggaggtactccccgcatatagatcaacattgttcctacccacgcgtccgtgaaaatgacattcaccttttcttccactgcgatttactaaacaagtatggtccactgccactcctccaatgcctactaacattattgttgcagatgaagatggagttcaacaagctctacctctccttattactaacaacccatcagacactactttgcgtaaaacgctttttactctttggtacatttggaaagcctgcaatgataaccgctttcaaagaaaaacatggact

SEQ ID NO: 4648 - DNA, 399 bp, Sorghum bicolor
  Clone ID: SORBI-28MAY03-CLUS84478_1
cgccgccgccggcccgaccacgaccacgaccacgagcgcgatcaccgcacgtcgtccccctcctgccgcgctgccggcgccgccggtccgcccgctgctggagtacacgccgccgccaccggcgtcccggaggccctcgtcccagatgcagagactggaatgagctaggctgcatgcgtgtggtgtgcacgcgatcgagacagagctttcatctctggtgttctgtgatgatcgatgcgatgcgacgagtgatgtgtgctagtgggcagtggcaatgccattgcatttgtatgtcgacacgaccacacgtccttgtaccaaacttatgaactgattttggcgggggtgtttaaataaggagattacgtggtccttatagtagtggaattgcgaatgccc

SEQ ID NO: 4649 - DNA, 666 bp, Sorghum bicolor
  Clone ID: SORBI-28MAY03-CLUS84492_1
ggggtagatgataatggaactggtgaaccagcagcagaccttaatggcagcaaatccaaacagctaccaagagttgctatgtactgcactggtggtatccgatgtgagaaggcatcaagctttctcctcggcaagggctttaaagaggtttatcatttggaaggtgggatattgaagtatctggaggaaataccaaaggctgaaagtttgtgggagggtgaatgctttgtgtttgacaagcgtgtctcggtagagtatggattggcccaaggcacccacaaactttgctatgggtgtaagcagccagtaagcaatgaagacatggaatcacctcaatgggagtatggtgtctcttgtccttattgcttcgcaacgaaatccgaggaggagaaggaaagggctagggctcggcagcatcaattcaagacctggggagtgattggtggtcctgataagggcaggagtacaaaaaggcctgatgctaacaatgcaatggagtccatacagttgcccaagtcagtctaacataaattgcgtgtctgaaactcagatgattgaagtgttgttgacaaaagtgagggaacccgccagatgggcagtgcttttgtattggtttgctgcctagagacaagctgcatggccatattggaaacagttggtaccatt

SEQ ID NO: 4650 - DNA, 570 bp, Sorghum bicolor
  Clone ID: SORBI-28MAY03-CLUS8450_1
gcacgagggctccgccgccgttgccgccgccatcgatctctacaccaggtcctccctcctcctccgccccacaggagagggtggcggcgctgacttcggcgcggtggagctgtacctcagggactcgcgcctcaccttctcgtggccatgctcgcgcctccgcggggcgctaggggaggagatcggcgccaaccccggggctccggcgccgtgctcccctgaccagttggccgccattgcctggctcttggaggaccaagagatccctgaggccaagatctggctctccgccggcctctctgctttccttttcctctacacctccatcttgggatgcaggcctggcaaggcagaggtgacctcggacctgcccatgggtgcagggctcggctcgtcggctgcattctgtgtgtccatgtcagggcgctatggacagctgctggcgctgtcagtgttggagcaagcaggggtgctgagggatgggaggtgttggagaaggctgatcttgagctggtcaaccagtgggcgttccaaggggaaaagatcattcatggcaagccttctggcatc

SEQ ID NO: 4651 - DNA, 801 bp, Sorghum bicolor
  Clone ID: SORBI-28MAY03-CLUS8459_1
tctccttccgcttccctcggcagggcagggcagggcagggtagccatgcttggtcttcgggcccgcgcagcggcgcagctcccgcgcccgtccccatcttcctcctccgctcccgcggcgtcgctctcgctcgcgaggctcgtgtgcgcctccccgctcgccgccctcgcgcctctggcgtccgcaccgccgtcggcgagggcgacgcagccggccttcctctccgccaggtggaccgccgcgcctatgcgtcccgggggaaccggtggccactccaggccgaccacacgcgttctctgcactgccactggcagcgtccaaagagaggggaaagaattgctagttcagcacttgcttgttggtgaaaaggatgtcaggcttctggttgatcttgaaaagagtatcattgcaggaggggcagacttgagcgatttagctgtggagcactccttatgtccatccaaagaaaatggtggcatgctcggatgggttcgaaagggacagatggtaccagaatttgaggaggcagcatttagtgctcctttgaacaaagttgtacgatgtaagacaaaatttggatggcatctattgcaagttcttgctgagagggatcaatgcgtactgcaagacattgacccagaagagcttcacacaaaaatgcaagaccctagttttcttgaagaagctcaattgattgatgttcgggagcctgatgaagtggagaaagcttcacttccaggcttcaaagttctaccactccgccagtttgggacctggggacctttatgacagacgagttta

SEQ ID NO: 4652 - DNA, 713 bp, Sorghum bicolor
  Clone ID: SORBI-28MAY03-CLUS84578_1
gcaacacgcggcggcaccgccaagcaatcgtctcatctgctccacctccaccccatttaacgcactctccccagcctccactctccgctccctccttcgcggcggcacggcagaggccattaacgccgctgcggcgagcgccgagaggaaatgggcggcgacggggacggcacgagggcgctggaccagacgccgacgtgggccgtggccgccgtctgcgctgtcatcgtcgcggcatccatcctcctcgagggcctcctccaccacctcggccagttgctcaacaagaagcggaagatagcgctgttcgacgctctggagaaggttaaatccgagctgatgactctggggttcatatcgctgctgctgaccgtgacggggaggtacatagcgcacatctgcatcccggagggagccgccaacaccatgctgccctgccgccgtcagtccggccactcggaggcggaggagcccgaggaccatggccgacggcacctgtctgaagatcccaccaaccttttttcctgccccaaaggcatggtgtcgcttgtttcagccgacggcatgcatcagctgcacattttcgtcttcttcttggccgtcttccatgttaccttcagtttcttcacaatgtccctgggtagagcaaagactcgtatatggaaggtgtgggaaaaggaaacttgctcccctgagtataattatttaaatga

SEQ ID NO: 4653 - DNA, 661 bp, Sorghum bicolor
  Clone ID: SORBI-28MAY03-CLUS85154_1
tcaggggccccgaaacgtccaagcttccgaaaagtttcgtcagtaaggtgaaggagaatgaggagagggggctcattgtggcatggtgcccacagctggaggtgctagcgcaccccgcggttggctgcttcgtgacgcactgtggttggaactcaacaatggaaggattaggcattggagtgccaatggtggccatgccacagtggtccgaccagccaatgaatgccaaatacattgaggatgtatggagagttggcgttagagcacgacctgatatggagggagttatcaggaaggatgaggtggagaggtgtgtgagacaagtgatggatggagaaaagagcaaggaatacatggaaaatgcgatgaactggagggaaaaagctaaaagggccatgagtgaaggtggcagttcggacaggaacattatagagttccttggaaaatttgggtggaattgatatatatggtggtctcttatcatcccgaggaaataaaccgcacattggctgtgtgttaacttatatctaccgtaccatgcttaaggcgttagtccattccctcgttattctatttctttttggtctttcctgtccatgcaggttagtaattcagtagtaatatatacaagcgtataattggaataaaggatccttgatgt

SEQ ID NO: 4654 - DNA, 659 bp, Sorghum bicolor
  unsure (1)..(659): unsure at all n locations
  Clone ID: SORBI-28MAY03-CLUS85190_1
gcgcgctgccgctncagaggcagacacagagcggactgcgccatggctggatccaacaacgtgagcgttcgcgtgctcctggtctcgtacccagcccaaggccacatcaacccgctcttccagttgggcaagcggctcgccatccaccacggcgtccggtgcaccctagcggtggcccgctccgcccttggttccagcgtgccgccgggacccggagcggtccccgtcgtcgccatctccgatggctgcgaccttggcggctacgacgaggtcggcgacgtgcatgagtacctggcacggctccagtccgccgggtcgcgcacgctggacgagctcctcggctccgagtcgtcccacggccggcccgtgcgcgtggtggtgtacgacgcgttcctgctgtgggtgccccgcgtggcgcggcagcacggcgcgtcgtgcgcggccttcttcacgcaggcctgctcggtgaacgtggtgtacgaccacgcgtggagaggcgacgtgaagctgccggtggacaaggtcctggcggagctgcctggcctgcccaagggactgcagctggaaccgcgcgattgctcctcgttcctcacgcagcaggacgacagctcctccacctccacctatcttgacctcttgttgcagcagtgccaggggct

SEQ ID NO: 4655 - DNA, 736 bp, Sorghum bicolor
  Clone ID: SORBI-28MAY03-CLUS85160_1
gagttggccagttatgatcaagtcaagcagacaattctgaaactccctgggttcaaagatgatgtggtcatccacctctttgctggtcttggtgctggcttctttgctgtttgtgttggttccccagttgatgtggttaagtcgagaatgatgggtgactcagcctacaaaagcactctcgattgttttgtgaagacacttaagaatgatggccctttggcattttacaaaggcttcctgccaaactttgcaagactgggatcctggaatgtgattatgttcttgacattagagcaggttcaaaagatgtttgtgaggaaaccggcaagctgaagatagaggttttgtgggtcaggtggcgtacaatggcgcacacagtttttcttctatagataaggggaaaaaaattcacaccttcccctgaagaattggggaacaaggacaaatctgacacttcaattgcgagaataaatcacagcgggcggttgcatgatccctgaacgattaaattcacaactagcaaacagatgtgagtaaacaatatgtggtgaatgttggaacttgaactgatgtagttcaatggggcggcctgttaatgatgagcatctgttgcatgtttcgaatcgatttaatgatttgttttttcttacttgtactgaaatgttttgatcggtatgacgatcaatgtgtgtgtagagtaatccaggtgataaatggtctgcagtgcttgattgtt

SEQ ID NO: 4656 - DNA, 558 bp, Sorghum bicolor
  Clone ID: SORBI-28MAY03-CLUS85223_1
ccagtcctctcacatccaaccagtccgcgagaccgcgacgctgtcattagcgagctgctacccctctccactgacatccgttagcagctcgcatctcgtctcctgcaactgtgcaagtgcgcgggcatggcggcttcctctcgcatctcgtctcctgcgtggctgttagccgcgcactggcactgcgctctcctgctcgctctggctggagccgcccgtggccacgccggcgcggcgctgagctccgcgttctacgaccagtcgtgccccggcgcctacaacgtcgtccgtcgcgtcatccagagcgcgcgcgtctccgacccgcgcaccccggccagtctcatccgcctccacttccatgactgcttcgtcaacggttgcgacggctcccttcttctggacgacgatctcccggcgatccggaccgagaagaacgtgccagccaacaacaactcggcgcgcggcttcccggtggtcgacggcatcaagcgcgcgctggaggaagcgtgcccgggcatcgtctcctgcgctgatatccttgccctcgcagcagagatc

SEQ ID NO: 4657 - DNA, 930 bp, Sorghum bicolor
  Clone ID: SORBI-28MAY03-CLUS85287_1
tcacagttataaaagctcaaagctgagttcatctcctcatgggattcctactgggagctcgcctgttggatctgtgcccaaatcttctccacagtctcaccatcttacctttcatcttttagaaaaaaataaactccagcagcaaaggtacaataagttcaaaaatcaatgccttatggagcgtaagaaattaggcactggccagagtgagcaaatgaactcactgtatcgtttttggtcatactatctaagagataactttaatgaagatatgtacaatcattttaagaaattagcactggaggatgctgcagcgagctacagatatggtctcgagtgtctattcagattttatagttatggtttggagaaaaacttccaacccaatgtatatgaagatttcgagaagcttactctcgaattctactgtaatggcgatctttatggactcgaaaaatactgggcatttcaccattaccgaaatccagatagcggccgtgtagataaacttccagagctggagaggctcctgagggaggagttccggaccctagaggacttcaacaaggccaacaaggcaaaggagaaagcccgagagacggcagagaaaggaactggcatcagtagcagcagtgtggcggcggccgcaagtcataccaaggttgagactaagtagatctgagcccggcatgaaaactttttggtggtcgccccagaaaaggaggaagtagtgttttctttttctttgcagagaagtaatgattcgagtagacatgtgcagattttggtatacccccctgccaataccttgtgttgtggctgcccaggaaattttcctcccttttttcattaccttcctggcaccaatgtgggagttgtacatagatattttttcctcttgtaaatggacaaataatagagaacggagtt

SEQ ID NO: 4658 - DNA, 634 bp, Sorghum bicolor
  Clone ID: SORBI-28MAY03-CLUS89901_1
actgaatccgcccgtcggcagcaccagcacggaccactaccatctcaatctcacgcacccctctcgctccccccaaattgcaaccagggtcccgaggtccctccctcctgtcctggggccgccaatcctctccccacccccaccccaatccaacggatccgatcggcagatcggcggcgcgcgaggatgggcatctcgagcatgccggcgcccaaggacagcctgctggggttcgtgctgtacaacgcggcggcgtccgtcgcgatcctgtcgggtctggtgcgcgccgcgctgctcttcctgggcgtggcggcggcgccgtcgtcgtccccgtgggaagcgccggaggaggagcggcggcagcagcagcagggggcggtgagggtcacgcccgtggggcccaccctcgcggaccggttccggagcaggttccgtccgtcgcgcttcgggcggcgccgcggctgcggcggttcgggggactgccgcgtgtgcctggtgcggttcgagccggagtcggtggtcaaccggctcccctgcggccacctcttccaccgcgcatgcctcgagacctggctcgactacgaccacgccacctgcccgctctgccgccaccgcctcctgccccccgccgcag

SEQ ID NO: 4659 - DNA, 617 bp, Sorghum bicolor
  Clone ID: SORBI-28MAY03-CLUS89906_1
tgggctccgccccgcggccgcgcgactcggacgcaaatcctccgccctgttttacgttttctctgacacacgtcgccacctctcctgccccaatggcctgcatctcctgccccacgcggcctctcttctctttcatggcctctgcaacgcctcgctggtggacatcagcgcttgcgcgacgagttccctcattcatgctacctttctgtcgtttttcccgattttctcatgaacctcggaacatagccacaaccaatcgagtaaaagacgatgggtctggtaaaccagacaggcagctacccatctcttctgccaacgttattactagatcccagaacaagcattctgctgtcacccaaggcatgaaaaacatcaccagtggcagaatcttggaggttatagctggagatgagaaaagtgataaagatgattgtagggtcacctcagagtttatatatgataaatgtgacatatcggggcacattgtgaagctcactggttatggtgaggaagacccaaggaatgcaacggataatcaaaggggtgaaaccgttgccagcaacgacaaagaagtcagtgacgatgaagaatatactatggatattatacttccaaaa

SEQ ID NO: 4660 - DNA, 883 bp, Sorghum bicolor
  unsure (1)..(883): unsure at all n locations
  Clone ID: SORBI-28MAY03-CLUS89908_1
gggagcgaccgaagcatgtcgtggcggtgggctctcgcgcgccgcgtcgccgcgctggccgcgaccagcggcggcggcggcggtgcggcccaggcgcagaggctcctgcccacctcgtcggccgctgctagcactggcctcctggggcggcaccacatgcccctcgcctctcagattcggagcaaggtggttggttgcagaggagctgctctcgtgagctccagatggttgcatgatgcccaataccaggttcgccaggatggggcttcaagagctcaggaacagcaagatccatttgcacggggcgccgatgagctatcacttcttgcaaataggttacgatcaatggtggctgctgaggtccccaaactggcatcagcagccgagtactttttcaaggtgggagcagagggaaaaagattccgacctacggtattgttgctcatggcatcagctctgaaattccctttgtcagaatcaacagaaggcggagttctcagtatattggcagataaactccgcacacggcaacagaacattgcagagataactgaaatgattcatgttgcaagccttctgcatgatgatgttcttgatgatgctgatactaggcgtggcgtcagttcattgaatctcatcatggggaacaagctttccgcgcgggctggatactaactgtatcactcccgtgcattgaggctaactacttgaatagtttgaagtccaaatgaaaagttttagcttccagtgaactggtatacattcgtgctctagcaggcaaataaaagcttctacatttggttccaggttaatatgaagttaggatatttagaaatccaaatattttgataagcattaaattagctggcgctctcatcttana

SEQ ID NO: 4661 - DNA, 639 bp, Sorghum bicolor
  Clone ID: SORBI-28MAY03-CLUS8992_1
cactcccttcttcttcttcttacccctcaagttcggtcgcgctttccgtttcccccctccccctcttcgaacgaactcctcgttcgaacgaactcgggtccgattcggcaggttcattgtgaagttgaggtgagtataggtatcaaagagagcatgagcactgtcagtggtacaaggcgtgcaccaaggagacagtcgcaagatgggtcagctgataaagtattggtgataatcgaggcaagctcccgggtggcggggagccgtcgtggaccaccgacccctgttcctggcgcacgaaactcacccattgatgtggaggccatcgacgatgaagttcaggcagtatcgccctcacgagtgcccccgccaaggaggaacaggaggaccaggagggaacctataacagtggttgacttggaggttgaatctagcagggaagggaacaaacaccagagggttgtaccagtaggacatcacctctcttcagattcgggagcagggtgcagcttgcaggtatttattttatagtagtctcgattgaagggagtaactttttcaacttcaaagctagatagatgacctacttgtgtactttcagctatttagtgtgcataaggttcttgttaatgctcaatccta

SEQ ID NO: 4662 - DNA, 785 bp, Sorghum bicolor
  Clone ID: SORBI-28MAY03-CLUS89974_1
atcctgctcgacagctgcccagagttcttcaattcccatgacagggaatttcatgtagcaacccttccatataaacctgacttcaaagtgatgcctgagggctgggatggcacagcacgagatcctgatgaggttctatacgaaatttcaaagaaggaagatcaaatgttgtatgaggaatttgttcagcggttggaattcaacaagaagaaggtggcaggggaggttaagtgccacaagtacagccgacgccggccagacaatggatggagctacatggtcgaaaagcttggttctcagggaaagcgtggtgttggagggggctggaagttcatcagcttgcctgatggatcaagccgtccactaaatgatatggagaagatgtatgttaagcgggagactccaaaacggcgaaggaggataattgcaccatacaagtgacattgacaacctcagtttgtcgaaatgcaatttttctcaactgtcttttgacattctccagggaggctgaagctgaaactgtgaagttgtttggaacccccagaactggtcctgtctgtgttttcgcagcgcagtagatggtttgatgaatattgtattttgtaacatggatgattttccacatttaggcagctgaataatcatctttggagctgttggtgttcctcccctctctatacatacatttccgagcaacatttccaagccacgtgctttgttgcaggatctgcaaggcaaaacactttgcgtatagacattttctcataagctgaaactcgagattt

SEQ ID NO: 4663 - DNA, 913 bp, Sorghum bicolor
  Clone ID: SORBI-28MAY03-CLUS85611_1
atcagtcgtccattagcacaagtctctctactgcattgcacagccacagccagatccgcaccaggattaatctaacaagaagaagaagatcaaattatcacaatgtccaaggccgccatcctcgccgtcgtggttgctctggcggtgcagctcgccgccgcggcggaccaccccgtgggaggcgacggctcctgggacgccagcggcaacggctacgacgcctggtccgccaagcagacgttcaagcaaggcgacaccttgtcgttcaagttcgcgtcgtcgcacgacgtcacggaggtgaccaaggccggctacgacgcctgctccggcggcagcaacgccgtcaagtcctacaccggcaccagcgccaccgtgaagctgtccgcgccagggaagcgctacttcatctgcagcgtgccgggccactgcgccgcgggcatgaagctcgaggtcaccgtcaccgcgcccgcgccatcgtccaagagcaagccccgccaccagaggagcgtcgccccgaccccggcacccgcgccggccaccgacggcgagctgcccaacgtggcctcgcccgacgccgcgccgtcccccaagtcgtcggacgccgccaccatcgccatgctcggaggcaaggctgtcgtggggctcgctgtcgccgtggccgccgccttggccatgtgagagcgagtcgtgacatgcatgcatgatttttgcagataaatataaatatatacagcccattcattattgcattgtgcggcgcaccgacggttgttgctgagatgtttgtggacagcctttttttttcattggacttttgattcgattattatatgtgctagtagtacaatactgtttattagtgtatacaatgtatttgtcgtcactgttgatcgaataaacttatcatgttgtc

SEQ ID NO: 4664 - DNA, 658 bp, Sorghum bicolor
  Clone ID: SORBI-28MAY03-CLUS85618_1
cttgagttggctgccagggttgataaagataaagataaagtgagtggggatggcaactccttgtttcagttggctgcaagttggcaagctaacaaaaactttctagtgaagggaaagcttggtccttccaagtcttctgtagctctggcattcaaatcatggtggagaccatcctttacatttagtgtaacagctgtgaatgatcatgcaaagggcacaacatcatatggatttggccttcgtgttgaggatcttagacaagccagttaccaacgagctgatccaaactatgtcatgctgacaccaagcaaggagcacttggcaccaggtgttttgcgcgagtacgggaagcggcccatgttccagacacagattgattcgggcaactacgatcatttgccaacagagttgaagccccttggcaggatattctaaccgtaggctgacacgctgcggcgagtcgtaggagcctttccggcagagccttgtaaatcgtagccatcttagtccttatagacatgctgctgtaaccaaatgggattccacacaacgaaaggctatcaactccagagtcttgaccatgacagagcgcgttgcatcgacttgtgagctgaattcgtcatgatagctgcgtgacttctgaaagtcagaagatccc

SEQ ID NO: 4665 - DNA, 698 bp, Sorghum bicolor
  Clone ID: SORBI-28MAY03-CLUS8565_1
ggaggatcaaaggttgaattatgttgagatgcatgcaggaaatgttggcatcaaaactgataagcttgaaagcttgcgtatagctgtggctaaagattctccaatgtgggaaactcttgatatctgtataaaaattgttgataagaattcacttgatctattggttcctcgcctggctcaaatggttagatcagctgttggcttaaatacaagggttggtgttgctagcttcataaccttcttggttcagaaggtcatggttgacatcaaaccattcacaacaatattactgaagttattgtatagtgctgttctggaggaaaggagttctgccgctaaaaaggcttttgcgtcctcttgtgcaactgttttgaaatacgctagtcctccccaggctcagaagcttattgaagatactacctctctgcattcaggtgggaaaaacgatcagttatctggtgcaattcttattaaagcctacttgagcaatgcagctgatattcttggtggatataatgcggtggttatccctgtaatttttgtgtcgaggtttgatgatgataaagacaccagtgctttatatgaagaactttgggaggatattcctactagtgaaagagtaaccctaacactatatttaccagaaattgtatctcttttatgtgatggcatgtgattgtcatcatgggctggtaaaa

SEQ ID NO: 4666 - DNA, 641 bp, Sorghum bicolor
  Clone ID: SORBI-28MAY03-CLUS85652_1
gagaatagcgcaccaacagttgggtaacatccagttagtttctcagtatttgacaatactgggaacattggcgcttcagctacatgacgcaggacaggccagagagatcctgaagtcttcgttgaccttagctaagacgctatttgatattccaacccaaatctggatcttgtcagtatttacagagttatatcgcgaactggaagagaaggaaaatgaaatggagaactctgattatgaaagaaaaaaggaagatgatctgcagagaaggctttctgaagcttattctcatgcttttcaccaggagctggtggagaaatcaagaatccagccgctgcatatgtcaagtaagcagccagagatggctgttccaacagctaatgctgatctcgatatcccagaatcagtggggctttccgctcctcagccgttcctcaaaagacttgttgagtctgagccagtgaggcgcagtaccaggaggcggcaatagtaatgaaacttgtcctgacgcctcacgcattaaaatcggggtgctgtattttaatagtgtagttattacttgtaacatttagcagtttaggtttttatttttccgtttgttgtgttaattatttgtatcttgggttaaaatgtgtagattg

SEQ ID NO: 4667 - DNA, 503 bp, Sorghum bicolor
  Clone ID: SORBI-28MAY03-CLUS8507_1
cggacgcgtgggcgccttcatgttccgggagacggcgcggctggacccgggcgccacgctcttcgtcaacgactacaacgtcgagggcggcaacgaccccaacgcgacgcccgacaagtacatcgcgcagatcgccgcgctgcagcagaagggcgcggcggtgggcggcatcgggctgcaggggcacgtcaccaaccccgtcggggaggtcatctgcgacgcgctcgacaagctcgccaccaccgacctgcccgtctggctcaccgagctggacgtcagcgagtccgacgtcgacctccgcgccgaggacctcgaggtggtgctccgggaggcgtacgcgcacccggccgtcgagggcgtcatgttctggggcttgatgcagggccacatgtggcgccaggacgcctgcctcatcaacgccgacggcaccgtcaacgacgccggcgagagggtcgtcgatctccggagggagtggacatcgcacgcgcgcgggcatatcgaca

SEQ ID NO: 4668 - DNA, 466 bp, Sorghum bicolor
  Clone ID: SORBI-28MAY03-CLUS85102_1
gacacgtcagaaaaccagaagaagcctgcgcccgcccgcggctagcctaccccacccgccccggggccgggggaatatgttatgttatcccctcgcggcggccccccccgcgaccccacggcgcgctccgccctgccctcatcctcgtcaacccgccacacggacatggaagacgacgacgacgccggcgccggcgccggcgcgtgcggccgcgtgctcgagtgggagcacggcctgcccacggaggaggtgctgacgccgctctcgcacccgctcgtccctccggcgctcgccgccgcgttccggatcgacgtcaggggcaccggcaccgccttcccctcctcccccgccttcgactgccccgtcgtcttcgcgcacaactcccccacctctcacctgtccttccgctgcgaggacgaggacgaggacgaggacgatgagggggagggggaggagggaggaggag

SEQ ID NO: 4669 - DNA, 494 bp, Sorghum bicolor
  Clone ID: SORBI-28MAY03-CLUS8511_1
atctgcagctgcatcaggggcacaggatcaggcagaaactgatcacatggctagcgggtgctacagatcagcagaaactccagcgaatattacaaataatgctatatctcagtcccagcctcaatggacaggtccatcccctgtggatgactctgcagtaaacagtgaaatgcttaacaaccagcagttggcaatagatgaaggaacgatcagtgtgtccagtaattattcccaagagttacttaactcgttgactcacgcccttcaaagctcaggtgtagatttgtcccaagccagcatctccgtgcagatcaacctgggaaagcgtgctgtcaagagacctgttgctccttccaactccaaggaaccagctgatccagcatctagtaacgaattaggccatcagctgatgatgttgggtgccggtgccgacaatctctctcacacaacgaagcggcataaaccgggcaacagctgatgaccgctcacactca

SEQ ID NO: 4670 - DNA, 704 bp, Sorghum bicolor
  Clone ID: SORBI-28MAY03-CLUS85119_1
gagccaagccatggattctattgatgtgtgggtactcaaagacggatgggttccagtacatactgtggatctccctattactgaaatccaggcaatgagaggcatcaaacgttttggagaacctatcatatatgtggtgctcgaaacattagatatgctcatttggactccagagttctttatggttgtggatcccagtggttcggtgctggaatatcaccagcatcatcaggattggattctacttccaccccacatactaaaagtaagatttgaagagcagttcttcgaccctgaggatgcggtgcccttcttttggtttcctgaggttcctgctagtggctttactcagagttcccctgctgagaggtcaaatcaactgactgtgcaccagggggggaagttaagttcatatctgtcaagacgagtatgatgagtattactgagagaagcaatggactgccatgcatacactgacgagatagataggctactcctggattctctgttggtgccaataggatatgattctttgtcttgtgttggcatagactgctggtgccaataggattgtctgaaaacctgtaactaggataaaaactttgtgctgtacctcagttaaagtctcaaccttggtattttgattctgtttgtgaactgtgaccacactttctttataaggtttctgagataactttggcttc

SEQ ID NO: 4671 - DNA, 681 bp, Sorghum bicolor
  Clone ID: SORBI-28MAY03-CLUS85148_1
tgaagctagtcatcagagagtccttacggctgcacccgccggcgccgctcctggtgccccgggagaccaccgagccctgcacggtgcacggccgcgaggtgccggccgggacgcgggtggtcgtcaacgccaaggccatcgggcatggaccccgacgcgtgggggccggacgcggcgcggttcgtgccggagcggcacgacggcgacggcgacggcgcggacctcggcgaccacaagccgtggcacggcagcttcgcgctggtgccgttcggggtcggccggaggagctgccccggcgtgcacttcgccaccgccgtggtcgagctgctgctcgccaacctgctcctctgctttgactggcgcgccccgcgtggcgaggtggtggatctggagcaggagaccgcgctgacggtgcacaggaagaaccccctcgtgctcgtggctgaaaggagaggcgtgccctgtgctcgctcgtgcgtcggtcgtttcgtggacatgcggtctccctgccgcgcgtcgctgcctggtggccgacgtgacatcctggcgtcgtggtgacgtatatatatgctatctgtttgattttttaaaaatggatatatatacgttattttcgcttggaacgatttattctcccatctagtgtatggttgacaaaaatcctgttaaaattatggttcc

SEQ ID NO: 4672 - DNA, 613 bp, Sorghum bicolor
  Clone ID: SORBI-28MAY03-CLUS85767_1
gagccccattccattcttcccccctacgctgccgtgcacacacgccgctcctcgcctgccttctgcgccatggacgccggcgactgctccacctccacctccaaacccccgcagccctcagccgccgccgccacccaaccgtcctccccctccgtgtgggccaggctagtgcccgccgattccgcgtgcccggtggtggaggtggccgaggacgactccgtggtctgctccctcgtcgcgccggcgccggcctgcggcggcggggacggggaggaggtcgcgtggtgcgagatcaggcgcaatgccggggacgcgtcggccgccacgattcggaacctcagctcggatgcaattattgttgatggaagaattgtcaaacaagaatgtgtagacatcaaaccaggcagtgagattgtctctggaccccagaaagaagggcatttagtatatacctttgaaattacagaggaagaggatcatgaaaaaaagaatgtcaagattgttctagatattgagaatgcaaaatgcagcatatgcctgaatttgtggcatgatgttgttactgttgctccatgcctgcacaacttctgcaatggatgtttctcagagtggt

SEQ ID NO: 4673 - DNA, 853 bp, Sorghum bicolor
  Clone ID: SORBI-28MAY03-CLUS8578_1
catttattcccttgcaatcagttcgtgtgaagccaataattgagaagctgcgaactcttggtggatctgcgcagttagtttttgatgtcattcattttgaccgagttttggagaaagcagttctgtatgctgttggaaatacacttgtctgtgataaacttgatgaagctaaagccttaagttggagtggtgaaaggtataaagttgttactgttgatgggattctgctgactaaatctggaacgatgactggtggaacaagtggggggatggaagctagatcaaacaaatgggatgacagtgcaatagaatctttgaagaagaacaaaaataagttggaaactgaaatgtcagaacttggttcccccagggagctgcagagaaaggagcttgccatatctgagaaaataactggacttgagaaaaagttgcactactcgaatgttgaacagaataaccttagagggaaactagctaaattagcatctgagaggagtaatattgaggcagagattaaacgtctgaagcctggagaggaggagctcgagacccgtattgctgagagggaagcagaagtaagaaaacttgagaaaaaaattaatgacattgtggacaaggtgtacagagattttagcatttcagttggtgtgaagaatatccgcgagtatgaagaaaggcagctaaaagatgttcaggcactacaggagaggaagctaagcctaagtaaccaaatgtcaaaattgaaataccagcttgaatatgaacaaaagcgagatatgcaggcaccaattgtgaagttaacggagacacatgagtccctagagaaagagctgaagggcttacaggagagaga

SEQ ID NO: 4674 - DNA, 666 bp, Sorghum bicolor
  Clone ID: SORBI-28MAY03-CLUS85786_1
ccgccactaccacttcctcgggggagcagcagcagcagcagcagatggcggtggtggcggagcggttcccgcgggaggtgagctcggaggcgctgttccgctgcgtccgcctgggcccggtcgacgagcccgacgccgaggtggcgtaccagaccagcgtcagcatcgccggccacgtcttcaagggcatcctgcacgacgtcggcccggacccgtcggtcgctgcgggcggcggcggcggcggcggcttccgccacgccaccgacgggtcctccccgagcacggcagcggcgggcgaaggcagcgtcgcggggcccgtatcgtcatcggctgtggtcatggacccgtacccgacgcccggcccgtacggcggcgccgcccatttcttccacggccatccgaggtgatcaaaacgtacggccaccacgattgacacggctagcctatatatctggtttcgttcccttctggatgtgacatgccatgcatctctagctcttcatcgatccactgcttcaatattgccttctctagagaaggattgtcgatcatcaccaaattgttactagccagtagcttttatttgtttccttcttcctccatccctcttgcttatctctttcattctcaatgatcgatgcataaactgatgagtaccgttcatca

SEQ ID NO: 4675 - DNA, 1142 bp, Sorghum bicolor
  Clone ID: SORBI-28MAY03-CLUS85790_1
agtacagtttaccaagttggagcacaaacccatggcgctgccgctgctacggaacagcattcctatggtctcgctggccgtgtcagtcgctgcgttgtacacgagcgccgtgtcctcgcatgtgagacccggcttcccccgtgtggccatgctactcccggtgggcgtcctcttcgtggcggtcccattggctttctcatccgccgtcctacggtgcagtgccttcttgttcctcacatggctcggagcgttcaaggtccttctcctggccatggaccgtgggccgctaaaccccagcctacccgttctccacttcctcttggctgtagctctccccgtggagctcatcacagcaagcgacggcagccgtcgtcccgacaaagacaagccgttgctggcggcggcgtctatcatttcgtgcacgttcaaggtggtcaccgtagccgccatggcccatttctactggttcttcgacaggttgcatctctacgtgcgcctcgcgctgtacggggtccggttctggttctccatagaggtcctcttcgcctgtgccgcggccggctgcagcgcggcgctggatgtggaggtgaagccccagttcgtccagccgtaccttgcgacgtcgctgcgcgacttctggggccggcggtggaacctcccggtgtccgccgtcctccgggcggcagtgtacaacccactgcgcgcgcgggcggggaaggaggccggcctcctggccacgtttctcgtgtctgggctgatgcacgaggccctgctctgctactccaccctgcagcgccccaccggaaagatggccgccttcttccttctccacggcgcatgccgcgtggccgaggactggtgcgcgcgccgctggccgccaccgccccggcctctggccacgttgctcttcgtggcatttatgactacgtcgttttgccttgtcttcgcacctctttgttgcgatggatgggaggagatgctgcattcttaccgcagtcccaatagcagaaactagacataatttttatagcgaagccaatcccaataatacaatctaggtatagtttttatagcgggctacgtcaataaaaaattatctataaaaactatacaggagatttctttgcctaataaatgttgct

SEQ ID NO: 4676 - DNA, 585 bp, Sorghum bicolor
  Clone ID: SORBI-28MAY03-CLUS85809_1
caatgaagactagagtgtctcccggccgccggtgaagacgaagaagcgtgcgggtgcccggtggcggccagcgcggttgggcgttgcggcgccgtccatggcgagagcgtccgccggccagccgggatcaatcgcgttcgtggcgggtgtgagttgagtgagtgagtgactggcgtgtggtgtctgttcaagtctccaggagcaccaaggtacgttgaagctgctctgggctgtcgccgccttttggccctccgtcgtgtcttcgacgtcggttggtggcctgtggcaccgcaccaccgccgtcgagccgccgggaggcaggccgcacgccgcgcgccgggtgctcagctctgcccttgcgccaccgactgctgcatgctggcttttgccgttgccgttctgcatccacaacaccatcttgacggcgaagggaaccggccggccggagcagtaccacggggagagcacagcagcgacaccaagttcgagggtgacctcatcatcctctgccttcaggatctgcatcactgccttctggctttcctttatcaaaaaaaaaaaggggattttggcttctgcgccgtc

SEQ ID NO: 4677 - DNA, 548 bp, Sorghum bicolor
  Clone ID: SORBI-28MAY03-CLUS96441_1
caccccggcggggagctcggcggccgcggaggcgatgcggaacgggaacgccgcggcggcggcggcgacgacgacagggccggagccggaccagggggacgtgacgtctggcctgcagctgcagcagttctacggcgccggcgatgcccttgcgtacatggcgcgcttcagctacgatgacacgttcgatctcgaggccattgttgtgttcggagctccggattcgatcacggacatttatgctgatgagtagcccaaggaatcggaagaagatggtggagcaggacaggttgatggatcgacgcgtatatactgtgcgaaattaaaataatggctgcgcggatcgcaattcgcaatgcctagtttagtttgtatatatgagtagtagctgttatctactctgttgtaagattatgttgtaagattatgttaagagtttgttccttagctactaggagcagaactgaagaagcttttggttgcccttctacgagaacagcggaacttgttaccccttgtgttttcagttggcccttgtttagttccag

SEQ ID NO: 4678 - DNA, 1178 bp, Sorghum bicolor
  Clone ID: SORBI-28MAY03-CLUS85272_1
gttcccactccccactccctccctcccccgcctgccgagaccgaggccgacgccgcccgaggcctcgacatgcaggcggcaggcggctgccgcgccgccaacctttgctccccgtcgctctcacgctttcggtgtggcttccgtctccccggccgggcccgcctcttctctgaaggcgtggcggcggcgccacttcgcgtcggctacctgccccagccgcggacacatggcagcggccgtttcgcgcacctcgaagccatggatgcggaggcgccgcggctgccgcacgccctccggggaatgcttatcgatcatcagaaaatggcatgtcccaaccttctgaaagctgctgtactttcaaccatgacattacttgctgtacctcttgaggcatcagcggagatgtgccaaccacctaattctttcgccaatatgccaattttcattgctgtagctctaataggagctgctgttggcggattgttagcacgccaaagaaaggcagaattgaagcggctcaataatcaacttcgccagatcaatgcagcacttagaaggcaggcacagattgaatcatttgcgcctggccttacttatgcgccagttaggagaacaaatgaaactgatgttattgttgacccaaggaagcagcagttggtcacaaatctgagaaatgggaagaattacatgaggaatcaagatcttcataaggctatagtggagttcagaacagctttagagcttgcagagagcataggagatcgttttgaagaaaagaaagctgcacgaggactaggtgcatcgctgcaaaggctcggaaaataccgagaagcaatgagacagtacaccaaggttctggagctgtctaaggagacaggtgaagattctggctgcaccgaggcctacggtgccatagctgactgctacaccgagctgggcgacctggagcgagcggcgaagatatatgacaagtacatatcgaggctgccgcccggcgaatagagatctgggcagctggctcttgattcttacagacgagacagtgagttccttcctgttggttgagtttttctcggcacaagtcgtgggttttgtcggtctgttaaacttgactgcagggcttggatttttctgagaacgattttgatatttgtatagaaataaatactgatgctctg

SEQ ID NO: 4679 - DNA, 807 bp, Sorghum bicolor
  Clone ID: SORBI-28MAY03-CLUS85291_1
gattttgctttctgtgggaatactttcttggaatcatgccagtcaataggtgatgcatctggtggtggatcctttagtagctcagagttgaatgggcaaccactaaatgaatcgatcttggatatggaatcatcatcatttagcttcttgaaccaaatgccccaaaacttcatcttttcagacttggcagacgatttcaaccaaagtgcagaaataacaccatttctcactcctgaaacaaatttctccgattcgacggggggagaacatacaggttgagtggccatgcacagcacaccaaccatttgtatatacgctcatgggcagtcacgtctgcattgatgaagaacttgaggaccttttgatctagctgttccatttctagttttcgcctcttatattgtgatagttgggactttgggtttggtgggttgtctagccccatcagaacacataattggttggtcttccagtatcctccctgatggtgctgtcgtgccttgtacattgccgtgcttctgtaagaagcattaggagcggcgttgttcacatcagcattaatttggctaatttccccgcttggcttgtacaacaaattttatcaactggattctgaattcaagatttaggccatgagttgtactattgtatatgctgcttcccactgtgccttgtacatccccgtgcttctgtaagaaacattaggaggggcgttgctcacatcagcattaatttggctaatttccctgcttggcttgtacaacgaattttatcaatattaatgaattttaggccatgagtttacta

SEQ ID NO: 4680 - DNA, 501 bp, Sorghum bicolor
  Clone ID: SORBI-28MAY03-CLUS8545_1
ccactccctattcgcccgccattaatagggatttgatgaggaggctgcggagcgccatagagaagattcagaccgacacgacggcgaaggtcgtccttgttgcgagctccgtgccgggggctttctgtgcaggcgccgatctcaaggaaaggaggctaatgaaatcttctgacgttggggagtatgctagatccttgagatctacattttcgtcttttgaggcactccctattccaacaattgctgtcattgaaggagctgcccttggtggtgggctagaactggctttggcatgcgacctccgaatatgcggggaatatgcagaacttggactgccagaaacaggccttgctattatacctggagctggaggtacacaacgccttccaaggatcgtagggagatccagagcaaaggaactgatattcactggccgcaaatgtggcgcagctgaagctgtaatgatgggattagcaaactattgtgttccagcaggagagg

SEQ ID NO: 4681 - DNA, 563 bp, Sorghum bicolor
  Clone ID: SORBI-28MAY03-CLUS85485_1
aggatgtcgctcagttatatgctgctaatgaactatacaataaagggtggttttaccacaaagactaccgtgtgtggctcacaagagctcctaattctgcatctctcgtgaaaactccacttcatgaacgagggtcctacatttgttttgatccaagcatctgggatactgtccataaggacaactttgttctccattacgaagcagtggagaagagacctgtccttccttctgctggccaaaatattaggcgagaattataagcttgccctaggttctcctgcatttgaagttagtttggtttgatcagtagctgttgtcatagatgggatgagttcatacaaaatgattctgtaagatctcctgagcccaggaaattggcatgcatgctgattggaaaatggagctcctttgttggccggctgccctgccaggtggcagttgtagacatgtagttgagatttaggtttgcttcagtatttgtagggcaattgtacctatgttttgacttttgactttctttttgctgttgtgacgcagtcaccgtgttgactatcaatgtt

SEQ ID NO: 4682 - DNA, 765 bp, Sorghum bicolor
  Clone ID: SORBI-28MAY03-CLUS85517_1
agcagcagttgaaaatgattcagcagaagataaggaggttgttgttttggctgcagccaaggatggtaatggtgaatccagtgttgaagcattgacatcaaagacaagcgatgggacaggaagagaagagaagactgaagctggtgactcatctaagggggttggtttttcagtggttgcacaaccatcagtgcaggaggaagatcttagctgggaggagattgaggacatcggcgatgaagatgagaagaatgggcctagccaacggtcaagctctgtcagcaaagtggaggatctccgaaaacgtcttaattctgtagaagatgatgatgaggatctaagttgggacgtcgatgagtagaaagaacgtgtgcagctctgcactgagttgtctgaagaacttttaaattagagactgccatagttttgcctccttaagcatgaattgaatctgcgtggtgtcgatgaatatgctttgtggatggattgatgcgattggatatcgggattcaaattcatgggtgctgcatgtttgattatagcccccttgcaagaacttgatagagtgctagtgtttttgtgtagtgttggtaatttgttttcagttagaatacacatctgttgcaagttcaacatgtaccactttcctgtttgaatatgacacagatcatttacatgtgtactcagatttacatggtaaacatcaaaattgtgaaactattcatccaaagtgcttgcatagttgcagttcatactgtgctttta

SEQ ID NO: 4683 - DNA, 818 bp, Sorghum bicolor
  Clone ID: SORBI-28MAY03-CLUS85580_1
ctactggatgaatacagtacatacacccacactatcccctgcaagcagctgaaccgaaagcaacctccccaccccgagcagagcagaggcgtccgcgccaccaaactttatagcttggaggtgcagctccctgctccacagtcgtcctccgctccccgccccctaccaaattcgccaccaatcctctgctcatctaccatctaacatctttggttgcagtttgcctctccttcacttcacctcacctcactcgccgccatcatcgccatcgccccgcggatccatcttctttgcagttgcagcagcagcggcagcaaatatatcagccagccgccgcccgccggccgccgccgccatagtagattagattcatccctcagacgcagaggccccagggaaggagcgaggagcgaggaggagcaagcgccgccatcggccatcgccatgtccagccccatgcacgtccgcaaggccatccacttcgcctcgctgcgcgccaagctcgcgcagcagggcaaggccggcctcgcgctacgcctgctcctcgccgccgcgctcgcgggcttcctcctcgtcttcgccgcgcgcaccctgctggtgtcctcccctgccgccgcgacctcgtccttggcggagtgcgccgccaaggggaccgcggcggcgacggcggggctgccgctggcggtgatggaggcgctggtgcactacacgacgtccaacgtgacgccgcagcagaccgccgacgagatcggggtctcgctgcgcgtgctgcagcgccgggcgccctgcaacttcctcgtcttcgggctcggccacga

SEQ ID NO: 4684 - DNA, 660 bp, Sorghum bicolor
  Clone ID: SORBI-28MAY03-CLUS85505_1
cctggggcctacgtgctttggtatcgcccgctttacaatgcgatgaggactgaaagtgctttgaagtttgggtggtttttcttgttttacctgctccatatactattctgtgtctggtcagctgtggctcctccatttccattcaaaggaaaatctttggctgggattttgccggctattgatatcataggcaggagtgctattgtggggatattttacttcattggatttggaatgttctgccttgaatcactgctcagcatcgttgttattcagcaagtatacatgtacttccgtggaagtggaaaagctgcagagatgaagcgagaggcagcccgtggtgctatgaggaatgccttttgatagagcggcctaggtgactggaagagacagggtgtgacaatgggtaactgcgtcatgtacatatgctgttcgtctctgagattacttatactagcttatagccttcttcccctcatgcaatatataccacctacccaccagagtttgatctcttatacctaggttcagatgtgcttatagataactccttttttttttggtaatacattttcctaccctgatttgtgctcttaacttgcgagacaattgttgttgttctttttatcttgagtgattctttgcacggccttaaaccgc

SEQ ID NO: 4685 - DNA, 727 bp, Sorghum bicolor
  Clone ID: SORBI-28MAY03-CLUS85862_1
gcacgaggaatccccacgaaaaccgattccgcttccgcttccgcacccacccacctcctctcctcatccctctcccctccgacctctcgtctcccatccggttgccgagcgagcgagcgtgagagagaaagaggggccatggcgccgctatcgtggcggcaccacaccctgctgcaggcgctgctcacgcggggcccgctctcggaccgcgacttccgcgccgtcttcgccgccgtctccggcaagaaacccgctacccatcagcagctgttcaatgatacacttctcaagctcaacaaggagttagcatacctgcagtttgagttgcgagcatgcatgaaccagtatgatggagtggtgtactatggagtagtaaataacattgtcgatgacgaatcaaagctcggaacaaagtattctgtgccacaagttgcatactacaaagggctgttagaagcagttattcaggaagctggaaatgatgggagcataaccagtattggtgctctccatgtgcggcttgacaaccaggtcataattttagatggaggttcacatgacagccaatctcgccttccatcttgcattacggacttcaaactgagccagaaagagaaaactattgatgaactggtaagggatcgatggctatcatacacctccacaggcaagattggtctaggcatcagatcatttcttgatcttcgaggctggttccgtgcgaatg

SEQ ID NO: 4686 - DNA, 669 bp, Sorghum bicolor
  unsure (1)..(669): unsure at all n locations
  Clone ID: SORBI-28MAY03-CLUS85929_1
aaaaacaacaaatctcccgtagccttcttctccctcgtgcccttcttctctcctggcggcgacggctcggcgaggcggcgccgttcgcaggtcttcgccggcgacgagcatcaccaggtcgaccggaacgcagagggtgggggatcggtgagcagctgcagccatgtccgtggcggccggcgtgagcgacgcggccatcgcggtacgcgacaagctccgtggcaagattggccagaccaaggtcaaacggtactggccggggaaggcgccggagtgggccgacgacgccgatgaggacacggatctcaggacgacacgggttgacaaggcgttccccaaggacgacgacggggatgtccccgccaaggatgaccgccggctccgccgccttgcggagactcgcgcggagaataaggaggagctgagggcggatcatcgccgcatacggcaggcggagattgtgtcgactgcggaggaggagaacgagaggcaggaggctgacatcgacgaggaggatgaggaggcccaggaggagaggaggaggaggataanggagaggcagctgttgagggagcaggaggagctgcttcctcangaagaggaggaaccggtggaggatgaggagtctgaggaggagtcggagtatgagacggactctgaggatgagca

SEQ ID NO: 4687 - DNA, 1220 bp, Sorghum bicolor
  Clone ID: SORBI-28MAY03-CLUS85944_1
ctactggaaatcccagttcccagcccgaaccatccgctccgcttcgctatggcgctctcgctcgcgcgcagccccagccccggcgcggcgctccccgccgcgcgggttccccactttgcccttcctctcctcccgctccgctcccctcgccaccagtgccaggcgcgcctccgcctccgcctccgcgtcgcggcatcctcgcccccggcggcgcaggcagccgccgcccccgtggtggcggaggaggaggaggagcagggggagaagcggcggaagctctacgtggccaacctgccctggtccttcccggcgccggagatcgagaaactcttcgcgcagcacggcaccgtcaaggacgtcgaggtcatcaaggggaaggatggcaggaacagggggttcgcgttcgtgacgatgtcgacgacggaggaggcagctgcggcagctgagaagcttaactcccatgatgtaatggggcggacaatcaaggtggagttttcaagaagcttcagaaaaccagctccgcttcctcccattatagagaggcacaagctttacgtgtccaatcttccatggaaagcaagggctcccaatgttaaagagttctttgcaaagtttaacccgctttctgctaacgttatattcgataatggaaaagcagctgggtattgttttgtttcctttgggacaaaagaagaagcagaggctgctctcactgagcttgatggaaaggaacttatgggaagacctgtacgcttgtattggcgggaaagtggtgatgataaggttgaagttgcaaaggccgacagtgaagttgaagttgtaaatattgaaggagcaagcgttgatgatgccagcacagatggaggtgaagataaacaggaatagtcaaacatactatactggcctacaggaagaaagctccatccgccttattgatataaacacagatgtggaactttgttgtacagttacaagtttttttctgacactccctgatctagtgcctgccttttttatatctggatgcggaataagaggtggcaatcataaccaacactcaattattattgtctgccttggtcctgctaaggtaaaggtcaacaaaaggcattaaaacttcaggtgaagtaatgtccttgtagcttgcaattgtattcaaattcagttatgttattgtgacaatattgtacttatttatattacataatggagaagtttct

SEQ ID NO: 4688 - DNA, 685 bp, Sorghum bicolor
  unsure (1)..(685): unsure at all n locations
  Clone ID: SORBI-28MAY03-CLUS85933_1
aaaaaaataatcagctgccactgctgttgtgtctcagcaggaggcgttgcggccatggcggcttcgaagcccatcctgtacagcgcgtggatcagctcctgctccttccgagtccggatcgccctcaacctcaaaggtaactggatcaaatcgctggctctggtttcctgctccacagatgacggcgaatcttgcccaaaacaggggtcttgttagcgggagatggggaattggggacaatgtgacctttttcttgatttattaatcagttcgacagattttgggggaaatgggtgggtagctactaggccaccctgattttagacagagagtatctttggggtttgtcttaatctctgggctccagggaccggggctcctgttataccaggtggtgttactaattaaatgagataaagcaagttaatttggatttgtgcaaatcttcacttgtcttttgactatgtagcttgtgagaaatggattatatattgtaatgttctaattaatcgatggacagaanagaagtatgcgtgcatccaacttattagtaataaagttctttaaatgctctgacggtagactactcaatttttactgcaagttgaagcacgtaagattatagcttcttgtgctattgcttgtcatttaatcgttactttttgtgtgaactaattcttccaat

SEQ ID NO: 4689 - DNA, 392 bp, Sorghum bicolor
  Clone ID: SORBI-28MAY03-CLUS86001_1
gacccatcgaccagcagcttggagatccggctgatccaaagccaggacgagatccgaaacccatccgttacatgcaaggctgtgaagtatggaagctgaatccatagtccccccctgactaagctgccaacaataatgagccgtgcctggcccgcccataagcccctgtacctacttccatgactcttgggcttcagttttgggatactgattctgttaccccttagctctgaaatgagaaacaatcagatttctgggaagaagaataatagatgcaggctgtgcggttgttccagtctgtgagaatgcggtggtggccgtgactgagattgtaaatggttggcgcatcctttgcatgcagaatgaatgaacagccgcattgttgttgttcc

SEQ ID NO: 4690 - DNA, 596 bp, Sorghum bicolor
  Clone ID: SORBI-28MAY03-CLUS85954_1
gaccatcactaccggcggcggcgccgccaatgccggcaccagctcgcggccctccacggcagcgctgccaagcaaatcggtcgtgtcggacctcctcgacgccatcgagacgaaccgggcggcgccacggcgcgacgccgcccgccgtggatccggtggcagcgctggactcgggtggtggaacctcaacgtggagggcgtaatgctgctgctcagggtcgtccaggcggtccggggaaggaggcatctagcggcgccggcggcaggggagaagaggccacgggatgagggacccggtcgcgacaccatgagaggcggcgttatgggaggcggcggcgcggcacggcggtggtgcggcgggaggtcgaggaagattgggaataccgttggcgcctgcgggagctcttaagagtcttcagcgctcaaggagtagtgagaaattactactggtaattagctaggggtttagggaaattattagggaacggtttgatttgttgatctgctctgttgtacgcatcaaatagatgcatgcttgacgatcggtatgctttcagaattcaattatttatatgagtagttctcgtctagccctc

SEQ ID NO: 4691 - DNA, 779 bp, Sorghum bicolor
  Clone ID: SORBI-28MAY03-CLUS8566_1
gccggccgggccgggcatatccaaagagtggagaaaacttaggccgaggcattgagttgttacataatgcacaaggatattcatttacttttgataaagtatttgatcattcagcatcacaagaacacgtgttcatagaaatatctcaactcgtccaaagtgccctagatggctataaggtttgcatatttgcctacgggcaaactggttccggtaaaacatatacaatgatgggcaatcctgagtccgaagatcaaaaaggaatgatacctcgatctctggagcagatttttcaagcaagccaggcacttaactcacagggttggagatataagatgcaggcctcaatgttggagatttacaatgagaccatacgcgacttgcttgtgacaaatcgcatggctgctcaggatggtggtcctacaaagtacagtatcaagcatgatgccaatggtaacacaatcgtgtcagaccttacagtcgttgatgtaactactatcaacgaagtttcttctctcctcaggcgggctgctcagagcagatcagttgggagaacacaaatgaatgaagaatcatccagaagtcactgtgttttcactcttcggatattcggtgtaaatgagggaacggatcaacaagtgcaaggagtgctcaatcttatagatctagcaggcagtgagcgtctgaacaaaaaagtggtgccacttgtgatcggctgaaagaaactctggctatcaataaaaagcttgtcatgccttaaagtgatgtcatcttctcga

SEQ ID NO: 4692 - DNA, 608 bp, Sorghum bicolor
  Clone ID: SORBI-28MAY03-CLUS85659_1
gacacagttcatgggggcaatccatatgaaaaagatattccagaaagatgcatacagcaatcaggcaaaacattgcaagctgtaatctcagagtggatatcaaaatttgacaacatggaaattgatcgctcgaggttgcaactgaataatgtggatgcaattacttccaggacatatatttgcaaccattgctacagcaagttcattgatttcctgctctactggttccgcgtatcaatgccccgaaatcttcttccgcctgatgccgccgacagggagagctgctggtacggtttcatgtgccgcacccagcaccaccggcctgaccatgccaagaagctcaaccacgtctgtcgcccgacaagaggcaacccctagttccagcatcccatctcatctcccggggatctcaagaaaataaaaaacaaaagttcagtgattctgtagtagtgtagaagtagaagtacatggctgagattaaacacatgtaacaatgtgacgtgagactaattctctcaccattgtcattactcattaccatccaattatgtgtgtgatgttgagctttcaaaatggtcaggaaatgtggcagcatccatgatgaaatg

SEQ ID NO: 4693 - DNA, 658 bp, Sorghum bicolor
  Clone ID: SORBI-28MAY03-CLUS85680_1
attgggtacatagctcctgaaatggtatctcgtagctttggcgccatatcaagcaaatctgatgtttatagctttggtatgctattgttagagatggcgggagggcgaaggaacgcagatcaaaatgcagccaactcaagtcaagcatactacccagcctgggtctatgatcgtctagccgcacaagaagtcggtgagatatctgttgcatctgacatgcatgagttggagaggaaactatgcatcgttgggctgcggtgcattcaaatgaagccgcaagatcgtccgaccatgagtgaggtcatagacatgctcgagtgtggcactgatggcctgcagatgccttctaggccattcttctgtgataatgatcataatatacctgctgcagattcttaccatttctcatcggagcttactgaaatctctgaggaagacgagtgaagaaatatttccatatctttgcatttgtggtctggtgctggcagtatgataataaggtgagcagagcattagcttgtgaaacctgaaatagagcgttaagttttatggtacatgagtttctgattcctgtaaacatttactatgtggtgaaaacatgtatgtataacttaagatggagactagcaactattataatcatgctgggatttaagtt

SEQ ID NO: 4694 - DNA, 658 bp, Sorghum bicolor
  Clone ID: SORBI-28MAY03-CLUS85706_1
atctagaaatctctcatggcgaactcatgtgcagctgcagcatttcttcatccttctgcatcttattggcaagctttgcttgtctttatttctgtgactgcggttcgtgctgcaggtgctgggggccgaggtacgtgtcctcctttctcctgtggtgatcttcacaacatctcgtcccctttccgtaggccaggtgacccacctgagtgcggtgtacaagcatacgagctgtcctgtagccgcagcaaggctaccattcgcatcaacacggagacatattttgtcacgagcatcaactatactgatctttccttcggggttgtggacgccaacttggatatgcacagcagttgccctcttcctcgtccggaccagtttcgttacaatgatgattatacgggttcttacttggaaagtggtttgcattctcattatgatttaggatttgattattccaataactgggcatgcttcattaattgttcacaatcaaaaacgaatagtagttggtacaagccagtcaattgcctgagtgcgaacaattcctttgtttatgtcatggttgattattctgattgttcagtcagctctcttgaaccttcttgtggatacttgacaatgatcccctttggtaactggcgtaccatcacagacccag

SEQ ID NO: 4695 - DNA, 646 bp, Sorghum bicolor
  Clone ID: SORBI-28MAY03-CLUS85725_1
aacccccgccgcggcgccgcctgacctggacccggaacaattgcattggtgtttcgccgccgccgcaaaaagaggcgggcgctgtggagttcaagggaggaggaggcgccggagaactgctgtagatcggtgagccgagggcgagatggggatattcttcagcaaggaggagccgccgccgccgccgccgatggtgcttgtgccgccgctcttcgattaccctcccatcgccgcccgcaccagggtggcggtgccagcatatgagctaatgtttgggaagctctcgctgcacaacctgtttgaggactacttcgatcatgctgggaatatgacctcaaggatcatgttaaagccgctggaagatcctcacgttgatttgattgctactgtgtctgctgctgctgctgataaaaatagtggaacagaagtaaaaggggatgctctatttcgctggcagagagaactgtatgacccccatacctttgtggaccttcttgtgtcaacttcaagtcccttgttgcagctgaggtcatgtgcgtatgatcctaagtatcgtattggtgcctttgggacactacctttgctaatggggaacagggtgcgttcagaagattatggggtcgtgggtgtaagatatggttcagag

SEQ ID NO: 4696 - DNA, 465 bp, Sorghum bicolor
  Clone ID: SORBI-28MAY03-CLUS861_1
cgtccgcatcccggtcgaccacgcgtcctgccttcgagaaggccgcagagcgaaggaaactgcacagtgctacccgtttcttgggctcttggcgcggaagaagaagggagagcgcggaagaagaagaagaaaaagggagagagaggggggcgacgaagatgtttatccagaaggcatggcggacggcggcgtttgggctctacggcttcacccagttcaccaaatccggtttcctggagcatgcaaagaaattcagagaggaggatatgcagatccggttggatgggaaaaattgcctggtaactggagcgaattctggcattggttttgctacagctgagggtttggcttcacatggtgctaccgtctatatgctctgtcgtaacaaggagagaggggaggctgctcttgaccaaataagatccaaaactggcaatgcaaatgttcatctggagatatgtgacc

SEQ ID NO: 4697 - DNA, 667 bp, Sorghum bicolor
  Clone ID: SORBI-28MAY03-CLUS86102_1
aaatgccaaatccaccgcgcgcagctccgccgaccaaaccctagctctgatccgcagcgagcagcatggcgccgcggccggcggcggcggcggcgctgatggacgagctcgtggaggagatcctcctccgcattccgccggacgacccagcgcgcctcctccgcgccgcgctcgtctgcaagcgctggtgccgcattgtctccgaccccggattccgccgacggttctgtgagttccaccggaagcccccgatgctcggattcgtctgcaccgccgggccatggtgcacctctggccccttcacctccttcgtctccaccacctccttccgctcgtccccctcccgcctcgactacagggcggtcgacgcacgccatggccgcgtcctcctccacggcgagatctggaaccataagcggaagcactgggacgattccttggtggtttgggatccaatcacgggggttgagcgtgcgagactaaccttgccgccgcggtccaggcaccaggaggccaactacagctctggtatctggaatgtggccgtgctctgcgcctccgccgccgttgacgacgcctgtgatcacctcgattgccacagcggacccttcctggttgtctttctggctaggggcaggtctgggatgtgtacccaagtctactcatc

SEQ ID NO: 4698 - DNA, 700 bp, Sorghum bicolor
  Clone ID: SORBI-28MAY03-CLUS86111_1
aagagaaaatcgaacagcaatcgtccggctcactggtcaacctgctcgctgaacaggtgaggcgagggaggcgtttgggtggtggtgctcgcggtcgctgcagctgctgacgcggaggggccggacgaggagggcggcggcggtgtacccgaagatggcgcggccgccgatcctgtccgtcgcgctgccgtccgacaccggccgcgtgctcagcatccagtcccacaccgtacaggggtatgttggcaacaaatcggctgtctttcccctgcaactccttggctttgatgtggatccaataaactctgtacagttttctaatcatacaggatacccgacatttagaggtcaggttctcgatggcaaacagctctgggaccttattgaaggactggaggaaaatcagttgcttcattatacccatttattaacaggttatataggctcagtttcctttctagagactgtgctacaagttgttgacaaattacgatcagtcaatcctgatcttttatatgtttgcgacccagttctaggtgacgaacgaaaactatacgttcctcaggagctaatatctgtttatcaacagaaggttgttccagttgcttcgatgcttacacctaaccaatttgaagttgaactacttactggattgaggatcacctccgaacaagatggcttgacagcttgtaataccctc

SEQ ID NO: 4699 - DNA, 602 bp, Sorghum bicolor
  Clone ID: SORBI-28MAY03-CLUS86129_1
gacgccatggaaaggagtaccagagagacaacaccgtgcagtttgattaggaacccagagatgataagcaccccaggatccacaactaaaagtaaaaccagcaactcgatgacttcccgtcgcagaatggaaacctcaatccgccgtttcataccaagttcgcatgagatggaagagttcttctcagcagctgaaaaacaggagcagcaaagcttcagggagaagtataacttctgtcctgtgaacgactgtcctcttccgggtcggtatgaatgggcgaggctagactgctagattcccagcacaagtgcaccattgatctgatatgtctaccacaatgactagtgccttggcggaggcgcaatcaacccaatcgcattagctttcttgtctgttgtaaaaattagagtagttagcttgtagctggatgatctttgtgtaacgaacaggcgtgattcttagttacaccctgatccccaacctcactttaaccgttaactgctcaagctgtaaccgaaccatctcatgtagtgtaggcctagcgcattcatctgttcctagttctcgcattaattgaatgaaattagagttagattgcaggc

SEQ ID NO: 4700 - DNA, 991 bp, Sorghum bicolor
  unsure (1)..(991): unsure at all n locations
  Clone ID: SORBI-28MAY03-CLUS86152_1
aacgcgctaacgaagctagcaagcatcggcattcggccatgtccaaggcaaggttggacggcaaggtggcgatcgtgacgggcggcgcgagcgggatcggcgaggcggcggcgcggctgttcgcgtcgagcggcgccacggtggtgatcgcggacgtgcaggacgagctggggcaggcggtggcggcgtcggtcgggtccggccggtgcgcgtacgcgcggtgcgacgtgacggacgaggcgcaggtggaggcgacggtggcgcgcgtggtggcggcgcacgggcggctggacgtgatgatgagcaacgcgggcgtgctgctcccgacggggtcggtgatggacatggacctggcggagctggaccgcgtgatggccgtcaacttccgtggcgcggcggcgtgcgtgaagcacgcggcgcgggcgatggtggcgtccggttccggcggcggcggcggcgccatcgtgtgcacggcgagcgtggcgtcgctgcagggcgggttcggcccggcgtcgtacacggcgtccaagcacgcgctgctgggcctggtgcgcgccgcggccggggagctggggagacacggcgtgcgcgtcaactgcgtgtcccccggcggcgtcgccacgcccctgagctgcgcgctcatgggcgtgggcccgcaggagctggaggccatgacggtgccgcacaacgtcctgcaggggaaggtgctgcgcgccgacgacgtcgcggaggccgcgctgttcctcgcgtccgnaccaggccgccttcatcaagcggtcataacctcgttcgtcagacggcgccatacactgccgtcaaccccgcccgtgctgcagaaccgtcggggctgtaaacgcccaaacgatcgctgccaccagtagatcacatgcatacacacatagaatacatactttgagtgcaaatgtttcactcgttcgttttttttttttttttttcgccattggttggcatcaagaaaatctgctttcgt

SEQ ID NO: 4701 - DNA, 692 bp, Sorghum bicolor
  Clone ID: SORBI-28MAY03-CLUS85813_1
gttttcattgttgcagtgcagatcatgaggctttggagatgatcctaatgtgattttactgaaaaacatatattgagttccttgtaatttatttttttatgggcatgatcctaatgtgagtttactgaaaaacactataatattctttgaggtgactgaaaagctgggcaacatgaagttgctcaacagctcaaactgtagataagttaacacaacttagatgaaagtccagctgccataacctgaagggcagttgcacaactgattctagaggtcaagtacgaattaagacctctacctatactataatatatttagggggaattaaacacattacctgcagagaatggatgatgatctgcaaggtgcagctccactggcaagtcttcatttcctcaatgtagacatgtactaaatgtgagtgttgtccctgctggatactactgcaagtaaaggataatgctgaaatccttaattcacctgatatagttgtttaaatatatgtaataaaaaaataaaatcatttgtcattttatttcttatgttttctgacctgagccactcatcctttccacctggcaacatgatccaaacccttggtgtccataaatcagtcaattgttgtgagctccatagatcatacctgcatgtcaaatgacaaattactaaccacttgattgcctgctaggctt

SEQ ID NO: 4702 - DNA, 663 bp, Sorghum bicolor
  Clone ID: SORBI-28MAY03-CLUS85827_1
tatggtttatgctattcccatggcagggtctgcttgatggcaagttaggttcagatgagagccttcagattgttaggaattacaccgacaagggatttaaaggtgtgatttgttgcactctgtaattgaattgttttttggtcattgaatatcattcttccttgagtatgcatctgaaaattaggcagatacatggtgtaccataacaaatggtatttccttgagtacaccctgtcagtgcccttcctactcttgtgttctttaccttttgttgcatatattttgtgtgtacccactatgacttttcccctggatttgctcggcaatcgaaaaacttctggaaggttgtgacagtaaatatgctactggagacgaagtccaactggcagatgtgtttcttgcaccccagatccatgcaggcgtgacgcgcttcaaaattgatatgtcaaactaccctcttttggagaggttctacaaagcctatatggagatcctagcatttcaagtagcggctcctgaaaaacagccagatgcgcctgcgtctccatactgaaatgaaatctacagctatgttcagatagatgcctgcagtgattcataataattatggctgtagagattcaaattaattaggacgcttgacgtaagtgaagttgcttcgtc

SEQ ID NO: 4703 - DNA, 643 bp, Sorghum bicolor
  Clone ID: 30967258
aggtgattggggcagtggatatgggatttctgcccaggcattgacagcagtggtgagagcttatgatggccgaggccctgaaacagcgcttacaaacaacatccttgacttccttggactggcatcgccagacgaattgataggatggacatatgaagaccaatcatgggctcgtattgctgatcttcttccagttgtggtagaatcagctgaaagtggtgatgaggtggcaaacaagatcctacacaattcagttggagaacttgcttccagtgtcaaggctgtagtgcaaaggcttgaccttggtggtgaagatggcaagcatccatttccacttgttatggttggtaaagtccttgaggcaaacaaaaggtgggacattgggaacgaagtgatcgattgtgttaccaagaattacccaggtgcctatccaatacatcccaaggtggagccagctgttggtgcagctttattagcatggaatgctatagcaagtgaattagatggcgatattagaactgttcaataatgaaacatcctacaaattattgtatattatgttttagtgctgaatcatcacctagccttttgcatttgatgtaacagattgcttgaaaaggttgtaatcttctcgagaaagaaa

SEQ ID NO: 4704 - DNA, 435 bp, Sorghum bicolor
  unsure (1)..(435): unsure at all n locations
  Clone ID: LIB3476-051-P1-K1-C5
agggaaaatcagagaggattcttgtgtcaccttcaccaccaaggtcaagcctttgcactacagccttgacactggaagcaagttctccaactgaattgtgtaggatcttgtttgccacctcatcaccactttcagctgattctaccacaactggaagaagatcagcaatacgagcccatgattggtcttcatatgtccatctgttgtcagaacaatgaacaggaaacttgaggagagcaaggagctgcgatggttgagcgagtccaggtggtgttacctccgacggagttgtggttggagcagccggcgacggtgcgggagaggaccgggagcgggtcgtgaagggcatggcggcggggatgcagacgcagacgggttgctggcaccgcgtnacgccgagatgagctgccatgcgcggctctgactcttcacgtc

SEQ ID NO: 4705 - DNA, 649 bp, Sorghum bicolor
  Clone ID: SORBI-28MAY03-CLUS85829_1
atctggatatgtgggactgagagatgtgaacactggtgaaaaagataacatgatgcagagcttcttcctggcagagacgctcaagtacctctacctacttttctcccctccatcagtcatatccttcgacgagtgggttttcaatactgaagctcacccattgagaattgttccagtaaatgataacaaaggcattggaacgccggtccgaccattcgggagaaaacagggaaagcctgagtaacctttggatgtagagcagtggatttttgaatccgccgtctgattctgacctccctgatgaagatgtgttctgacacgagggaactttctgcctgaaacagtaagggttagaaatcacggcaatagattgcttagagcaaaaatcataggtagagcatgatgctatatgcggggcagtgacctccgtggatatgatcggaggtcaagagccccatagaagcttttatcttcggacttgcttacgcacctgaggtgccttgttgatgtgtagcatacatctaactcactgtccatatgttgttgctttcctggggcctctgcggagctgtattgtcattatgtgccccctagttattacttttttcagatatgatttatataaaaaggttgtttgtggttttccttc

SEQ ID NO: 4706 - DNA, 654 bp, Sorghum bicolor
  Clone ID: SORBI-28MAY03-CLUS85838_1
aaaggcttcaagagcctgtcctggctgtggcactgaatggccccgtcaggaaggcgaagtcgatggtgacgatgatgcaaacgagcctggtgaagatggaactgcatcagccaaccgttcttcgaggaagagacgcaagggagtgaaagctgaactggtggaggatcgttcttcgaggaagagacgcaagggagtgaaagctgaactggtggaagatattcacaatgcagggccattaacggcggcggttcctaggagggcgaggagcctgagaagagcgaaagccgaagcagtcgaagccgctcaagaggtgtcgtctgcagggccttccaaggcggccagagcttccaaaggaaggaagaagtgaatggtgcgggctcatggatgataggtagtgagattgcaggctctcttttgtcgtgtacatacggttgatggttgcacctggtggtagtagatggtccttttgggtgtggtgagggaaggctgctgcgacttctagttgttgtggcctaatatgtatagcctccacaaactcgtagagcttattttctgtcatctgacagtaacagatcaacctagactggtagaaccaatcctgtgctggtacttgtttggaattagtgaccatattagagcactgaaaagctgagc

SEQ ID NO: 4707 - DNA, 775 bp, Sorghum bicolor
  Clone ID: SORBI-28MAY03-CLUS86308_1
gcgggcccgacgagtacgacaacttcgccgacgagagggataactacgagcagacggaggccaccacctacaacaacgccccgctcatgggcgtgctcgctcggttggccgccggtcacggcggcggccggtttggtcaccactctgtcgccgccgatttgcctgcagaagcttcttcctccacggccattaatcggacctcactgccatctcctactccggcagctcctgagcacgcgtcgcccattgagatcgagcagaacgcgacggcgtcgtggacggagcggggcaagacgtaccaccggtacgcggtgacggtgaccaacaggtcgctcatcaagaccgtccacgagctccacatcggcatctccaagctctacggccaggtgtggggcgtcgacaaggcgcggtacggctacgtgctcccgagcgggctgccgtcgctgcccgccggcaagagcgcctcgttcgtgtacgtccaggccgcgccgccggccgacgtctgggtcaccggctacaagctcctctgatacggcacccgaagtagcgagtggccctttgtgtgtgtgtttattatgtggaaggagtgaaatggaggtttacaaaaaaagggggcaacgagtgatggggctagtaacgatctcggtcatcctcattgtccattaatatagaagttaagcattcagcagctatagtgtgttgcttgtttagttgtgtggtgattggaattggaatagtaagatgaattgtatgctacaatacaacataatggaat

SEQ ID NO: 4708 - DNA, 552 bp, Sorghum bicolor
  Clone ID: SORBI-28MAY03-CLUS86343_1
gagctggaccgcaagtacaggttcgtcatgcgcctcgtcgacctctacgggcccttcgcgctcttcaagggcatcttcgacgacgccaacatggagaggctcaggatcgccatgcccgtcgctgaccgggtggagttcaatttcgacccaaagaccgtcgattgggacgattacttctacaagatccacatcccagcggtcatgaagtacgtcctcaactagcagctgctagctagctagctagctagtcacgacgactcacattgttattattgttgccacgttcatccaaggattatgttgttattaattaattaaatcaatcggcgtcggcgtgcgtgtgtgtatatacacattgttattgttgctctaccttcatccatccatcctcgactcctcactaaccatgaggagaaatcgaaatgtatccagtcagcagctgctctaattagtacggagtacgtactcccactcctagcttgtttatttgtgttgatttagttggacctgatgaaatggtgataccccatactattaatcacatgttcctcg

SEQ ID NO: 4709 - DNA, 654 bp, Sorghum bicolor
  Clone ID: SORBI-28MAY03-CLUS86387_1
ccgtcagccagccccatctccaccacaccctccccgtccccgacgaagcagcggagcggcgaggcgcccgaagtcggcgcctcaccaattgcttctccgcgctcgcgcgcgccgcctccccgcactcggatgccccctgcgccggcgcctagagcggcggccgtctagcgggcgcccggagcggtgaacccaccgatggccgacgctctcctccttccgcgccgcttcctcgcgccgtcgccagccgcatccggcgtctcttcgtccgcctcttcgtccccgccgtgctgttgggtgctgtcggcgcccggctccccgcggcgggcgcgcctggcggccgctcacccgcaaccccggcctcgccggctcactcgatacaagacttatgcagcagagccaaagagtggtgagcaaccgaaatggtgggagaaaaatgctggaccaaacatgattgacatccactccacggtggagttcttggatgcacttagagatgctggagacaggcttgttattgttgagttctacgggacctggtgcggttcatgcagggctctctttccaaggctctgccggacagctttggagaaccctgatatattgtttctaaaagtgaattttgatgaaaacaaacctatgtgcaaacgactgaat

SEQ ID NO: 4710 - DNA, 750 bp, Sorghum bicolor
  Clone ID: SORBI-28MAY03-CLUS86412_1
gatgcaacaaaatttttcctttcctcgcttcatcgtcgtcgccctctcggcttcttcttccccagcgctccgtgctataaatacgccctcgtctgcatctactgcctccacccaaaacggagatcatcgctgcccattgcgccgtcgtcccttccttccttcctttctcggctagtttctggggcgccctccgccatggccaggggaggaggacgaggaggcgggggatcgcgcggcgcggtggtggactccatggccgtcgtgcttattggcctcgccatggcgctcgccgccgcgacgacgcaagtggcgtcggccgccgggcacgactaccgccaggcgctgagcaagagcatcctctacttcgaggcgcagcggtccgggcggctccccggcagccagagggtctcctggcgcgccgactccggcctgcgcgacggcaaggccaacggggtggatcttgtgggcggctactacgacgccggcgacaacgtcaagttcggcctgccgatggcgttcacggtgaccatgatgtcgtggagcgttctcgagtacggcaaacagatggcggcggccggcgagctcggccacgccgtcgaggccattaagtggggcacggactacctggtcaaggcgcacccggagcccaacgtcctgtacggagaggtcggcgatggtgactcggaccacgactgctggatgcggccggaggacatgacgacgagccgtcaggcctaccgccttgacccc

SEQ ID NO: 4711 - DNA, 387 bp, Sorghum bicolor
  Clone ID: SORBI-28MAY03-CLUS86019_1
ccccccccacacacacacacgtacacaagttgaagaaatgcgtgtaccgtacgagagcgttttttttgttgaataaaagtacggtagtataggagtgtacttagtggggatcatgcagtataactcaacttatataaggcgttgtctagttggataggtctactgctatgttcttgttacagtagattggaacagtaaaaataaaagtgtgtcctttattaatgaacagtaaaagtatatatacacattctcaatggagcagttctagatggagcggggagttcctactcccacgacaatgtctcgtggcgacaactgctattagcagttactaattagccttcaattgatcactaagaatataagaatattcttaacactctcccg

SEQ ID NO: 4712 - DNA, 630 bp, Sorghum bicolor
  Clone ID: SORBI-28MAY03-CLUS86041_1
tgatagtagcaaaacaaaactcgtgctgagcaaccacacaagacacaagactagagtgcgtgactccgcggttaaggcagcaagcaggcagcagccatggcagccgcaaacgccgagaacacgtcgtcgctgctccggctcgacggccgcgtcgcgctcatcaccggcggctcccgcggcatcggccgcgaggtgtcctcccacctcgccgccctcggcgcgcgcgtcgtggtgaactacgcgtccaattccgccagggcagacgagctcgtcgcggagctcgcctcccgcggccaccaggccgtggccgtccgcgcggacgtgtcagacccggacgccgtgcgcgcgctcttcgaccgcgccgaggaggcgttcgggtccccgccgcacatcgtcgtctgctgtgcaggtgtcctcagcgacaagtacccggcgctcgcggacaccgccgtcgaggacttcgacgccatgttcgcggtgaacgtgcgcgggacgttcctcgtgtgccgtgaggcggcgaaccgagtcccagccaacagcggcggccgcatcgtgacgttctcgtcgtccatcgtcggcacgctcctgccgggatacgcggcgtacacggcgaccaacgccgccgtggag

SEQ ID NO: 4713 - DNA, 570 bp, Sorghum bicolor
  unsure (1)..(570): unsure at all n locations
  Clone ID: SORBI-28MAY03-CLUS8606_1
gcaggcgacgaggtatgcccgccgccgtaccacaataggatttcagcatggttgattctgttcatgacaacattgtgctgaacaagtgtatcaaggacatccttgcactaatcaaaccagtagaggatgatagaagcaggcggctatccacaattcaggagctggaaaactgtatccactctcaagcatctctgtcaggtgctgctgtcaaaccttttgggtcctttgtatcagatctttactcaaaatcaggcgacttagatttatcaattcagctctggaatggttcaaaccaccctataaacaagagaaagaagcagaataccttgagagaagttaggaaaaccttactaagtcaaggtgttactggatacatgcagttcattccacatgcaagagttccagtccttcaatatgtcagcaaccgctttggcatctcctgtgatatatcaattgataactttgctggtcgaattaagtccaaaatcttctactggatcaatactttagatgagcggtttggtgatatggttttgctgatcaaggaatgggcaaaagctcanaacatta

SEQ ID NO: 4714 - DNA, 638 bp, Sorghum bicolor
  Clone ID: SORBI-28MAY03-CLUS86074_1
attgcatgcccatgatccacctcgcagtttggtctgaacaaaatacacaccaccatgttgaggtgcttggtgcttgctgcagtgtcgttggcgctgctcgtgctggctccgccggcacgcgccggcatcccgttcacagagaaggacctggcgtcggaggagagcctgcgagcgctgtacgagcagtggcgcagccactacatggtgtcgcgcccagcaggcttgcaggaacaggacgacaaggcgcggcagttcaacgtgttcaaggagaacgtgcggtacatccacgaggcgaacaagaagggccggccgttcaggctggcgctgaacaagttcgcggacatgaccacggacgagttccggcgcgcgtacgccgccggctccaggacgcggcaccaccgcgccctgagcggcggcagaaggcggcacggcgatgggagcttcatgtatgcggatgccaggaacctgccgctggccgtggactggcggcagtggggcgcggtcaccggcatcaaggaccaaggccagtgcgggagctgctgggcgttctcgaccatcgcagctgtagagggcataaacaagatcaggaccgggaagctggtgtcgctgtcggagcaggagcttgtggactgcgacga

SEQ ID NO: 4715 - DNA, 640 bp, Sorghum bicolor
  Clone ID: SORBI-28MAY03-CLUS86061_1
agcggcgatctctctctctctattccttctcctctgatacctgtgtctcccccctcccctctcccttgctttgcagcaatacctgaagctttcttctacatcgcgtcaagatctcagcgagctgggtagacgtgttaccttcaagcaaggaaaaagaccctctcgatcgtgggtaagcactaaacagtagtataaacattaacagtggtcttctaatctatactgttaacgtgtacaagggtccagggcatgcatgatcgatcatgcaaaatatctgagaaaaaataaatatctgtgtatagatacccgcttgccagacgtacgccagctaaatagtcgatcgaactcgtatcttgggaagtgcagcatgcacacgtcgtgcggaatcggcggccggtcgacgtcgtgcgtgcatgtttcttccgttccatgcatgcatgcatcccagctagcgcatcacttgctcgtcgtggaaccacggcaacgtgcggtgttagttctgatctgtgtttccaacgagcagcattgccaaccggccgggtgcggatggcgtctcgggagggaggaagaggaggtgctgcggcggcgggccggccggcgctgcgggtggggcggacgcgtgagtaccggacgggcatgg

SEQ ID NO: 4716 - DNA, 673 bp, Sorghum bicolor
  Clone ID: SORBI-28MAY03-CLUS86655_1
ggagctggaaggtcaccaaccccagctgctctaccctccctttggaggggcgctgggagagggactgcaagatcgatgcttcccatatctcaggctcactgcctaagctgctgggacaagctgcttctctgccaccattgcagcagctgcacacaggccatcccacgctgagcttggacgacgatgatgtggtctatgtcgtggccaaggtcgaccatcgggacgacaaagcgtttgtgcttgctgttaacatgtggaatggcgcgctgcaagcagcagattactttggagctgagagaatgataggtataagtttcacctacacacagtacaggccatcggactacgccgaaatcactacaggttaaatggggaagcataaaaggaggctaactaagatgcctggacttggtatgatggacttcgacaatttagagatgattggaggtacaaactagtcatgggatctgttggacttaatttcacaagagagtattctgagtgtgggctatttagggatgtaggagcttgctgattaagtccaactgcatatattatgtaactgcatgtattattcgtcggcgatgtttgtacatgcacgctaattctggttatatatcgttgtatctgaatatggaccaaccctgttgtcaaagtggctcctgctgaagat

SEQ ID NO: 4717 - DNA, 665 bp, Sorghum bicolor
  Clone ID: SORBI-28MAY03-CLUS86666_1
tgacgaacggagggacgcaggtgtacgccgaccagcgccggaactcgctggaggaggccgtcaagctgtgcgtcgccggcgggctgcaggggatcgtgtccgaggtccgcgcgatactcaggcagccgtcggcggtggccgagatcaaggacgccaacaagctgtcgctcatgacctacggccagctcaacaacgtgccggaggtggtgtacgtgcagcacctgatgggggtggacggcgtcatcgtcgacctggtgggggagatcgccgaggccgtgtcggcgttcacggtcacgcccgtgcaggcgtcggggtcccaggatggcggcggcggcgtggtgggcgagaggatggagacggccgccgccctggcggtggcagcagggacgacgccgagcttctcgccgcgggagatgtccttcctgctgaggctcattcccgagctagtgcagtagcgtggtgttgttgctggcggaatttctgccatggattgacccggcccatttgtagatttatcaaccagcgtcgttgacttctttttttttttctttttgtctgtcaactgaaatcgaaaaggttgtaggttgcatttgtaatatcccctgtacatgaattagaaacactgtagcttgcatcagtgaaatctgtagtcctctctttatccg

SEQ ID NO: 4718 - DNA, 1037 bp, Sorghum bicolor
  Clone ID: SORBI-28MAY03-CLUS86678_1
gacttcccactccccgaccgacgcgcccttttccccctcatccaaggaagcgcgccgccgtgcggcctccgatccgcggcgcgtcgcgtccgccgatgacaagggcccacctaccggcggcggcggcgggggcggcgcagcggcggccgacggtggctctgctgctgggcctggcgctcgccttctgcctcgccgtcctctccatccagtcctccttcttcgccgccccaggggcgccgagcaggaggctggatctggacgccgacgacgtgcgcgagctcgcggggttccagtcccgcgtccagcagtgcgtggccagcagaggacttggtctcacagcagatattattgatcattgcaagctggtccttaaatttcctgaaggaaccaacagcacctggtataacacccagttcaagatttttgaacctctagaatacaagtatgatgtctgcgaagctatcctattgtgggaacagtaccgcaacatgacaactgtattgacaagggaatacttggatgtgaggcctgatggatggttggattatgcggctaacagggccccacggcttggtgctgataaatgctacaatcgtactctctgtgatgagcttcttagcattttactgcctgctaaaccccctttccatccacgccagttcgcgacgtgtgcagttgttggtaactcaggagatctcttgaaaacagagtttggacaagagattgatgcacatgatgcagtgtttcgggacaatgaggcacctgtgaataagaaatatgctaaacatgttggatggaaaagggactttcgactggttgtgcggggtgctgctcgaaatatggcaccaatactgaagggctcctccaatgaggcacttatcattaaaagtttgacgcacaaagaaatcaatgcggtgataaaggaacttccaaatcctgtctacctttttcaaggtatagttttaagaagaggtgctaaaggaactggcatgaagtccatagaactggccctttccatgtgtgatattgttgacatg

SEQ ID NO: 4719 - DNA, 608 bp, Sorghum bicolor
  Clone ID: SORBI-28MAY03-CLUS86742_1
gctccgcctccacgcccgagctcgtcactccggcaaccgagcagaagcaggccggtggttccggtgacctcccgatggcgtctctcgctgccgtcaagaaggtgctggtgctggtgccgatcacggcgggctcggagcccgtggaggcgttcgtccccatcgccgtcctccgccgcgcgggcgccgacgtcaccgtcgcggccgcgggtgccggagccggcctgcgcgtccacgccatgtacggggtcaccgtcgtcgcggacgccaacgtcgccgactgcgccgacgcctcctacgacctcgtcgccctccccggaggcgtccccggcgcggacaacctcggcggctgcgcggcgctggagagcatcgtgaggcgccaggcgctcgggggcggcctgtacgccgccatctgcgccgcgccgccgctggcgctggcgcgctggggcctgctcgacggcgtcaaggcaactgcgcatccggcgttcgtggacaagttcccggcggaggtggccgccgtggacgcgaacgtggtggtcgacggcagggtagtgacggggcgtggcccggcgccggccatggagttcgcgctcgctctcgtggaacagctc

SEQ ID NO: 4720 - DNA, 620 bp, Sorghum bicolor
  Clone ID: SORBI-28MAY03-CLUS8679_1
gcacgaggggcaagcgatcgaaggtcagccatctccttccgcaagagcgagcggtcccctgtgacctcgccgacccacgcgtccgctcctcctcccttgagtttgcgtcaagaactggcttcttggatgcccatttatcggcccttgtagatggtgccgccactcactctggggctcagacgctgatcatccttgttgatacgtcttgccctgggagctctcaccggctccttggccttcttctacccatgctgcggtggatgtgccgcagtaggcagcgtggaaagttccagaaccttgctactttcatcatgtctgctggcgtagctgctgcgtttgcattccatggggtgcactttgtcaagctccagcgccggagtgcctctgcattgttacataggcctcttgcgcactgtgggtggtgtgcgcttcatggttccaagatatctgaaccgcttctgtcagttgatttctcagcacttccttcatacttttggagcttgcaatatgctgtagctcttgaatcgatgtatctgccagctatgattcggcacagcaggctgctggatgggggatctgaagaaatctatcctcacactcctttgtatttggattctggg

SEQ ID NO: 4721 - DNA, 1243 bp, Sorghum bicolor
  Clone ID: SORBI-28MAY03-CLUS86788_1
ggcggacacttcgaacggacaaagcaaagcaatggcgccgccgccgaggtggctacggcgggaggtgttcgtggggctcgcgctgggtcagttcgtctcgctgctcatcacctccaccggcttcgcctcctccgagctcgctcgccgaggtgtcaatgcacctacatcacagtcattgctgaattacatccttcttgcacttgtttatggtggaacactgctatacaaaaggcaacatatgacgatcaaatggtactactacttgatcctaggcatcgttgatgtcgaagctaactatattgttgtgaaggcttatcagtacacgtccttgaccagtgtgatgctcctggattgttggtctattccatgtgtcattgtgctcacttggatcttcctgaagacaaaatatgggctgagaaagttcattggtgttggagtttgcgtggctggccttattttggttgtattttctgatgtgcactcttctgatcgagcaaaaggacccaaccccttgaaaggtgatttgcttgtcattggaggctccatgctttatgccatcagcaatgttaccgaggagtactttgtcaagaaaagcaacagagttgaggtgatggcaatgctaggtgtttttggagcaattataagtggtatacagataagcatacttgagcaaaaagagctcagatcgactcactggactgctggtgcgatccttcccttcatagggtttgcattggcaatgttcttgttctactcaacggtaccaattatactcaagatatgtggtgcaaccatgcttaatctctcactcctgacctcagacatgtgggctgttctaatacgtatttttgcttaccatgagaaggttgattggatgtacttcgttgcttttgctggcacagcaactggccttgtcatctactcgtacaggggctcaaagcagatttccgaagagacagcacaggttacacaggccatggatgaggaggccgcagcggcaaacagcacagcacaagttcctggtgtcggagatggtgggccagcctccaacaaggacttttcattagctgccactgcctcaaggtagtcggcaaccggctgcaaaactagacttgcaagaacatgtatacagtggtggttgatgtagacggttggacaagcctttggttgtgagtgatgttttgctatcagctatgagagaaggggttaggagctaggagaagtacatgtataatatagttcc

SEQ ID NO: 4722 - DNA, 701 bp, Sorghum bicolor
  Clone ID: SORBI-28MAY03-CLUS86158_1
ctctcaaaactactactccaccgaagccccagctgctccatacaactaccctaatttccagtcatatccaagtttccaggacagcacggcaccttctgtcccaacacatcaatcttcattttatcctgcaagtgatggccctgcagctacatcatacactcctgcatcgaattcctctgcccctacacactacctctcaactgctgagtcttcacctcaacttgctcctccagctgtgccaccagctagccagtataaatatgatagcagttaccagccagaagttgagaagattgctgaggctcacaaggcagccagatttgctgtcggtgctcttgcatttgacgacgtatctgttgctgtggatcacctgaaacgtgcactggatcttctgaacaaacccttccgctgaacctcattagctcttggcatcaccgtgcgtgctcttgtcagaagcatcatctgtacatatacaagattggtataccacccatgggatattgccagtttgcatacatacaagacaggggttaccacataaatttaggagataataagcgagccgtgtgggcttttgaagtgacacttacaggaattgtcaaattcaattattttattcagagttttgtgctacgtaacccatcgtattcattcatttgcatattcttgaggtctggtatggtattttgggttggattgtg

SEQ ID NO: 4723 - DNA, 663 bp, Sorghum bicolor
  Clone ID: SORBI-28MAY03-CLUS86177_1
agttcaggtcagaggagcggctcatgctagagcaagccttgttacaggagaaaaagcaggctcggcggggactaagagcagagatggagtcgagagagaaagctggtcgtgaggctgctgaagtgaagatgcgtatggcaatggagcatgctcgtgctgaggcacaagctcactctgagatgttgaatcatggtcctataagggccagtgttgttgcttctcaaggggacaatggtccgagtcatgaaatggtgcaagaacatggtgaagatgggtggagaaattctcagagggatgatgaagagccatctgaggatttcctcaatgatgagaacgaacctgagaatgggaactcagatgggcatgaggactggcgcagatctggggagcttgatctgaactctaggtaagccagttggatttgcacaggttgagtgaactacatgaaaattctaggaaggctacaatatgctggtattgtatctattgttcaactgttgtttttggtgaagatgatttaaccggcctttctggctgtaaacatgccattcaaacaaattagcttctctgctgtttcactatagcaatactagatggtagccatgcgttgctgcgggaacttgtagtatgagagggctaataattgatgaaatgagaaatagt

SEQ ID NO: 4724 - DNA, 613 bp, Sorghum bicolor
  Clone ID: SORBI-28MAY03-CLUS86237_1
acccgccctcccgcgcctttttcccgctagccaacgcacggcaccgcaccacaaggcaaggcgcgcctctgcctctgcccgctctcggctctcgctctgctcctcctcccccttctctctctctctttcagcctgcagcgctagcgagccctcgtcttcccctccccattattcccgggattcccctgttgctgcgtgcgactgcgccccacctacctaccgcctccgcctccgcctccgctcccctctcctctccagcgaaccgcgaccaagcggcagggacgggacgggaccagccgaccaggccatggggaagtacatgcgcaagggcaaggtgtccggggaggtcgccgtcatggaggtccccggcggcgcgctgctcggcgtccgcacccgctcccgcacgctcgcgctgcagcgcgcgcagaggccgctcgacaagggcgacgccgaggacgccgctgcggagtacctcgagctcaggagccggaggctcgagaagccgcacaaggacccgttaccgccgccgtctgcgcctgcgaccaagaggggcgccgggaggaaggtcgccaccgccgccgccgccgccgcggcgccgcacgggctggcggag

SEQ ID NO: 4725 - DNA, 651 bp, Sorghum bicolor
  Clone ID: SORBI-28MAY03-CLUS86282_1
gaattttgatgaaaacaaacctatgtgcaaacgactgaatgtcaaagttcttccttccttccatttttaccgtggagctgatgggctactggtggctttctcctgttccttagctaagtttcaaaagctgaaggatgccattgcaatgcacaacactgctcgttgcagcattggtccacctgttggagttggcgatgttgacttgctggatagcacgagccctcaagagaaacctgcagaagctagtccacggtagattcatcagaatgagctcctccctatccacttctacatccttctcattgttttcttcactctagatcttaatgtaatcagttcagtagaatctaagtaccctcgattcatgaatcacatgcatggattattgtaaaagcattcttgaagccttgtctggttgcaaatcaatcccagggggtggaggggatttaaatccctagcctcccaatcccctttccccccttgtaatggggaacaagcaaacaaggcccgaaagggaaaaggtgtattatagcgtgatgactgtaccttttgctggtcagaagaacctagaattgtacatcattttaggtgaagacgccatgaacattgaagcgcccttgtgggccgttttatgtagtctgtcagtccact

SEQ ID NO: 4726 - DNA, 626 bp, Sorghum bicolor
  Clone ID: SORBI-28MAY03-CLUS8626_1
tcacagtgcatgtgatgaaattgaatggtatgtgagtcccgatttcaattcctcttctactgaagatcatcagagagtcgcaagagggaaagtgctggtagattttttcccaaaaatgatggaggatctagaagacaaggtcactctttggaacctcaaagaaggaaagcttaccttctcattcgacggagttgatgttagacaaaaggtcgaggctatgaagacttcctatgctcgtcacataaaaactgatatggatgcagttcctggaggcattgatatacaacagttggttgtccctcggagacctcgcactccaatggtaccagtgcaggtgaacgagccaccaccaccgcagccatcagacgttgacgactctatggcatcctctgggagtaaatccgattctaaggactcagactaccaccctagtgactctgaggagtaatggatgattagatcttccaaaccagaatatctcgtagcaataattgaaccacgttgtatttgctagcaatcaaattgtttctgcgatgatacccgaatgaggctgcttaattttctggtatttgcatgttgtttgatggtctggattagtgaaaagattctattattcggtttgatgg

SEQ ID NO: 4727 - DNA, 771 bp, Sorghum bicolor
  Clone ID: SORBI-28MAY03-CLUS86951_1
acgtgggcgcgcgcaggcccgcggagtgggacgaggacgaggaccacgtggtggtggcgctggacggcgagcccgtcgacgtcgagccgtccaagggcgcgcggtgggcgtcgagcgccgtgccggggctgaccgtcacgcgcaccgacgccgccgccaacgccgtcgtcgtcgagctcgacggcgcgttcgccatctccgccaacgccgtgcccatcaccgacgaggactcacgcgtccacgcctacggcaagacggggaaggactcgctcgtgcacctcgacgtctcctaccagttccacggcggcctgaccaaggacgtcgacggcgtgctcggacagacctaccgcccggactacgtcaacaagctcgacatcagcgccaagatgcccgtcatgggcggcgccgacaagtaccgctcatcggggctcttcgccacggactgcgccgtctcacggttccgccgtgccggcggtggcgctgacgccggcggcttcacctccttcgcctcgtaaatggcaccacacgcgcgcgctctgatccggaattccggtcgtccatgaaataagccagcatctgatctttgccaacgtatatgtaatacattcctgtaggggccaaggcccctccagttccttaaaaaaaaaacggtatatgtaatacgtctgccgtacgtatatagcgtgtacgctgggccatataaacgtaacagaagtattgtgtattgttttgtatttgtgacggaaatttataatatactaatgcattcgg

SEQ ID NO: 4728 - DNA, 672 bp, Sorghum bicolor
  unsure (1)..(672): unsure at all n locations
  Clone ID: SORBI-28MAY03-CLUS87044_1
gcctaccggatcaggcaggctgctgggcacgtgcgcgtgagggacccagtagcccttgttgagaaccatccttcatgcaggnaaaaaccgtgagggccagaaagtgcttccgaatggccaaagctggaggcatcagttgctacttttgtgctactcctcgaagatattatcagaagccaactcacttctgaagcttcaggatcctaatcctggaaagctttttggcttccgcttccgctccccacctcttcctttcttgttgtcctcactcttgcagtctagagcccacccgaaactttctgctgagcagggtggcaatgaaggtgattctgacattgaattggatgactattctgatgtagaacaagacgatgacgaagaagaatatgatcagcttccacctttcaagcctttgaccaaagctcagcttgcaaggctcacaaaggagcagaagaatgcttattttgatgagtatgactacagggtcaagcttctccagaagaaacaatggaaggatgagatccgcaggttaaaggagatgaagaagagggggaaaactgatctggatgactatgggtatgcaagtatcggtggtgagaacgatcaggatcctcctccagagaatgtatcagttcccttacctgacatggtgctgcctccttcatttgactg

SEQ ID NO: 4729 - DNA, 681 bp, Sorghum bicolor
  Clone ID: SORBI-28MAY03-CLUS87063_1
atggtcgtcatctgagagcacacaacacaactccctcatccccccccatctccagccagccatcatctctgtcgcctacagcttggctactacactcactcacctctaccggcggtcctagtaggtccagctagcagcaatggccatccgtggaggagccattgccgctctgctgctggtggcgctgctggcgctgtcgtcgtcggcgtcggcgcagtttgtctcccggaggcccagcaagcagcccccgaggacgtcgacgccgggggaccccaagaagcccccccgcaacggcaagttcaccaccgtcgtcgccaacaggcaccacaagcgcaactaccagatcacctgcaccaccgactggggcgcctcctgctacgtcaagtgccctgctcgctgccccaacaagtgcctcgcctactgcgcctactgcctcaccttctgcatgtgtgatctgatgccgggcacctcgtgcggcgacccgcggttcacgggcgccgacggcaacaccttctacttccacggcaagaaggacgagagcttctgcctcgtctccgacgaccgcctccacatcaacgcgcggttcatgggcaaccacaacgccgactccggccgcgacttcacctgggtgcaggcgctcggcgtcaccttcggcgccggcgacggcgcccacagccacag

SEQ ID NO: 4730 - DNA, 432 bp, Sorghum bicolor
  Clone ID: SORBI-28MAY03-CLUS8711_1
atgcccaggcggccgtagccaggtgcactacagcagccagcatcttcctcctccgagcagagcaacagaggaaacaagaatggccatgcccaccttccaccttgctcctgacctgccgcccgtttcccgcctctgcttcgggacgatgacgatgggagagcagagcggggcggcatgctcgctgcgcctcctcgacgccgcctacgatgccggcgtcaacttcttcgactccgctgagatgtacccggtcccacagcgcagtgagacgcgcgggcgtagcgaggagctcctcggccgctggttgcgggcccgccgggccccacgagacagcgtcgtcgtcgcaaccaaggttgccgggccttctgggcagatgacatggattcgcggcgggccgacgtctctagattcgcggaacatcgcagaggcaatcga

SEQ ID NO: 4731 - DNA, 636 bp, Sorghum bicolor
  Clone ID: SORBI-28MAY03-CLUS87195_1
gatcgccatttctccgtcccaaaaccctaggctagtccccccctcggcacctgatcgatcggaaggccatggcgacggcgaggctccgatccgcggcctccctccgcggggctatcctccgccacttctccgtgggtcccgcctcgacggcgcacgccgtctcccgggtcccagatttccatgttcgtcagtctattatgtggaggcatttctcaacgtccaggcctaattctcttgcaaggcatgacaactttggtctggttgcctgcttgcacactcagataagatgggcttcgcaggctgctgctgtcaaagaaactgaagccagtggtagcaagataagcattggacccaaacccaaacagatcaaggaggatgacgaagatgctaacctggtatatcaggggccaatatcatcaaccataaagaaagtgaagcttctctctctgtccacctgctgcctctctgtgtcactagggccagtgataacattcatgacttcacctgacatgaatgtgatcctcaagggagcggttgcatccaccgtcattttcctcagtgccactacaactgcagccttgcattggttcgtgagccccatacattcacaagctccggtggcgtcctggttcagat

SEQ ID NO: 4732 - DNA, 240 bp, Sorghum bicolor
  unsure (1)..(240): unsure at all n locations
  Clone ID: SORBI-28MAY03-CLUS872_1
ccggtccacgattcccgggggaaaaagaagagagagatcctggatgttatagatcaacgggggcgggattgcttcggatcccatgccattgacattttcatcagctagctagctatatacgtacccaacagcataattacttataatacagcggctataattttttttcagcactatttatttgcaaacataactcatcttcaactgggggggggggtcacaataaacacacccncttat

SEQ ID NO: 4733 - DNA, 498 bp, Sorghum bicolor
  Clone ID: SORBI-28MAY03-CLUS8650_1
gcacgaggcgcttacggtcacactggcatagcgacactgctcacgcttcttccccgtgcttgcagttgctgtgcctgtgcctgtgcagctgttcccacactaccccgtcagtctcagtcaccgcattacctcaagaagcagcaatggagttgccaagatccatggccgtgcttgtgctcgtgttcttcgtcctgtgcggagtgggggaggcggcgacgttcacgttcgtgaaccggtgcacggacacggtgtggccgggcgtcctgtccaacgccggcagcccaaggctggagcccacagggttcgagctctcgccgggggaggcgcgcgcggtgccggcgccggcgggctggtcgggccgcatgtgggcgcgcacgggctgctcccacgacggcgccacggggcggctcgtctgcgccacgggcgactgcggctccggctccgccgagtgcgcgggcgcgggcgccgcgccgcctgccacgctggccgagttcacgc

SEQ ID NO: 4734 - DNA, 931 bp, Sorghum bicolor
  Clone ID: SORBI-28MAY03-CLUS86485_1
gcgttctcgtggagccaggcttagctagcccgcgctaccacgtctctcaccttctctcccgtcaccccttcacgcaacccgccgacgccgtccacatctcccaccgccggccacatctcccatggccaccgcgtgctccctctcctttccagatccgctgccccttctctctccctgatctcctagcagggaggatctgagcactcctccaagctcctcctctttgcggtcgcctccgctgtcgccgtcttcttgctgcgcggcgtggcgtcggacgccgccgtgttgctctaccttgactgcttcgcccgctcaggcttgggtggccccgccaaacttgtccccgcccactgcggcggcggaggacgagaggaaggagggggaggtggcgggcacttggcctcgggagtctgctgcttgtcctcggttggcggcggggaaggaggagggacggcgagagtgggaggcagcggtggggagccgaggcggaggagggagaggagcaggaccaggaaggagagcgaggccggggagagcacgagcagcagcaccggccgggggaggtagagcacggcgaggagggaagcggcggccaccgtggcgaggagcaggtgttggtggtggtgggactggtcgccggctgcggtggggagctcttgcgcgtccggcgccggcggggtaggggaaggagctcttgcgcactgaggtgcccgttgccatggttgccgaggtgctcgtccaccatgcccgcaacatgttcgactgaagttccaggagggggtaaaattaccaggtgaaggaagaggtgagtctattcaaactaaaccaagcaaccaaacacatcaattcttagccaagcttagctagtacagggaaccaaacatgtgctacttacattagttaaagttgggcaaagctagcctgtcttagt

SEQ ID NO: 4735 - DNA, 570 bp, Sorghum bicolor
  Clone ID: SORBI-28MAY03-CLUS8655_1
cccacgcgtccgataatagtggctgtggtggtggcctcatggattatgcttataagtttgtggttaaaaatggtggaattgacacagaggaggactacccctatcgtgaagcagatgggacatgtaacaagaacaagctgaaaaagcgaattgtgacaattgatggttactctgatgtaccttccaacaaagaagatttgttacttcaggctgttgcccagcaaccagttagtgtaggaatatgtggcagcgctagagcatttcaactatactcccagggtatctttgatggtccatgtccaacatctcttgatcatgctgtgctaattgtgggttatggctctgaaggtggcaaggattactggattgtgaaaaactcttggggtgaaagttggggaatgaagggctatatgcatatgcatcgaaacactggtgatttcaagggtgtatgatgtataaacatgatggcatcatttctaccaaatcaagcccaaatcctactacttcatcatgcccaggtgcaaccaagtgcagtctgcttacatactgtgcttgaagatccacctgttg

SEQ ID NO: 4736 - DNA, 764 bp, Sorghum bicolor
  Clone ID: SORBI-28MAY03-CLUS86571_1
cgctgtgcgtgtttgtctggattgggatgggggcgtggcccgattcgccaccaccacaagcacggctcctcttttttattgcctccgcactgggatttgctttcgccttgttgcagtagtagctatttccgcgaatcgtcttctagggctcactttacccttcgtttccccacttctccccgcaccgaatccgcccccttccccggccgcgcgcgtccggccgccgattcaggccgtgcagccgccgattccgccgcgaaatcgcgtcctgggtttgggtccatgaggaagcggtgttgatttggaggggaggcttttctactgcttggccgccgacggggaggctccggccggctagccatgtctcatcaaatccaaagcttctcgcggaacaactgtgtgcttctcgcggtgctgtgtggcaagtatgctgagaagcgcgcaccagcagcgaggtctgggctggaggcgaaacggccgcggccgtcgtacccgttcccggagctcagctcggctgggagattggaggtccacaccctgttcaatcctacaccggagcagttcctagaggcacagcgggtggtgcagccaaacttcttgtacattcagggtcaacagctcgaggatgagaaggagattggctcacttgtgtggggggacgccgatgtctctgatccgcaggcgtttagcactcttatcagcccaccattcccaacaatagtatatctggaagttcctattggtgaaaaacttgcccaagcagt

SEQ ID NO: 4737 - DNA, 611 bp, Sorghum bicolor
  Clone ID: SORBI-28MAY03-CLUS8662_1
cccacgcgtccgtcctcgtggagtctcaagggagtctctcagaccaagtggacctaccgacaccgaccatggccaccgccgacatccgcgtctccatcgggcaccagacccgcttcgcgctgcgcctcgccgccgcgctctcctccccgtccccctccgcttcccccgccgggaacgtcgccttctccccgctctccctccacgtcgcgctcagcctcctcgccgccggcgcgggcggcgccacgcgcgaccagatcgccgccaccctaggaggaggaggcgacgcggccgagggcctccacgcgctcgccgagcaggtggtgcagctcgtgctcgccgacgggtccggcgccggcggcccgcgcgtcgccttcgccgacggcgtcttcgtcgacgcgtcgctcaagctcaagccggccttccaggaggtcgccgtcggaaagtacagggccgacacccagcccgtggatttccagaaaaaggctgctgaagctgctggtaaagtgaactcatgggtagaaaaaattacttctggtctcatcaaagagatcctccccccagggtctgttgaccacaccaccaggcttgttcttggtaatgcgctgtatttt

SEQ ID NO: 4738 - DNA, 1252 bp, Sorghum bicolor
  Clone ID: SORBI-28MAY03-CLUS86284_1
actcgtgcctacatatcgttgccagttgctcgttgcaatgacaacgtcggattccagctgaaactgacccacgtcgacgcgggcacgtcctacaccaagccgcagctcctcagccgcgcctcccagcccacgccctacttcgacgtgaagaggtccgccacgtaccgcgccctcccgtgccggtcgtcgcggtgcgccgcgctctccagcccttcctgcttcaagaagatgtgcgtgtaccagtattactacggcgacaccgcgtccaccgccggcgtcctcgccaacgagacgttcacgttcggcgcggccagctcgaccaaggtcagggcagcgaacatctcgttcgggtgtggcagtctcaacgccggcgaactcgccaacagctccggcatggtcggcttcggccgtggcccgctgtcgctggtgagccagctcgggccgtccaggttctcctactgcctgacgtcgtacctctcgccgacgccgagcaggctctacttcggcgtgttcgcgaacctcaacagcaccaacaccagctccgggtcgccggtgcagtccacgccgttcgtcatcaacccggcgctgcccaacatgtacttcctgtcggtcaagggcatcagcctggggaccaagcgcctgcccatcgacccactggtgttcgccatcaacgacgacggcacgggcggcgtcatcatcgactcaggcacgtccatcacgtggctgcagcaggacgcctacgaggccgtgcggcgcgggctggcgtcgaccatcccgctgccggcgatgaacgacacggacataggcctggacacgtgtttccagtggccgccgccgccgaacgtgaccgtgacggtgcccgacttcgtgttccacttcgacggcgccaacatgacgctgccgccggagaactacatgctaatcgcgagcaccacggggtacctgtgcctggcgatggcgccgaccagtgtcggcaccatcatcgggaattaccagcagcagaacctgcacctgctctacgacatcgccaatagcttcctgtcgttcgttccagctccgtgcgacattatatagctttccttgtcaggtcttgcttctttagccttcaataagttcgctgctagtttgttgttgtagctgcattagcttcacacgtagagtagccattgcaatgcactgagattgcagtgttatgttatccccaattctgtagcagaacatttagtgtgccacacgataatcatcatgtggt

SEQ ID NO: 4739 - DNA, 641 bp, Sorghum bicolor
  Clone ID: SORBI-28MAY03-CLUS89978_1
tggaacctttggatccctgcactgcacagagaccataccatggctcaagctcgcgtcgctctggctctgttgtgcgccctgctcctcgtcgccggcgtggcaccgagagccgaggcggtctcctacaacgtcggcaacagcgccgggtgggatcccagcgccgacttgccgtcgtgggccggcggcaaaaccttctacgtcggcgacgttctagtgtttcagtactccagctaccacacgctggacgaagtcgacgaggccgggtacaacaactgcagcgccgcggacgcggtcctgtcccagaacgacggcaacacgacggtgccgctggcggcggccggcgaccggtacttcatctgcggcaaccagctgcactgcctgggcgggatgaagctgcacgtgctggtcaaccagccggcggcgggaggaggagctccggcgggcgccccgccgcagtcgccgccgcagacgggctccggggccacccttgggcctcctaccaccgacgacgacgccggcatcccctacctcgtgctcggcgggtcccaccgagctacggtaggccccttgctggtgacctggctgctcgtattagcagcggctctgcttgtatgaagattgtgaggaagaggtgtttgact

SEQ ID NO: 4740 - DNA, 679 bp, Sorghum bicolor
  Clone ID: SORBI-28MAY03-CLUS8743_1
gcggggaactttatctggccaaaggcaaggacagcctgtatttatttgtaaactcgaaggttataggagtggaacagcatctgggacacgggcagcggactggccagaaactatgcacattgttcgcctcatagcccaggagcatatgaacaacaaacaatatgttggcaaggccgactttcttgtttttcggactttaaatcagcacgggtttcttggacaactacaagagaagaagctgtgtgctgtgatacagttaccatcgcaaactctgctgctgtcaatgtctgacaaagcaggtcgtttgattggcatgctcttccctggggacatggtggtgttcaaaccgcaggtcccaactcagcagacaccaatgcagcagcagcagctacaacaacagcaacttcaacaacaacagttacagcagcagcagctgcaacaacaacacatgcatatgcagcagcaaggcctcccacttcagcagtcgcagatgcaacttcagcaacagcagcagccacagatgcaaccgatgcagcagcagccaacacagatgcaacaccagcagcagcaaccttcgcagatgcagccgatgcagcatcagcagccgcagccacagcagatgcaatcgatgcagcaccagcagcagatgcagcaccagcagcagcagcagcagcagatg

SEQ ID NO: 4741 - DNA, 497 bp, Sorghum bicolor
  Clone ID: SORBI-28MAY03-CLUS8756_1
aggaatcaatccgccccatgcccacatccgtcgccacgcacgcatccctcctcctcaaagccgcagccgccaagcccttcttctccccccgcgcggcggcccggatccacgcccccgccccttctcctcaccctcctccgcccgccggccgccgcctgccgaccacggcgcccgctctcgccgccgcagcccgccggttccggtggccgtcggcggcgcgggggctgtgcgccgcgccgcattccggcggcgaggcgatgggatctgaggcgggggtcggggccaggaagaggccggtgccggcggtgaacgggctcgccaaggacgtgccggcggtgaacgggatgaccaaggaggagcccgccaccgcgccgcccaggctgctcacgctgcccaccgtgcttactattggccgcgtcgctgccgtgccgctcctgatcagcactttctacatggagggtccatgggcagctacgggcacaacaggcatcttactt

SEQ ID NO: 4742 - DNA, 593 bp, Sorghum bicolor
  Clone ID: SORBI-28MAY03-CLUS87563_1
gccggcaaggggctcagcgccgaggacatggtcgtgctctcgggcgcgcactccatcggtcgctcccactgcacctccttcgtccagacccgcctgagcgccccctccgacatcgcggcgtcgctggcgacgttgctgaggaagcagtgccccgccaacccgaccaccgccaacgacgcggtggtgtcccaggacgtggtcagcccggacgtgctggacaaccagttctacaagaacgtgctggcacacaatgtgctcttcacctcggacgccgtgctgctatcggcgcccaacaccgcgaggatggtccgtgccaacgccaggttcgcgggctcctgggagaagaagttcgccaaggccatggtgaagatggccgccattggcgtgaagaccggccgtgacggcgagataaggaagaactgcaggctcgtcaactaggaagctgcgagcgaagctagctttattctcttgagcaagctagaatcatcacgtttgcgcttctgcttttgaggaattgttttcaaattacgtactttttgcttccgtcgcgacgatgatgttgtactttttttttaaagagaattaactctgct

SEQ ID NO: 4743 - DNA, 411 bp, Sorghum bicolor
  Clone ID: SORBI-28MAY03-CLUS8763_1
gtcctcccctggccgggtgtccctctctagtttctacccccaacattggcctgacgcagctgccatgtagcccgtgcagcgttcccactctcggcttcaccggagacggcgaatacttcgcggcaacaccggcgacggcgagtactacaacgggcgctgactgtggtgctggtgccctgttgatagggcagggcagctggcgttcggccatgtagggcaactatacatctttggcagatcttcatcttccgtgggaagatggtaatggagtgcgtgtatatccagaccatctctttgatgagtcatagtagagatgcaatatcatgtatccattatcttcattacaacagcaataatgagaattattagtgaagtgtaaaagataaaaaactaacctaaaaaactatctag

SEQ ID NO: 4744 - DNA, 305 bp, Sorghum bicolor
  unsure (1)..(305): unsure at all n locations
  Clone ID: SORBI-28MAY03-CLUS877_1
agcgtccctctctagggcgcagccagagataggggactgtgaattcaccacgctgaggcccaacattggcagcctgacctacgaggactacttctcagttaaagtggctgatatacctggcctgatcaaaggagcacatgagaaccgtggcctgggtcatgctttcctgaggcacatagaggggggggggttatcgcctatgtgcttgaccttgcagccacncttaatggcaggaagggtgtcccaccttgggaacagntgcaggatttggtctcaaagttggagcattaccaagaaggaatgac

SEQ ID NO: 4745 - DNA, 645 bp, Sorghum bicolor
  Clone ID: SORBI-28MAY03-CLUS93307_1
cttgcccccgccgtcctccggagttcgaaccctccctttcacctgacctccgcctcccgttcgaacgcggcaacgtgcgcccctcaccctgcgccccagcctcggatctcatctcagtaccaacctagtcctactcctttttgtacataaaggaagatgggagcatatgcgacgactggtatgcagatgatggcaacgcgcccttgcatcccagcctgcaggcaaatgcttgggccgacatcagcactgtctgcatttggaagggcaatttgtaccagaactggttttgctagctcttctaaagccacatcagcaggaccactggtttctttaaatcgcaagagggttgttgtgagggcaatgtcgcagagaggtgcccaaggacttcccattgatctcacaggtaaaagagcatttattgctggagttgctgatgataatggttatggttgggcaatttctaaggctcttgctgctgctggtgctgagattcttgtcggtacatgggtgcctgcgctgaacatatttgagacaagcttgagacgtggaaagtctgatgaatcacggaagctacctgatggatctcttatggaaattgctaaagtatatccactggacgcagtttatgacacccctgaggatgtt

SEQ ID NO: 4746 - DNA, 589 bp, Sorghum bicolor
  Clone ID: SORBI-28MAY03-CLUS93329_1
ccatcttgcacccgcaccccctcctctccttctacttttcttcttctcctcatcctcgtcttcagccttagcgagctctcgccattgccaattattctccaaaggagagctagcactttagttaagtaccgcctgcggcgatagatggcgatcccggtgatcgacttctccaagctggacggccctgggagggctgagaccatggcggccatcgccgccgggttcgagcacgtggggttcttccagctggtgaacaccggcatccccgacgagctgctggagcgggtgaagaaggtgtgcagcgactgctacaagctgcgggacgaggcgttcaaggactccaacccaacggtgaaggcgctcgccaagctcgtggacatggagagcgagcagggcttgcccgcgaagaagatcgaggacatggactgggaggacgtcttcaccctccatgacaacctgccatggccttccaaccctcccgccttcaaggagacgatgatggagtaccgcaaggagctgaagaagctggcggagaagatgctgggcgtgatggaggagctgctggggctggaggagggacacatcagga

SEQ ID NO: 4747 - DNA, 565 bp, Sorghum bicolor
  Clone ID: SORBI-28MAY03-CLUS93337_1
catgcgctccggcgagggggccggccgccgcctcctggggctccacacccccgccgaccgcggcgcgctcggcctccccgccggggtgcgccggggccacagccgcctcgtgccccccacccccggcgagctcagcccccgcggcctcaccgacgggctgcccctcgtccagccgtggccgacgaccgcctggcctgtgtgcggactagtccgccgtgctacttacttctaccaacttgttctgcttgtttagctgctgcagacgggctagccgggggcgtcccgtgcctctccctcctccgtctgcttgttcatgttattcggtggcgcgtgctgcgttttgcctggggccttccggctcccggcgttggtctctctccattagttaacttgttgtgctgtgtgcgttgctccgtctgggtcgtgccctcgggcactcaccatcatctttcctgtcgtcttctgggcggtacactggtattttcctgcgctcttccgctctgcatcatccgtccggtcttcctcttgtctgtaaagttgtatttttcttatttttcagttgtgc

SEQ ID NO: 4748 - DNA, 594 bp, Sorghum bicolor
  Clone ID: SORBI-28MAY03-CLUS93354_1
atgggctgtaccggctgcagttcggatccgtcgtcgacgtcgtgctgcagaacgccaacatgctggcggccaacaagagcgagacgcacccgtggcacctgcacgggcatgacttctgggtgctcggctatggcatcggccgcttcgacccggcggtgcacccggcggcgtacaacctcaaggacccgatactgaagaacacggtggcggtgcatccgtatgggtggacggcgctgcggttcaaggctgacaaccccggcgtgtgggcgttccattgccacatcgagtctcatttcttcatgggaatgggcatcgtcttcgaggaaggcgtcgagcgcgtcgctcagctgccgaaagagatcacggggtgcgggatgaccaagggcggccactaaacaactggccctggtagcaatcatcaacaacaggagtccagggactgacgttgttcagcgcagctgtaccgtaacattattgatcgatctcattaattcttttgtttcttcagttctgggggcgcttaaggagaagacacgaattgttgcaataaataattttgttttcatcaatgtttgaaaatgaaacccagatgtt

SEQ ID NO: 4749 - DNA, 655 bp, Sorghum bicolor
  Clone ID: SORBI-28MAY03-CLUS88024_1
acacagaacacgagctccagatcgcacttgcccccgagctagctagccagccagcaagcccactaatcacttggcctcacgaggtagctagctacaagagggcagaggcatgccggaggcgccggtcaccacgatgcgagaggcggcgacggcggcggcggcggcggcggtgcccgagacgcaccgcgagctgctcgagtacatcgagcgcgtgacggcgggggcggcgcaggtgcagcgccgcgtgctggcggagatcctggcgcagaacgcgcccgccgagtacctccggaggctgggcgtggcgggcgacgcgccgggcgccgtcgacgcgttccgccgcgccgcgccgctcgtcacctacgaggacatcctccccgacgtgctgcgcatcgccaacggcgacacgtcgcccatcctctccggcaagcccatccgcgagttcctcaccagttccggcacgtcgggaggggagcgcaagctgatgccggcgatagccgacgagatggaccggcggtcgctgctgtacagcctactgatgccggtgatgagccaggccgtgccggggctggacaagggcaagtgcatgtacctctacttcgtcaaggcggagtcgcgcacgccggggggccacccggcgcgcccggtgctgacg

SEQ ID NO: 4750 - DNA, 684 bp, Sorghum bicolor
  Clone ID: 30975198
atgacacggtgacgacaccctctctcggctacctcgaagccccgctgccgctcaagtcgtcacctcgatcgccggcgtacgtgcgcgatcctgacccgctgccgggcggcagtaatgcagttcctaacgggccccgcctcagtctcctccatctcctccggcgcctcgacgacgccggtgccgctgccgcccgcgcggctcctcggcctctcgaggtccccgcatgcacctccgccgccgcggccgctactgctggtgcttcccgcccatcagccgagcccccgacagcggcttctccgcgcgcgtcgttccatgctcttgtaaatattgccgatggtagaataaatatccatgtcctcatggctcttgcagcatttgcttctatatttatgggaaatgcattggagggtggcctgcttcttgcaatgtttaacttggctcatattgctgaagagtactttacaagtaagtcaatgtttgatgtgagggaactgaaggaaaatcacccggaatttgcgctgttgttagaaacaagtggagaagaatctgtacagttttcaaatctaagttacaccaaggttcctgtgcacgatcttgaagtgggttctcatatcttggttagagctggcgaggctgtgcctgttgatggtgaagtctaccaaggttcatcaactgtcacaattg

SEQ ID NO: 4751 - DNA, 512 bp, Sorghum bicolor
  Clone ID: LIB3476-054-P1-K1-A9
atgcattggagggtggcctgcttcttgcaatgtttaacttggctcatattgctgaagagtactttacaagtaagtcaatgtttgatgtgagggaactgaaggaaaatcacccggaatttgcgctgttgttagaaacaagtggagaagaatctgtacagttttcaaatctaagttacaccaaggttcctgtgcacgatcttgaagtgggttctcatatcttggttagagctggcgagttcttgtattctttaggctgtgcctgttgatggtgaagtctaccaaggttcatcaactgtcacaattgagcacctaactggtgaaacaaaacctttagaaaggacagttggagatgccataccaggtggtgccaggaacttggaaggaatgatgattgtaaaggtgaccaagtcatgggaggattcaacactcaacagaattgtccaattgactgaagagggccagctaaacaagccaaagttgcaaagatggcttgatgagtttggagagtacta

SEQ ID NO: 4752 - DNA, 781 bp, Sorghum bicolor
  Clone ID: SORBI-28MAY03-CLUS8809_1
gccggccacgaccccgcccgacacaagaagctcttcggcgcccggttctgggtcagccgcctcgactgcatcttcgacaacaaccactatgcgaatgatcaacaagtactgaggaaaagaaaaacagagctggggggcatgttctcggtggctaccgtgatactcttccttggattagccacagttctgctgtatcaagccatccacaggcgtaacgcccaagtacatcgagtgaaaccagctaatgctccggatttgctggattttgtgaatgatcttgagtttcacataacaactatctcaagcatgtcttgcgcccaagtagtggcaccttctacaatagcaatgggaacccctgggtttatggacttcagggtgctgcctctgtcgacactcttgacctacacttgccagaacacgagcgaggggccatcaattacactgaagtgcaatggctgccgaatccctccaagagaccactatgtatcctggcagtttgttgacctgccaaggcaaccggctgctgctattggcttccagtttaatttgactgcaaaggaacatggagatgataaagatatgagctttgtgagtggtactttaagctctgataattacgttgatgccaagctgaaaacattcagagggccagattccaatgtgctcaaaattcaattgtttcctcaaatatacaacaaccatcgtggcttgaagctcttgcagccgcttgtccaggacttcactcaagttctaccttatcagatttgagcagcttgaatgc

SEQ ID NO: 4753 - DNA, 1074 bp, Sorghum bicolor
  Clone ID: SORBI-28MAY03-CLUS88052_1
tactggcatcgccatattagcaaaggtggatggacgtttagtacagcagatgatggttggcaagtttcagattgctctgcaaatggactaaaggtgtgtctattgttgtcaacgatctctcctgaaattgttggtgaaccactggaaatcgagagacagtttgatgctgttaattgtttgatgtctttgatgaataatgatggtggcttttcagcatttgaacccacaaggtcttcaccatggctcgagcatatcaatccttctgaggcatttggacgcacaatgatagattacccgtatgtcgaatgtacatcatcagcaattcagtgtctagcactttttagaaaacttaaccctgggcaccgcaaggaagaggtggaaaattgtatcaacaaaggggctgatttcattgagaatattcaaagaacagatggttcatggtacggctcttggggagtttgttttacctatgccacatggtttggggtgagtggactagtttgtgctggcaggacatttgagaatagtactgcaatcagaaaggcatgtgattttctattgtcaaaagagcttccttgtggtggctggggagagagctggttgtcatctcataatgaggtttacacaaatcttagaggtaatcgacatcatggtacgcacactgcatgggccttgctggcactaattgaggctggacaggctgaaagagatccaatgcctctgcatcgggcagcaaagactttactcaacttacagttagaagacggtgaattcccacagcaagagatcatgggagttttcatgcaaactgccatggctagctactcccaatacaggaatatcttccctatatgggctctcacagagtaccgccgtcgggtgttgcttgcgggcaagaaatcggaatgagttaaagcgcttggcgtttgttctacttgcaaaaagatacataactccttaaacttgttttcacagaaaaatcacgaggatctctatgtgcatagaaataatatatgcgtggacgtgcaagtgtactaaaatacacaaaatcaataaagaaggtaacacaagttt

SEQ ID NO: 4754 - DNA, 630 bp, Sorghum bicolor
  Clone ID: SORBI-28MAY03-CLUS88068_1
atcagccccacaggtctccgaccaaccccttctagaagcttccaaaccctagcgcaggtggaagagcagcgtggaggagctccagggatggcgaaggcgaggaagcagaagggtgacggtggcggtgcgggcgcaggcgccaccgtgctccaccagaagctctgcctctccatcgacatggagaaccagctgatctacgggtacactgagataaaagttcttctagctgaaaacgacacatttgctctacatgctgacaatatgacaatcaggagcattctggtggatggtgaaactgttgagtttgactattcccctcattggaaaaatgaaagtgatcaacctaattggtcttcaatatcatgtttgaagactgctgctgatgctgcatgttcaacgtatacttcgtctctaaatcgagaagctacaccaaatcttattgtgtcatctgagagatcagttaagtcaatgactgagcagcagttagatgaaaacagtgaaaagcatgaagaaatcagtggaaggcttgaagaacatggtgcaaagcctgttcaatcttcctatgatcaaattcttaatggctgcaatggttctgcagttgaagagggaatagaaaattctgcggggaag

SEQ ID NO: 4755 - DNA, 551 bp, Sorghum bicolor
  Clone ID: SORBI-28MAY03-CLUS8722_1
gaagagggcaaaggatcttcttggggtgcattatttaagaagcagcagcggaagattcaggtgaatggcataagcgatgatttgctcaggaaagctgcaaggaagatcgatggcttctctgggagggagattgcgaagctcgtggctagtgtgcaagctgctgtttatggccggcctgactgtatattggatccacagttattttcggaggtagttgactacaaagtgactgagcatcaccaacgcatcaagcttgcttccgagggtatggtttgatcaataagaaatatttacctggaagccacaggtttcaagtagagattgggtttggtggtgagtgacaatcacctcccactgactttaagtagtagtgtatgcatgttttggatcccgcaggacattttgtagacggagggtctattaccaccacttttgttccatgtgccttgcctgcagcaagggttggtcccggatggacatccatacaggcctggtcaactgaatttagtttactcatttagtaggtttgcaccgtgttttaactttttcac

SEQ ID NO: 4756 - DNA, 793 bp, Sorghum bicolor
  Clone ID: SORBI-28MAY03-CLUS87289_1
acggcacgaaagcgcaaaccccaactaaaaagccgccaggcaacgagaaaacgcaacgcgaagcaaacccaacatttcggcgtcccgatccgctcttcccctcacctccgaggctccaggaacggcgggatgaggccggcggcgacggcggcggcggacgcgcaccagtcgcggctgctctacgagctctgcgcgctcctgctcaccgtcctccgggcgtcgccggacgacggggcggtggcgcggccgctgctgccgcggcaggtgacgcccgccggggtggcgtccatgctgctgggcgcgtccatggcgctgatgctctgcggctccgtcaccttcatgctcggcttcttcctcatgccctgggtcgtcggcctcggcttcctcttcctcttcgtcggcttcgtcaccaacctctccgggatctggagggccatcctcctctggccctccgccgcggactcgcccaaggaggcatcctccccatggcatatattttccaagccttcattcatgtcgatgtgaagccagctacaaagtaaggctcccacggaggtgtatagaagcaggggagtttgagcagactgttgtcgttgccaacctatattttccttcctggacaacctccttttttaccatgtaacaccgcagcaagtttgaaatggttttatactgtgactaggaggatacttgtttgtacatacggaaaagatgatctggtctaaacatcacgtggagcttataatttttcagaaatgttgttccttggtgaaaaaaaaatagaagaaatctc

SEQ ID NO: 4757 - DNA, 535 bp, Sorghum bicolor
  Clone ID: SORBI-28MAY03-CLUS87373_1
tggattccctgcgcaacatggtggagccgattcggacgatgcagatccgccccgtgctcgcccaaatcatcaccctagggatgatcctgacttcggcattgatcatatggaaaggattgattatcgtaacagggagtgagtcaccagttgtggtggttctatctgaaagcatggagcctggatttccaagggttcattcctcctttgcacaatacaataatcagcactcctttgtccagctttacattttacatcttacagaatccccatgaatgctggtgatttttatgtccaatgtgtctgtttttttttttcactctcttttggtgctatggcataccacagcacagggaagattgtgactaattaacctgaatttcagcaacttatgcacaatacaaaaatttggtcgattgtttttcagcaatatacgagtttcatcggaaacttataaaatttccatagccatatttgtgccatctgctgatgggcacaacacattatatgtgggcattttttactccatagatcttac

SEQ ID NO: 4758 - DNA, 587 bp, Sorghum bicolor
  Clone ID: SORBI-28MAY03-CLUS87392_1
cagaaagacaaccttgatctgacagaactgaaccacagatgtttcatttggtttttggaatgtgcacgcatttagaagaatctcacatgcacggttgcaaaccatctaaagttcaaccaacaagctcaatatagtactgttagatccattcaaattactctagcacccaacttagcaacctcacaataacagcatgctagttgataccttactctgcagggaccatacagttggagaaaaacaggtaatctgaaaataaatgtctacacttggctgactacaaactcatactccacagcagtttctcatatttttctccacttgcctaatacatggttgttatatttttaggaagtgttgggcagtctttgacttcagtctctggaaagtggttctccacataacatggtgggtgtactctaatgttggcaagccattgcttttggttttttagttcctagaatggttgtgtgcacaaaccttagtatgtttaacacaaaatactagtattgcttgctaggagtgtatttatgtaatcttttggagggaagcttctttgcattgcaaaataagtcaagggaaaggat

SEQ ID NO: 4759 - DNA, 617 bp, Sorghum bicolor
  Clone ID: SORBI-28MAY03-CLUS8739_1
atggtgctgtggcaggttcattcaggggaagagggaggttatcaataaatgagcctataaaggactatgctccacctcaaaatggcatcaataggaattttgatcatgttgacataccaaacacagaaagtgttgttacggaggtggaaagggtattgtccaatccaaatatgcctgaaatcgagaaggcaaggaaactgctgaaagatcaggagcagtcattgcttgatgcaattgccagacttgatgaagcatcggatagcgatagtgaagatatggccatggaaggccgaatgggttctgctggggaaaggaacggtattgctacttaggtgctgtttggttgtattcggtaacgtaaatggaaaaggattgaagctatggatgttacggcaagacataccacttgaacaaatttcatttccatttgcgctacagatgtacgaaccaaactgcacattagttgcttctgccatgttggaattggaatattaacatgcatttgtgtaccacctacctcgaccacagaacaaagaaaccgcattatggcaaatctgggtaaaaaataaaaaaataattataaaaaataaaaatattttactttataaatatataaa

SEQ ID NO: 4760 - DNA, 696 bp, Sorghum bicolor
  Clone ID: SORBI-28MAY03-CLUS87425_1
ctcttcaggaggcgggcgcgcctgctctgccgcaagtgcggcggacgcatcggcaacgcctacgaggaggaggacgacgccagggactactccagctccagcctcttcgacggcgacggcgacggctcctcggatgacatgcgccggagctccggcttgggctcgggccgcagcagcatcgtgtcgtcgagccagaagaactacgtgatcaagatcagcgcgctgcagccgtcgtcagatgattctgctgctgttgttcccttcacacatcgatgatggcaggcgtcgagttgctgttgctgcaccgtgttcttgttgaatttgaatttgctgcaacctggggatggggatgcgagtggtgtatgcagtgctggaggacaaaatgcagcaagggaacatcttggcatgcctagactgttcagaggtttgatcatctgcatgctgctttcagtcatcttgctgtttgtagtggctctttgtttcctctgtacatcggtaagtttgcagcgacatggttgttgaaattttgcttggcgttaggaaaatgattaagtttgctgtatttcgattgatccatagtgtttgtattaagtcatggaattgcaattttgattagtcatctcacttgcatgtgcgaatgattgagctttatagctctcttcctttctcgagaaaaagccatatactggtacaatg

SEQ ID NO: 4761 - DNA, 712 bp, Sorghum bicolor
  Clone ID: SORBI-28MAY03-CLUS88313_1
aaaaaaaaaaaaaaaaaaactcgctcactcgaacgcgccgtcgcggtcgcgcctccgaccctcccgcccgcactatccaattcgcggggagatttggccggagacaccgcgcggaaccggctggctctctcggctcgcgtgaaaggcgcagggagctaggcacgccgcacgtggtttggtttctctcgtcttctgccaccgacgcttcccgtgatcagaatcccgcgaggggcaggtccaggtccagcacgcgccgcgcgaggcgctgttgctctcctctgtttcttggtttcttgcgctgcgcttgtggagagccgtggcggatccagccgccggcctagccggcaccggcaggacctcgatgtcggcctcggcagcgggggcggaggcgggggcatcggcatcggcatcggcattggcggcggcggcggcagcccttcgccgccgtcgtcgtcgcagccgcggccgtgcgacttcgagaacgagcggctgtaccgggcgtacctggtgatccagcagttccggagcacggtgacgtgcgacccgatggacgtcacccggagctggagcggcacggacctgtgcggcggctacaagggcttcttctgcgagcggccgcccaacgtgacggaccggaccatcgcgtccgtcgacttcaacggctacatgctgcgggcggactccctgcagggcttcatcaacaacctcccgg

SEQ ID NO: 4762 - DNA, 592 bp, Sorghum bicolor
  Clone ID: SORBI-28MAY03-CLUS8841_1
cccacgcgtccgcggacgcgtgggcttgccgcggccgtcgatggagaacctccacctcgccatcgcccaccgcccgcctctgccggtaccggcggcgggccacctccgccgccgccacctccacctccaccacctccccgccccactctcccttcccagcacctcccactccctttcctccccgcatcatcaccgccttactcccacccttcgccgccacctccgcccgcctcttcgcgtctcccagacccctgatgctaaccccgagcctgagcctgagcctgagcccaagcccgagcccactggcgcgaagctagtgccgttcgtcatctccatcgccgtcggcctcgccgtgcggttcctcgcgccgcggcccgttgaggtgagcccgcaggcgtggcagctcctctccatcttcctctccaccatcgcggggctggtgcttggcccgctccccgtcggcgcgtgggccttcctcgggctcaccgccggcgtcgccactcgcacgctccccttcgccgccggcttctccaccttcaccaacgaggtcatctggctcatcgtcatctccttcttcttcgcgcgcgggttc

SEQ ID NO: 4763 - DNA, 649 bp, Sorghum bicolor
  Clone ID: SORBI-28MAY03-CLUS88428_1
ccagtgcacccgcccacctcctcgagcgactccgactcccgaccgagccatccactgttccagacatggcggcgaggcccgtcgctctgctgctgctggtgctcgtctccggcggcctggccgcgtcgtcgtcggccggcgcgacgcagttcaaggtcggcgggcagaacgggtggggcgtgccggccgccggcgccgagtcctacaacacctgggcggggcggctccggttccagatcggcgaccagctgctgttcgtgtaccccaaggagacggactcggtgctgctagtcgacgcggcggcctacaacgcctgcaacacctcctcctacatcaccaggttcgacgacggcagcaccgtgttcacgctcgaccgctcgggccctttcttcttcgtcagcggaaacgacgccagctgccgcgccaacgagaagctcatcgtcgtcgtcctcgccgaccgctccggcacccgcacgcctcccgcggcgccgccgacgtctcctcccacgccgctgcccagcccgccctcctcgcctcctgcgcctgcgacgagcccgtcgtcgtcgccaccctcgggcagcgctgctcccgtgccggctcccgcggccaccccgacctcgccgccgtccccagcagcttcggctccggc

SEQ ID NO: 4764 - DNA, 811 bp, Sorghum bicolor
  Clone ID: SORBI-28MAY03-CLUS88449_1
gcacgaggctccactgtacgccctgcacgtttacgtggacccgaaatttattccgtccctctggtgcacaaagaccaggcgtacctgatcgtgcttcacctcgaaggaatcgaccccatcaccttcctcctcgttatctcgcagccgccgccgccgcaaaccctaacctgagttccgatccggttaatcgacgacgaggaagacgacggtgggttgcagatctgaggggatccgacggcggcggagggggagatggtggtgaacggccggccgctgaagagggcgagggcgcgggtcgaggccacggacttcgctaggttcccggcggccggagactgcggggcggccggtacgttcagggaggcggtgagggggttcctcgcaaagcatgcgaggctgctcccgttgccgtccatcttctccccggcggccgcggccgccccgccgcgcctgctgatctggagggtgtccctaagggtcggggaggcgggggaggaagagagcggcggcagggtggagctcaacgtcgttgaggaggatgtgctccgatcccgatccgtgtattgcgaccagcgcagagtcgtgggttggagtgggcacccagtctgcgtgaagcggtaccatttcatcatcgagaatgatagcctttctgatcgccggcgcacctgctgcctccgctgcggaacacccatggcagctggagaatcaaggtgtgctctgtgcaatttcgatatggatggtgaggaggtcgaagagtgtgcatatctgcatctggatgactcatctcacttgctgcacgctgtagtgcatg

SEQ ID NO: 4765 - DNA, 640 bp, Sorghum bicolor
  Clone ID: SORBI-28MAY03-CLUS88467_1
agcagaagtctccaaatgcaccgcttcttcctcctcgtttctgcactcgtagccatagccaccaccacgctttccgccgacaccacctccaccattgccgctgcccagagccagaggtcatgggctgagctcagcgggcgggacaactgggacggcctcctggacccgctcgacgccgacctccgccgcgccgtcatccggtacggcgagctggcgcaggcgacgtcggacgcgttcatcggcgacccggcgtcgccgtacgcgggcgcgtcgcggtacgcgcccggcgcgttcccctacaggacgcaggcgcccggcgggtccgacccggacgcgtacgccgtcacgaggttcctctacgcgacgtcgagcgcgcgcgtccccgtccccgacacgttcatcacgcgcccggcgccgccgggggcgtggagcgccgagtccaactggatggggtacgtcgccgtggccacggacgccggcgccgccaggctggggaggcgggacatcgtggtggcgtggcgcgggaccaagcgcgccgtggagtgggccgacgacctggacatcacgctggtgccggcgacgggcgtcgtcgggccggggccagggtggtcgcagccggcggtgcaccggggtttcttgt

SEQ ID NO: 4766 - DNA, 622 bp, Sorghum bicolor
  Clone ID: SORBI-28MAY03-CLUS87776_1
gaggtttcagcttaataagaagaagagatttgctggccatattgtggcaggttatgcttgtcaggtgaacttctcacctgatgggaggtttgtgatgtctggtgatggtgagggtagctgctggttctgggactggaaaagctgcaggagatttaagactttaaagtgccacaacggagtttgcattggatgtgagtggcatccattggaaactagcaaggttgcaccctgtggatgggatggtgtaattaaatactgggactgaagtttggcagagagattgcatgagctcatggtaaaggttttgtaacaatccaattcacaagggccgaatgtcgtgagatactgtaagtcaacatgctcgacgagagaatcccagtttgatgcaggagaaaaatgttgtgtttttgaggttacatatatggccctgctaaatgttgaaatgtacaatactcgccccagattcaaattttgagttgtatctttggcactagcaacttgtttgctgtttctggtaatcctgttgcttccaacttttgtagcatccgaggaaagtgtgttgtgctccattttattataaattagatagcggtctttttaatagctacagccaagtgaacgg

SEQ ID NO: 4767 - DNA, 613 bp, Sorghum bicolor
  Clone ID: LIB3481-057-Q6-K1-E11
gtgctctgttctgaccacccctttgcgggagtgggccgcttctccctcgagaaatgctctccagttcatcaccctcttattccttcatacacaggccatcatcagacgagagggagaatcagcagggagtgacaagaagatgctgaagaaactgctgccaaagactaagagcaagaggagggggggggctgcctcctctgccatacccacgttggatcggctccatgagaccctagaaatgctggagaagaaagagcgtttcctccagaagaaatgttctgcagaaatcgaaaaggctaaggattatacaaaatcgaagaacaagaatgctgcaattcagtgtctaaagaaaaagaaactgtacgagacacaaatcgagcagctatcgaattttcagttgcgagttcatgaccagattataatgcttgaaagcgccaaggcaactaccgacactgttgatgctttgcgctccggatcatctgctgtgaaagctattcaacaatcagtgagcatcgacgacatcgagagcgccattgaagaggcgaacgagcagacggagaacatgcgggagatacagcaggcgctcgcgaccccagttggcgcttctgctgac

SEQ ID NO: 4768 - DNA, 531 bp, Sorghum bicolor
  Clone ID: LIB3476-053-P1-K1-G1
gtattcactcacacggcagcgccacctgctccgcggccccatcggcgatctgctgcgcgctccgtcccagtcccaggcacgcggcggcgggctgcggctgcggctgcttctgcttcgaggcgaggctgttggttcttggcggccgtgcttgacccctgcggggatccgactccactggtgctacttctggatttctcaagcttgtttcgttcggggccatcatcagacgagagggagaatcagcagggagtgacaagaagatgctgaagaaactgctgccaaagactaagagcaagaagaagaaggaggctgcctcctctgccatacccacgttggatcggctccatgagaccctagaaatgctggagaagaaagagcgtttcctccagaagaaatgttctgcagaaatcgaaaaggctaaggattatacaaaatcgaagaacaagaatgctgcaattcagtgtctaaagaaaaagaaactgtacgagacacaaatcgagcagctatcgaattttcagtttcgagttcatg

SEQ ID NO: 4769 - DNA, 623 bp, Sorghum bicolor
  Clone ID: SORBI-28MAY03-CLUS8780_1
cggcggcggagcccaaggtggcgtcggagttcccgctgacgctgacgaaggaggcggtggacgtcccgtcggtggcgatcccggcgaagcagccagggaaggacctggtgctgctcatcgagggcatcgagtacgacccgcagatcaacaacaagttcgacgtgatcatcaacgtgcccaaggaggacgccggcaaggtggggcccaaggactgcgagtacgccggcagcttcaccgccgtgccgagctccaacgccgccggcgggacgctcgtggggaaggtcacgctcttcatcgacggggtgctggccgacctcgggctcaccaacgagagcgccgtcgacatcgtgctggttcctcacaccgacgaggagatcaagatctacctgccgccgaccatcgagaacgcatgagaacgcattgctggctgttatcttcgccgcgccgccgccggccggtgactgagcagcggcggcgatttctttttaataaggtttaaaaataaattagtaaaatgttctactcctgccgtttgattattgtgtttgtaagtttttaataaactggatgaaatgaaactccggcacattgcggcgggacagtaatatatggaatgcatgatt

SEQ ID NO: 4770 - DNA, 1019 bp, Sorghum bicolor
  Clone ID: SORBI-28MAY03-CLUS87932_1
gagccgcaacgccacggcaaccaaaaccagccgacgaccgttcgtacaacccaagaaggggcgcaatgccggcgcggcgggggcggcccaggaagggcgaccgccggatcgacgcggccatcgaccacttcaccgtcatgggctacgcggcgcgcgacgttaaggccgtcgtcactgatctcctcaaggtgtacgggggccctgatgcgtggcccttactggaggaaggtggctcctaccaggttgtgcaagagaggctcttcgagatcgaggagaaggagaaggagaagaaggaccagcagctgctgctggagtatcaccaacagcaggatggccagcaagtggaggatgagcttcctcagcaccaagaaccagcagcagatgaggaagcggaagaccctatgttcattgaaccacaagataccatatcaatttcaaatgaggcaccagcagagactaagtcagcagataaggaagtggaagaccctatgttcatcgaaccgcctgctcgtgaagctgcattggcacttaatgctgctaggactggcccaaggcgaccctgctatggatggcttagtgagtcagaagatgaggaagaggaacaacctacttgtcaaaaacatgaggtgcatgttccaagtccaggagagcaagcccagtagatgggcggctgataccaacctgtcaaggtccatgatgctccactaagatgcagaagtcttggtgtcgcagaccaaaaactttactttcagaagccttttacacaaggctaccagtatagcagaagtatctgacaatatagaacgtgtgcttgatgtgtgttaagtaacaatatagaacctgtgtaagtagagcatgttccacctgtttaaatgagagccaactttgattggagcagtctgcagtgacataatttgagaagctgagaataagagcttaacttagattgaagtagtgacataattttagaaggtgagatgatgtttaatcggttaatctaggcgttgaaatgcttatgc

SEQ ID NO: 4771 - DNA, 658 bp, Sorghum bicolor
  unsure (1)..(658): unsure at all n locations
  Clone ID: SORBI-28MAY03-CLUS87971_1
accgccgccccagaatttcccccccttcttcgtttgcggaaaacgagagcgcccaaacgaattgcgaagtctgaggcgccgtcagattccagaagtttccatcgccgtgacgatcgtgcgtagcctgcgcattggtctggttgtcggcgtcggtcgagtcgtggggtgcgcggtcgtgcgagatcgaggcggggagctcgcgaatcggaggccgcggggcgcaatgctgcgtcggtagggatggcggaggcggcgccatggcgaggggcatagcgcgggcggtgtcgttcgggggccgcgccaccacggggtggtgctcctaccggcgcgtcaccgtggccgtctgcctcggcaaccttgtcgccgcgttgctcgtgctccgctccctcaccgcccccgcttccttcgcgcccaccgctcccaaccgcgtggaagtggtacagtatacggaggagcagattaggagcgtggaggagtcgatccggattcgccgcgaggcggagccggttgagctcgttctggcggtaaagaaactgcggaagaaatttgcccaggaggagaagcggcgacgggaggagctgccactggtactgaagcagaaggtttcttatgatattgtgcggcggctgcacgacttgngggataatggcagcctcgc

SEQ ID NO: 4772 - DNA, 631 bp, Sorghum bicolor
  Clone ID: SORBI-28MAY03-CLUS88651_1
agggtttgggaagagaggagagggaggtggctcagagacagagaggacagaggagggggagacgctaggagagggtcggagtcggcagggagagacagagaggtatgggaaggggtaatttttcttctattgcttaattagattgatcacatcattcttgcatatatagttcctattggactatcccaagcaactacgggagatccttgtagattggattacataacaaaccatactctaatatggtaaacctcctaacctaatcccttccgagccggctagcgcccctacttgggcttccctagtcccgttagctctaggttaggggcctctcattagacgaatggcaccatcaatcctggataagcatcaggtctcatgtttgcttgatgtcccgacaacctcgctatatctgcattgaattgcctaacgatgtacaggaactgtggacgttgacggcgacctcaagatggaacaatttgatgacattatcacataatagttcattccccttgggacatgatgataagcacgtttgtcaagttccttgtccctgaagcatcacatgtttgaccacaattgtttatcgatgataattcttgtttaataaggttacttgataattatgcct

SEQ ID NO: 4773 - DNA, 619 bp, Sorghum bicolor
  Clone ID: SORBI-28MAY03-CLUS88674_1
ggatggagctggtcgaagttggaccttcaatggatctggttgtaaggaggcacagacttccagttgaaagcttaaagaaagaagctatgaagactgctgaacatgctaagaagatgaaaaatgtcactaaggatccagtgaagggcaagctgggcaaggtctacatgccagaccagcaggttggaaagttgaccttatcaaacgacgtaaagggtctaaagagggagcgccgcgaagccaagaaaaacaacgaggactcgaagaagcaaaaggtcaaccctgagtaaagatcgctgaagtttacctttgtcttggatacaaaccagattaagaaaccctggttgtaactgttcccaactgctgcgttatccaagtggaagccgcttgctgtcagattatgtggtaaatagtttagtgccatcttcttaggctatttgtacgacttacacaacagtttttgtgtaccaattcatgttaagacataagcatggaaattttgagaatgttatcctacagtacacttgctagtcctgatgtcactggtccatgatggatgtgctttgccctcacgaattggatggcatttctatgattctgtcaatgtggttcaagctgtaac

SEQ ID NO: 4774 - DNA, 682 bp, Sorghum bicolor
  Clone ID: SORBI-28MAY03-CLUS88709_1
tttgaatgatacacagaaatgcaagaagaagaagaagaagaagaataagactcgggagcaacaggagttactacctgatttggattccacagcggcagcagaggcagagggacaagtagaggcaaagggaaacgaggtggaggagcatgaggccaccgatgctactgcttctgcaatggaggggacaccaaaatgtaatgaggaggattccaaaatgaaggtcagtttgatgcctgagaaggaagccaacaccattgttgttccagttttggagagtacaccaaaacacaagaagaggaagaaaaagaagaacaagatgcaggggcaactagattctgcaaaggcatcacctagtgttgttgctgtggatataactatggccgctcgagctgaaaatggttgcacagatgtggtaggggcatcaggacatgctgatgttaatatggatcccataaatggtgatgatcaaagtagtgctcagtcaaaggcaaatgattctgatgttttactgaagaataaggatggaaacaaggtaaataagaattgcgctgagtacagcggcttgttgcaggagagctctgcacgaagaaaaagacgcaagggaaaaagaaagtgggcttcagacaatggaggaccaggcttctcttctggaaataagaattgcgctgagtacagcgaattg

SEQ ID NO: 4775 - DNA, 618 bp, Sorghum bicolor
  Clone ID: SORBI-28MAY03-CLUS8872_1
gcgcacacgcgtttgcataggtggtgtagagggtctgcaaacatgcttggtgggtttactgtcgatgtcaaggtggtttaaacctgctgcaggatcgtttgtgaaagtgccattttttggagctgtttcataccttacattggcagtttgtccgttttgcatagtatttgctgttctgtggggtgtttaccgtcggttgtcctttgcttggattgggcaagatattcttggtattaccttgatcgttacagtcatccaaattgttagaatacctaacctcaaggtgggttcagccctcctgagttgtgccttcttatatgacatcttctgggtttttatctccaagatgatattccatgaaagtgtgatgattgtggttgcacgtggtgataagactgatgaggatggtgtacccatgctgttaaagattcctcggatgtttgatccatggggcggatacagcatcataggctttggtgatatccttcttcctgggctgttggttgcttttgcattaaggtatgattgggctgccaagaagaccttgcaatctggctactttttgtggtcaatggtggcatatggttccggtctcctaattacatacgtcgccttgaa

SEQ ID NO: 4776 - DNA, 626 bp, Sorghum bicolor
  Clone ID: SORBI-28MAY03-CLUS8876_1
cccacgcgtccggtgggtgggaatggtgaatttgcccctgatggcaatggggaaaagcagaagggctcgcctggaggccaagtgccccgtcttaatgaggcgactggtgcggagcacgagctgccattcgagttccatgtgctggaggttgctcttgaggttgtgtgctcatcgttggaccttagcgtggcagaccttgagaggcatgctactccagtgcttgacgagttgaccaagaatgtcagcacgaggaaccttgagcgagtgcggagccttaagagtcatcttacccgtttgcttgcccgtgtgcaaaaggtcagggatgaaatagaacaccttctagatgataatgaagacatggaacatctgtatctaacaaggaagcaagtacaaaaccaacaggttgaggctttaatgtcatctgctgcttccaacagcattgttcttgccggaacaggtgtgcccaggctgaactctagctttcggcgtagcatgagcattgctaccagcatgcatttggataatgatgtggaagacctagaaatgttacttgaggcctacttcatgcagctggatggaatccgcaacagaattttgtcggttcgggagtatattgatgacacaga

SEQ ID NO: 4777 - DNA, 1225 bp, Sorghum bicolor
  Clone ID: SORBI-28MAY03-CLUS88181_1
gcacacccccgctccttcgtgcgcgctctgcttcccttgccgccgtgggctgcgcgggccgcgcgctgcttgctgcttggctggccgtcgatgagcatgggacgcttcgtcaactccatggatccgaggtcggggctggaggtgatcagggactggaacggcgtcgcccaggtcgtgctccgctcgcccaagggagcctccgcgcgggtgagcctgcacggcggccaggtcgtctcctggaggaacgaccgcggcgaggagctcctcttcaccagcagcaaggcaatcttcaagccgccaaatgcaatgcgaggtggagttcagatgtgtttcccacagtttggatactcggggacattggagcgacatggatttgcaagaaacaggatatgggccctggatgatgagcatccaccactgactcataatgataacggcagcaaagtttctgttgaccttatactaaagccatctgaagatgacctcaagtgctggccacattgttttgagttccgtctgagggtctctctttcaaaggatggggacttgtcattaatatcacgcatcaggaatgtcaatggcaagccattcagtttctcatttgcttatcacacatatctttctgtttctgacatcagtgaggttaggattgaaggtctggagacacttgattatcttgacaaccttagccacaaagaacggtttacggaacaaggagatgccataacatttgagtcagaggtcgaccgagtctacgttagctccccaaatgtagtagcggttcttgaccatgagaagaaacactcatttgtcataagaaaggaaggacttcctgacgttgttgtgtggaatccatgggaagagaaatcgaagaccatgatagacttgggtgatgaggagtacaggcagatgctttgcgttgatgcggccgctgtggagagagcaatcacgctgaaaccaggggaggagtggactgggaagctggagctttctgcagttttatccaccaactgcagcgatcatcttgatcaccctgtcagcatctagtgtttaatcacattttagtgctatatatttgcctcacgagagaagtatgggccccttttgtaaatgagatcaataggtaggtctattattagttaacagctcgacttgattctggaatcggcacaattctgtgacctggttttggaatctcaataatgaatgataatagcgcctgttc

SEQ ID NO: 4778 - DNA, 637 bp, Sorghum bicolor
  Clone ID: SORBI-28MAY03-CLUS88185_1
aatagataaccaaaccaaagaaagaagttgagttaggtgacacatttattgtttcagaattttgctaagatagctttttaattctaaatatcactgcaatagtcatcacatgctttatataatcgttttttctatatgagtattttaggagttgttgggataggtttttgagctaaaattctcaaaatcttcactcatttaaacacttcattagcaaagcaactatgttgttactatacaaatctttagttatttcactgaatatttggtgttaagagcatggtgatgtgccatgtataatttacaggcaatcatgtatactctttagtccttactaaacctattactactatgcactgttatattcattgttgaatcacagatgttctagcactaatatcaaggcatactattggtgcacttgagcttggagactatcttgttgggttcatcacccaaagtaaaaatatttcctttattcatatgtagttctttattttccaatgtatgtaatttcaacctttggggtaatattctcagtgccagactcggtttgcaccttgcagttgttaagccaagatgagacatcctcttgttatctgtttggtgtttggtactgtaaagttcccatttttat

SEQ ID NO: 4779 - DNA, 1006 bp, Sorghum bicolor
  Clone ID: SORBI-28MAY03-CLUS8819_1
cccacgcgtccggcagcagctgctttatccaacatgggcaacttcctcactgaaatgagcagtgattcttaccagcttcttgggatggctgagcgtggcatgctccctgacttttttgccaagagatctcaccatggaaccccgcttatcggcatccttttctctgcctttggtgtgatcctactatcctggatgagcttccaggaaatcattgccgctgagaactacctctactgctttggcatgatcctggagttcattgccttcatcaagcttcgggtgacccatccgaacgcctctcggccctacaagatacctctgggcaccattggtgctgtcctgatgatcatcccaccagctgtcttgatcatcgtggtgatggccatcgcatcctacaaggtaatggcggtgagcatcttagcgatggtcattgggttcgtgctgcagccatgcctagggtacgtggagaagaagcgatggctaaggttctccatcagtgcagacctgcccgatttgcctgatgcacaggaaactgctgaagatgatgctgttccactcgtattctaaacttccaatattccactgtggaggtgttgttcccaatcgaggcattgtaggacggaatgtgatactgggattctcaacctgtatctcctggatgagttccaaagccagcaatcttagacatgttgtataatgatgcattatgttgtcaccatgctattggagacatcatgatggcatcaaacagaaatgtaacaccaccaaatacttgttgcatctgccgtcagctgctgcttaactcatttatatactagggtagatccatgatacgacatgaggttgctcatctggaaataggaactcttgatacaagtttcgcctttaaataggagaacgtgaactcttgacctggttgcctggttttctttatgggggaactgttatcagtaattcgatcttttatgtacaggtttgtgttataaatggagcatcggtataattg

SEQ ID NO: 4780 - DNA, 483 bp, Sorghum bicolor
  Clone ID: SORBI-28MAY03-CLUS882_1
aacggccacaccctcaccgtcaaggtcgtcagcgccacccgggtgcgcgggcgcgcgcgcccaggcgcacccgccgccgtcccatcccgcgccccgcgcatcgccgagtgcctcgtcggggacgagaccggcgccatcgtcttcaccgcgcgcaacgaccaagttgatttactgaagcccaatgccacagtgatggggcgcaacgccaaaattgacatgttcaaaggatcgatgaggcttgcagtggacaaatgggggcggattgaggctacggagccagctagcttcacagtgaaggaagataacaacttgtcgctagtagagtatgaattggttaatgtggctgagtaaccgctggagcgattctgctgcccctattttcgcgacataagaaggaagtaccatgaacgaacattataaagcctctcgaagcgagtttatttattaagggtgtatcgcttgtgttagaactttggatccatt

SEQ ID NO: 4781 - DNA, 671 bp, Sorghum bicolor
  Clone ID: SORBI-28MAY03-CLUS88277_1
gaaactgaccacagatccaccatcaattcagactgctacacactccccacagtcgaacacacttctctccatggccgccgacgacaagacgggacgacgccaccaccatttcctggtggtggcctacggcctccagggccacgtcaaccctggacgtgccctggcccgtcgtctcgcacagctcgatggctccattacagccacgctctccgtgccggtggtcacctaccgacgcatgttcccttcgtcactactggattccgcggcggcggtggcggcggaggaagagatgaccaccgacggggtcatctcctacgtcccctactccgacggcctcgacgacggctccttgtcctggcccacggacgccgagtccagggcgcgcaggcgccgcgcgagcgccgacagcctctcggccatcgtcgcccgcctcgccggccgcggcggcggccacccggtgacgtgcatcatgtgcacgatggtgctgctcccggtgctcgacgtcgcgcgggagcacggcatccctctcgccgtgtactggctccagccggccaccgtccttgccatcggctaccacttcttccacggcctcggcgagctcgtcgccgcccacgccatggagcctgcgtacgaggtgctcgtgccggggctgaagctgaaccgccctctcc

SEQ ID NO: 4782 - DNA, 615 bp, Sorghum bicolor
  Clone ID: SORBI-28MAY03-CLUS88284_1
gcgcgaggacagcccgcgcgcctcccgctcccgccgccccgccgccccccgccccccgcgccgccgccttcgccccccggcccagcccgccctccgcggccgcccgcccgctcctccctcgcgcctccggccccgtcccggcttcctcggccgcccctctctccccccgccgccccgcccccggcgcccccgccgcaggcccggtccggcgcccccgccccccccggccgcgcccgccggccccagggcggccgcctcggcccccccgacgcgcgcgtcctcgaggaccccccgcgggctcgggcttggcggctccggacgcctcgcccgttccacagcccccgcgcgctccccgcgccgcccccacctcggcctcctcggccgccgcaccttccggtctgcgtccgggtgcccgcactgctggcccgtgccccagcgcggacgactgctccctgttgctcacggctttgccttcttgcgcaccgctcttccccgtccccgacccggggctgccaaaggctgccgggggccctgcccccaccgcggcgcgctctgactctcgccttagcaatgatctggtaaaggcggctttgatccggtggccaacatgcagat

SEQ ID NO: 4783 - DNA, 626 bp, Sorghum bicolor
  Clone ID: SORBI-28MAY03-CLUS89062_1
gttattatgttcacaggttatttggtaggattttctatgttcaaagctctgttcaacaatagtgctgtactgagtgctgctggaggtatcttaggattagttggtggcatgctggtggagaccgttctcttcatcatcagatcatcgagtaaagagttgccctcctctgttccaagatcaaagaaagatcagtagacgcttgaaatgctatcgtcagttggaagtatatggagcatttgtttgggtttaaaaatgcaattaatcgaatataggtaattgacgtccagtttcaatttgcatcaagaaggaatagggcagagggatttgactatttttagctgcccagaagtttgtatctcgcccagtgacaggcatgatgatcgttgaagaacatgtccccccgggaagtaagtaaatccaagaggatattatgcttaagtccaattgaagagtatattggcttgaaattttgtagttaaaagttgttatttttgcatgtgaggtttttgtgtataaacatatatatggtatcctaagatttttctcagatttccttttttttcccatagcattttgagtaaattgaaatgcaaatttcgttggtatttccgtgactgttcatttag

SEQ ID NO: 4784 - DNA, 624 bp, Sorghum bicolor
  Clone ID: SORBI-28MAY03-CLUS89076_1
gcaggtggaccgcggcgacgcgctgccgctcggcgcgccggcgctcatggtgtcgccgcaggccgtcgagcctggccgcgcgcgcggcgagctggtgcgcgcccgtgacgagaggtacagggtcgacagctcggcgggggggctcaaggcggcgagggtggagatggacgagccggagtggatcaacccgaacgccgactactggcggctgcaccgcaaggggttcgccgtagacgtcgtccccgccgagatgaagcgccacgcgcccttcccgtgagctcccggttttcgttgtgacacgttcggaagtaggaaaagatcgatgttctagccaggggcgtatcctgggggaaaaaaaatatagcctgtaagagagggggagagtacggagctgtaagagatgccactttaattaaagttttatactgtaatatctaacgttctgttttgtatgatactgggctgaggtgctgtggtggattgtcagcaggcagcagcgatggtgcgggcagctgccccggcggctattttgctcgccgttcagatttgcaggcagagtccggtggatgaacaccgcgttgcggagaaagaatatatatctgtgtcggagactttccttctcct

SEQ ID NO: 4785 - DNA, 617 bp, Sorghum bicolor
  Clone ID: SORBI-28MAY03-CLUS89090_1
gaatcatcaattgacaaaagcccatatgtgaatttcatggaagatgggatggtagctgcagtaacaaatgatagccctaacaacggtgactccttgcacaacgagatttctggtgaaattgaactcaatgatagcatggttgtccaacacgtacaacacaatcaaaacaccggagcaatacaaaatgagagtgacagttgggcggatgataaaaacagctcagaagggaatgcgatgactgttcaagcacatggaggatctcaagaacagcgagaagagccatatgcgaacaaaatctgtgaagccattggtcctgttaagaaatccataaaccaactcagtcgaacccaggggaggtcagtctggttgcttgcttacattgctcttgtaacctcttggccgttgcttggggccctaggtttttacttcttcaggaaaaggtctagtaattctctgttagctagaaagctgaagaaattgtaaacactgtgctaacacggatttgtttcatatgtaacacgtcaatcaaatccttgtaagccattaatacatgtatgtataatgtatgcaacattcggtaacagaaaaaatgccctaaacgagaaagcccactctct

SEQ ID NO: 4786 - DNA, 610 bp, Sorghum bicolor
  Clone ID: SORBI-28MAY03-CLUS89123_1
actgtcaggcaagctgtaagaaatcgacaattggagagcaaacttgatctcactgaaacaataaaagatggagcacggatgttccttatcgatgctggtatcaggagacaacttatactggccttcactgaagactccaaattgcatgtagaagagcttgtggatgtatacagactggtcgaagatcaaatagatatgccttcagttgcccttgaggttcttcaagatttaccatctgttgcacgtgacttcatgctttcctggagtgattccatcctgtcagatcgccagtactaatgatcttttacatagggccctgcatggttatggtacctcgatatgatctacaaggaaaatggctagacaagaattccttctcgctgtatacagtttgtttttgctttgatttttgtatagcaaaatatgcaatgtgcagttttttttcttttctccattgtcaatttctctgcacatgccatttgtatagtatagcgcgagggatcttgtatataaaataaaatgagctcgtgattcgaatgtagtagaaatagatgtacacagttagcattcaaatcaaatacatgtagaagcatcaaaggcttctaagctt

SEQ ID NO: 4787 - DNA, 1125 bp, Sorghum bicolor
  Clone ID: SORBI-28MAY03-CLUS89136_1
tgtaaagtgtgcaaagatgaacaaggatgcatttgcagcatatcttaccatgaacggatgtgcagggtgattgttgaactagctattccttgtgttaaaagtggtcccagagtatttaagggtttcacggtgggcttccatccccggtcatcagaaattgtttataatggattcactcagttcggattcgagcaacctcatcatggatttagcttccagaccgagcagattcatgtgtctctgtatcttagtgccaagtcctcactctcaggccttattggaaaaccgaccttcaaggttaatccagtgaaagggcttggtgttacacttgtaggattcaatggtgccatgcctagtaccctatctcctacagttttgaatgtgaattggagatgtgaaattgcccgaaccaatccttatgaggtcaatatttttatcccagtggagggctatgatccaattgaatttacactaacgaaaaaatgtggttacatacaagaaaaagagagtgatcccatgaaaggctgggcaatatttggaattgtttcttgcatgttcattgtcttgtcaagcctactttgttgcggagggttcatctacaaaactcgcgcggagcatttgtacggtttagatgcgctgcctggtattgccgtcttgtcagcctttttggatgctgttggtagaccaagaggctacttgcctgcagataatcctagtgaaaatcatgcaagccatacatcttgggagcacgcggctggtaccacacaagtagcacaaaggacaaatgatatggcatatgggacaacgtgaactaatggtaaagcagatgcttggtggttggatggttcagaattctgaagatgccagcttatgttgtggttgggtgcatagacgacgcttgggaacccaactgccacgaagtcaggttttctgcaatcaactactaggttttctgcaaccgtgtgtatttttgtaccagcatgcattgacctcctaccactaccataccagctgctagtggttagagcagttagtagaccttctcccggacggaatttcttggctacgatcgaacagaattccgttcttttaagcgtgagactgatagtacctacctgtcattgc

SEQ ID NO: 4788 - DNA, 1047 bp, Sorghum bicolor
  Clone ID: SORBI-28MAY03-CLUS88480_1
gcgggacatgttgtgggcggtgctgctgcacggccccctccagaagatggagccggctgaggcgaacaagaagcagcgggagattttgcagatgaggaggacgatcctgatggagaccaagatgtgcccggcttgctccggttcgccgttagagccgtgcccgcctcgcttccgttcgctgttagccaagaagcccaggcccgatgaggaggacaaggctggatcgaagagctcgagggaggaggtcaacgagttcatggccatccttcggtcggagtgctggaaggagattgcgacggatgacgaggcgatggtggcagacgccagatcgtcggagcacaagttgaagcgatcgagggaggatggcaagagatctagcagcagacccgaggagaagaagaaggccgagggcgatgataaggaaggcagccgatcctcgaagaagaaggctaagagatcgaacgaggtggagggcagtggattgaaggaggcggagatggagcgcagcagatcgatcgatgaggtgttgtttgagggcatcttcgaatcaggctgcggagatctgaagactaaggtgcattttaggagggtgctcaagaagactattgagagtaagccccctgtcaagattgaatgggagccaatgaaggaggacattgaattggctgggggagagtggaagactaagatggtgactcagaggttggacaagggctgcgttgatcgtttgattaatcggccctgtcctgagcctgtcacctacaataagtgttttacaagccgagacgcttttgatgctcttgctaacctagataaggttcatcgcttgttccactggtacttgcggtaccagtccatcatcaaggggtatgctgagtaccagaaggaggtcaccgatggcgtaggtaatgactggggtatgtatgctgggtaccatgaggaggttaccgatggcgtaggtcatgactggaagtgatgttgaggaggttaccgatggcgagttcatgttgcctagcataataatataagtgataaccttgctttttc

SEQ ID NO: 4789 - DNA, 662 bp, Sorghum bicolor
  Clone ID: SORBI-28MAY03-CLUS88488_1
cgggagttgatgatgtaactggagagccgttgattcaaaggaaagatgacacagctgaggtcttaaagtcaaggcttgaagccttccacaggcaaactgaacctgtgattgactattactccaagaagggcttagtggtgaacctgcccgcagagaaaccaccaaaggaagtgactgttgaggttcagaaagccctctcgtgatgagaagtgtccattcttcaggttaagcatgacatgacatctaccaaaatccctttgtctgggtttcttcaaaatttatacttaggccaacatcatggggtttttattttcagcatcctttttgtgcgaatatgcaccattttatcacaagctttgacaagctcgggaactgtctggataatctctgtttcaaatgagggaagtgtttttcagtaacaatactgatatgattacaacaattatgattacaacaattcatctttggaaaattttcctgatattctgttcactcagcaccttgccctgttgagttgagagttgagacattgttgtgctgtgaggtcaaataaacatttcatgttgtaagttttttttttttttgaactgactgatgtatgattttgaacttgtggcaaggtgtactcgcacttgcaataaatttcagtgagttatgtggac

SEQ ID NO: 4790 - DNA, 370 bp, Sorghum bicolor
  Clone ID: SORBI-28MAY03-CLUS88529_1
agagcgtaaagcagagtagtagccttccattccattccccattttttcccccccactgcttcctatccctattttccttttcctcctagttaggtcatccatcagtagtagtttttttaatagctagactttggtcaatcaatttttttcttgactcatcagtcaatctctctctctctctctcaggtttttgggagttagtagtagcagtagccatgctgaacaagactcatcccctgctaataatccattcaatcttgtgatgatgcgcttgctcagctgtagtgtagtataatgtaatgtaatgtaatgcagttatgcgatgcaatgttccctgactgggaatgctggtgttctagctcctaggagc

SEQ ID NO: 4791 - DNA, 710 bp, Sorghum bicolor
  Clone ID: SORBI-28MAY03-CLUS88553_1
ggcattatcctttcctttggtttcgcactcccatcgcccacccaccgctaactctctcgagctaaaacccttgctctccccgcccgcccatttccctttccccttaggcgacgctgcttctccggcggatcggattggcgatccatcatcgccggcggatcgcacccgcctacaaggctttgttgcgggatcggatcggattagcgatcgatctgtcgcgtaggcctgcttgctttgctttatttcccatcccatggaggtggagatggaggtggagatggggacggatcccaatcccaatcccaatcccaatcctaacacttccccctcggccgccgacgacgccgccaccgcctcaggcgaggccaaggcctgcgccgactgccacaccaccaagacgccgctctggcgcggaggacccgagggacccaagtcgctctgcaacgcctgcggcatccgctaccgcaagaggaggaggcaggcgctcggtctcgacgccgcggccgccgactcacagcaagatcagcagcagccgaagaagaaggccaccgccgatccgcagcagcaggatcagcatcacctgagaaagaaggccgccgatccacagcagcaggatcagcatcacctgagaaagaaggcagctgccgctgccaccaccgatccacagcagcaggatagaaagaaggccgctgccgccagcagcaccaaca

SEQ ID NO: 4792 - DNA, 973 bp, Sorghum bicolor
  Clone ID: SORBI-28MAY03-CLUS88514_1
aacctgacaacctgagccatcacaacaaagaagcgtccgccgcacacccaggtccttttcatccttccgtcacgctcggattcttgcgcgccgaccgccgaaccagtcgccgccgcccgccagccagccagccagccatgtcgtcgtccatggcgttccgagccgccgcgggccgcctccgcgcggccgtgctgcggcgctacgcccgccccatcatcgctccggcagccttctccccttcccgctccgctgccacgacgaccaccgccggcgccgagcaccacagggcgggcaccggcaccggcggcggcggcaataataacaagcaggtgccgccgcgcggcgactacgtgccggtgtatgtggcgctggggctgatcgcgctgtcggtgacgctgggcctgcacacggcgcggcagcagctggcgcacgcgcccaacgtgtgggtggacaagaagaagcgggaggcggtgcccgaggtggcggcgccggagctggcgctgggcgacgccgagcgcttcgtggaccggtcgctcttccgcaaggtcgcgcacgtgcaggacgaccgcagcctcgccgccggcgtcgccgaccccgtcgccgagtacccgacgaagaaggcggtgacgctcaaggacgtgggcgtggagacgccggggatcgagcagagcagggagggcgtcctcgacaagatcttcaagaagaatcacgcttagttaatcaagtgcaacgacggggtggatgctctgtctggattgcattgcttcgagttccttcttagttctactcacttcactgcttcccttccacttaactagtgtgtattacaccgtacatacagtatgtacgagtatggggtttgggtcgaatcagctgtagtacctttttttagacgaatcagctgtactacttttgaaagggcgatgtgtgtacatagtcgagaaacactcttgtttagtaaagttcatcacgt

SEQ ID NO: 4793 - DNA, 1174 bp, Sorghum bicolor
  unsure (1)..(1174): unsure at all n locations
  Clone ID: SORBI-28MAY03-CLUS89261_1
gactgccagccatctcattccacagaaaacagagagagcaccgaaagctcgcagctttgccagcaagaaagacatcagcagcagccagcagcgttacggcatggagctggagctcgggctggcgccgccgagcgcgcgtcaccccattcccatgacgatcgaccacctcaccgccgaagacgagctgagcagcacctcgtcggaccaccaccaccacccttgtgctgcgcgcgccgggaagagagcgttcgcggaagcgttccaggaggcagcggcgacgacgacgacnacgctgccgctcttcgatgacggctcgtcgtgcggcgggacgaacggcagcagcagcaagaggccgctggtcgggtggccgccggtgagctccgcgcgcagcagggcatgcggtgtcggcggcgccaagtacgtgaaggtgaagaaggaaggcgacgccatcggcaggaaggtggacttgtcgctccacgcctcctacgacgagctcctcgccacgctctcccgcatgttcccgaccaccggctgcaacaaaggtaggtaccattgttcgttgttggtccatcagatttcaggggatctataatcaatcatcatccaatccaacccaccgattctgttgatctgatccccaaattattgccatcctgttgcagacgacaaggagatcagcagctccagcagcagcaccagccatgtggacgtggtggtcacttacgaagatggagaaggggactggatgctggtcggagatgtgccatggaagtaagttttcgctatgatcattgcatacatgtggagttcatcttatcctaccggattgtcactgacatcgccctgcgattttttttattgcagtgattttgcaaggtccgtcaagcggctcaagatactgggatgattgaagtctggccgcactgatgatgtacatgttcttataattggagtataagccctttttttgtttttgtttttgtttttgtttttgtaaagcacttggtgttaagacttaagagtcaaggcagtagcctcttgtgacaatacgtatacgaactggttttctggtcttgtctgcgagaatgtttctcttggagatttgtctctgtgttttgcgcagtttatgctgcaactgatcgcaaattgatataatacatatattcattaattc

SEQ ID NO: 4794 - DNA, 850 bp, Sorghum bicolor
  Clone ID: SORBI-28MAY03-CLUS8928_1
tacagcaagtagctgagttagcttccaactagcagttgaagaagctgcatatcgtgatgttcaggagagaaaagttgagctgcatgatgcgttgattaaaatggtacaaggtggaagtgttgatggtttgcttcaggttcgagccgatcgaatccaatatcaattagaagagatggaaaaagctcttagtgaacggtgcaaacactttggacttcaattcaaatcatccgcatcagttgagcttccttccggttgggaacctgggccacaagagggactcattgagtgggatgaagactgggataagtttgaagatgaagggtttagtattgttaaggataatggtacaatacaggaaaacccagtttctgctgaaaatggaaaagtgccatctctttgggatgatggtgatgatatgtctcctgttgcatcctctaatggtcatatcaaggaagaaaggcgttacagtggaggtgatcaagtggctgagagtgaaatagcatatgattttggtgatgaatctgtgagaagtcctggcagtgctggaagaagtgcctcaggcagtccatttaaatcttcccgctttgggatgcatgattcatctcccagcaaaagagaaagttacagtgaccatggtggttctgaatctgtttttggtgacaagtttgctgatgaaacttcttggaactttgatgatcaagatactgactctgtttggggttctactgcactgaacactgaggctgatcaacatggtggcacacatagctctttctttgggtccgaggcaggctcttcaagtggcgctagtgtatttggaaagaagaggagtacattctttgatggatct

SEQ ID NO: 4795 - DNA, 573 bp, Sorghum bicolor
  Clone ID: SORBI-28MAY03-CLUS8938_1
gcacgaggctgcatttgcatttccatttccatgcacagacttggcaagtaacacggacgcgtgggatcccatcagcagcagcagcagcagtcaccatgcagagactcgcgcgcgtcctcgtggtgctcgtcgtagccgccgccacggcgtcggcacagggcccgacggcggcgccagcgacgcccacgccggcaacacccgcggcgccggcgcccaaggcagcgacaacgacgacgacgtcgagcaacatcacgggcgtgctggccaagggcgggcagttcaacaccttcatccggctgctcaagtccacgggggtggcgtcgcagatcgacaaccaggtcagcaatggcgggaacgggatcacggtgttcgcgcccacggacaacgccttcacgtcgctccccgccggcacgctcaactcgctgtcggaccaggacaagaacgcgctggtgcagtaccacgtcgtgtccaccgccatccccatgtcgcagttcgacaccgtcagcaacccgctccggacgcaggcagggagcgcctcccccggggagtacccgctcaacgtcacctccgagg

SEQ ID NO: 4796 - DNA, 656 bp, Sorghum bicolor
  Clone ID: SORBI-28MAY03-CLUS89439_1
cctactggatatcctccactttttttccaccatccactctatgtttccttcctctagtcttcttgagtgggagaggtccacaaattgtgaatttgtgtaagaatcgagattttgtttgggaaaggaggtcccgaatcctccttgtatccttcgggatttggcaaaagatttgtgttttctttaaattgtgtttgtcttgtttgcggtcttgtcttttcccttcttgttttagcctcgattcgttgttgagaccacatcgattcgttctttttgtgttggtttgatctatgatgtgagttgagactttccaccaaaggaaatcaaccaaccaatttatcatgagagcgtagatcgggtcaaatcttgttctatgggcttgagttctagtgtctttcgttccttttcgatttccatggtttgacttcaaattgagcgatgacattttagaggtagctcccgtactgcctcgtgatgatgctcacaaagtttggtggcagttggtgttgatttgatcgtaaatcgagaagatcaaaggacgaggcgatttgaagtcgcctgttttctcctctctgcatgatttgcggacagtccgggcctgacatgcggacagtccgccaattggggtttcagtaggagcaaagcttgtgctatatgtc

SEQ ID NO: 4797 - DNA, 392 bp, Sorghum bicolor
  Clone ID: SORBI-28MAY03-CLUS8947_1
gaaaacgccagtgtcagcaagaagctggcggcgctccaggcgaacatgcttaatgtggacgcgcagcccttctactctctgcgagtgccgccgcttgcagcgaagcctcataacacgctgcctcagcagcagccgcagcagaaaccacataacacgctgtctcagcagcagcagcagcagaagccagctcctgcccatgatcccttgggcaacctgaagaggacacggtccggcaattgcatggacaaggcacgagcagtggtggacaaggagcaagagcagagcatcgactagaacagcggcaggaggaagtcgctctctgctgaggacagatggccagagctgcccgaccacaacgcgttcgacgaggccatcggtgcggctgtcctggg

SEQ ID NO: 4798 - DNA, 669 bp, Sorghum bicolor
  Clone ID: SORBI-28MAY03-CLUS89493_1
aaaggcactccgtcccatccgcgccgagattgtttgtgtatctcgatctccgccgtgacgaggccctccccctccctcccccacgacgcactgccgcaggccgccgccgcagcccatagcgccgcgcccggcgccactcctgcttcctttttttcttttctcttttggcccccttcctcctgacctccgcgcgcgcgcgcgcgtcgtttgtaatgtaaccaccaccaccagcagtgaccgtcctcgcctatatatccacgacagcctcccgcacttttctcctcgatcgcgccagagagccacgcaacgcaagctagtgtcagtgtcacgcagctgcgcgcaccgagggctccggccaggcgacaggcgagctagcgaggctctaggcccagcggcaggcggcaatggcgagagccggcggcggtggtctcctcgtcttcctcctgcgcggcgcggcgctggtgacggtggcggccgtgctgctgggcggcatggtgggcgcggcgagggcggcgcagctgcggcagaactactacggcagctcgtgccccagcgcggagtccacggtccgctccgtcatctcgcagcgcctccagcagagcttcgccgtcgggcccggcacgctccgcctcttcttccacgactgcttcgtcagaggatgcgacgcga

SEQ ID NO: 4799 - DNA, 668 bp, Sorghum bicolor
  Clone ID: SORBI-28MAY03-CLUS88719_1
gagacttcgaagagccctaactaaacccatggcgctctccgccgctcgccggctctccaccactacttccacctcctcctcggccgcagccgccgcggcgccgccgaagctctcctcgctgttccgcaatccgaagcctcgaccgcggccggaccccggcgtcgatgcgccgcggcgggggcctaggcccaagccgaggcagccttgggaggaggaggcgggggcgctgctgcggcggctccacgaggggggctatctcccggggcccgacctctcttcggcgccgcacgccgcctcccccgactccgtcaagaccgccgccgagcggttcgggcacgaccaccagcccgtcgccaaatggctgtcagggagtgatttgaagaaggttgccttgtttgggtgtcccactgttgagcgaagaacggttttcgcatcagaaagattaagagtgttcttcaacctccaggaagacaaaatatgcagctcttgtaaactgagaagttcgtgcaagtttgtgaaccaggaagtggttaggcataataaagtgattctatcagatacgatgagaattatttctttgtttgtactggatgcttgcgcgcagcaactccaggttactgctgagttaaaagccagcgtctgcaagctgctgaaggataccataaatc

SEQ ID NO: 4800 - DNA, 965 bp, Sorghum bicolor
  Clone ID: SORBI-28MAY03-CLUS88831_1
acaactcacgcctaacaacacgattcagctactgccagtgccagctaacagctctgtcaaggactcactgacggccatggccagagccctggtcctcgtcgctgtcctcctcgccgccagcgccgccggctccacgacggcgaccacgctgacgatccacaacctctgcccccacccaatctggccgctggtgaccccgaactcaggcctcccctccatctccgacaacacggcgcgcctcgaccccaacgcgctgctctccctctccttcccgcccaccttctgggccgggcgcgtggccgcgcgcacgggctgcgacgccgcggcgtcgggctgctggacgggcgccgcgccgcccgccaccgtcgtgcaggtcaccgtccacgacggcggggacctggaccaggccgcgtacagcgtcagcctcgtcgacggcttcaacgtgcccgtggtcgtcagcccgcaggcgatcgccggcggcgggcagtgccccgcgctgggttgccccgtcgacctcaactgcgactgccctcctgcgcagcgcgccgccgagggcgtggcctgccgcggcccgccggagtacttcaagaaccggtgcccgctcacccggaccatgcccaccgacgtcgagcccgtcccgcagagctgccgcgggcccggcgagctcaaggtcgtcttctgccaggcgaccatcgtcacaggcgccgccggagccggcgaagccgagatggtcatccgttcagtcgtcgccgacagctagactgatcgatcgagacgtccagagctccattggcctcctcgcttggttgaatccttgtcatgatttctttttacatgctacatgtgtttgtgtttattagtaggggtttgtgtttattagtaggggggttttgctttggcctcgacgcgtgtactctggtggtttttagaaatcagcactgaagcaaaataataatgcccagttc

SEQ ID NO: 4801 - DNA, 645 bp, Sorghum bicolor
  Clone ID: SORBI-28MAY03-CLUS88880_1
acccttaccatctcgggctccggcacactcgcctcccactttccctttccgcgcccaccaccattgccacaaatagcaaccaccacatagcctatcctagcctagctagcgaccaccgtcggcgagagtactactactagtatatatacacgcgcacacacccgcaagctgctgggatcagcgcggcagtgcgcgcgcgacggccggcacggcagtctgtgtgtgtgcagcagggaattagtaatggacagtcgatccatggcgaccagcggcgccggcgtggacgcggccggcggcgtggcgccgttcgtggccaagacgtaccgcatggtggacgacccggccaccgacgccgtcgtcgcgtggggcagggacaacaacagcttcgtcgtcgccgaccctttcgtcttctcgcagacgctcctgcccgcgcacttcaagcactccaacttctccagcttcgtccgccagctcaacacctacgtgcgtgcgcgcgcctgctcttgtcaagtgttttttttttatgttcttcatcggtgaacctgatcgggatcgacgacgacgaccataactcgttctctgcatgcagggcttccggaaggtggatccggaccggtgggagttcgcgcacgtgtcgttcctgcg

SEQ ID NO: 4802 - DNA, 1143 bp, Sorghum bicolor
  Clone ID: SORBI-28MAY03-CLUS88933_1
agtttccctgtccaccccctcctctggctctgccccgtcgccgccatctccttccccatctccgtccccgtccccgtccccatcccgcctcgtgccgcagctcctggtcgccctcctccagcaccgccgcttcgacgccacgctccgcgtctccccgaccttccccggcttctccctgcactccatcgcagccttgctccatgccatcccgcgcctcgtccccccgcgctcaccgacgtcatccgcgcgctcggggaggaagggctcccgcgccacgcgctcgccgcgttccaccgcatgcgccagctccgctgcgcccctgacgcgcagtgctacaacaccttgatcgccgcgctgtgccagaacgggcggtttagggatgcccggttcctgctcgaccagatggagcgacccggtgcgcgctgcaagcctgtgtaaaacgtaccgtgtggaccgcgcccacgaggtgttcgatgaaatgctgaggaaggggtgcgcgcccaaccgggtgacttacaattcgttcatcagatactacagtgtggtgaaccaggtggacaaggctgttgaatggatgagggaaatgatagcgagggggcatggaacggcttcaacgagcacatacacgcccatcatccactccttgtgtgagagccggcgtgttatggaggcgaggcaattcttgattgatatggctgaatgtggacatgtgcctagggagcatacatacaagctggtgaagtctgcaattgacgatgctcgtgaggatgccttgccagcagagctatgtcaatcaattgaggatggcattacagcaagatttcgacaggtgatgcaaattaaacccataatgcgaccagtcacaagatgatctgaaacaaacgagcttatggataaagccgaatctgtttgcatgagagatgctggtcttgcaagagaagtgttcttggttgagatatgtaggatgttagtggttcatgactacaagctaatatatgtgtaaactagtgccagctgagtgctcttgtaagaagggaggatttgttgtaaggccttgcaagcgagcaggcaatgagaccacggagaagttttgggataggtaaactatttgtggctataataaagtttgtttgcacataaggt

SEQ ID NO: 4803 - DNA, 663 bp, Sorghum bicolor
  Clone ID: SORBI-28MAY03-CLUS89013_1
aggggacgcattcaattcaattgacagaagaacacacactctgctctagcttgctctattccggatcgacatcggggctatgcaagctcgatcatcagctcgatagtaggcggcggccggccgttggtgtggtgcacgcgcggcgctcgatcgagtgcgcgccattgtcgggcggcggccggcgcgcgcggcttctgacggcgcgacggtgcttgggaacgcgcagcgaggcgggcggcggtcgtggaggcgctcgtggcagggaggcgcgcggccgggcgtacgtggtgcgcggccagctcgccggtgcggtgagccggcgacggcggtgtgtggctccaccggcggctcagaggtccttgggcgcgcgtgcccaggcagggggcggcttcggaggtccttcagcacagctctagcaccgagtgcacatcagcagtaaaggccagtggggagagcgaaggccttgagactggagaccaactacggagctgctgtcgccgtaccaggctcggggtgtttgttcctcatcggctctgcacagcgacagcggcgagcaaaaggaggaccatacgcaacacatgctcactgaaggctggtcagtggctgtggagcggacgccatcacgccgtggtttggactctcggagatttgctgtggactctc

SEQ ID NO: 4804 - DNA, 657 bp, Sorghum bicolor
  Clone ID: SORBI-28MAY03-CLUS89779_1
gcccgcgcgcgcaaccagcgcctggacagccgccgactccgaccccctccaaattccttaaaccctagcagcagcagcagctcccactgccaccgctacggcgccgtcgacgacgagggggagcgcggagtagaggggctccggcgaccgcgtcagagatggcagcgagccacagccacggcgcggggacgctcaagtccaccgccatcaacggggtcaagctctactcgctcaccggcagccgctacgtcgccccctgggtagtcgccaagaagaagcgcgccctccgtaaggacaaagagtatcagcggaggttggatttgatccatgacctgaggttcgagaccgccaccactaagatcaagctgacgcccgatgaccagtacgtgatcgcctcaggtatttaccccccgcaagttaaagtctatgagttgaaggagttgtcgatgaagttcgagcggcacttgatctcagaaattgtaactttccagatccttggcgatgactattcaaaacttgcgtttttgtgtgctgatcgttctgtaaatttgcacgccaagtatggaagccattatagcttgagaattccaagaatgggaagggacatggcctacgattgttggtcctgcgacttgctatgtgctgcttcatcaccag

SEQ ID NO: 4805 - DNA, 722 bp, Sorghum bicolor
  Clone ID: SORBI-28MAY03-CLUS89807_1
ctactggaactagctgtccgccgaccagctttcctccccgttttccggtgccttgcttgtgctccgtgctcactcaaacgcctccaaggctcggaggccgcggcgaggaggaggaggaggagcagcggccagcgggggaggacacgaaaagtagccggcctcccgccgcccgaagcccgaccgctcccgcaattgctgttgtttgctaccctgcccctgcgtgcaggcggtttcgaattgccgtctgctacccacgaataatccatggccccgcctccgcctcggcttgccgccctcatcctcctagccgcgctgctgctgctgctgctggcagccggcgccgcggcaaccggcgtcttccaggtgcgccgcaagtttcccgccggagttggagggggcgccagcgccaacatcagcgctcttcgtgtccacgacggtcgccgccatggccgcctcctcgcagctgctgaccttccactcggcggtctcggcctcccaactgacaccgggctctacttcacggagatcaagctcgggacgccgcccaagcgctattacgtccaggtcgatactggcagcgacatcctctgggttaactgcatctcctgcgaaaaatgcccccgcaagagcggactcgggttagacttgacgttctatgaccccaaggcgtcctcgagcgggagcacggtgtcctgcgatcagggattctgtgcgggcaccta

SEQ ID NO: 4806 - DNA, 702 bp, Sorghum bicolor
  Clone ID: SORBI-28MAY03-CLUS89817_1
gaggaaaaaaacttttgttggcagaattaatattccagctgtttcttctgaagattattatcaggaggtcacgtctttgcaattggatgaagatcagggataccttatggcagtgggaaccagtacaggaaagatatcaatatatgatttacgcatgtcttctcctctgcgagttaaggatcacatgtatggtagcccaatattgaatatcaagtggcaccagacacttaattctactgaacctaaactgatcactgctgataagcacatagtgagagtctgggatcctaatacaggaaataacatgactagcattgaaccagatggtggtgctataaacgatgtctgcatcttccggaatagtggtttaatgctattagctctggacaatagccagatacctgcccacttcattcctgcacttggccctgctccaaagtggtgctcacatcttgataacctaactgaggagatggaagagaaaccagatacaacactgtttgatgagtacaagttcttgactaaagaagagatggagcgactgaaccttactcaatacattggcagtagtgctgtaagagcatatttacatggatttgtcgtacgttatgaactatacaagaagcaacgggcagaagttgctcctgttgagtacgagacaattaaagaagagatcaagaaaaagaaaatagaagctcagag

SEQ ID NO: 4807 - DNA, 646 bp, Sorghum bicolor
  Clone ID: SORBI-28MAY03-CLUS89812_1
tgggacatcaaacaattccactcaagatgaatctaatggtaagaaaggtgctgatcaagctgcagatggagagaaaaaggacgatgcacctgctcctctagaaagcaagaactcaaagaagaagaaatctaagaaagacaggtcttcaaaggagccaaaggaagcgcaggatcaggccaatggattggaagatgcagctgttgcagaacctgatgaagatacagcttctgtggatgtcaaggagcgcataaagaaggtagcctcaatgaagaaaaagaagtcgagcaaagagatggacgctgcggcaaagatcgctgcatccgaggccgcagcaaggagtgcgaggcttgccgcagcaaagaagaaagagaagagcccctacaaccaacagcctgtgcggtgaaatcccctggttttggatctctagaaaacttttgagctctgatatccccttgttcgttttggacctgcaataaactttttgagactgtttttgacttggtggatgctcgttttgggaattaaaattatagtaggtacataggggggctgtcttgtcgctggattctggatggtgtaatgagctctgaactgttcgtcatatgaaccctgctgactatatggaaaatatgggatattcgatccc

SEQ ID NO: 4808 - DNA, 507 bp, Sorghum bicolor
  Clone ID: SORBI-28MAY03-CLUS8988_1
ccacagacatggtgatgatgattctaacacaattttggaatctcttctgtcctattctgaccttaagcaatctggatccgagtcatcgggttctcttggaagtttatttgattctgataatgaagcccacgcgtccgcccacgcgtccgggaaagtaatcaaccaagacatcaagccagagcttgattctttctcagagaagtggtcatttttactcagaacaatgaacttttcacaacaagaagttgatttagccttcaagcaactaggtgatgaagcgccattagaacagctcgtggacttcattgtcaatgctcaatcacgagtatcgtctggaggaccggaaaatggtgatgctacaaatgaagggaagactgaattactctatggtgtgatggaaaaaacacttagcttgcttcagatgggctttaccgaggaagaggtatcatcagtgcttgagaattctgaccagagagcaactattcaggagctggctgactcaatttt

SEQ ID NO: 4809 - DNA, 778 bp, Sorghum bicolor
  Clone ID: SORBI-28MAY03-CLUS8914_1
caatcgcaacagttggcaaagattgatcctactgcagctggtgcagtgtatgatagagaattcattgtttgttcgttggacctactgtcaggacttgcagaaggtcttggtgctggtattgaaagtcttgttgcacagagcagtttgagagatctacttttgcaatgctgcatggatgaagcagccgatgttcgacaaagtgcccttgcccttcttggagacctttctagggtttgcccaatacatttgcatccacggcttcaagaatttcttactgttgcagcaaagcaactgaatcctcagtctgtgaaggatgcggtatcagtagctaacaatgcctgttgggctatcggagaattagcaatcaagattggcaaagaaatttcacccgtggtgatcactgttgtttcttgcttggttcccattctaaaatccccagagggtttgaacaagtcacttattgaaaatagtgcgatcactcttgggaggcttagctgggtctgtccagacattgtggcccctcatatggagcatttcatgcaagcatggtgcagtgccttgtgcatgatcagagacgattttgagaaagaggacgcttttcatggactgtgtgcaatggtggcagcaaaccctacaggagcggctggttcattagcttacatctgtcaggcctgtgcaagttggactgagataaaaagtgaaggtcttcacaatgaggtgtgccagattctgaatggctacaagcagctgcttggaaacggtgggtggaacaatgcat

SEQ ID NO: 4810 - DNA, 625 bp, Sorghum bicolor
  Clone ID: SORBI-28MAY03-CLUS89171_1
tctgggaaactactgcaattacactcgctgtttcctctcggtctcccccacccgaattcgaaaaggcggcgctgatcgcaccaatctgatatcgatccgccctttgttcccctcaattgcgtgcgctcgactggcccccaagggagtgtcgcagttctcgcacagatcctacccaaaccccaatctctccgcgatctcctccaatgggagccgagccggacttctcgctaccgccgccggagcccacgcactcgccggagccggaggtctccggcaaagacagtcggaactggaaggcggagatgatgtcggctctcggcgagtcggtctccttcggccgcttcctcacggagccgctcgaatgggggaagtggtccaccttcgcgcacaaccgctacctcgaggaggcggcagtgcaggcgcgctcaggctcagtcgcgcagaaggaggcattcttcgaggcgcattacgctaggaagaagcgcaagagcgaggaccacgccgccgccagtgatgatgttgcaggcggtgatggcgatctcgaggcggcagaggatggtggtaccgcctcgtggttgttgtctgctgcggagtcttcctgcatgaccgatgaaccaccggcacc

SEQ ID NO: 4811 - DNA, 625 bp, Sorghum bicolor
  Clone ID: SORBI-28MAY03-CLUS89224_1
ttctggagatccttcgccacccaaatccggcgagccgcccgctccgccgcgccagccaatccccacctcaaataacccccggcgcccgcggccccggccccacccgcccgccgaggggaaataacaagcaagcccccgcacatcaacgagaacgccaccgccgcacgaagcgaggagccgaagccagccgggagagaaaacgggcgggatccccaccgcctcgcgcgccgcggcggccgacgccgccgcggcaatggaggtcacctcctcctcctcctctccttccgcgccgccgccgggatcctcgaagccggcgctccggctcaaccccgcggcgggcctcctccgccgcctgccgaccccggccccgaccacggcgacgcccgtcaccgcgtcagagccccctgcgcggcccggcggcgcgtccaacccgctcgccgccttcctctcctccctcatccctttctggcgcgagcggcggtggggaccgccgaaacagccggcccaccccgctgcctcccccgctgcggcgcggagggcggccgagcaggaggcggaggcggaggcgcgacagctggtggggtgtgcggtgccgctgttccggccgtacgtggcgcagctgccg

SEQ ID NO: 4812 - DNA, 597 bp, Sorghum bicolor
  Clone ID: SORBI-28MAY03-CLUS89199_1
cctctggagagacgaatcagctcgcgtgtctgcccgtcgcttcccaaccgcagcgcggcggcgagatcgacctcctcaatcgacaatcggtgaccgttccgtgactccgtgtcgatccccaatcggtgaccgtgtcgacccctactgagctcgcgggcgcggcatcccccaacccaaaattgatggaggctgcggtctccagcgccggcggcgagtcagcgggcgagctgcttctccgcgcggcggcgctggtgccgtggacgcgctacgtcctcgcggcgctcgccctcgccgccgcgctcctgtacaggttcctcgagctccacttcctgggcgacctcctccgcggcctccgcggcggccgcgtctcgcttaccttccaccccgactctcaagtgtaccaccgggtcgcctccaagtgccgctcgctgcacggcaggtacctggcgacgccgtggttagcgagtcctcatttgcagacgttgttcctgagcatatctggcaggccaccttcattcacctatgggaggcagctgtacactgttcgtgacggtgggaccattgccttagattggttactagcctctgatcttgaag

SEQ ID NO: 4813 - DNA, 497 bp, Sorghum bicolor
  Clone ID: SORBI-28MAY03-CLUS8926_1
gcacgaggaggaaaaccacgctacaccagcacttttcgccgtcgctgcgtcctgcctaccagtgactcgcaaggttcgtctccatcgacaatgtgtggcggagccatcatcgccgacttcgtccccgccggcggccgtcgccaggcaaccgacgacaccatctccgcctcctccctcctctccggcgaggaccagcatctggaggagctcggcagcagggtgccggcgccggggcgcaagacggcgtaccgcgggatccggcgccgtccctggggccggtgggcggcggagatccgcgacccgcggaagggcgcgcgcgtctggctcggcacctacgccaccccggaggacgccgcgcgcgcctacgacgccgcggcgcgcgagatccgcggggccaaggccaagctcaacttcccgcccgccgtcggcgccggcgcgcgcgagccggcgcgcgagccggccccgacgtcgtcgtccgcggcggccgaggagagctc

SEQ ID NO: 4814 - DNA, 449 bp, Sorghum bicolor
  Clone ID: SORBI-28MAY03-CLUS900_1
acgcgtggtcggacgcgtgggcctcgtccgccgcagcgccgctaatccacccgccgccgctgccctggaatgtatgatatagaaaaaaaaaatattgttttacgcacaaagtcgcatcctccggccgccgttgattcgccaaaagtaaatcagccggacacctgatctacgcacaaaggagcacctccagaggacactcttggagctcctgggggttgtcgcagatcgccgcagtgggctgccgattgcaacatgtgtttcctcccgtgatgagcttgatgccgtctgtgctgccgtcgccaacctctcctttgtgtcaatgtcaccgctgtatagtgatcaagctgaagcagagcgtgcatctgttcttgagaagtttcgtcaagaaacaattcagtggaatcaaactactaaagctaccaatattgccgaaagttctaggcttgaaa

SEQ ID NO: 4815 - DNA, 595 bp, Sorghum bicolor
  Clone ID: SORBI-28MAY03-CLUS90017_1
gcaattttatctgttggcctgggatggggagtgcagattggaggagagctgacagactttatcattgtgcttcatgaccgtaaagctgtcaaggctttcagcagtcgcattcatctttcacttggggcaggattgagtgctgcagcaggacccattggcagagcctttgaggcagacgttcgggccagtgacaaaggttctgggatatgctacacttacagctgcagcaaaggtgcctttgttggggtttcactggaagggaatgtggtgacaaccagaatggagaccaatctacgcttctacggagatgcatacctgacggcaaccgatatcctgtttgggagggtggagcggccccgagctgcccagcccttgtactcagctctagatgatctgttctccaaaatggttaggtaggccatttagattggtgtggtactatgctgcattggtggtatgcagtcatgtatataaacataaagtagcagcaaaaattctcccaaaaaaggaaatatggcagggaaaaaatgtacagcttttgtttgatggtttcagtactgatgtcagtctacacatgtaaatatggcagaatttt

SEQ ID NO: 4816 - DNA, 635 bp, Sorghum bicolor
  Clone ID: SORBI-28MAY03-CLUS90028_1
acaaaatgtgacaaacgcaagaagaagaagaatggcggcaggagacccgaagaaaacgtggaaactttccagagcctaatccgtgaatacttcgaggctgcgcctccttggatcatgacaagcagcgtgaccaaccagggccgcgatgagatactcctgcacatgtctcagcttaggaattattggctcaagcattgagatgcaatgatacctaacctgggtcgaagcaaccgaagcaacatacagagcactgtctctcattgatgcatgagctggccccgcctccgcatgccggccttggctccaactaatccgccttttgagctgtttgctgtccaatatgacccctatacatgattatccaatcaacactctgggaatacagacaaggtgctaaaatcagctgatcctggttttttctattgtgtacacgtacaatcccaatgttttccccttgttcccttctgattataggtttgtgcatgctctggggttaaatgattaataaaccctggtgtcagctaatcatcagcgggaatctgacttttttttgtttgttacttatgtgctcccttggaccctgcagcatacaaatggcaggaggtgcatgaacttgacctgttaagaaatggctt

SEQ ID NO: 4817 - DNA, 904 bp, Sorghum bicolor
  Clone ID: SORBI-28MAY03-CLUS90052_1
aaaaaaaagagtctcagaccgccaggcgcaaacccctcctcgtccgtcgtctctctcgcagtcgccaccggcgcctttttcgcacgccgccaccgaggggacgaaggagccgcgcacgcgtgcgacagaggggtaagatgggaggcgggcggaagcgcgggcgcacgcagcgccgccacttcaagcagggccgcgagaacgtctggaagcacaaccctcagcgtcctcccgccggcgaaggaggcgaggggcgggagggcaatccctcgtggcagcccttcgccaccgagaacccgtccttcgaggagtactacaaggagcagcaaattgttcctgaggaagagtgggatagtttcatgagtacgcttcggaagccattacctgccacttttaggattaatgcgagctgtcagttttatcaagatatctgctcacaattggaaaacgacttcaggaaatcattagagactgaggtgaccgatgaacatgaagaagatgctattaggcctttgccttggtacccgggtaatcttgcatggcatttgaacttttctcgaatgcagctgaggagaaaccaggcacttgagagttttcatgaattcttgaagagagagaacgaagttggcaatataactaggcaagaggctgtcagtatggtcccaccactgtttctgaatgtgcaacctgatcatcatattcttgacatgtgtgctgctccaggatctaaaactttccagttacttgagatgattcaccagtcaacgaagcctggagtgcttccaaatgccttggtggtagctaatgatgttgatgtgcaaagatgcaatcttcttattcaccagaccaagagaatgtgcacagctaacttgattgtgacaaatcatgaagcacaaaactttcctgg

SEQ ID NO: 4818 - DNA, 673 bp, Sorghum bicolor
  unsure (1)..(673): unsure at all n locations
  Clone ID: SORBI-28MAY03-CLUS9018_1
gcacgagggctgtttctgtgtttgcctaattaatatgagttttgattcgctcttggggcgtagcttgttgaaaattcttttcattttggccgtttcacgtctggatctctccgctaatcggcttggggtattgggattccaacttttgatttgtgttgatgacaagccatgaacagcgcaaccaccagttgttaactaaccctcttgtaaacttcaagcaaccgaagcgaagagcagaaatggtgttccaaaagaggtcgtcgtcagagatggagtcgtgcggtggaggccaagtcgcggagatgccgcgcgttcccaagtctgcaaggggcaagagatcggtcaggaagaaggaggcccagagcccggcccagatgtccgcattcgaccttctcgcgacggtggcagggaagctgcttgatgagggggtgggctcgctggggaacatgagcgccggtgcctctgccttggctgcgtgcgcgaaggatgtccgtgtgaagcaggagcagtgtgatgaggaaatgaacagttcaagcatgaggtgacggatcaggacagctgcaatgagagtgcaattctcccccacattgctttncagcgggcggtgaataatgctcgaactgaggtcctaaggcgaaatctgaggcccaggacaaaggaatctccatgatca

SEQ ID NO: 4819 - DNA, 621 bp, Sorghum bicolor
  unsure (1)..(621): unsure at all n locations
  Clone ID: SORBI-28MAY03-CLUS89565_1
ggtgttccctagtgttaggttacagcaagaagttccccttaggcctngtngtcgtcgtcctgtgttacgcaagactagcactgctcctaacattggtcttaacaacaaagctccccttcctcctactgggctactggaggatctgataagctttgccggagatgctggtgataacgagggtagtggtaatgccaatagtcaggagggtaaggtgtcatcctatgagggtgacttgatggggcttctctacaccccacctgacagcgttaagaaaattgatcacatgatcgagaccaacctatctggcttttcgagccatgtgaatcgttgtagattaactgttagtggttgtagtgtaagcaggagggtgcatggagactagtaagtttatctgatgagattgtcatcgtcctgtctttgagcgtgcgtgcgtatcacctaggagtactgcagtggctcaataaatttgtactacatcagcaccagcgttttccttgtacatactaagtaaaagaacctcgtgtagtgtgactatgttctgtggttatggcatgtaatgtaccaagtgttacataactactggggatgttcttaatattatatatctgttgctgttttgtg

SEQ ID NO: 4820 - DNA, 599 bp, Sorghum bicolor
  Clone ID: SORBI-28MAY03-CLUS8964_1
actgaagaaagcgctaaaggattcgaaacaacaggaatcgctggaagacccaaaggaacatacagcaaagaaggccggcaagcgtgtgacgttcgccgaggtggagcctgagaaggagctcaaggcctcgaacagtgactggcacccatcctccgatttccacagcgcgtaccctgagcagaactcgtgggcgagcagcttcatgatcttcgaggacgaaaacagttactggaaccgaggtcacccagactgctgagatatcaaatgtatcgaggtggacattttttggtccatttgcggtgaaagagctcagtccatcttcacccaaggaaatgggggtctcactcgcattgtgatgacttgcgagttgcgcctgccgttcactctgactctctgtcatgtaacatatttgtccgagtccgacatatatacctgtaggttgcaatgtagaattatgcagtatggatggtgaacctgtgatgctgtgtttgaggcggtgaacctcgttagttaggagaattgagatagtagcagtgtgttgctaaaaaaaaaaacaacacaaacgcaaaaccaaaagccaaaaaaacacgaaaaaacac

SEQ ID NO: 4821 - DNA, 1019 bp, Sorghum bicolor
  Clone ID: SORBI-28MAY03-CLUS89679_1
ctgaatcgggaggtaataaagggcccgtaacctaatttgattccattatgtgcttggttctctgatttgcacttcaagttcatggcaaattggcagcatgaggatactccttcaactagtattttttatgttgaccatctgtccatctcaagtttcttttcgatgcttgctgcttgaacaggtcagcaccacagttgctgatactgtcgcatagtacatgtgctggtgaagaacttgttctttgcgttgcctaatgtactttaatcataaaaaatattttggagggctacatccattcttatcagctgtgtttccattccttgcaggctccagaaacactttcatttttgcattgacttcctatcagcaaatggtaaaaatggtcacttcttgataactgtaatctagtcatttctgatctcgatcattgacaacagaatgagaatttaaagcttaatgataactgtaatctggaaagaaacttgagatatatatgtcatttatacattacagtgtgcctattctagtacattgcacctcatgcaagtgacctcaaccatgtttttttgtgtggttctagctactcaatttacttgttggtattgtaaatcatacgattttgaactctaattatgttgtaaattgcttaatagctgattgcttctatggatcctttaaaattaccttaagcatattagtaagttcatggtttgcttccatgcttgcaggtcctagagcaaatgagtagccaatcactattgactcctctatagagcaacttgagccttggaattaatttgtgttgtgcgctgctgtgttgccgctgttatgagctgttcttgtcactgttacactattgtgtcgctactgttatacaaatttgagacaatagtttcttgaattttaagactattagagtgaaattattatgatatcttgctgtgttcgagcagcaaattcttgaattgtaagactaatgatttaaagataatattatgtgatgtatgggctgattttgt

SEQ ID NO: 4822 - DNA, 322 bp, Sorghum bicolor
  Clone ID: SORBI-28MAY03-CLUS8969_1
ggctcccattccatttccgcgaggagacgaggaggggagggaggcacgacgccgccgccgccgccgccgtttccgcttcgacttcggcttcggtttccacgagagttctagcaaaagtcttctggactgttcattttcctgcattttggtatggacgaatcctcctgtagatccactactccagtggggtttcttagaagaggttctggcatttccttgagaaatcaaagcaacgaggataggccaagccaatacaacaagcagcccaggaagagttcaaatctcaatccttgtaaatcacggggtcactgaaataaagaga

SEQ ID NO: 4823 - DNA, 528 bp, Sorghum bicolor
  Clone ID: SORBI-28MAY03-CLUS8974_1
gtgttgcgtggcctgaggctgagtgagaggttgtcctcaacgcaaaggcaaaggcaaagccagcccagcagccagcgccttcacccatcctcctggctcctgccgtgctgccaggagcttagcatctgccgccgggtatgccatcccgatcccgtcctgattgatccagcagctagcgcggcggaggccccgcagaaatggacggtgcctcgtcctcagccggcggcggcagcggtgcttcttcttcttcgtcgccggcagcggtgcaggggagccggggcggccgggagctcgccggggagggtgggcgcgaccaacatcggcaggctgcggcacgggaagcagcagcatggcacgaggcccggcgtcggcgtgggcatcagcatcagcgtcacgtcctggcacctcagggtgttcgcggccgtcgtcggcctcatgggctgcctcctgctcgccgcctccctcgccatgtccgcgctgcaccaggtccagttcaggaacgccgccatctccaggaacttcaggggc

SEQ ID NO: 4824 - DNA, 594 bp, Sorghum bicolor
  Clone ID: SORBI-28MAY03-CLUS90310_1
acacggccggcctcacgccgttgatgaagatgcacaccctcggccacggcttcgtccccgacccgatccatgcaggtgggcttcgctaccatggaatggcacctctgatctcgcacgtctacgagctgggcttcatggacgccattgctatacagcagactgaatgcttccaagctgccctgcaattcgccaggacggagggcatcatcccggcgccggagccgacgcacgcgatcgcggcggcgatcagggaggcgctggagtgcaagcggaccggggaggagaaggtcatcctgatggccatgtgcggccacggccacttcgacctcgccgcgtacgagaagtacctgaggggcgacatggtcgatctctcgcacccggcggagaagctggaggcctccctcgctgccgtgcccaaagtttgatggcgttggagcgaacggcggcacatgcgtactggaatggagcaaatgatccattgagatccccttcttgaatcttgtggtgatccgtcggcagtggatttggcagctgcgatgatacttgtgttccatatgaaatgaatgaataaattctcaataaaaggattaattt

SEQ ID NO: 4825 - DNA, 569 bp, Sorghum bicolor
  Clone ID: SORBI-28MAY03-CLUS90367_1
tctgcgggtgattccagggcaccatcattccagacttaagcatgtgaagatcatcaaattcgttgctgccaagactctggccgagctaacatgccaaatcctcaaatctgcaacttcactggagtgcctgacgttggacaccaccaatggccaccctggatgctctgtaagcaaaactggcaaatgcgtcatgatgtccaaagatgcactcgttaaagcccatgaaggagtcctggctgcccagacttgcatcaggcccaaggttccctcaacagtagggttcagtcttttggaaccttgcagccggtgccatgctgttgggatttagacaatcatataattatgagttcagtgctggagtttttttaatctcactgaagtatgtggcgccctgcaggcctgcaccttttattatcccgttgcctatagctctctcactctgtactgcatttgaggtcagctgtcccaaatgccgttccttcctgctgctacatcgacatcgagtaaagtgcacccagacacccagtaccattgcgagttggaaattgcaactcccagtttgcggatcc

SEQ ID NO: 4826 - DNA, 778 bp, Sorghum bicolor
  Clone ID: SORBI-28MAY03-CLUS90368_1
gcaacaactatactacacaccgcttttctttctcaactcgggtatactggctctcgcgtaaacgcaatgcggccgtcgtcgtcgtcgtcgcttgttgtctccctcctcgtcctgtttctcctcttgtccaccggtgcgccgtcgctgggcgatgccgcagtcccggttcatcaacaacagggggccgccggcgacgatgggcacggcggctcggcggcagcggacagcgacgcgttctgccggaaggtggccacgttcgcggtgtttgtgtacagcctgtggaacgacatcaatccagtgcccaaactggagaaagtgctgtcggcatccacgaggccggcggagggcagcgcaagcgcaatggagtaccacctggtgctgcgcgtggccgggctcggcacgttccgggcgctcgtgtggggcgtgccgacccagggatctgaggactggaagctcaagtacttcgagcccgtggacggagcgtgatgactgagaattgaaaggtgtacgctacatgcctgactgcctgagagcgagtgagcaagcatgaccaaacaggacgtatatatgtatatgcttattattacgtgcgtgatctgtacgtggaaggacgatgtacgtgttttgtgttcagtgtgttctgatggatctacgtaaatgggtatacacatgtactcctatgtaatatgtctcctgattatcaacgtgtataacataatatatatatttgataataataaagatacgaccacccaccagagaggtacggtggctagct

SEQ ID NO: 4827 - DNA, 839 bp, Sorghum bicolor
  unsure (1)..(839): unsure at all n locations
  Clone ID: SORBI-28MAY03-CLUS9037_1
cccacgcgtncgcccacgcgtccgcccacgcgtccgggagaacacgctcgtgccgcatgaatgggtgaaccaccgccactcgtactggtccagcggcggcaaggacaaccccgacgcccccgagagcttgacctacaggctctcctctgacctctgcgtgattgatgagatcagggtgcgcccctacaaagctgcttttcagcttggccatcctatttactcttccaaggcggtgaggatccggctgggtcattccaagcttgatcctggaacagagactttcgtgtcagctgagaatgagaacctgacagcaatcgctgatgaaaactacacgtggacatacacgtcgccagagttccctatgcttcaggaaaatgtgttgcaaaccttcaagcttccacgccctgccctttgcattggtggtatagtgaagattgaacttctggggagattacagaaacaatctacagatgataagtattacatatgtgtctgccatgtccaagtgatggggcgctcactttcaccagatttaatgatagacatctccgatcctgctgattactcaaacctcaagtatttgccgggtgccggtaacttgcgcccagaagacctactgagcagtgacgccaaggaggactcatcggactggcgctcgcttgtttctaggtacaggcagatgaggcaattggcgatggtgtatatgctgcttggacctgtgcagtttgcggatgaagaagacgaagctgaggctgacatgctgcacttgttgtaggctttgttttctctaaaccggatcttgtgtatcctaattgagtggagtttgttctgataaatat

SEQ ID NO: 4828 - DNA, 651 bp, Sorghum bicolor
  Clone ID: SORBI-28MAY03-CLUS90470_1
cctactgggaaaaataccgtgtgcgcagcagatgccgtgccgtgcagtgcaggtgcggggatctctgaatctctgacgcccaagcaggttcgtctcctcggtaatcgggcggaagaggaagcgcggagactggaaatcgggccccaatcgggcgtcgaacgcgccgcttcggtctcccgaatcggcgagaaggcatgattcatacagccggctagtatggcctcaaaagctataaaaagaaggccttgcagtgctgagactgataaaacaggagaaaaacaaatggaaacaacactgtcagatcctataacagaatctcttctcggaaatactcaggaagagaaatccaagatatatgagcctattacacggtcaggtttcttggatgggacgagaaaggagtgtcttcgttgggcacatcttctagcaacttttgttgctcaatctgcaggaaacatagtaaatcttctttctgaatttggatcttggctagctagactctttggttgttctgcttccaaaagttcacaaaatggacagacagttgcacttaatctcagtccattacaggaagaaaggttaagattgttgagacaaaggatagatgtgccatatgactgctcctctgtcaagcatcaggatgccctgaaa

SEQ ID NO: 4829 - DNA, 624 bp, Sorghum bicolor
  Clone ID: SORBI-28MAY03-CLUS96293_1
gggcgccaggctcgcgccggagcggatggtgaggcgcgtgttcgtgttcagcgacatggagttcgaccaggcgtcggcgaatccgtgggagacggactacgaggcgatcgtgcgcaagttcacggaggccgggtacggcgcggccgtgccggaggtggtgttctggaacctgagggactccaaggccgtgccggtggaggccggccagaagggggtggcgctcgtcagcggcttctccaagaacctgctcaagctgttcctcgacggcggcggcatcgtcagccccagggctgtcatggagaaggccatcgccgggccggagtacggcaagctggccgtcttcgactgaagccgaagaagccccccatgagatggcaatgcattacacatcaaagagatgagcgagagagaatgcagcattttcccttattaagcttctttttttttttttgcttgatcgataactcgagtctggggaagtttgtaaataaacaaataaacaaagtttgctgtgctttcttgagcttgttgcattgcatttgcatcacattgctgagttgcatgccagcttcttgttaatgcaagtatagttaaccgaaggtcgttcaaataaactattattat

SEQ ID NO: 4830 - DNA, 542 bp, Sorghum bicolor
  Clone ID: SORBI-28MAY03-CLUS9631_1
gcacgaggctccattgccactccctgcttctctctctcttttcctcctcttgctccaccgggtggccacccacagcagtttacaagcagcagcagaggaagaagaggaacaagaaggtttcggctgcctgtatgagcatcatggcgtggtacccgttgccgcagagcggaggcacaccgtcggcgcctggcgacgagttcttcgacgaccagctcagcgccgccggctggccgctctggagcttcggctcatcagctgacgacgatcatcatgacagtcacggtgctggcggcgcggcgcgtgcagagaagcacggcaacgacgacgcggcggggagttctgtcgaacacaccgagggcctcccggtgccgcgccagcagcgcacgcaaccaacagacgacatcttcatgagccagttctcggacgaggagatgaggaggatggacgcgccgttcgaggcgctggacatgttcccgggctccatgcaccagctgctgtcctacgagaacatgctcagcggggtgctcaccggcggctcatcg

SEQ ID NO: 4831 - DNA, 577 bp, Sorghum bicolor
  Clone ID: SORBI-28MAY03-CLUS96335_1
gcacgaggaaaccctagcccgctacacccttggccccttctctcttcgtggtcgccgccgccgccgccgcgcccaagcctctccgactcggccatggcgacgtcctcagctctcctcttcccttctccgtcctcggcgtcctcgccgccgtcatcggcgcgggtggaggcggtggtgctcttcaacgtctgcgacagctacgtgcggcgcccggaccaggcggaccgcgtcatcggcacactcctcggctccctcctccccgacggcaccgtccacgtccgcaactcctacgttgtcccccacagcgagtcggccgaccaggtcgccatcgacatcgactaccaccataacatgtacgcctcgcaccagaaggtgaaccccaaggaagtcatcgtcggctggttctcgactggatttggtgttcctgggggaagtacgctcatccatgagttctattcaagggaagtacaaaaccccatccatcttacagtcgacactggcttcacaaggggggaggcttccatcaaagcctacatctcatccaacctgtcccttggagataggcacctcgctgcgc

SEQ ID NO: 4832 - DNA, 702 bp, Sorghum bicolor
  Clone ID: SORBI-28MAY03-CLUS96362_1
gcacgaggcaactctctggatcactcattgctcattggcctgaaccctgtcctgtctgtcacagttcaaaaaaggttccagttcatcatcgcccaatgtcttgcttcggttgaaagccgcgcgagatttctgctgctgcttttgtggagtttggcttcggattggagacagaccgtaggcagaagagtgttcttgcgggggcggtggtggtttttggcgagtgggaggacgcgaaaggcaggcgtcaggcgatatgcctttcagcagcatgatccatgagatgaagggcgagatcggcgccatctcgtcgcgcggcctgctgcggttccggtcggggggtcacgccgccgccgccgggcgagcgtcggcagccgccgagccggacgaggcgctgcgggagagctgctgggcgcgggtgccccccgagctcttgcggatggtgctggccagggtcgagcacgaggaggcgcgctggcccggccgcagcgccgtcgtggcttccgccggcgtctgccgctgctggagagccgtcgtcaaggagatggtgcgcgtgccggaggtgtctgggaaaatcaccttccccatctctctcaagcagcctggtccaagagatgccccaatgaaatgtttcattaggaggaaccgggcgactcagtcatattctctgtgcattggagtcactgatgctttagctgatgatgg

SEQ ID NO: 4833 - DNA, 821 bp, Sorghum bicolor
  Clone ID: SORBI-28MAY03-CLUS9634_1
gcacgaggctcgcctcccgactgccgccgccgctccctccaccgcgcaggaggccggcgctgctcgtccgcccccgctcgcgcagaaggccgccgccggtcgcactactggtgccctaagcccagatatcccgcgtcacctctggttcctcctcccccacccaaaacccgagcttcagggttccgccgccatgccgcagggagaccacatcgagcttcaccagaagcgccatggcaagcgcctggaccacgaggagcgcaagcgcaagcgcgaggcgcgcgaggtgcacaggcgctcgaaggatgcccgcaatttgcttggtgctaagggcaagaggtttgccaagaaacgttatgctgagaaggcacagatgaagaagaccctgaaaatgcacgatgaatcaaataaacgacagaaggtcgatgatgatgtccaagagggtgctcttcctccgtatctactggatcgtgatcagacacagcgtgccaaggttctgagcaacacaatcaagcaaaagaggaaggaaaaggctggcaaatgggatgttcctctgccaaacgtcagacctgtagctgaagaagaaatgttcaaggttctacgaactggcaagcgaaaaaccaagctgcggaagagtatggttaccaaagccacctctcggtgcagctggatctactaggacaccagctaagtatgaacggttcattcggactgcctgccatcctttaacaaaagctgatgacaatcacctcgaactgcagtgcactttcatccttgacataatattttgtgaaaaaaagctcaaatggtccaatgtacacgtc

SEQ ID NO: 4834 - DNA, 456 bp, Sorghum bicolor
  unsure (1)..(456): unsure at all n locations
  Clone ID: SORBI-28MAY03-CLUS964_1
tggacgatccacagagatgtttgaggaatgcttccaacagaggtggtacaggactgctgcttgctacatactggtcattgctaagctggagggccctgcagtcagccagtattgtgcactccgtttgctacaagctacacttgatgagtctttgtatgagcttgctggggagttggttcgcttcttgctaagatctggaagagattttgagaatgctacttcagactccgagaagctctctccaagatttctaggctattttcttttccgttcaccatataagcggcaatcttctgatttgagaagtaattcaatgaaagaacttagtccacatattgcctctgttatgaacattctagagcgccatgcttgctatttgatgtctggcaaggagctntctaaactcgtcgcttttgtcaaggggactcaatttgatcttgtggaatatctacaacg

SEQ ID NO: 4835 - DNA, 607 bp, Sorghum bicolor
  Clone ID: SORBI-28MAY03-CLUS9078_1
cggcacgagggttccccgtcctcatccagcggaaggcagctgtgccagctcaactgctcgaaccagcaggcgtgggaatctgggcagcggagcggagaagaggaggcaggcagcggtctcggccatggcgagctcttccgaccccgacaagctcatgagcaaagccgacaaactaacaaaattaagttttacaaggtggaatgctgattggaaaagcgccacttccttgtatgagcaagctgcaattgcttataggttcagaaaggacaatgagaaagcaaaagatgcgtttgagaaggcctcaaaaggacaggaaatgatctcctcaccatgggacgctgctaagcatatggagtctgctgctgctttagcaaaggatcttggacgctggaatgaagtatctgatttctatcacagagcttcagaattataccgtgaatgtggaaggtcacaacctgcatccgatgctctagcaaagggtgccagtgcattggaggagaaatctccagaagaagctattaaaatgtatgatgaggcttgttcagttctagaagaagatgggaaggaacagatggcttttgacttgtatcgtgctgcagcagctttg

SEQ ID NO: 4836 - DNA, 1153 bp, Sorghum bicolor
  Clone ID: SORBI-28MAY03-CLUS90781_1
ctctctctttctggtctctgcttgtggtttcaggggacgctggtggcgctggcggccttctcggagggccgggtggtggaccagctgaaatccgcggcgctgctcacgccggtggcctacctcgcccacatcaccacccccatcggcatcctgctagccaaggccttcgtcggcgaggcgctctcggacctcctcggcgtcgccgagttcgacccggtagcgtacgtacggcgtcctcgggctcgcatctccaggctgcagtccctgcactgcagatcgattcagattattcatctctccgtttttggatcactcgattcgtgtgttgtgatcagctgacctgctgctctgctgactgcgcaggccgccggtgacgaacctgatcagggcgttctgccgccggccaggcatgaactgctacgaccttctcggatccatcaccggcaagaactactgccttaacagctccgccgtcgacgtcttcctcaagtacgagccccagccgacctccaccaaaaccatggtccacttcgctcaaaccgtgcgcgacggcgtgctgaccaagtacgactacgtgctgccggagcgaaacatcgcgagctacggccaggccgagccgccggtgtacgagatgtccggcatcccggcgggcttcccgctcttcctcagttacggcggccgggactcgctcgccgaccccgccgacgtgcgcctcctgctgcaggacctccggggccacgaccgcgacaagctcacggtgcagtaccttgaccagttcgcgcacctcgacttcatcatcggcgtttgcgccaaggactacgtctacaaggacatgatcgccttcctcaaccgcttcaactagtagtagctatagctactagttcagtgactgccatcttcagtcttccactcactgcagggcgtgaacattggtcatacatatgtcagaagtgaaaaatatacatgaagtaatttaatactactagattactagatagttatattgatatggatttgtctgagcaaggaagctagctagatagccagctaggtgtcatggagaagggtgatcaccggaacagcggtcagcccagccagtcgtcacactgtatttgcaatttgtaaccctgaacaattactaaaggaaaggtag

SEQ ID NO: 4837 - DNA, 426 bp, Sorghum bicolor
  Clone ID: SORBI-28MAY03-CLUS90784_1
attcaggacaaggagggcatccctccggaccagcagcgcctcatcttcgcaggcaagcagcttgaggatggccgcacccttgctgattataacatccagaaggagtccaccctccaccttgtcctccgccttcgtggtggtcagtgagcttttgctgcaaaagattagaggtgtggtcatgtcgtttgtgtcatgttaagtgtggtcgagttccagtaagctgaataagtatactgtgtcatcgtgctagtatcagtatgtgtggaggccttgtgagccttttcgatggatggtctcttgcttgaaacaatattatcaagttctacttgaatatctggtgattctatctctttatttgtgttactgaaacagtattactaagttttacttgaatatatggtgattccatcaaaaaaaaaaaaaaaa

SEQ ID NO: 4838 - DNA, 611 bp, Sorghum bicolor
  Clone ID: SORBI-28MAY03-CLUS90804_1
gctgttcagctggccaaccaagtggaggttcttcttgtatgccacctactgctggctgcagcgtatcattgacttgtgatcaatgcccaggtgcaagcactgcataccctagtgtttcaaacttcatgcaggccccaacaaaggtatctaccaatgatgatcaagttgctaaggccgcaatgatgactgctgaaggtgcctttaattttatgaaaagtacgatatctggactgcctggagcccaaaggaacgaatctgatactggaaaggaggaaagcacgagtatgggcatgaacccaaatcttgatagtgatcttgctgctctcttgaattcatggtatgctgctgggttctacacttgcaggtacctcatgctgcaatctgcgaaaaattccagaccttagtgtagtagtctatggccgtcttgagataggtgtctgagaacaagcaagctgaagcatcactgggtgcctgtgcgccttcaactatgaatattttgctggagttgtgtctgtattatgtcatgctggtcacagctatttcaagctagactttcggtatgttcatatgtgaatctgttgacgtcaggcagcaaaattggtaaaagagtt

SEQ ID NO: 4839 - DNA, 956 bp, Sorghum bicolor
  Clone ID: SORBI-28MAY03-CLUS90848_1
gcacgaggtagagagtggatgtgagcccgatgtggtaacttataatgtgaaggccctgtattacatggcacatgggaagccagaagaggttattgaggtgatgacagagatggaagcggctggactgaagccgaacaccatcacctacaattacctcatgattagctattgcaagagtggcaaattggaggatgctaaggtcctttaccactccctagctgagaaggggtgctcggcagatgcttacacgtacaagcacatgttagcagagctatgtgcccatggagactttgatgctgggttgggcatcttcaaggatagcttaaagaagcgcaaagtgccagattttaggacaatgaaaaggttggtggagggattggcaaagggaggtagggtggctgatgccaaagaggttattgcagaggtaaaaaacatgttcccagagaatttgctgtctgggtggaagaaggttgagaaggagcttggattggactcagatagtggaggaactcctcagtcggaagttacatctggagaaactgttgctgaggttaggcctgatgctgcagagacagaggcgcttgagctggaaggatctgcaactgaggaaactgctgtatcagaagaatccagtgatgatgaagcttctgtgcctgaagcatcatctagtgaggaagtgccagaaggtcgtgcctaagcggtattaccatgttcttcaagtttcatgtgtctagggtgtttgcattgatcacattctctacattgaagaatagttaatgctgccctgtagtggtaaacattagattctgaatacaggctcctgagctgctatcatggccaactcttgggatgaaagcatacctggtatgcctgctgtataatgctaagaggctattgttttggtgatgcttatcttgtcatcattttatatgataaatgcattggttttgcagtcc

SEQ ID NO: 4840 - DNA, 484 bp, Sorghum bicolor
  Clone ID: SORBI-28MAY03-CLUS90068_1
ccccgcgccccccccccctctcgcccccgcgtcctccgtctcccgcttgcgctagctttcgcttgcagttgctggtagggagcgcagcccacccatccgagctggggtgggcgccgtgctgaccggtggggccggacggcttgggctcgatatgcgctggctactgccttccaacggactcgcgggagttgtcacagcaggcgtcgtctcgggcggcgccgtcgctccccgcgcacctgggctatccttcgtcgtgtttcttctgctggtggtctccgtcccgtcgtgcgctccacgctcgccggggtttctcgaggggacggtgggcttgcgcgagatattggctaacaacgcgcgtcctgcgggatcgcggtggtgcggccagcacccggtgagttgtcggccgctgctcctggccgcgcgcgtgcccgtgccgaggatcgaaacaatgaataagcacatcacagaagcttacgatgaagca

SEQ ID NO: 4841 - DNA, 602 bp, Sorghum bicolor
  Clone ID: SORBI-28MAY03-CLUS90188_1
gctgggtttgccgccgcactgcgaccgtaacctcatcacgctgctcctccagggcagcgtcgccggcctccaggtcgcctaccgcggcgactggatccgcgtccagcccgtccccggcgccttggtcgtcaacttcggccaccagctcgagatcgcgacgaacgggctgctgaagagcgtggagcaccgcgcggcggccaacgcggcggtggcgcgcacgtcggtggcgacgttcatcatgcccaccgacgactgcctcgtcgcccccgccgcggagctcctcgccggcgacctcggcggcggcgcgcggtaccgcgccgtgacgttccgggagttcatgagggtgtacaagaccgtcggcgcgcgcagggagagcgtcgagaaggccttcaagatctgattgatgtcgtcagctgtttggcagctcgtctgtgaccaggccgtgctctatagccgcacgccagagatgaacaaattgctttgtatttttttttttttgaaatctacatcatcatattgctttgtatttttttttttgaaatctacatcatctatagccgcacgccagagatgaacaaataaggtggccgctcgtttatttc

SEQ ID NO: 4842 - DNA, 769 bp, Sorghum bicolor
  Clone ID: SORBI-28MAY03-CLUS90209_1
gcctactgatggcgtctctctgcctcgtcagtcgtcactgagcaccggcgccgcgccccccacctccactccacctgcacaccgccgtccccccaccctcacccccacgcagccatccgctcctcgtcgccttccgacgccgagttcgccggtgtcgatttgcgccggcggcggctcgatctggccgccgcccgtgccgacctgctcgtcgaagcccgtggcagacgtaatggatgggcaaggcacaaagcacaggattttgatggtgtctgactttttctttccaaactttggtggggtggaaagccatatctactacctgtcacaatgtctacttaagcttggccataaggtggttgtcatgacgcatgcatacggaaacagatctggagtacgatatgttacaaatggtttaaaggtttattatgtaccatggaggccattcctgatgcagaatacacttcctacattattcttgacgttcccaattgtaaggacaattattattcgagagaagatttctgtcgtgcatggacatcaagctttttcaacactgtgtcatgaagcattaatgcatgctaggacgatggggttactcttgcagatattgatcaggcaatatgtgtctctcatacaagcaaagagaatactgtcttgaggtctgggatatctccagagaaggttttcatggttcctaatgcagttgatactgcaatgtttactccctcccccaagcgcttaagctgtgatgaaatagttattgttgtga

SEQ ID NO: 4843 - DNA, 631 bp, Sorghum bicolor
  Clone ID: SORBI-28MAY03-CLUS90359_1
ggttggcttaccctaacagacaacttcctcctctgaagtcagatctctggaaggagatgggctggcagaactcagatccatcaacagattttagggcagctgggttcatgtccttggagaatctaatatacttcgccagaaattacccagattcctttcaccggctactgcataaggcggatggtaagagagctgaatgggagtatccttttgcagtaggcggcgtaaacatatcttatatgttagttcaaatgctggatttacagtcaggaaaaatgagaacaaaagctggtgttcactttgttcaactactcgaagatgacgatgtggctttcgataaccttttctgtttagcatttaaggtgcttgattcccaatggcttgcaaggcgagctagctatatggaattcaatgaggttcttaagtctacacgggttcagttagagcaagagttaaccatcggaggtatttctcgcattcaagacatgccatcattcagattgctgaaaaagtagcccagtttgtacttcacaggaaaagagatacattttagatgtcaatagattgtctaaatttgttgtccattctttcactggatgttgaagatgtgatattgtgtagttcatatatg

SEQ ID NO: 4844 - DNA, 605 bp, Sorghum bicolor
  Clone ID: SORBI-28MAY03-CLUS90226_1
tcggcatctcgcatcctcgccgcgccggtgctgctgcaattaacgccaacccccggccaacaacccgaaacctacctccgccgccgccgtcgtcgccgccgcaacatggcgagccaaggggagccctcggcctctgcttctgatccgaaggagaagaaggattactcgacggcgatcctggagaggaaaaagtctccgaatcgccttgtggtcgatgaggccaccaacgacgataactccgtcgtcgcgctgcaccctgacaccatggagaggctgcagctcttccgcggcgacaccgtcctcctcaagggtaagaagaggaaagacactatttgcattgtccttgcggatgaaacctgtgaggagcctaaggttcggatgaacaaggttgtccgccagaacctgagggtgaggcttggtgatgtggtttctgtccaccagtgccaggatgtgaaatacgggaagcgtgtgcacattcttccaattgatgatacagttgaaggcattaccgggaacttgtttgatgccttcttgaaaccatacttcctagaagcctacagacctttgaggaaaggagaccttttccttgtcaggggtggaatgag

SEQ ID NO: 4845 - DNA, 637 bp, Sorghum bicolor
  Clone ID: SORBI-28MAY03-CLUS91018_1
aacggcggtgggactggcgagaagacgaagacgaaggcgacaggaggcctcaccggtcgcgaaccctcctcctccagccacgcctcgaaacggcgtcggggcctgcgcggcgagtccatggctgaccgcttcttccccaacgactttcccgacttcgtcgccgaggctgaggcctccgacggcgacggcgaggggcaccgccccgcgggacttcggggcctgctcgagcttccgtacaccaggctctgcgatcgcttactccgcgccgcgcgccgcctcaaggacaaggtggtggaggagacgtggctgaaagccgggcggaaggtgacggactacacgctatacacgggctctctcgggacagcgctgctgctgttcaagtccttccaggtcactggagaccgcggggacctcgccctcgctgctgacatcgtccgcgcgtgcgacgaagcgtcccggggcctgccgttcttgacgttcatatgcgggagggccggtgtctgcgctcttggagcggtgattgccaagcattgcgatgatcagctgagggtcactcaatatctgagctcctttgatgagataacagtcactgagaaagttccaaatgaactgctgtatggaagggtgggctatttgt

SEQ ID NO: 4846 - DNA, 682 bp, Sorghum bicolor
  unsure (1)..(682): unsure at all n locations
  Clone ID: SORBI-28MAY03-CLUS91233_1
ggcaaggaatgaacaatacttggcatgcatgatagtcctggcagccttgcaagttttcctgcggnctaaccagagtgaatgttaccattctgttcttgccaatgctgtcccgagccataagttccaggagcagcccagcagtgatcggtaacatcgtgctggttttggtgaactcctgtggagttcttggatctgcactttcagtgaaacagcttggcagggaggtgacgttcgccatcagtgccatcgtgatggtaatttgccaggtcgcaattccattgatcctagaagttcagatcggagttggtggtggaactcgcatgccgatgggttacacaacagcgatgttcgtcctgacttgtgttgtctcctgcggcctcagctggtcatggggttcattcttctggaccttccctggtaggaaggttcactcggctggacaggttctggccatggctgtgaacctgggcgtctgcttcgcccagatgcagtacttcctgctggtgctatgcaggctgaagaacgccactcttgcctactatgcactgtggatctggtcatgattgggattcagctgaggaaaatgcgtagctagatgagtgtgtgttaactctggttacttgagtgggttagtttggtggatgtaatttctcttcccacttctttatcttggcctggtttg

SEQ ID NO: 4847 - DNA, 708 bp, Sorghum bicolor
  Clone ID: SORBI-28MAY03-CLUS91243_1
aagaagccaaggaagaagaagcctggcagtgacctcagtgcgactgagggattctactactatgctgggttcggcccattccggtccaagaggcagtgtcgaagtggcggcacgaacatgaagtggccgcaagatgaagaggatgacgcgaaagatgatgcttctcctagtgagcagcaggctgaagttgatgatggtcatgatcataccaatcagactgtggctgcagcccgtggcgatgcatctagctgcgaagatgacacggcagggattgccggcgtcgatgaggggagcagcgatgacgacttcgatggacttggtatctctggccacggcatgaatggaaatggtgattccaaagctagcaatggtgatggcaagagaaagatcccgtggaagcggtggaggaagcccgtgaaggcgcggtcgctcaagtccttgatgtaagcacctacatacgtcctcgatctcgcatatcggcgacgacgtagaagaaaggatgctagcaggtatcccttttggcttagtcgatctgttctgattttgttgttgaccagttgtacaagttgtttgacttttgcattatcctttttgcgattggatggttattcatttaattagtctgtcgtgttgaggcgttgtgtgcttcttccttgttgcgtttgggatgaactgatatatgctgtctggtgagtgatggaattttgc

SEQ ID NO: 4848 - DNA, 527 bp, Sorghum bicolor
  unsure (1)..(527): unsure at all n locations
  Clone ID: SORBI-28MAY03-CLUS9128_1
gcacgaggccctcgcggcggcctcctcctcctcatcctcccccatctccgccgccacttgccgccgctttgccctgctcttcgaagcagcccctcgcataagcgcccgggaccaggagccttcttcgcccccgtacgcgccgtctccggctactccggcatggcggcggggacgccggaggagcagcagcagcagcagcggagcgttgtggtcagggagaccgtggagctcacggagacggaggagcgcatcttcaaccgccttctcgaggttgttcgccacttcggcctcggcacgcagctccgcgtcgccggtggatgggtccgggacaagctattagggaaagactctgctgacattgacattgcccttgacaatatgacgggccagaatttctgtgagaaagtaaatgagtactcaaagttgataggggagcagcagaaagggaattgtgttatccagtgttttttgcagtaatcctgatcaatccaagcactnggaaactgctaggatngctattctcgaca

SEQ ID NO: 4849 - DNA, 657 bp, Sorghum bicolor
  Clone ID: SORBI-28MAY03-CLUS9049_1
cttatgacttctttcgttgttggatttatcattgaatggagagtggcaatacccacgcgtccgcccacgcgtccgcttgtgcttgccaactttgctcagcaactttcaatgaagggctttgctggtgacacagcaaaggcacatgccaagagcagtatggttgcaggtgaaggagtgagcaatatccgcaccgtagcggccttcaacgctcaaagcaagatcttgtcactcttgagccatgaactgcgtgtaccagagcagcaaatcctccgccgcagccagacatcaggtcttttgtttggcctgtcacagctctgcttatactcctcagaagcgctcatcctctggtatggttctcatcttgtgcggtcacacggatccaccttctctaaggtcatcaaggtttttgttgtccttgtggtgactgccaactccgtagctgagacggtgagcctggccccagagatcatccgcggaggtgaatccatccgatccatctttggcatcctcaacagagcaacaagaattgagcctgatgatccggagtcagagcgggtcaccaccatccgaggcgacattgagttgcggcacgtcgacttttcatatccagcacgcccagacattcaaatcttcaaggacttcaacctgaaaatccat

SEQ ID NO: 4850 - DNA, 509 bp, Sorghum bicolor
  Clone ID: SORBI-28MAY03-CLUS90571_1
gccgaggcgacggatcccatccatcttcttcttcatccatccatccatcccccaaacacgccaaaaatcaggtcgccgatgccgtctactatctgacatccatcagccaggcaggtagatcgcgcaagcaacccacacgaatccaaaatccaatcctgcttcggtcggcgtcggcggtgatggagggccggagcggcgcgtggcgcctgcagcagcagcagcgggggcccggcgcgcccgtcgcgggcctgcccatcggcttccgtttccgccccaccgacgaggagctgctgctgcactacctccgccgcaaggcgctcgcctgcccgctccccgccggcgtcatccccgacgccgacctcgcgcgcctccacccctgggacctcctccccgccgccgtacaaggggcagccgatgccgacggggagcgcttcttcttccaccgcccggcgacgcggtgctggcgcaagggcggcggcgcggccagggcggctggcaccggcgtctgg

SEQ ID NO: 4851 - DNA, 488 bp, Sorghum bicolor
  Clone ID: SORBI-28MAY03-CLUS90581_1
tctggaacgccaacgcggccgccggacgcgcattgctccccctccctggctcgtctcctaatcatcgccacctcttcctctgctccccctccctggggccgttcttggagctccggttccttgagctgcgcctgcgtctgctgctgacgccgccgccggtggtcgcgtaggtggtggcggcccgcaatggggagaaggagcagccgcgcctgctcccttcttggttccgcccagctgctcctgctgctgctctcgctcgcgctcggctccgccgccgcccagaagggctccacatggaagaccctcagcggcaaggctccagtaatcgttgctaagggcgggttctctggtctatttcctgagtccagtctatatgcttatcagattcttgggagtcttagctcccctgacacagtcatgtggtgtgatgttcggttgacaaaggatggcggaggtatctgcctaccaagcatagacatggataactg

SEQ ID NO: 4852 - DNA, 861 bp, Sorghum bicolor
  Clone ID: SORBI-28MAY03-CLUS9061_1
tgaggctcgtgttccattccttgacaaaagtttcatcaatgtagcaatggacattgatccggaatggaagatgataaaacgtgatctcggtcgaattgagaaatgggttatccgtaatgcatttgatgacgaggagcggccctatttacctaagcacattctttacaggcaaaaggaacagttcagtgatggtgtcggctatagttggatcgatggattgaaagaccatgccaaccaacatgtcacggattccatgatgatgaatgctagctttgtttacccagagaacacacccacaacaaaagaagggtattactacagaacaatattcgagaaattcttccccaagcctgcagcaaggtctactgttcctggaggtcctagcgtggcatgcagcaccgccaaagctgttgaatgggacgcatcctggtccaagaaccctgatccatctgggcgtgctgctctgggtgttcacgatgctgcgtatgaagatactccaggggaagctcctgcctctgctgatccggtctcagacaagggccttcgtccagctattggcgaaagtttagtgacaccagttgcttcagccacagctgtctaaccttctgtttatcacacagcaatgctcgaccagcaaagtctgtgcatttcttgtgtcagtttccttcagatcctgtttattccatcagcaagcaatgaagatatgtttgtgcttcatgcttgatagcatcatgtttgggttttcactgagcaataatactgtttgttttttatggactgaaaagactcgacagctttgtaaatatttgtcactggccaatttcctttggttgtttatgtgatttgcagattgcagtggtt

SEQ ID NO: 4853 - DNA, 825 bp, Sorghum bicolor
  Clone ID: SORBI-28MAY03-CLUS90654_1
acggcccttgcgaagttgccatggccacgacgtcagcgcggacgcacggccaccagcagcaatacggtctgcggcaggacccgctgcgacgcatgcggggcctggatgccaagtcgtcgctccaggccagcccgcgcgcgaccacggtggccacggccgccctcctcgtcccgctgggtgccgcgctgctgggcgcctcggggctcgcgctggctgcgaccgtgaccggtctcgcggtcgtgacaccgctcctcgtgatcttgagcccggtgctcatacccttcgcgctggccgcggtgctcatcgcgtcgaggctcctcgcgtcgggcgcgctcagcgtcgcaggcgtctcggcgctcacgtgggctatcgggtacgtctggcgatggcaaggcgaaggcgaaggcggggtgacagggatggtggtgcagccgctgaaccacgggttgaagcggcacggcgtggaaggcaccgctgcgttcgtggggcaccggcccctgccccgggacatcgatgttgctagtgcatgatggtttggtgacgtgtgcaacttttctagtttttctatggaagtgcaacttttctagttcgcaggtgtgtgacgcatggcatggattttagcttggatggatcacacgatgtttcagatgatgtgtttatttacagccggaataaaacagatttgtgttacttgtaataataacgttcatggaaaaattaaaatactctctccatcctaattttttatatattctagatttaataactatcctatgaagatgttatagtgtatgtctttgtatatgtttttaatatatatagatt

SEQ ID NO: 4854 - DNA, 837 bp, Sorghum bicolor
  unsure (1)..(837): unsure at all n locations
  Clone ID: SORBI-28MAY03-CLUS9067_1
gcacgaggcaggatgccatctgcaagaatactgctctccagttcaagtatgtgacctggcagttgcaagctgctctagcaaacctgccacatagctgttttcagatatcagatgaagttcaagaagaggttgacttagtgcgagcacagcttagaagagaaatggaaaagaagggaggctttgatgtaactgtatttataaaagttcatgatatcttagctcaaattgacaacactgcaccacaatctcaacaaccccatcaacaaccagagcagtcacagatggagaaattcagtaatgatcacctggagttgcaaaatgtcgtttcactagtttctgaaataagcgggttgtccaaatctgacatgacgaagataacatcagagctaattgaaggacttcaaaatgttgaaactcctgaatcgccaaaaccagacaatgttgatagccaatcaagtgatgaaacaaaaagctcatctggagaagttaagaagcctgactctgtagctattcctgaagatttccgttgcccaatatctctcgagctgatgagagatccagtaattgtttcaacgggacagacatatgaacgtgctttcattcaaaggtggattgactgtggaaatcggacctgcccaaaaactcagcagaagctgcagaatcttgcattgaccccaaactatgtgctnagaagtttaatattgcaatggtgcgaggaaaaggggattgaaccancctagcagatctaaaagtgatggttctcctctttgagggtggtggcaacagattagcaattgaagccttagttcgcaacctctctagtagtcattagatgaa

SEQ ID NO: 4855 - DNA, 493 bp, Sorghum bicolor
  Clone ID: SORBI-28MAY03-CLUS9150_1
ccggtgcggaaggccttcatcaagatgtccatccagctctacaactacggagaagggctgatgggaaaggtggcctctgataaatgtcacaaatgggtcttcaaggaaccttctgaatgcgagcccaacatctccaactactggcagagctctttcgacgctcttcctccggaatggaccgatcagttcgcatcaagcatccagaccatagccgtgatccaagccgggcatggcctcctgcagctgggctcttgcaagattatacccgaggacctgcacttcgtgctgcggatgcgacacatgttcgagtcactgggctaccagtcgggcttcttcctctcccagctcttctcgtcctcgcggggcgcctcgccgacgccgccgttccccctcaagcagcagccgcctccggccgccgcgcgtgctccgcagcagctcttcaactgggcaggacaccaccagccgcagcttccgccgtcgccgggcgcgggag

SEQ ID NO: 4856 - DNA, 514 bp, Sorghum bicolor
  Clone ID: SORBI-28MAY03-CLUS9161_1
gcaaacctatgtggtgaacagcagtgaggttgatagggaagttatagaagaggcactgtcattaagtgaccccccacttctgacccctcaaacagaaacagatggagagtctactgatgatgactgtgcatcgtttcctactactggacagactgagttcttttttaaccgaccaaaaggtctatcactatctatggtgctgtctacgcccctttttataactgtaccaaatgtcaaggaggaaggccccaagctatattcagatgtggacccaaagtatgtgcagcgtatggttaaggaatacttagatgcacgtccttgtatgaacctccgtgcaacttcttataacattctggctgttgaggatccaactgatgcccgtgctgctgaaatgggtacagaatcacggctacccaatgttattactgaacagacttctgttgcagctgctcaccctcgtatggtaccaactgaatcaaggcatgaagtttcagcagaagaaattattcccact

SEQ ID NO: 4857 - DNA, 540 bp, Sorghum bicolor
  Clone ID: SORBI-28MAY03-CLUS9162_1
gcacgaggaaattgcggaagggggtgaaagaggctaatgaggaagatcttgaaactgtcctggacaaggtgatgatgctgtttagatatttgcaagaaaaagatctatttgagaaatattacaagcaacacttggcaaagcgtcttctttctgggaagaatgcttctgatgattctgagagaagcatgcttgtgaagctgaagacagaatgtggctaccagtttacttcgaagttggagggcatgttcaatgatttgaagacttctgaggatactacacaagggttttatgcatctacttcctcggagcttctggcagatgcccccacaatatctgtccagatactcaccactgggtcatggccaacgctaacctgaactacctgcaaccttccccctgaaattgtccctatctcagagaagtttcgggcttattaccttggcacacataatggcaggaggctaacatggcaaacaaacatggggcatgctgacataaaagcaacatttggaaatggcagcaagcatgaactgaacgtct

SEQ ID NO: 4858 - DNA, 579 bp, Sorghum bicolor
  Clone ID: SORBI-28MAY03-CLUS9168_1
gcacgagagttaccattcccaagtccaaatgatgaagtcgctcctcttctccgtccaccccacgccgccgctcctccccaccccccgccttcgcaggctcctgcgcttccgcgcctcctcctcagcctccgcctccgcctccgcgccgccccgagccgaccgccgctcgccccggcccgcgccgtcgcgccgcccatcctcctcctccctctatgcgcgccccagcctcctcgagatggagcgcgagcgcgccgcccgccgcgcggacgttgacgccttcctcacctccctcggcgtcgacccgggcgagctcgcgggcctcgagctcccggtcaccgtcgacgtcatgcgggagcgcgccgagttcctgggctccctcgggctcacccgcgaggacctcgccgcgtaccctctcgctctcggctgcagcgtgcgcaagaacatggtccccgtcctcgactacctcggcaagctcggcgtccgccgcgacgcgctcccggacctgctgagacggtacccgcaggtgctacacgccagcgtcgtcgtcgaccttgcccccgtcgtcaagtacctccaggg

SEQ ID NO: 4859 - DNA, 511 bp, Sorghum bicolor
  Clone ID: SORBI-28MAY03-CLUS91870_1
ctctggttattgtgcaaatgtgtgacatgatgattgatggcgatggaaacagtgttcccttgtcggaagctcagaggaagaacgtcttgggtactatcagctcttttgcttcagatgctttaaggacattgtgcctggcatataaggaaggggatgatttcagtgatgatacagatagtccaacaggcggttttactctaatatctatttttggaatcaaggatcctgtgcgcccagcagtcaaggaagctgttgacgcctgtatgtctgctggtatcatagtacgaatggtgactggtgacaatatcaatacagctaaagctatagccaaagagtgtggaatactgactgatggtggcatagcaatagaaggaccagaattccgaaacaaaagcccagaggagatgagggacctgatacctaagattcaggttatggctcgttctttaccacttgacaagcatacccttgttacaaacttgcgaggtatgttcaaggaggtggttgctgt

SEQ ID NO: 4860 - DNA, 649 bp, Sorghum bicolor
  Clone ID: SORBI-28MAY03-CLUS90899_1
aattcccctcccgtcccctcccgtcgtcgtctcccccctcacccgaaaccccgattcgaagccggcggagttcgatttggggatttcggcgcctcgctccccgaaatctcctggatctgagtctgtccgccgtcttcgatctgcggctggagtgagcctgcgagtttttcctgcttgatttggtcggggcctcgggcggtcggggtcttcgatttcggggatggagtcgtcgccggtgtcctactggtgctacagctgcagccgcttcgtgagggtgtctccgtcgactgtcgtctgcccggagtgcgacggcggcttcctggagcagtttacgcagccgccgccgcggggcggcggcgggagcggccggcgcgggacgatgaacccggtcatcgtgctccgcggcggatcgctttccgggttcgagctctactacgacgacggcgcaggcgaagggctgcggccgctgcccggtgacgtccagcacctcctcatggggtccggtttccaccgcctgctcgaccagttctcgcggctggaggcggcggctccgcgtccgccggcgtcgaaggctgcggtggagtccatgccgtcggtgacggtcgccggaggtggtgctcactgtgccgtgtgccaggaggcctttgag

SEQ ID NO: 4861 - DNA, 587 bp, Sorghum bicolor
  Clone ID: SORBI-28MAY03-CLUS90911_1
ctgtccatttccgttcccaattgcactcgacagaaaccgaactcagccgatccccacaggaacaccgcatcctcgccgacgccggagaagccgaagctcccagttcgcgcgtcggagccccagcacagccgcctgccgacgggatggggagcgcggacctggtgctcaagctggcgtgcgagggctgcggcaacacgtcggatctctacggcacggggtgcaagcacaccactctctgcagcgactgcgggaagtccatggcacgctcccgtgcccgctgcctcgtctgctcggcgcccatcaccaggctcatccgggaatataatgtacgagctaattctgttacggataagacatactctattggaagatttgtcactggcttacctcctttttcgaagaagaagaatgctgagaataagtggtctcttcataaggagggtctacgaggacgtcagataactgacaatatgcgggaaaaatacagcaagaaaccatggattttggaagatgaaacaggccaatatcagtatcaaggtcaaatggaaggatcacagtcggctacagctatgtattatttgttaatg

SEQ ID NO: 4862 - DNA, 661 bp, Sorghum bicolor
  Clone ID: SORBI-28MAY03-CLUS90940_1
tgaactgaaaccagatgagcaggacgatgtaaagaacaccctgcggtatatgatcgagaacaggtttcctagtggcaactatccctcaagtgaaggcaatgaatcagatcgcttggtgcattggtgtcatggtgccccaggtgttgctcttacgcttgctaaagcatatgaggtcttccatgatgattatttcaagcaagcagctgcagaggctgctgaggttgtctggaaccgagggcttctgaagagagtcggaatatgtcacggtgtaagcgggaatgcctatgtgtttctctcactctacagactaagcggcaatgttgagtacctctaccgagcaaaggcttttgcctgctttcttctggagaaagctgatcagctgatagccgaaggggccatgcatggtggtgatcgctcgttttcactgtttgaagggaaggcggggatggcatacctcctcttggacatggttgatccatcagaatcaaggttcccggcctatgaactttgagaaacccaatctgtacaattaccctgtggtttgtgaggctgtgtgatgatccagcactctggaaaacgctgtgtttgtgttctctcgtctactctgtaaatgtgtgcttggacctcggtgacgcctgctgtgttgtagatttgggttcct

SEQ ID NO: 4863 - DNA, 609 bp, Sorghum bicolor
  Clone ID: SORBI-28MAY03-CLUS90989_1
accatccgcttttggaaaattttctaagcatgaagcatttactggtgaagttaatggagcatctgttctcttcttgccttgtgctgtttataattggaccccgcctgagggtgctggacagtttcatggtatacccttagatgttaaggttgtccatttcaaaggttcaagaaagcgtttgatgcttgaggcatggaatttttacaactcaacctttaagctgtctgatatgctatgcctaatcttgagaagcggccggacgaaatatgacttctgaacttttggttaaaaactgacatatgccgctcctgattctggatctgcctgacctgggcgcggtcttcgctagggtcgggtaccgcatcaagtggacgtgtagcttcctccagggatctgggattcgtctggctccgtgctgggttgtgagctcgggtgtgaaactgtttgatacagctcagtagaagttagaacccatacaaggagaaccatacacggggtgaccacgtagggattcaccttttgttccttgtggttccccccctccggtcgcttctgctatgtggttcccaagccctgtctccgtggtagtaaaggcaatttctccatcgg

SEQ ID NO: 4864 - DNA, 716 bp, Sorghum bicolor
  unsure (1)..(716): unsure at all n locations
  Clone ID: SORBI-28MAY03-CLUS910_1
acccacgcgtgacgcnacatccaaagcgcccggcgcagcttgaggccggccgggccggggcgagagatgtcgctctgctgctgcagcgccgccaccggccgcggtgtgctcctccctagcctcctcctcggcaggcgccaccggctgcgtcaccccctcgtcaacctccggaccatcgcgaccttcgcctcctcctcctctgccgccgccaccacctcctctctctcgccgccgcagcagcgccaggtcaccatctacgtggacactctccttgaatggaaccagaggatgaacctcaccgccgtcaccgacgaggccgaggttatgacgcgccacgtggcggactccctcgccatgctgcccccactggagcgcgcgtaccgcggccgttccacctccgctggtggctctatcgacggggttagccttatcgacgttggctccggcgccgggctcccgggcctgatccttgccgttgcgcggccgagctggaaatttacactgttggagtcgatgcggaagcgatgcacgttcttggagcatgccgttgaagccatggaattgtcaaatgtgaacgtggtgtgtgaccgagctgagaaagttggccaaagttttgatttcagaggaagatatgatatagtagctgcaagagccgttgctgaactgaaagttcttgactttctcttttgcagcggagtattgcatcccattggttc

SEQ ID NO: 4865 - DNA, 598 bp, Sorghum bicolor
  Clone ID: SORBI-28MAY03-CLUS91138_1
attccagatggtccctcaatacgtaaggagataccagttcagccttgggaatcaagtattgattcatctctgacaagcgaggaaagggagcaaaagcggaaccaagctcccgacagagcaacctttgtgcaaggcctagtgctgtctactctattcggagattgattgttcaaaacagccctaggttcttgcacttgctagatcggcacttactcctgcctggtccacatagtcagatagtgctcaacccggtttggtgcatctatctctgatggcaggaaattcgcctcaggaaacttagccgcgttcatcttggtttcagtgaattgcgcagttgattcttccatgatacagctttgatttaagctagctgttgttgtacctttgtttttatcaatttatcagccagcaattcttatctgtaactcactggtacattgtgtttgtaccgacatacataatagctgtaacatctacttacacaatgcaagaaagacacttgttcgagagcagttgccaaagtgcaaatcttttttgttgtagtagggatgaaaatgatacggatatttttcgattgtattcgagatcgaattcgttt

SEQ ID NO: 4866 - DNA, 666 bp, Sorghum bicolor
  Clone ID: SORBI-28MAY03-CLUS92278_1
gcaccggggccaggggcgccgcgctcgcgccccgcgcgcgcgcctgcaggcttccactcggccgctcgcagccggtcagccggtccgcccggggcaggggcggcacccggtgcacggccgggcccgacgggccggcccggccgcccgcgcgggggcggcgccccacgtcgcgccggcgcggctcgtcgcgccggcctgcaccgtccccgcgctctgctccctccccgccctccgcgccctcccccccctccgcggccccctccacctcggccagccgcgcccgctctaccagccgcgccccctcgtcgaggcgctcctcatgctcctggggggcgtcgccccgctgctcacgctgtccccccggccggtccagcggcctgccgccccgcccagctccgcggccggcgcgcggccgggcccctgccccggccgccggcgcggcgcggctcctcccccccccgccccgccggcgcgtctggtcgccgccgatgccctcggtggctgcggccgggcccgggcgctccgcgaggctggggccggggccgcgccgggcccaaggggccgggcagctcctccgctgccccatgttgcctcgcgccggctcccctgcttctttctgggcctcgccgtcgcgcttgtatttttctgtgctacaactatgctttt

SEQ ID NO: 4867 - DNA, 683 bp, Sorghum bicolor
  Clone ID: SORBI-28MAY03-CLUS92438_1
catcagttgcagatgggcttagcatccaagaaatattggagaactggttaaaactgaagcccactctcatggatgagtggcaagaagatagggaatctcttgtagatctctttggccgtgtaagagatgattggattgaaaatgatttttctggctggataggtgctaacaggttttatcctgggacagctgatgcattgaagctttcaagctccgaaacttacatagtcacaacaaaacagagtagatttgctgaagctctactcaaagaattggctggaatagactttccctctgaaaggatatatggccttggcactggtccaaaggttaaagttctccagcagctgcagcaaatgccgcagaaccaaggcctaaaacttcatttcgtcgaggaccgacttgcgactctgaagaatgtgatcaaagaaccagcgctggacaaatggaacctctacctggtgacatggggatccaacacacagaaagagagggaagaagcagaggctataccaagggttcaactcattgatctcccagatttcagtaggcagctcaaatagctagcagtgacattggcgtggatcttggaaactttgttttcgtttgatgtacgtaattacatatgaacagcagcgatacttgaattttcgattgaataaattgttcacatatttgtggac

SEQ ID NO: 4868 - DNA, 569 bp, Sorghum bicolor
  Clone ID: SORBI-28MAY03-CLUS9247_1
gtctggctgaaccatcctcagcggaccctgggccatctttccgtggcgcaggatcatcctctgcaagccgtgggcgatcttctggtctcactggatggtccacagctgaccttgagcaatccttcaagagaacaaagagaacgacaaacatgcagtggaagatatcaaaacatagagcaagctaggagcacctggcatgatctatggattatcctctaggctatacagcagttggttccttttgccccatacaagctgccatcttttgtgtagaaggtgcaatgctgtacttgctcattgctatggtaccattgaaagcagccgacaatggggcatagtatacaagaggtaatcaataaacatcaagatcaagtgacgtggctttaactataatctaatgcctttgggcagtggtctactcctgctttgtggggtttatacagttgaaaaatgttgaggttgttgtttgctttgtacttgtataagttgtaaactgtatctgtatgtatgtgttgcatttgtaaacaaactggacgagtacaagtgttgcttatacatgtaggccattc

SEQ ID NO: 4869 - DNA, 343 bp, Sorghum bicolor
  Clone ID: SORBI-28MAY03-CLUS9255_1
cgcaggccgtcatgaagcccatgctcgacttcctggcgcagaccgggtcgtacctcatggtgaacgcctacccgttctttgcctactccggcaatgccggcgacatctccctcgactacgcgctgttccgccccaacgccggcgtgctcgatgccgggaacggcctcaagtactacagcctcctcgacgcccagctcgacgccgtgttcgccgcggtcagcaagctcgggaactacaatgccgtacgcgttgtggtctccgagaccgggtggccgtccaagggcgacgccaacgaggcaggcgcttcggcggccaacgccgcagcgtacaacggcaacctggc

SEQ ID NO: 4870 - DNA, 675 bp, Sorghum bicolor
  Clone ID: SORBI-28MAY03-CLUS92941_1
agcggcgagggagagttggaggccgaggaggagcagctgctgtaccgcgtgcccatctttgaccctgcgctagccgagttctgctcgccgccggcgcctcttgatcccgccgccgcccgcttcgggcacgccgccctcgcgctcccccccaaccccgagcccggccccccgaccccggcgcccgcgccgggggcccccggcggcccccgtccccgcctcgccctcgtcgacccctccccccccgcgctcaggggggtcgccgcaggcgtggcggccctccgcggccacggcctgctcctcggcaccgcggggctcgcgtcggtcggcggccgggcgccccgcctctcgcgcccccgggaggtgcgcggcgccgccccccgcgccaaggtggtccccgacggcggccgcgcccgcggcgccgccaggcgcccgcgggcctgcgcccgcgtcctcctgcgccccgccgccgctggcggcagcctcgccatcgctggcctcgcttaatgccgccggcgtgctgcatgtttttggttgtgcctgcgtggagctgcgagaccgcgggccgcgcgctcgtccgtcgtcatgaaatgatgacatgaacaaacaactcgtcgaagctgctttttagttaattcaactcaaatcaaaaagaaattacctgtttttttttcacgg

SEQ ID NO: 4871 - DNA, 632 bp, Sorghum bicolor
  Clone ID: SORBI-28MAY03-CLUS91292_1
ctggggtcgacggagagccgcaaaggaggaggaggaggaggaggaggtgtcgggatccggcgggccgcccatgtcgagcggcgcggacggatccgatcccagcacgggccttggcccggggacgatcccagagctgccggaccgtgagccgcctctgctgcaggcgccgtcgccggcgccgcagcaggaggcggtggtgccgcagaccgaggcgccggtgccagtggtaaccatcgtgatctcgcggccaggggaggaggttcagacgcccgatgcaaaggttggctccccggcgtgctccccgcaggccggtgacggcaaggctacggccacctcggcttcgttgaccgcttcggcggccgagctaggaaggtctgacagcttcgacgactacgagcaatgcagagccgcaaaggaggaggtgaaaggatccggcgggctgcctgtgtcgagcagcacggacggatcagatcccagcatgggccttgacccaggaatgatcccagagccgccagactgtgagccgcctctgctacaggctccgttaccagcgccgcagcaggaggtggtggcatcgcaggccaaggcgctggtgccagcggtcaccattgtgatctcgcggccaggggtgg

SEQ ID NO: 4872 - DNA, 691 bp, Sorghum bicolor
  Clone ID: SORBI-28MAY03-CLUS91315_1
gtctgctactctgctctacccaccaccggcgccctcgccgcctcgcccgcctccccctgaccccccgcgggtgcttgccccctcctcggttccccaccgcccccgacctcacgtactgcgatgctcccagctcgagagaagcgcacggcaggcgagaagaaaaggcgctgacgcctcgtttccgtcgcacacactactcgccagattggatcactccccttccctgctcttccgtcttccgcgggccgggcgaagctctctggcgcggcgacacttcctccaagacctcgccgccggcgtgaggggcagtcgccgccggcagtccgcggcgcggagcatcaaggccgcagcaaaagggagagcaagtgggcgaagtggtactgttgcggtattctccggaacactctctccatccccatccccatccaccaaagcagcagccagcagcaggtgttctcaaaatgcagtcatctgtgatggcgttcttccctagtgttgccacagcaaaactggagctgaattctctgtacaggaaatatgtggacatgtttggtatatcgttaaacaactctaccgttggctgccatctcacccgcaaaatggcgcaccttcctgttctgttgatcgatcgtacatttttcagtactggttctgctattcagagtattgccaccagctacggagctcttat

SEQ ID NO: 4873 - DNA, 717 bp, Sorghum bicolor
  Clone ID: SORBI-28MAY03-CLUS91338_1
aagctgctaagccaccagtccaccacccatcggtccatgtccatcaccctctctcgtttatttttgcgccatcttcctcgcctcctccacaaaacaagtccacctcccgactccaccaaaatcccaaaccctagcggccccggctcagatccctccaccttcagctatccatcgcggtgggcaccatgcggatccgcaagagcgcctcccgcctcctaggctctgcctactccgcctccgctgccccgcccgttggtgcggcgcctccgttcgacctgcttccgccgccgccgccgccgccgccaccgcacctggcgccgtgctccgcgcccgaatcctggggcggggccggcttctcgggcccctctgcttcctctgcggagccctgcgagctcagccgctcgccatgggacctcatcgccgagctctccctctccgacccacaggtggaggatgacatcgtggacaagtacttcgtccatgtcacgacccgctcgagctggctcttctcagccaccatgccagccgcctcctccgccaagaagaagaagaagctgcaggctgcagctggtggggatagcacgaagctgcgccgtgacactgtgaagaagcctgcaatgagtaaggagaaggagggcgaggccaataagaaggcaaaggtcaagaaagaggaggggcaggatcaggatggggcagcacgggtctggatgtgcaaga

SEQ ID NO: 4874 - DNA, 488 bp, Sorghum bicolor
  Clone ID: SORBI-28MAY03-CLUS91393_1
aaaaagcgagacctcgcagctgacgcgctcacggcaaaccccaatcggagccgcggaccggatcggagctaggtctcgaggccatggcaagcggaggcgagggcgcagggagcggcgagtcccctcccgctgcctcagtggaggcggcagcgggggaggcgacgctgcacatccggtgcgcgaacggctccaagttcacggtgcagacggacctgggcgccacggtgggcgcgttcaaggaggtcgtagccgggagctgcgacgtgccggcgccgcagcagcgcctgatctacaagggccgcatcctcaaggacgagcaagccctagaaagctacggtgttgagacagatcacacaattcacttggtgcgtggtgtcgccccaccagctgcatccagtgcacctgctgctgccagccccctagcttcatctactcctagtagtggccctgcaggtggactgggaggcctatttccaggtcttggtgct

SEQ ID NO: 4875 - DNA, 642 bp, Sorghum bicolor
  Clone ID: SORBI-28MAY03-CLUS91430_1
cgagggcgcccaaggcgtccgtcccctaccgctacttccccgacgtgcacgcgctcgccgcggactccgacgctctgatcgtcgcgtgcgcgctcaacgacgcgacgcggcgtatcgtcgggcgccgcgtgctggacgcgctgggcccggaaggcgtcctggtgaacatcgcgcgcggcgggaacgtggacgagcaggagctggtcttggcgctgcaggatgggaggatcgccggcgcgggcctcgacgtcttccagaacgagccgcacgtgccgccggagttgggagacatggacaatgttgttctgacggcgcacgaggctgtgttcaccgaggaatctgccgctgacctccgcgagctcatgattgggaacctcgaagccttcttctccgggaagccgttgctgacgcccgtgcttagtcgtccatagtacatagcatagctgattgatgagattggtacagtatgagttgattctttttaatcttactgcaattggagtgcatagcatctatgtgtgttgtggctgccagtggcaacttcagtgcagagcaatgcaagtgccggaatgcaggaattagctatttttaggatccagcacacttaattgagttcaggttgaataaagcgacactgatagt

SEQ ID NO: 4876 - DNA, 776 bp, Sorghum bicolor
  unsure (1)..(776): unsure at all n locations
  Clone ID: SORBI-28MAY03-CLUS91439_1
attttagtgcagtgctatgcatcttctggttggattatttacttctgtcagatgtatacccatgattaattgttgaaactttagatatttatggatcaccatataactctgtatattgatgactaacttgcgagtctgtgacttcagccaaaatgtgaagtgtcttactctttccattgttctgcggctatatatttaccaaaatacccaagcaacttctgataatgatccagacaatactattgtgttgatctgtaaatagttctgttgtttccaagctacatgacagatatttattttctagacttgcttcattactgttgatctgtaaatagttctgttgtttccaagctacatgacagatatttattttctagacttgcttcattacttgcaggntatttgttggtggtcttcacttggtgtgactgccggccttctgaaacaaaccttcagtccatagggaaaccttctctatgtcaaattgcctgtagggaagctttgtggatttgttcaatattctagcagtcatgaagaatatctttttttcatgtattgtgcatatcagtttatacaccagtcaatgctgattaattatgttgtcttgagtgtacagttccatgttgaaaccttcttgcgtcaatattttagtgccacagttagagcccaatttgttatagtaattccacgttaactgaggagtgtaatgtgtaaattagaaacatatgacaaaggatttcaaatttataatagacaatgcttctattacttttcgt

SEQ ID NO: 4877 - DNA, 671 bp, Sorghum bicolor
  Clone ID: SORBI-28MAY03-CLUS92694_1
aagcaggtagcatctgacattggaaatggcttacaagtcccagtgttcctgtatgcagcagtccacccaacaggaaagtctgtgggtgcaattcggcgtgagcttggctactaccgtccaaattacaaggaaaaccagtggttaggtagcgtactccctgatgttctgccagttaagcctgatgtgggtccaactcatgtctcacataagagaggtgccacaacagttggcgttacgccttggattgagggctacaatatcccagtactgtctaaggatgtcccagctgtgaggaggattacccgcagggtgactggacggagtggagggcttccaacggtgcaagctcttgcactcttccatggagatgattgcacagagattgcatgcttgttggatccagatcatgtcagtgcctatcaagttcacaccgtggtggagcagattgcaggagagcaaggacttgaagttgagcaggggtactacactgacataaccaaggatgcagcgctcgataagtatttgaagattgcttgcactgatgattgataaagcctgtatagactttatgtggctgacatccttgtaaccatcaatgtctgaagtgggcatccattgctgtttagttgtctatcgtcatctcaacctgaatgaagaactgattctatttt

SEQ ID NO: 4878 - DNA, 546 bp, Sorghum bicolor
  Clone ID: SORBI-28MAY03-CLUS9273_1
gtttctgagaaaaaggctaaagcatggtgtgcttcaaagggaaacatcccctactttgagacgtcggctaaagagggcttcaatgtagaggctgcatttgagtgtatagcgaggaatgctgtaaaaaatgagccagaagaagatatgtatcttcctgatacgattgatgttgggggcgctggaaggcaacaacgttcgtcaggttgtgaatgctagaagatatggagcacagcgatttgctcggttggttggtttgattctctagggcttgttgtttgggacatatattatatatttagtttgcaaaactgctatttgtggatactggatagtctggcaatctgcatgggggtgcttattgtcgactcccctatgtagatgcagagaattcatttgtaactgctgtttcagtgctgtatcggcgctagatgctagtgttgtaatgctttgattgttgatgaattgcatatatgtatgttttggttagtattgctgtaaatgaactgaacatagtgcccattttgatagtgttggttcgttggtttg

SEQ ID NO: 4879 - DNA, 670 bp, Sorghum bicolor
  unsure (1)..(670): unsure at all n locations
  Clone ID: SORBI-28MAY03-CLUS92764_1
gagcagcatcgtcgttcgtgctccgacgagcccgcccaccagcctctctgccctctgggcgctcgagcctcctcgttgccggcttgtttgtccatctgctgagaaatagaggtgcgagatggcctccgttctgccggatactgcctcggatggcaaggccctgacggacgcctgggactacaagggccgccccgccagccgcgccaccaccggcggctgggcctgcgccgccatgatcctaggcgcggagctgttcgagcggatgacgacgcggggcatcgcggtgaacctggtgccgtacatgaccggcaccatgcacctcggcaatgcctccgccgccaacaccgtcaccaacttcatcggcgcctccttcatgctctgcctcctcggcggcttcgtcgccgacacctacctcggccgctacctcaccatcgccgtcttcaccgccgtccaggccacgggcgtgatgatcctgacgatctcaacggcggctccaggtctacggccaccgccgtgcggtgacgccaggggggcgagcgccgactgcgtgccggccaccgggnacgcagctcggggtgctgtacctaggcctctacctgacggcgctgggcaccggcgggctcaagtccagcgntgtcgggggttcggctccgaccagttcgacgagtcc

SEQ ID NO: 4880 - DNA, 714 bp, Sorghum bicolor
  Clone ID: SORBI-28MAY03-CLUS92815_1
ttttctcctctttccctccttcatcactaaggtttctctcttgcagccctgttgcatgccatcttccttgctagcaagaatctcttgcccttgatccccgaccctgagcacttcaatcaccttccttgtgttcttgattataattcctagccttgttctcgtgaccagaccatcaatccttaggcttgaaagatcatatttccattgaaagaaattaaagcttcctggggagactctgccaaaatttttacctgcagctaagctcatacaggagacatttgttccggtgcatctgcatcgtcaacttgtttgtttctgtaaaaagcttattattgtaacgttttggcgaattgatcgatgatagactaaagagaggaaggtcgtgtggcttgttagatgtcacaaatcctctctgaggtcagccactccagatttatgatcaactcgacgctccggcgaggcacccatcttgttctctctttctccgttgtgttcctctactggttctatgtgttctcagtaagatcctaaccactaccacaaaatctcttctattgatagaccattcaaatagaaacatactagtatcatatccttgtactgtctacctactacactgctccttggaaattatagcctctacatacaacttaactagaggaagcttctagtctagatataactttgggtacagtgagcatagtgtcaaggtcg

SEQ ID NO: 4881 - DNA, 879 bp, Sorghum bicolor
  Clone ID: SORBI-28MAY03-CLUS91898_1
ggcaacccggctaccggaacggccaccgcgggacgtcgccaagcctccttcccctgcgcgcctctattggatagtgtttttcttcttcgttcaccccgcctggcccgaccgccgccgccgccttactcctagctgcccaggtctctgtcggaccctttgccggcgacgagcacccaccagaccaggcaccggtgcttgtcctcgtcccctccacagctccaccagcggcccaggttcgaacttcaagtaacaagctgcccacccgcgtgaccatgtcctttattctgtccgcccctgcctgaagtaggtaggtcgacctgcgccaatgcactgaccacaagggggatacattcttcggcgaagaatagtcttaggccccgaaccttttttggggggactcgagctattgcaatggagattgtgaacagtgtttacttcggcttcataggcgtcagcacaactagaataaacaagacagtgaaggtaggatcccaaccacaccagattggctggaagctaagaaggacatgttgcgagtactctcctggtacttctagaaagaagcaggagaagtatgagggacaaccacagaacgtcgatcttccagaattacatccaaaaaacaaaaagaaaccctttcctgttcctattaaaaagatgttgcaagcttctcggcgagataagaggcttgcacaaatgcatatagagaagcctcttgaacccccaaagaatggtttgcttgtgccagagcttgttccggttgctcatgaagtccttgataactggaaagtgctcatcagagggctatctcaacttctgaatgttgttacagtttatggctgcagaaagtgccctcaagttcatgttggtccagttggc

SEQ ID NO: 4882 - DNA, 757 bp, Sorghum bicolor
  Clone ID: SORBI-28MAY03-CLUS91886_1
aaccaccaggctcgttcttcttcttcttcttcttcttcacggtagaggcagaggcagaggagcggcggctggacctggagagccgccatggcacgcctgctcctctccctctccgtcccagtctccgctagcattgtgctgccgtcgtcgtcgagtactagtactagtaccgcacgggcacggcgccgagggagaggccgcgtggctgtgcccgccacctccaccgccaccgccacccaaggacaagaagcaccggcgtttgaccccgcggcggcgccaccgttcgggctggccgacatccgcgccgccatccccaagcactgctgggtgaaggacccctggcgctccatgggctacgtcctgcgcgacgtcgtcctggtgctggggctcgccgccgccgccgcgcgcctcgacagctggctcgtgtggccgctctactgggcggcgcagggcaccatgttctgggcgctcttcgtgctgggacacgactgtgggcacggcagcttctccaacaactccaacctcaacagtgtggtcggccacatcctgcactcctccatcctggtgccataccacggctggcggattagccacaggacacaccaccagaaccacggccacgtcgacaaggacgagtcatggcatcccctccccgagcggctttacaagagcctggacagcgtcgtcctgatgctgcgcttcaggcttcccttccccatgctcgcctacccattctacctggccaacaggagccccg

SEQ ID NO: 4883 - DNA, 666 bp, Sorghum bicolor
  Clone ID: SORBI-28MAY03-CLUS9193_1
attctcgagcgtccaggttctccaggagaccaggagccggcaggaggggaaagagatcacgccggtcgccgatctctcaccaccaccgccagactccatgaccggcggcagcggcgggcgacgagaccacgagtccgaccgagacgcatcgacggccttgcccgtcccggggccctgcgcctcgacgcaccgcgcgctcgccgagtgccaccgccgcgccgcccgcggaccgctgcagccggaggtgctgtgccggcacctgaaccgcgcgctggcggagtgcgtcgtgaccgcgtgctgcccgacgagaccgacgccgtccgccctttctgcggcagcgccggccagccgctcaagcgtcagcagtgccctcggcttcgcatcgaattcgccctctgcctcgatgctcatatcgagccctaatcaatctgtgttcgtcttctcatccggtaactgtttactttcacgatcacacgtattcgttctatgtgtaaacctcttatatttttgtagtaaaatgcaatccaactatggaacattggagcccccaaccaatttgtgtgtaaagagccccattggggattagcgctgaaggtaacattatagaaatagcaggaatgaactctgaaaaaaattgcagatgttttggcatttgcttggcttgaa

SEQ ID NO: 4884 - DNA, 628 bp, Sorghum bicolor
  Clone ID: SORBI-28MAY03-CLUS92143_1
ctactggatcgacccacctatccccattcatcgtcactccccagtccgcgcaagggtgccggacggcgaggcaagggtgcgaggtgctcggcagtcggcaagaccgcaaccccgtcgattcgaggcgcgggcaccggaaagtgccactcggtgaggcacgaacgccggcagggctgacgcggttgccacagccgccgccctcctttcagagtttcagagtccagaatccaagctctaaacaggctcgacgtccatgagcagataagccacgccacggcgcggccaccgcgagtacgcaaggcgtcccagcacccccacgtaaaccccatcggcgcgcgggcatgagggcgctacccgtcgcccacaagctcgctctgacggccccgttgctcccgtgccaccgccggcccgcggctcacggccggcgccggcggtacggagccgtggtggcgtacatggagccgaaccccaactcgccgggggccatcgcggggcggctcatcggcgccctccccatcgtgggcctcgtcgcgcgcatcctcagcgacgaggggcggcgtcggcggcgacatcatcgacttcgccgagttccgccgccgcgtcagcaagaagtgcaccgtcatggact

SEQ ID NO: 4885 - DNA, 651 bp, Sorghum bicolor
  Clone ID: SORBI-28MAY03-CLUS92175_1
gcacgaggctatcctctccttgcagatctgggcattcaattattttcgtccctgccatggcgagctctcttccagttcacgatcgacttgctgccgccatgcacggccgccgtttgttcaccgtcgtcgtgctcatcttcgcgctggtcacgccgccggccgatgcggtcaccgcggcctgcaacagcaccggcggcacctacacgagcggtagcgcatacgacatcaatctcagtcgagtcgtcggcggtctccccaccaacgcctccgcctcccctgagctcttcgccaccgccacggtcggcaccggcggcggcgacaaccagaccgtgtacgccatcgggctctgccgcggcgacatggccgccgactcctgtctcctgtgcctccagtcgagcttcagtgacgcccagggcttctgcccttccgacatggacgtgagcatggactacgactcctgccacatgcgctactccggcgccgacttcctggcggcgtccacaaacaactcggtgcagcaggccgtgttcagcagcttccccgccgtgaccccctcctccgccgccgccgcgttcaacggcctcgtggcccggctcctcaacgcgacggcggagtacgcggcggccaactcgagccggaggttcgccacgg

SEQ ID NO: 4886 - DNA, 485 bp, Sorghum bicolor
  unsure (1)..(485): unsure at all n locations
  Clone ID: SORBI-28MAY03-CLUS92239_1
gagacgaccgccagccacagcgcagcggtgtgtgtgtctgcgcgagagaccaaacaccaacctccccccaccctcgacccatccctccgcgcatccccacctcgccgccgccgccgcacggtctccttccccgagattcgtatgcgataggaagtgcatggggagaaaggatgccagagttgcgtagtggagtccggcaatctcggttgagggcaaagaaggttgaggatcttgtggctcaggaccctacagacaatttggttgtggcggcacctacggtggcaggaaggcgtggtagaggaaggggtggagggagaggagcagcacggggaaggggaggaagacgaagaggtgttccantgattgacttggatcctgaccagccttgtgaggttcttccaggagctggtgttggtggccgcgctgcaggtggagcacagcccattggagctgataaggttgtgaaaatggatggtgggagtgct

SEQ ID NO: 4887 - DNA, 644 bp, Sorghum bicolor
  Clone ID: SORBI-28MAY03-CLUS93045_1
cgggcgccccgccggcgggggggcccggacgctccgccgagcggccgcggggcggcgggccgcccgccctcggctgccgcgggtggcctccccacgggccgccccccgggccctccgccggcggcgcgtccgcgacgcgctctggatggggcccggggcgggaggccgtcacccctgggggccccctcgggacgctgccaccgcaccccgcccgggccgctctccggatgcccgtcgccgcgtgcccctccacggggggcgggctcgccgccggcctctccgtctccccctttgacgtccgccgcggcgtgttcagcggtctgtgcagcgcggcaccgagtgacggcgggttgggtgggttccggctccccgaggcggctggcacatacgcttggcagctccgccgggtcgcgaggtgcccttcggtcccgggcgcctctgcgcaggtcggtgcccgcatgcgcaccctcgagttgttggcctgccgctgctctcgccagatgagcccggttcttgcgtctttgcgcttagaatgtgcgcggctgcccaacacctagagacgtcggttttagatttttttggctccaatagttggctgtcacatagatttgtcagttttgcttagtcaagaagtttctttgttc

SEQ ID NO: 4888 - DNA, 588 bp, Sorghum bicolor
  Clone ID: SORBI-28MAY03-CLUS93071_1
atcataaaatgttggatcaaatgagcagggaattgctcaaggatgtatatctgggattagttcttttggaagtatactaggtcccctcatatttactcctttaactgcatggtttctttctgaaacagggcccttcgacttcaaaggtttcagtattttgtgtgctggcttttgcaccctcattgcgtttattatcagtttgaggatgcgtggagctcaatctagtacgtgcaagaagaccgcggttcagcatgagcaagcataacagaatatagtatggtgccacttactgttttttattctgcccaagtacatagacagaaaaggacaggatggaaaaaacgtcacttgaagcaaaaaaaaaaaaggtataatgacagaaactgctatagaaatatgctcgatttcgtatgttcaaagagaaggaatttctatgcaattaggcattttatccttcactggaatgctaagcattgcaaaattggcaactgccatgccgtcgagcatgttcagtcgtttgtaaatatgttcctaatagaaagtaattcagctatttgcaaatattatttgtcttttgcatgatgctcc

SEQ ID NO: 4889 - DNA, 603 bp, Sorghum bicolor
  Clone ID: SORBI-28MAY03-CLUS93093_1
gagaaaacgcaaaagggcgagcacttcaaagcaacgagaaagagaaagccaaaacacactagacacccaaacccgagaagagaagagaagagcacgggggagaagtgagaacccaaacaagccaaagccagcaaagccaaagcgagtgagggagagccagccagcgcgaggaggaagacgcaccaggacattgacgagccgcaggccgccgcagcagccccccagcactgggggtaggcagcaggctcgctcgctcgccgccgccgccgccgcgtgaagcgaaacgcggacgctgacgctcgcttgctgggtgggaggctgggagtgggcccgccgcccccctgatgggcgcctgcgcgccggcggccgcgaggggaagcgtgaggacgaggagagccggcgggctccgcgcgaagcaggccgggcgagccagccgccgcgccgcctagaggaggggcgcccgcgccgcccgtctttgcttgcttgtttgctcgcacgtcctgttccagtccagttccaggccaggctagtagagagaaagggactgcaggcggcgggcctgcggaggagctagggttctctctctctccctgcgtcgctggg

SEQ ID NO: 4890 - DNA, 590 bp, Sorghum bicolor
  Clone ID: SORBI-28MAY03-CLUS93163_1
gcgcgcacggcaaacggcatcggcgcctcccaggtcgcggaggagcactgcgttgggaaagcttctgaagcagaggcagcaaccccccctccctggctccctccctcatcgtcaaaccccactcgcaaccggcaaccgcggacgcgttccgcctcgcgcctgggctgcttccctccttgccctgctccccacgcaagggccaccgcgcgccggagaccatcccatggcggcgccgcagcgtccgaggccgcagctcgcgcgcatcaacgcgatgaagcactcgtcgtacccggccgaggacgacggcgctgaggacctggcgccggtcgacctcggcccggagttcgcgtcgcagaccagcttccgcatccgccgcgggggcgccgaggtcgccgacctcttccggaagctcggcctcaagggccccgaggacttcaccatcccgccggccgtctatgctgccgccatggcgcacatccccaactcttcccgcagccgccgccagtcgcttgaggcgccgccgccgctgccgggtgcgggcgccgacggggtggcaccagcaccacagggaccgccggatgtttctggac

SEQ ID NO: 4891 - DNA, 506 bp, Sorghum bicolor
  Clone ID: SORBI-28MAY03-CLUS93276_1
tctggggtcaaatcttcaaatggcgctgctcagcccgcgcgtgccgcggctgccgccctccaccttcaccttcaccttcgccgccgcggccggtgccccgtgctttggccgtgccgcgaggtgccaggcgacggcggcgggcggcgtggcggccgcggggcccccgtcgtcggagatggaggccgtccagtggggcagcgcccagctgcagggcgttcgcgacgagatggaggatgagatcttgctccgcccgggctccctcctcgacggcttctccttcgccgccgtcttggatggacacgccggcttctccgccgtccagttcctcagggacgagctgtacaaggagtgcgcagccgcgttggacggcggcgcggtgctcagcactaagaatctcgacgctatcacggcctccatccagcgtgccttcgccgctgtcgacgccaagctctccacctggctcgagcaagcggacaaggacgacgactctggtgctacggccactg

SEQ ID NO: 4892 - DNA, 658 bp, Sorghum bicolor
  Clone ID: SORBI-28MAY03-CLUS93232_1
gagctggggatcatagtgcactcggtcatcatcgggatgtccgtaggcgcatctgagagtcccagcacgatcagaccactggtggccgcgctaacgtttcaccagttcttcgaaggattagggcttggagggtgcattgttcaggccaaattccgtctaaaacaagtgctgatgatgacgctattcttctcacttaccacgccgattggaatcgtgatcggcatcgggatctcctctgcttacgacgagaatagccctaatgcactgatcatcgaaggagtcctcgacgctgcggctgcgggaatcctgaactgcatggccctcgtcgaccttctagcccaagacttcatgaaccctagagtgcagaacaatggaaggctgcaggtcatcatcaacatctcgctgctggttgggacggcgctgatgtctatgctcgctgtatgggcgtgaacactcgagtactgtacagtgtatagtacttcaactttaatttttttttaaaacgaacggttttaatttggcctccgcggcccgtttgatcttgttgtgagatcatgacatgacagttttatcatctgttgcatttgttaatagaatgatttgtatatccatccatgtaataaaagtgtcgattatcctcctaataaacgacaaaact

SEQ ID NO: 4893 - DNA, 616 bp, Sorghum bicolor
  Clone ID: SORBI-28MAY03-CLUS92552_1
gcacgggggccagccacggcggcccccccgcggcgccccccggcgcccccgcctcccccgtccgcccggccgctgccgtcgctctggcgggcggccggcgccgccggccccgccgcggcgccggggggtgccccgcccggtgcccgttgcgtccactgccggcccgctcttcgcgcagccttgcttctggatgtgctggtctgccgtgtgctgaggccggggggcccagtctgcctgaccaccgccgtggacccgccgtccggctgtgcccattcggtcaggccagcgtctgacattgctcgtgtccgggtcttgtcctcttcggctcggctttgcctgccgcgacgttccgtgggtgaggacaaccgcttttggttcccgactgtctcgtgctgtttggtgcttgccagcttctgacgtgctgggagggtggggtgtgcctctccagacgcccggttgctcggcagcccacgcgttcacagctggggctgtgtgcgggtgggtgtgttgttgcgcaatctgaggccttgtgggggggaaatgcaaggtgaacatagtttactcgccgtcaaaatgtacagaatctgtcaaacgaacgtgtaacaatgaacgagtc

SEQ ID NO: 4894 - DNA, 541 bp, Sorghum bicolor
  Clone ID: SORBI-28MAY03-CLUS92576_1
gtgaatagcataaaacctttatttgaagaagcaagaattgaattaggaaagagcgaaatagatacacaagttgttgaaatggtttgggaaaagatagcaccaggtctggactcgcaatttgatgccccctattcacttcctttgcttgcaccacggccgctgctccttctaaatggcgctgaagaccctcgctgcccaataagtggtttagaagaagctgcttcaaaagctgctaaggcttatgaagaatctggttgtgcggagaagttcatgttcattgcagagcctggaatcggccatcaaatgacaatagacatggtgaaggcagcaagccaatggttcgatcgcttcctctagtgagccggccctacatgaatgcagcaagtcattattgtcgcccaccatttaccattcttcatgatggggagctagggacaagacagtagaatgatatcacatacagtcccctctaataatgtctatttatcgattgtattttgtcgaatgtgactggaactcctaatccaacagcatcacagtt

SEQ ID NO: 4895 - DNA, 553 bp, Sorghum bicolor
  Clone ID: SORBI-28MAY03-CLUS92595_1
gccaaggtctagcaatgggtattctcaatttagctattgtcgtaccacaggttattgtgtcacttgggagtgggccatgggatcaaatgttcggcggtggaaatgcaccggcctttgcggtggcagccggttcatctttcatcggtgggctggtggctattctggggcttcctcgggcacgcattgcatccgcacccgcctcaaggaggagaggtggcacgcaccgataagtttgctcattaccattacagacaccatgtgaatgctttggaagagttgcagcttgcaacaattctttgcggttggctgggcacatcaagcctggcacgcgtggaaactcttgtgggttggagaagagcacagggagctcttgaatgctgtcctttttggtggtttgccccgttgagctatttttgcagccttgtctccaaatctttgttgtttaattcacatcacattgaatgtatgtatgtatgtatgtacgtatttgtatgtatgtggatcatttgtagagaggtcaatcaatgaataaaagttacaggagttaacgttt

SEQ ID NO: 4896 - DNA, 455 bp, Sorghum bicolor
  Clone ID: SORBI-28MAY03-CLUS92614_1
gcacgagggtgctctaaagctaacgctctctgcagtctggactctggttcgcggtggccgcagctgcagcgtcccctccctttttttgccaccgagcatcacctgtgccgccggcgcgtaactgcaccgcggtcaccgcttaagaggcagaggaggaggaggacggcagcggcgttggggggtctagtctcgtcgtgcgggtggccatgggcgtgcacgccaagtcgatgagctggtacatgagcccgccggggtcgccgccggcgccggggagcgccgccaccgaggcgcagcacgcgctgagcagcagccccgggggcagcagcgacgccagcttcgacaccaacatggtcatcatcctggccgcgctgctgttcgcgctcctcttcgcgctgggcctcaactcgctcgcgcgctgcctcatccgctgggcgcgccgcgcgtcggagggggag

SEQ ID NO: 4897 - DNA, 652 bp, Sorghum bicolor
  Clone ID: SORBI-28MAY03-CLUS92658_1
ataccgcgcgcacctccacccctgcatccgtctacggctagcgatggtgacggccgccgccgccgcatccacgtcgctccggccactgtcttcgtccccatctcccatcgcgagtttgccccgtcggtggtgttgggggatcccggtgcagtccgccgggcggagcgcattccatgcggaacggcggagacggacgactttattatgcgcagctgataaacctcctgaagaatccctcaaaaagaccgtagaagtggataggctgattgatatgctgaggaatgcaaatcctagagagcttgatcaaatagtggttgaaaatgttctgtcattcgacgctggtttctgggttcggctagcagctagaattgacctctgcaaatcagatgatgataaaaaagattatgaagagctggcagaaaatgtcatgaacattgttgaccggcttgttcacaagactaatcaaaagattgatcagtcaacagatgtgcagtggccaccaagaggtccagacactctcaaattgatggagaaagaattaacacgccgagaacaagaaggacagcttgatgagggatttctgtcagaagttagtgctcagttgaggcaagctaaacaagatggagataagccagggcttcaagctatgcta

SEQ ID NO: 4898 - DNA, 589 bp, Sorghum bicolor
  Clone ID: SORBI-28MAY03-CLUS92662_1
gcacgagggcgactcgtcctcgtcctccatcgtggcgcccaaggccgagagggcgtcggcgcggctgatcaaggaggaggagcgcgcgagcgggcacgtcagcttcaccgtgtacaagcagtacatgacggaggcctggggttggtgggggccgcttgtggtggtggttgtctccgtggtgtggcagggctctctgatggccagcgactactggctcgccgaccagacctccgaggagaacgcatcctcgttccagccgtcgctgttcatcaacgtgtacgccatcatcgccgccgtctcggtggtgctcgtcgcggctcgctccttcctcgtggcgttcattggcctccagacggcggatcggttcttcaagcagatcctcaacagcatcctgcacgcgcccatgtccttcttcgacaccacgccatccggcaggatcctcagcagggcgtcgtcagatcagacgaacgtcgatctcttcctgcccttcttcgtctggatgagcgtgtccatgtacatcaccgtgatcagtgtgctgatcgtcacgtgtcaggtggcgtggccgtccgtcatcgccatcatccctctg

SEQ ID NO: 4899 - DNA, 657 bp, Sorghum bicolor
  unsure (1)..(657): unsure at all n locations
  Clone ID: SORBI-28MAY03-CLUS93368_1
cctgcagatgataattgaggagcaacaaaagcttggtggatcaattanagcttctgaggatcagaagctttcagattcacctccaagcttagatgactacccagagagcatgcagccttctcccaagaaaccaaggatagatgcattatcaccggattcagagcgagatagaacacaacccgaatttgaatcccatttgatgggtccgtgggatcaagaaatctgtgcgaaaaacatatgcggcgttgcattcccagtggaggagttcaaagcagaccctggtatgagcaagtcttaaagcacacttctgcgccttgacagaattttttcagagttgacctccccacgagatgatcattcgcatgtgaatatatatcatcttaacaacagaatgttgcacgggtttttgaccctgcacctgatcccttagccacgagccacgtccagttgttcttatcactgtagtatccatcaacaactcctgtaattatgaggatggtgttacagagtttctagcaagcatgtccatcgagggaatagccctgagctgaaccatgtaccaagaaacagaacatgctttcacatttgctgagaagagggcacgcccctggagctacctgaagctatgttgataaaaaaaaagattgtggtatatta

SEQ ID NO: 4900 - DNA, 541 bp, Sorghum bicolor
  Clone ID: SORBI-28MAY03-CLUS93437_1
ttgacacatagcagctatagtacattgcagctgcgtccagtagcagccagagctaaaggatcgctccaaaccccagcaaccaacgcggctagctagctagcttgccgacggtgacaggggtagctgtctaaaggagcgcaaatcgagctccaaccagctggggtgagtctcgttccggccatgggtcggctaccctggctcctctgctgccccttcctgtccctgtcgctggcagcggccgcgcgcgccgccactgtccaccaggagtgggagatcagctaccagttcaagagccccgactgcgtgcgcaagctcgcggtgaccatcaacgggcagacgcccgggccgaccatccgcgcaacgcagggcgacaccgggggggtccgggtgaagaactccctgctcaccgagaacgttgccatccactggcacggcatccggcagatcggcacgccgtgggccgacggcaccgagggcgtcacgcagtgccccatcctccccggcgacaccttcacctacaccttcgtcgtcgaccgcccgg

SEQ ID NO: 4901 - DNA, 536 bp, Sorghum bicolor
  Clone ID: SORBI-28MAY03-CLUS9354_1
cgtaggcctttctaacaaaaccaaccccccgccggacccccgccgtcggatgcaacggaaaaggcgtcaatggcgtcctcctctgccgccgagcccagctcccgcctctctgatcgagcgaagaggtcgtcgctgggactcagattcatggtgctcctgatgcacttgctgttcgttggcgctgtcttcatcctcgatccgaccctcgactggcgaatccacgaggagccgtggtatatagggttgtatggagtgcttgtcctgctcacgttagtgcaatacttctacacagctggctcatctccagggtatgttgttgatgtaatgagagctggttccatgatgcatgcaaccttcgtcaacactactgctctttcaaagcagtcaaattcaagaaatggaaacacaagttccccgacgagtcgtgctcaactacagaaacttagcacgatgactcctacatcttcgtgggcacagatggttatggatctttatcctccagggtcaagcagcagggattggacctgcacttactg

SEQ ID NO: 4902 - DNA, 623 bp, Sorghum bicolor
  Clone ID: SORBI-28MAY03-CLUS9361_1
gcacgagggcttctccaaccattttcagtcctattacctgcatggatcatgtcaacttgagacccagctatcatgctcgacaaatttgtgcaatagatcagtctgtttttcatgcagatcctcattttactgcaacagccccaatggcatataggacagatgtcaggcagttgccaaattctgaaagaacaaaaattcattattatacaactccgagcaacaagtatccatgcaccaaacagcaagagctttcgatggagtgtttttgctctgaatgtttggggcatcataatccagagcagaaactacttgggatgcgaaatagctgtctaagccagaactttgggcaggacacccaacacaatgccgaaacaacaatgcgccttatgggaaaaacagttacacttgggaccagcagcattcattgtagacgtctgaatattgaaactccatgttccagtaaacaaagtcaagctgaaaatcagttcttccagggaacacgtacaaaagtttttccacaattgttcattggaggactggtctatcccccgtctacattttcagatggagagagacaaccatctggaaacctatcccatttttcttttgttccagcagctgta

SEQ ID NO: 4903 - DNA, 627 bp, Sorghum bicolor
  Clone ID: SORBI-28MAY03-CLUS93640_1
ggcctgcaagtccaaccactctgcctgcgacgcatcccagatgaaattcctgcaagatttcagagaccagatggtagcatcggtgaacaacggcttcgctggctccaggagcaacgggctcttcatcaactcctgcttcgcgcactgccagtccgagctgccgatgacatggagcgacaacgcggcaggtggtggtgcctccccggccattcaaagcagggggattgccaagtcagtgggcgactggtactttggtcgagctcaagttaaggccatcgactgcccctacccatgcgaccgaacatgccgcaacatcatatgacaacaacatcgtctcctgctgcaccacacatcctcgacagttgtacatcacatcacatcacatcacatcatttttttttgagaccacatcacatcaatttgtgaacacagtgaaagcaaatgggtgcgaccattaagattaaatgagcgttaataagccgagcctatatatgtagggcttaagtgatagttaaacttgcattgttaagtgattcattcatacagaaagcagatgagagtgagtgtgtactgtttatttcgcaggatgttggcctccaagtttaactcgatctgcttttccacgtc

SEQ ID NO: 4904 - DNA, 746 bp, Sorghum bicolor
  Clone ID: SORBI-28MAY03-CLUS9284_1
gttggtaggaacacaaaggccctggttgctggtgtatctgaaagagcatctaggcatccagatgctatggcttctgtcttccatgcagtgaactctattagtgaagagctttcaagcattgttgagttagcagccgaggatgagatagccatcacctctaaggaggataagctagcagagcttatggagatgaaccaaggtttgcttcagtgcatgggagtcagccattcttctatagaaactgtgttgcgaaccactctgaaatatagcttggtctcaaagctaactggagctggtggtggtggctgtgtgttgactctaataccgactttatcggccaatattgttctagagaaagtcaccacagagctcgaatctcatggttatcgctgcttcaaagttgaggttggtgggcgaggtctccaagtattccgaggataacagtcaacctatttcaaggagatgttgtaccatacttttagaaaatagcttacctgcactgaagctgtttagattcacttcttgaattattccaagatcagaatagggtattcttctcctaaccctagcatgatcttgtatccagctgttccaggattaggacgttcttatgctatccctagcactcttgtatcaaataagctcttagatacatgaacattgtgggtgtgattgttgtatcaaataaacgaacttttagttgctccaaattttgtatcaaatgaaaaatatatatcattgacctc

SEQ ID NO: 4905 - DNA, 485 bp, Sorghum bicolor
  Clone ID: SORBI-28MAY03-CLUS9290_1
cggacgcgtgggctcttcccgatacttctcgtcgcctccgtcgccttctctccccaatctgtcctcggcgtgacggatgggggcggccatggctgcggcgcactctctcccctcccggcccatcagcgcgagggcatcacgtcgtggtgacggtggcgcagcacgtgggcggcgtggcgcgagcgcccctgacgcggcgggacggtgccgatgcgtcctcttccatcctgaggtagcgacaagcgcgcgaggcggcagcgcttcttgcgggcggcgtgccagcgtgaacggccaccgtcccttcccccaccgcccatggggccaggccatgcggcatgggtgcgacctcaggcggtggtcgtacctctgctctccctcggtccatccgctcgcaagtttgtccccccccccccccccctctccttactctatgcgggcaacctgctaggtgcacgatttctccattggatgggtgatttggaggg

SEQ ID NO: 4906 - DNA, 624 bp, Sorghum bicolor
  Clone ID: SORBI-28MAY03-CLUS92956_1
aggatgctcgcctccccctcctcctcttcttcccgcctgctgctctgcctttctggtaagacatggggcggtttcttgctgaatcaaatcaatcgcatttgtatgtagcaatagcactgcactggtagtggtagttacgtaacggcgcgaacacacgcgtgcatgccctgcgccggcgtgtcctcttgctcatggcatgtagcgcgtgtccgggcactctctgcactcgaagggggccgtccgttcacgcgtgttggacctttgtgtgcgagagagggattccaatccgttgcaacaaacgcattgaattttagcgtcccagatttcctctcgtagcctcacacgagcagtgctgccgccgcttctccgaagagcgccggagcttcgtcttcgtgcttgtacttgcttcgtatagcccaagccagcagcctcctgttcgtccttgccgggctcacgcatttgtggcacagcaaggcaggctccatcagtccagctcctcctctgcttctgctgattgattggtccggaggcgcctcgtcccgctccttcgccgccacaggatggcgctgctcacggcgccggcggtggccgcgctgctgctcgtcttctggtccgcggcgtacg

SEQ ID NO: 4907 - DNA, 611 bp, Sorghum bicolor
  Clone ID: SORBI-28MAY03-CLUS9302_1
gcacgagggctttccagacgatggctggtcttctttgttgagtagtgatggtgctgaggatattacaatttcaatcaactcatctccaaacaaacttattggatctcatgtcagcccttccccattcttttctgctatggggggtggcatcatgtgtgcaaaagcatcaatgttactgcagaatgtgccacctgctatacttgtgcgatttttgagggagcatcgctctgaatgggctgatcctggtgttgatgcttattctgctgcctctttgagggccaacccatatgctgttccaggtttaagggctggtgggtttatgggcaaccaggttatactaccccttgcacgcaccttggagcatgaagagtgcttggaggttattaggcttgaaggacatggctttagccatgaggaggtgctcatgtctcgggatatgtttcttctgcagttgtgcagtggtgttgatgagaatgcacctggtgcatgtgcacagcttgtctttgctcctattgatgaatcttttgctgatgatgcaccgttgctaccctcaggcttccgtgtgataccacttgatgctaagacggatgtgccatctgccacacgcacac

SEQ ID NO: 4908 - DNA, 726 bp, Sorghum bicolor
  Clone ID: SORBI-28MAY03-CLUS93038_1
acgcggcgctgtgcgagtcgctgaggctgtacccgccggtgccgcaggagctgaaggaggcggtggcggcggacgtgctgccgagcgggcacgaggtgcggcgcggggacaagatcctggtgtggctgtacgcgatggggaggatggaggacgtgtggggcagcgactgccgggagttcaggccggagcggtggatcgcggaggacggcggcagggtgcggtacgtgccgtcgtacaagttcatgtccttcaactcggggccccggacctgcctcggcaaggacatggcgttcgtgcagctcaaggcggcggcggccgccgtgctcagcaacttcgacgtggaggcggtgccggggcacgtcgtggagcccaagctgtccatcatacttcacatgaagaatggcttcatggcaacggtcaagagaaggcgccaggcgcttagcttagcttcagaataatcatcatctgagatcgatcggcgtatacgtacggtcctttgttatgatgtgtcggtaatcaaactatgagatggtgatgatcggtgctgttaactctcgtatgtatgtcgtactaccgcactctatcagtagcgcgtgtccacactccacagtcggtactcggtacgttaactcacatgtgctagctatgtagtagaaggtgcaagaacaggtactcatcgtgctgcctacgtgtacaacgctccgttggtcgttgaaagctagtgtt

SEQ ID NO: 4909 - DNA, 301 bp, Sorghum bicolor
  unsure (1)..(301): unsure at all n locations
  Clone ID: SORBI-28MAY03-CLUS93997_1
tcgcctagtgcatgacactgctggctccatttgtttcctccacttccacactgccatcctatggacaaggaatggaaagcagtaacctgaaaagtggcagataaatccatggacaacagctgacggtgtaatcaatacagaatgtgagcaatgtggactaactgaaataataaagaagcatggcaataaggagtggaagccagagcttgctgtcacatgagttcaggaggtgcagctgcagacttgctgagcatgtcagctaagctgagcaacaataagaagcaagaagtgggggngcagc

SEQ ID NO: 4910 - DNA, 573 bp, Sorghum bicolor
  Clone ID: SORBI-28MAY03-CLUS93950_1
cctactggattaggtgctgattcccctcttgttctttgttttttatttccccctcttgcccttcttcttcggcgcgtggctgggaactacatcttgggatttcttttttctattattattggccttgatatggtcatgtgggtgattctttgcctgttttatctgtgagatggcaagcatttatttgttcttttgggccactggattagctgtgagttttgtttaaacccctgccttatcctgagctcagtctactcatattgcatcagaccaacaatggcaaacagtttccatgaatatggttgttcatgaaaaatccttaccagtaggtttaatcaatctcttcaaactagtgaaatttcttgaaagttggtttggtccttgaaaacagcttgttgcctgagctggtgggatggactagttctttttctgtcgttctgttgatagagctgagactctcgacttgtggaggaattggaacctgaacctgaacctgaaagatttgattctgacgtgcattcagagaatcgatttttctgtttcccaaggaatcctattaagtcgattgttgct

SEQ ID NO: 4911 - DNA, 368 bp, Sorghum bicolor
  Clone ID: SORBI-28MAY03-CLUS9401_1
tctaataatagccgcatatttttgtcacttaaagatgtaaagcctaatccatccttaggtgctttggaagcagtaattggtgaggatttatcgcttggtgaagctcttgaacctgtgcaatcagattttgagtggcctgaggtagatgcccttatggaagagctgcggaaaatagagggtgtaagagatgtctataaaggacgattcttccaaagcccaaggttagctccgacgtttcaggtttacatggcacctgtggttggtccgaaatacaagctcctggcacggtatggaaacaatgttcaagaagtgatggtggagacaacacttgggaaagaagagttggaagaagccattttgatgtgcac

SEQ ID NO: 4912 - DNA, 631 bp, Sorghum bicolor
  unsure (1)..(631): unsure at all n locations
  Clone ID: SORBI-28MAY03-CLUS94010_1
tcccggatgtgaaatgtagcgttttggatttggaccacgttgtcgccaaggctccgagtggcacggacgtgcagtatatcgccggcgacatgtttgagagcgttccaccggcgaatgctatgttcttcaagtgggttttgcatgactggagtcacgaggagtgtgtcaagatattaaaaaattgcaaaaaagctatcccgccaaaggaggaaggaggaaaggtgataattatagatattgtgattggagaagaatcgtcaaacttgaagcacaaagagacgcaggccttgtttgatttatatatcatgcttgtaaatggcattgagagagatgagcaagagtggaagaaaatcttttttgaagctggatttagtgattacaagatattcccggtgttaggccctcgatcaatcatttcagtctgcccatgaatccctcgcgaacacacagttaaactgtcttggattgcgttggtttgtaattttgaatacgtttgttccctccaatgtggtggtaattattccaatgtcttggattgcgttggtttgtaattttgaatatgtttgttacctccnaatgtggtggtaattatatattccaatgtacttgtgtaaaaaactttattgtgcta

SEQ ID NO: 4913 - DNA, 714 bp, Sorghum bicolor
  Clone ID: SORBI-28MAY03-CLUS94016_1
ttttcaagatgtgtgttctttcggctgctaattatattcatatcaaggtcgccggactatttttttggtaaccaatgattaatgtcgattgactcccttccctgttcgtttgctacttgctccctttcctggtcgtcgtcgtgtgtctctcccccctcttcaattgcaggcaggttgcttggcatgagtgttggctcctaggcgttcggcgtcccggctcccctagctcttgtttcgctctgcttgcttcggcctctcgttctctggtgttgtgggcccagttttgcagcttcgctcctgctggtttgttctgccttcaatcgcgcctccctttttgtccagcgccatgctgtgtcacgctgtcagattccattcttttatggcttcttacggactattgggctgaagccaattgtacaattcttcatgaagccaattgccatcattgaatctatccaaaaaaatctatcttgcgaaaaggagtatagcgataattgaatctgtccaaaaaaaaaaaattctatcttcacctgaaaaggagtagcttgtgctcatcgatgatgtttaagtgtcgagaaagcatatggaatgtatttttcaacccatatgaattcttgtgtgatgaggtaactgatatagtagagtttatgagcttgcgatgccacacttttcgtgactgtgttaatttcatgaactttgctttttggattataa

SEQ ID NO: 4914 - DNA, 875 bp, Sorghum bicolor
  Clone ID: SORBI-28MAY03-CLUS99337_1
cgaggacgaagcagacggcgcgtaaatcggtgggaggcaaggcgccgcgaaagcccctggccgccgcggacctgttccctgggcaccacacaaaccccgcctttggggccacctctctcccaacgccgtgcgccgtcagcgacagcgactttccgtgctgcgtcgagtacgccaagagcgcgcgctctgcctgcaggtcatgctcacgacagatcgccaagggcgtagtccgcatcggtcagcagtacgatagggaccacagcggctaccactggtaccacgtgagctgcttccgaggctttcctcgcgatgggagcgtgacggccgaaggattcctctttggcttcgagaacttgtcgcccaaggacaaggcgtctgtgcgggacaccctggagggtcgcgctacgcccacccatctccaacgacgcgacagcttcagttcagaagccgaggatcctagctgcggcgaggaggacgaggaaggaaccgaggaggatgaggacgttttcgcagccaagcccattgccggattccagcagcagtatggcttcggttcagctcacgccagcagtgcgcgcgtgggtacagcgatggcctttggcggtgccccgacgatgctgggggcggaagcagtggctggcctgaccaaggcagcttctgctgctgggatgacggaccgcttctttgcccagccccccactaccgcccatcgggctcttcgtgccgccatcgaggcctttgagatcagcgctgatgttgaggagctttctgacacccttaccctcattcaccgcctctttgcttgagtggcgacatgctttacccctctctctctctcctgaccggcgcgcttcaataaactactagtagggggt

SEQ ID NO: 4915 - DNA, 413 bp, Sorghum bicolor
  Clone ID: SORBI-28MAY03-CLUS99309_1
aggcccgggggatcgaattgattatagaaacatgagtttaattaatcgatttattagtgaacaaggaaaaatattatccagacgaataaatagattaaccttgaaacaacaacgattaattactgttgctataaaacaggctcgtattttatctttcttaccatttcgtaactatgagaatgagaagcaatttcaagcccaggcaatttcaataattactggtcctagacacagaaaaaatagacatattcctcaattaacacaaaagttcaattccaatcgaaacttaagaaactccaaccagaatttaagaaacaacaatcggaacttaagttccgattgttgatgttttattcgaaaggctcagactcatatataaagaaagtaatccaattttgattcttgtgtttgtt

SEQ ID NO: 4916 - DNA, 525 bp, Sorghum bicolor
  Clone ID: SORBI-28MAY03-CLUS99345_1
cgtcacgtgcgacgagcggtacggccacgtgcgcgaggtcagcctgcgcgtcgaggacgccgatggcgccggcgtcagtggcagggacgggctcgccgccgtcgccgctgccatggccgcgcccaggcggcgcgggtgcggggaggacgcggcgagggaaaggtacgaggacttcgtcagggggaagagggcgcgcaaggagtggaaggccaggcgcgagggcatccttgacctctgctgctccagcgtcggcgccgccgcgttcctcggcttcctggccgtgctcacgttccggtgagcactcgtcgtccggctcaccgggcgacgccgaagcgacattcagagtgccgttgacatgtacagtgtagttcagggaatgtgaatatatgattgtgctgtaggttatacggtcggctgtcaaagaaatgtacaacagggaaagtcaacatcatactttttttttctactattcattttcctttctagacagcgaggtttatgaaataaaacgattcaaacttttta

SEQ ID NO: 4917 - DNA, 894 bp, Sorghum bicolor
  Clone ID: SORBI-28MAY03-CLUS9937_1
cccacgcgtccgataccctgtgttgtgatgtggcctcctcttgatgagaacttccaagagatccatgaggaccaagcgggaggatcaacatcaagagtgaatgatcgcactagcaccgagttaactcagaagctatctgctgcctcagaggagttgcaattcctaagatcaaaactgacactgatggagagatatgccaatatacttcacatctcaatctttcgtaagccacttgatgaacgggcgctaccacgttcacttcaggaatcttctgtctttgatatcagaaaggaatttgagaacattttggatgcagcagacactgatgaacttaatcgtttggagatcttctaccgcagcatgctttctggcgtgaaagataagcttctgaagagaagagtccaagagatggtccaacaatgcataatttcactctcagcagggaggcaaaacccttaagataagtgaattggattattgtacttgttaccggactgcaactgagtacagtatctccaaactgggcctcatcaaaattgcaataaccctgtttatgccaacccacagtctatgaattgttaccggactgcaagtgggtatagtatcaccaaacttggtctcactaaaattgcaacaaccctgtttatgcacccactgtcgcatctgtttcttcaagtataaagtgagtaaatctatcctggcatcaagatcatcacccggtagaccatagcacaaagacgacattactcacactgacatgtaagcgtatatgttgtttatgaaattctttatgtgataaatgcctcctagataaaatgaatcctgtgtaaaggatttctctatgggttgtcatagtaaaatgttattggaaaagccttaggcaaataccaattt

SEQ ID NO: 4918 - DNA, 339 bp, Sorghum bicolor
  Clone ID: SORBI-28MAY03-CLUS99511_1
agccccccgcatgcatgatcagaattcagaaatacagtagtatgcagggtcaaaaatgagcaaatgtccaaaaccgctgtcaaagttttgtttttcagaaatcaaccagcaatgttgaatttgttttttttgtgcaaataaatcgtatagttatttgattcgaccggtgagagcaagggttgtacaggaagggagttggtgaccaacacatgggcgccatttgatttcagtatccatttgaacagtttgggcaaaatgtttgaaatttacgcgaaatcatagatcagatcagctagttggataaaaaaaaaaatggaacctgttcttagtccctgactt

SEQ ID NO: 4919 - DNA, 449 bp, Sorghum bicolor
  Clone ID: SORBI-28MAY03-CLUS9421_1
agctagttttgcaacagcagaagagatagggagaggagaaagcataagctaataagcatccatcaatggcggatgctgtcaacaaggaggccgagggtcgtctgacgctgctgggcctgcacgtgagccctttcgcgcttcgcgtgcgcatggcgctggacctgaagggcctgagctacgagtacgtcgagcaggacctgttccacaagagcgacctcctcctcacctccaaccccgtgcacaagaaggtccccgtgctcatccacaacggcaagcccatctgcgagtctctcgtcgtcctggagtacctcgaagaggtctggcccgggccgcccggcaccggcaccggcgcagccatcctccccgctgacccctacggccgcgccgtcgctcgcttctgggccgcctacatcgacggcaagctgttcccggcgtgggtagacgtcatg

SEQ ID NO: 4920 - DNA, 694 bp, Sorghum bicolor
  unsure (1)..(694): unsure at all n locations
  Clone ID: SORBI-28MAY03-CLUS94243_1
cctactggattgccaattttgttgttgttaaaaaaaaaatctgttcctgctcttgctgttgctttgcgttgccacnaagaaaacaagcagcagcttgcctggccttcctgtagggctataccatannccatacggccaggnnttcagctaagcttggtggggacaagacagagagaccatcngtatccgcccgccggcgcggcngaccccaagccatctngagttgacgaccatcagcatgagctgcagctcgccgccgccgccgccgccgctcgagcatcacgctcacgacgatggccggacgagagccccagcgctggacctgctggacgagtactggttcttcagcaacaccctcgtcaccaataacagcgccaagaagaagccgccacacctgcccaggtcgccgtccacctccacctcagccacaagcacaggggagaaggcctcgggctcggctgggccgccgtccaggatagggggccggaggctgctccggacgccgtcgctcccgacgtctcgcgtcgggatgacgatggagcaggtgcatcaggacggagcaggtgctgctgccgctgccggtgccaatcaacagccccatcgacggcaactacaagttgtagcagcggatgaggtggacgacgatgacctcaactggagctccatctacgagggcgtcctgcgaacacggatg

SEQ ID NO: 4921 - DNA, 751 bp, Sorghum bicolor
  Clone ID: SORBI-28MAY03-CLUS94292_1
ttctactcctatgttgttcttgctggagggaatccacctcctaagaaggcaaaggctgctgcttgatctgatcttgaagacattcaccgaagcttctcataattgtactatatctttctctgctggtgaatactgcacacaaaagttgtgttataggctctgatatacttagtaaaagactgaggagataagatttccctctatcctgcataactgttgtttcctacatcaataaaggatggtttggtgccatcccattttttggtgctggattggaccatggtggtaaatagggttgtcccaggttattgcttcgtggcataggactttgggcaaaagccttgccttgcttactttggccggcagccgtttggctgataagccatggcagaaagtactgttggctgattgattgtgagagaaaaacacggctgaatggctgggctgaagcgaacaggctgcgacatccctgacgtcatatccctctttgaaggcgtggtcaaagaagctgttgtggctagtgaattgcaaggcgataccataatggtatattagaatggtctaatgtcgtgtctttgtcttctgttgctgtaactggttatgcctcatttgctggggcttgttattgttgttatttgtggtattgctacaacttcacccttgagctagggtgtgttctaattcgtggttgcgccacatcttcttcacacttatgttgggggtgtggttagctgtgatacctaggttaagg

SEQ ID NO: 4922 - DNA, 1071 bp, Sorghum bicolor
  Clone ID: SORBI-28MAY03-CLUS9434_1
atctcatctcctcacctccccgacggcgactcccctcgagctcgccctcctccccctcccccccgcctcgacgctgtcgcctgctcctccgcggccgactgtcctgattcgattggttttgcaggtttcacacttcttaccatggacgacaagaacaaagtcaagaaggaaatagatgccccccttggacccgctcctcgcaaggggggacttaaattcgcaccaaaagtacctcagaagaaacctgccaaggttgtcccaaagaaggaaccagttgaggagagcaaggaggaaactgtggataaggagttattgatgaaacttaagatgtcgcagaacaagtatccctctgcaagaattaagtccggggacaagcgtaagaatgctggtttttgttcaccacatgctttatagtctaaaccttatcactacctgttaaaattgtagtttctacttcctactcactgagcatgctcaaggctactgtcattaattgttattgattagtcacttatcattttctggtctgttttacatttttagctttaataaatatatctaactctgaatgtttgaggctgtctattggacatgcttgattgattccttaccacttgataaaactgccaacataacaactgcatatgtcgtgcacttatatgagcaaaagcaatcttatttactatgttatatacttagcttctgtacttcacttgaaaagcaattttctgccaataatcctaaaagtatatttgttgcaatgttgcgagtagttttgagctgataaaatacaagcatgtgatttggtttgcatctatgtatgatgatgtgctctgagttggctaactataattgtacactttggttgggagattcatcactatttaatacagggacatacttctgcattaggttgtcttaaaaatgcagtgtagagcatgtaccaaaatttttattagatagaattgaagtttagtacataatatagtataaaagggtaaccaaggtttttgttacaaagaaaataatctgtgttctttcttaggtgttatggattaattgggtatataa

SEQ ID NO: 4923 - DNA, 845 bp, Sorghum bicolor
  Clone ID: SORBI-28MAY03-CLUS94363_1
attgattgagacggaccagctcggcccaggccaggccccgccatcgccgtcgaccaggccggccctccgccgtccgccgcgacgagatccgcgcctccccgacgccggcgagagccgagagggttgcgcccctgcttctttctccgatctctaccccaagctccttgcgccgccttctcctcctcctcctcctgacaaatggtagcggggggcgggcggtgcttgctcgccgtggcgctcgccgccgcttggatctccggcgcggtggccgccgcctcgtcgtcggctgagcaggcagccggaagccaaaaatcggtcaaatgcatgccctgctctaggccgtacattggtgatgcatatctagacgacaccttgacgggccaccttgctcagcgtcgtggcttagtggaaatgtctgattctggtgaattgtgcaaaggacttgctgaagatgtcgacgtgcctgtgctctcaaaattgcgccggcaactggttggtgaaggttctcaccgccgtttagtctattctatggattttggtgcctgtgatggtgctgtggttaattttcttgatggctatgatgcccatctggtgatatttgaaaaactcccggatggggtgtttgctgacccatttgagctacagcattttgttgagcgcaaagttttcgtggatgttgctgtttttggagacaccaatcttgaacttcccacagctctatccaatcggtcatctgtcgagattcattttgatctcaggctaatcatttcaaccgactgtaaccttgaaatagacttgcctctccatgctagatacccggtaaggtcctataaactaccagtggc

SEQ ID NO: 4924 - DNA, 931 bp, Sorghum bicolor
  Clone ID: SORBI-28MAY03-CLUS93651_1
tggccacctgggaggacgctgaggctcttcaccaacaattccctcgcgctcctgcttggggacaagcgggtcttcatcggggaggggatgttagcaacggcaaggtaccaggtcacgacagggtcaccagaggaagcaacaatggttccaacgcggtgaccatgaaccaggcgcgacgaggcaaccgagccaggcgtgcaagtgtgcggttcagtgggcaagattgggtgtgagccggtgacatccactgctgcgtctgtgcggctccacgtgggccaacggccttgtataaatcacgagcgagggtggagagaaggggtaacaagagaatacacaaaagacaacctgttatctaataataactcatctacttcctgcccaagttgctgttcttgctgttcctattcctaattctacctatcccccttccaatctgttaacaattgcttcccagagcctttcgttctctcgtgtttctctgcctcgcttcctgggtccgccagttgtcggcgtgggcgcgtcgcctgtcatggctgtgggccgctgcgccgtgtcgtgtgtcgccgtggtgcctcggccccgtggttccgttggccaagcgcgctccgctgcgttctccgcctcctcctcgccccccgccgcccccgctccaccgccccttccccagatctgtccgacgccagggcgccatgaatcaggacacccagttgctgcttgcggagatccaaaagctttccgctgcccaggtcgccacccagcagcagctatcggagcagaagacccttctcgaacggcgcttcgcggaggccgacaagaccctggagcagcgcttcaaggacgctgacgccgtcgtggagcagcgcttcaaggacgctgacgccgtcatggagcagcgaatcatcaactccgagcttcgcctggattcgcgcct

SEQ ID NO: 4925 - DNA, 602 bp, Sorghum bicolor
  Clone ID: SORBI-28MAY03-CLUS93695_1
gctcgatcatatcctggcaaataaaatggtcagacaatagcttacgtagagagcagagctcccagttcatgaccagctcaagaagactagttgttagttagtgtcagtcatgacatcccactcagcagctgtattggcagcaggattagtgtgtctgatcagcgcggtgctcgtggtgccatggctcgccgccggggagagtagtagtagtagtagtagtgtcgccgacgactgccagagatcatgcggccgcgtggacatccctttcccgttcggaatgggacctgatcactgcatgctgacgcgtgacttccgaatcacgtgtgaagacgtcgggaacggagtccgtaaggcgccgttcttggcaaatttcaccaacgtggaggtcctcaacatctctctggagcaaggacaagcccaggtgctcaaccccatctcttcttactgctacaacgctacggttcagcagtgggatgagtggacgtgggacttgagtagcacgtcctacactttctccaacacggccaacaagttcaccgtcgtaggctgccgggcgctggcatacatcggcaacaccaaaggcaacacttctgcgatgtacc

SEQ ID NO: 4926 - DNA, 728 bp, Sorghum bicolor
  Clone ID: SORBI-28MAY03-CLUS9370_1
cgctcgaggccggccgggccggatggcctcttcaccttgaccgggcagacgtacaacatctcgagcatcgtggactctcacttccaatttgatacggaggcatacgagaagaatggtccgctgtacctcagcactttctttgctgtcacctatggtgttggtttcgcatcccttaccgcgacaattgttcatgttttcctcttccatggaagtgaaattttgcagttaagtaaatcagctttccaagaaaaaaaggtggacatacatacaaaacttatgaggagatataagcaggtcccggagtggtggttcatctgcatcctcattgctaacattgctgtcaccatatttgcctgtgaatactatattgagcaactccagctgccttggtggggtgttctgcttgcatgtgccatcgcgtttaccttcaccctcccaattggaataatcacagcaacaacgaaccagactccaggcttgaacatcatcacagagtacatcatggggtacttataccctggacggccagtggcaaatatgtgcttcaaggtgtatggttacatcagcatgagtcaagctctgacctttcttcaagattttaagctgggccactacatgaagattcccccaagaccatgtttatggctcaggtggtgggaactttgattgcagcatttgtatacctcggaacagcatggtggttgatggacacagtccctaacatctgc

SEQ ID NO: 4927 - DNA, 648 bp, Sorghum bicolor
  Clone ID: SORBI-28MAY03-CLUS93736_1
cttgcctaatcgtgatgatgtcaagactggtgtaatatcctacaaaatttctgctcatgctgctgatttggcaaagggtcatccctatgcacaagcttgggatgatgcacttagcaaggcaaggtttgagtttagatggcttgcccaatttgctttgtctctggatccagtaactgctatggctttccatgatgaaacattgccctctgagggtgccaaagtggcacatttctgctcaatgtgtgggcccaagttttgttcaatgaaaatcacggaggatatcaggaagtatgctgatgaaaatggatatggaacagtagaggaagctttgatacaaggaatgaatgctatgagtgctgaatttttggctgcaaggaaaacaattagtggggaacagcatggtgaagcaggaggggagatctatgtcccagaaagctatgcagcccagaaataaggtttcctcagagccatcctttccaagtgaggcagatgtgctggctagtggctagggcattcatcgcagcagctctcccatcttttctaatgagatggtaaccagtatgtgaataaagctggtgttgcttcccttcagtttgtaaatgtcattatgtactgtaataaaaaactctgtattgttctccctagcat

SEQ ID NO: 4928 - DNA, 734 bp, Sorghum bicolor
  Clone ID: SORBI-28MAY03-CLUS9374_1
tggccatgccgcgaaagcatgtccgcggtggtggcggctgctgctacccagcctgctgctctggccggcgccggagctactgctgctggcctcactgtcaatcagcaccagcagccggcgaagagctatgccacgggtgcggctgatccttgctctctgcaataacagggaactggtgaacaaacagaatgagagtgaaaacatgcaggactctgacaatctctcgatgctgacttccatgactacaggaaacacaggcagcgtgtttccattctccaaacaaaataatccttttgaagtgaccagctcaaggccagagtttggccttgtttcatcagactcactgatgagctctccacatagttccttggagaatgtgaatctgctcagctcacagagtctgaatgaacaccagagttcagccaccctgcagcactttgtggactggcccaggacacctgcccagggaggtctttcatggcccgaggcagaagacatgcaagctcagagatcacagctctcaatatctgctccaatggcatcctctgagctatcatcggcctccacatctcccatccatgagaagctgatgctatcacctcttaagctgagccgcgagtatagtccaactggtctcagcattgcagcaaacagagatgaagttagccagttagaagcaacccgggcgacaatgttcccgcgatcttcatgggcggtccgttaagggaggtttt

SEQ ID NO: 4929 - DNA, 529 bp, Sorghum bicolor
  unsure (1)..(529): unsure at all n locations
  Clone ID: SORBI-28MAY03-CLUS93942_1
gaaaaagtaaaatggcgcgggggaaaaagagaaggaagcagagccaacagggnaagggaaggggtccagggccggcggggcgacgatggagaggaccggcggtggcggtggcggccgcggggacgagatgatgatgacctcgggcgcgacgggccggatcgtgccggtgttccgctccgtgctgtcgcggcgcgcgctgctccgcgtcgccgtcgcgctgcactcgctcttcctctggctgctgctcctcgcccgaggcctccgcctgcgccgggcggggtccgagacctccgcgtcggcgttggaggcgggagcggggggcgggtcctggaacgcaaggcggcggcggcggctgcaggccgcggaggaggaggacgtgcgccgccgcagggcgctcgcggaggaggtgccgatggaagaggtggaccggggcaccaggtgggccacgttcctcgtcaccgggggccaggaggaacgcgctcttctggcgcctctgggcgccggccgccgacgagatgaggggcatttt

SEQ ID NO: 4930 - DNA, 568 bp, Sorghum bicolor
  Clone ID: SORBI-28MAY03-CLUS94768_1
aaaaaatgcgtgctctgactctgagcattggcccaaaccgagcacattggtccaaccatgaggcggacggcggcgttgctatggacccacggcggccgcagcatcccgccggcgctcgccgacgtgctcgtctgcccgctctccaagcagcctctcaggtactgcgaggccaccgggtctctggtcagcgacgccgccggggtgtcctttccggtacttgatgggatcccttcacttgtaccaaaagatggaaagttactcgacgaccaagaagtgaagtcagaacaagagtccagcactagggattcgtctggttgaatccttgtctatgcaacagccaattgaagcaatatgttgtagtaagtcgacagtaataaaaccagagctatagttctctccaaattattgtttcttgctgcaaatcgtcactaccccgttgatgcgtactcaccatattcccctagagaatgagatgcttataccgtttctgttgaaaacgcttatatggttttgtcttgaatgacaacaatgagaataatgaaatggccaaaaaaaaaaaaaaaaaaaa

SEQ ID NO: 4931 - DNA, 475 bp, Sorghum bicolor
  Clone ID: SORBI-28MAY03-CLUS9484_1
agtaaaaaactctcttgaattattaatgaacagaaaggtgctattgtctctgacactgtactgtagagatagaatatttcttaagtgcttatagtaggataaattgttgacataatcttcgctgcagtgtcagatttttaaccggacactccagaaatggtgggacagatccactacatgtagctggaagtgcagctgatccagacactactttggttgtgtacatgggtttgtcaacacttccatcactcgctccaaagttaatgaagcacggcctgccgccagatacccctgctgttgcagtagagcgcgggactacacctcaacaacgaacggtagccactctttggcccgcaaaaactaaattggtcatatccttactcctacatcctgaatctctctcactcaggaggtgttctccttgctaaaggatcttggggatgaagtcaaggcaactgatctagtttctccaact

SEQ ID NO: 4932 - DNA, 704 bp, Sorghum bicolor
  Clone ID: SORBI-28MAY03-CLUS94916_1
tgtaccatgtaaggcattatgatgttctcaagctcatgcatttgaaggagccgctagatatattcttgtcacatgattggcctctgggcattactgagtatggaaactggcagaagctcattagagtgaagaagcactttgaagaagaggttaacaacagaacactaggcagcaaacctgcagctgaattactgaacaaactaaaaccgccatactggttttcggggcaccttcactgtttgctgccggctcccacccaccgtggcttgtctgcaccttcggcgacgccccttgctcctggtctctgctttcccgggcgctctttttcgcaggttatcgacctcccagccgttccggggccatgtgtcatcctctctgcccgggaacgccctgcatgatcacgatagtgcgccaccggttgcccctgagcacgctctcgatgttcttggcgggaggaccaccctgtcgctcaagtaccccggcaccgggtctggtgcttgctgactactcgaggagccagtttttcaaaaaagggtagacgaggaactacatgtactagattgtattgtcatagctgcttgtttgtgagagaacgtttgtggaattacagggtgatcagttgatcacaatgccaactctcattcgcgtcgagttcatactgatttttcaaccaagtactattaatcactagatgcatttggtgg

SEQ ID NO: 4933 - DNA, 611 bp, Sorghum bicolor
  unsure (1)..(611): unsure at all n locations
  Clone ID: SORBI-28MAY03-CLUS9493_1
atcctttttttaacttagcatggttgcacaaaagctttttctagattgatgttgcactgttgacaaagatgaaacggttacctatatttatatacgttaccactattacttgttacaaacgcatattatagaattttatgtgaacttcaatgtttcagtattgtttatcttcgacatatgacagattatatgtggccccctgcttacaactcttgatgaataaacatctacagtcctattgtcttgtactggatttccttttgtgctataattgacattagtttatgctcttttctctttcagcaagcagtcatggatatcatgtgcaaagtcgcaggtacagatgttcagatatcataaaactataggagatcaagagttatatttttgaatcactacatggaaggcacgactcccctagaggactctgttctagacatcttgtgataagtgtgagttttagttatctntttggaacttgtgcagacaaagctaaatcttctgaatttcgtaatgtgattatgtgatatctatgtgctgtttgaagaatagatctgataaggtaaggatatccctngntcatgtatgggttgtggctctattttggcatt

SEQ ID NO: 4934 - DNA, 478 bp, Sorghum bicolor
  Clone ID: LIB3478-002-P1-K1-F11
gtttagttttcaaagtcttcacttggaaagaaacagtatccatttctgttgcgaagatccatggacataaacagcaatagcatgttcgcttccagcagggctacacggcatggacaaaccactcggcaagaaccaccatcggcagcagaacatccaacctgtaaacaatgtttatctaaacttcttgtgccatgctatcgaatctgtgaaatatccatgcaatatatagtcatgttaccttttattatttttagaattaacccatatatgtaatatatgtgtgtatgtatatatttaggatgccttcagttcatagttgtacatctcatcagaatcactgcagcacaactccgttatatacacactgtaaataggacttggttagaacattaaaataagtagaaaggcattgggttgcaacgttggtttgccaagacatagaaataatttaggatgccgctcctcaatcatgactatg

SEQ ID NO: 4935 - DNA, 450 bp, Sorghum bicolor
  unsure (1)..(450): unsure at all n locations
  Clone ID: LIB3478-033-P1-K1-H2
cggacgcgtggggatcgatgttgtgtgtttcaaatattggctctctatttaccattattagtgtagtctttttcaatggtaaattttatataaaaaagcttatgactactcagattgtagaggtatagcaaattctattttctttctgtagcaaccgaatttccattgttccaaaagttaagagcatcttcgcttccagcagggctacacggcatggacaaaccactcggcaagaaccaccatcggcagcagaacatccaacctgtaaacaatgtttatctaaacttcttgtgccatgctatcgaatctgtgaaatatccatgcaatatatagtcatgttaccttttattatttttagaattaacccatatatgtaatatatgtgtgatgtatataattaggatgccntcaattcatagttgacatctcatcagaatactgcacacaact

SEQ ID NO: 4936 - DNA, 598 bp, Sorghum bicolor
  Clone ID: SORBI-28MAY03-CLUS94942_1
tcagtttgggcgtgctggtcctagagattgtgagtggccgcaggaacagctcttttgtcgatgatgaatggtcaatgaccctcttgggctatgcatggaccctgtggaaggaaggcagtgtctcagagcttatcgatccgcttatgggaacaacatacacttacgacgaagtctgcagatgcattcaggtgggtctcctgtgcgtgcaggagttaccagctgaaaggccaaccatgtccacggtgctcaggatgttgagcggtgatgttacgattccgtctcccaagcaagctgcattttttgttggaagggctcctcgtcttcctgcggatgacaacagtactgaatctgggaatcaattaacgtacacggatcttcagggcagatagtgtcactgtctcaggctgcccaagtttcacactgtatatcgtcttcctattactaagtttgtacggagtatctttataagcagcaggggcaactccagctgatccctaaaaaacattaagtttgtacggaatgtttagttcaaaaatatagtccttgtaagttgtaactcgtgaactgtattcatatttgggaatactgagtgcatgtg

SEQ ID NO: 4937 - DNA, 920 bp, Sorghum bicolor
  unsure (1)..(920): unsure at all n locations
  Clone ID: SORBI-28MAY03-CLUS9403_1
gctacgcgagccctaactgccgcagaggtcagtactaacagctgtagccttactaatggaagcactgcgcctgggacgtgatcataagccgtagaggacagctgcctgtgagacagcgaaagactgacagagcacatgttttagacaaggctaagcatctttcaaggctaaatgtgaaggagtcaggaaaagtaatgttgaaacgtggtgaaggaaagcttgaaaagcagttccgcatgagctgtgtgggatgtgacctttatgtttgttcccgatcagaagaggatctggaggttgctcctttcatatacgttgttgatggagcactgagttcagttgcagctgaaacaaatccacatgatgctcctgtacctncttgcatcacacaactggaaggtggacttgtccaagtagccattgaagtggaagaccgggcacaacgttcagcaataacaagagtgaacgcagatgatgttcgagtaacagtagctgcccctgctgctcgaggggaggctaacagtgagttgctagaatttatgggcaaggttcttggcctaagattgactcagatgacccttcaaagaggatggaataacaaatcgaagcttctgattgttgaggatttgtctgcacggcaagtgtatgagaagctcctagaagctgttcaaccttaggaaccctagtgatggagcaatgtggtatacttttggatattctctattgagggcacaagggtcccattcattgtgcaagaggaggtgcttagacgtgctgagactaggtcgaaaacatgactgaaatgtaactagaccaaagcaattggccaatctgggcagtatcggactcattatctgttgtgaaactcagacactactatgtcctctgatctgaagggaaggttgtttgtcatttcttaattc

SEQ ID NO: 4938 - DNA, 443 bp, Sorghum bicolor
  Clone ID: SORBI-28MAY03-CLUS94150_1
ctcgccgtaccagatgccccgctttccgtctcgctcaccgggtggtgctggcgccgatgaccgcgcgcggggcgcccgacgcgatcccgggccccgcgctcgcggagtactacgcgcagcggtccacggaaggcggcttgctcatctccgagggcaccatcatctcgccctccggccctgggttccctcgtgtccctgggatatacaatcaagagcagactgatgcatggagaaaggtggttgatgctgttcatgccaagggagctatttttttctgccaactatggcatgtagggagagcttctcaccaagtatatcagccgggtggtgctgctccaatatcctcaactgataagccaatatcatcaagatggaggatactgatgcccgatggatcctatggcaagtatccaactccgacgcgcctagccacatccgggata

SEQ ID NO: 4939 - DNA, 650 bp, Sorghum bicolor
  Clone ID: SORBI-28MAY03-CLUS94160_1
cgccacggccacggaccaccaccaccacggagacggagacggagacgggcagcggcagaccaagtcgacgcccagcatgcccaggctgctccggcactcgcacagcacgctggggaggcacacgccgcccaaggctgagcacagcgcggtggcccggtgcagcagcaagaagcagacgagcggcggcttccatcagttgcagttgcaggacaagaagtggaagagctccagcgacctggagtccatcgaggtgcaggggttcagggaccttggcttcgtcttcgaacacgaggagctgagggagagcctggccgacgtgctcccgggcctcaagcagcagaccaagagcaccagcaccagcccccgcccgcggccttacctgtcagaggcgtggcagcaggtgcggcggccggcgctggcgagggtgcagtcggcggcggagatgaaggaccagctcaggatgtgggcgcaggccgtcgcgtgcaacgtgcgacaggagtgctagttagtacattatttatttatttatttattattattatattagaaaaaaaaggaagaaaacagagacagtcgcaccagaacgcacgcaccacaagagcaaccagatgaaagcttctttgttaaacatacatacagtataaacagta

SEQ ID NO: 4940 - DNA, 762 bp, Sorghum bicolor
  Clone ID: SORBI-28MAY03-CLUS9412_1
gccggccgggccgggagaaacctaggtcctcactctctcttttctccctcacgccgtctcgcagtcctccacaactcctgctcccttcctctggcggcgcagacaggtacgggatgaggccccagcggcgcgcatctgcgatagcaagggcgccccctccggtggcatgaccttgcactcaactacggcttcccaacgagctcgtagaggcacggcgcaggcaccggcgaccctcgaccgcacgtcggcttggctctccagtcttcccctcagtggttgcagttcggccggtcggcggcaggccgcacatagcagcagccagcgccgcacccagggtgcaggggcagagcagatccacgctgcgcccagatgcagatgcagagcacatcgacctcgctgttcattgacccacgcgcggccgccgtcacggcttgcggtagcaggaaggtcgcacaaggcggatgggctccagtggccgtatacgtgcagcccgcacaacaatctgggctcctttgtggcaacgaactaagtggcagcaggtcagaagagagagtggatgtctcagtgaagtggaggatgtctcagtgaagtgaaaagcctcagtaatgtttaggggtaactacaactcttttagttagcttgatgaatattcaagatgttgagagggctatgttctttgtcattttggacttgtgacttagatgtagcgtgatgtatattgctacctggatgtatgagtttgacaatataattttttacaac

SEQ ID NO: 4941 - DNA, 160 bp, Sorghum bicolor
  Clone ID: SORBI-28MAY03-CLUS9417_1
gcataaacccatgcatcaagcagcgcatggcgagcagcaccatggctctctcctccacggccttcgccggcaaggccggaacgtgccgtcgtcctttcgcgaggcccgcgtgacgatcgcagacggcgcaagccagccgcgcggtcgcagccgggacgcc

SEQ ID NO: 4942 - DNA, 532 bp, Sorghum bicolor
  unsure (1)..(532): unsure at all n locations
  Clone ID: SORBI-28MAY03-CLUS95019_1
tgggttttctggaggaccaagcatcaccagggcggcaatggcgcctcccatctcagcatcacaaagcacaatcaccattctgaagatttttccaaaacctcctgctcctgatatcagcagcaataacttcactgttggagccaaattcgacaacaggagggcacttttatgtggcttggtcgctgctgctgctggcaccgtgttgagccctgacatcgccggtgctgcttcgaagaggcggcctccaccaccagggccggcagaggagaagaaagacccgaatgttagcggtgtgcaggctaaggtgcttgccagcaggaagaggaaggaggccatgaaggaagctgtggccaagctgagggagagaggtaagccagtcgataagtgaaggccagattgccagaaccagtagcctcattatggctcgagaaatgtaacttactgataataatataattgttactcgtttgatgtgtaaaaaaaananaaaaaaaaaaaaaaaaaaaaaaaaaaaaaaaaaaaaaaaaaaaaa

SEQ ID NO: 4943 - DNA, 484 bp, Sorghum bicolor
  Clone ID: SORBI-28MAY03-CLUS9505_1
ctacgatctttcagagtgctggattctctggggcatctgatgctactcgtgtatccattcttcttggcgtactgaagctaatcatgaccggagtagcagtccttgtggttgacagacttggcagaagaccgttacttattggaggtgtcagtggaattactgttgccttatttttgctgtcctcctactacactttactgaaagatgcctcctatgtggctgtaatagcacttctactatatgttggctgttatcagctctcatttggccctattggctggcttatgatctcagaggttttcccgctgaggctgcgagggcgtggattgggtgtcgctgttcttgtgaattttgcgtccaacgctctggtgacctttgctttttctccactggaggatttgattggaacgggggcgctcttctctggatttggggtgattgcagtggcatctcttgcattcatattctggatcgtccctgagac

SEQ ID NO: 4944 - DNA, 512 bp, Sorghum bicolor
  Clone ID: SORBI-28MAY03-CLUS9508_1
gcacgagggtcgtctttccccttccttccctcccacgcgtccgcccacgcgtccggaaagggggaagaagggacgaggagcccagcatgccgctctgcagcttctacgcctccacgtccgtccccgtcgtcaagccccagcagtccgtcgcctcctccaagcccccctccacggcggcggcctctgtgactacaactgtgccgatgcgcagtgcgacgacggcgacggtaacgacggccgtgcccacagcgagccaaacgctgtcgctgacctgccggagctgccgtcgcaggtgaaggacaagatcctgagcctagagctgatgggcgtggactacaggcgcgcgctggagctgaacccggcgctccgcgacgcggcgccggagtccatccacgcggtggtgtcgttcctccagtcccgcgggctccagttcaaggacctgggccgcgtcttcggcatgtgcccgtccgtgctcaccgccagcgtccgcgccgacctccgccccgtcttcg

SEQ ID NO: 4945 - DNA, 645 bp, Sorghum bicolor
  Clone ID: SORBI-28MAY03-CLUS95095_1
acacaggtacaagatttacatcgaggggcgggggtggtcgggtgagcgagaagtacatcctggcgtgcgactcggtggcgctcatggtgcggccgaggttccacgacttcttctcgcgggggctgtcgccgctgcgtcactactggcccgtccgcggcgaccgcggcatgtgccggtccatcaagtacgccgtggactggggcaacgctcacacggacagggcgcaggagatggcggggaacgcgagcaggttcatccaggaggagctgacgatggaccgcgtctacgactacatgttccacctcctcacagagtacgccaggctgctgcggtacaggcccgaggtgccgcgcggcgccgcggaggtcaccgtcgagtccatgacccggggaaagcgggggctggagaggcagttcatggcggacacggcggtggccgccgcgaacggcgaaggcccctgcaggctgcagccggcttacagtgccgaggaactagaggcgctgcggagagcgagagaggatgtggtgaggcaagtggaggcgtgggagaagtgacggttgacacgcgtagagagtaggaggtacggttgcacctttttttttacctttccccaaatttggtcaaagaaatatagagcgaatttgt

SEQ ID NO: 4946 - DNA, 1149 bp, Sorghum bicolor
  Clone ID: SORBI-28MAY03-CLUS95097_1
aaaaaaaaaaaaaaaaagattttacaatcattattgaaggcaaatttctcacatctgcattgaattttcctggagaattccttgatatatgtttggacgcttcttctgttatatgttgtagagtaactccacaacaaaaagcacaagttgttaaattggtcaaagaagatggtcacgtgactctttctattggagatggtggaaatgatgttgttatgattcaagaagccaatgtaggagttggaattgcaggtagagaaggattacaagctgcaagagctgcagattacgctatcggaaagtttaagtttttaaagagattgttgcttattcatggaagatattcttatgttagaactgcttttgtttcgcaatattgtttttacaagtctttatttatttgctttattcaaatattgtattgttttttgagtggatttgcaggaactagttttttcaatacatttagtttgactacatataacattgtatttacatcacttcctattgtactttacgtacttgataaagatgtgcctgaagaatatgcgtggaatcatccttcgatatatggtgatactcaaagaggtgataatatgactattcctactgttgtaggatggggtctaagagctttctatcaagcattagctgtatttataattaccgttatatcagctcgtcatttcagttatgatggttctttagactatgcttcaatttctattgttgcatatactgctttagttgtaataaactgtttaacagtgtttctagaatcaaagagattgacatgggtaaatcatattgcattgtggggaacattagtcacctattctattacaatgactattgttaatcttattcctggagttatgtatggtgtagtttctagacttagaagtgatcctttatattggcttactgtattattatctgttgcatttgctatcgttccagtctacgcaattagattttattatctcatattcactgacaaaagagaaagcactcgagttagtagattacgtgttgaagacccttccattcgattagatcattattcaatcacaaatgtaaatgacaaaacaccattgttaaaagagcaaaatgtataagaattttttgtatataaaatttatttaactg

SEQ ID NO: 4947 - DNA, 511 bp, Sorghum bicolor
  Clone ID: SORBI-28MAY03-CLUS944_1
cctctacgcgcctcgcgcttttctgtgcgccctgtctctgcggaggcttgctggcctctctctctctctgtttttgcttgctgggcgggatttggccctggatctgtgcaccggacgccggatctgggcggcgagttggtgcgctgtaatgcctcttgcgcgatgctgtgttttgtgcagcagtgaatttgggagcttgaggtgttcatctgagacatggaaaaagtgacctgtcgggcatatctccttcaatgcaagcagttcttttcaaaagaaactcttgattggtgtgtcttagctcgtgggaacacccatctctcctctctggtgaactacacatagctgctatatgcttctctatgctcatcaacaagcaggctgatgtgatattttcctgaagttactatatttcagtctatgccagacatctacatggttaatatctttcgtgagttcaaacgacatctgttgctgccctagttagttattttagtatattgtgttctatctg

SEQ ID NO: 4948 - DNA, 582 bp, Sorghum bicolor
  Clone ID: SORBI-28MAY03-CLUS94401_1
cctactcgaccccgtcgcagccggaggggagaggacgaaaggcaatgccgtgctgccagacggtgctcagtgccgccgccgccgccgccgccgccagcagcacgccatcatggctccatcggctgcacgccaaagggggactctccttcccctcccacctcaacatcgacgacctcctctacgggggccgacaggcccaaactccccctccccagcccctgccgccttcttcctccaatcaccacaacgacctcgtcgttgttgtcagggagccgcttgcgaaggccgccgccaagcccaagcagccgccgccgccggcgcagcgcgcgccccgcaaccctttgcgatcaaaccctagctctagcaattccccgccgccgtcgcaacaacaggttcagctcgctgctgtgatctccgaggtcttcgcggtcccatcctccgccccgccgggcatcccgccgcccaaagccttccgcaagcagtcccggccccgcccgagaactgacgaggaccagccgatccctgcccttcctgcacagcgtccgcacaaggacaagaaggacaagatcgccaaggccaaga

SEQ ID NO: 4949 - DNA, 738 bp, Sorghum bicolor
  Clone ID: SORBI-28MAY03-CLUS94428_1
ggtgctgcatcactcgccgcaatccactcccaatccaaaacccgaaagctctccgctccgcctccctgttcgctcgtccgccttttgactctatctcctagctagctgctgttgcggagcaacccacaattccaagaaaagcaaactggtcaagaaagagtggaagaaaggaggatggtgatgatgatggcgataagtcacctcatgattcgccccatcattccgtcgcctccgaggcctgcgcgctgctaaaagggcctcgccgtctgtcgtcgtcgtcgtcgtcgtcgtcgtgtgcgtgggcggggactcagtcgctgcgccgccacaatgccgcagtaccaggagctgccctgcggcgggcaggtgctcgacatcgacacggcgctcaaggatggcatcctcgggggcgcgctggagcccgtggatgcggcggcgggcgacgccgggaagcagcctctggagctgcgcaagatgatggacgagctggacgcggccggggacggcggcggcgacgaggcggtgccggcggtcttcatctgcccgatctcgctcgagcccatggtggatccggtgacgctctgcacggggcagacctacgagcgggccaacatctcgcggtggctcgccctgggccaccggacctgcccaaccacgatgcaggaactctgggacgacgcgctcacccccaacgccactctccgacagctcatcgccgcctggttctcccgccggtac

SEQ ID NO: 4950 - DNA, 593 bp, Sorghum bicolor
  Clone ID: SORBI-28MAY03-CLUS94431_1
aagagcctcaataccaggcttaattgacgaaacgtcatgggtaactcttcttctcgagggcgatcaaagctgagtcagcgcccgcagacgaccatgaagtggagcgtcgatggattctcctcactccttgacaagggtgaaggatggacctactccagagtgtttgagattatgggccacaactggtaccttagactgaatccaagggacaagaagagtggtgatgacaaggagtacgtctctcttatacttgagctggatatcagctcagtgaagcccgatactgtcgtggaggcctctttcaagctgctgatatatgaccagtcgtacggaaaccacagcgagtatcaaggtaggcacaattttcagactgcaagcacaagctccggagcctcttgcatgatttcccttgaaaaactgaaagaacggccctcaaagtttattgtcaataaaagctgcacctttggtgtcgagttcatcaaagtcaccacttccaaagtgagcacgacgtcagaaacgctatttgtccagaagccgagcatcttcaacgaggccaaaacatacacttgggacatcgaggacttctttgcact

SEQ ID NO: 4951 - DNA, 614 bp, Sorghum bicolor
  Clone ID: SORBI-28MAY03-CLUS94639_1
ggctgcacaccggcgacatcggctatgtcgacgacgacgacgagatcttcatcgtcgacaggctcaaggagatcatcaagtacaaggggttccaggtgccgccggccgagctcgaggcgctcctcatcacgcacccggagatcaaggacgccgccgtcgtgtcaatgaaggatgatcttgctggtgaaatcccggtcgccttcatcgtgcggaccgaaggctctgaagtcaccgagggtgagatcaagcaatttgtcgccaaggaggtggttttctacaagaagatccacaaggttttcttctctgaatccatccccaagaacccgtccggcaagatcctaaggaaggacttgagagccaggctcgccgccggtgttcactgaggccgtatacagcttttcagacggtcacactgctgcgaaaaaaagcaatgtaatagcggtaaccttattcatgaaagggcaacagaagaggcgcgtaatcctgtggaaacatgttgccaaaagaggttttagttcgtttgtttgtctgtttgtgtaatgttcataaacgatatatatatagatgtatctatatttttttgacccaaagaacaaggctgatgacggcaatac

SEQ ID NO: 4952 - DNA, 641 bp, Sorghum bicolor
  Clone ID: SORBI-28MAY03-CLUS94661_1
aggagatcagagccgcgccccggcgaggtcgcacgctcgcaccagccatcgtctccttccttccaaattccaatagtaccatccaactcaccgcccaccgcagcgttttaccttcccgagagctcgcaaggtcgagatgggttccgtggacacggcggtcgcggtgccggtgccagtgccggagccggaggcagaggagaaggcggcggtggtgttccgttccaagcttcccgacatcgagatcaacaacagccagtcgctgcagacctactgcttcgggaagatgagcgaggtggcggaccgcgcctgcctcatcgacgggcagacgggggcgtcgtacacgtacgcggaggtggagtctctgtcccgtcgcgccgcgtcggggctccgcgccatgggcgtgggcaagggcgacgtggtgatgaacctgctccgcaactgccccgagttcgccttcaccttcctcggcgcggcgcggctgggcgccgccaccaccacggccaacccgttctacaccccgcacgagatccaccgccaggcggaggcggcgggcgccaaggtcatcgtcaccgaggcctgcgccgtggagaaggtgcgcgagttcgcggcggggaggggcgtccccgtcgtcaccgtcgacg

SEQ ID NO: 4953 - DNA, 572 bp, Sorghum bicolor
  Clone ID: SORBI-28MAY03-CLUS95345_1
cagagaagctggaaattgtggatttcactagctttgtggagaagtcaagtgaccctggtcgctatgtcatcttctgggagctgagctccgatgcaagtgaggatgtgttacgaagctgcgcaaattgcttggccctaccctttgttgatgcaggatatatgggttcaaggaagatcaaagccattggcccacttgagctacggattctgaaaaagggacccttcaaggagattctagatcacttcctgacccttggtggccccgtgagtcagttcaagacccctcgattcgtcagtccgttgaatgtcaaggttctgcagatactaaataggaacccccccggaagttacttcagtcccccctatgggctctgataaataagaaatgctgctagttgttcctggtaattatcttttttcactgttctgttctagtctccagataaagaaaacaaactgtcttagtctcttgctgtaaaactcatattctagtgctgctggttgctagaatatctgtaaatccaaatgcagttgtagcaagaggtatcagaaaagtgaagctgctgctccctc

SEQ ID NO: 4954 - DNA, 336 bp, Sorghum bicolor
  Clone ID: SORBI-28MAY03-CLUS9537_1
gtgcaagcagtccaaatgacgcgcgctatgcaggggcgaggtcgagcctgccgtcgctggactggccgaagcgtctgaagatcatcaagggcgtggcgcgcgggctggcgcacctgtacgaggagctgccgatgctgatggtgccgcacgggcacctcaagtcctccaacgtcctgctggacgccacctgcgagccgatgctgagcgactacgcgctggcgcccctggtgacgccgcagcacgcggcgcaggtgatggtggcgtacaagtcccccgagtgcgcggcggcgcatggcgggcgtgccggccggaagagcgacgtgtggagcctgggca

SEQ ID NO: 4955 - DNA, 657 bp, Sorghum bicolor
  Clone ID: SORBI-28MAY03-CLUS95394_1
actgagtgaagccctggacgagctgcgcttgacgctgaagagttcaacgatcgtcttcgtggatatgtttgctatcaagtatgatcttgttgccaaccacacgaaatacgggattgagaagccattgatgacatgttgtggtcatggaggccccccttacaactatgaccccaaggagagctgcatgacttcggacaaatacctgtgtaagcttggcgaaaagttcataagctgggacggggttcactttaccgatgctgcaaacggcattgtggcttccaaagtgctcagtggcgagtacaaccattcccagggtcaagctgaccagcctcctccccaaaccaaaatccgatgaataatggtgatgcagcatcttcgttggcctttagtttggcctatcaaggatgatgaaaatgaaactactaacaaaactgaccacaccaaagtttaattattctgaggttattacattacagccgttgcagaagacgactttccttttgttttcttctatttttgtacaatcggggcatatgtatatcctagggcttaatacatggttgtactgtacatgatgatgcgccgatgcaggtgtctgtaccatctaccatgtattattcttttcttatgaattttgggtacaataaactagagatg

SEQ ID NO: 4956 - DNA, 618 bp, Sorghum bicolor
  Clone ID: SORBI-28MAY03-CLUS9542_1
gccggccgggccgggctctcgctcacttcctccgatcgactcgcctgcggcggcgccggcgaccagcgaccagcggcgatgcgggtcgcacccaaggtgctcttcctcgtccgcgacgccgcgggatacggcgcggccctcgccgactcgctccgtccgcggaccgggctaacgagggagtcctcgcccttcgagcttgcccttgacaagtacggcctccacggagagaaggcgtccggcgagctcctgagcttttccgattccaatggctctccacaggtgtccatttttgttctgccagactataagccccctcttgcagcgtgtgttgtaaatgaggtcttggaactgatttcttctgaagctacctccactgagcgaattctaattgtcccattcatcacaagatcgtcaagctatcatcgtggaatggaacatgcgacaaaagcatcgcctgtacttcatggtgctgaaataggggcaacaactgactatactcacttgtttgttggtgggaccactaaacctcctacattcttgccaatacgtagcgaaccaacattatgttcgctggaaaaggtgcgcgcgttgaggatgcctacagttcttcttgccctt

SEQ ID NO: 4957 - DNA, 711 bp, Sorghum bicolor
  Clone ID: SORBI-28MAY03-CLUS9547_1
gaaagagaggtgcctttgtcagagaacctccttcaaactgaaccaggagagaatcaaattcccaatgaacaggatgaaaaggacaaacaagatgagtttcaaaccccaaaagaaaggaatgaagaggacgtgcaagatacagaatttggagaggctaagaaagaagttgaacaagaattacctgtctcccattttctgatgaatctaatattgggaaaagagagcagtgatgcaaatgaagattcagaatctaaggctgcaaggaagcaaggtgaagcgacagaagatggcagctgcgcgttcatttctaaacaagaagaaaatctggggtcacttcctacagaaaataaggtggatgacaatctcacctttgttggacaagaaaaacatgaagttaaatgccctgaagaaacacaggaaatggtcaaagaacaaagtgatgatcttaagatggacacagaaagatcaattaaaactgtggaggatatcaaaaagaacactcatgatttggaaataccagcataccaagacaatagccaggatgacatttctggtgaattgctgacaggagaagcagctggtgtttctacaaaaatggaaactagagatattgatatttcaagtgttgagctggatgacatagcagttggtactgtgtgtcaggaaaacatggaggaatcaacaaaaactgaaaatggaagcttgaggagc

SEQ ID NO: 4958 - DNA, 674 bp, Sorghum bicolor
  Clone ID: SORBI-28MAY03-CLUS94946_1
ccatcagtgaggacagtctctccagaatgacttatctgaaagctgtaatcaaagaaacgcttcgtttgcacccaccggctccgctcctcatcccgcatctctcgttagaggattgtgatgtcgttgacaacttcaaagttcctgctggcacgactgtgctcgttaatgtctgggcaatcggccgggaccctcggacgtgggataatgcggaggagttcatgccagagagattcatccatgatggagaaatcgggggagtcgattttaaagggaaggacttccagtatctgccttttgggtcagggagaaggatgtgtccagggatgaactttgcattagccaccattgagatcatgctggcaaatcttgtgtaccactttgattgggagctgcctaaaggagcagagaagatcggcatgagtgaagtgttcgggttgcctgcgaggcggaaagagaagcttctccttgtccctatcgcacgtggtacggtgtgcccatcaaatgggtaggaagaacttacgtttgagttctgttccttgcagtggtggttgcttgatgtgtacctaaaatggacctactcgctttgtcgtttttctttgcaattatgtgtccgtacatgttctgatatctatatatcatattaatgcaacatcgacaagtgatattgcgtttcg

SEQ ID NO: 4959 - DNA, 520 bp, Sorghum bicolor
  Clone ID: SORBI-28MAY03-CLUS9495_1
gctgtggagacggacaccctgcgcgactgggaaacggtcccggcccgctgcgagaagtacgtcggcaactacatgctcggcgggcagtaccgcagcgactcccaagccgtcgtcgacgaggccgtcgcctacgccgagggcctgaagctctccggcgatggcaaggaggtctgggtgttcgacgtcgacgagacgacgctctccaacctcccctactatgctgagcacggcttcgggtctgagccgtacaactcgacggccttcggcgcgtacaccaagttggcaaacgcgccggcgttgccggagacgcagcggctgtacaagagactgcaggagctgggcatcaagccggtgatcctgacggggcgacgcgaggacaagcgggagtccacggccaagaacctcgccgatgtggggtacaccggctacgagaagctgctgctcaagcctagagacgccagggtgactgcggtggagttcaagtccggcgagcggaagaagctggtggacgccgggttcg

SEQ ID NO: 4960 - DNA, 680 bp, Sorghum bicolor
  Clone ID: SORBI-28MAY03-CLUS94966_1
aatgtccacagctagcaaaaatacatttctactttagtacaagtcccgcatggctcaagtagtttttgatcagctcgcctgcgactcaccgacggcagaagtttttctccttgtgctcctccctctcctactactcttcgtgctgctgcgctgcttcttcaccacgggggcagcgaggagtagtcgaggcagaaagagcctgcctccctcccctcctgcgctgcctctgatcgggcatgtccacctcgtcggtgcgctcccgcacgtctcgctgcgggccctcgtcgagcggcatggtgtcgatggcctcctgatgctccgcctaggtgtggtcccaactctggtggcctcctccgcgcgcgctgcgcaggctgtcttgcgcacgcacgatcaggtgttctcctcccggccgcggtccgtgtgtggggacgtgcttctgtacgggccgtcggacatcgccatggcaccctacggcgagcagtggcgtttggcgaagaagctgtccaccacgcacctgcttagcgccaagaaggttcagtcctaccgcactgcccgtaaggaagaggtggagctagtaatcaacaagatcatccatggtgcggcagcaacacgcacggtggtggacatgagcgagctgctgagcaagttcaccaatgacatagtgtgccgcgccgtggcag

SEQ ID NO: 4961 - DNA, 582 bp, Sorghum bicolor
  Clone ID: SORBI-28MAY03-CLUS9501_1
ataacagcccatgccgacggccgtgcttcccagcagagaccagagcttcttcttggccttctctgcttctctgctctagttcttgaatccagaattcagttagggagattgttctttctcaccgaccgggagatcctgaaaagagacaacacacggttgggaaaaaggggatcggcatgaaccttcaccaagacatggacagggagcagatgaggatggccatcctgaaccaagaacagatcttcagacaacaggtacacgagctgcaccggctgtaccatgtccagaagcagctgatgcagcaagcacagacgactggtccggcgagccgtgctccggcggcggtcgtcgacgtcaagccaagacccgagcttgacatctgatgcgtatagaaggcgacaacaactcctcagcagcagatcatcagcttcaacaaggacacaacacctgcaatgatcgaggaatgcaaccttgagctgacactgtcaacgctaccgagcagcaacagcagcatctgcgacgtcgagaggcggcaggcgaagcggaacaaggcgtcgaccaactctgactcatgcgcgaccg

SEQ ID NO: 4962 - DNA, 512 bp, Sorghum bicolor
  Clone ID: SORBI-28MAY03-CLUS957_1
aagagcccctgcaaaaccctacctcatcccaccgctcgcatctcacggggaagactggtatgctcgccgccgcctggaggctgtcgcagcgagccgtcacgtctcctctcctaggcatcgggcgatcccaaatccgaaaccctttctccaccatggcgtctctctcgccggcagctgcctcgccgaagaggctgagggtctactcgtcccccgccgccgacggcgccggggcgggaagcggcaagcgcgtggggacccacaacggcagcttccactgcgatgaggcgctcggctgcttcctcatccgcctcacctcccagttcgccggcgccgacgtcgtccgcacccgtgactcccagatccttgatacattggatgctgttcttgatgttgggggtgtctatgatcccagtcgccatcgctatgatcatcaccagaagggcttcagtgaggtttttggacatggattcaacacaaaacttagcagtgctggacttgttaccaagcatttt

SEQ ID NO: 4963 - DNA, 627 bp, Sorghum bicolor
  Clone ID: SORBI-28MAY03-CLUS95701_1
tcctacctttgaaaatggagtcacaggctgggaactagcccttgtgactgcaccaagttcaaatgagaccgccgttgccccaagcaagaaactggccggtggtctggacttgctgaccctggacagcctctacgacgaggcgaaccggagagcgagccagccggcggcaagctacaacccctgggatgcgaccccggccaccgccgcgcctgtcccgatgctgaccatggcgccggccatgcacgacccgttctacgcctcgaacgggtacgcggcgcctcacggcgtgcagatggcggcgatggcgcagcagcagcaggccttcatgttgcagcagcagatgatgacaatggccccggcgccggcaccggtggtccaccacccgatgcagatgcagcagaaccccgcgaacccgttcggcaaccccttcgcggccgccggcgcgcacccttacggcgccgccgccgccggcatgccgctccacgctggccccggcaacgtctacacggggctgatctagtgccacgtccagcggtcatcgaatcaaatttcttggttgcttagcggagcgctactgttaccacaccaattcattctttttgtccaagttttcttgttgccattgtg

SEQ ID NO: 4964 - DNA, 639 bp, Sorghum bicolor
  Clone ID: SORBI-28MAY03-CLUS95770_1
caatccagcgccgcccgggccgttgcatccatccccatccccatccgtcacccaccccgcgcccctcctcctctcccaatgccggctgccggccagctccgtccccgggatccttgagctggaggtggcggtggatgaccagctctcagagtctgagcggaggatcggagggcgtttcgttaggtccgcggttggtgagcggcggtcggagcggtctcgcgcgcggcggggtcgttgggtgatgcaggaatcgggctctgggagggtgggaatacctcgcgctcgcgctcaaggtgctcgattaattacctagctagtggagcgcgcgcctgtgagccgagcccttcctgctgcactgactactgggcttgggagatggttgggagcgtgcacgtcaatggatcggtccacggtggcaatggcacggccacggaggagcggctggacgagctgcgccggctgctcggcaagtcggagggcgacttgctgaagatcgtcagcgtcggcgccggtgcgtggggcagtgtcttcgcggctctcctgcaggatgcctacggccatttccgggacaaggtgcagataaggatctggcgccgcccgaggcggacggtggaccgctccaccgcggagcacctgttc

SEQ ID NO: 4965 - DNA, 851 bp, Sorghum bicolor
  Clone ID: SORBI-28MAY03-CLUS9582_1
ggtgtatgagtgccagcatcttgagaaggggaaattgcagacaagcttataactaagaattacattttgatctgttattgacataatgaagcttcatttccctcttttttttaatccttcactgcttgtagggtttcatggtttgggcggagtttgatcagaaacaaacgaagctgtcgtaggcgtcttactcatcataatgcacgaaggaggaagccacaggcagatgcaatttcattcaattcatcacggctctcgtcaatgttttatgatacaagccaccggacaaatcttttctttagtcaacctctctatggccaagtgagaagcaatgcagtatctccgtgggataactcgggaggcttcaaatttatggaaacaaaacatctgtgcagtgcagccaacaaaaacagtacgcctggatgagctgcatttctcaaccccccagatatcaactagtgttgtggcgcacactggacatcatcataacttcgataggttcatgccattcaagggaactaacacaaaggttcttaaccaaggtactttgctaatctacggatctgttactgaacttgagaaggttaaacagtgaaccctgacagcactaaaaagttaaccatgttgatgaagtatctgagtgcgatcagctcttacaattcctaagaaactgtgcagatgatctctcgcattatttgaattattattctccagtaagcactgctttttaggtgacatcacaatatgttctgtacactaccattctaattcctagcagtttcaactttcacgacactgaccagcatcttgttctttgtggttccaattcgcataatactattaacgttaca

SEQ ID NO: 4966 - DNA, 661 bp, Sorghum bicolor
  Clone ID: SORBI-28MAY03-CLUS95810_1
gccatatgaagcccccacacctggatcagggtgggcaaacactccaggagttagtttcaatgatgcccctactcccagggataactatgcaaatgccccaagtccatatgtgccttccacgcctgttggtcaaccaatgacaccaaactcggctgcatatcttccgggcacacctggtggtcaaccaatgacccctggcactgttggactggatgcaatgtccccgatactaggtggtgagggtgatggtacatggctgttgccggatgttatggtcaatgtattgaggggaggtgatgatggtcctggtgtggttagggaagtactcggggatggatcttgccgagttgcacttgggtcgtcgggcaacggtgacatggtgacagtccttccaaacgaggtcgaggtcatcaggccaaagaagagtgacaagatcaagatattgaatggtaatttccgtggatacacaggaaaactcataggtatagatggttctgacggaatagtgaggcttgccgacacatacgaagttaagatattagatatggtgattttggccaaactggcgacttgaaatggatatatatatattctgtaacgtgtccatcatagaacataattgtaacaatgccctcgtttgcaataaagctttttgttgctt

SEQ ID NO: 4967 - DNA, 953 bp, Sorghum bicolor
  Clone ID: SORBI-28MAY03-CLUS95107_1
tagaggaatggcagttttgacagtcccatttacaatgaattttgctaaggcaattttctgttactggatcacatcaaacatattcaccctgttatatggtattgttatccggcggccagctgtgaggaagtggtttaatcttcctgctttggaagctcagccttcgctcacggcaaagccaatcttcaatatgtttggtggatctaaggcaataccagccgcagagtcaccggtagcaatcgcaggagcccagcaatctggtctgggccaacctgatgctgctgctcttggctataaggtaaaaaatcttgaaaagaaagtgaaatccaggggtaaatctcggaaacagaggtaaattttgggcatctatgccccaaatgagcaagctgtactttgaccattggaatgatggatatttgatttgtcctgatatggtcccaaaagtcaggttttgcattaggaagctatctttatagttttcggctgctgttgatttcattttttggggtgaaataagcaacataaattttgacttagtttcatagttgattatacacaaatgtattccagatacttgtatgatagttaaaacattgggcattggggttcatctcccaaggattggtatgaaagatatgttgaagttcagggccagtcagcccccaacaacttttgaggcgccatttgacattttgtagcaattggctaggaggttaaaatgatatttcattgtattcacatgcttccagcagcagatgcaaaatgcagtatggttttagatactttgatcatcagagtacctgcgtcttgtgcttgcttgtgtgcacatgattctgcatataatggccgagtcaggatgtaaaagtgagctgtgcagaatttgtggcctgaataaatgttgagtttgtatgtactaaactaccctaaaatatcatttacttgaattcttgagc

SEQ ID NO: 4968 - DNA, 775 bp, Sorghum bicolor
  unsure (1)..(775): unsure at all n locations
  Clone ID: SORBI-28MAY03-CLUS95102_1
ccgagcatctgggtgctgtntgctctacagatgtggattccagtgtcacccatgttgtaactgtggatctgggaacagagaaggctcgctggggtgttgccaacaagaagttcttgctcccccctcgctgggtcgtggctgctgattcccggcggccttcgcagccggtgggacaggtgcccgtcgcggccccgaaggaaaagagcagagatatagataatgctgtggctggcaagaaggaaaccagcaaggataaagagaaggaaacgatgaagggcaaggaagaaaatgctgcagctggccagaaggaaacgatgaaggacaaggaagaaaatactgtggctgaccagaaggaaacggggaacgatgaaacaaatgtagccggtcaggagaaagatggtgccaaagaaaatgctgtggccacatctactacaggttatcctactgactcgtaatctatgttgggctccaaaggtatctgacacatagtgtaggcatgcaggtttggtaagggggatggaaattcagcttttgttattatccgttcgtgctggcccaggattttagatctggtccattgcaatttttgctgctgacctgaagctgattgggcctccgcccctaccacttttacacaacgatggaactataggagtttaagcaaattgatgttatggcacaattctagttgaaatccatgcgactatgcgcagatatatggactgatccctagtggaactatggattctttagttgaaaatggtccacgctttgt

SEQ ID NO: 4969 - DNA, 664 bp, Sorghum bicolor
  Clone ID: SORBI-28MAY03-CLUS95155_1
aaatatacatgtgctgatagtaagaatggattcccaaatgaacagaccaactttgatccttctgagaggataaatgactctatgtcacagaaggatggagcatcactcagcgaagcgccaattcttacagatgaacaattaataataaccacaccacctacaaagtttgttacagctgctgcgggtgacagtattgacgtgaaggctttaaaagggaaaatgtcttctattaccaagaaaaaagcaactcctaaggaagattgcaaagtcaaattctgtggtaaacaggagtctaaaggagacgcaaaacctcgaaaacaggcaatcaaaccaagtaaggatgagctgagggaagctgtctttcttatcttggataccgcggactttgccacgatgacctttggagatgttgtaaaagaagtcgacaaatactttggcaaggatctgtttgagagaaagccactaataaggtgtcttatagaagaggagctctttaagctagcagacgaggctgagaagaaggaattggaagagttggaagcagcagaggcgaaggctagagctgagcaagctgccaaggagatggcacaagttcaaacagttgaatcgggtatcaacaagcaaaatgtacttcaagctggtcgagacagcaacactaaagaca

SEQ ID NO: 4970 - DNA, 869 bp, Sorghum bicolor
  Clone ID: SORBI-28MAY03-CLUS95194_1
acataggacgcaacctcgcaaaatcgccgccgccagcacctactcctccaccggacgccgatagctccgccttcccttcctccggcgcgccagtcgccatggtgaagcggtggctccccctcgaggccaatcccgacgtcatgaaccagttcaagtggggactgggggtccccgaggacgtggggttctgcgatgtgtacggcctcgatgacgagttgctcgccatggtgccccagccggtgctcgcagtcatacttctctaccctcaggaccggatcaaggaatcccaagcttcagctacctcgtcggtggagaccaaggagcccagcaagaatgtatatttcacaaaacaaactgttgggaacgcctgtggcacagttggtattattcatgcactggggaatgctacttccagaatcaagctagctgaggggtcatatttcgatagattttataaacgaactgctgacatggatcctagccagcgtgctacatttcttgaggaggacgaggaaatggagaatgctcattccattgccgctactgctggtgacacagaggccaaggatggagtaattgaacattacatttgtttctcttgcgtcgatggagaactttatgagcttgatggggggacatcacagccaataccccatgggccttccactcctgataccttgttgcaggatgctgcaaaagttataaaagcaagactttccatgtattcccagtcaaacaacttcaatgtcatggctctttcaggcaaagtgatatagcattatagcactttcagtcataggcagttgagaaccccatttgctttgcagcagcctcggagtccaacattgcagtatgtagtatcatttact

SEQ ID NO: 4971 - DNA, 609 bp, Sorghum bicolor
  Clone ID: SORBI-28MAY03-CLUS9520_1
aaaccctccgcgcgcacacggggccgccctcggattgggctctccctctcaccgcgagtcgtcaccgctcgccgcccacaccctggcgcccatggcgtcctcgctcgtctcgcgcccgcacctcacccagcgcccggtccgcgccgccacgctcgcctcccctacccgcgcccgcctcgcggccggggccggggcccttggtgggcgcggcgtgcgctgccaggcgcatgcggcgggggacttggacgcccagtacatgcgacggtgcgtggagctggcgcgcaaggcggccggccacaccagccccaaccctatggtgggctgcgtcatcgtccgcgacggccgcgtcgttggagaaggattccaccccaaagccggccaacctcatgccgaggtatttgcactgagagatgcaggtaatttagctgaaaatgcaacggcttatgttagcttggagccctgcaaccactatgggagaacccctccttgcactgaagcactcatcaatgcaaaagtaaaagaagttgttgtggggatgacagacccaaatcctattgtcgcatccaaagggattgaaaagctccaaggtgctggaataaatgtgagggt

SEQ ID NO: 4972 - DNA, 655 bp, Sorghum bicolor
  Clone ID: SORBI-28MAY03-CLUS95213_1
ccttgaagcatcaatggctgatccaaagactcagaatgctcttggaaatctgaaggagtttgcaacctttttaagagtcctcggaagctatcctgtagatgtgaatgaaccttagatagaaagtactgcagactacatgctggattagcaggaatgggtgaaatggttagagttggttttctgagcaggttgaaaagtgaagaactctattaaactgatgctaacttttacagagcaaaaggatctacattatagcagtagagaagggtggatttgaggcttacattggttgtgatcttggaagaaaatttgatgtttagctggtgatgttcttctgacttctgaagcaacaaggatacttgaaacagcaatcttcttcaatgtcctatcatatgggagctcgaaaagcacttttaaacatggagaccaaggggttgaatatttggaaatacttcaataaggttttatttttttatgataataagttttatatgttttcatgttggagtgtctgtcatggtagcatgcaggttgttaaaatgcagttacattggaataatgggccagtgtctaagagcacttgtctcttttttttttttgtgggtgggattgtatgaactgatgttttcatttcattcggacttcctcaaaagtt

SEQ ID NO: 4973 - DNA, 1193 bp, Sorghum bicolor
  Clone ID: SORBI-28MAY03-CLUS96137_1
ctactggaagagctatggacaagagtgagaagttctccttgctagcaaagaggaatctctacccccatcacctcggcagtacagggtatgtggtgaagaaaaagaaatggcggagagaagaaagggaggcagctgtggccggcaagcctatagagtatgaggaacatttactccacatagggaaaaggatcaactgtcggctgcgttgggcaatcccgagcatcgtggtcgcgtccgaggcatgtcctcaagaatgagctggaaagatgcctgggccatcgacgcggtctcttgtaggacgcaacagggttacaaggaaaagttgatccaagaaaccagtgaggaaacaatgagggaaattgtgatggaagagatccgtaacgttctgacgagtggtgaccctaagatggtgcaactgaggtcacagtttttgggcaaggctagctcgatggaactaatgcaacaaacacaaccggaccaaggcctgtcagttcctagcagctcggcgtcgactgtgaaccaaccagctgatgatattatctcatgtacgccgtgctcattgcatatcccggtcggcaggaagaagcggatgatggaggtggccacaggcatggcaatcccgggccgcacatttcagtgccaacccatcccgatcgactacgccaaggtcttggtggttgatgtccatcctaatcaccagaggcctgagatcgacttgcccaccaaggaaggcatctggtacttgggagatgcaaaaaacaacttaatactttggaataggtacgacatcggccttgctactgcatcaccgccactgcctccaatgcagctggagagcgacaacgatccttccccaggtcaggcgtcggcgtctggaaacgtgacagacgagggagaagcagcaaccccgtcatgagacatctcactgtaaacgatggagcaggcacatctgtacaggttaaggtacatctatggtcaaacgaatagcaaaaggtaaatggtactcaacctacctgacaagtatggtggatccattagtgagaaaaatgtctatattatattaaggagtctgatttctatgtgcatcgatgtgtctcgtcgtcaagaccttatgcttatttctgtaatgttactaatgtatgtatcagagttggacttggaagtactccctccatttcaaattataaataatc

SEQ ID NO: 4974 - DNA, 566 bp, Sorghum bicolor
  unsure (1)..(566): unsure at all n locations
  Clone ID: SORBI-28MAY03-CLUS96181_1
ctccacccatgattcccatgccatctctgctctgcttgnggtgccnctgccctgccctgcccataacaacaaccgtacccatccatcccaccacccatcttccttccttggttcctcttgacagttgagagttgacacacacacacccacccagataactactgagtgagtgagtgagtgagtgagtgagtgagtgagtgaatgagtgagcgagccagccagccagccatcgagcgagcgaccttgagatcgatctcagctttgtttgttggcccgccgccgccatggcgataggtggcttcgtggatgcccctgccgctgccgccggcgccgactacggtggccgcgtgacttccttcgtggtgctctcctgcatcttggccggcagcggtggcatcctcttcggctatgacctcggcatctcaggtggggttacgtcgatggagtcgttcctgagaaagttcttcccggatgtgtaccaccagatgaaaggagacaaggacgtcagcaactactgccgcttcgacagcgagctcctcaccgtcttcacctcgtctctctacgtc

SEQ ID NO: 4975 - DNA, 730 bp, Sorghum bicolor
  Clone ID: SORBI-28MAY03-CLUS9619_1
gtctacgcatttctacacaattatacattgttggagcacacacgtatgcattgttagaacactttgacataaattgttggaacaattatttgtaaacttctacacaattctatacaactttctatgcattgtttgggttagggccaccacgattccggtacaataattccacatttttgtattttgttggagcagttatctatgcatttctacacaattatacattgttggagcacacatgtatgcattgttagaacactttgacataaattgttggaatagtttttgtaaacttctacacaattctatatattattggtgcataattctatacaactttttatgcattgtttggttagggccaccatgatttctgtacaataatcccccagaaggaagggtattttgtgttctatgcactatccctctatcaattgtacgtctctgagaataatgttttaggatggggttgccacggctttggataaaataatctcccactaaggagggttgtatcaggttctatgcattgtttctctattaattaccaagctagatgcaaggtttggttacgaccataataggtttctatgctcgcagaaacatgtttatgtgcctttttttgtcgctgtaaggttttcccgcgcactacatgtttctatgcctttcttttgctgctgtcaagtttctgcacctgctaaaacatgtttcttttcctttattgtgatat

SEQ ID NO: 4976 - DNA, 635 bp, Sorghum bicolor
  unsure (1)..(635): unsure at all n locations
  Clone ID: SORBI-28MAY03-CLUS9621_1
gcacgaggctcgcgcgtttgatttgaaccacttggcgctgcctgacggtactcctcaccccaacccgagtttccctgtcaccggcggggcggcgaggcgatcactgcgagtctcccaccaccgcctccacgttaacatggcgcagcaggctgctgcaccggcgaggcctgcgggccccaccaggcttgtctacttcgatgatatgggagcgctccgctactccgccaccgtcctctccgtccaccaggaggacggcggccgggtagcggtggtgctggacgccacagtcttccacccgcagggcggcggccaaccggcggacacgggcgttatctccgccggcggagccaggttcctcgtcgaggatgtgcgggcgaaggacggagtggttttccactatggaagatttgagggcacggaacaaggatgtgggattggatttaaagagggtgaaaccgttagcttggaggtcgacgcagaacggcgcagctttaattcaaggcttcattctgctgggcatttgttggacatctgtgtccacaatgtaggcctctttcatctgcaacctgngagaggctaccattttcctgatggagcgtttgttgagtataagggagtaattcctccagatcaaa

SEQ ID NO: 4977 - DNA, 458 bp, Sorghum bicolor
  Clone ID: SORBI-28MAY03-CLUS96290_1
attgcaacggttgctgtgagatacatactgaaccagacatctgttgcaggttccatggttggtgtgagattgggactctctgaacacatcaaagacaccaacgccatattctcacttgaattggatgaagaggacatgaacagcattactgaagtatcgaagaagggcagaaatttgatggatattattggggattgtggtgacgagtaccgagcttagttgttcatgctgctgctgggctcgtatagacctatacccgtgcccaattttccacagctctaaaattttggctattttgcgcaaagtctagtggctcagagcattgttgaggtaagcctatacctgaatgcctattattcaggtgccagcatgtaacctccagcccaccacggaggaaactctagttataaaacggtaaatacacagcgatgcagatggcttaatgtggtaatttgttc

SEQ ID NO: 4978 - DNA, 1036 bp, Sorghum bicolor
  unsure (1)..(1036): unsure at all n locations
  Clone ID: SORBI-28MAY03-CLUS95544_1
aaaaaaaaaaaaaaaaaaaaaaaaaacataccgacaccctcaaagaactcatcagtcatcgccctcgaagaactctccggtggtcactggagtgggagatgactgacggccggcggccggatgggagctacgggccggagtacggccctgtgcctcatgagcttgagtacgccttgtaccatcagttgccgtccaggagcaggaggaggtccccctggcctctgcatcatggggattacccttggaggctttcagagcagaggttcggaagacgacctttcgagcgttccagttccagcgtctggccaactgatgttgtgctcaggcaccctttgcagccatacacaccattccaaatccaccatgtccatgacagcagtggcagtggcgcaaccctaaacccgagacggagtcaagaagacactggactaactgatgaggagttcaggaaggccatggatcagctcaggaagcaggaatacaggccaccggatccgcagaagaagcaaggcgacagcggcggcggcagaggcatcctccgcaccaggagtgcagcaccaccggcaaccaccggagagaaggcctgcaccgtatgcctggagacattcctgcccggagagcaggtggcgatcacgccctgcaaccacatgtttcatcaggggtgcatcgccccctgggtcaaggggcatggcaactgcccggtgtgccggtttgtgctctgcgagaggaggaaccctgccaccgccgatgccgccaatgaagacggagggatggatctggagctgctggcaatggtgaggacaatggaggaggcattcagccggttcaggctcttctcagactccacgccacactaccactagacgaataacaatagcacaacaaagccggttcaggtcctgaatctcttcagcctgaaacttgctagcagtgccacgttgtagtaggattcacaaaactccagtatcatcagatatgttgcaataatgcaagactagattgtgantgctccttataatgcatttcatagcaagtc

SEQ ID NO: 4979 - DNA, 686 bp, Sorghum bicolor
  unsure (1)..(686): unsure at all n locations
  Clone ID: SORBI-28MAY03-CLUS95592_1
gcgcacccggtcgccgacgtggaaacaacagccgacggaatctcacctgctccccagcccaggccgtcgtcgctctcggctctcgctgccctgagccttccgcgtcccctgcccgcgccgcgatgccggcgtgggccgaagcggcgctcgtgctcggctcgccatcccctgccaccgccaccgcctcctcgaccacctcgtcatgtggcgtcaggccgcgcgccgccgtggagtccggcaggctcttgtgcaaggggttcccttgtaccattcgttccaaagctggattccagattcataattaccgtacaaggacgttcaagattaaagcaaaagcagaacctggtgatggctacacacggcttgctccacttagatttgaatctccaagtggtcaacttctggttcaaatactacaatcacaccctcaccttattcctgcaacagttgatcagcaacttgaaaatcttcaatcagagaaaactgcccaaagcgaagaagcctcaaaagttccccaggacctcctctacaagagaattgcagaagtcaaagagaaggaaaggcagaatgccttagaagagattatctactgttggattatatataggttcatggataatgacatatctatgacatctgcattatcacctgngggtggccctgtacgtgacatatctgcattgcct

SEQ ID NO: 4980 - DNA, 437 bp, Sorghum bicolor
  Clone ID: SORBI-28MAY03-CLUS956_1
agcgccaccacatccgccagccatggcgttcgcgctcaaggccgccgccacggggtcggcgtcgttctccgccgcggggccgaggcggggcgccgcctccgccacggggagggtctcgttccggggcgccgcgcccgcggtcgccgtcagggcgcggcggctgccttcttctatgttgcggaggacaagcgcagcatctccggcaccttcgccgagctcatggagcaggggaagactgccttcgtacccttcatcactgctggtgaccctgacttgtccaccacagcaaaagcactcaagatccttgacgcgtgtggttcggatgtcattgaattgggtgtgccttactccgatccattggctgacggccctgttattcatgcctctgtgacactcgcgctagcaaagggcaccacatttgatgatgtcatctccat

SEQ ID NO: 4981 - DNA, 668 bp, Sorghum bicolor
  Clone ID: SORBI-28MAY03-CLUS95632_1
ctggatataataccacagttgttgatacgatacgatcgacctggtagctagctagctagctagtagatcgatggcaagatcaggcaacaacgtcgtcgtccatgtcctggtggccatggtcgtcctgtggggcggagccgcagcaggggcggcggcgttgcctctgcctgatttggagacgacgacgatgaacgacacggtcacggggagcttgtcggcggacttccatttggagtcgtgcccggacctgcatagcatggtgcggtccgccgtgcaggccgcgcggaaccaggacgtgcagatcaccgcgggcctcctgcgcatcttcttccacgactgcttcccgcaggggtgcgacgcgtcgctgctgctggacaagacccaccccggcagcgagcagcacgtccacccgcagaacgcgggcctgaaccacaaggcgctgcagctcatcgagagcatccgagacatggtgcacaggaggtgtggagaaagaagcgtctcgtgcgccgacatcctcgccgtcgcaaccagccacgccgtcaacctggccggtggccctttcatcaacatgcaactcggccaccgtgatagcgtggaccctgcacaaccatggcaagtgcagaccttgccggcccccaccgccgacgtcaccacgctcttcaacagct

SEQ ID NO: 4982 - DNA, 510 bp, Sorghum bicolor
  Clone ID: SORBI-28MAY03-CLUS9569_1
atcacggatgaggctttttctccattatttagctgtcgatcaccagatttgcttggcaacatgcaaattcaagtaaatggaggatacactataaatgacaagtacagctaaatactggttgacaacaccattcatttgaagtggatagctatagctgttatctgctccaatttagtctcagtttatacattagttatcttgggaaatattggatagactccagtacacctctgcagttgccgatctaaatactacctgatcaccttagtactggcctggaaattcttttctgcaagcgataaccattagtagtttgtgctgctaccactaaacttctgtaaagctgagcacccaaatcaatatttctctgtgaaacaagtaggcaacactagaatatcagtccaaggtattatttttctagaagtagccttttcctcccattccccatgccttaaccttgtgcatattcgcgtaaagttctgcatcttacagaacccaactactatacct

SEQ ID NO: 4983 - DNA, 653 bp, Sorghum bicolor
  Clone ID: SORBI-28MAY03-CLUS95688_1
gcacgtgcctctctttcctgcgccggccacccctgcccttccccgtcccgccacctgggcgggtttcccggtggcgcccccccggccgggccgcgcgtcccgcgcggccgcccgcccaggtctgcgccccctccctccttcggggcgccccccgcttggagcacccccggccgcccacgcgccccgccctcccactggggccccgccggccggtcggcccgtgccggccggccgaccggggcggccaggcgcgccggcggccgcggggggccccggcgcacgggggggcccgcggggccgtcgcgccccccgcccacggtggccgcgatcgctgggcggccgctgactttgcccgcggacccccctggggcggagcggtgcgcttgccgtggtgcgggctggccgagggccgggacgggctgccggaccaagtcggcgggccgcgcggggtccgggccggggccgtgatgcgcgagtcggccctcggctgcggctcggccgtcggccggggctaccgtggtcgatgggaagaagaaaacatcgacagcggctcgcctccatggttttaaatggcgggctatagcgatcctataacgatgctatattgactgtagagacttcatgctaagttattgctattgtgtcgttatgct

SEQ ID NO: 4984 - DNA, 859 bp, Sorghum bicolor
  unsure (1)..(859): unsure at all n locations
  Clone ID: SORBI-28MAY03-CLUS9640_1
ctatgaaagattttggactagaagatggtgaaagtgatgaagagaataatgtcacaaaggtatccaaccatgaaaccaaaatgaaagaagactttgctgtcttatcaggcgatgacaaaatggatgtggtatacagttctgcccctgaactcgttagcttgttgtctgagttgaaggatgcccatgaagaacttagggctataggacagcttaccagtgaggtcacgtcttgtctaggcaaagataaaatgcaaccttttgaagtgaagaaagcttgtttgcttgctcattgtcaagctattaccttctatctccttatgaaatctgaggggttgtccgtacaggatcatcctgtaatttctcgcttgatagagaccaagaatatggtagagaagataaagcaagtcaccatgaattcagcgaggcaaaaagggagcactgatgaccatattatgcatagcggcaccatccaaacagataagaatgtcgcactggacaaacaggaaggcaaatttagcaatgtactagcactggataaagtgatccaaggtgctgaagtctctgaatcaagaaagagtgagccttctaaaaatgatttccatgaagtcaacgaacagaagaacaaggatgaacatatgggtttgcatagcctggaaatgttgaaggtaagagcagatcttgaggaaagattaaagaaaaaagggctctataatttgaaaaagtcgaagccagagaagttgtcaaaaaccaggacaactagtaataagggcctgcagacattggatgactttgatgatgaagtgctngaagaataatcaaataatgaaacctagcaagcttgttgcagctgctgctaaat

SEQ ID NO: 4985 - DNA, 662 bp, Sorghum bicolor
  Clone ID: SORBI-28MAY03-CLUS96409_1
ctactggaaaaaaaaaaaaaaaaatgatctagcctatatacacacacaagctgccagcactgcaggcggtacccagaagcacacaagaaaccccggagcacctggagctcagccctcgcaaatacgtttccagttcccgagccgagggttcgcttcatggctggctgcacgcagcagccatcgcttttcgccactccaagctctcagtactgatcctggcactggccacggggggggccgccgcacgggctcagctgtcgccgacgttctacgcctcgtcgggccctgccgcgctcgtcaccatcaagaccgccgtgcgggctgctctggggctggaccggcgcatgggcgcctccctgctccggcttcacttccacgactgcttcgtgcagggctgcgacgcgtccgttctgctggacgacacgggcaacttcaccggggagaagagcgcgggcccgaacgcggggtccctcagggggttcggcgtcatcgacaccatcaaggccctgctggaggcgctgtgcccgcggaccgtgtcgtgcgccgacatcctcgccgtcgccgcccgtgactctgtcgtcgcgctaggagggccatcgtggacggtgcagctcggcaggagggactccaccacggcgagcctctccaccgcgaacaccgac

SEQ ID NO: 4986 - DNA, 351 bp, Sorghum bicolor
  Clone ID: SORBI-28MAY03-CLUS96424_1
cctccaactggtccacggcggacaacggcgccagcgaagtgtccctcttcctgctggacttctgcgcgggccccgacctcggcgccgtcgccgccgccgaccagctcaagctacccggcggctactactaccctctcgactcgagcttgtcgccggtatagctagcttcttcatgcgtacgtcgtcgtcgtcgatcgttccaacgacagagtagcggtagattggtagtaccatgttgcatgttctcgggagtcggggtcgtcgcttcgtgatcagacgctgcatgaaaacccgcgttttgtcttcacggaaaatttctgccgaaattaacatttccatcggtgatcggtg

SEQ ID NO: 4987 - DNA, 512 bp, Sorghum bicolor
  Clone ID: SORBI-28MAY03-CLUS9644_1
gtgtcccgggaggatattatggatgcaattgagagggagaaatacggggtcaacgggagacaagaaactgatgattctgaaaggcaaggcctcaccaagttatttccatggttacctaaatctggaaataaaccatcaagccctgatgatttccgaggactgatgggttatcatacattaagctaacttagcagctcttgcaagaactgagaaagaatataaactgaaactaaatctgggaaactgtttcctgtagttttatgtatatcagcaaatatacatcttgtatgtacgaaggatgttgcaaatcgctgtcagtagctattggtactttcagaagaaagctgttacaagctacatgaggacaacataacaatacagaatttgaggatttttaagtctggatgttttgcgagttgggtgtgcaattttactaatgcaatgtcaagtgcacatgggaactgaatttgcagcgatgtgcaagaaatacacggcatcatatttgacagttc

SEQ ID NO: 4988 - DNA, 686 bp, Sorghum bicolor
  Clone ID: SORBI-28MAY03-CLUS95906_1
gcatgatcttgtccttttagacaacttgtcatttggagtaattataagggtggaagctgaagcatttcaggttctgaaaggagtgccagatagacctgaagttgtgctcgtgaaattaagagaaataaaaagcaaaattgataggcgctcatcagctaaagatcgttctaataatattatctctgcaagcgcgggcgtaagggttattgaaggagcatgcaaggggaagcaaggacctgtggaacacatacacaaggggatactgtttatctatgacaggcatcaccttgaacatgcaggctttatttgtgcaaaagcgcaatcttgccttcttgttggtggatccgctggtggccgtcgaggaaatggtatggacacagctgatgcacggcttggtgctttgagatcttcagcaagcattctgcaatctccaggaaggctgcccccaagaggacctaatatgaattatggtggaaggtttggaggcggccgtggtggtagaggacatgatgccttggtgggtaaatgtatcaaaattaaatctggcccttataagggataccgtggccgtgttaaagaggtgactggtgcactcgtacgtgtagagcttgattcattgatgaagattgtcacagttaaaagagatgatattgctgacacacctactgttgcaacaccattccgtg

SEQ ID NO: 4989 - DNA, 1209 bp, Sorghum bicolor
  Clone ID: SORBI-28MAY03-CLUS96004_1
aggaaagcgtgaaccgcgcgaccccgcagttctcgaccgttgcgtcgccgcagcaactcgcctcgccggcggccgcgcgcccaccgaacgatggcagcagcagccgcagcccaccaccttcccgttgtgccgcaccgccttgccccgatgcggcaaatcagcagcagcccgccgccgccgctgcatccggcctcccgctgctccgccacggggaagctgcccgtccagctccgagcggcgccggtgagggcagagcgggcgactgggttcgccgcacgcgtcgcgttcaacccctccgggaactacgacctctccctctccatgggccaagacgagaccccacaggaccaacctccgccaccacctaccgaagggcgttttgagatcattatcaacaataacaccatccgaacactcgacctatcgccggttcaagaagcacttggtgacttgagttccttaacagcagctgattcaaagaccctgttggatcaaaccgttgggttcaccattaactacgagagagaggatgagtacgacacgcgtgagctgtcagagttccctgacatacggctgtggttcgtgaggcttgacgctgcttacccttggttcccagttgtacttgactggagagctggcgagcttgcgagatacactgcaatgcttgtccctcatcagatgagcatgcgattgggtgtggtcttcaacccagaggcgctggagctgttcgtgatgaagaaagtgtttgctgtggagacttggctgaagcagcaaaatcatccgaagccgaggttgaagactgcagacatggccaggatgctcggtttcggtgttggagacgagctgttcgagttgatcgagaagtaccctgtccatcgttcgtgatgaaatatacaaagctcaaaatggggatccgatcccacagaatcagttaacagaattgtacagaaaggcacgtttgcattcttccaggagcttggtgctgttgttgctcatggccttttcgctctgttgtcagtggcagcaaacgaggtcggtgcccctgctcctgcgacctagcttgtctctgcattagaaaataataagtgtcgtctacagtgggacgatttttacaagtcaatggatggtaaaatgaaattgggtaaaatggtctacccagcgaacgaattactttatgtcatcttttggtgtagaatgaatttgccttgc

SEQ ID NO: 4990 - DNA, 650 bp, Sorghum bicolor
  Clone ID: SORBI-28MAY03-CLUS96079_1
tactccgtctcatcattctcagatctctccctccccctccccttccctccttcccttcctctccctgaatccaacccagctcgccgtcctcgcattccgccgctcgccctcgcggatccgacagctccttcctcgctgtcggttcttgcctcacctcgtctgctgtcctggaagctgctgccgggtcacccgtggctggactcgacccggccgcctccggcgtgtgggttcgccggatggttatcgcctcctgatccatccggacccccggatccgccgccaaaggcaccgcctttgtgggttctccgcgcccatgcaggagggtttggcgcgtcggcggtgaggcggggctctggtttagttcttgcgttggactagtccggagatgcttcgtggggcggggcacgggggcggcgatgcgcggaggcgggcactgcgctcgtcgcgacggcggctgccggggtggatctggtggcttctcgggatcttcctcctcgtcgggctcatgctcttcgtcctgcaccacaaccagaaggagcagttccggccgcccgtcgtggataatggttcagagatcgaggaagtccctcatgagagagtgaatttctcagaagagcttttgagcagcacatcatttgctcgccaattag

SEQ ID NO: 4991 - DNA, 840 bp, Sorghum bicolor
  unsure (1)..(840): unsure at all n locations
  Clone ID: SORBI-28MAY03-CLUS9613_1
gcacgaggatcgtgggagaagctatgaagacaccggttacgagctctcagctcgccaccatcaccgtcgcttatcctgcctacaagcggcggttccccaccaccgttctactccgagcctctggccccgtcggcgctgctccatcccaccgccactcctcacgaccccacccctctggcaccgctcccatcccaccggcgccactccccaccccttcggcgccacatcagggcgtcgcgccgccgctcgccgtagcgccgtgggtcgtcgttactggcgtcggtcaggggcgaccagtcaccacgtgccatcttcctcatgctgagagacttggagacggccacgccggcggtcagcgtcttctgctgcagcaacgacatcatccatgattttttcagctttcccaaacccatgtaccagatttattagctcttggatagttgaatcttaatctattggtgtatgttgaattaacgaattctatgaaggcgctgctagcttgctatgaacgactgctttttaatactaaattttggctgaattccgccatgctttgcatcctcctcaatgaagatgatggtggcaccttgccttgtcgttgccggacacggtccatgtcagcaggtgctgggtgttggcaaagcttgggcactaccaggcatcattagatgctggcccgctccacgtcaacccgcccacgctagctgtgtctaatagtcatggcaagaacccgaatgcctgatagtccacgtcaaccctgcaggagcctaaaattaggactctttttcaaccagtgaagctagatatgtnctggtatctatcttgcaggctattggacac

SEQ ID NO: 4992 - DNA, 438 bp, Sorghum bicolor
  Clone ID: SORBI-28MAY03-CLUS960_1
gaaaaaaaaaactcggccctctccctgccgacccgacggtctctcctctcccgagctcgctcctcaccgcgccgccgccgtccttctccccagcaccgacaccgccatggaatagcgcaacttggcgctggcggtggcctccgtaagccttcctctgttgccgcctcctcccaccagtctatgtggcctcaatgaaaccctagcgtcgcgaggcaactctggcggcgcaaccctctggcctcttcctcatcagcggcaacggcgacggtgatgctcaacggctggatctaccggtatctcacgctcttcttctcccccgtagtctcgtggctcctcccccaagatcctctctcgatggccagtgtgcgggctgcgctagattgcggctctcctccagtcctcttcctctcaaatcccggcgggcagcggaacggtgtg

SEQ ID NO: 4993 - DNA, 470 bp, Sorghum bicolor
  Clone ID: SORBI-28MAY03-CLUS96845_1
gcgccgacaactcgtggaagattgggtatgggtttaacctggccgtcatcctcgtcgccgtcatcgcgcttgagttcatgctgtggacgaggtggtctaagaacagcacctccaccccgacctactagaaacctgctgcgtgtttgtgttgtcgtggcggcggcgacgcgatcgagaacgcgaagggcagcccctaatttttttttaaaaaaaaaaattatggttctttttccagggttggatgatgttgtgttgccctgaccttgtttttttttctttgttggtgtatgaattgttcggaactgcaatcgtgtcagtgtgtgagtttaggcaagtgcactggcactgcccataggtgtgcacgcctggtggtatagtggtcctctatgattctttgtttctcgaggcatgttacagccgtgtatgataatttgaacgagaacaacgtgcccatatatagcttcacccat

SEQ ID NO: 4994 - DNA, 646 bp, Sorghum bicolor
  Clone ID: SORBI-28MAY03-CLUS96889_1
gttcgaacaatattcataggacagaaaatgattcatgtgatcaaaacacagaatataccccatacctttacactaccaccaactctgcaaattctggcctagatgaactttcttattctggcactggtgcgccggcatcgtttacagcagtatctggaaaagttaaaaactgcctgcaaactgagagtgacaagtttctatgtaagtctgtatcattcagcagcaacccttgtgcttctaaagtccaagaaaatcgcctatcaccataccatgccctcatgcatgaacaatccctgatacctgacgatcctggagaatctgtgaggctcctctcacatgaagaatcatttaatgttcaaggtgactcaatgcaattcgaggatgctacccgctttacatgccaggataacagtacatttcctgaattaccaaacagatcacctgaagaagctactgctgaaactttagaaaaggacagtactggaaataacagtctgctggaaactatgatgcttgatcttagcactaatagctttgtgcaagattggtgggatgacagtgttctactggcagaaaaccttccaaattcaagtgaaaagcactcagagcctgctatagaattggccaataggcattcattgccaac

SEQ ID NO: 4995 - DNA, 807 bp, Sorghum bicolor
  Clone ID: SORBI-28MAY03-CLUS96969_1
cctactggacatcacaagtaagcagcagcttgagatctttcagtactctctttgctagcagtagcagctactagcagtaaggtgagaacatcaagaaccgttcaaacacccatggcggcctctgcaacggatcccctcgccacggcgctcgtcatggcggcggtggcgctcatgctcaccgccacgacgacccacgccgcgcgccacctcgccgacacaaccccggcggccgcgcccgccgccgtcgtccctggcatccctgccgtgccgaagccgcccgtcgtgcccaccgtgcctgcggtggtcgccctgccaccgatgcccgccgtgccgacgacagtgcccgcggtgggcgccgtcccaccgatccccgcagtgccggcagtccctgccgcgacgaccttgccgcccatgccatctgtgccggcggtccccgcggcgacattgccgccgatgcccaaggtgcccgcggtgccgaccgccgcctcgttgcctccgatgccggccatcccctcagtacccaaggtggcgctgccgccggtggtcccgtcgtccgtgccaaaggttaccctgccgccgatgccgtccgtgcccaaggtgacactgccgccgatgccttccatccccggtgtgccgatgccgttcttggcgccacctccttcggcttgaagcgcgcttctgcggcatctgccaatgtctgaattctcttgtggatgattgggtcattcgatagtgtgtttaatttaatttgctggacatgcatgctgttcttcgcatgagcagatatgattatatatacttgttgat

SEQ ID NO: 4996 - DNA, 687 bp, Sorghum bicolor
  Clone ID: SORBI-28MAY03-CLUS97059_1
tactggcctcggccccttcgccttccttcttctcagttccgcacaaagtctgctccagttctgtccttgctcttgtcattcctttcctcggcgcctccgccccgcgggccccatcttcctctgctctgtcttggcacggcacaccaccttcagctgccgcgtcgtccgctgcttccttgtcctgtacctcatcgtcctttgcgagcgttctcttctttcctcccgatgccgcaacggccggcgcggctggctcctcctgctacgtgtggtcggcccgaggcgacgctccggcacctccgccgctccttcccccaccctcacgtgctctccctttctctctcccgacaaccgcgcccgtgtctgctccgagcaaaccctaagtgccactcttcatctctcccccctctctcaggcccaacatgggcagtgcggcggcacggcctacctctcgctctccccagtgcgcgtgacagccagatggccagcggcacgcgaccggtggccgccccttgccacgacggcgcaccaacgtggccacggccctggcccgcacccacggtgggctcagatctgtcgccggcgatcccccgtgtgcgttgtcacgatgcctatgaggattaccttgtggtcaatgcatccatgtgcagcgctatgcccagccaattgcaagctccatggctaaattaa

SEQ ID NO: 4997 - DNA, 624 bp, Sorghum bicolor
  Clone ID: SORBI-28MAY03-CLUS97087_1
taggagtgctgcaaagttgcatcacccacgtctcaccaacctaccagctccaccgcttgggctccccgcctcgccgaacccaggtgttcgaccatgtcctcgccggcattatcaacgacctctagccacgtcccacgaggcgcgccgcacgtcgtcctcttcccaagcgccggcatgggccacctggtcccgttcacccgcctcgccgtcgcgctttccgccggccacggctgcgacatctccctcgtcacggcgatgcccacagtttcgtccgcggagtcccgccacatcgcggcgctctgcgctgccttccccgccatccggcagctggacctggacctccgccttgccccgttcgacgcgtcgtccgagttcccgggcgccgatccgttctacgtccgctacgaggcgctgcgccgcgccgcgcccgtgctcctcggcccgctcctcgccggcgcaggcgcgtcggctctcgtcgcggacatcgcgctggcctccgtcgccatacccgtggcaagggagctccacgtcccgtgcttcgtcttcttcaccgcgtcggccacgatgttgtcgctcaaagcctacttccccacctacctcgatgccgtcggcgccggacatggt

SEQ ID NO: 4998 - DNA, 554 bp, Sorghum bicolor
  Clone ID: SORBI-28MAY03-CLUS9733_1
atgatttcagatgtttctcaggttggatggaccgttgataggttggcaatttacatttaccccttttatgtgccacgtttaaaattcttgtgaatttgtgatagtgtattggtttgccaaataaaattccctagctacattatcagcccgtcacatgagagagtggtaatattaggaggacagttgtgccatggagctagttgatctgctgcatagggtccatatgcattagatgctattttgcgtgtctgttcatatagtagtatattactcattctgcagatgttttgactgttcgctggccagctcttggttaaatagatggtgagcgtgtaaataggtacctagcttgtcctgtgacctgtgtgtcgcattttatccaggccatagaatacttgttctagttgatcgactaagactctagccttgggttagtagtatttctatttgttcgctgtagaagctacatcatctgctagtgggaatatgatactatgctgtgtgtcacactgcagtctctttactgtacagatcttctagctgtggctgtgatg

SEQ ID NO: 4999 - DNA, 480 bp, Sorghum bicolor
  Clone ID: SORBI-28MAY03-CLUS102833_1
gcacgaggcaagaagtcagttcaagatgagagcgaagtggagaaagaagcgcgttcgtcgtctcaagcgcaagagaagaaagatgagggcgagatccaaataaacgcatcgcatcaactcggcctctatcggatctgaatgtcacttcatacccaccatgacaacatagaccaacacactacgcaactcccccgcatcaatacccagaatcacacacctcatcaccgttgacggaacacattatgtatcgttgcaaggacggttggaagtcgttcgggagcccctatttgatggcgcgctgtgtggcagttggtggaagcattggcaaaagaaggaactggtagcctgtcaagatagtcgagtcgacttcggcatgtgtttacggaatccgtcacaggaagctttactgcctcgcctgggatgcaaattcagtcccagagccagtttgctgagagagaaatcaattgcagtattgcttct

SEQ ID NO: 5000 - DNA, 517 bp, Sorghum bicolor
  Clone ID: SORBI-28MAY03-CLUS103049_1
gcacgaggacaaattgaacaagaagctctatagctgagttcgaagagcacaaacataaaagcaagtggaatactaatccagatggctcccacaacctactttctccttgtttcttttctggcattggtcacttctcaggccattgcttctgaccctagcccgctccaggacttttgtgtagccgacatacactctccagtgaaggtgaatggatttgtttgcaaggaccctatggccgtgaacgtggatgactttttcaaggcagcaaaccttgacaagcctagggatactatgaaaagcaaggtcggatccaatgtcactttgatcaatgtcatgcagttgcctggactcaacaccctgggcatctcactggctcgcattgactacgcaccattaggtcagaatccgctacacacccacccacgtgccacagagattctcaccgtgcttgagggtacactctatgttggatttgtcacctccaacacagacaatggcaacaagctattcaccaagg

SEQ ID NO: 5001 - DNA, 560 bp, Sorghum bicolor
  Clone ID: SORBI-28MAY03-CLUS103065_1
gcacgaggtattgctatccatttccttctttcaagcaatcctgcgcttgcacggcggagttagagttcggcgttgtgggccggcgattaggcgatgctaggttcccgggcgagttcgtgcctctaggattgttagttggtggtttcctgggttaagcgatttctctgagctaactaagcaaccatgatgaggtggttaggtgtattgccgtgagttgattgatcactgtgaatctagtctggcgggaggttcagttgcttgttggccatgggtggccgcatgcacgaggcacagagggtgaattttcgctttgatttgtgtgtacaaatgggaattatgtctgggaatcttaggcatcgaatcttggtattccttcaggtgtatttggatatacttctctttgcaatttatgcttccagcttccttgcaacttcctgagcacatgcatgtcgaacggtcaaacatggcaggcgcggttctcatgatatatctgaataagggagtgtaattatgtaatcatgaagttttatttatgcaatgtcttgatggtactttgcata

SEQ ID NO: 5002 - DNA, 983 bp, Sorghum bicolor
  unsure (1)..(983): unsure at all n locations
  Clone ID: SORBI-28MAY03-CLUS103166_1
gcacgaggaaggtggacgacgcgaagcgcgccgtcgaggagaccgtcgcacacttcggcaaacttaatcacctggttgccaacgcggggatctggtccagctgcttttttgaagagatcaccaacataaccgctttccataatgtgattgatctcaacttctggggtgccgtctacccgacctacttcgcgctgccgtacctcaaggccagccgtggcaacatcgtggtcaccgcctccgtcgccggcagggtccctacagcacggatgagcttctacaacgcaagcaaaggtgccgtgatacggttctacgagaccctgagggctgagctggggtcccacgtccgcgtcactatcctcatgcccggctacgtcgtctccaacctcaccaagggcaagggcctccagaaggacggccatgtcggcatcgacgaggaggcccgcgatatcaacgtagggccgatgccggtgggcaagacggagtcgctggcggaggtggtggtggcgagcgtgcggcgaggggactactacgtgacgtggcccggctggtactggcccttccacatggtgatgtgcgcggccccggagctgctcgactggttctcccgggccttctacgtctccaagtccggcgagcaggacggcggccccgcgctcagcaagaagatcctggagcccgtcggcgggaagaagttcctctaccccagtaccatccgatcccagaccgccattgcagctaactgactgactgaatttgtcaacatgttagccccccangatatatatatatacagatatatatataaatgtaatggtctgttctctgttgttggattagcacgggatgggtcaatagggctgggtggaattgaaatgggtgtgcgcgtccgatcaacactgtattttttattcgtttttttcttttttttttctacctttctcttcgtttcattttattactacaagtgatccaatgtgtgaatt

SEQ ID NO: 5003 - DNA, 611 bp, Sorghum bicolor
  Clone ID: SORBI-28MAY03-CLUS97422_1
gaaattgcaaaattctgtgatgtgtatttgatggagcgtgttcttgatgatgaaagtgagggaaaggttttattggccctgagtgaagctggactttttgctggtggtggcttgataaaagataaggttcttttctgtagtacagagaatggccgtacatcttttgttcggcaactcgagcctgattggcacatcgacacaagtcctgaaattgttcaccaactagctaggtttatcaaatatcaactacacatttcgccgcagcgaactgaaagaatagcaaccaatgttttcagcgctccaagcttggaacaatattttggaggcctagaccagagatagaggtcaaactccatccagcaaagtggtggcggcttagtgatgagaacggaggacatcgttgttttttattttctctgctcgaatgatgaactcgtttttcctgtatcatgtgtaaaaccctgtgctatgtactagtaatccgttgttatgcgatatgcagtgcctcacaatctatgcaaggagataacatatgtagtagcttacatggcgaatcagttgtgttaatgtacaagtataaccaaagtacctgctgctattgccttcggtct

SEQ ID NO: 5004 - DNA, 631 bp, Sorghum bicolor
  Clone ID: SORBI-28MAY03-CLUS97451_1
agtgctgttggcattcgaggtacactagccaagttatcacagcttgtagcaacgtatgatggagaactccaacatcatttggaagtaactacagaagttaatccccagttctatgcattcagatggataacgttactgctgacccaggaattcaactttgccgacatcattcacatttgggacacactattaagtgatcccgatggcccccaggaaaccttgctcagaatatgctgtgcgatgctgatccttgtccggaagcgcctcttggccggcgatttcacctccaacctcaagctcctgcagaattacccgccaacgaacatcagccacctcctctacgtcgccaacaagttgcagtgagccgatctcttttgcgcctgaagcactgctgtgtttgttcagccaaagctgtggctgagtcctagcattgcaacagaaacacagaactgaccagttgcggcgataatggtttatgtatcttgtccgttaatctgacgccctgcattctgtaacatgtatctgttcatctggcaacgatttctagtatcccagttaattaaggtgacatgattatactatctaagcttatatgctgaccggttcttctttgataatggtatatcctgtc

SEQ ID NO: 5005 - DNA, 583 bp, Sorghum bicolor
  Clone ID: SORBI-28MAY03-CLUS97497_1
ggcaagaccaaagccccccaaccgccaacaaatcgctcgcgaatcgcaagaacaagagaagaatcaatccgacaacaccactctccttctcccacatctacttgctcgcccagcagccgccgctccccatccccccctcgcatccgcatcgaatcgaggcagctcttcctatatatcccactccgctcgcttcgattcagcttccccttctccctcttccccgtcgataaaaccgatgcatcgacccgcctcgcgaaccctagcggcggcgggacgagagggacaaggttacaggcacggcgcgtgaagggtcagtcctgtcctgcacagtcccgtccggggaccccccgcgatgccgtggctcgagatgtggctgcctcccgcggccggcgagggggcggtggcggcggggctgttcctcgacggcgccgacgcggcggcgcacggcgcgctcctcgcggccatgcccggatgctccctgtcgttcgggccccggcaccggcgcccccggggcgcgcagccgccggggttcctgtcgctgacgatgtcggtgaaggggggcagggggttcgtgccggcccct

SEQ ID NO: 5006 - DNA, 521 bp, Sorghum bicolor
  unsure (1)..(521): unsure at all n locations
  Clone ID: SORBI-28MAY03-CLUS97510_1
tcggctcctgtctcctctcctctctctctcctcctcctgaacccgctgctgggtggttcctcgtctgccgtctcctntctgtttcgacaggatccggcaacccggcgcgcgagcgagcactgctggttctgggaggcgtcgctgggcgggtgcgcgcgtgttttccagccgatggccgagattccgggcaccaccgcggcgggcggtttgctcgggggtacgctgtgacgccggtcagtagctggcgacggtgcccgtgcatctctcggttgcgattgcgcgcgcggaaagctgaacaggttttgatcgctgtgagagggtggaattgaaggtgcgaagggaagtggtggtcggaggcggagaggacggctgcgtgttggagctttttctttcggtggtgctcggcggccggcaacaatggcagcagccgtagcgatgcggagcgggagcagcgatggcggcggcgggtacgagaagggcgggatggacacgggcaagtatgtgcggtacacgccggagca

SEQ ID NO: 5007 - DNA, 571 bp, Sorghum bicolor
  Clone ID: SORBI-28MAY03-CLUS97522_1
gcacgaggctccctcctctctctctcctcttcttccccgtcgtggtgcggggcatctcgcaccccacccgtgtgcccccgctcgccggtgtgcgcgctttcctagggtttcctgtgcccgcgccgcccaccccgctctcctctcgtcagcggcgatggcgtcggcgtcggcgtcggccccggtgacaggggccggggcaggggccgggggcgggaaggacgacgagctcgccgatctggtgcggcgcctcgtggacgccctcgcgcgctacgctgatcgtctgcccttcgaccttgatcgtcagaaacttcgttcacttactacacttgctgcgatctcgatcacacttctgtttgcctggaaaatgttgagagctcctcaagagcaagctcggaggcctcgtaggagggctgccccatcatctagcaacaccagcactagatcacaaccaggtgctttaaccacaacagatgcttgttcatcagcagattcaagagcacacgaagcagtcaaccagcttttccagccagtaaatctgactcttgagcagcttgtcaggcataagctaagc

SEQ ID NO: 5008 - DNA, 494 bp, Sorghum bicolor
  Clone ID: SORBI-28MAY03-CLUS9802_1
atttaatcctttgttttcttctccgatgagcttactaaggctttgtttagttcaccccgaaaagcaaaaagttttcaagattccccgtcacatcgaatctttcggcacatgcatgaagcattaaatatagacgaaaataaaaattaattgcacagtttacctgtaaatcgcgatacgaatcttttgatcctagttagtccataattggacaatatttggcacaaacaaacgaaagtgctacagtagcgaaatccaaaatcttttcgcatctaaacaaggcctaaggtttctaaatagattgctgaccaggctgcattgcttgaacataggtcgtcattgcttctcatccatccatccatccatcttgacctttttagattcaaattgattaacttgccctcgtaaaaatggtttcattagctatttgtaaaatctgaatgtgaggctgtatggtgatattggaattaatgtttatcaggttggtcgattcaaag

SEQ ID NO: 5009 - DNA, 468 bp, Sorghum bicolor
  Clone ID: SORBI-28MAY03-CLUS96489_1
gcacgaggctctagtcttcttgccggccggctgcttgtgctagcagtagcagataggaggagtggccggggtgcccgggtgtcgcccatgggacggacgccgtgctgcgacagggcggccgtgaagcggggcccgtggtcgccggaggaggacgtgccgccgcgccgctgcggcctgcgccgccgccgcggcgccgcctggcccgccggcccctcgcatgccgggctcaagaggtgcggcaagagctgcaggctgcgctggctcaactacctccgccccgacatccgccacggcggcttcaccgccgaggaggacgccgtcatcttgtccctctacacccagctcgggagcaagtgggcgctcgtaccccccctcttcgtgcggtcgtcggtccccggccgccaggccctccccaacccccggctcgactgccccccgcccgccctcgctggaacgtacgcgcaggtg

SEQ ID NO: 5010 - DNA, 863 bp, Sorghum bicolor
  unsure (1)..(863): unsure at all n locations
  Clone ID: SORBI-28MAY03-CLUS96528_1
ttccgggttttctccccacccntcctccgcctccngccgctagntcccgccgggagcgcagcgtcgcgctgctctacgngacgccngctcgccgcntcgcggngagcgctcctggttcttcagcatcggcgccngtcagcgctgcnggtcgcctggtaggacggggtngcgccatctcccaccgacgcctccccttcctcggggcaagaggtctcagttctactcgaatggagtctgcttccaccacagtgccctccattgtcgtgtatgtgacagttccaagcaaggaagcaggcaagaagctgtcacagagcatcattagcgagaagcttgctgcttgtgtcaatatagtacctggcattgaatctgtttactggtgggagggaaaggtgcactctgatgctgaacaattgctcatcattaagaccagggaatcacttctggatgccttgactgcacatgtcaaagcccaccatgaatatgacgttcctgaagttattgctctacccataactggcgggaacaccaagtatttggaatggctcaagaacagcactagggacaactgatctcttttagtgctcgaaataatgcaaagatgaaagtgcccaagaatatgaagtgactcctctattcttccagtggcttgcacaagggagtttcctctcttgacctgtatatcagttacattgctgtaccaaaatccatgtttaccatcttgtggtgacaaatgatttgatgtctcgtgtgggtactcaaatgcatgagtattgccagattgacccgtgtgagtccaagccagatcatcatatccaaacgtgcatattgtttgctcttgatcgatatatgcgatgagttttctg

SEQ ID NO: 5011 - DNA, 481 bp, Sorghum bicolor
  Clone ID: SORBI-28MAY03-CLUS96537_1
acatgggctccctcaccacgccgccctgcaccgagggggtcatctggaccgtcgtcaagagggtccgcaccgtgtccaagcaccagatggagcttctcagggaagccgtgcacgacggcatggagaagaacgcgaggccggttcaggacgtgaacgacagagacatcagcatcttccgcccaaagccccataagcactactagttataggctccatgatccagcagcgtagttagcacagtatcagtgatgatgcatgagctgaacacccgtggttcagacagaccttcagaataatatacatatgagatgaattacatccaatttgttggatggttcagtgttgagggggagatgtatactgtatatgattacagttttgtattgtaattctttctacctctctgttatactctgatgaagagtaggactaaataaaataagcatcaccttctgcccttctggtgaagtggtgtgcactt

SEQ ID NO: 5012 - DNA, 694 bp, Sorghum bicolor
  Clone ID: SORBI-28MAY03-CLUS966_1
agaatcaccccttcattcgacctgcaggtattggaatcttttttattgatgtgcaggtgcagcctccgatcaaaatacttgttaaggcgcgtgtcgaacaggtctcttctgtcctcatggcggaagcagcggctgccgctctagcagctcaactcttgcatctcctccaagcacaaaattcttatgttctttcagattgccagcagctgatgcaggaggcatttccattcgcaagattcacagatcctcaaatttgacggcgcatagtctagccacccaggcatctagactctcagcggtcctccctcggaggagttgctcatccactgctcataatcagaagtgtcctgtactgaatgctctccaagaactttcagtatcagatccgctgctggtgctgtgcgatgtgttggtcgccgtaggacgaagacgagcatgttctagctgctggtgctgcatagggaggggctcatcggctgccgactctacaagacgctggtgctgaactgctaactcacggcttctactttccagtgcatacagcagtaacttctccagcaagtggaagcactatagcaggaagcaacacgtcaaagtcaagcaccagctcaggcaaaggcaggggctagctggaccattattcttctgagtttgaactctaaacccaagcatgacttatgattcatgcaacaat

SEQ ID NO: 5013 - DNA, 498 bp, Sorghum bicolor
  Clone ID: SORBI-28MAY03-CLUS96633_1
aatcagctcaacggccaaaagaccaagcagcagctcggcacacagagagaggctacagtcagaactcacaagagcatgggtccagcaggtcggcacctccgcggcgttctcacggcgctcctcgcggcggccctcgtgctctccgccgccgtcccggccgcgagaggccaggaggaaaccgagcacgaggaggagttcaactacgtggtcggcgacgagcacgggccggcgcactggggcagcatcaaggcggagtgggccaactgcagcgccgggcggatgcagtcgccgatcgacctctcccacgagcgcgtctctctggtgcgttccctcggctacctccaccactcctaccgccccgccgacgcctccatcgtcaaccgcggccacgacatcatggtgaggttcaatggcgacgccggcagcctggtgatcaacggcacggcgtactacctcaggcagatgcactggcactcgccgacagagcacaccgtcgac

SEQ ID NO: 5014 - DNA, 1195 bp, Sorghum bicolor
  Clone ID: SORBI-28MAY03-CLUS97858_1
ggttttctctctgctcgcgggactgcgagcacaggcctggggcctgcatctcgatgggattcctccttgctgaggccctgttcatctgtgggtttgtcatgtcctacctaggggagatgcattgctgcctaatctgccgttggttcctcagatgaacagcttacagaactcaactgacaggcatgatggttggaggatagattccttcagctgtacgtcatggtgtttcttgagttcaggcagggtgttccattcgtaaataaagatctgatgtctcgacagtctacctccttgatcagttcactgtttctgttgtgacatttttcaggtttcacgttcttggtaatcgtgttcttctattctaggattactgttattatatatttctgtgatagtgatacctctgaacaatgcacctagctatagtatgtgtgttagatacatctatatgttcatggtgttagaatgaaattaagcccatttgcttgtactacggataccagaatcttccatgtacttcattgttatagttttacctcataagatgaagttgatctttaacagtccaaactcatcctctgtttttgttactgagctagaagtttgttattgggtgactggtgtctggtgtcttgtgtgtggttgctgacccgttactgagctaaaaatgaaatatttgactaatctgttcatttttctcatggactagctgttcagttaatcaaatttgactactcgagacttgtctatttacactgacattgatctctacacagactattccaccggaccaagccactggaattctcttaattttcgtgtgctggtttatttgtttctgtctatacatgtcattgtttttctgcttttctttttgtttgaatttgtctttatcattgcaaggaatattgtggcgaccagggcaaattactttgagctcgctaaatgcaagtcaagtactgtatccttgggcatcctctggctaagaagaaacctgaccatttcacacaggcctggaagacgtgatgtttatcgatcctcttcctccttaagcttgttggaatgctatttctaaaattgcttgttgtcatgctatttctaaaattgcttagtgtcttctgctgatacagtttagatttctctttacctgtaacattgtagatatgtgataagtaccttattcccacacccttgc

SEQ ID NO: 5015 - DNA, 1184 bp, Sorghum bicolor
  Clone ID: SORBI-28MAY03-CLUS97881_1
ataaatctatttgtggattgatacatggatgcacatatttatagcaagtgggggtttctatgttccctgcttttctagtcgatctgtcgtcctttgctcgcaaatttttgtggtgggccgtggaagcgagcatatcattccttcctccgatcgatccccagctagccgctcgcagatgcttcaaactgcagtgaccaatccaaactgcatccccctctgtgctgagcctttaaaatagcagttcgtagagtgttgagaaagctaagtgcccctaaccctactaccctcctactcctacacagaaaagctagcgtcccaaggttttccccgatcccgataagctagcatccaagtgagaggtcgtcgtcgtcgtctatccttcgccacttctccttgtgtggctacgctacgacgaccaagctacgctctcttaatttggccggcgagaagatgtcaagatatcatctgaagcagtacgagaaggagcatatgaagatggccatgctgaagcaagaagagacgttcaggcaacaggttcaagagctacaccggctgtaccgggtccagcagctcctgatggccaaagacgcggcgaacgaggcaacaatggcaatgccgcccgccgccgcccgacgatgcaaactcgaggacgacgacgagaggcgccgcgccgcggagaacgacgccggctcgagcaggtcgtggctggacgacgcctactcgcggcagcagcagggccaggggaataataacaaggcccctcctccgctcgttctccaagagagcgagctggagctgacgctggctctagggtgtttcggcgcgggggcggctgccggcacgaagaaggcggcggtggcggccaagaaggaggcgtcgtccagcgtggactcgaggacgagcttctcgtcgtcgtcgacggagtccggcagccccgacgactgcggcggggtccgccggctgcctcctccgtctctgatcgggtcggtgctgccgggccagcagcctactagtgctggcagcgttgggcagcgtcgtctggagcaggaagggctgccgcagcctcctccctggatccacaagtgtctgaatttggcacggtagggtagttccgggtctcactgtattcttggtaccaaccactcgattcttatgccactgcagatacttctcttctcgatctc

SEQ ID NO: 5016 - DNA, 795 bp, Sorghum bicolor
  unsure (1)..(795): unsure at all n locations
  Clone ID: SORBI-28MAY03-CLUS9793_1
gccggccgggccggggcacaccccgaagcctttgaggcccgaaaccctagctcctcggcctctccgccgcttccacccatggctccaggactgcagctcttcactgacattgccgacgacggcacgccccgtctcaacgccgcctccggcgaggagctggtccgcgtggaccgcgccgtcgctgtcgcccttggcccccgctcaccggagtccccggggactctgttcatcaccaccaggaggatgatttggcttagcgaggcggagaagggcaagggctacgcggtgggcttcctcgacatcacgcttcacgccgtgtcgcgcgacctggaggcgtatccctcgccctgcatctacacacagattgaggcagcagaaggtacagatgaggaggctggtgaatcaaatcctgaagcaaatgaactagagctatctaaagtatctgaaatgcggctcatactagcagaccacagtcaattggatgcactttttgatgtcttctgtcattgtgctgaactgaatcctgatcctaatgctgagcgcgacgaggagaatggttggttccatggtgaagatatgtctgatggtggctgggttcatgatgatgaggacatggttgatgaaaatgccccccagtttttcagtgccaatccgataggtcaaaatggtggatatgacctcactcgttcagtacttgagcttcaaatcgacgaccagcgttttgaggatgcagaggaggaacaggagagccatgaaaatggacattagaaacaggaacatgttccttgngagcat

SEQ ID NO: 5017 - DNA, 556 bp, Sorghum bicolor
  Clone ID: SORBI-28MAY03-CLUS98007_1
aagcctcctcctatcagtgatggtactccaaatgagagcgttgcagacgtatttgttcgggtgacacagctcatgtcaatactagagacccagtactcaggggaaactgttgtcattgtttcaccagattttgacaacttgtcaatttttcaagctggattgattgggcttgaccttcggaggcatagcagcttattttttcagcccggtgaggtccgtccagttgatccctcaagcatatttgaatacaagcaacctccttttactgtttttaagtgtgcaaatccgccaagttgtaaagattagttcacttcctgaccctacgttggtatattctgtgtacccatgacaaatgttttggtgataatcgtatatagctgaaagtatgttttgtgtgtcacaaattagtgatccccttgcgattgcatggcccttttgctgtacagtggatcgcaagttttttagcgacgcatgggtccgatcgattatactctggtaataataacagtaattgtatataaagtgagcattacccggcaacgccaaagttagtgcg

SEQ ID NO: 5018 - DNA, 742 bp, Sorghum bicolor
  unsure (1)..(742): unsure at all n locations
  Clone ID: SORBI-28MAY03-CLUS980_1
aaatgaaaaaanncacnntgtgcgattaaatttaagatggatgataatgctgaactgtatgattttgatgatgagaaagatgaaaacaaggttgatttcaagaaacttgttagtgataactggatcgagccacctagaagagaaaggcaggaggactactctgagtctgagtactttaagcaagcacttcgtcaaggtgcaccagcaaagccaagggagccaaggattccaagaatgccccacttgcatgatttccagtttttcaataaccaaaggctaaatgaattgtataaaaaggaagtgcttatccttatgcaagcaaaccagaagaaagataccattgatggtgaagatgaagatcagttggagcctttgacagcagaggagcaggaagagaaggaacagttattagaagagggttttgcatcatggacaaggagagacttcaacacattcattcgtgcatgtgagaaatatggtcgcaatgatattaaaagtatatcctctgaaatggagggtaagacagaagaggaagttcaacgttatgctaaagttttcaaggagagatacaaagaactgagtgattatgatagaattataaaaaatattgaaaggggggaagcaaggatatcccggaaggatgagattatgaaagccattgggaagaagttagaccgttacaagaacccatggttagagttgaaaattcagtatggccaaaataaaggaaagttctataatg

SEQ ID NO: 5019 - DNA, 965 bp, Sorghum bicolor
  Clone ID: SORBI-28MAY03-CLUS97360_1
gcacgagggctcgaccgccgcggcctcctgagccctgaacgccgcccgcctgcccgcctgtcgggtgggagaggataggagggggtggcggcggcatgagggacgaggcgatgggctctgcggcggagctgctggcgccgcggatgctggtgtccccctccagccgcgtccaggagctcgagaggttctcgcattacgtcgctaggcaaattggctttgacgatgtgaaggaatgcccccacctgtgcacgctagcttacgattatctcaggaagaacaagggctatgaagagaatatttttgcattcttccagaataacgtggatcctgaacccctgattgtgtactggatcgaggagcttgacaaatgtatagttggctacttctccttccattggaaatatgccacttacataattacccagtgatatcgacaggttctcacggtagaaggtgcgactaaaagaaagttcaagaattttgtgctagaggccaccaggggactgcccttcctgaggctgactacctgtctgccaagtggctgatgttgtgctacttatgctcattccctctattcacattagatttccaaatttcccttcattactttcagtatgagtgctttctacttcaaccttaggtagtagttaaaccatgtgatctcttggctggagtatcattaatgaaaaatatattgattactttatgtcttgagaatctctcgtttgttgttaaatttggatcacattccttgatgtactagttgcttgaatcttaattatttgctcggtttgacgtgtttattatccttcgttcacttgaaattcccaaatgccccttgaatacttttataagtggtttgtactttacatattagttaaaccatgtgatctcttgattggagtgtcattaatgaaattatattgtttaccatatgtgttgagaatctctggttattgttaatg

SEQ ID NO: 5020 - DNA, 484 bp, Sorghum bicolor
  Clone ID: SORBI-28MAY03-CLUS9737_1
gcacgagggctgagccgagcagggagaaggtgtcggagtcggacgcgagagcagcagcatggaggcggcggcggagaggggcaccgtcgtcaccgcctgcgtgaccggcgcggggggcttcctggcgtcgtggctcgtcaagctcttgctctccaccggccgctacgccgtccgcggcaccgtgcgggatctcggtgatggcaagaatgcccatcttatgacactcgaagacgccggcgagaggttgcagttggtcaaggctgacatgctggactacggcagcgttgcgtccgcggtcgccggctgtgagggtgtcttccatgtcgcgagccctgtcccctccggtcaactctccaaccctgaggcagatgtcatagctcctgctgtaactggtacactgaatgtgttgaaagcttgccacgaggcaaaagtgaagagagttgttgtggtatcttcagtggctgctgtgttcataatcctaact

SEQ ID NO: 5021 - DNA, 839 bp, Sorghum bicolor
  Clone ID: SORBI-28MAY03-CLUS9738_1
cttccttcgtaatgtttccttgacttcaaactggagcaacgaatttcttcaagaactttcttctcagctcaacttgcgtgttaatcaatttgagattgtaaatttttatgttgttggagcttctgggctaaatatcacaatggatatagctccccatactggaattagctttgctgctgatcaagtcaaggcaatgaattattcacttactctgcatacagttcagattgatcctgtgttggtcggggactacaatcttcttaatttaacttggttcaggccattggctccagccccagctccagaattcacaatagcgcctagggcctctccatctacagtatccaacttaccaagaccaagtgagggtcccagcaacaatggacatccaagcctgattactgtggttatcatatgcgttggttctctaattggagtcttgctgattgttttaataatatgcttctgcacatttaggaaaggaaaaaagagagtgcctcgtgttgaaacccccaagcaaaggacgccagatgcagtttctgcagtggagtcccttcctcgccccaccagcacaaggttcctttcatatgaagaactgaaagtggcaacaaataactttgagccttcaagtgtgcttggagaaggtggttttggtcgtgtctacaaggggatactgagtgatggcactgctgttgctataaagaagcttactagtggagggcaccaaggagataaggagtttttagttgaagtggaaatgctgagcaggttgcatcaccggaatcttgtgaaactgattggttactatagtagccgtgagtcatcacagaaccttcttt

SEQ ID NO: 5022 - DNA, 667 bp, Sorghum bicolor
  Clone ID: SORBI-28MAY03-CLUS97401_1
tgagaggctaaagttggagtatatagttcgtggtgagcagggccgtcggctgctgctgatgcaagtaaaagcaaacagattgaatgcatttgccacatgccttaagattgttgatcaaggtggggtaccagcactgtatgccggtctgatccccagcttgttacaggttctaccatcagcatcgatcagctattttgtttatgagttaatgaagatagtcctgaaagtggagtgaatacaaagtaattggtgagcctacgaagcaagttcaaatggtgaccacgtatcttgataaaattgccggaaaaaaaaccagtaacttatcaagttttctcgtaggcttgcttgacgaaagcaccagatgcagtgagggtagcttcaggttattgttcaactgaagctttgcacactagttgaccaaattgtacacgaggtcctgttgaagacctgattcgtggcttaatagaagattgttctcttggactctgcccccaccgaaaacagggcgttgcccattttctgttgacaatttttccatactttatcgttggtgtatttgacacactgacagcaacatttgggagattcacgttgtgaccctgtctgatgcggcctatttagaccgatctccctgtggtcacatgactttatgatgcatagttgggaa

SEQ ID NO: 5023 - DNA, 616 bp, Sorghum bicolor
  Clone ID: SORBI-28MAY03-CLUS97413_1
gttcaatgcttatcattggctccgcagcaggagttgcttttatgggaatggagaaggtggatttcttttggtattttcgcaaggtgagtggttttgcccttgcaggttatgcagctggtataatctcttacctagctgctcaaaatctccatctatcgcttcccacttcgctggctgagatcccttttatttcgtgatcataaaaggttggcctttgtagtcatgtaagatctagatatggaggtgaaccaagcaccattattgttttccatatcttatgtaaggttcagtgtgttgacatatagagtattcagaacttgggaataagacagccatgagcttcaaggcccaacatcagatttggaccggcttatctcaagtgctggtgaacttttaggctagggttgaggatgctgtgagaaaggctgcactgtttactaggactgcttttgaaccaaggatatatcagtttggatatttgctaacctactccgcgaaaataggagcaacctagaaatgtgcaattatgtaagaaacaagcttggttctcttgtatgctaagtatgtaataagatccagaaatgtgggttaactgctgtctggtaatatcgttgat

SEQ ID NO: 5024 - DNA, 544 bp, Sorghum bicolor
  Clone ID: SORBI-28MAY03-CLUS98356_1
ttggttagctacgagtagttcttcacgccggtgcaagctgcgcctgtcgtagcaacgagaacacaaacgccatggcgggcagtagtagtagaaatggtggtctcctcacactccgcatcattcttttgtgcgccttcgccgccgctgctatcaccttgctccctctcgtcatggacccatgcgcacactcgctgtcaagaagcatcctcgccgccagcggcctcgacgcatacctcctcccccgcgccgccgacgcctccaaggctccatcgtcgcacggcaaggacgccaataggaccagcggcggtggaaatactggagcacgacgacccattatcaccgaccagctgtgcgtcaagggcgtgctcccaccacacgcgctcccgcccttccagtgctgcccgccgccgccgtcgacgtcgtccgcgtcgggtcccatcaacttcacgttcccggacccggctgacccgctccggacgcgcaggccggtgcatgtggtcggcgccgagtacatggccaagtacgcgcgcgccgtggcgctgat

SEQ ID NO: 5025 - DNA, 506 bp, Sorghum bicolor
  unsure (1)..(506): unsure at all n locations
  Clone ID: SORBI-28MAY03-CLUS9837_1
ggagtggttgattggcgaagagaagtacaaacaacagacgcaggaaaagcacatccttttggcagttgctgacaagtttttggttgatagacaggcaaataaaactggagcaagcattctatgctttgatgagatacagactatcgatgtttttgcagttgtagcactttctggcattctaagcaggttgttaagcacagggacagtacttgtagcaaccagtaataaagcaccagaagatctgaatcaggatggaatgcaaagggacatcttccttgagttattatcaaaattggatgaaaactgcaataagattcttgtgggtactgaaaaggattatcgtcgcctaattccgacagaaggctcaactgaggttcactatttttggcctgctacttctgacgctcgcagcatgtatgaggctatgtggtatgacataactaacaaatcangaggaaatattaattctgtcaccattcctgtaatgtttgggaggatgtctgata

SEQ ID NO: 5026 - DNA, 704 bp, Sorghum bicolor
  Clone ID: SORBI-28MAY03-CLUS984_1
gtccggatcccggtcgccccgctccattgtctccggccgaggcttacatccgcctcgccacggtcgctcgcggtctcgctccggcaaacccaatggccgccgccatccccaacggccacaccgccggcggcgacgacgcgccccctcccgcttcgtcgtcgctggtgttcctgggcacggggtgctcgagcgcggtcccgaacgcgcggtgcctgatccagccccccgacccgccctgctccgtctgctcccagtccctctccgtcccgcccgagctaaaccctaactacagatgcaatacttctcttttgattgactattgccaagatgaaggtgcacataagtatattataattgatgtggggaagacattcagagaacaagttctgcgatggtttgttcgccacaaaatcccttgcgttgattctattcttctgacccatgaacatgcagatgcaatcttgggccttgatgatgttcgggtcgtacagccatttagtcccacaaatgatattgatccaaccccaatttatctctctcgatttgctatggacagcatctcccaaaagttcccttatttggtcaaaaagaagttaaaggaaggggaggaaatcaggcgagttgcccaacttgactggaaaataattgagagtgatattcagaaaccatttataacttcagggctagagtttgttcccttgccg

SEQ ID NO: 5027 - DNA, 624 bp, Sorghum bicolor
  Clone ID: SORBI-28MAY03-CLUS98423_1
aagggtatgtatggggtcgccggatttgccttgtccccaggtttgctgccttccttgttgctgctgctgttgtatagcacaggtatcatttcataataaaaatcatgtacagatccaattgtgcgtttggaggatttgcagaagtgttgtttgggggacattgttgtagggtaaagaatcagaaatattgtatctattgtcttattccgatccattagatggatcttaagcagtcacttaactgattgacttcatttgagatcaaatttgacaacttctagaatggacatttgtttgctttgctactaatccaagaaacggaaagatcaactgcatgaagcatagccaccacacctgttggaagaatttgaagctagctagcttagatctaatcactggaaagtgaaggcttgtcctctatgtattgtactccgtagctatatgtcatctgatcactggaaagtgaaggcttgtcctctatgaattgtactgtgtagctatatgtccctacgactgtgagtgcaagatgtacagggtaatggatggggaaaccattgttactgtttgttgtaaaagtgtactagctagttcttaaggagagcagattgatatgaaccagactta

SEQ ID NO: 5028 - DNA, 482 bp, Sorghum bicolor
  unsure (1)..(482): unsure at all n locations
  Clone ID: SORBI-28MAY03-CLUS98515_1
cctactggaagcccccgccttccttcctcccatcgccgctcctccccaatcctcctgcatcctctcatcccttcgccgttcccaagtcccaatcttttccttctcggccctcgccgccggccagccaacatgatgcacatgaccttctactggggcaagtcggccacgatcctcttcgacggctggcgcacctccacgtggttcgactacctcctctccctcgcggccctgctcctcgccgccgccttctaccagtacctcgaggccctgcgagtccgcgtgaagctcgccgcggaagggggaggaggaggnggnnncgncgnnaagggtaagncagnctcctccatcccgccacccgccagcgacgacccgcgggcgccactcctcgtggacgtcgccgggcgccgctggccggcgcgtgtggccgtggccgccatggtcggggtcaactccggcctcggctacctgctcatgctcgccgt

SEQ ID NO: 5029 - DNA, 518 bp, Sorghum bicolor
  Clone ID: SORBI-28MAY03-CLUS98748_1
acatatcatggtccctacaaatgatagaactgcgggatctcaaatcaattgctttcagttttctcatatttccaatttgtgtttttcgtcatggtcaccctaccaatctgtttttttattcctttagaaactatcaagatcaccgggcaggaaggcaaggagaacgcaagctcaattaggtttttttatccatactcaatcagggttgtcatctcctgtacaccatcctacatcgtggaaccggcagatcttgttgtaggtgcatatcgtgttttaggtacaaatgtgcaagagtctagacttctgatcgattatgtttggtctaaattcaaaatggttcctgattaattaggccagttttatcattaaccaaaactcaaatctgaatcgtgtcagtgcaatgctgattttctgattattcattggattcagtttgagttgcttgcctgcaaaagcatttggattgaatttgaattgctgtcctgcaaaagcatctatggactgttgtccgaactctg

SEQ ID NO: 5030 - DNA, 418 bp, Sorghum bicolor
  Clone ID: SORBI-28MAY03-CLUS9756_1
gttgcttttgatgatattcctgaagatggtttaaatagccctctgcgtcttgagaagcttgcaaatgaggtcacttatcggaggatgaaggatgcactaattgaacttagcaaggctgtccaaacaggaccttgtgcaaaccttgttcctgttttatttggagagaaggcacccatgcgctccaaggatactatgaaattcagtccattcaataagaacttggatgattcacagaaagaggctatttcaaaggctcttggatcaagggatgttttcttgcttcatggacctcctggaactgggaaaacaacaactattattgagataatattgcaggaggtcaagcgtggatcaaagattcttgcctgtgctgcttctaatattgctgtggataatatttgtgaacgacttgcacgat

SEQ ID NO: 5031 - DNA, 486 bp, Sorghum bicolor
  Clone ID: SORBI-28MAY03-CLUS9763_1
atttgatccacgccatatgcgcatttccatccaaggaagtggaatttatttgaatcgagaaagagggcacagcattgacccgattcacatagatgatccactttgccctgctaacaatgtgggcaggaattgtttccgcattcaccaatgcattaaggcatttgctgatgcttttgctgttcttgagaatgagctactgcagttcagttcagaatgtagcatgcctgcatcagcattcaatatactaaagaaaataatcccgagtatcgattctgatgagctgtagctataaaaagaggcaggattccaacacaatacatttgatgtcagggtggaatgacctgtgctgcgttctagacactctgatggctatgcagctgctcagaagcctcagtctggcaagtttgatacctctggaatagaccaaaaagtagaccttgcagatggcaatattcaaatgccagcgcatgtgtgttcatgtaatgg

SEQ ID NO: 5032 - DNA, 731 bp, Sorghum bicolor
  Clone ID: SORBI-28MAY03-CLUS9766_1
aaaagaactatgttgattggtactagtagtactagtagtgctagagacattctgattcatattatcatcaggttctaattattgtcctaagccagattggttctaattaagaatacaccttcgatgttaacttctgtacaaatgaggacctgaataaacatgttctttctttcatttgtagtctgttctatttagaattaattttaacacctctgttctaaatccaaggttggggattatgctatttagacttaattttaacggctctcatatgtttgcaccgtgggtattacatttgcactgaaaatattttaaagtgtatccagatatgagtatgttttcgctctcatatgtttctctggttggcaccttaggtgcctaatattaacacctaaaaatatgactgaaattgtgtttgtatgagaagtactgctgttgtctccagctgcatagaaagaacaatgaaagattcacaaaaacagatcaggaaggcaggcactgtgctgtgataatcaaagtattatattctaaagtggcatcagcaaggtaaggatgtctcatttgatagatactttgtagcataagttgtagttgcacctaaagtttgtaaatgatgaaacatgtgtaatggatgaaacatgtgtaatgtgtgagcaagatctacagccaaagcttgtgcagcagtacctatagtactgcagtcgagatttttttttatttctgtacattgt

SEQ ID NO: 5033 - DNA, 604 bp, Sorghum bicolor
  Clone ID: SORBI-28MAY03-CLUS97725_1
catcaacacgaacgctaccggtggtccagtgccaagccgagcagcattgttgtcgctgcctctgcagccggcaccagcaacactaccgccccagctagtataggaccacgaccagtgtggcggcagttgttggtggccacaaatagcccgcaatggcttcggaaacaccacaccgctagtggcacgaacaaccatggccgccactgtcgtagaagagtcgtagctctcccaggacaaccaccagatggagcagaaacggccgccccgcaatgtcatcggcaacatcacaccgcgagtagcggcaggagcaaatgtggctgccacgaatggcatccgagcgttgatcattgacaaagacaacaagttcttcaaatcggtcaacatggtactacccatcttgaaattcgagggtgccttgtacattttggcaatcatggtttttatgccaaatcattcggctaaaatggctcttcgtatactaaaccatttggtagggcccctctagaagccggagccggattctaagaggagcactgccaaaatggggccttataatttgaatggagggagtataattaatttagtgcaaaaaaaaaaaaaaaaa

SEQ ID NO: 5034 - DNA, 619 bp, Sorghum bicolor
  Clone ID: SORBI-28MAY03-CLUS97780_1
ttcttggtgtaaattaagggtaggaactattatttttatattggtattgcataattcaatagtgtgtttggtgatctgacaatttcatattctctatttgaacccaagccgttatgtttatagcagttttattaattccatgttatccccatctaaactctgtcatctaagtatgaatttctaatcactgtctgcaggctgctgttggggttctaatgtttgtactgatagtcctggcaatactaaaaccaggacacaaaagagcatgactaagaaaagcttagccttgctgaagattattttcctataattgtttgtcatgattatcacatgacagacttatgtgcatgcagtgtggtggtttacatctaggactctgtgcgccacctttcaaaagaacagcaaaggaacttttcactgatgaagataccataggtgatgatgatgagtgtgtagatagtactgctgttgcagagccatctgtgctccaattgataatttttaaattcatgcaaccacaaattaaacactaatcagcgacaaaaaataggtgtagaaagatgtgctcagtttatgattttctattcatgaacaactaattaaacattgaccagcaaca

SEQ ID NO: 5035 - DNA, 492 bp, Sorghum bicolor
  Clone ID: SORBI-28MAY03-CLUS98712_1
gcctaacgttgtcaatatcagcgaacttccggataagcacggcaaaagtgagctgcttgagggcaggccagtgcctgaactgggcaatccggattacgtttacgaactacccgcacatcagttccacgagatgccaacggatgatgaacacgaagacgagaagaggaaagagaggacagaaatgtgatatgtgttgaggaaagaaacggattggcggtgattgatttcctcgagatgtttcgcgaacgttggaagacatgtggaaatacgccgcactcacaatattgcatgaccgagacccattgttgccataagtggctagcatacgagtcatattctttattttcagtggactcccagtatttcctcgatccagaaatggcgtatccacacgttggttggtagagcggcgtggaagggcacacaccctcccagcgcgtcgcgaacaggacggatccacaagtcccaatccaatctggtatgagaaaaggc

SEQ ID NO: 5036 - DNA, 445 bp, Sorghum bicolor
  Clone ID: SORBI-28MAY03-CLUS98742_1
aggagtacaagtccctccaggatatcattgccattctgggtatggacgagttgtcggaagctgacaagctcaccgtcgagcgtgcccgtaagatccagcgtttcttgagccagcctttcactgtcgctcaggtcttcactggtattgagggtaagctcgtcgatcttaaggacaccatccggtcattcaaggctatcctcagcggtgagggcgacgaccttcccgagggtgctttctacatggtcggtgacctggagtcggcgcgcgccaagggcgagaagattcttgcggagcttgagaagtcatagacggctcgtggacgtgggtaaaatgagggtggactattgtgtctaaggctcgtcggtgatggctctcctcaatctgtacaaaatgtataccattgcgcaatcaaggggcgaacattaatccccacgggtctccggtg

SEQ ID NO: 5037 - DNA, 476 bp, Sorghum bicolor
  Clone ID: SORBI-28MAY03-CLUS98743_1
ctaggataccccgtccgcctggagaggtggcttatggagggaagctatgatcgagtatggaaggcaatgaagagcagcgaagtcccctgcgacgagtacagtgtcttctctgagattctcaagaaccaaatccgatccgaaatcgccagcagcagcgagcgggcctaccccagccttccgataagctccaccaaatcgctattattcctaaactcagaaggagatgttattcagtttgccaagcaccgcggatggctggttaaggagggccacatctatttccccaacaatgcggcagaaggcagcgaagatggagtttacgtcaaggatatgagccaaatgatcatggaaaatacactgggctatgctcgcgagctggaaaccattgtgtagagagcgtcaaacaaggcatggtttggtttagtcacattagatgcaacatctcacaatgctcagcaggcataattaattattta

SEQ ID NO: 5038 - DNA, 479 bp, Sorghum bicolor
  Clone ID: SORBI-28MAY03-CLUS9878_1
ctcctttgtttcacaggcacagaagctctttttgctgatctaggatacttcagcatcaaatcaatccagctaagctttggtttcggtttagtcccgtcagtattacttgcttacattgggcaagcagcatacttgagagtacacccggaggatgtggctaacactttctacagatcaactccaatctcgttgttctggccaacgttcattcttgcactagcagcatcgatcattggaagtcaagccatgatctcctgtgcctttgcaacaatttcacattcccaaacacttggttgctttccaagggtaaagatactgcacacctcaaggcaatactcaggccaattatatattcctgaagtaaactacttgctgtgcttgggtgcttgccttgtcacaattggcttcaggacaaccgtcatcattggggaagctcatggtatatgtgttgttcttgtgatgatcgtcacaaccctatt

SEQ ID NO: 5039 - DNA, 446 bp, Sorghum bicolor
  Clone ID: SORBI-28MAY03-CLUS98765_1
tctatcagagaaggaatacccgtacagctagctcatggcggcctacgcatcttcattgacttgtaatgcagtttgttccgtctgtccgttgctcatttcaaacgggaacaaagttcagaccggattgtgcagccgttcggcgattactttatttgtctataatttttctatggaaaaggtattttttattattacccagggaaaaaagtgttgcactcaccatgctgttaaatgtctagtcatcttcgctagttgtacaagctccaatgtttatataaccactaaacaggctgctaaatgccggtgagttgattgtttaggagcacttaagcttttatgcccagtagcaaggtggctaattctatgtaatgtaatgggaaatttcattcatctcttactttgatgtcaatgtttgaatgtaatataattatgacctttttctaata

SEQ ID NO: 5040 - DNA, 973 bp, Sorghum bicolor
  Clone ID: SORBI-28MAY03-CLUS98120_1
gcacgaggtgcgcgttgagctcgagtagatctgatggttggacgaccgattggttcgttggctggctgcgctaaggttgggctgggctcatgttgcgttcgctgttgcgcgtgattccgcggatggacttgcgcttgattgccgccagatcacgttacgattatgtgatttcgtttggaactttttagatttgtagcttctgcttattatatgacagatgcgcctactgctcatatgcctgtggtaaataatggatggctgtgggtcaaactagttgattgtcgagtcatgtatcatatacaggtgtatagacttgcgtctaattgtttgcatgttgcagttatatgatttgttttagattgtttgttccactcatctaggctgtaaaagggacactacttattagcttgttgtttaatctttttattagtagattatattggtaatgttttactaattattattatgttatatgtgacttctgctcatgcctgattataatcatagatcactgtagttgattgttgaatcatgtgtcaaatacccgtatacataacactacacatttgcttagttgtttccttaactcatgcaaattgaacaccatgtatgatttgcatggtgctgtaatgttaaatactacagtcctgttggtacttgtttagtaagaatctgcttcatacaactatatgctatgcctgatgataatcatatatctttgtgtaattaataattagttgactgttgaataatgtatcaagtacataccatggcacaattgcttagtcacttccttaaccatgcatattgaactgaccccttcatgttctgctggattgttctattctgattagaccatacatcatgtattgcaatctttatttgcaattgtaatgtaatggttcggttctcaaatgttaaatgctataattgtgctactttctaatgttaaatgctatagctgtgctacttg

SEQ ID NO: 5041 - DNA, 519 bp, Sorghum bicolor
  Clone ID: SORBI-28MAY03-CLUS9821_1
gagaaaggagctgagattggcattggaaaagaagggctgggcttcagaaagcaacttttgaattgaaggaagaagaaggatggaagaggtgcaggtgcatgctactcagactcagtgcaggtgcaggcgtgcagctgctcgtctcatcccattcagaatcagaccagagaccatcagagtctttggttgtagcagcacacctggaagtgggtgggatagtatcccctttgggtactgcccacgcaaaggcaaaagtttatctttattgtgatggtcctcagcccttgtcctcactcaggtcagcgcttggtcctcgagctacctgctttgatttccgtcggggtcactgttgacttctttttgcttattgttagtccactagtagaatgcctgatttagcagcacaactggaactgggatagtgtatgttttagaacggagggagcgtgtgcttgtcatccacattcgtgccctatttcacgcattcgtgtcatcaatatcaatatatgtttttttttg

SEQ ID NO: 5042 - DNA, 583 bp, Sorghum bicolor
  Clone ID: SORBI-28MAY03-CLUS9832_1
agaaatattatgttccatatgcttctgattcaaatgctattcgtagagtcataacacatgatgtggcatatgcggctgttcaagcttacccagatgaatataggcccgattggggacgtatgagcttccttgtagacatcttgagaccaactcctggagaagggccttcatggtaccatcttttgaagaaagctagtggcggttgcaatgaccttatgtacagtggacacatgctcgttgctgtccttactgcaatggcgtggacggaagcatatgggggctggatctctgttgcaatatggctcctcgtcctgcacagcgcacagagggaggtacgtgagcggcaccactacagcgtggactgtgttgctgctatctacgttggcatcctgctgtggaggatgacagggttcatctggtctgccagagacctgacccgagctagacggctagccaagcttgaggagatccagagcaggttggtccatgctgccaaggacagtgacattgacgagatcaggggcctgctgaaggaggtggagctagccggccaggagaagcagggcttctcgcagagggctat

SEQ ID NO: 5043 - DNA, 611 bp, Sorghum bicolor
  Clone ID: SORBI-28MAY03-CLUS98331_1
aggcggacgccggggacttcgtcaggttccacgtgtacgtgaacgcgagggcctaccacagggtcccgtcgggagggagggagatggccgggtccttcgttaccctgaagcatcccggcaaggagggaacggcgctacggaccagcatgacggtggcgctaaatgagctgctggaagccctcggagccgaaggagacgacagtgtcaccgtcacgctggttccggtaacgggacaggttacaatcggaggcttgagaatcgtgtacatggacgagtgattcgatcgatcggcagacagtgtgcagaggcgtccctcgctcccgctctacgagggtgcgcggctcgtgctacctgcccacttgtccacgcgcggactcgcccccacggtgttgcgggcctcgctcgctgtccttgggcgcggccgggcatccgcgctccgctgtgtactggcctgctcggcgtccggccaccgcaccgacgtagaaccgtacgtgtagtatacgtgcagggctgagggctaccggctgtccgccatatatatcacatggagctgccgtgcatatatatgaatcagtggtttaattatgtgcctagtgcggtcgtttgtactc

SEQ ID NO: 5044 - DNA, 628 bp, Sorghum bicolor
  Clone ID: SORBI-28MAY03-CLUS9834_1
ggaatatgaagaagagaactttcaaatacttgggtttctttcaaagttattgtatttgaaatctctaattccacaatttaatttgcaggatgcgaggggaaatgatgtggagttgagtagatacaaggggaaggttctgcttatcgtgaatgtggcttcccaatggttaaaattctgataatcatttcctggttcttgaatgagtttctcccttctttttatgtgtgttttcctacctgacttggtatccttgcagtggtctgacaaattccaactatactgagttgggatcactccacaagaaatatggcgaaaaaggatttgagatactggcgttcccatgcaaccagtttgttggacaagagccaggtaccaatgaacagattgctgagtttgcttgcacccgtttcaaagcagattttcctgtttttggcaaggttgatgtgaatggcgggaaggctgctccgctgtataagttcctgaagtcagagagaggcggtctgtttggagaacgcatcaaatggaacttcaccaagtttttggttgacaaagatgggcacgttgtgagcagatatgcaccaaccaagctccccgtgagtattgagaatgacattcagaagcttttgga

SEQ ID NO: 5045 - DNA, 961 bp, Sorghum bicolor
  Clone ID: SORBI-28MAY03-CLUS9890_1
accgccgagcgcggagccaccgacacgacaatcgcagctgtagtccggcttcagacctgcagtgtcactgtgtcagtagtcctcggtggcgctgttgcccgcctccgagatcatttggagccgggggcgtgtcgagagggatggggatggagtggccgccgacgcctgcgcagcagaggaaggcggtggtgggcgccgggtcggcgctgaagctggtactgttcgtgatcctcgcgggccccgcactgcggctgctggtcggccccgcggcctacctcctgccgcccaccgccgcgccagaggggggcgctcgtcttatcgcggcgccggggagggaaagaaccggcggcggcgggattccttccgtcgaaacggatgatgcgatttttactttgacctctgcagaacctctaacagctatagacaagaaggaaggttccccaaaaccagaagaaagttgtgatcttttccatggcgagtgggttcccaattcatcagggccagcttacactaatgcaagctgccgcttcattgagtctcctcagaactgtatgacaaatggaaggcctgacacagattatctcaattggagatggaagccatatggttgtgaggtaccaccatttgatggcaagaagtttctggatggcatgaagggcaagcattgggcacttattggtgattccatccttcgcaaccatgtccagtcattgctttgtcttctttctaaggtcgaagatgctactgaggtctaccatgatgatacattcagatccagaagatggcactttccttcacacaatttcacagtctctcttatctgggcaccattcctggtcaaagctaaaatatttgaagacagtgatggagtttctactgctgatctccagctgcaccttgacgttctaaagaaaaattggactagtcaatgggagagctttgattacgtagtgatatccac

SEQ ID NO: 5046 - DNA, 492 bp, Sorghum bicolor
  Clone ID: SORBI-28MAY03-CLUS98902_1
ggtcagatccacgccggctatgcccccgtgctcgattgccacactgcccacattgcctgcaagttcaaggagctcatcgagaaggtcgaccgtcgttctggcaagaagatggaggacaaccccaaggccgtcaagtccggcgacgccgccatggtcctcctcgtcccgtcgaagcccctctgcgtcgagaccttcaccgattacccgccgctcggccgtttcgccgtccgcgacatgaggcagaccgttgccgtcggtgtcatcaaggccgtcacccgcaaggacccgaaggccggcaaggtcaccgccgccgccaagaaggccggcaagaagtaaactgcccctccccctgcttcccccacgccccgcgcgccggtcggccccccctccctgtcgtcccctgcgcatggcgcgcggcgctcgtcccccagccagactcccctcctgcctgcgcgcaattttgtcttcaaaacaaaaattataaaaggtttt

SEQ ID NO: 5047 - DNA, 522 bp, Sorghum bicolor
  Clone ID: SORBI-28MAY03-CLUS98906_1
aaatctggctatgccagcaaagattcaacttgcactgaaggagcacttaacttactcatgttacccccagaaaagttatcattatttgtcccttctcagtatgccaactctgatcaagacttgctgctggagattcctctcaatgcacggcacccagaggcagaacttctttgtcagccatctcagctgagctcaataacccacagctccacctctgtggatggggttgctgacggggaggggcatctgaagcaaccatagtctcaggtcacatcagcaagcaggttaggaacaaccattagttgcagtttactttagcctcgtggatcatggtgcctctatttgctgaccaccaacgggcgtcggtttgttcacgggagtgctgtaattgccctgatttacataacaatgtgtgtcgactgctaactttgttcagctaacatttgtagcgtgcttttggaccatgtttttgctggttttctgtagcatatggctcatggagaaagtatagcttatctctgt

SEQ ID NO: 5048 - DNA, 534 bp, Sorghum bicolor
  Clone ID: SORBI-28MAY03-CLUS99056_1
aagaacagaatattaatatttgttttatacaaaagagaagcaccaaagattgaaggattattaaaaagacaaggatataaagtagctgctattcatggtgatatgagccaatctcaaagaattgctgctttacaatcttttaaagatggtacaaatcctcttttagttgcaacagatgttgctgcaagaggtttggatattccagatgtagaatatgttctcaactattctttccctctcactatagaagactatgttcatcgcattggccgtactggacgtgctggaaaaactggtgtttcttttacaatgttcacttctcaagataaattgagagctgcagagcttgttgctattttgaaggaagccaatgctgacattcctcctgccctcataaaattaagtagctatggatccaagaagcaagagcacgctctttacggcgcccacgccaaagattttggaaacaagccaatgcccaagagctcacatgttaagtttgatgactaacttggtacaaataaagaaaattta

SEQ ID NO: 5049 - DNA, 849 bp, Sorghum bicolor
  Clone ID: SORBI-28MAY03-CLUS99020_1
gcacgaggcacgccttcaccgacactcttcctccgcttccagtcacaccctccctagacggcctgctttatttgccgcatcgctcgtacacagcccttcctgtccgcatacccccccaaccaccgccgtcatggaccagatcaagcagcgtatgaatgcccttcgcatcgaggccgacgagagcgccgccaaggccgaggagtacaaggcaaagctgaagacgctggagacggagaacacccagaaggagcaggagatcacctctctcgcccacaagaaccaggtcctggaggccgaggttgagaagctcgaatcgtcagtcaagaccttcaaggacgaggccacgggcggcgccgcagcgagctcccaggtcgaggccatgcagcgcaagatccaggttctagaggaagaggctgaggagtcggacaggaccattcgcgagctgaacgagaagctccgccagaccgacgtcaagtctggccacttcgaacgcaaagtccaagctctcgagcagacccgcgaccaatgggaaaccaagtacgaggagatggcgaagaagtacgccgacaccaagaaggagcttgacgagttcgccgccgagattggtaacctctaatcttgcggctctcatctctctttcgcggttgttgacctacctctgtctagtgaactactaagccaccttgaccaacaccacaaggcgacgtcgagccacgacctaaagcgaaggatcccgttgctaccctttttacctgcatatcttggtgtcgtcctgggaatggcggatgagcttggatggctccttctaaactgtctctaagcctggaaatacattttctcttcatcgtc

SEQ ID NO: 5050 - DNA, 368 bp, Sorghum bicolor
  Clone ID: SORBI-28MAY03-CLUS98560_1
ccgagtatcgacttcaaattaatggacagtatgcaagcaaaattggcctggcatgaagggctcagcgacacgtccagtgactttggctccgtcgccgatattatcaagccggattggagcatcccagaccacgccgcagatcctctagcattgcacggcgatccggagagaatggagcatgaatggctggcgttcgagaagtggaggcaagggaatgtatgacgcaatatcaatcaaggacttcaagctgtacgcatttcattctcatggctgttgttccagtgtgggtcatcctccgagtgtcacccatatcgagattttgcttgtgattatctttcgttactgtgaatccccccttcccttctttc

SEQ ID NO: 5051 - DNA, 587 bp, Sorghum bicolor
  Clone ID: SORBI-28MAY03-CLUS98574_1
gactgtttcatcatattcgcgtcagatggtttgtgggaacacctgagcaatcaggaagctgttgagattgttcacaaccatcaacatgctggaagtgcaagaagactcataaaagccgctctacaagaagcagctcggaagcgtgagatgcgttactcggcccttacaaagatcgataagaaagttcgcaggcattttcatgatgacattactgtcatcgtcttatttataaaccatgccctattattgaaaggtgctccgcaaggccaacccctctccatcagatgtgccctagattattgacagtgagctagttcatcccctggtgttcagctcctatgggcagccatatccagagtcagctgacatggtcaaccggttgtgaaaagcgcacaacctccggcaccagtttcctttttcgtttcccatttttgcacatataaaattgacaagttgctgaaaatggccagtttcccctcttgaactatgtcggataaaatgcggatactcttcggttttggagatatatgtctaggctttagagcgtgagggaagtttataaaggcttccagtatgtaattctgctc

SEQ ID NO: 5052 - DNA, 929 bp, Sorghum bicolor
  Clone ID: SORBI-28MAY03-CLUS98618_1
gcacgaggctcaacaacacatatcacgacaacagcgtccatcatgtccgacaacggtgaagtcgaggtcgagaacccctcgggttactacccagccctccccaaggatgtccaaaccgactccgtcaagttgttcggaaaatggagctacgatgatgtcgaaatcagggatatctctttgaccgactacatccagatccgttctcctgtctacctccctcactccgctggccgatatgctgctaagcgtttccgcaaggcacaatgccccatcattgagagattgaccaactctatcatgatgaacggtcgcaacaacggaaagaagatcatggctgtccgcattgttgctcacactttcgaaatcattcacatcatgaccgaccagaaccctcttcaggttgccgtcgacgccatcgtcaactgcggtccccgtgaagattccacccgtatcggttcccagggtaccgtccgccgacaggccgtcgatgtttctccccttcgccgtgtcaaccaggccatcgctcttctcaccattggtgctcgtgaggccgctttccgtaacgtcaagtctattgccgaagttttggccgaagagctcatcaacgccgccaagggaagctccaactcctacgccatcaagaagaaggacgaactcgagcgtgttgccaagagcaatcggtaaacgatttctttttgtctgtttggtttacgcgttcagggtatggacggagtgtcatttattagggcttggtcgactcgcatgcatctactgagactgtatctacggaacagtccgtgaaacaggaagtaggacccataaaaaaagtaacatggatagctttcttcgaggtagtcgagatgttctgacgaaaacttgatccttttttaatgattatcaaaatagtcaagtacgccgttccaatattg

SEQ ID NO: 5053 - DNA, 415 bp, Sorghum bicolor
  Clone ID: SORBI-28MAY03-CLUS98622_1
ctcgctgccgtttcgtctctgctcatggagaacacacctccccctgtcacggccaagtctggaggtacctccaagggtaaccccaacgccggcaatgtcggagacggcaagattgataggacctacaagcctttgaccactgcagacagggctggtgctggtatcatcactttcttggttctgtcatttgcatgcggcatctttggctggatgagcatgggcaaatagaggatctttctcgatttctgaatatgccgaaaaacgaagtccggcatgcacaattgtgcttcttttgcacccttgtatttggaatctgaagaaatgatctctggggcgttggatggagtataacttgccctaaatagcctggtaggctggatatctattctctaaatgttataatgttttccccttt

SEQ ID NO: 5054 - DNA, 1006 bp, Sorghum bicolor
  Clone ID: SORBI-28MAY03-CLUS98655_1
gcacgaggcgcggatcctcggtgaggtgaacgagaactcgctgcgcaagttcgcggagacggcggagcggtgcctggcggactacgggcaggagcggccgtccatggccgacgtgctgtggaacctcgagtactgcctgcagctgcaggagacgcacgtccgccgggacgcgttcgaggacagcggcgcagtgggcgcgcagttccccgaggacgtcgtcgtcccgcgctgggtgccctcgtcgacgagcttcatgacgacgggagatccggacgacacggccgtcacggacgtgggcgtcgtcaacagcaaggtgttctctcagctcagcagcggcgagggccgctgatgagctgctggtggtgccggcgaaccggctcctgcaaacaatccgagccacagtcacgtactggagtgtactaatcatggttttgttatcgttgcttagtttgacagtattattatagagaggacatcacgttatcacagattcacagcagacaagaaattcagagctgctggtgaatgtgctctgaactctacggcaacccagaaactgttgcgaatgccaaccaatccttttttgctgtccctacactctgcaggtctgcatcacggtcacggataatccatgttcgttgtaagcgtgctgtgcgtatgcatgcggatgcggccaaagcaaattgaccagtggctgtctgattgattgagctacataatttaggcgcctgtacgactgctcgcatggcaacaaaacttttgcggatattctcttcttctctggtggtcacactcaccagaccacgcgtatagcagatagtctagagcagagcaaggtgccaaggaaagctggccagaagaattggcagtggggatatctcattcagtggttgcaacgtgtgttcaacgtcagtctgatgctagtgttcgccgacggtcaccaagatcaattcggttagatatcgatgttcccttaaagactgtgaggagaaggtttcagactttc

SEQ ID NO: 5055 - DNA, 578 bp, Sorghum bicolor
  Clone ID: SORBI-28MAY03-CLUS99176_1
ccttgcagttcatttcttgatgtggaagaagagttgaagacagtttaaataattgctcaatgaaaaccgtcatgtattctaggtggctttgattgtcgcaggcggttcaagaattcagcaagaagaacactgagcttcctgctctcacaagcgattcagcaacagcatctccagcacgggacgcggtacgggtaacagtagcagatttgaatggcaatgatgctccagagtttcttacaggggatgccagcttgtctagccacaagactacaccgtcaaggccaatgattaagatgctgtcatgcttgtttccttctcggatctgatgaatgatcgatcactgggcatcgggtgtccgaggtgcatgcatggtgatgccccagtctatctgcgaagtggtgtgcagatctgtaaggacggtggcagcatacctttccaaaaaggaaatggcaccagcattggcataaataatatttcttcgagtcatattgtccatattcatccgatttgcatgtatataccttcgtcatgtgaaattcattgttcggacctttgatgagaatgcacatcttggattg

SEQ ID NO: 5056 - DNA, 473 bp, Sorghum bicolor
  Clone ID: SORBI-28MAY03-CLUS992_1
ctcgccgccgtcgtcgccgccgcactcgtatctgcggcttcccgcgccgtatcctgcggaagaagtgcttaacgggctacaccccaccactgcacgatgtcggcagcggcgcgggtgctcccgaaggcggtgaccttcgtgacgggcaacgccaagaagctggaggaggtccgcgccatcctcggctcttccatccccttccagtcgctgaagctcgacctgccagaactgcaaggggagccagaggacatatccaaagagaaagcacgaatggctgcatctcaggtgaatgggcctgtattggtggaggacacctgcctatgttttaatgcactcaaaggcctaccaggaccctacataaagtggtttcttgagaagattgggcatgaaggtttgaacaatctgttaaaagcttatgaagataaatcagcgtttgctatgtgcatcttttctcttgctcttggaccctggag

SEQ ID NO: 5057 - DNA, 405 bp, Sorghum bicolor
  Clone ID: SORBI-28MAY03-CLUS99231_1
taccaggtcgtcatcggcggcagcacttacacggtctcgggcacgtcggcctcatcgccggtctttgccggtttcatcacgctcgtcaacaaccagcgtgccgccctgggcaaggcccccgtgggcttcctcaacccggccctctaccagctcgctgcccagaagtcggcggtcttcaacgacatcaccgtgggccagaacaactgctgcgccggcagcccgggctcccaggtctgctgccagtacggcttcaacgccaccgtcggctgggacccgctcaccggcctcggctccgtcaagttcccgctcctcctccaggccctcgcccagctctaatcccgcctcttgattttatttagaaaaaccatcatttatgaatacagacaataaatgaatggtattgtt

SEQ ID NO: 5058 - DNA, 617 bp, Sorghum bicolor
  Clone ID: SORBI-28MAY03-CLUS99261_1
ggttcaacgctctcgagttttttgtgtacgactgtgatgttatgtcatatctggcatttgaggacggagctatgcccagcctccagaagcttggtttactactggatccacataaatgggacaaggttacacctcttggtctccaatgtctttcgaacctcaagaaaataactgtatggacggttgccaccagttatagcaacgacgcaggagcgggtgacaaagaatcagaggagatgtctgcggctgctttggtccgcaaggtgtttcaggaagcagccaacgcacatccgagtcacctagcatatacctttcacgaagggcttgataggccggcagaggaggcacaagagtagaaggtggatggaacacagtgcagaattattgggactctgttgccatcacgcgttcatgctgctgctatctctcctgtagcctctccactaatccttcaagtcataatgccatttcattttaactgccggtttgcctcctacaattgcaggggccatatgctgtataactcttgaaaaatttattttgttgtatctactttctgaaacaatggctttaatttactagcgtttattgccaacagaagctgttctgttagctgt

SEQ ID NO: 5059 - DNA, 604 bp, Sorghum bicolor
  Clone ID: SORBI-28MAY03-CLUS99275_1
aagttctttttctatgcccagaaagatggggctactgctttcttccttgttgaatgtattgtgaacacagcatcagcgaaggcgcagctcaaaattaaggctgatgatggggctgctgttgaggcattctcgactttgtttcagtcagccttgtccaaatttgggctttcttgatcctgagtattttgtctgagcgattcagtggtccactgtttttttctggctttcacagtttgcccccactctgctccctaagcttgtccagtacttgatcaaactattggagaaatcagagtagaaggtgcaattcgagggcatagcaatatattattattactagattcagcaagagagctctggagttctgcggaggaaaatcttatttgtattatttgggtgactgtgcatctgtacatgactacatgtcacccagataaatagctgggttatttaggattgtactagttttgatgtcttgatctcttctggagggccttctttttctttaaggttgtagaaacaacacacaacacccccttccatgtattctatttaccgttatttcttgcacagatgatcaatacagatgtttcttccattttga

SEQ ID NO: 5060 - DNA, 1053 bp, Sorghum bicolor
  unsure (1)..(1053): unsure at all n locations
  Clone ID: SORBI-28MAY03-CLUS99686_1
gcacgagggcaagaagaagacacgcgtggtgaatttgaggcgtaccaaatcagaagttaccaccccagagactggcagtgaagcgtcagatacggcatctgtcgatgtccctctatctgagcccatgattgacgaatcaatccctgaggagactgagtcgtctatcattgctgaggcatccacaccaaataaagttcgctttagaagcgcgggtgaggcaggacgtccctcagtcatggccactcttgaggaagctcggaggatgggctccccactcaagaacgctgttgaaccctcagaatctcagaactatccatcgatcgctgctatcacttctgaactgaagtccgagaagggcaaatctcctggattggaaaaccaaagcattagctcagagacttcttctgtcatccttgaacaagcttggattatgaagatggctggcgaaattgccaagcgagtttatgacgagaagaacaggcaacgtagcccctgngacgagcgtgaggacgcaccaccaccagcatacgaagctgctactcagtagcggaaaagtcacatatgtcagcacatacaactatcctactctcgttagcattctatttgttcattctttttaggcaggcgctggagtttggaaacttcgggctgaggaaatggcctggaggaagcaattttttatgtttttttgtgtcgtttggtggcgttggaagagccagggcgaagggtaaaataggtgtgcctggtcatgagttctgaccggacaggtttcagaggggtggtactgttgttcgtcctctatttctatgccacgacacagttgtctgtttggactggtcgatagccccaggggggttgactcatgacgatgtcagagtctttacaatgttatttacaaaatgataggcgagacaggcggggtttagacggtcagagagatcgttggggtatctagaagatatcatggtatcaggaccaaggaacgaggaacgaggctagtgttggttttatataaccgcgtagtactcgcaaaacaactccaattcacattcg

SEQ ID NO: 5061 - DNA, 577 bp, Sorghum bicolor
  Clone ID: SORBI-28MAY03-CLUS98783_1
gctcgcaaacatttttatcacgtttgcactacctctttggaacctctttgctggattcctcatcgttagaccggcaataccaatttggtggagatggtactactgggcgaaccctgtctcgtggaccatctacggtgttgttgcatctcagtttggcgagaacgaaggtgagctttcagttcccggtggcagtgggaaacccgtggtggtgaagcagttcttgaaggataatctcggcatccagcatgacttcctcggctatgttgtgctcgtccatttcgcctacatcattgcattcttcttcgtattcggttattccatcaagttcttcaacttccaaaaacgttagctccacctctacgggccgtcggaatctgtaatcggttgccgtaagttctagttctagtcaaaataagtgcagtcgaaatgtgtcattaagaggatttttttaggagttaccatatatatatagcgctattctacaccttaggtgtagaatattattctacaccgcaagtcaaaactgggtagaaaaaatactgagcagtactgaacaacattcagtatcatcttgtct

SEQ ID NO: 5062 - DNA, 583 bp, Sorghum bicolor
  Clone ID: SORBI-28MAY03-CLUS98798_1
taccttgcctacttttaggcacctactcattgcattcggtggacttgctggtttggaagaaagcattgaagaagatacaaatttgaagggtaaacacgcagatgatgtattcacatcatatttgaatacatgccccaaccaagggagcagaacaataagaacagaggaggcacttctcatttccctccaatacttccaagatccaattaggcgcgcagaacagaaaatgtagaaggtaatacagacacatgcaaatctagccatgcccaacaagttggctacggagcttcagttgtaatagtggagttttctcactgagaattttgacccttcgttcacgtatgcgttgatgacagtggagccaagaggttgtgagccatcgaggacattttgacacaaccatttcagtttagaatatttgatgtggggctgactttcattgaaagcgagtgttagctttgccatttcaattgtatccagtggttgtccactatagtctatatcgctgtttcatgcctttgaccctgtactaaaaacggaggatggctgttaacaccataaggtcatgcctttgctaaagtct

SEQ ID NO: 5063 - DNA, 659 bp, Sorghum bicolor
  Clone ID: SORBI-28MAY03-CLUS98848_1
gcacgaggcgggaacgtcggatttcaatcaaaaaatagctaaatatggagtgtggttggagcataattattctgctgattttgtacatcatttgggatgttaactactttatacgggtcgtttttactgttgtgtttggtcgtttattccagaagaaagtaaaacttacggaaactacatccattttaggtttctgcacatcacaggatgttgacatttttatacgccatatgaacaatgcaaggtatgtccgagaattggactttgctaggttccacttctacgcattgactggtctatatgaagagatcaaaaaatcgaaaggtggagctgtccagggtgcttcttcggtcagatatagacggacgattcccatattcagttcatacagaatcgaaacaaagctaatttggtgggacgagaaagccatttatttggaacaaaagttcatcacatcttccgataattttgttcgagcggtcgccacgtcaaaacaatgcataaccaatgttaatgtggtggaattgatgaaaaagttccctgaatgcgccaaccggccagctgccccagaagaactagaaatttggttgaatgctatcgaaatttccagtcagaaattaagaaaagataaataaaggttccgtgatccgtgacggttt

SEQ ID NO: 5064 - DNA, 106 bp, Sorghum bicolor
  Clone ID: SORBI-28MAY03-CLUS98867_1
ccacgttttgttgcccaagtcttcattccgactgatggtgatgttatgttctgataattctgttcatcacctgtttaacgtggtaggactgatgcctgttcgtttt

SEQ ID NO: 5065 - DNA, 171 bp, Sorghum bicolor
  Clone ID: SORBI-28MAY03-CLUS98881_1
cccctatgtatgggggtccaaatttttttttttttttttttcccttgtgccgaataagtccgagcaaatgctacgggctaaaaacttgtggggaaaatccccccgttcagtttggactttggaatgaatcccctgggttatcatttgaactgctatgtggaaattcgcccg

SEQ ID NO: 5066 - DNA, 602 bp, Sorghum bicolor
  Clone ID: SORBI-28MAY03-CLUS99499_1
gcacgaggattttgcatgattcagtccaagagttggctgatactgttatagcagttgttcgacgtcttagattgtgtggtgaagatggaaaggacatatttccacttgttttggttggaggggtccttgaaggaaataaaaagtgggatatcagtggcgaggtcataaaatgtatttccaaggtcttcccaggcactgatcctatttggcctgaggtggaaccagcaatcggtgctcccttgctagcctggagccatcactgcaaagggttgaaattggagaatggaagttgattcccggcatttaaggatgtcaattgtatattgaggaattggccacccaaaggagaaatttgatcccaaagatacattcatcggcatgaagccctttggttcccaccaagtaataaatcccggatggatgcaaacataaggtgtggataaaacatatttctgatgtaagtagttagtgtgtcaaaagaattgttcaatagccctctgattctaactatcggtgattgttgtatgtgtcctgtttgtgtttggggttaacatctgtgtcccatggataataaatcttcaaattgtgtatttttttttcct

SEQ ID NO: 5067 - DNA, 536 bp, Sorghum bicolor
  Clone ID: SORBI-28MAY03-CLUS99650_1
tccgtcgtcgactccggcaccgtcatcacgcagctgccgcccacggcgtaccaggcgctacggacggcgttcaagaaagagatgaaggcgtacccgtcggcggctccggtgggcagcctggacacctgcttcgacttcagcggcttcaacacgatcacggtgcccacggtgacactgactttctcccgtggcgccgccatggacctcgacatctccggcatcctctacgctggctgcctcgcgttcacggccacggcccatgatggcgacaccggaatcttggggaacgtgcagcagcgtacgttcgagatgctattcgatgttggaggcagaaccattggattccgctctggtgcatgctaaatttctaggatgatcgagccaataagtgttcgctacctaagaggtatatatatcgctctcgtcaatcaataatttttaaggtaatataatgtggtaaaatatatatagtcccgaagtaagtatttcattgaaatacaaccgaataagcatgaatgaacatttagatgttgttt

SEQ ID NO: 5068 - DNA, 368 bp, Sorghum bicolor
  Clone ID: SORBI-28MAY03-CLUS99653_1
ccgccacgccccgagccgccgccattaccgccgccgtggctctgctcctcaacaggatgctctgatctgatctgaggagtggtcagtcggttcagctggctccagatcttctgtgctgatgagtttgtggtgctacacctacactacagttttcttcttctttatttgtaggtttctattaattttttccttgagatcgatgatctctactactactagtagtttttttcctgcttcttgaattgattgcgtgattattggttggttcttgcttccatctctctctcttgcttctgtcgtagtccagttcagtttgttgatgcagtttgcagaccagatgatgattaattagtataatgtcaagtgtg

SEQ ID NO: 5069 - DNA, 648 bp, Sorghum bicolor
  Clone ID: SORBI-28MAY03-CLUS99655_1
ctccatttgctgccaactttaggtagacgaagaagcctccaaagctctgatcagagtcgtcgaacgagcaactagctagctacctgcagcctaccacagatcgatcgacctggcctgatgatatatatatatatatatatatccatgcatgtttcttagtctagtcctagcagtgtatggtcatggttcgttatctctcgtaactgtagtagtactaagcatgcagcagctctggcaacgaaaaaggattgcagactgagcttgctagctagatgaacctttggaatgagtccttgaagacttggattcattctccaggttcatctatctatccatccgatccatcagggaataagggatcagctaatatattttgagagaggacacaacaagtctctactgatcgtcatcagcttctaattatgattggttgttaggttgcatcattgggtagttgtacgtggaaggatttgttaaagatgtgtaatggtttctagagtttaaactagtgacagacggaatggatcaaagtgtgtagcaggtttctattgattgtactaccaaataaaaagtggcatctctttgattgatcggagcacgcttttggatagctttttttttgaatctaaaccacacacataattttga

SEQ ID NO: 5070 - DNA, 651 bp, Sorghum bicolor
  Clone ID: SORBI-28MAY03-CLUS99679_1
ctcacgaagaaaatgaaaggctagtgacaaaggagtcagttgatgaaaaaatctatgagattgcaaggcggaagctagtactagacgccgcaattcttcattctggagcagagttggacaatagtactgatgtaccagaaaagacaatgggagagattttggcatctcttctcctagtctgaagttctaatcctggagtttcttgaaggtattcagttctacctgtgggatatctttaacaatgggtttttggccttcattgaagctagccattcaccctggctaatgtcttgaggtcttaagatgtgcatccatgattcctttttgctctggagacctcccatcttttggtctgttcatcttttgttctatgaatgctctgctataaactactggatttccaaagtgtttatggttctacataatgacagtgtttaaggttactgtaggtggtaatggagtctgattttctttttctccgatataggaaggactgaaatatgaagtaatacatctgtaccaaagtttcaacatgttttaaatgaaatgcagaatagttccaagttgcacatttgcttcagtttgtaccattatttttttattttatctgcacaagtgtgtaccgacacttaacattgtcaaagatgatgt

SEQ ID NO: 5071 - DNA, 342 bp, Sorghum bicolor
  Clone ID: SORBI-28MAY03-CLUS99079_1
ctccctccccctgattcgctgccatctggtctgggagcccgagtgggcggcagcaggagcccacaggcggcacgccaaaccaggacagccatggtcgtggtcttcgaggccggacgggcgacagtagaagccagcaggccaaacgcatccagctcctcagtctggctcatcgtcgccagccacaccctttgcccagttgattagaggtccgacagccgggagttactcttcctgatcaagatgccagaaagaaatttactcaaatccagcagaaattggttgttctactcattgtttttgatcctcacttctctcccaggttggtgactagctctttatcgt

SEQ ID NO: 5072 - DNA, 622 bp, Sorghum bicolor
  Clone ID: SORBI-28MAY03-CLUS9910_1
gcacgaggcttgcccttgcgcggaagcagagcggggataagcgagggaggagggagaaaccgaagatggtcctgctgcgcggcgccagggcggcgtgggcggcatccaccgcggtggccgcaggcgccagcggcggcaggtccatatccattcggctgatccccgtcgccgcattgtcctcgggcggaaggaagaggaagggccagcggcggggcgaggccaagcccccgagcccgccgccgccacagcccctgcctcggcagagcgagaccctgagcagcaagaagaagtctggcgcgaagccgtcaggcgaggccaagaagagccgccgcccagtggagctgggagaagcgcgcggcccgcggaggctggagggcagcgaggcgaggaaagggaatgtgcagcagcagcagcagcaagagaaggcgaaggcgaagaggctggtccggtggaagtgcgcgagcggatgcggcgcgtgttgcaagctggacaagggccccgacttccccactcccgacgagatctttgccgaccatcccgatgacctccagctgtacaggagtatgattggctctgatggatggtgcgtcaactacgacaaggccacccgcacctgcaacat

SEQ ID NO: 5073 - DNA, 546 bp, Sorghum bicolor
  Clone ID: SORBI-28MAY03-CLUS99165_1
acgctgttgatgagtgggtggttgaaactcgcaaggagaagaagcaaaaggagatcgaggatgcggagaagcgacgcaaggaggaacaggaggcccgcaaagcggaagccaagaagaagcgcaaggaggaacgagcaaaggcgaagaaggccaaggctaaggctaagcgaaagagtaacggcgagagctctggttccgactcttctgattctgataccgaatccgagactgaaaaccgcaccagcgaaaagaaggatgaaaagaaggacgagaaggacacggagaagaaatctgaagacacgcctaaggaagctgaggaaaacaagaaactggaggttccagatgaggaatcaagcaagtccaaaggaacatctgattctggatatgacacccccaacactgctttgtaatcatttgcatgagtggaagagtctcatagagaacgcatacagctgcgttggatggaagttttctgcatttgtcaactttaaagattgatcatcttgaatagcgtcagcgtcactttttcaaatacacttaatagtc

SEQ ID NO: 5074 - DNA, 569 bp, Sorghum bicolor
  Clone ID: SORBI-28MAY03-CLUS99172_1
ctgatcggccgtctcttaccgtagcttagatctctccccactgggaactatgctgagtcgaccctggctgttacccactcccgggttctaccctgttcgctacttcctctggcaccgcgctccccgtggacccatctccatccgttcttccaggtggtgcggtcggttccccctcggaacctgctcacccggcccactcctttcgtagctcgctgcttccacctctcgtttttcccttggaactttgctgtatctccctcctgctgtcccgacctctccgatcctctgcgggctccccctgcccccgggcggcgttagacattccgccatcaccggccatttttccgggaggttgcccctgccgccgggtgttgttcgtgagtccctgaccactggatttctttccccgttgttgtgctctgtgctcatcggtaatcgtgtgttccgatcgggtgtagctcagtcccctctggtttgtcctgtccccatctggattggtgccttcggctagggtgtagctgagttaggactggattatcaagtcacaataatgatatttgccttcgtca

SEQ ID NO: 5075 - DNA, 578 bp, Sorghum bicolor
  Clone ID: SORBI-28MAY03-CLUS99167_1
tcttggaaatatctttgggcggtggtcaggatcgagacgaacggtgtttttgcgacaactgatatcccattacgggacggaaatctgggaaattacggggagttggtcgaatttttggtgtagtcccgctgctgcaatgaacgggaaggaaaaggttcacccttgcccattcctttctttgtatcatcttgggacggcctatatatttgtcctctttttattttcttgttcatggtgtaggcctgagcgccatagccggtgctggtctgcctagtgtttttgggaccggagtagctttctactttggagcgttgtttggtttgcccaagtcctggttggacgggcttcttttacaatattttgtctcgcctcggcaagcatctggagtgttcagggggcctggaatacatgtcatgatcagattcaaagagatttgttttgggatttgggaggccctcgagcctggttttgcaatgcagcggtagactgcatgtgtggctattgttaactgggtattggcgctgtctggttgcgacaacgcggcttcagcgctgcgagacgagaatatacgaatgttc

SEQ ID NO: 5076 - DNA, 531 bp, Sorghum bicolor
  Clone ID: SORBI-28MAY03-CLUS99783_1
gcagctcgaagggcatgcccgcctggtgagaagctctctagcgaggctgtcaagtccgtacttgcaagctatgctcaagagcgcgcgcagccagctacaacagccctggagagatctcaaatggttggaaaagcactgttgtgcacgcctggaccagcaactactcttgtcaaggacatgttgaagctcagtaacgaagactggcttttgcgtgcgtttatggcactctgtgctgcgccgtacctggaggatattgagcttacggctagaggacacctgtacaacaaggctgttgatgaagcgagggcggagatggccaaacggcagaaagtggcgaaggaggtcaaggaggtggaagagaaggagagtcagaagtctgtgagtatgagtgagactgagcagcggaatgactttgtgggacttcggaacccggtgcaggtagctactggagtcgttgaggttggttcttagaatagcctctcgacagacttattcgatcacaatctaagctatctattactcagactattc

SEQ ID NO: 5077 - DNA, 833 bp, Sorghum bicolor
  Clone ID: SORBI-28MAY03-CLUS99821_1
gcacgaggagtaacaagcttagcatcaagcacagatggacttctacttgtctctggatttgaggatggtaatgttcgggtctgggatactagatgtcagcaggtgacccgaaaattcaaacactcccaaggtccagtaaccaatgttctgatagtaacgccacaacgagtaaatctgccaccactacaaccattacgcaaagtttgctcagcaaatggggaggctgaatggcgggcagtagttcttcctcggcctgaaaatgatgttccaattcctggaaataaaacctccatctttatggagcgctacttggatgagcttcagaagcatggtggttcttccaggttatttgatttcgagctgaatgctcagaatggcactccaaaccaacagggaacagaatggagagatagatacttggagttgcaggatctctttgtacatgaggtcctccatcagatgccatcctcgaggaacccatgatgcgcatgctttggatatcataggttgctattgtcaattaagatcatttgcggtattgaaacagtgatggttgccattcgggccacaaacgatgtagatgagctctttggagtaattcaactggtggtggctgtggggtgtaattgagggtgcctgactgcctttggccgcgaggaacttttcagattcttagtaaaatcactagaatcgctgccaaagttcacttggaactgattctcatttttgtactagtctcgataaacacaaaaacctagtttctcttgattctattctagttctaattttaagaatccagcgagctaggtaaataaagtgattttgatttatta

SEQ ID NO: 5078 - DNA, 418 bp, Sorghum bicolor
  Clone ID: SORBI-28MAY03-CLUS99827_1
ctcttccgatctcaagggcaacaccaactcctccatcttcgatgccaaggccggtatctctctcaacgacaacttcgtcaagctggtctcctggtacgacaacgagtggggttactcccgccgtgtcctcgacctcctggcccacgttgccaaggtcgatgcctccaagtaagcgtagagcgctcatgaggctggaagcaaaaccaaacctaatcaggcgcgacatgatgacgatgccaatctgccgcgtgttttaatgaagcaaggaaatgaaaggaagtaaaaataccaaaattaggggagattgtcggaggggatgacaacggctttgttctcatcggctccagttccctactagacaattgatcttagtatagccgtggacagaaaaaacaaataaatagatccatccctcttg

SEQ ID NO: 5079 - DNA, 678 bp, Sorghum bicolor
  Clone ID: SORBI-28MAY03-CLUS99848_1
gattggccaagctgtgcctgaataaagagagtgctatctctattgctggtgcaagagggacaataggttatattgccccagaggtctactcaaagcaattcggactagtgagtagcaagtctgatgtctatagttatggaatgatggtccttgagatggttggggcaagggacaagaataatacaagtgcaagtgttgagtctagtagccaatatttccctcaatggctttatgaacacttagatgaatattgcatcagtgcttctgagattaatggcgagactactgagctcgtgagaaagatgatagttgtaggtttgtggtgcatacaagtgattccaactgatcggccaacaatgactagagtcgtcgagatgctggagggaggcacaagtaatctggaattgccgcccaaagttctcttgagctgacaagcatagatattttcctactaataaatgttgctagcgttagcaggttgtacaaatgcaaatatttgttatatactatgcagaactaagggcgtgtaccgaatgctatttttgtcctgtaaacatagatgtaattaataactacataggaatttctggacacaaacgcaaatatttgttatgtaataccgactgatatttttgtcctgtataaacatagatgtaataactacataggaatttctgg

SEQ ID NO: 5080 - DNA, 661 bp, Sorghum bicolor
  Clone ID: SORBI-28MAY03-CLUS99859_1
gggatgccatcatcccactcagctacagtgacagcacttgcagtgtctgtgggaatccaagaaggctttcgtagtgcaacctttgcaactgcactggtctttgcatgcgtggttatgcatgatgcttttggagtccggttacatgccgggaagcaggcagaggtgctgaatcaaattgtctatgagctgccagaagaacacccattatcagagacaaagccattgcgtgaaatccttggacatactgttcctcaggttgtggccggttgcatccttggaatcctcatggctgtcgttatgcacttggctctcggcagttcttagtcaagtgttgttcctggatgtcgtgacagatcaccaaatatctagctggtgatggctacaaagcatgaaaggatgatctccccatggatctggttgtctcaagtgtttgacagtacaaagttctaactgatttagatctggactgtaggatataggttgtagctcgagttggttgttgtaaatctgaaaagttttactttcaactccaaccacggtgtgatggaagctttgttatacaatcagcagcagtaagatcattcttaggtaatgaaatggatatcacgccatcacattggctttctgcttccttcattccaaattgtaagtattcataggt

SEQ ID NO: 5081 - DNA, 478 bp, Sorghum bicolor
  Clone ID: SORBI-28MAY03-CLUS110019_1
cggggtttcagcacccgccgccgctcacgcccaacttccccgcgctgtctccggcacgagggaccggcatccttggcccagggcccatgccgccgccgccgtcgccgggtctctggttcccgcagtcgccgtctgggctcctttctccatcaggcttcttgccgatccttagcccaaggtggagagatatatagcaaggctgcctctgacggtcctgagcaaggcggccgtgtaacatttgacggtagggacatagccacggtgaggtcagttgggtcgtccgccggagttggctggagaaacacacacacacaggtgggttgtaactttggacaccgatatttgttgctgctacttactgcttctgtggatgattagtcaagtatgtctgtctgtaaggtcttggtaaaggagattggttatatatttgtaattgtataactggggaacatttcaattcattcaaaaaaaaaaaaaa

SEQ ID NO: 5082 - DNA, 908 bp, Sorghum bicolor
  unsure (1)..(908): unsure at all n locations
  Clone ID: SORBI-28MAY03-CLUS11047_1
gctgcatcatccttggtcgagcagatagcatcacttgcagcaactatgctttgtcatgctggtggngtgatattgatttgtctcctctacgagcagattatgcccactctgctgctttcaggtggaaaagctaagcttggttccgctggtcaggtatgcagcataatcgaaggattcacattagctcatgttctcctcgtttcgggtgcaagcatctggggagtcggagaaacgtcgccagcttacacttcaatatacacatccaaaaggcaacgggttgtcgatagacacttggagttcatgaccagggtaatggagggtaacattgtgctgggctgtggcgataccacatggaggtcctatgttgtctgttttgtcaacttgctggtcaactttgtgcccacctggattcctgaagtgaagctaaagacgctacagaaattggcatctgggcttcagagatggcacgagggtgatcttgccctctctttgcttgagcgagggggagccaaaaccgtgacttcagtagttgaatcccttttgtaataagcaggtgctcaactggcagtatagttttctacgacagcttggtcaatatacacacataacatgttattgatctgagaattcagtcatcagaaaaaataaacagtacagttctaccgaagcttgattgttcatattgtcggtcagctaaagagatgggcagcagtttttatagtagttagtagtacatgtcagtgtgtaattaatgaacttgtcatttactggcagtagtccatttggggtgatataaaattcatggaataattgaaaaaaaaaaatcagtattagaaaacagtattgctgggagcctggagtccgttccatcggacgacccgtgcagatgtgccattagttttttgctc

SEQ ID NO: 5083 - DNA, 852 bp, Sorghum bicolor
  Clone ID: SORBI-28MAY03-CLUS110570_1
gcacgagggaagagctcacgattcctcgcagcattcaatcagttatctgcctcaacctgccaagcttctcgggaggattgaatccctggggaacacctggcactaggaaagtacaagacagagacctgactgcaccttacgttgatgatggccttatcgaggttgtcggcttccgtgacgcctggcatgggctcatcttgctggctcctaatggccatggaactcgtctagcacaggcccatcgaatccgtttcgagttccacaagggagcagcggagcacacgttcatgaggatcgacggggagccatggaagcaacctctccccaaggaggacgacacggtggtcgtggagatctccaacctccgtcaggtggccatgctggccatcgacccgtgcaggtcgaagagcgtgaacgagccgtcctccccgttgtgccacagccacgaggacgacgacagcaacagcctggaggacgaggacgagtgggaggacgggaggaagaagttcggcgcggcggccaccttcaagatccctgacgaggtcgacatcgctcatcttagttagaattagaaacccgtccggctgcttctgcgttcgtgatgagtttgtgcatgcggttcccgggggtttattttaggatccatttcagtgtcttcactgctgctcttagtgataccactcccttttttttttacgagttcagatttcagaagctaacccccgctgttagcgaaactgctcattttgctatctacagctatattctgtaaattcaagtgtaacagccatgtgtagaccggctgcattgcactgactgaaaattttctgtgggctacgcccattgggatcg

SEQ ID NO: 5084 - DNA, 557 bp, Sorghum bicolor
  Clone ID: SORBI-28MAY03-CLUS11022_1
gctgaatgctggaatgaggccttcacattggttttgctccaatggtactctacaaatgatgtaattcttatactgtcggatgctagcaccgaaagtgttcagtagcaactgcatgccatatttcaagttggcagcaggctgaaagaacaaagagctttttgttcacttcagtttctttgagatccttctttttgtgagggagtttccgaagatcctgtcagcatgagctttgacatgctttcagctggaggtcactctttctgtgtgtcgtcttgtcaatgtaaacatgttgttacagtactgagcaaaacaaaaagatgagtggagtcatcaaacatttcccccattacagaagcaagtgtgatgaaaaggtgacacctcttgtgacacatgtcctcacagttcacagcagatctgattcggtggctgtatcttgtagggtgctgttagacatgttccttgggggcaagaagctcagttgaacctttctggaacagctccacgcatgaacatcacgacgcaacatggtcagtgtacagtggatgataagtaagagc

SEQ ID NO: 5085 - DNA, 755 bp, Sorghum bicolor
  Clone ID: SORBI-28MAY03-CLUS21056_1
gccggccgggctgcgcccctcgtctcgtcacctactcacctcgttcccgaccacgccagccatggacgccctgacgcgcctccaccgctccctcgtcggcggcgacgacgacgaggatccgccggaggactccatccttgctgacaccgagggcctctgctccctctcccctctccagaggatctacgccttcgcggcatgcttggtggccggactcgccctcatgatcttgtcttttattgtcttcgtgagacctatcaagtttgcagtcatgtttacgtttggaaacatattggcagttgggagcacagcctttgttatggggccacaaaaacagataaggatgatgtttgatccagttcgtctgtatgcgacagctatttatgttggatgtgttgttttggctctaatctttgctctttggattcatgacaagctgctaacgctgattgcaatcatatgtgagatctgtgccctattttggtacagtttgagctacattccattcgcgcgaaggatggtttctgacctgatggtgaagttatgtgacactgaactttgagctgctgcgggtaacatagcactcttcggggtctgtgaaatcagggaatagaatgggtgcttggtcctttgcccatttcctttgggtttaacattgtttcgtaaactacgagctagcatggtacttattttgtgtaaaaatgaatgccacaatgcagtatttttaaagcttttactgcatgctcaaaacagag

SEQ ID NO: 5086 - DNA, 506 bp, Sorghum bicolor
  Clone ID: SORBI-28MAY03-CLUS9993_1
atggctagtagttgtcttctttgtgggcagcagtaattctagttttaatgtgaagaccatttgacaagaggagatgctaggctatactataatgtactgtagtatccagtctcggtatggaacatgcgggcgctggaaagaggttgtacattcgacaaatcacagaagaaaagacgcaatcatcatcatctttgggatggtgatatgctgtgcatgtgcctgtggattctcggggtccatcttagcggcgcgggttagtcagtctcagtgatactgaaatgttgtacgtcaaatgcagagatacttattcagtatgttttaaaaacatttttacgctgcgtttcatggaattcaaggagagtgacacccttgatcagcatcacatgtctctcgcccatcttgatcaatacgtcatctccttttgtgtgtgtgatcaggttgtctgccactccgttgcccggcaacctttttgtgtacttttattgatcgagtagaaagaattatat

SEQ ID NO: 5087 - DNA, 616 bp, Sorghum bicolor
  Clone ID: SORBI-28MAY03-CLUS99949_1
gcgcatgaataagactaagtgattagtcaacttcttagaaaagacagtgtattcttttttcgacaaatacaaggaagtggaaggcaataacaggtctgtgatgccctttagatgttctgggctgcacgcgcgttacactgaaagttgcaaagagtgcgttgtgcttttcttttcctgcgagcaagatttgctcggggggggggggaggcgcctgcagtgaagacgagcgggcaaactgtcgatcaacgactttcgtgatggggattgatgattgtaattgttcatcatgaacgaggaatacctagtaagcgcaattcatcaaattgcgttgattacgtccctgccttttgtacacaccgcccgtcgctcctaccgatgaatagtccggtgaaatacaggaacctgacgagagaaaggaaactctattgaatcttattatttagaggaaggagaagtcgtaacaaggtatccgtaggtgaacctgcggatggatcattcaaaaagaaaaaagaatataaatatttatttaattatttatatttaattatttatatatttatatatttaaaaaaaaaaaagaattttattttattgttttttattatttaaaaaaatt

SEQ ID NO: 5088 - DNA, 892 bp, Sorghum bicolor
  Clone ID: SORBI-28MAY03-CLUS99950_1
gcacgagggccgtggctgtggccagggagctcggtgcccatgggagggtgttcgccacggatgtcagcgaggtggccattgacgtcgccaggctcaacgtccagaggtacggggtgcaggataaagttgaaataaggcatggctcatggtttgaacctctgcaagatttgaaaggaaaacttatgggtgtgattagtaaccctccatacataccaaccgatgacctaccgggtctgcaacctgaggttggatggcatgaaccaaagttggcgctcgatggtggtaaggatggccttgagcatctgctccatctctgtgaagggttatcctcagttctggaacctgggggtttctttgtttttgagacatcaagcgttttgtaacgggatatcgaagatgaacaatggagcacagatgttagtgtaatcatttggagacatgttttgtctctttatgaccaggaccttcccatttgaaaaatgagatcagtctgggctggcttcggcagaaagcaaacaacacatacaattgctcctttgcagagcttatcgcttggagtttaagcctgctggtggcaataatatatcacaaagtcaatcttaaattcatattcataatatatattgtttaggcacgcgaggcaatatgtttgccagagccaaactacagatagatggtccaactgcccaaggaagctctacgatagtagacaagagccctgcggcagtttgcttttagaaaattgtagcatgtatttggccactagttttgtggctgagttgggtgatgattgtgatttaaagtggaggctttttggcgtccaaaattattccgccgtccacacgcccaccttgtgtgcttcattattggtgatgtggtcccagttatgttt

SEQ ID NO: 5089 - DNA, 558 bp, Sorghum bicolor
  Clone ID: SORBI-28MAY03-CLUS9999_1
gggatgtcaagtacaggaaattcatccctggcataagcaaaagccaggagtttgacactaaggaaaggcataataagcaaagcaggttaagcaaaagtaacagccattcaccaagcagtggcaaccgtaaagaggtgctatcaatcaggaggctgcttcctgtgatcgactttgagatcgaccggacaaaagcccttgatatgatcgatagagttgacaatctgagagtacaatgatgaatctagattaatcaatgccaaagtctgaaaatgcaccctcaatctatgatcctgaaaatcaagattgcttgaaggatacaagtaatcggccgagctgagttggcatgctgtcagcacttctgcagcaatgtgcctgcttgagatgaaccggcatcacggtgcccgtttgaaggcaccatgcggctagagatggggcatgcccatgtctggcacttgatgatatatgcaggtatagaaggaattatgtaagggttgtggtctagtagcaagatgagttggaggagggggataaaaaaaattttattttttttatttttta

SEQ ID NO: 5090 - DNA, 444 bp, Sorghum bicolor
  Clone ID: SORBI-28MAY03-CLUS99981_1
atctcaactctgccgatatccaggcgaccagacgcactccgagcacactacatgacacattttggcacactcctctccgaggaccttcaggccttgattcaggtcctctttatcaacccaggtcctcttatccggtatcaccgccatgtgaagatcagtataacataacagaattacaagcaatgccgcaaacgatacatcttgattctcttgggtcacggtctccataccaacgtcgcggaatgtcttcatttcctcagtatttcaacgcaacttgccaagaaaatgctttaacgtccagcttttcagggaacgaaatagagagtttatctcctccggtattacaaactcaactactgggtcctccaaggctccctccaaggggatctccggaaggataaagataagaggggttaatcttaatataaagtttaatatatattt

SEQ ID NO: 5091 - DNA, 798 bp, Sorghum bicolor
  Clone ID: SORBI-28MAY03-CLUS10001_1
gcacgaggctaacccggcgccgccgaatcctcctttcgcccggcttccgccccgccgtagtccttctcctctcctccggccgacggctgctgctcctctctcgctcgagcgggcttggagatccgtccgtcccgggatcatttgctgcggcggttttgcttgggaagatggcaaacatacgtgcacttctggtcggcttgtcgcgggcaaggggttccttagcagaggtgggcagatgtgcgtccacgaggccatcacttctagcatctctgggcgcacattacaagatccccatgccagcccactggttctcatctgcagggcttcctccacatctggtggttggaatgccagcactatcccctactatgaatcaaggtaacatcgcgaaatggagaaaacaggaaggagacagcacgggggttggtgatgtgatatgtgagatagaaactgataaagccactcttgagtttgaaagccttgaagaggggtatctggccaagattttagcacctgaaggttctaaagatgttcaggttggacaacccattgctgtcacggttgaagacctcgaggatattaaaagtataccagccgatacatcttttggaggtgaacaaaaggaggagcattcaacagaaagtgtgccacaaaataaagtagttaatgtgcctgaacaaacctcaacagtgagccggatcagcccagcagctaagttactgatcaaggaacatggactggatacgtcatccctgagagcaacaggcccccgtggcacccttctgaaaggggatgttc

SEQ ID NO: 5092 - DNA, 981 bp, Sorghum bicolor
  Clone ID: SORBI-28MAY03-CLUS99735_1
gcacgaggctgacgagttggaggagaacgaggaggtggaagatggggatgacttcgacgccgacgaagaagaagaaggcgatataatggacgatgatgaagagtttgaagacgactataactttgaagatgattttgagagtgatgatgaacaggatctttatgctggagatggaggtgctggtggcggaatatcccttgctggcacatggtgggacaaggaagcattagctttggcagaacaggtctcagcatcattcgatgatgacttgaaaatctatgctttcaagacagctgcaaatttgaccattagagtacgcattgagaagatgtccaccaggtacggttctccaactatagatgacattgaagcttacacaattgcataccgtgcaaagttggacgatgcagagtcaacaggaaagataccaaagaacatatcgttggaggtgtcatcccctggcttggagagagttatccgtatccctgaagagcttgagcgcttcaaagaacgggcaatgtatgtcagatacactacaacaagcgatgaggcagctacgcctcaggaaggcgatggcgtgctgaggctaatctcctatgacatggacctgcgagagtgcatctggggcatagctgacgtgaagataaaccggcagcagtctggcaagggcaggcccctgagcaagaagcagagggaatggaggctgcagacaccgtttgagtcgctgaagttggtcaggctgtactctgaatgttgagatgccaggttttttgagtaaattttgagtttccttttgttgcactccattcagaagtttatccatttttctgaactccggtaggtcgctggatgcgcagtttatactagttagaatgttgttgtgctatctctgtcacaatcaatgataattttttttctactgctaacagataacaagttaagaacagaggtttagcccacaaaaccagtgttgtttgcctc

SEQ ID NO: 5093 - DNA, 786 bp, Sorghum bicolor
  Clone ID: SORBI-28MAY03-CLUS9974_1
cccacgcgtccgaagtgggatccgactggttcttttttggcttcatgttctgatgattggacagcaaagatatggagtatgaaacaagacaaatgtttattcgatttcaaggagcataccaaggaaatatacactattcggtggagcccaacaggcccaggaacaaacaatcctaatcagcagttgctgttggctagcgcatcttttgattcaactatcaagctttgggaagttgagcatggacgccttctgtacagcttgtctggtcataggcaaccagtgtattctgttgcatttagccctgacggtgaatacttagcgagtgggtccttggatcagtgcctacacatctggtctgtgaaagaaggcaggatcctgaagtgcctacagaggtagtgggggcatattcgaagtttgctggaacaaagaaggcagcaagattgctgcctgtttctcgaacaacaccgtctgcgtgatggatttcaggatgtagtccaactagtagggtagtgcatgtcaagcctaaaacaaggctgggtcatgtccttccaatggaaatgtgtggagggcggacttgttagcaaaatgtagatcttaggtggctttaatttttatccatgtacagtttttttcctggtcatacttaccttagagtagcaatgtgtagttcgaatgccttaacagggttcagtagcatggaaatgttttggtgataaaggccttgtttagtttctcttaaaaaaaaaaaaaaaaaaaaaaaaaaaactcgagactagttcctcgtgc

SEQ ID NO: 5094 - DNA, 511 bp, Sorghum bicolor
  Clone ID: SORBI-28MAY03-CLUS99754_1
ttgcttccagaaaacattttattttatgcatttctgagattaaaaacttaagaagaaatcgcagtcgagattttagtgttcagaattctaaattcatttttaacgtctttgagttcaacatttcagagtttatgcatctcgatgtgtatatcactcaatgcgtctctctattgtcgtcgcaattgtatatatgcaattgctcactcattggttcttcaacaacttccttgagcttcgaaattctttttaatttcatatgaaatttgaattgaaaagaaatttgacctcacaacagctgacatgaaaatggtttacattgtattgggattaactgtgggtaaaatggtgtatatacgatacgacgaccaatatggtgaaaatcttgttgttcaatatatcagattagtgaagtggatgttaaataaattttcgttttctcgtattattcacactgaaacattgtatgaaatgcataaatatatttaaagagaattaaataaagctatttaat

SEQ ID NO: 5095 - DNA, 618 bp, Sorghum bicolor
  Clone ID: SORBI-28MAY03-CLUS99766_1
acgctgaggttatgcctgctcaatgggaatatcaggtcggtccctgcactggcattgaaatgggtgaccaactttggatttcacgattctttttgcatcgagtcgccgaggaattcggtgcaaaggtttctctacaccccaaaccaattgcaggtgattggaacggagctggtcttcactcaaacttttccaccagagccatgcgcgaggaggggggtatgaaggtcattgaagaggccttgaagaagctcgagcctcatcacgtcgagtgtattgccgagtacggagaggataacgaattgcgcttaaccggccgccatgagacgggatcgatcgacagcttctcctggggtgtcgccaaccgtggcacaagcatccgtgtcccacgcgaaactgctgctaagggctatggctactttgaggatcgtcgccctgcttctaacgccgatccctaccgcgtcaccaaggttctcctccaattttctatggcttagagcgagttttggagtttttttgctttctgatgacatggtctacggcgtgaaggtttgggaaactattgattacatagacagcatgatagcttgtcctgaaggacagtaatgacaaccaatccgt

SEQ ID NO: 5096 - DNA, 513 bp, Sorghum bicolor
  Clone ID: SORBI-28MAY03-CLUS99773_1
accccccagaaagccaacctaagccggctcatgccaacggtatctctgcgagcgattctaagaagcccaccagtgcattcgagctgttttgcttagaaacacggcctggtctcgagagcaaggaaaaggccaatgaaatccctgtgaacattgaggatgagcttactcgtatctggaagggtctctctgatggtgagaaagatgaatacgaggcaaaattcgaacttgcaatggccaagagcgatgaatcgaagaaaagccccgcatctgacaagaaggatgataagcctgctgagtcaaagcaactcgttcaggacgaggacatagagatgggtgatgacactgaggatcaagatacacaggctggcgagaaagtagaggaatgaggacatccattcaatgtctccaggggcgttttggcgggtatacaatttcgcatgtcatgacatcaacccatgtactagtaattagatgcttttcacaacaaagaaccaagttccgagaaaggattca

SEQ ID NO: 5097 - DNA, 500 bp, Sorghum bicolor
  Clone ID: SORBI-28MAY03-CLUS100373_1
gcacgagggtcttgatcaactgtcggagcgatgtgtgtcgtgtctgtacaacattgttgagaaacacaaaggggagcgagttatcctggtttcacatggcggcaccatcagagaactctacagacacgccagccctacaaagccgctccactgtaaaatacacaacacgtcagtgagtgtcatcctcgtgtccgattccaccggtcgctgcatcgtcaagatgtgcggggacatcagtcaccttcaggagacgggcgtcctggagaatgcctttggtggcgataagaactccgcctaagatcccagatttgggagcatcgtagtacatacaacatttatcacgtgcagaatacgcagcatttatcacgtgcagacactactcgtttcggtcgtatttttactgtaccaatcagtcctgttgctatcagtattcagtaatggtctactagtggagaatggtatactttcccccgttgggaacgcgggaattttgccgaacc

SEQ ID NO: 5098 - DNA, 444 bp, Sorghum bicolor
  Clone ID: SORBI-28MAY03-CLUS100400_1
cgccgcccaaacggggccgccaaagccgcacggcgacgtggagtccgtcctcctggcgctgcggcgggtgaaggagcagctgcgctacaccatcgagcagcggtcgcagctcgtcgtcgcccaccaggaactctacggccactgagcccggccaccgggcgcgctgcactacgaaaccttgtgattcgcccccttctacggtgtcgaacattcacttgtctgcctgcgtgaatattcgtaccgctgtttagggtgcatctcttcattttcagccgcagtgattcttatactgtagcagtttagaggggcacctgtagagaacggaataagacggctcatgtggagtcactatttaactttatttgcttctgttgactgatgagtatatcgcagagaatgtgatacggttgtcagaggaaatgacaacggcattttgctggatct

SEQ ID NO: 5099 - DNA, 830 bp, Sorghum bicolor
  Clone ID: SORBI-28MAY03-CLUS100430_1
gcacgagggcaagactgacgcttgctccaacagcgctggtatctgccctcccgtcgccaagcgctccgaccctactgtctgccctcctggaaccggcttcttccaatcttgctccaacggtttccgtggttgctgcaagggcgatgcctgtggtcagaaggagcctatctgccccaccactgtgaacaagcgatctgatcccactgtctgcgctcccggcactggcttcttccagtcttgcagcaatggtttccgcggctgctgtaagactgacgcctgcagccagaagcagcccatctgccctcccgctgttgccaagcgatctgaccctactgtctgccctcccggcaccggtttcttccagtcctgctccaacggcttccgcggctgctgcaagggcgatgcctgcggtaacacctggtgccccgactacaagaccggtacctaccagcctgcccagagcctcgaggtcaagacccgctcttctggcacttgtgctcctggtaccggcttcttccaggtctgtgccaacggctttaagggctgctgcaagaaggacgcctgctgctccgaagcagccctgtctgccccaagtaagaggcggtcactctcacatttttccagtaatggttttacattggcatagcgttgcatagaacattactagcgtgcatagatagatatggtgtttgtcgattcttgtttggaacagtcctttatgagttattatggcattgattgagctcctattcttggtatttacttattcagagcattgattttgtcggacacgataaaaatctaactaatacactcctttaaaaaattcg

SEQ ID NO: 5100 - DNA, 751 bp, Sorghum bicolor
  Clone ID: SORBI-28MAY03-CLUS100437_1
aagtgtataataacacttgcaatgtattgatcagatactatgaatctatgatagcatgtcagttccacttatttatttgtctttttaccacaccttcacatgtacccatttgtaacaactgtgttcatgttacaattgcatccatgtttatcattctttttattatttgccctagaacaattgtgccatgtgtgttttactgatgtctgtggtctagcttcaatgatttttatgtaatatttgatgtttctcaatgaacaggcttgctgatgaaataaaacactgggttttctcaaggcatggggcgagcataagctttcataggccatctatatcatcagtcagaatgcatggtggtcttatctccatccagttctacaagaaaaatgttgcagctataagctcccacagttcccctgcagctctaaataatactggagtgggtacgaggctggaaatccatggcgagattaggagtgtcactgaataattagatggctgggcttaactgttaccatagccacgttgtgtcccctttgatcttgcatatgcttcagaatcacctttgtccggtatgccccccttgccgttggccctgtacagtgtaaactgttgaaaggtgaaaataccctttgcggagtactagtgttgtaaattatcacgagttgattggtgatattttggttgtgattttgttgaagccatttaggaagaggatacagtgcccgttaaaagtattggcagttgtttg

SEQ ID NO: 5101 - DNA, 616 bp, Sorghum bicolor
  Clone ID: SORBI-28MAY03-CLUS1005_1
ctcccggctcacgcgcgcgccactgtttgcgccgctgcgcctctcctctctccccctgtccccgtgctccccgcgcgccccgggggcgctccgtccgcccctctccatctccctctgcctctctctttgcccacagcttcccgcaccctccggttccgcccctcttcaccggctcctcttccctctcgccactcgctactcgctaggctctagcccctggtctggtcctcccgctgtgcctgtgcgttcacagcggaagcgcacaggcgcgagcagtaaggggccgctggaccgaggaggccgctggctgctctgccgcgctgcagcaaggctgcaaagctggcggcttctgtccaccgggcgtcgccataaacagtggagattcccatccccattttcccaattatggatacccagcgtcgaccgggggagcactgctgaggccgctcgcccgcctgccattgctcccgtcgagggtcatagcttatcctacatattgtagctcggcaacctgttcagatgaatcgacacttgatgtggagggacattgctaccatcaacagtcattcccttgttctccatcaatgcaaccaattgcttctgggtgcacacacac

SEQ ID NO: 5102 - DNA, 437 bp, Sorghum bicolor
  Clone ID: SORBI-28MAY03-CLUS99860_1
caagccagtctacctgctcgacttcacctacctgtcgcagctccgcaaggacgcgcaccccaccaagtacgacggcggcatcttcggcggcgactgcacgcactggtgcgtcgccgggctcccggacacctggaacgtcctcttctacgccgcgctcaccgggcaggactgattgatgactcattactagtagtacattttttacagacagacagacagacagtgttactttattactggtataagctagcttagggtggagtagctcaataagtaaaggaaaagatagcagattggtttcttatagttatagcgggggtcaaaagattttcaacccaaatgagttgatagaagaatgtcaaaagaaaaagattgtaattccttcctgaattcaatggcaattttttttggggggtggtttatacaaaggaacaaaa

SEQ ID NO: 5103 - DNA, 484 bp, Sorghum bicolor
  Clone ID: SORBI-28MAY03-CLUS99876_1
ccatttcgatgtttaacatctgcgaggactctctccttgcttctcccctgatcatcgacctggtcatcatcgctgagatgatgtctcgtatccagtggaaggctgcgtctactgacggagctgccaccactgagtacaagagcttccacagcgtcctgagtgtgctcagctacatgctcaaggctcctctgactcctcccggcaccccggttgtcaacgctcttgccaagcagcgcgcggctttgaccaacatcttccgcgcctgtgtcggtcttgagcctgagtctgacatgacccttgagcacaagctcttctaagcgttgcgtgctcaattgatgcaactgcttttacatagaatgaaagaggaggaattaggacagtcattactgaaagagacaacgtaaaagaacccaaaaaaaaggaggagagacaagtatcaactacatattcataggctccaaaattgaacatgtccattcttctc

SEQ ID NO: 5104 - DNA, 251 bp, Sorghum bicolor
  Clone ID: SORBI-28MAY03-CLUS99877_1
gtctctttaaccatcaatttccaatcaagcgcatccacctgtgcaagatttaggacaaacaactatccaatatatcccaaggtatatactgttacaagctgtaaatataagccatctatcatgtctatcctatgtatatgaccatcagctgttgtacgccataaaccaccaacatcactgttgtatgcctcaaactctatgtttcccccaagattgtatatatatatatggatcaaggcatttttttgtgc

SEQ ID NO: 5105 - DNA, 682 bp, Sorghum bicolor
  Clone ID: SORBI-28MAY03-CLUS99893_1
gcacgaggcacattccaagatgcctgcctaccactcagtcttcctcgatgagcccaaccagcaattgattggcaactttgcactcctcccccttcgtacacgcactcgtgggcccgccatccaattgcccgccctgcccgcagatgtcaccgagctgaccattgatgcctcgcacgaatcctacgaccctttagacgagatcctggccctgttccgcgccaacacattcttccgtaacttcgagatcaagggcccagctgaccgtgtgctcatctatggcattctctatgtgagcgacgtactgggcaagatcaagccgggcatgacacggagagaggctgagaaggccgtcatgaactccgccctcgacaccaactttgcgatccccggtgatgctggattcccattgaaccaggctttcgaagcccccccagacaggaactcggccgaagtgctacgacagtacatcatgcagatgcgccaggagctggcaacacggttactgaacagggtgtatgcggatgagaccaacactcccagcaagtggtggctaagctatacgaagagaaagtttatgggtaaggctttgtagagttgcagtgtgaaattagcgggctctgcagccatagaatcaaaaatcggatgaaagctgtacagacatcctgattcctagctcttaccg

SEQ ID NO: 5106 - DNA, 993 bp, Sorghum bicolor
  Clone ID: SORBI-28MAY03-CLUS9988_1
atagaaaatctgggcagacgtttggttcaagttcttcgccggaatggaccctttgtagttcttcacttacggtatgagatggacatgcttgccttctctggatgcacacatggttgcagcaatatggaggctgaagagctcacgaaaatgagatatgcctacccatggtggaaggagaaagtgattgactctgatgccaagaggaaagacgggctctgtcctttaacaccggaggagactgcactggtgttgcaggcactcggcattgatcgcagttatcaaatttacattgccgcaggtgaaatatatggtggacaaagaagaatggctgctcttacctcggcttatcccagtgtggttagaaaagagacattattgccttcagaactcagtcttttccagaaccattcttcccagatggcagcactggattatatggtatccttggagagtgatattttcatacccacttatgatggtaacatggcaaaagtcgtagaaggtcatcgcagatacttgggattcaagaagacggtactgctagatcggaggcatattgtcgagcttgttgatgagtacagaaatggcacattgagctggactgatttctcctctgctgtcatggcgtcgcatatcagccgcatgggtgaaccgtctaggaggcagatgattccggacaaacccaaggaagaggattacttctatgcgaaccctcacgagtgtttgcctgtagaagatttctcagccttgtgatacccgcggtacagtgaatgcgcggcctttcagagctcagaaccatatatatagcacactcgacaggattggcaaggattatgcgtgttgagttggcaataaaaggaggcctcgtttgttctgatgaacaagcatatgagatgagatgagatgaaggacctcctccttcggttagttaggttagatacagattcatgaaatgattcaccgattcttttttgttcagaataaacagacttg

SEQ ID NO: 5107 - DNA, 1115 bp, Sorghum bicolor
  Clone ID: SORBI-28MAY03-CLUS100725_1
gcacgaggaaagcatctgcggatttttgaatgtcccagtttgtctaagccttgggaaccttcagctaatggggagagccagggccttgatttcccattgcatctggagaagcttgagattgacaacacctcattctttaaaatatgtatttgcaagaagctcccgtttcttcaacatgttgtgtttttcatggctaataatgtgagagccttcacagaagaacaagagaaagcactttgtcaccttacatctctccaagtacttgacttctgctattgccctgatctgcagtcactgcccaatgagttgtattgctttcaatcccttaagaagttgtcaatcaaggcttgtccaggactacaatcactaccagaaaagggccttccagcttcactgcaggagctttatgtgagcaactgcagtgttgaactaaaggaacagtgcaggaaaatgaaaaatgttaggcgtgtctatgttgatagacatcgaagcaaattcataactgtgtgcaagatgttgcgtctctatttcaggaataggagaagatgagactggagcctagcagattcaataagcctatggagttgaggttggcgcagagttcgaaatcaggattttgctcaaccactgtaactcttgtttgctgtttcttcttgcttgacattactacacaaaagagccgtaggttaatatggccaaaaaacatgctcagttagtgctgctgtttgagtctagggctctacgccacagagcgatactgaatcacacttgcgatggagcttttcatgctcagatagtcagatggaatcttgggaaggaatttgtgcactggatcagtcacgagaactctcaaggtgtgtaatgatatgtaattatgtgtgatccatatttagttagaatactactccataatctgccagcttgaacgccgtttgcagtgtgattccttgttatgcaatcctttttggatattgcatcggaacgctaaagtttgctctcggttagttcctctgatacgcggtttgattgtttgaaatatgtgattcatcataaggattttggttagttttatttgttttacactaatttaatagaaggtatctgactctgctctg

SEQ ID NO: 5108 - DNA, 810 bp, Sorghum bicolor
  Clone ID: SORBI-28MAY03-CLUS100800_1
ttgaatttaggattggatggtggagtatgctgctattattggattaatcggtgaggaaggttagttagctttgtatttttgtagggtctggtgatcttgcatggagaaagggttagtgatgtcgactgattttgggttcttgaatgaaaatggttttttagttgtatttaacgctttataaatgaggattcttttctacccacagtggattaatcttggttgtgggcattttacttctatgtttggttgttccttaggaaggagcgggccgctgggcacctgggcttctgcggttccagccaggtctgccaggccttatcggcttagccatagggcaagctgcattttttggacgggtgcacaaaccagtgctctacagagttgttgcttctctgcatcatcgttgtccacctctcggcggtgtctaggcggccttcctggtggtgtggctcatccgtgcactcaacctaagaaaagttaatattggaacaaccctgtgctacatcagctctgaaggggtcaatatcactaaatcgggaagcaagcatggattttcaatttctactttgattatccaaaatattcaggcaagcaggtgcaaaggaagaacttcaacaaagttagctaaagtacaagtgttgtaggtaaggcctggtattatgcctaattcgctaggcatgtcatttcctacgcaaccagctcatggtgtaccacctcaaatgtatattctctatttcatcctgtctacttgcaccaatttaattatgttccccattctattccttatatacaagttattgatttgtatgc

SEQ ID NO: 5109 - DNA, 585 bp, Sorghum bicolor
  Clone ID: SORBI-28MAY03-CLUS100832_1
cactccaccattacctgttacacccacgcttccatctccccggatggtcctaacacccaaccaagatttgcaggtataggtattgtctttgtcaatatgcagggtgatcctgggaacaagctatttataaaggccatcatcaaggatgcttcctctgtaatcatggcagaagcgggtgcacttgcattggcagctcgaatagctgtgagcatgggctacaccaatgtctcattcttttcaggcagtagtcagctggtgcagttcctttctactcatgatcacagtcactctccagactggagaatgaagaacttcactcaagaatatgataactccactgcctccattcaatccaatttgtataagataaatagagcagagaatctagtggctgattcccttgccagaaatgctctgcctctagcaagcacggttcatcaaccgttctctttagattgctcctttagagctcatgaatctcagtgtcctatgtttcaggcactgaagtctgtaaccacaactatgcactctgtttggttacttgcagcttcttgctgctgatatgaatgaattgtgttttgttgt

SEQ ID NO: 5110 - DNA, 880 bp, Sorghum bicolor
  Clone ID: SORBI-28MAY03-CLUS10091_1
gtgaagcggaagccagtgaatgcagtggatgggaaacatgcagatggggagggtcgcaggaggcaaaaaatagaaaccagaattagttgtgctaaaattgctgctgttactagtacagctattaagcacacagatctacaaaacaagcatgcttcccacttgcctacatcagccacgccaagtactgaagccaatggtgtttttagggagcgtggcactaactctgaggagcatcaacattctgtagagaacacggaaacttcacgacaagctggcagtgattgtataaaagatgtgggcagtatgtctcccgagaaggctgtaaatactacaaacacaagtgattcagagccttattcagtaagatgactactccacagctggtttgcccctgtacccaacctgttctctagccaacaggaaggaattggaatgtggttggcttcgaaggctgaattcattgatatcaagctggaagcatgattggaggtgacatagattgcagctacctttacatctcaagtaaaattccagttacccctttttgagcctgtaaagttaattttccgcaaggaaagatctgacaaacatgagaattggaatgactgtagattcgaacattgaatgggccttgctcctgctgctgcgctcgctattgtatctgtttatgagctaatggagtagcagtgaatatgtgccttcaacttcattatttttcttcacaatcattgactctgatgttactgttgtaaaacaagtaggattaaggcatagtttctgttgaatagcgtttttgcaagagttgtgctaactcatctatacgattgtaatttgttggttcatagattgggttggacatgctgtcttggataattaatct

SEQ ID NO: 5111 - DNA, 715 bp, Sorghum bicolor
  Clone ID: SORBI-28MAY03-CLUS100837_1
tccagttaggttaggcaacttctttgtatataatatgttaggattgtttgctaggcctattgggtgggatggatgcctccttcaatccgattagcgtgctgctgccgtgcttggtaccctgtggcgtgcaagtgcaaatatgaagtcaacatgacttttacacttactgtagaacttcaaaagctagagagatgtactctaatgaattcacggaaaattacttagagcaaaaaatattttggactgcagtgccatgttcttaccatcataactaacaatagggattcagttgtagtgatttctgcaatttaatttggttttggttggtccactgatggcctcaacattgtgattctggcctctggtgtctggtactacagcgacgtcttccgcggttctgcctcaagttctcaaaaaaaatggtttgtttggattctctacatatgatgcctggtgggagcacatggtctgcgcacgctggtggactgggtcacagtggtgggcttggttggcctaccttggtttggtcagttaagaggtttttgtggtcaggtctcacgtctatccacgtgtattcacaaatgtatagtactataaatgcagatgattgtaaaccactaatgagaactttagccatccacaaaattcaatttgtaatcattattgttttttaactatacaacatatttatagttaaattattagagcattattt

SEQ ID NO: 5112 - DNA, 714 bp, Sorghum bicolor
  Clone ID: SORBI-28MAY03-CLUS100967_1
gcacgagggacagggaggagaggacaccgccccaaagctccgagccgcggcacctgcaagcacgggcgcgcggccgagaaaagcgcagccctgccgcgactctgccacctctccctcgtggtctcctcctccacttgctcctgctcctccagacctccacccctccaaaagggagccggcccccaatccctcttagcccggcgcacggcgcaggaaggggttcgatcggatcggcgccgtcggaggcgagatgtgggagtcggtggcgctgacgctggcgggcaccgccggcaacaacatcggcaaggtcctgcagaagaagggcaccctcatcctccctcccctctccctcaagctcaaggtggtcaaggcgtacgcgtctaaccagctctggatcagcggtttccttatggacatgtgcggcgccgcgctcatgctcaccgcgctctcccaggcgccggtctccgttgttcagcccattgctggttgcggtctcgcaatactctgcgttttctcccatttttacctcaaggaggttatgaacggcctcgattggattgccatcacgctagctggtctcggcaccataggtgtgggtgttggaggcgaggaacagaaagttgatcagatacctcttttaaatataccctggctagtgctctccattgtcatcttgtttgtactgctcaacacatggcttcatatgtataaaaa

SEQ ID NO: 5113 - DNA, 821 bp, Sorghum bicolor
  Clone ID: SORBI-28MAY03-CLUS10005_1
gtaaaaaaggtttcgctgccttattggcaagaagtttgttgaagtaaaaagaaaggtttcattgtctcattcgcagaaagcccagtaaaaaagtttgacgaaacgcataccaatggcattctggacatttcgtcactggcacaaggctggatagttgtgagctttgtgttcctctttctgtccaggcaacctaatgaagatggaaaagggtcacccaggactccagaatctgccatttatagttttgtccccttaaatcttctgtaataacaccaaacattgtgttaacaaatgtggtaggaaactaggaacggtttattttccagagtatgtagagatttccagttcaaacacatacagcagtatataagcaggtcagcaacaattcggcgtagacatcgagacgtggactgtgctgactaaccttcatgaagctaataagttatatcaagtgtttgtggtagaaacagagaagcattcttcagtggtctttcaaagaagttaacaaaattttgaatgccggagttatcactgaaccagtctttttctttgacggggcagtccttccagaaactgaggtgccctatcatctgaaattttatctattccctacaggcgttatatgttcaatgtgaaaaaagagctgtacaagagttcagtctacccacgagaattggctgctgggcagcgatctgtgtgactgtcatgcgagtgcgcgcagcgtcaggcatagctggctgggtgttaccattccacatctgaatatttattgcgatgcaaatgaaagtggcctactagttaaaaaaaaagctgttgtttgc

SEQ ID NO: 5114 - DNA, 573 bp, Sorghum bicolor
  Clone ID: SORBI-28MAY03-CLUS1001_1
gcacgaggcagcaccacagcctgttcttgaacaagggaagagtgctccttctgtcagcggtggtgactgggcatcttttgatgcttttggccaacaacaaacaccacaaacagcccccggtgtaaatcctcttgagtctgcacttgcacagctgtcattctccgaagcaccctctgcaccgaatgcgtcagcttatcctgcttctcttgatcccactgtgaaagcaaatgatggaggacattcatctgtgctagaccattcacattccttgtttgatgcgccctttggaatctcaggcaaccaggcctcaacagtaatgtctggccaaggatcatcggttcaacaatctcctctagctgcccctacggctggatttccatctcaagctactgcaaatccgcaaggaatcagtggtattcaaggagcagcctcttctactgacagtaaattcagtggcaggaaagaacttccagcggatatcttcactgcactatatccaccatcaactccaatgatgcctggttggcagagagctccccaatttggaatgggatacgccatgcaatatccagc

SEQ ID NO: 5115 - DNA, 441 bp, Sorghum bicolor
  Clone ID: SORBI-28MAY03-CLUS10007_1
gcaaaagcgaaagctttccccttccatccttccttcccctgagagaggaacgggtaccagccaccagccaccagcgatgggctcccgctacgaggtggaggtgaccgtgggctctgcccgggacctcaagaacgtcaactggcgcaacggcgacctgaagccgtacgccgtggtgtggatcgactccggcgccaagacctccacccgcgtcgacctcgacaacggcgagaaccccgcgtgggacgagaacctcctggtctcgctcccgcctacctcccgcctcgacgacgccgtcctctacatcgacgtcgtgcacgccaacgccgccgagggcgtcaagccgctcgtcggatccgcgcgcctcccgctccgcgacgtgctagacgacgccggggtcgggggcaaggcctcgcgcaacctccgcctcaagcgcccctcggg

SEQ ID NO: 5116 - DNA, 734 bp, Sorghum bicolor
  Clone ID: SORBI-28MAY03-CLUS100160_1
accacagcttaaaaatctctacctgacaagctgggatcaattgaaatttataaacagtagctcttatgtttatggtcatggtgccagtttcctatctttgaagaagtttcatttggaggggatgcacagcttgcagcgatgggaatgggatgagctgtgtacattcgcccctggtctgcgtgagcttgttgtcaagaattgccctcaacttcgtgagcttccacggtgcattcagaaccttcgagacttggaagacatggagattgttggctgttgggagctcgctctcctcccacatttgaatggccttacttcactgcaaagactggagatttcagactgcaattcgatttgttccctgccatgcactggcttgcctaggtcactgcaggtcttgagcataaacaattgtcatcagcttagccactcttgcaagaatctgagaagcatcatctcttcggtgtggatcgacggacatcgtatttagtctggctgtatgagtgtactaccatgataatgatatatatagggctcaagtaagatttagctaggattctgaagttcctgaaaagtagactctgtacggttctactagagtttggggtttaaactttttttttgatcggctttgggggtttaaactttaaatgatagctaggattttgaagcacatttacttcctagaatgtgaaccaaacacaaccttaattccagcgattgtaccatttcatctc

SEQ ID NO: 5117 - DNA, 879 bp, Sorghum bicolor
  Clone ID: SORBI-28MAY03-CLUS100356_1
tccctagtctgtacactctgagcatcgcggtcggggatgtgtttggagcaaggcacctcctgtacggtgaaaagtcccttgatacgataacaagagttaacgacttggttttggttggattggggcatgtaattggttatcccatcgcttctgcgtccgttggtgcactgcggggcttattgacaaacaatttggtcgcactaaaagggtcctgcccaaattgtggtgagcaggtatttgcatttgttaagactgataaatctgttcgagcacctcatcgagcagaatgtcatgtctgtgaatgccctttggagtaccgcacgaaaattgagaaatctttgtcagggcctagaagaagttgggtctatggccgggtttatctagtgaagcaaggacatcctaggaaacggaaatggataaatgactaaaattttagttgcacctgctgaggcaagtttagataatctcatgagatggcactcttctgatcgactgaaacatttttcagatgtcactcttatattgatcagaagggcttactttgtacgaatctttgaaacattgatcaagtcaagtgttttgtaaaatggatacattcctttctgagatgtgtccatacgcagcggaatgaaacccatgctgcatttttttttttctgtttttcgtgtttagataaacccaggatacaatttggattgagaactactcaagaggttaggaaggtgtcattgctatcaggagggagggttgctgaaaggccgacgctcatttgatcgaagatgtgcgtgaattaatttatcctggataactcagcatgtatacagacttgtccaaaccgtgatgtgttatacaaggtatatatatgaagttttcagggtt

SEQ ID NO: 5118 - DNA, 506 bp, Sorghum bicolor
  Clone ID: SORBI-28MAY03-CLUS101260_1
tatgccgcccagtacgcccagtactacggtggcgcagacccttacgcagcctatggtggttatgctaactatgttgctatgtaccagcaatactatggagctcaggctcaagcacacgctcccggcgctcctggtgccacccccggacagtcagcttcacctcctccgcccccgggtgaagccgcccctcctcctcccccaccgcctagtggcacctccccctcctcccccttctgggtcccctcccgggacaggtgggagctacggttcggttccccctccaccgggcctctgattcttgattgggtcatccatcaccaaaggggagccacagaactacagattttgacagaaaagcatgccgctggatatggaattccatggctatgtacgtgaacgctccagtttacattgcagaaagaaagagtgttgatttaggtctcgtatgcgattacgagctatttgagtaggaattcacatcgaaccatctttgtatggatgcgatt

SEQ ID NO: 5119 - DNA, 469 bp, Sorghum bicolor
  Clone ID: SORBI-28MAY03-CLUS101320_1
gcacagatccctcccagcgtcaatgggaagtaaaaacctggtccgacgcacaagatctgaaaatcccaggcaccgatggcataccgggccgacgcgagatcacagtccgcagcatgatgggcgactttggcggaaacgccggtctgctgagtctctggttcgaccaggaatcttgggagtggaagtatgagtacgccacgtgtccgctgggaagccagcacttctggtggttcgtgcacatcttcgactttatcgtgctggtatggatgcagtcgtacgctgtgctctctgtgatggaggcttatggtgttgatgtggacgggccgttttggaggggcgtgtcacggatgaaggattttgtgctgcggcggaaacaaagtgtcagtgataagaagtaaaactatttggataaaacgatgtttgggttagtgatattttcttcatagaatacaaagcgttctgatttcgt

SEQ ID NO: 5120 - DNA, 834 bp, Sorghum bicolor
  unsure (1)..(834): unsure at all n locations
  Clone ID: SORBI-28MAY03-CLUS101391_1
ggcctgctaatgaggtgcatctggttgagtggctcaaaatgatggttggctcgagaagagctgaggaggtggtggatcctgacatggagttgaaacctaccactcgggctctgaagcgtgcccttctagtggcactgcggtgtgttgacccagactctgagaaaagacccactatgggacaggttgttcggatgctcgaggcagaagatgtcccatcgcgggaggaccgtcggagccggagggcccacagcagtaacgcagacagcgagtctaaggcaagctcaagtgaattcgagataagcagtgatcgaagagagttgggaccgtccgcgaggtttcagtcctaacccctgatgagagcacagcagatcctgatggccaagaactcggttttggactagcggtgagcattggaggaacgcggtgtgggtggggctggtcggtagagataggaaggacattgcatttctggagggcattgcattttgtactgtagagattggaaggtcattgcatttctggaggaggtaggtattatccttggtagtggccagcttagaatgcagagtgagatggatcccctgagagaaaagattcagacttgctgcgaatcttactcggtattctgctggtgcggcggcagcagcagcttgtacagacatttcttttctgtctttcgttaggacttgctggctagcagaaaatatggtctccttcctaatgtgatgagtgttgagtgacttgaaccatcaaaaaaaaaaaaaaaaaactcgatctctctctctctctctctctntctctntctctctctctctctctctctctctctctctt

SEQ ID NO: 5121 - DNA, 622 bp, Sorghum bicolor
  Clone ID: SORBI-28MAY03-CLUS101427_1
ttcgtttctaatcccagccatcactcccaaattcccagcggctggcatgcctcaactgttgctcgatgaagccgagagatgaccagatgtcggagagtggatagggccggatagcttcttcacgcagtcgcggttcatcctctcctgcctccccgagagctgactgtaagtggatcgcgaggtgcccgctatacctctctggtggtgacggatctcgcacactccacgctcgtgtggtagtggcggagctcgggcggtccatggccctggcagaggttggcgagggcatgttcccggctactcgcgacgacgttcagcggcggtggctgaggttgcgtgggcctcgcttgggtggatctctcggcgacttgcgaggggcctaggcatggcagtgggttaccatgacaaggaggtcgtctagatctggtgagcagcggtcctagaacgtagcaaccatgctgtgtggagaccggcaacgtcgcaggactgctgttccctcggtgattgcggtaggcgacgtcgggtgaggctctgcccgtttggtattgatttggtattgtactctatttggtcttagtctaaatcgtgatgcccttgatttagttctctgatttctcctggg

SEQ ID NO: 5122 - DNA, 577 bp, Sorghum bicolor
  unsure (1)..(577): unsure at all n locations
  Clone ID: SORBI-28MAY03-CLUS10145_1
gcacgaggctcgtctccgactccgccgccgtcacgccacctcgccggccggcggagaacccgagcgcgaggatggggaacatcttcgtgaagaagcccaagatcactgacgtcgacagggccatcctcaccctcaagacgcagcgccgcaagctcgcccagttccagcagcagcttgagaaggtaatcgaagcagaaaaggaagctgcacggcagctggttcaacagaagaagagagacagagctttgattgctctgaagaagaagaaagctcacgaagagttgttgaaacaagttgacacatggcaaatgaatgttgaacaacagctggcagatattgaactagcaagtaaacaaaaggctgtatttgaaagcctgaagtctggaaacgctgcccttaagtctatacagaatgagataaacattgatgatgtccaaaagctgatggatgacacagctgaggctaaggcttatcaagatgaaataaatgctgttctgggcgagcagctntcagctgaggatgaagaagctgttatggccgagtttgaaaatntggaagctcagcttgccgttgagtc

SEQ ID NO: 5123 - DNA, 795 bp, Sorghum bicolor
  Clone ID: SORBI-28MAY03-CLUS10059_1
gcgtgcacatgaacgcgacggccgcgaacaaggcgacgccggtgaacctggcgcagcacacgtactggaacctgggcggggagggcagcggcgacgtcctccacaacacggtgcagctgttcgcgtcgcggtacacgcccgtggacagcgcgctcatcccgacgggcgtcgtggcgcccgtggccggcacgccctacgacttcctggccccgacgcccgtgggcgcgcgcatccgccaggtctccggcggcaaggccggcatctacggctacgtcaccaactacgccgtggacggggacgacgccggcgccggggcggcgctgcggaaggtggccgtcgtccgggacggcaagtcggggcgggcgatggagctgtgggcgaaccagcctggggtgcagttctacacgggcaacttcctccaggacgtcgaggggaagggcggcaaggtgtatggccagtacggcgcgctgtgcctcgagacgcagggcttcccggacgccgtgaaccaccccagctttccctcccagatcgtcagtccggggcaggtgtacaagcacgacatggtgttcaagttctccttttagctagcaagtcacaataatttccatcagtttcgcaaagctgaatcgtttgcgttgttcaaaactgctgtcgtttctttgccttgttcgtttggctgataagccataacaaaagatactattgactaatttgttgtgagagaaaaatactatataatggttgacatattcgactaataaactcaaacgaacaaggcggcatatttttttccac

SEQ ID NO: 5124 - DNA, 838 bp, Sorghum bicolor
  Clone ID: SORBI-28MAY03-CLUS10051_1
aaagaataatatagaagataatttaaatgctaataattttgatttagaactagaggttcagccgaatatggtcgaaccatcatccggcattacttcattaggtggagatttgcagccagtggatgatgacaaagagctggttaagaaccagacatctttggaggacttagattccacagctaatgtggactcatacaagaaagatacctgaaggtggttctccagagaaattaaatctagacaggagttcaggtgatgagtcaatggaggagcacgtggcggaaattaaacaagttgagtccaatatgaaatctgatgttctcgaaggaaagaatgaacttaactcagaagatgtgaaagaggtgatcctccctgattctgttgttgagccttccaaggaggttatagctgaagaaaagtcagcagcttcagcagaaaagaggaaacttgaagctgaagaaggtgttgcaaacactgaaccaatcaagcggcaacgtcggtggactgcagacgttgccaaagttccagagagacaaacattgagtcaaactggtcctgaaactcctaaggatatttttcagcctgctttcaaacgatcttttgggaggtctgattcaacagccagtatagattctcctaaggagcggattgtaccaccttctgagaaacctgccacaacttctttgagaattgaccgatttgtacgtccatttaccctgaaagctgtgcaagagcttcttggtaaaactggaactgtacaagacttctggatggaggatatcaagactcattgctatgttacattttcttcggtggatgaagctgtggctactaggga

SEQ ID NO: 5125 - DNA, 518 bp, Sorghum bicolor
  Clone ID: SORBI-28MAY03-CLUS100652_1
agggtattcctcccgatcaacagcgactcatctttgctggcaagcaactggaggatgggcgaactctttccgactacaacatccagaaggaatctactctccacttggttcttcgccttcgtggtggtatgcagattttcgtgaagactctcactggcaagaccatcactcttgaggtcgaatccagcgacactatcgacaacgtgaagagcaagattcaggataaggagggtatccccccttatcagcagcgtcttattttcgctggtaagcagctggaagatggtcgccccttgagcgactacaacatccagaaggagtcaacttttcccctcgttttccgacttcgcggtggccagtaagcgattccaacgaacggtgatggattttacgacggcgttagggactggcattgaattcgagatcaggcaacttttaggcctgtcatgattattatgtagtttttgcccttgcgaatattctgcaaggtgctaatagactctattgaagtctacttg

SEQ ID NO: 5126 - DNA, 572 bp, Sorghum bicolor
  Clone ID: SORBI-28MAY03-CLUS100641_1
caagcccgagattgctctcatgtggcgtggtggttgcattatccgatcggtcttcttgaaggacatcaccaaggcctaccgcgccaatcctgaactcgagaacttgctcttcgacgacttcttcaacaaggctatccacaacgctcaagccggatggagagacgttgtttccaagggtgccctctggggtattcccactcccgctttcagcaccgctctgagcttctacgacggttaccgcaccaaggacttgcccgccaacttgctccaggctcagcgtgactacttcggtgcccacaccttccgcgttaagcccgaattcgccagcgaggactaccccgaaggcaaggacatccacgttaactggaccggtaggggaggaaacgtctcggcttcgacctacaacgcataagctgtgaatacaatcatcttcattagagtaggggctaaagcgcggtcgcacatgtacatggtcgccagatgtcaaaacccatgcatatagggatcaatgacattctaggtcgctgagtggagacatggctcatgacattcgaataaaaatttaaacgttc

SEQ ID NO: 5127 - DNA, 436 bp, Sorghum bicolor
  Clone ID: SORBI-28MAY03-CLUS102140_1
gcacgaggaagataacgcaggtgtcctaagatgagcccaagaaatcgccacatccctcgtaaccgccttcaacacagccctcaagaacaaggacctcacagctctcgcccgtctattctccgaagacggtttctggcgcgatcatctcgccctatcctggaacttccgcaccgtccaaggcccctccaacatcctctcattcctgaagtcctgctctgaatcaaaggacggtctgcgcctgaccaagattgaggtcgatagctcagctcctgtgcgaaagccccagtttctgcctatcgatggcgctggtgaagtccagggcgtacagttctttttcgagattgagactgtgcgcggtaagggacttggtcttgcaaggctgattgaggagaatggcgagtggaagattttcacgttttatacgagaattcaggag

SEQ ID NO: 5128 - DNA, 745 bp, Sorghum bicolor
  Clone ID: SORBI-28MAY03-CLUS10215_1
gggaaaatactcaggagcttaagctatttgtggagttgtataagcatgagtccactgattccagacagctgatggaatcgagagagagggaactcgctgaatgggctcgagtccacgttctcaaatattctcttaatgaaagtaaattagagcagcgtgtaattgcagccaatgaagctgaagcaatctctcagcagagattggcaactgctgaagcggagattgctgaattagggcagaagctagaaacttctgggagagatctagtgaaacaatctgatatactgaagtctaaacatgaagaatgtgaagcatacgtggtggagatcgagagcattggccatgcctatgaagacataatgtcacaaaatcaacaattgctacagcagattattgaaagagatgatcataataccaagcttttcatggagggtgttaaagcaaaacagtcacacgatgctttgcatttggaaatgtgctcgttgcaaagaaatttgcagcatgcaagtactttgatggatctgtgcaaccagaaaattatccgcctagaggaccagctaagaggttggtcagaacggttgaggagactgtcagaggatggaatgcagcagtctatgtcattgggcaattctcaaagaaagctggctggtatgcatggagaagctccaaagctcaggcagtcgatggatgttctacaagcgaaggttgggagcaatcggctgggagttgctgagctgcttataga

SEQ ID NO: 5129 - DNA, 563 bp, Sorghum bicolor
  Clone ID: SORBI-28MAY03-CLUS102165_1
gcacgaggctcgtcggtcccaaagggcaaaggggaagaggggaaaccgggcagagcgcagcgcaggacagggagagaactcgccggcctagtctgcgcggtgatccgtctcccctagggtgttccgccgtgctggggcagagacacggggttgccgttcttcgccgccgcacgccaaggttctgctccgcttgatcctgcggcggtgcggccctgtttttgtttttgtttttttttctctcgtttcaggtggccagccttggttttctctcgtttcagactttcaggtggccagccttggttttgccgaactcattctgtggccctctgctgtagtgtccaatggcggcaggagcaaccttaaactgggttaaaatcccatttgacacccggagattccatgacctatctagtttaagtttccgatcccgaaacccttttggatcaattcagccctggtggctgccaaccgatcaagactcatcccttatcaaggttcgcgtggctgctgattattcagactcaatgccagattcaaagtacacgagagatcggggttatcac

SEQ ID NO: 5130 - DNA, 514 bp, Sorghum bicolor
  Clone ID: SORBI-28MAY03-CLUS102261_1
gcacgaggcttacatccataccttcaatatgagcatgctttcagctgaagtcacagaatggggccaatctcccaaatctgtaaaagtcgtccctccccaaactccagtcaacgactccgaaacagagatccgtgtcatcgctgccggtcttcaccagctcgttcgctcaagagcagctggcaagcactacactgctacagaacttccccaccgacctggcgtagacggtgtaggcgtcaatgtatccacgggaaagaaagtttacttttctctgctgggtaccacgcagggcagctatgccgagatcgtcaatgcgccctcgcacaatatcgttgagttgcccgagggtgttgatcccgttgtagcggcggctttgatcaatcccgttatggccagttggatggcattgagaaagagagctggtttgaaggagggggctgcgttcaaagtgtttatcaatggtgttactactgcgagtggaaaaattgctattcgagttgcgagaagccttggg

SEQ ID NO: 5131 - DNA, 487 bp, Sorghum bicolor
  Clone ID: SORBI-28MAY03-CLUS102294_1
gcacgaggcatggatcggcccgtcggttaattgttagctagctgtagctgctgcatagagacatcacctcgccatcggcaagctagctagctaccgatcgattggctgctagctagtagctagctgctccgatatatccttcatcacacgccgccattgccgacagcttgcggcgttcgagcagcacacggccggccggccggccggtggtcgttggcttcgatagttatatattcagtcgttattagcagcttatatatatcgagacaggagcaagcagagctagaagcgaattgaaaaaaggcgaaagagatcgagagcttgaagacgaagatccaagagcgggccgggccgggatagatagatgagctgcaacgggtgccgcgtcctgcgcaaggggtgcagcgacgcctgcgtgctccggcccagcatcgagtggatccacggcgcgcagccgcaggccaacgccaccgtcttcgtcgccaag

SEQ ID NO: 5132 - DNA, 2303 bp, Sorghum bicolor
  Clone ID: SORBI-28MAY03-CLUS101_1
gaattcggcacgagccgccgccgcccgccggttcgatcctttacgcgagatcgagcttccccgggttggggttgaggctgccgtggcgatatctgggatccgtcgtctcgtcctcgtgttcttgagcagttttacacttgccctggcagagaacatttgacttggaagagcaaattgggtaactggacacacaggaagctttgtggtttgtcctaactgatcctatcaagttctcataggctgcatacgggtacaacatttttcctgagttttgggctgcagaagagggggagtcaaggattttctatcttgtaagacagtaaaccacgaccttggtggtcaaggtctgtgcccacttaccatagtctataaggtggacattgtaaaggcagggtgcatcttgctttgtatagcctatctgtttctctctcactgtatatagagatccatataatggacgagaggaggactattttgatggaccgttatgaaatcgggaggcaattaggacaaggaaactttgctaaggtatattttgctcgaaacctgactgatgggcagtctgttgcaataaagatgattgataaggacaagatcacgagggttgggctaatagtgcagataaagagggagatctctataatgagactggtaaagcatccgaatgttctgcaactgtttgaggtaatggctagcaagagcaagatttactttgtattggagtatgctaaaggtggtgagctgttcaacaaaatatcaaagggaaagttcagtgaggatgttgcaaggaggtatttccaccaactgattagtgccgtggactactgccacagccgaggtgtttaccatcgcgacttgaagccggaaaacctacttcttgatgagaatgagaaccttaaagtctcggattttggtctaagtgccctagctgaatccaaaaggcacgatggcctcctacataccacctgtggaactcctgcctatgttgctcctgaagtgcttagtaggagaggctacgatggcacaaaggcggatatatggtcttgtggagtaattctttttgtgctagtggctggttacctacctttccatgacccaaatcttattgagatgtacaggaagatctccaaagctgaatacagatgtcctcgttccttttccggtgaattgaaggacctgctttttagaatgcttgatccagatccaagtactagaatatcaatttcaaggataaagagaagcacttggtacagaaaacctattgaggtaaattcagcaaagatcaagcatgacacaacaagagacaaggtgtgcaacggtgaagccacaacctctaactcaatagaatgcagtaattcagaggaaactcgagggtcatcgagcctccctaacctgaatgcatttgacatcatttctctttcaactggatttgacctatcaaatttgtttgaagaaaaatatggccggagggaagagaggttcaccactaggcagccagcaggaacagtatttgctaagctaaatgaactggctgagcggttaaagctcaaaattaagaagaaagaaaacggggtcttgaaactggcttcaccaaaggaaggaataaagggatttctcgagcttgatgcagagatttttgagcttgctccttctttccttctagtcgagttgaagaagaccaatggtgacaccatagagtatcaaaggctcgtgaaagaagaaataaggcctgcactgaaggatatggtctgggcatggcagagcgaccggcaccagcagcgcaacgagtctgtgcaaggagagcagcagctgtcatcacctttgccaccacagcagtagtcactgttgttgttgcggcaccacatgactgattgccaacatacttgatagcacagtggccagagcagaggacaagccccagctaccgctgcactgccaaggtgaccgtgccctccaacaattgttggagccacatgattcccacaaccagttgcaactgccattatcaaatcacatcattgcaactgcatcaggcctgcatgactaactccacagcctgacagccagactatagtccatcatgcatatctcattgcgaaattgggatgttcaggttaccctgtggtaggtaggatctaaagcacctaccatttggtgttttctatactgtacattagatatacttgacttttcaatttttgattgaaacatgtgttttcgatatgatttgtaacatttaatccatggatgattgatgtatgtacattttttttttgaaatgaatgtatgtacaatgtttacca

SEQ ID NO: 5133 - DNA, 541 bp, Sorghum bicolor
  Clone ID: SORBI-28MAY03-CLUS101086_1
ttgaaagccataagggacggagcagacgtcaaaggatactctgtgtggtcattactggatctctacgagatgttcgggggttacaaggcgcatttcggcctcatcagcgtcgatttcaatgacctgaggcgtcagaggcagcctaggctgtctgcgtactggtactcagacttcttgaagaataatgttgccattcaggtggacaatggtgaagcaactgcaacttctcatgaacaaatttaagtgctccatccaaagattggcattttatactctgagagctacactctgaacagaaataatggaaaagggtaaaatttacgaaatatttcaacgtatttggtgtactctatatatgaagcttaaggtcgtgtgggttgtaaagtatttactataatagaaactaaagaaagaagtcaaagaaccgtccttgagtacactctgcaatcagaaaatgtattagttagagaatcatccatcgtcataaaaagagggagattgaatgtatctcaggccccagtatcagaatctccttattaga

SEQ ID NO: 5134 - DNA, 565 bp, Sorghum bicolor
  Clone ID: SORBI-28MAY03-CLUS1011_1
cggacgcgtgggccctccgcccctcgctccgtgcccgtgcctccccgcacgatccccacattccttcgccggctccgcgctctgctcttgttgtgatcgttagtacaggtgcgatggcgatgaggtcggccgtggcccgcctgattcgctcctcctctgcctcgccctcccgtctcagctcgtcgtcaatcttgctgaaaagtggcaatgcattcttcagcaatgctacacccagtgatcagaagcacattgaggagtcttttaatgccacacccagtgatcggaagcacattgaggaaccttttgaggtgaaggaggcagaacctgtgaatgcgtcaaaatcttctccagagaagctactggttctaggaggaagtggttttgttggatcgcatgtttgcaaagaggctttggacaaaggattagttgtctctagtcttagtagatctggaaagccatccttaaatgaaccttgggctgacaaagttatatggaaccaaggcgacctccttgaaccggcttcattgaaggatgctatggataatgtttctgcagtggtatcttg

SEQ ID NO: 5135 - DNA, 482 bp, Sorghum bicolor
  Clone ID: SORBI-28MAY03-CLUS101094_1
cttcctccaagcagcatcctacgcgggcttcatcgtgttctactcctggatcagctcatccttcccgcgcccgcctgctaagcgcgccgtcgccatcgccatgatcaacgccttcagccagctgggcaacgtcgcgggctcgtacgtctgggacctgaaagagaacgggtaccgcaagagctacggcatcgtgctgtccatgtttggcgtcacggtggtgggatgctacatcttcaggctggtgctgatcgacctcaacaaaaagctcgagaggggagaggccgcttgggagacgcgccaggatgtggctgcgcatacggcggccgtcgaggtcatggacagccccgacgaggctttgaggatgaagcgggatttccgataccttatttaaagcggcgacgtctgggcaggtctgggcatacgtgcatgcatgcatcaggggttatattagactcaatgcaaataagacaagtttttgtttg

SEQ ID NO: 5136 - DNA, 778 bp, Sorghum bicolor
  Clone ID: SORBI-28MAY03-CLUS10115_1
agggcacaaaattatctgatggaggaacaaaaaaggaaccaaagaaacaatctggtggctcaaaatcgaagacagctgaggctgacattacagttgcaaaattggatattagagtggggcttatcagaaaagcagagaagcatccagatgctgattcgctttatgtggaggagattgatgttggagagggcgcaccaagaacagtggtcagcggccttgtcaaattcatacctcttgaagaaatgcagaaccggaaggtttgcgtactctgcaatctgaaaccggtggcaatgcgtggtataaaatcgcatgcgatggtttggctgcatccaatgaggaccacacgaaggttgagttggtggagccacccgaatctgctgccgttggggagcgtgttacctttgctgggtactcgggggagcccgaggcttccctcagtggcaagagcaagacgtgggagaagctggccgccgagctgcacagcaacggtgagctcgtggcgtgctacaaagatgtgcccttcactacctcggctggagtctgcaaggtcaagacaatagcaaacggagagattcgctaggcacacatcaccgaactgcagccagctgacccaatctgcgggtctggtttcactgaaagctattgttcctgattttcattttaaaaaattttgagtatttccctatgtagtttttgtattttgagtaaagatcagctcaaatactgcaaagcagccatgattggaaaaatgccgagagtgccctttgtgcatcctcgt

SEQ ID NO: 5137 - DNA, 413 bp, Sorghum bicolor
  Clone ID: SORBI-28MAY03-CLUS102516_1
gcacgaggacgccactgcggcgctaggagctcgcagaagcgccgccccgcgagagggaggccagagaaaggaggagatccggcggcagagcaggtcagtcggagatgggagtccccgcgttctaccggtggctggcggaccgctacccgctgacggtgtccgacgcggaggaggaggagcccgtggagctcgagcccggcgccttcgtccccgttgacctccgccgccccaaccccaacggcctcgagttcgacaacctctacctcgatatgaatggcatcatccacccctgcttccaccccgagggccggccggcgcccaccacctacgacgaggtgttcaagtcgattttttattacatcgaccacctcttcggcctcgtccgccccaggaagctcctctacatggccatt

SEQ ID NO: 5138 - DNA, 456 bp, Sorghum bicolor
  Clone ID: SORBI-28MAY03-CLUS102583_1
gcacgaggggacaaggagctcgacgctggcatctccaccaccggccgccttcttcacaccgaccagctaaagttctttgacaaggcggctatagtgacggacggcgacgtgctaccgtcaggccagccgaacctatggcggctgtcgacggtgcaccgcgtcgaggagctcaagtcgatcatacgcatgctgccgatctgtgccgccggcatcatcctggtgacatcggcgtcgcacaatcacagcttcgccatccagcaggcccgtaccatggaccgggacatcacgccgcacttcaagatcccgccggcctccatgctcatcttcaccaacgtcggcatgctgctgaccctggccttctacgaccgcgtgctcgtccgcgtgctgcgccgcttcacgggccgccccaacggcatcacccacctccagcgcacgggcgtcgggctgacgatcgcc

SEQ ID NO: 5139 - DNA, 579 bp, Sorghum bicolor
  Clone ID: SORBI-28MAY03-CLUS1026_1
atctagccaagacatgctgctttcaggtggtttccctttgcaggctcatggtgttggtggccagtggaaccaacaagccagagagcaattgcagtctcagcatcagcagagaccagttgtgcaaggcagtgtatatgctccttcaaattctgggcctggctgatcattaattatttcggctttgtcggtttcagatagcaaggtttctttccattgtaaagtgtacaggtgtccctgccttggaagctgtggacgacagtgcttaatcttacttggagctagctaactgtagtcaccttaatgtcaggtagattaggtaattaattgttcgtgtgtcattttaggccctaccttctgaagatgggattggttgcagtctagtagaatgtagaagataggtggaggtggtggtgggattgtttgtaacccagaaactgggcccagcccagccgtatatctctggcattagagtcagtcgggattatatttatctattgtatgtatataaacagtgctgcatgtactagtgcttttataacatgtaaggtgttgcatgacgattttaagtcattctaatta

SEQ ID NO: 5140 - DNA, 509 bp, Sorghum bicolor
  Clone ID: SORBI-28MAY03-CLUS102663_1
gcacgaggcttgaacaaggaaccccttctctctactgcccattctaccacgcttggcaggcatcaccttgccattagcacaacaccagcctcagctcactgctttggttcgtgaactgcacaccatctacacatcctgacttcgcaaactcatcgccacccgcctcattctccaagtaattaccatctctaataatccaccatgtcacgttcatccgtctactcagatgacagccgctcatcggcatggacgactacttatacccggatacccaagaaacagcccaaggctctccgctttctctcatgggtagctggagcaccacctggagctacagctgtcaagaagagaacaagagactaccgtgatgaccgttcagtcagttccagtggctcgacgttctctaactgggatcagtccgacacacaactctactgggttgttcaccccaacagctactactacagcggtagcagtaggggaagcaccagcagtgggcatagtaagcg

SEQ ID NO: 5141 - DNA, 719 bp, Sorghum bicolor
  Clone ID: SORBI-28MAY03-CLUS10271_1
gcacgaggcgggccccttccgcgccgtccacctcgtctgcggctactacgcggacgccgcgcgccagcggcagctcgcgcgctgggtccagacgttcgtcgccaagggcgtccaggagctcatcctcgtcaaccgcccgatgccgctccacgtgcctctccccgccgcccacgcgtccgctcaatcatacacccgcctctacctcggcctctggaaattcccggacacctccgctctccgacagtgtcaaagtgacgctggcgtggtgttcccgcacctccgcgagctcgtcctctgctgggtgatggtggagagccgcgacatggacttcctcctagctgggagccccgtcctagagacctttggcataatgggaatcagggagaaggcgatgcgcctccgccacgctggccagcatctccggtgcacgcagatcctcatgtcaactgtggacagcgtcactgtggtggacgccctgagccttgagcggctcatcttgtgggaagccatgccgtgcaacagctcttgcatcagggtaaagattggcaaagtccccaagctgcaagtacttggatacttgagtcctggaagtcacatgctggagatccggaataccgtcatcaacgctgtgataaaggcgacaccaagcaccatggttccaggcattaggatccttgggttatacatgcgcttcggagacacgaatgattccaagatgc

SEQ ID NO: 5142 - DNA, 547 bp, Sorghum bicolor
  Clone ID: SORBI-28MAY03-CLUS101521_1
catttctttgagatggaaaaatccattagatcattacataggtaaaaggtatgatactggatttttagcagtaggattgcttctattaccaagtgtcccagaagctcctatccttttgtctaatctccatatgctgcggtttgatacaaaactatagcaggagtcttggctaacattaatgttctccaaaaaagttgctagtttgtactctgcaggctccaaagcatatgtctgatcaatgaccacgtccactgtctggaatattcgtgaaccaagcttagttaactctgttactgagtgcggagtcactgaaaaatgtgtcaagtaatagagcatttgatgttttgcaggaaatttttatttgatgcaaccagtcaagttataaatgttaattgtgtcaggattaatcccttttctgaccaaaagaaaatgtgtcttttgtacacaacatgcaacagtgagctcgtcaactattagcattacagggttgtaatattagattctgaatggttgatactcacacaaagaatagcatggaagttgtccc

SEQ ID NO: 5143 - DNA, 428 bp, Sorghum bicolor
  Clone ID: SORBI-28MAY03-CLUS101790_1
gcacgaggcccaaacgcactctttgctagtcgccttctatccccaggctgtgcctactttcgtcgctttaattaatccatcgtgctgtgcacgtatcgcaaatcagacaattaaaaacaaagacatctttccaacaacagtaattcaaaaccgacaacatgcgttccacattcatccttgccacattggccatctcgacccttgccgccccagtcccgcagtctgaggtccgatcagctgcgcccatcgagtccaactttgaggctcggtcggcagagccttggaccaggaaaaagggtgttcgttctgcttcaccagacccatacatccggggcaaccagagccgatcaccatacatccggggcaagcaaaaccgtgatgccgaccctgagccttacatccggggcaagcagaatcgcgatgttgag

SEQ ID NO: 5144 - DNA, 620 bp, Sorghum bicolor
  Clone ID: SORBI-28MAY03-CLUS101800_1
gcacgagggtcatatgcttgtttcaaagattaagccatgcaaatgtaagtataggtcgacagaatctttcggggttgaatgtacgacgagactgtgaacggctcattaaatcagcaataattaaatcggtggatgttggaagacggagacggataaccgtggtaaatctatagctaatacgtggaaagagagatattgactgtgatggaggagtgaatatgaaggatattaggagagtagacagaaaaggaaggagagtgattgatagtatgtgagtggatcgtagagaaagagacgacgagccgaacaaatttctgccctatcaactgtggacggtagcatagagggctacggtggtgatgacgggtaacggagaattagggttcgattccggagagggagcaagagaaatggctgccatgtctaaggatagcagcaggcgcgtaaattacccaatcctgacacagggaggtagtgacaacaaataacacgggtcggtggtttggtaaaacaaaggccgactggggtgcaatgagaacaacgcaaagtccttatcgagtagcaattagagggcaagttctggtgccagcagccgcggtaactccagcatctaagagttt

SEQ ID NO: 5145 - DNA, 440 bp, Sorghum bicolor
  unsure (1)..(440): unsure at all n locations
  Clone ID: SORBI-28MAY03-CLUS101845_1
gcacgagggctgggcgctcaccgcgccagcaggcaactctcgttcgtctccactctccggcgagcgccacacccgcgaatcctccaccagatcctcctctcctcctcctgctgctgttcgtccccgatccatctgcaatcggatggtcttgctccggtgcgccgttgatctctgcggcagcgctcaggtggtttagatcggcgcggggcgcgacgccngggccgagtcgaagcacgggatccatggagagagccaggctcacgccgttcccgccgagggaacaggccacgaccaggatatgcaaggtgtcgaggtactagtactgccgcaacttattacactacacggacggacgacactacactggtgtttgagctgaggaatttctgaatctggatgcttatgtataagatgttctttagtcctactaagactatctc

SEQ ID NO: 5146 - DNA, 605 bp, Sorghum bicolor
  unsure (1)..(605): unsure at all n locations
  Clone ID: SORBI-28MAY03-CLUS10186_1
ttgggccggagctttatacacatgcatgcatggcgccgccgtcgcagtgccacatcaacagcaacaataantggcgtccacctcaacggcaccngcggccgtcgtcccgacggaaacggagacggtgctgccgccgccactgctgggctcccgtctgcttgatgccgaagagttcaggcggcagggccaccaggtcgtcgacttcatcgcggactactacgccagcatggaagactaccccgtgcaccccaacgtgacgcccggcttcctccgccggcagctcccctcggacgcgccgtcgcgccccaagcccgacgcgttcgccgcggcgctgcgggacgtccacgacctcatcctgcccggcgtgacgcactggcagagcccgcgacacttcgcgcacttcccggcgtcgagcagcaccgtcggcgccctcggcgaggccctcgccgccggcatcaacgtcgtgcctttcacgtgggccgcctcgccggccgccaccgagctcgagatggtggtcgtggactggctcggcaaggcgctgcacttgcccaggggcttgctgttctgcggcggtggcgggggcacgctcctgggcacctcgtgcg

SEQ ID NO: 5147 - DNA, 696 bp, Sorghum bicolor
  Clone ID: SORBI-28MAY03-CLUS103127_1
tcactgcactatgacgagcttcatcacaagacacagtctgccggcacagccggccacggtgtaaatcttgctccgactctcgtcccaggcaccaacattacaaactctgagagcttgcataccccctgccgttcttgccgcgttgtcgattgcctgatcgaccaatccgcgtcccacttcaatcattactagcattgcgaagcgttacgacattcccctcgcttcattattttactgcacggcgctaggtaggcatgtgccctgacaaggtctgtcggggtttgcatggggaatctttgaaatacaggtcttggctcggtctcggcggtggaaggaagcgtattcccaagacccgagagacgcgagatgcgagatgcgccttagagcttgcgacgaccatgtcaaagcaaaaacacgaaagaaggaatttggaaggagtgaacacgagtcgaacgaaccacgcgcatccatgccaggctgtttccgctaacgtccggaacgcctgattcgacggaacaacagacgatcgcagcagcaggacggacacgtccctgggacgctccgaacatgcgaggcgcggacgacgcctttcgctcatgctatgaaagggccgtacgatggtggctctttccgatttgaataaattcttgtcgatatgtgcgaaatgtcaatagagaaagcgtacttttgcccctg

SEQ ID NO: 5148 - DNA, 659 bp, Sorghum bicolor
  unsure (1)..(659): unsure at all n locations
  Clone ID: SORBI-28MAY03-CLUS103198_1
acaaaaagtaaagatggtgaagtggagcctgatcaaaccaaagctcctgaagttacagaagaaggggcggcggtaaaagatgctactgaagagtcgattgcagccgagcagcccaaatcctgggctgactacagcgatggagaggctgaggtcgttgaggttgcaagctaaggaaaatacacccttatcagatagccaacacattcagaaatttttactcgaacagatgagcatctcttcttctcaatagatgctgccgtttttttggatagaattaattgctttccagtggcactccgtgacctttggtatttggaattttgaagactttccagtacgtccaccgcccatgtttcatgctgctttttttttgctgcgaagaatcttgaggaagaagagcacctcaaagtatcagcaagagagatgcgtcgttaacgtttcgtcatttcctcatcttgcccgtgatttttgtccccttttcgaatgtactgtcgacttaacgtcttcatagttatttctttgttataaaatagactttttgaatcatgtataaaatataaagaaagtggtgttgtatttcncacacttgcggttaatccgtccgagctgtatagcatcgagatcgaactaaagaaaggttcctattgaatttcgctttt

SEQ ID NO: 5149 - DNA, 902 bp, Sorghum bicolor
  Clone ID: SORBI-28MAY03-CLUS103200_1
gcacgagggttctccagatttggggaatatgcttggtggttcacctgatgtctctctttttaatcagatgttgcaaaaccctgcaatgatgcagatgatgcagagcattatgtctgacccacagaccatgaaccagttgcttaacttcaacccaaatacacgcaacctgatggaatcaaacactcagatgagggaaatgcttcaaaatccagaatttcttcgccagctgacatcacctgacactttgcagcaattactctcatttcagcagtctttattaggacagcttggtcaacttcaacctagccagggtggcaacaatgcaggcagtgccacaggtacgcagggaaaccctagccttgacaccttgatgagcatgctcagcgggcttggttcgggaggtggcctaggtgttccaaatacttccaatgtgccaccggaggagctctatgccacacaacttactcagctccaagaaatgggtttcattgacaccgcggagaacattcaagcactggtcgctaccgctgggaatgtacatgctgcagtggagcgtcttctcgggaaccttggccagtagcttaagcgagcgagccagacactgcccgcaaatcttaaaatgtcacgcatctgcaggagtgtttggcttaacgttcttcaagccccagaatttgaaggcggcggcgtccatagtcccgaaaacaaaataatcaaaaagtcaggcagccattaacttttctcatacatggtggtcatgtctttgtttttacaagtgttgtatttgcgatttggattggtgtacatacatatcggtcggatgttacctcatagaatgtctgtagtggtgtcttttcaacagttgattcttgattctcaatatatcaaatcaaactatctgatcc

SEQ ID NO: 5150 - DNA, 996 bp, Sorghum bicolor
  Clone ID: SORBI-28MAY03-CLUS10333_1
tctcctcttttccctccccacccttcgtcggcttcctcgtcgtacaaccaccgcggaaccctagatatctatctatctatcgaatcagcgaggggagaaggcggcgtcgagatgaccggcctcaacggcaagcgcaaggccgtggagaccccgctggccaagcgcccagcgcagcacaagccccaggcttcacgccggaccaagcgcaccaaggaaccggctcttccccggaagcgcgagtcctccaccgctcgggcaccgctggctgacggtcgtgatgaatatgcctctgtcagctacagcctccgcaaccgcatagtctacgtcccgatcccgaagaataccagcaagcacatcgtcccttctaccagcgagcccgctcccccagaatcagacttcagaaaggaacctaagtataggcaatcgaatcagacctcaacatgtgcgcagatgggtctggaacactacaacagcatgaatcagggggatgagcatgagcttgttaaagctgtggacagtaattccgttatcttcaatggtgtgtggatacatgccaatttccttgctaagcggaaaggtgctaccacctgtcctgatcttgttcctaagtacttcttcactgaagtgaaatgtgactataacggactctcttgtctctcatgtgttaagctggatccaggagtacccagaaagtttggtggttgtggagtctgtccacctcaaattatgcatcctgttgatggtggatatctgagtgcacagccttttaatccctcggcccctccaggaaattgtgtgatgggattgtgagttgtgaatcgttgtgatagtattgaaagtgctacaatccataaaccatgtgtaccgagtttttcactctagcattagggatcttacgtgtttgtctagaaattaacgttactttgcgttaatgtattttcttgtactcgagcacttattacatctatagcaatctttcataaaactgttggattc

SEQ ID NO: 5151 - DNA, 503 bp, Sorghum bicolor
  Clone ID: SORBI-28MAY03-CLUS103357_1
caaccgccacagcaccgttccccgccgcagctccttgcacgagggccccctgcgcgaataggcgaaccgccgcccgcccgctcgccagcggatgcacgccaggcgctcgggtcagccagttctcggcgcgcgctgctcttgggggtcgaccaagccgttgccgccgtgccgacccctacacctgcaaccgcgacatcacccactcgccgccggatgcacgcgaggcgctcaggttgcgtgcctctccttcccatccccacgcgaccacgccgccgaatgcactttcccatctcttccacacgccaagcccacccgccgcctcctaccatctgctctcgattcccagcccaacatccactccctctcaacggatccagtgaggacacatcccagttggtgtagaagcgttctacctcgtcggatccagcgtagaggcgaacccacctccagggagaaccccctacccgcgatcccactgccctggagttcgagtgtctgacacc

SEQ ID NO: 5152 - DNA, 426 bp, Sorghum bicolor
  Clone ID: SORBI-28MAY03-CLUS103364_1
gcacgaggctcctcctctccccctcctcgcaccgacccaccccagccatcctcgcgagccctagcgccaccacgtccttcctcgcctccctcgaccgcttcctctccgacccgcatcccgctgcctccgccgccgctcccggcgaacttgacgccgcgatccgggtccaggaggaggcccgtctctacggggacgagtaccccgcatggcccgcgccggccgcggggccgctcagggtctacgtctacgagatgccgggcaagttcacttacgatctgctcaggctgttcagggactcctacagggacaccgacaacctcacgtccaatgggagccccgtgcaccgcctcatcgagcagcattctattgactactggctgtgggcggatctcattgcacctgaatcacaaagacttttgaagagtg

SEQ ID NO: 5153 - DNA, 767 bp, Sorghum bicolor
  unsure (1)..(767): unsure at all n locations
  Clone ID: SORBI-28MAY03-CLUS102370_1
gcacgagggtcaaaacgagaaaacaagacgagaggatttccataggacatggagcaggtacattccagataatgtcatgtgttccatgggactctttgattctccaagccagtgtgatgtgaaagttgctccttttgatcgtgatcttcttcccattgatgttgatgatgtggaaaagcttgcaccccagtctatacttgggtcttttctgaaatctgagagatcacagctagcaaagcctttgctaagcaattctagtaccagtggaaatttgaacaaatctgagcaaaatcctctgagcgctgatgataagatggatttccaagattttctggggggctatgattctattgatattgcaggaactagtaagttagaagtggaaaatgccaggttaaaagcagaacttgcttctgcaattgcaattctctgcaatgtcggtgctgaatatggatatgagtctattgacgaagggcaaattgatgctgtattgaaaaaggcaagggaaaaaacagctgaggcacttgctgcgaaggatgagtttgcttaccagcttcagtcattgctcactgcaaagcaggaaaaatgcttggcatatgagaagcggatccaggatcttgaggaacgcttagccaaccagtacatgcaaggtcacatggtatcaggaagcaaaggcacgtctgattccctgctttctgcatttaanagtaacgactgcaacctggatgtatctggagtcaggcaaacccaaatacgtgatgaatcaa

SEQ ID NO: 5154 - DNA, 624 bp, Sorghum bicolor
  Clone ID: SORBI-28MAY03-CLUS102392_1
gcacgaggcacccctttcatgcaagtaggtccatccattgctcgcatccatgggggcactggtattggattaagcatcagcaaatgcttggtcggcctcatgaagggagagattggatttgcaagtaaaccccaagtcggttctactttcaccttcactgcagtgcttacgagggccccccccggtggaaatgagaataaatcatcagagtttaaagagatcaatgcattggtggtagatcatagaccggtccgtgccaaggttactaagtaccatttgcagagactgggggttcacaccgaattgacaactgacctagatcagtatatttctaaaattaattgtggatcacagattgcaaagcttgtgctcattgacaaagaaacctggctggaggaatcccactctatgcctcatttggttactaaattgaggaacaaagatcagccagactctacaaagttatttcttttggagaaccctaaaagttctgtcaaaagcagtttgcatatattcagggaatataacttgaatgtaattatgaagccacttcgtgcaagcatgcttcaggtttccctacaaagagcattgggtgggatagataaactgcattgcaggaatggg

SEQ ID NO: 5155 - DNA, 727 bp, Sorghum bicolor
  Clone ID: SORBI-28MAY03-CLUS1024_1
cctttatgtatgatggtgtacctcttctagctatgttggatgagtatgttatgctcaggcaggaaagggaagaagagaagaaaagaatgcgggaacaaaagcgctacattgagcagcaactgaacactgatcatgaagggccatttggatcacgagtgagtccaaaccggcctgccagttcgaagaaggccattggcccaaagttgaatggcagcgtctcaaatggcactcctccaaacagaaggctctcaatcagtggccaacagaacggcggtggccatggtgtcaggtctggagggaaggatagcaagaaagacacggtgaagacagcatctcctgggaacaatgcagctgcagctgcacctgtgggtgtggcagcaacagccaaagaagacgcggcctcccaaatttctgtcagcgatccggttccgagcacaccatgatctttaacctagcatcgtatattagatataagtgactctttctgatgttctattgttttgtggtaatatattgtaatgccttcgtagagtaattatgatgcccatccttcagctgctttggcacctgtaattcttgttttagttccactcggctgtgctgtttcgacttgttaaacggtgtagtatagtcttactgagatgtattgtcattaatcagtgtgctggacgtataagctgttgaaacgtttttgatgtgctcgtccttgataaaaaagtttacaaga

SEQ ID NO: 5156 - DNA, 678 bp, Sorghum bicolor
  Clone ID: SORBI-28MAY03-CLUS102432_1
gcacgaggcgattaatcagcgtaaaccatcctgttttgcagccctgacactgccatcccatcagctgttgggacctcacatgttttctgtgcatgagcaaggtggcagctcatccctgcgctctttttgttctccccacctttcccttttgctgcagtcctcatgaccttcaccatggcgtgcatggcctcaagtgagtgagagagatctatctggcgttgtttgacccctccatttaaggagagtggacaaccaccaagccaaagccagcacgaggcctaaacctctgcaggggtcacaactcacaaggccagtagatgatgaggcaacggcaaactggccgttcgctgcttcttcgctgcagcaagtactagtgctaaaggaccagagaccggaggtgctctcgccaagaacagcgcgccgtcgcaggcggcggcagctaggcaggtgtatatgagcaggttcgcggggcagatgtccaggccacggccgccgcctgggattgccccccgctcgactgcacgagcgcgacgcgtcgccgccggacaagctcagtcactcgcccaaggtggaggagcccgtggcggccgtggtggacctgacggtgctgatgccggggcaccggtacccgacgttcctggcgcagccggcgccgctcgcgccttgccccagggaagg

SEQ ID NO: 5157 - DNA, 445 bp, Sorghum bicolor
  Clone ID: SORBI-28MAY03-CLUS102440_1
gcacgaggagagaattcaagaagcagggtatgcaccaaacacaggctctgttcttcatgatttggatgtagaagagagagaatccatgttgcgcatccatagtgaaaagcttgctgttgcgtttgccctgatgaactctgtacaagggtcagtaatccatgtcataaagaatctccgggtctgcactgattgccatgcagcaataaagattattacaaagcttactggacgggagattattgttagagacataaagcgctttcatcatttcaaggatgggttatgctcatgtggggattattggtgacattatgcaaagaaacttagtttgtgattccatattggtaggcatcagaatatcacatattgagagactctcagtgcatctgtccagcacacaggccaatacatcagtgatataatttataacttttcatcctgatta

SEQ ID NO: 5158 - DNA, 595 bp, Sorghum bicolor
  unsure (1)..(595): unsure at all n locations
  Clone ID: SORBI-28MAY03-CLUS10380_1
ggttcgtacgcatcctatttccgccgtctagaggaagaagaatcaacggttgctgtccgcgtcagctggtcggctccgccaagaaaaaacccaaacgcaaccacgcaatcgccgtccgccgccgcggcgactaatcaatcaacttaactcttagtattcagcgcttttcgatctctccgtccttcgtttggtttcctccctacctccaccacaacccacctgctcgcgccttttcccaggaaaatcctcttccgattcacctgattattgcttctaggtccttgaatcttgatatggagcagcaccccacttgcgccccgccgccggcgcccgtgcccgttgctggggccgtcgtcccggtggacttcaaggtcgtgaagaagggacccgagatggcgatgcacgacgcgatcggccgcctcgccttccgcgccgcgggcagggacagctgggccacggcgctccacgatgaccgctggagtgtcctggtcaccgtcaggagcagcggccagggtgagtggcaagcatttagtggaaatagtttggagcagagacacatcattttcactgcanaagttatatctgcttcttcaag

SEQ ID NO: 5159 - DNA, 212 bp, Sorghum bicolor
  unsure (1)..(212): unsure at all n locations
  Clone ID: LIB5050-004-R1-XP1-H2
gcggcgctcgagncngccgggccgcgagtccgaatgaagcaaatttctcggcggtcgacggaaggcgatgctggatgcaggtccttgaatcttgatatggagcagcaccccacttgcgccccgccgccggcgcccgtgcccgttgctgggggcgtcgacccggtggacttcaaggtcgtgaagaagggacccgagatgggcatgcacgaccc

SEQ ID NO: 5160 - DNA, 618 bp, Sorghum bicolor
  Clone ID: SORBI-28MAY03-CLUS1039_1
agtcgctacacctacactgcacagtcacctctgcctcctgcagtcaccgggccccggcgcagcgcagccaacccaacggacacgatgcaggcccacggcatcgccgtccgcgcccgcgctccggtggcgccagcccacgcacgccgccggcggcaatgccgcgtgtcggcgacggccgcagtcgcggcgcccgccgcgcgcgcccgcgtgacgcactcgatgccgccggagaaggcggaggtgttccggtcgctggagggctgggcggcgcggtcgctgctgccgctgctcaagcccgtggaggaatgctggcagccgacggacttcctgccggactcctcgtccgagatgttcgagcacgaggtccgggagctgcgcgcgcgcgccgcggggctccccgacgagtacttcgtcgtgctcgtcggcgacatgatcacggaggaggcgctgcccacgtaccagaccatgatcaacacgctcgacggcgtccgcgacgagaccggcgccagcgcctgcccctgggcggtctggacgcgcgcctggactgccgaggagaaccgccacggcgacatcctcgggaagtacatgtacctctccggccgcgtcgacatgcgcatg

SEQ ID NO: 5161 - DNA, 761 bp, Sorghum bicolor
  Clone ID: SORBI-28MAY03-CLUS103900_1
cgacaacatgctcgagccgtccgacaagatgccgtggaacaaggccggcaccctgctcgaggccctggactcgatcaagccgcccaagcgccccgtcgacaagcccctgcgcatccccctgcaggacgtgtacaaaatctcgggtatcggtaccgttcccgtcggccgtgtcgagactggcatcctgaagcccggcatggtcgtcaccttcgcccccaccggcgtgaccaccgaggtcaagtccgtcgagatgcaccacgagcagaagctcgaggccgtccccggcgacaacgttggcttcaacgtcaagaacgtgtccgtcaaggacatccgccgcggccacgtcgctggtgactccaagaacgaccctcctctgggctgcctcagcttcaccgcccaggtcatcattctcaaccaccctggtgagatcaaggccggctacgcccccgtgctcgactgccacacttgccacattgcctgcaagttcgagcagctgatcaagaagatcgatcgtcgttcgggcgccgagctcgaggacaaccccaccaagctcaagaagggcgaggcttgcatcgccaagctggtcccctccaagcccatgtgcgttgagaccttcaccgactatcctcctctcggccgcttcgccgtccgtgacatgcgtcagaccgtcgccgtgggcgtcatccagggcgtcgagaagaaggccccggccgccgctgctggtggtaagaagaagtaaacaccagtccgccctcttccga

SEQ ID NO: 5162 - DNA, 622 bp, Sorghum bicolor
  Clone ID: SORBI-28MAY03-CLUS10401_1
gcctattggaaccttatctctctctcgcctgccacgagacgaggaaaacgttggcatgtgagcgccacgcacgtacacctccgccgtacccatgcagcctcccgtgcacgccgccggcagccaccggagcagcagcagcagcagcaccttctccgccaccagccatcgtctcctcccagtcgtcaccatcgccattatcaatcccatcggcaaagacagggaggcggcagctgctgctggtgtcatcgggcctgctcctcgccgccggcgcgcgtgctgcggttgctggtgcaggagaggagggaggagctttggcagtgtacaataatggcccgccgccgccgccgccggtggtgacggaggcggagcgcgcggcgagcgcggcagtgtcgcggcgcgtgggcgaggccgtggggctgctggagctggggcgggagctgcaggcgcgcggggagttcccgcaggcgctggcgtcgttcacgcgcgtggtgcgggagtacgcggacctggcgctgtcggagtacgcgcgggtggggcgggcgctggtgctgtacgagatcggcgaccgcgaccagtccatcgccgagatggaggacgtctccatcgcgctcaagggataccc

SEQ ID NO: 5163 - DNA, 440 bp, Sorghum bicolor
  Clone ID: SORBI-28MAY03-CLUS104029_1
gcacgagggttttcatcgccaaattcacaatataccgacataatggctgagagctaccacaaggaggtcatttctggccttaaggacaagagccttttcatccaggatgctttcatcgatggaaaatgggtcgccaaggagaacaagttcgatgttttcgagccctccactgccaccgtccttggccaagttgccaactgtacgctcgaagatttccagactgccatcaagagcgccgatgctgcccagacaaagtactttgatagcacaactggtgccagccgtggcgcccttctgaggaagtggtatgacctggttctctctcaccaggaggacctcgccaagatcctctctctcgagaacggaaagacatacgccgaagcactgggtgaggtaatttactctgccagcttcatctcctggttcgctgaagaagccac

SEQ ID NO: 5164 - DNA, 792 bp, Sorghum bicolor
  Clone ID: SORBI-28MAY03-CLUS38925_1
acgttcctcgccgtttccgtctccgtctccggaagggaaaaagagaaggaagggggagagaagaagaggaagaagaaactgaatttggtgaggccaagccgggggtgggactagcgggagcacgtggagtgggatcgccgccgataagccgccggtgggactagcgggagcacgcggagtggatcgaggcggatggcggctgcggataggcagcttgtggttgccgtccaggggacggcggcgctggggccctactggtccaccattgtggcggagtacgtcgagaagatcgtgcggagcttttgtgcaagtgaactgccaggccagaagcttgcagggcctccgcctgagcttgcattagttgtttttcatacccatggaccctacagtgcttttgatgtgcaccgaagtggatggacaaaagataccgatgctttcctgtcatggttatctggaatatcattcagtggtggaggattcagtgaagcttctacttgtgaaggtcttgcagaagcactgaagatacttcaaggtagtcctaatgcaacccaaagtcatcaaaaccatgaagcacaaaagcattgcatacttgtcgctgcaagtaatccctatcctttgccgacacctgtatactgtcttcctactcaaagtactgatcacaaagagaacattgagacatcaaaagaaccttctattgctgatgctgagaccgttgcaaagtcatttgctcagtgctctgtctcactgtcggtgatatctccaaaacagcttccaacattaaaggcgatatac

SEQ ID NO: 5165 - DNA, 661 bp, Sorghum bicolor
  Clone ID: SORBI-28MAY03-CLUS117943_1
gagagagagagggagcaaaaggcagcaggaatggcagccaaaagaggcggcggcggaggaggaggaggaggagtccggtgccgtcccaacggagtcgtcccccaaaacagacggcgccggcgtcaaaccgtccggtgcagcagagacgacgacgtcgagcaaggccgtgtgcaacacggacggcccggtctcggagacctgcgagctagacggcgacgtccggaccaacggcagcgctcgatcggtgaccttcgtgccagcgagcccgtcgtcgtcggagcgccgggagtggaaggtccggccgtactcgcgccggaccatgtccggcgtcgacagggtcaccgtgacgcagctggagtccccggcggcggcgtcgccaccgcccgcggcgtgcgcggtgacccacgacgtgccgggcgtgctgttcgcgctcggcgggctgacgggcaactactggcacgacttcagcgacgtgctggtgccgctgttcgccgcgtcgcggcggtacaagggcgaggtcctgttcctggtcagcaacatccagccgtggtggctgggcaagtacgaggccgtcgtgcgcgcgctgtccaggtacgacgccgtcgacctggaccgggacgcgcgggtgcgctgcttccgccacctcaccgtggggctccgc

SEQ ID NO: 5166 - DNA, 616 bp, Sorghum bicolor
  Clone ID: SORBI-28MAY03-CLUS118010_1
acggcgcggacggtgaactcgcacgacgtgctgctgggcgtgcacggcgccgggctgacgaacgcggtcttcctccccgccggcggcgtggtgatccaggtggttccctacgggcggctggagcgcatggcgcggacggacttcggcgagcccgtggcggacatgggcctccggtacctggagtacggcgtggcggcggaggagagcacgctgctggagatgctggggccggagcacccggtgatcaaggacccggaggccatccaccgcagcgggtgggacaaggtcgccgagtactacctcgggaagcaggacgtgcgcatcgacgtcaaccgcttcgcgcccacgcttgcgcaggccatggaccacctgcggcaccggcaccggcaccggcagcagtgagccgtgtctgtctgtcgacgcctcgacggcgacgccttcaattcgtttgattggccggccggacaagaacatgccgcacatggatacgtacatcacgcatctcactgtcacacaacccgacgcatatgcaaatttgcgttttgcagataggtttaggctccaaaactgtaagtcatcgatttgtttggtttggtacagaatcgagcgacgtatt

SEQ ID NO: 5167 - DNA, 576 bp, Sorghum bicolor
  Clone ID: SORBI-28MAY03-CLUS118039_1
gcacgaggctactacctagtacctactacggtcaagcagagcgcgtccattcagtcaatcatctgcatcccgctcatgggtggcgtgcttgagctgggtacaactgatacggtgttggaggacccggacttggtcagccgagcaactgcagctttctgggagccgcaatgtcccacatacttggaagagcaagagccgagcccgagctccaacaccccatcggcaaacgaaaccagcgaggccgcagcagacgcagacgacatagttgtgttcgaggacctcgatcacaatgccatggaaatggagacgattactgccgtggtcgagggacatggacaggagctacgagaagccgagagcctgtcaaacgcaagcctggagcacatcacgaaggagatcgacgagttctacagcctctgcgaggaaatggacgtgcagccactagaggatggctggatcatggacgggtctaattttgaagtcccctcgtccccgcaaccaacgcccccggggaacctagctgatggctctcgcgcgaccagtttcatggcgtggacgaggtcctcgcagtcgtgc

SEQ ID NO: 5168 - DNA, 712 bp, Sorghum bicolor
  unsure (1)..(712): unsure at all n locations
  Clone ID: SORBI-28MAY03-CLUS1181_1
ccggcggtcccggcccggactttcctggttggccccacccgtccgctatttcagagctattgcaagaaattgatcgtccgatcatcctgtcaatctcaccaggaactgaagttactccagcattagctgagaatattagtgatcatgttaacatgtataggataactggagatgattgggacaactggaaggatgtgagctcacattttggtgtgtcgagttccttcgctgctgctaagaagattggggccaccgggttgcgaggaagatcttggccagacttggacatgcttccatttggatggcttactgatccaagtgtaaatcagggccctcacaggaaatgtaaccttactcttgatgaacaaaaatcacagatggcactttggtcaatggctaaatcacctctcatgtatggaggagatttgaggaatcttgacgatagtacattaaacataattactaatcctgctttgttgaggataaaccactatagtagaaataacatggagttccattatgtgtacagtgaaaggacatcaaatgaagaacatcctggtcactntaggtctncttatcctgttcaccttaccaagaatgatggcatgttttgtcagtctcactacttgcagtgacgatgcagctatggatggtatatgtttncacaagatgggaaccagatcatatatgcaggaactatgaaatactgaat

SEQ ID NO: 5169 - DNA, 731 bp, Sorghum bicolor
  Clone ID: SORBI-28MAY03-CLUS10428_1
tactggacttctagctgcaaatttggtaagcagatcgcggtcgcgctgctacataataattagacagcaacccaaccacctgctggcctctgcttcttgctcccaatcttgacacattgatctagaggttgcagaatggagagaacattgatcacctctaacctctccatgagtgcacatgcttcaagatcgtccgggagggttcactacatctctcctgccgcctctgctgctgcacagaactccagctacaggaagaagaagaagagcgccccgtctccgccgccgtcggccgccgcaactgccaccgttgtcacctcccctccggccactgacaatgttcagtccagtgcagtgaagcagaccgggcgacaggagctggaagagctcgtggccaccaaggctaacacttcaagaattgcaagtgcgccgagccaagctcaggctcgggctcagcctcgccgccggcctgccccggcagccacgtccctgccgatggcgttctgcagcgcgttggaggaggcgatcaacacgttcgtcgacccgccggcgctgcggccgtccgtggacccgcggaacgtgctgtcgaccaacttcgcgccagtggacgagctgccgccgacgccatgccccgtcgtgcgcggcgccatcccgcgctgcctcgccggaggcgcctacatccgcaacgggcccaacccgcagcacctcccgcgtgggccgcaccacctctt

SEQ ID NO: 5170 - DNA, 891 bp, Sorghum bicolor
  Clone ID: SORBI-28MAY03-CLUS104273_1
gcacgaggcctaggagaaggcccgtgcgctgtcctgcgccgaacaacccgccgtccgccgcgttccgactccgtttctgtctgtctgtctctctcggcccccgtctctctctccgacgactggtgtgccgccgccgcccccgccctgcgcctggtgctaaggccttcgccggtctcttcgccggcgacgagcacccaccagctatgcatggatctatacgtgttgatgccttgatggacagctaaaaagttccttggcacgaggctggaaaggagggttgttttcctaattcctacatcttgatcatttggagattttcctgtcattctaatgaaggtacaggagttatgtgaccaagatatgttggttgacctggagaaaggcaactgcttgctatccaaagaggacaatagtgagatgaaggttaattcaatagctgggcatgcaaggacaaagccgcacagctcatgggatgatcttgtagcactgaaggatgataagagtcaccacatatctcgttactcttcacactgtcgagattcaactgttaaaagcggagagcctacggcatctgaaggggagatcaaggttgggcttttggataagtcagctgctgatatggaaaagaaaaaatggtacaagaagccaccacgacctccaagaccaccgactactccaccattagaccctgctgatcagaagctcatcagtgaactatcggagcttgcggtgttaaagagggctaggattgagcgaatgaaggcattgaagaagatgaagaattccaaaccagcatcttccattgggaacctggtggctttgaccattactgttatcttctgcttcttcatactttggcaaggtataacaactggtaacccataagaaatg

SEQ ID NO: 5171 - DNA, 622 bp, Sorghum bicolor
  Clone ID: SORBI-28MAY03-CLUS104375_1
cgccgccggacgtgctccaggccatcgcgctcgccgaggcggaggctaagaaggccgccaagaaggaaaccctcaagggcccaaaaggcgcggttgctgccgccgccgccgcggctgcttccaatgccagcgtcaaggcacggaaggccgccccgaccgcgccgcccaagttctccaaggcggccaggaggttttacaatgagaatatcaaggagcgggagccgcagcggctcgccaaggtccttgccgccgcaggagtggcatcaagaaggaccagtgaggagctcatcttccaagggaaggtgactgtcaatggttcagtctgtacttctcctcagaccaaagttgacatctcaaaggattctatctacgttaatgggaatcgcatttccaagaagctgcctccgaagctgtattttgctggtaacaagccaaaggggtacatttgctcatgtggtgaagactcaaagtctgttgtctccttatttaatgattatttgaagggctggaacaagattcaaccaggactgccaaaaccacgcttgtttactgtgggtcgtcttgatgttgccacgtctggtttgataatagtcacaaatgatggtgagtttgctcaaaaact

SEQ ID NO: 5172 - DNA, 473 bp, Sorghum bicolor
  Clone ID: SORBI-28MAY03-CLUS104377_1
gcacgaggggagattgatgagtacttcttgaaagcagcagcaagtgggaaagacgttgtgattcttttggactctgctggtgggcggcctgatgccttagagatagaggcaaagaaaggtgcgggaaaaaattccaaatctgcgaaggttttctccacgctttcttggagctggtcttttaaatctcagcaggctaacagcgaatcctcagttctgaattctagtgattcctctggatatggttaccatggcaagacgctggagaagctttatgatgaggagcaaaaactctacaagttaatcaagaatttgcaaggcttcagtataagaaacatgtctcagtgctacaaaagctagaatcaggggaacatgatagactgcatgcagaaagagtacgggatgctattgaagaactgcagactcggataatctcattggaggaagctgtgagtttggcgtgtttttccatatca

SEQ ID NO: 5173 - DNA, 910 bp, Sorghum bicolor
  Clone ID: SORBI-28MAY03-CLUS10455_1
aggttttgttcctgttgatgagcggatgcaagttatggatgcaactggcaatgtggttcctaatttatattgcattggagatgccaatggtaagctcatgcttgctcatgcagccagcgcacaaggaatctcagttgtggagcaaatcagtgggagggacaacatcttaaatcacctaagcatcccagctgcctgtttcactcaccctgagatcagtatggttggcttgacagagccacaggctagggagaaggctgacaaggaaggatttgaaataagtgttgtaaagaccagttttaaggctaacacaaaggctctggcggagaatgaaggagatggacttgctaagatgatttatcgccctgacactggagaaattctcggagttcatattttgggcttgcatgctgctgatctcatccatgaggcatcaaatgccattgcccttggaacccatgtgcaagacatcaagtttgctgttcatgcacacccaacgttgtctgaagttctggatgaactcttcaaggctgccaaggggacctcgggtgctccgcgtgctatgctccagcccgttgctgtgtcgtgggggaccggtctcatgtctccccttctgccgccgccccactccgcggtgacctcccctttggtcgcaacgtgtctgcccctcacaggcagctgtgtttctagcctttcgccggcctgctcattctgacttcctcgatgcgtgccgacactgtctatttaatgagaaaagagatatccagtgatgtatcctatgtatgggaaaaatgtaaattttgtagtccttgtagagagtaaacgtacagtgccttaacacgtcttgtgaatctatgatttgcttgaattgatagtgtgggcttgtttagtagagctccactccctgattctc

SEQ ID NO: 5174 - DNA, 367 bp, Sorghum bicolor
  Clone ID: SORBI-28MAY03-CLUS104727_1
gcacgagggagagagagagagcagggctgctgaagaagctgagagaggaatcgctgccagtggaaagcggcagaagcaagaaccagcaagaaaggggagagagaaagccgaggaacttttcctcggattggatccttcgcttttgggggaaggagaaggcccctctcagtcgtctctccgtccttgcggagggcggcagcaggagcagcaggaggaggaagagatgttcccgcctggcctgatccaccaccgcgctgacgccccagctcccggcgatggggcgccgcgctccggccccggcgggccgagccttgtactgacggcggaccccaagcccaggctgcggtggacggccgacctccacgag

SEQ ID NO: 5175 - DNA, 705 bp, Sorghum bicolor
  unsure (1)..(705): unsure at all n locations
  Clone ID: SORBI-28MAY03-CLUS10339_1
agttctagatcgcgatctagaactaggccaaaaaaagggagggatgaaaattttaggtcgttttggccacggagcattcaggcctgtccagggcgcgagtgcgccgccgccctaggacccccgcccgccgccgctgagatgttgctatcgctggtgcgcgcgggtagcgcccctctccgccgagtcgtctccacgttctcctcgacccgagccgtatcgcctcgctttcggtgcgccatcagtagcggcggtaacctcaacctcccgttgtacgctcacccctcgccgtcccgcgacggctcgagcggtccggctggtggagcccggcgaggaatgagcttctgcgcccgcgcggtggacgtcggggacgaggcagcctccagctccgccgccgtgggctcggacctctccgcaccttacctctccgtccgcattcgatgccgcaggcacgacgtggaagcactgtccgaggcgctcttgtgcttcggtgctagctccgtgaccgtggatgacattgccgatgctgaaaatctcgatgaaatctccataacttccttatatgccgatggggaagacgtggactcaagcgtatcaagtgccgcatgctcagctggtttgaactacagcccagtgtatgaaacctntgtcgggaagcagtgcgattgggtggcaaatgtgcaggaaacatacgagcccactgaagtg

SEQ ID NO: 5176 - DNA, 1016 bp, Sorghum bicolor
  Clone ID: SORBI-28MAY03-CLUS10340_1
cccacgcgtccggttccatctttatcagatctccaccttacccacctgcagtcgagcctgctgtacccggggctccgccgtcccgaccatgtcggtccgacgatccctatcccggcaagaatcagcaccgacctgaccatcggaggcgcaccggcgcgcgacgacgacgtcccgtgcgctctgtccatcggcgccaccaacaagcagaagcccgacgccgtcaagccggcggggctagtgctcttcggacggaccatactaaccgagcagcagatgagcctcagcagctccggcggcgcgacctccccagccgcgactaccggcaacagctctcagctgtactggaacgccgagaaggggcccaatgtctcggagggctcgggctccggcgtcatccagaacagcccgaccaagaaccacgcgtcgtcggagcggctgccgtggtgcgtcggggacggcggcagccagcagcaggtctccgagctcgggcttgagcccgggcaatgcaaggtgttcgtcgagtccgacacggtcggccgcaacctcgacctctcggcgctgagctcgttcgacgagctctaccgccgcctgtccgagatgttcggcatcgagggcgcggagctgcggagccgcgtgctgtaccgctgcgccaccggtgaagtgaagcacgccggcgacgagcccttcagcgatttcgtcaggtcggcacggaggctcacaatactaaccgatgctgggagcgacaacctcggaagctaaacgaggagcagctgcagcagtgagatattccagccgcgagtattatgatgttctttggtactattactgttagcatgtactactgctgtacaggtgaggccgtgaggcgtgagctatgatggttttgttcaaagtccgttccaactctgaactctgaagagagatttcgccatggacatggcagctcgtaggcaatgctgcaatgattaggcagcagctcgttcttgctccttctctgtatccaacaaatcactgta

SEQ ID NO: 5177 - DNA, 709 bp, Sorghum bicolor
  Clone ID: SORBI-28MAY03-CLUS10359_1
tctactggaagagaagtataccaggcctgttaattttgctggtcctataaaaatgtttggtgatgggcacacagtgacagtaattaatgttcagagcaagttgagctcacctcatatttacagcaaagatcctggggatgaggaaagactatctactccaggacagaacaataaggagagtagttgctatcataattgtgaaaggcactgttatcagcctatattaccatggataaatggcgatggtagcacaaatagcactctctatgaaggttgagtcgccgagttattggttatgtcatgcactatcctggactaatggaggaagatgttatccgtcggatggatgtattgaatcctcagacttgcaggaccctgctagaaaagctaacgcttgatgggtaccttcatgttcgggtgtttgaagaacctgtgccgatggctccgaccatactgcagggtttgttgaagcaacactctagtaaagaaccatcaaaatgtgtgaagcgctacttcgcaaacccaatgagcacattacaactgtaactgaaagaatagtttaactttgttctagatctagagtcgtgagtgcatcatgatttggaatgtttaaatgataccctccccagaagtgctaagggccttgcagaactgaaccatcatcgcttgtccgttttcaaggcgtgcttgatctaagacactcagtccc

SEQ ID NO: 5178 - DNA, 392 bp, Sorghum bicolor
  unsure (1)..(392): unsure at all n locations
  Clone ID: SORBI-28MAY03-CLUS103638_1
gcacgagggtcgagccgaagcaaccagcagccccatttcgatacgcgcgagggagccggatcgggatcgggatcgggatcggaagagaagtgtgggcgggcacacaagagacacacagggagggagggggaaccggggaacattccaatcaactgccgatgcagcgggacgcgagaagctggccgcccttacgcgatgccttcgcccgtgcagccgtcgtccacgagtccgtgccccgcgcggtgccacatgtcatatctcctgctgtccggtgctgcttgtttctgacggttttgctcggtcgatcggttgtgtgttccgccgcgcgcatgcaggcaccaaggagacggtgaagaatgcactgtcgcggtgggggcggaaggtcngcgagg

SEQ ID NO: 5179 - DNA, 491 bp, Sorghum bicolor
  Clone ID: SORBI-28MAY03-CLUS103647_1
gcacgagggcctggcgggcgcctccctcacttgacgcctcagctaacaccaccctcgtttctctctctctctctctctctttcccccccactccatgtgggtggcctcgagctctgcttagatcacagctgtgcgcgctggttgggtgatccactgatccgcccccttccccccttgtcggctctcctttctttcagcccgagagctccgggacagggagatctgcgctgtcgccgcgctcgcctcgcctttcttgcgcgcgcgcgtgtgggctgggcagcagtgagcttcccccgtcttcctcagcctcgcttcccttcttcctgctggatctggctcgcaagatccgacgtttcgtgccccgtttgctcaaagatcctcgcttgggtggtggttcctggagatttctgggaggatgcagcacgaccagaagaagaaggcaccttcagagatggattttttcacggagtatggcgagggaagcaggtaca

SEQ ID NO: 5180 - DNA, 712 bp, Sorghum bicolor
  Clone ID: SORBI-28MAY03-CLUS10525_1
gcacgaggaaagaatggagttgatgtaggcatttgcttgacatgcgcgagccagtccgcgctgaataaagtagacacgcgatggacaacaggaagagatgtttggtggcaggatgttgtgcccgatttcccaactaaatgtgatgtggaatgggttgatgcagaggatccactgtttcttttgtacacaagtggcagcacaggaaagccaaagggtgtgttgcatacaactgggggctatatggtctactctgctacaacatttaagcatgcatttgactacaagccaacagacatatactggtgcactgcagattgtggctggattactggacatagttatgtgacatatggtccactattgaatggagccacagttcttgtttttgaaggggctccaaattaccctgatcctggtcgctgttgggacatcgttgataaatatggagtgacaatattttatactgcaccaacacttatacgctcgcttatgcgtgatggtactgagtatgttgctcggtactctcgcaagtccctccgagtgcttggaagtgtgggtgagccaatcaaccccaccgcatgggaggggttctatgatgttattggcgactcacgatgccctatatcagatacttggtggcagactgaaactgctggattcatgataactccattacctggtgcttggcctcaaaagccaggatcagcaacat

SEQ ID NO: 5181 - DNA, 470 bp, Sorghum bicolor
  Clone ID: SORBI-28MAY03-CLUS10528_1
gcacgaggcggcatcctcccctcccttccgctgcagtgcccacgctctacccccagcagcaaccgctgcgggaggtggacgtggttgggtttggagggaactgccgcagcgggaggagatcaagagctctccaatcttccattccccttggactgccacttgtttcggttcgtgttgaacttgaaataggttagataaataaatgggagtccaagaagattctaggccttctggggccctgggtggcctgtacggggtacagtttgcgggccgggcactatacagtgacgacgtagcagtcaaaactagcattgtggattcttcaacttgtgaaccgcaagtggataatggccggagccggcgtttgctaatctggagattatggaaacagagacccccatgcttgaagcccgtccactgtagcctctcatgcgataaacatgttggcgaaactattgcaaatgttgtta

SEQ ID NO: 5182 - DNA, 643 bp, Sorghum bicolor
  Clone ID: SORBI-28MAY03-CLUS1053_1
tgctcttcagtttactactcgcaaataaagtattgtctttttttttttttgagaaagtaaaatataacttaggatttttctctgaacaaataaaagactccctcgaaaattacaaacatcataacaaatctatttagtttagaaacatgttacttatatgtttagatatttatttgaaaatactagcaaaatctcatgatttgaatattttttagaatatattctagaagaaattattagtcaaagataaacatcaaactgtgcaaaggcaaatgtgacaactatttttcaccagagggattaatccttagttggtcattttaaccatgcagtacatttaccttatctgttgcttctgatgattccaaatgatgtgcacaatgttctaattcccaaacatacatgctatgttctaacgaacctgcagagacatttgtacgtgccgatggggcattcatcccatttgctcatgactttgacatctccacagtctcaaccacagttaggggtgttggtgacattggggatgtcaaatttatagatctgcagtgtccacttaatagcctcatagggaggcaagtatgcaaaatcggcagaagttctggtcacacaactggaactgtgatggcttatgcccttgagt

SEQ ID NO: 5183 - DNA, 508 bp, Sorghum bicolor
  Clone ID: SORBI-28MAY03-CLUS105374_1
ccctccgaccttgagcgagatgttcccaactccaaggtttccttctccaacatcaagttcggtcccatcggaagcacctacaagagcgacggcaccacccccaacccccctgccagcagcagcaccactggttcttccactcccaccaacccccctgccggcagcgtcgaccagtggggacagtgcggtggtcagaactacagcggccccacgacctgcaagtctcccttcacctgcaagaagatcaacgacttctactcccagtgccagtaaaggggctgccgagctatctagcatgagattgaggaacgatgtgatgaatggatgataaaggagaagtgcgtggatgagatggacttgatgtgggaagacaggggttggctttcagttttccgagtactttgtgctcttcttttgcccttcgtttgtctcgcgcaagaaaaagcgacccttgtccctattgttatatacatcagtagaaaatagttacaactgtcgttatcaacct

SEQ ID NO: 5184 - DNA, 875 bp, Sorghum bicolor
  Clone ID: SORBI-28MAY03-CLUS105467_1
acagctcaaatgaatgtctttactttcagcaaagggcgtcgtcgccgccgccgccacgggcgactgagccacccccatcgcaatctccatgggtggttcacaggcagctgtgatctctcaagtggatcatccccagccagatgtacccgctggaggtgaggtcggcggggaaggggatgagcgaggccatctcgctggcgctcaccttcgtgcagacgcagtccttcctcaacgcgctacttggctcgggcgatgaaggaaggaaggagatcgacgcgcgcctctgctcggcagttgtcgacgagcagggagatggcggcggtgttgacttgattggcggcgagctgggaggcgtcgtagatctcgtgaagcacgacacgaagcacttcgtggaattggatttgggagctcaaatcttcaccaaacagataccctatcatgtatgcaagcacaccaacaagcaacagggcgagcatccgatccggccgatcactcaggtgcaggcgcagtgctcgatcagaggcgtcgtcgacgctgctgctgacgaaacaggagaacgaagccaccagcagacgtcaccgcagccgcggcccagactcccgccgccgcgacgggccacggcttcacgccgccttccttccggccgagctgggccgtgagctgccccctgagcgccctttccctgcgcctgggcccttcccggcgcactgccccctccggcgccgccgccctctgctcgtactcgcgaaggaagcggagcagcagcaggagcgcgccgcagctgacgatcacgaacgctacggacgcgacgtcccctgccgccgccgccctgtaggtggctgcggcgcaggtggcggtgaggaggaccctcgtgc

SEQ ID NO: 5185 - DNA, 668 bp, Sorghum bicolor
  Clone ID: SORBI-28MAY03-CLUS105618_1
gcacgaggctcctcctcctcctcctcttccattcggcgtgtacccgccgccaccccctctcgcgatggcaggccatctccagcagttgccagtatattatctgttaaagttgtggcttacgcttcaccttgacatttacttactaggaatatttggtgattttttcttttgcaccaaggttaggtgcttcttttacctgaatttttaatggaacccacaaatcttttgtgatgtttctttttttcattctgagatctgatacagttaataatgcatgtgatgctttctcaagcaattggttggtagaaagcatatcatcaggtcaatagtgcaccaatcataggctaggacccattgtagaactggatgatttgtctggaggtctattagtggttgtggttgaaattaaatatgtgcattcagcatttgtcataaagtatagtaacacataacatgaatcagaatagataatgaaatcctgatactagaaatatggtttattgaaaatgggtagctgtcgtctatcacttcgtagtcgacagagcatatgtttctgtatagattatgagatatcttggattgttagtagcttttctactaatgttcaaactgcagaacgtaaaggagattaccaaggaaaaactgttcagaattagagttaactatct

SEQ ID NO: 5186 - DNA, 1002 bp, Sorghum bicolor
  Clone ID: SORBI-28MAY03-CLUS104128_1
cttcccccaattgtcactcataatatgctcaacgatcatggcgccccggtcctgaaccagattcgacgtgtacaacttttcaaccatcccaccgaccgagtcaaggtagtcttccaccccgagttcctcaactctgccaaccctgttcttcctctcgattacgacgactttgtccgaggttgtcatctgggcgtcttctcttcgtactatgagccttggggctatactcccgccgaatgtactgtcatgggcgtgcccagcattaccactaacctttcaggttttggatgctacatggaagagcttatcgagaactcgagcgactatggtatctacattgtggatcgacgaaccaagggcgttgacgattccgttaaccagctcacttcgttcatgtacgacttttgcggcaagagtcgccgccagcgtatcaaccaacgaaaccgaacagagcgtcttagcgacctcctcgactggaagcgcatgggcatggagtatgtcaaggctcgtcagctagcgctacgccgtgcctaccccaattctttcagtggcgacgatgaggaggaggactttatacctggtgtcgagcaaaagatttcgcgacccttctctgtgcccggttcgccacgagaccgcactggcatgatgactcccggcgattttgctagtcttcaggaaggccgtgaaggcttgagcactgaggactatgttgcatggaagcttcctgaggaagaagatcccgacgagtacccattccccctcactcttcgaacgaagcagcctgccccccatagcccttctgataacgtgcctgtcaacggaacccagtaggaccgatgttccagattctttcggacagggcttagagaagaggctgaaggggagggattgtattgagtagacgggcagaaccttgattaattattgttgtttttatgggaacgagcaagaggtggaaatgagctttctcatcaggcagaagacttgtatgtcattaatggt

SEQ ID NO: 5187 - DNA, 491 bp, Sorghum bicolor
  Clone ID: SORBI-28MAY03-CLUS104171_1
gcacgaggagaagatatatcccagtgatggtttgcttcctatctacataaatcctcattctgggacagcatcatactcaactatcacatttggtgctatgggagatagcttctacgaatatttgctcaaggtctgggtccaggggaataaaactgagcatgtaaaacactacagacaaatgtgggagacatcaatggaaggtctattaagtttaaccaagaaaactacaccatctaattactactacatttgtgaaaagaatggtggctcgttatctgacaagatggatgaacttgcttgctttgctcctggtatgctggcattaggagcctctggttatggaccagaaaaatcagagcaaattatgaatcttgcaaaagagcttgctaggacctgctataatttctaccaaaccactcccacgaagttggctggagaaaattattttttccatactggacaggacatgagtgtgggcacatcgtggaaca

SEQ ID NO: 5188 - DNA, 333 bp, Sorghum bicolor
  Clone ID: SORBI-28MAY03-CLUS104181_1
gcacgaggctctcttctctcaacgcaacaacatcatgccttccagatctgagatcacgtattttggcgcaggcccggctctgctgcccacagacgtccttgagaaggctgcccaggccctcattgactatgagcataccggattaggcattgccgagcacagccatcgctcagagctggctacaaacatcatcaacgaggccaaggctgatcttgcttcttacattgacattcccgaggactatgaggttcttttcatgcagggtggtggaagtggagagttctccgctaccttgtacaaccttgtcggtgcatgggtgacaaagaagaaggc

SEQ ID NO: 5189 - DNA, 688 bp, Sorghum bicolor
  Clone ID: SORBI-28MAY03-CLUS10421_1
atattgttgggtggagaacatcatcaatcagaaaagattctgaactacccaaggtaaaccttctgtattagacattgtgacttgtgttggtttcactgaccgataacatgatcttttctttcattctaccattcctaatctgcattttaagtattcttccagtgggctgattcaaccaacaagatttacccgcatattgtatatgaggaactatccaaatcagaagttcctaatcaatgtgctgacactgacaactgcaaaatagaagaacgccttttacaaggacttaagcgtgtgtcatgggaaaaggtggacgttagcttccacaacagtaaagtaagatctgcggcacatagtgtgattcaggtattgcctttgccgtctggtggcattctcatattcagaagtaaaaatttgcctcggtaccaagtgcatgagcctggcgttcacgttcaacgaaatcccaggtggcacttttaggctcgtgtgggtcaggtatatagatatagagggtggaaacacgtgcacatgtttgttggtttatttagtaatctgtgatcatatatatatgttgtacgatatatgtaattttagcactattcttgttgtaaatgttcatttatttatagtgttggtcttctctaaccctaattttgtgagcattttattgttaaggaagaatgacctc

SEQ ID NO: 5190 - DNA, 762 bp, Sorghum bicolor
  unsure (1)..(762): unsure at all n locations
  Clone ID: SORBI-28MAY03-CLUS10571_1
gcacgaggcttttatccttcgtcccgtactcccgttcttggccgggacctccggcgaccgggcgaccagtgacggcagtggctgagtggcgggcgggcgagcgtcgacggccttcgctaggttttcgtcggccccttcgccagcgactggcaacgccctttgccaggtcttcgtcggcccctccgctggcgaccggcaaccgccctttgccagctcctcttccccggcaccaggactgaagataagatggctgccttgccattggccaccgctgaagcatgtgatgctaatgctgctttaattatgaatggtgatcttcgtgctctccaacctatcttcaaaatctatggaaggcggcagatttttgctggccctgttgtgacactgaagatcttcgaggataacgttctgctccgcgagttccttgaggagaaaggtcacggcagggtcctggtggttgatgccggtgggagcatgcgctgtgcagttttgggtggcaaccttgcccagctggcgcagaacaacgggtgggctggcgttgtggtcaatggctgcatcagggacgtcgatgagataaatggttgtgatgttggcgtgcgggctctgaactcgctccctatcaagtcaaacaagaagggcgtcggtgagaagcatgctcctgtgacctttgcaggnactaggatttgtgatggcgaatggctctatgccgattctgatggaaattctatctncagatcagaattgactgtgtaggccttttct

SEQ ID NO: 5191 - DNA, 772 bp, Sorghum bicolor
  Clone ID: SORBI-28MAY03-CLUS106108_1
gcacgaggcccctttccatcgccgattcctcgcctcctcccgtcggctccgattcgccttccccgaactcccgatttgctagcgacgccgacgccgtggtgacgcgccgcgccgcgccgcgcatggagatctccttcgaggcgtgggagggcgtgcagcgccccggccaggaccttgcggaccgcctcgcgcagggcttcacgggcctgctccaggcgccgccgcagttcccgtggccccccgcgccgcacaagcggatgcccatgccccttgacatcgacctccccgtcggccccgccggcgcaagctgccgacgccgtcgccgtcggcgccgactactcaggcgcccctgccccccgcggcttccgtgggcgagggggcggtcgggctctccgtcgaaagggctgctgtggataggtgccccctagaggcggcggcggccgctgccgctgctgcgactgggagcgcagccgcatcgagcgtcagcggtcatgttaacggcgacgatttggacgaggatgacgagggtttcggctgcgatattgggactcttgggaacttcaagaaggccaacggtactgtaaatatgtcggcaacatacaataccaggactcaggacatcgagagttctgttgttgcacgtggagacctctggaggctagaggcatcgcgtggtggatcaacttctggaaatgatacttcgcccctctaccttgttcagttgggccctctactatttgttcgagactctacgcttctcttgcctgttcat

SEQ ID NO: 5192 - DNA, 556 bp, Sorghum bicolor
  Clone ID: SORBI-28MAY03-CLUS10620_1
gcaaccgcatcctggccaccgagatcccacgtaactacccggactgccagagctcgccggctcgccgccactgaccaggcaggagtagcccagtgcccgccgcatggccgcgcgcgcaccgctcgtcatggcgcgcgccgccgctagcgccggcccgctcccggctgcggcaaccgtggccccgcgccagcccgcgcagtgtctccgcgcgaggggggctgtcagcggcctcttcttcgaccagcggacagcgcacccggtccgccgcctcctccctgacgccaagttcggagcgattgggagcaccgcggaggccgcgccggcggaggggctcgtgcagaagctgcagggagtcgaagtgttcgacctgaacggcaaggcggtgtccatcgttgatctgtggaaggaaaggaaggcagtggttgcgtttgcccgccatttcggatgcgtgttgtgccgaaagagggcggaccttctagccgcaaagcaggttccatggctgatttctcgtgctgttcttctgtagtatcaaaatttgccagttgccagtgtgcag

SEQ ID NO: 5193 - DNA, 672 bp, Sorghum bicolor
  Clone ID: SORBI-28MAY03-CLUS10625_1
gcacgaggaagatgccaaagcgattgttgtacagattttgagcgtagtggccttctgtcatcttcagggagtagtgcaccgtgatttgaagccagagaattttcttttcacgacaagagatgaaagtgctcctatgaagttgattgactttggtctgtctgattttattagaccagatgaaaggctcaatgatattgttggaagtgcatattatgttgctccggaggttctacacagatcgtacagtatggaagcagacatttggagtataggtgtcataacatacattcttctgtgtggcagtaggccattttgggcaaggacagaatctgggatcttccggtctgtgttgagggctgatcccaactttgacgattcaccatggccttcagtatctgctgaagctaaggattttgtgaagagatttctgaacaaggactaccgaaaaagaatgactgctgtccaagcactgactcacccttggttacgagatgaacaaagacagattccattggacatactcattttcagattagttaagcaatatcttcgtgctactcctcttaaacgtttggcattaaaggcactatcaaaggctttaagggaggatgaacttttgttcttagatgcagtaagctgtgaaccaaagggtgatactcgcacttcgcagtt

SEQ ID NO: 5194 - DNA, 564 bp, Sorghum bicolor
  Clone ID: SORBI-28MAY03-CLUS106315_1
gcacgaggaccacttcttcagtcaactcagtctcatctatccaacggtctagcttcacttcaagatgtatcgcgtcgtcgcaaccgcctcggctcttattgccgctgctcgggctcaacaggtctgctctttgaccaccgagaccaagcctgccttgacctggtccaagtgtacatccagcggctgcagcgatgtcaagggctccgttggcattgatgccaactggcgatggactcaccagacttctggatctaccaactgttacaccggaaacaagtgggacacctccatctgcactgatggcaagacctgcgccgaaaagtgctgtcttgatggcgccgactatgctggcacctacggaatcacttccagtggcaaccaactcagtcttggatttgtcacccagggtccctacagcaagaacatcggtagccgaacctacctcatggagaacgagaacacctaccagatgttccagcttctgggcaacgagtttacctttgacgtcgatgtctctggtattggctgcggtctgaacggtgctctctacttcgtcagcatgga

SEQ ID NO: 5195 - DNA, 960 bp, Sorghum bicolor
  Clone ID: SORBI-28MAY03-CLUS106696_1
gcacgaggcccggttgcctcttcctccgctccggtctaccccgttgcctcctcctcggccccggtctacccagctagctccgctcccgtctacccagccagctctgctcccgtctaccctgttgcctcttcctcggcccctgcctacaccaccaccgaggtcatctctgctaccacctatgtcgcccccggggagaccaccatcacctacggccccagcacctacgttgttagcaagagcggcaccctgagcatccctcagtacactgccacctacgtccactaccccgtggcttccgctcctcctgctcccgccaagtccacccccgctgtccccgtggccgccgccagcaagcccgcttacactcccccggcctactctgccgtcccccctgctcctcactaccctgccaccaacggctccacccccgctgtccctgctgctcagggtaccgccaccggcaccaagcccactgctaccaagcccgccacccctgagttcactggtgccgctggcaaggccaccgttggcttcttcgccgttgctggtgccgttgctgctttcttgtaagcagttcgctcttgagtggtttgttggggcatgattccgtcatgtctcatctgatctattcttgagagttggtgggggggttcaagaggagggaaacgaaaaatatggcttcacgggttacgacttgataactgcattcacgattcagtctcggattgagagttgcggtgtttccggtacgagcccttgcttccttgcgcaaatctgtcgcagcagcatttcgatggaaaatataatacttggtattgtaatacgcattggttggaatgcttagtcgccctatggagggagtcgtgtggtcctggtggactcgcttgtcttccatagattctttgcctgtagttttttgagaggaatccgcaagttaattgacagcagtccccctttttt

SEQ ID NO: 5196 - DNA, 701 bp, Sorghum bicolor
  Clone ID: SORBI-28MAY03-CLUS104919_1
ataataaaaggggagggccatggaagtgctgtggattggtggacctttggcatattcttgtacgagttgttgtttggcaagaccccgttcaaaggttcaggcaaccgggctacactcttcaacgttgtgggccagcccttgaggttcccagagtccccaattgtgagcttctctgcgagggacatgataaggggattgctagtcaaggacccgcagcaccgacttgggtacaagcgtggtgctaccgagataaagcaacatcctttctttgagggtgtgaactgggctctcataaggtgcgcaagccctccagacataccaaagcctgttgagctcgagtgccgcccaaagcaagtgccatcagcaaatggaaaggtcgcgccagtcgctaaccaaaaggggccagataattatctagagtttgagttcttctagggaatttatgtgatttctgaactgagagagagcatctgggctgatgctgttgaaagaaagtgaaagatgatgagctactctaggcatgtgcttggctggttttttttctgccattagactgtatgctcgtttcaggatatccgagttgttatttttccgtgttgaactgcttaactctagggtctactcaatccatccatgtatgttgaaattttcagcaaccccacctatggtacttgaaatggatttcaggtactacttgttct

SEQ ID NO: 5197 - DNA, 723 bp, Sorghum bicolor
  Clone ID: SORBI-28MAY03-CLUS10503_1
caacaatgatgatcactgctccccagtacaagttcattttcccgaggatcagaaaatttcccaagttgcatgcggatggaggcatacacttgccctttctgagaagaaaaatgttttctcctggggaaggggtactagcggacagctcggcaatggtgaaatagttgacaggaatacacctgtactgattgatgccttaagcactgatggttctggctgcaagaagttggagtcatcaacggcagccccatttgcagccaaagtttgggtatcgccatcagaaagatatgccatagttcctgacgaaaacgttcctaaagcaggcgaaggcacagcacgaggcaacggcgccgacgcgaacgtaccagagaacgacgtaaagaggatgcgcgtgcagtcgtagttcttctaccatccactccaccgacctcccttaagtccttaaccctagtagtactatgaagaagacctggtgccccgtctagcggtgcccgatttttgtgcattatgttgtgccgaagtactttccgtggacggacggacctcctggtgttgagatggtagcggtagcactgcctcgcgtcgtagcgatgatgtgtgtgtgatgtgattcacctcttagaggtggctagtagtagcccagtcgacctgcacttgttgtgatgttaagatgtgtcctggatctttgacattcatggagggtacaataagtgcttcattctc

SEQ ID NO: 5198 - DNA, 674 bp, Sorghum bicolor
  Clone ID: SORBI-28MAY03-CLUS105037_1
cagttcaaggctttctgggacaagactggcaagcaatggcagcagggtagcttctggggcaagcacgcgggtctcttcgtctccaccggtacccagggtggtggccaggagagcacctgccttgccgccatgagcaccctcgcccaccacggcttcatctacgtcccattgggctacaagaccgcctttgccgaccttgccaacctcagcgagatccacggcggctctgcctggggtgccggtaccttcgccggcgctgacggctcccgccagcccactgagctcgagatccgtgttgccactgcccagggcaaggccttctacgaggctgttgccaaggctcaccagtgactagatgatggtacttcgggggaaaagaaggccgttgcagcgaccgctgcagcgaccaacggaacgaccacaaccccggcagcgacgaccaacaatgcttctagcactccagctgctgctgctgccccatcatcgtcacaacctcagcaaaagaccgagaaagacaaggagggcccttgtggcttgccgacaaagtgcgacatcatgtgatgtcctcgctcttgtttggctgagctgcttgtctacccttccttcttttatacatataccctacctaaacgttaccgctatgatgcccatgtagtgaacaacaaaaaaaaaaa

SEQ ID NO: 5199 - DNA, 645 bp, Sorghum bicolor
  Clone ID: SORBI-28MAY03-CLUS105157_1
agatcaagaaggcgaaactcgacacatcaacattctttgagacacttggtggtactgagtctccaggcaggacatggatgcttatcttcactgcaaagggtcggctggtcaaagggcagtattttccagtgactgcagtccagcgcttcgatgccgcgggaaaacggattgagaatggcatatatttgggccctattgggtgcttaacgtttgaagggaggctgtcatggaaaaagaaaatacttgcattcatcttcgagcgggttcgcataaaggttggaccattgggtcccctagaaatcggcttcggaagcagcaatgatgatagggaacccagcacaaaggacccgttctttgtttggttctatgttgatgaggaaatcgctgttgcgcaaggcagagccggtggagtagcttactggtgcagatgtcagcgtgtcccctgaagattcagacattcggttcgcttcaaatcactgtacaagatcaggataatgtagtctctagtttgtagggttaatgttcatctttgtactatctgcttggtctccaaaaacgagaaaaggcaaggaggtgtagataatgaaaccctattaaaatcatacgcttgtgtttgtgtggcttttacagtttgagcatgtcagt

SEQ ID NO: 5200 - DNA, 774 bp, Sorghum bicolor
  Clone ID: SORBI-28MAY03-CLUS107519_1
gcaaagcagcaaccacccacctgcgggcagaaacatgtctccgcctgttaagatcatcggccattacgcgagcccattctcgcaccgcgtcgaggccgctctgcagctcaagggcgtgccatacgagctgatccaggaagacctgagcaacaagagcgagctgctgctcgccaacaaccctgtccacaagaaggtgcccgtgctcctccatggcgaccgggccgtctgtgagtccctcgtcatcgtccagtacgtcgacgaggccttcgacgggccgcctctcctcccggccgacccctacgaccgcgccatggcccgtttctgggctgacttcattgacaccaagctcgtccagccgttctggctggcacactggacagagggcgacgggcagaaggctcaggtggaagaggccaagcagaacctggcccttctggaggcgcagctcaacgggaagaggttctttggtggcgacaccgtcggctacgtcgacttggctgcctgtgtgttgggtccttggctcagcgcggtagaggaggtgactggagtggttgtgcttgacgaagacgagtaccctgctctacgccggtggtccaaagagtacagttcctacgaagctttgaagcaatgcggcccggggagagaccagctcgtcgccttctatactgaaaagaaggagatgtacaggatgttcgctaatgcattgttgcagcaatagttgggtgccagctcatttgtaattttcatgtctttttcctctctttgtttgtttac

SEQ ID NO: 5201 - DNA, 683 bp, Sorghum bicolor
  Clone ID: SORBI-28MAY03-CLUS10750_1
ggacgccgcgagggcgcaggagtactgcgagcgcgcccataagtgcacacagggcgacgccgaggcgctgtcgctctacgcgggcctcgtttgggagaccagccgcgacgctgcccgcgccgacgactactacagccgcgccgtccaggccgcgcccgacgactgctacgtcctgggctcctacgccgggttcctgtgggacgccgaggaggacgacgaagagaatgacaactccgagaccttgccaccgccttcgctgttccagggggcggttcagcatccttccatcacagcggcatcttagatgaacatgaactcgatctagatctcaccaccgcttgtgaacgaagctgaatctggaacactgaagagcaccatgcgagaaaccagaccggccccctacgagtcaccgacatcgctggccggctcctcgccgcttgtgaactgatgaatcacggctgatgaatcacggcacatgtaaaaactgaatctggcagagcacaaacgcgtaagcctcttaaggtttggcacctgaagaatttgcagggctatgtatagtagacatgtagattgagaccctgcagagcttctacatgcagaatgttattggtcccctgtgtatcagtactagtaatgcagtatccttgtgaaataaaggttttccctgctgcttcgtcagtact

SEQ ID NO: 5202 - DNA, 640 bp, Sorghum bicolor
  Clone ID: SORBI-28MAY03-CLUS107393_1
gcacgagggttcggtccatacggcgatatcgaggacctcagggtcgtcactcgatcgcaacacgggcaagtgcaaggggtacgggttcatcctcttccgtcaccgctctggtgcccgagccgcgctacgcgagccccagaagaagattggtaaccgcagcaccgcctgccagctcgcctctgttggccctgtccctggtggtgcgcccaacagcgctggcgctgtgccagccccggctcaattgcacctgccaccggtgtcagagtatacacaacgaaagatatttgtcagcaatgttggtgcagatatcgatccaaagaaactgcttcagttctttgcaaggtatggtgagatcgaggaaggtccgcttgggcttgacaaggtcactgggaaacccaagggatttgctctttttgtctacaagaccattgaaagtgccaagaaggctcttgaggagccacacaagcattttgatggagtggtgctgcactgccagaaggcgattgatggaccaaagccgaacaaattaggaggagctggaggcttttttggtgctggggcttcaagtgggggcaagggatttcctggttatggagctactagtcattctctgcctggaactgttggtattgtccagcca

SEQ ID NO: 5203 - DNA, 399 bp, Sorghum bicolor
  Clone ID: SORBI-28MAY03-CLUS107532_1
gcacgagggctagtgcgtttgcccgctcatcagcgcctgcttggcaactaccaaccaactcggcccgtcacccgtcagtctcctcctgcggctcctcctagttctcgcgcgccgccgtcccgcgggacagcgccacgtacgggccaaagcgcggcgtcccaagctcacagtctgctagggttgcggaatggcttcggcagcggcggaggcgaacggcggggagggggaggagctcctcctgctctcggccgcggaggctggccgcggcggcggcgcgaccgccgaggcggaggagtcgtggcggctcaacttcgaggggttccgcccgccggaggcgcaccaggagaggccgccgaccggtccgctccaccactgcctcggcgttctagctcaaggtcc

SEQ ID NO: 5204 - DNA, 409 bp, Sorghum bicolor
  Clone ID: SORBI-28MAY03-CLUS107295_1
gcacgagggacatgtctggtacagcaattagaacacttgaccttagtgcaacacaagcctggggcctcaagcaactctttttgttggggtgtgagaagttgtgcttgatattatggccaaaggagaaaaacagggagatatatttggagattttgtgcattgacaccaccactaccacctatgcagcatgggataggaaagaaggaaaatccaacaagcaagaggctactgctagtgacggttcaagtattagtatagggtcatcatcaggaatggtgtgtggcatggaccgaacaatcattgacttggattcatatatttccataagggatccaatgctttttcgttcacttgagagcttgagacatgaaaaatggttgcacgtggagatttcatctactggaccagg

SEQ ID NO: 5205 - DNA, 890 bp, Sorghum bicolor
  Clone ID: SORBI-28MAY03-CLUS105648_1
cctcctggcccgtcttcttctgcctcggccccgcatccgcagccgcgcagccgctgggtctgccggggcgccgctggccgccgcggcgtccggctcggccccgtcggaccggccgctggtcgcggccccggtggtgccccccccccgccaggacgtccgggagctcgccttccccggctgggccgccgggctgggggtcgcccgcggggccgctgaggacctccgcgccgttctcggtcttagctgcggcaccccggtgcgctcggagcactggggcctcgaacgggtgcgcttgggaggcagggctctgggcgactgggccgaggccggctccagcgctgcttttggagtcagcctccgcgacttctgcccgttgttttcggccggttcgcgcgagggcattcgacaactgacggaccgagctggtgccctgctcaccgaggtaattcaggcctggtacgtcatgggaaggctaggagcttataattcttcaaatttgcagctggccaactccatgatggactatgacccttcatatgattctgaagaagcttccccagtaatgccatcatctttccatgatatcagtgatgtggagttccaagactgttgcgctttggtggcttctggccgtttgggcaaaaggatgtgtgcaaattctgaaattcccctcacatttttttcttgcagggtggaccttggaacctcgaattatcttggcttggatgtattactaaactgcttaacacagtttagctcagaatttggaaacattaatgcaccagctttgttgccttgattacacctgcatgcacttgggtatcaaacaagtgggttttggaggcaagaaaatgggtgactgagaagagggcatgatgagctcacattat

SEQ ID NO: 5206 - DNA, 444 bp, Sorghum bicolor
  Clone ID: SORBI-28MAY03-CLUS10566_1
gcacgaggcaccaaaggatcagagctccgtgtcgcccaacgcaaaaacctgaccgatggcggcccggtgctacgcagctgcctccgtggtcagagcaggagcgcacgacctctccctctccccctcctccttttccgtcacagccgcggcgcgtccgaggccggtaggaggagtgtgggcctgcggtggagccggaggagggtacagctggctccgcgccgtccgcgccatgggctccgcgccgtcgtcgtcgtcgtcgcaatccccgtcgccgcaaacgccttcaggacaaacccaagggaaagcagattatacatcactgagtgaagaggagtggaagaagcgcctgactaaagagcagtattatgttactcggcagaagggtactgagagagcattcactggggaatactggaatactaaaaccccaggcatttatcactg

SEQ ID NO: 5207 - DNA, 1066 bp, Sorghum bicolor
  unsure (1)..(1066): unsure at all n locations
  Clone ID: SORBI-28MAY03-CLUS10553_1
ctcagtcattctttcgantattagctggaagacaaagaaacagattcacattttgccattagaaacagaaaggctcctatttgtatctggaccattgttgaccagttacatatttacattagccaaaggaggttagctgttcaaatagattggtcttcataaacatgcacctcctatgtgagaatatctgttgggtttcctttctttgttagtacctctatttcacacgagtgcaaaccttgtgtggtactcccttggttccaaattataagctgctttgacttttttggttcatccattttgctatgtatctggacatattattatagctagactagatgcatagcaaaacggatgtaccaaaaaattcaaagcgacttataatttagaacggagggagtattaaagtattaatatgttttcttcttgatgtttgcttctgaagatatgctatgaatttgactttgtgcgtgaagcaagagcaatggaaagaatacgagaattcctacgtgtcaccaataagaaacctccagttatggtgcctcgtgtgattcctgggatggttagcagagaggttttggtaatggaattcatcaaagggaccccaataatgaatcttggcaatgaaatggctaaaaggggcatcgatcctggtggtaagattgcagcaatggcaaagcagtaagccccttcatctcaaaagagaagattttgtcagatcttactcttgcatatggtcaaatgatcttgaaggatggctttttccatgcagatccacacccaggaaacatccttatctgtaaggacacagaggtggctttacttgattatggacaagtgaaagaaatgccagaagatttgcggcttgcttatgcaaatcttgtagttgcaatggctgatgatgatttcttgagggctgaggaaagtttcaggtatcctgaattgcacaccatgcattatttgtctaaacggccgttgagggcatttagacactacactgtggcacaccgtttccatttaatcacccatttatcccatttaaatggcagttttgcctgaattatgg

SEQ ID NO: 5208 - DNA, 439 bp, Sorghum bicolor
  Clone ID: LIB3478-015-P1-K1-F4
gtggagaaacagtttggaaagaacttcgatgacatattcgaattcttcgatgtcgagcctgttgggtctgcttctattgcacaggtgcatcgagcaaggcttaaattatcaaaggcagacgttgctgtcaaggttcaacatccaggagccgagcatttgatgatggttgatattcggaatatgcaagcaatggccttgtttctgcagaagtatgacatcaactttgatctattctctgccaccaaagagatggaaaagcagatatgctatgaatttgactttgtgcgtgaagcaagagcaatggaaagaatacgagaattcctacgtgtcaccaataagaaacctccagttatggtgcctcgtgtgattcctgggatggttagcaaaaaaggtttggtaatggaattcaataaagggaccccaataatgaatcttggca

SEQ ID NO: 5209 - DNA, 933 bp, Sorghum bicolor
  Clone ID: SORBI-28MAY03-CLUS10570_1
tcggcagtgcctcaagcgtcagtgctaccaccggttcctggcgccactattgttccattcactaccatgcaggctgcagtgagcaagaacatggtggagagcctggcagtgccagcattccgcgtcggctaccccattgtaaccgataagctcgatgcgctgtatgaaaaggttaagccaaagggagtgacaatgacagtgctgctggcgaaggctacagccatggctcttgtgcagcaccctgttgtcaatgctagctgcagggatggaaagagcttcacatacaacagtaacatcaacattgcagtggctgtggcaattgatggcggccttattacacccgtccttcaggatgctgacaagctggatatatatttgctctcacaaaattggaaggatctggtcaagaaagcacgtgcaaaacagctccaaccaaatgagtacagctctgggacttttacactgtccaacctgggtatgtttggtgtagatcggtttgatgcgatccttccgcctggccagggagctattatggctgttggagcctccaaacctacagtcgtggctgataaagatggtttctttagcgtcaagagcaaaatgctggtcaatgtcactgctgatcacaggattgtatatggtgctgatttggcagcattcctacaaacttttgcaaagattattgaggatcctgagagcttaactttgtaagatctcttgaagagttatctatatacccataagtagtctgattgcagttggagttctattgttgatactaccaatttattgtatctttgagcattcaacaggatttgtctgatcttttttgtaccaattcctatctctcaatgttgtgggttttgttggagaaattatactgttgatattatggaattgttggagagccaataagttataaactgtagaata

SEQ ID NO: 5210 - DNA, 1134 bp, Sorghum bicolor
  Clone ID: SORBI-28MAY03-CLUS10839_1
gctccaggcatgatgaagagctgatgacgaactctgctggttctgatagctcctcttcatgcatgagcgagggagatagggaaagcagctccagcagtacaacctcttcgagcactcaaaatccggaatcgtcttctgagtctgaggaatcacccaagagaataaacagcaaagtaggcacaccatcatcaagagctgcttcacggtctttggttgaagcatgtgcaggaaatggtttcagagaataccagccaaaagccacccgcccagcacacaatgacatgtttgggtacaatgtatcccctgtccaggaccagctgctgcattaccaaggcatgcatgcacctcaacgtccgccaataacaatggggtttcatgaccgtccttgggctgcaccaacgaatggaaacttccagtatgctcgaccatcccacctatattctagtccgctcgtattcggaatacctgggaatcattttattgattatccttacatggctcctgccttcagccatatacctccagagcctattcacaaggcctcagccagctttagagccatgcctctgtcaccgccttttcaaaatggacatcggcaggttgctggtcatactcagagagacatgaatctagagaggcaccattcaaagttgactatcccaacaggcatggatcccccagaagacaagaccaagtcgggtctaaaagatctctcagaagacaagaacaaaccatggaatgcggatgcatccttctctctgttccaattcaacttgccaatagcttcgcctgtaacaccgtcatcgaaagataagagcgaagagctggctgcaagaacaccactggttcaggttcaagctcagcattgctcgagggaacaggcagatgtgaaggagtataacctgttctcctcgaaagataatggtatattttcgtttatgtagataaaagaaaaactgtgacaaacctgctacccttcgtttctgctggctcttgctgcacttcgtgaatgatttgtgttctccgaagaaaaataaaggatgttggtattttcttcttggtgtctgtatcttcgtttacatttatgtttgttaccgtgtgtgctaaaagctagctaatccgcaatgctgctga

SEQ ID NO: 5211 - DNA, 754 bp, Sorghum bicolor
  Clone ID: SORBI-28MAY03-CLUS10868_1
gcacgaggcacgagagcttttatccagtggacattctgatattcctgaggaagctacattgacaactgttgagcagctgttggagcccttggaactatgttacagatcactctgtgcttgtggtgaccgtgtaattgctgatggaagtcttctggatttcttgcgtcaagtctccacctttggactctcccttgtgaggcttgacattaggcaagaatcagatcggcatactgatgtccttgatgccatcactacgtacctggggataggatcttaccgcggctcgccggaagaacgccgccaagaatggctactgtctgaacttaatggcaagcgccctctgtttggcccggaccttcccaagactgaggagattgctgatgttctagacacattccacgttatcgctgagcttcctgctgacaattttggtgcttatatcatttccatggcaacagctccttcggatgtccttgctgttgagctcctccaacgtgagtgtcatgtaagacaccacttagagtagtcccactgtttgagaagttggctgatcttgaggctgccccagctgcattggccagactgttctcaatcgattggtatagacagaggatcaatggcaagcaggaggtcatgattgggtattcagattcaggcaaagatgcgggtcgcctctcagcagcttggcagctatacaaagctcaggaggagctcatcaaggttgctaaggaacttcgtggtgagttgaacatgt

SEQ ID NO: 5212 - DNA, 610 bp, Sorghum bicolor
  Clone ID: SORBI-28MAY03-CLUS108480_1
gcacgagggcggcgccgcccccaccatcggcggcggaggaggcgagcgccaggacctgggccggccccgcttcgtgttcgcgggcgcggggtgccacggcggcggcggcggcatgggcgaggcggccatcgcggcgctgccgaggaaggaggtgggcgccggggacacccccgcggactgcgccgtgtgcatcgccgaggtgggccccggggaggcggcgcgcgtgctgccccggtgcggccacgcgttccacgtcgagtgcgtcgacatgtggctccggtcccactccacctgcccgctgtgccgctgcgcggtcgccgacgaggaggacgccaagcccgtgccgccgcgggcggcgcccgaggccgacccggagtcgcccaacttccccaccaacgtactcttcttcggcggcggccatcttcatcaccttcgtcatctccttctcctctcgtcgttgagccatttgatttgaggcaacacggacagggaaagggaagggaaggaagcaaagtgtacagtgatctgttgatctgtaatcaacagccacatactactgctagtagagaacttgttagtgatgatctataaacaacaagtttgatggatc

SEQ ID NO: 5213 - DNA, 474 bp, Sorghum bicolor
  Clone ID: SORBI-28MAY03-CLUS10821_1
cgcgtcatttgctagctgaagtactagttagccttgcccaattcaagtttggagcaattggtctgctcttctatcgataggatcgctaaatcatgccttaaactacatgttgctttctttgctcgctcatgtcgctttctacatctaactaatgctttgatccccttgcaggcaaaagactagccagaacattcttcaattagcaaaggatgcgaaagacaagctccaaaaggctgctgaagcagacaggagcactgatacaagtgcagacaagaggatagctgatatgaagcttgccaaagattttgctgccacaatggaggagttcaggaaacttcagagtcttgcgattcagagggagacagcatataagccagttgttccccaaaatgctcagtcaaactatactacagatgaccgaagttctgaatctggtaatatgcctgagcagcgtgcattgcttgctgcaaaaag

SEQ ID NO: 5214 - DNA, 847 bp, Sorghum bicolor
  Clone ID: SORBI-28MAY03-CLUS108574_1
gcacgagggaagactagccgcccttctgcgaactgtctcccatagtcccttgcacgaggcagcctcctcaccgtcggagcgatgcggcgcggcgcctccggccggccgtcgggcacggatggctcagacttttcctaccgcatggtcgtcgaatcccggtaccagagggtcgccgatggcagatcccgcctcgcgcgcctcatcctcgtgcaggcgctgcacctagtggtcggaggcgcgcttctgttgctgtcgttgtccaagggggcggcggggaacaagttcgccgtgctgtccgtggccgcgggattcgtggctatagtggttggggaattagggcgaaggcggactatggcagtgctgcttcggctttacacaagcttgtcatcaattgcggttgcattctctgtgacgtgcattatccggtcagagttgttcttgaaggttatgaagcaaaacacagaggccatcacaagctatgaaatgcttgatgctgttcgtgttgctcttggtatcctgctgcaaatggtggttatagctacaactaccagactcctgcagaatatgtctcctcccaagagagcttcatgaatgctgtgacattttagttttgtttccattagaaagggtacaaacttcgagttaaataccggccaagtgcaatagtctcgtaatgaagctggcaactggtgtacaactttgtcagcaatcatgggttatttgtttcctctttcctttttccttttttttacttcttcccttttgctgggtatgaaaaatttgtagtggttgacgtgctttgcgagctaaaggctaatggagcatgtgttggtaatctcatttttct

SEQ ID NO: 5215 - DNA, 964 bp, Sorghum bicolor
  Clone ID: SORBI-28MAY03-CLUS106874_1
gcacgaggcgtatttcatagtcagaggtgaaattcttggatttatgaaagacgaacaactgcgaaagcatttgccaaggatgttttcattaatcaagaacgaaagttgggggctcgaagacgatcagataccgtcctagtctcaaccataaacgatgccgaccagggcccggcggaccttgcgtcgaggactccgccggcgccgcttgagacctcctgggcgtggggctccgcggcgactctgctcgcgaggctgaagctgaaggggattgctcgtcgggctccactggtgctccgcccgacgctgaactggtatctgggacatttccggatgggcaggggagatcgcgtttcaggaggtccaagaagcagaatccacgctattatggcccggcgtggcacagcaagtgagggatatgacagcgtagcgatgtgtgagtcctataagtatcgtccagcattttgctgaattggctatgaggaatcttgtaagaactcgtccgtcctatgcctactgcttgctctgcttacctgattccgattcttccgctgcccaatcctctgctgctaacagtactttcgcagaagtccaagcatggttgagtgctagacatctctcttcctcttatgcaaaaaaagtgaaacggctactctttgcaagcttgcacgacagaaaagaattctgcattttctgactgccagtttatatttgtaatatcagttactgatgatctacgctactgaaagtcatgtgaaggagcgaccaaggaggtttattattatcgcatctttgttgtactaaaagcttgagatacgagtttgtattttctgttttgagatttaacgtttggccctacatctgttacttggaatgggctctgaaatatttttccttgaatgatctaaactactgaaggcagctttgcctcttgtcccaccgaaagagctgttattgtgggcgcttt

SEQ ID NO: 5216 - DNA, 977 bp, Sorghum bicolor
  Clone ID: SORBI-28MAY03-CLUS10691_1
gcacgaggcttgttgttgctaggaagctcaaagagctcaaggggactaagtcctgtatagtgtttcctgatcaacctgaaaagcgcagggcgtcacagttgttcaggacagctatagatacgattgagggtgtaactgtcagttccctggatgatgtacccaccgaccctgtcaacagcttcttcaaatcaataagaaacaccctggattttgacttctcagatgacaatgaagatagatggaaatctgatgaaccaccgtcattatatatcttcattaacagcagcacacgtgaccttgcttctatagagaagtatgtggaaaagtttgccacatctgttccagcccttctattcaatcttgaactagatacattgcgttctgacttggggcttctggggtttcccccaaaagatttgcactatcggttcctttctcagttcaccccagtattttatatcagacaacgtgactattccaagacaatcgcagtcgctccatacatagtgaattacagtggagctgtattccgtcgatatccaggcccctggcaggtcatgctgaagcagctcgatggctcctatgcatgtgttgcagagagtgaagctcggttcactttgggacaggcgaaagaagaactattgagggttattggtttacaagaagaagagggaagctcacttgaatttctcagaagaggatacaagaatgctacttggtgggaagagaacgttgatcaagagacgtcggctgcgtggcgaacttgagacgctgcagctgctggctgaatgctttttctgacctgggtgtggaaaataggccaaacgaaacgagtgtccatgtcttgttgtatggaactgaaaattctgaaattacagagagagaagtccatgtacagcgtaataatatttgcctgtgctgatatcgtatcgtatcattattgttatgtgaatacgaagtaagagcttctgagccct

SEQ ID NO: 5217 - DNA, 412 bp, Sorghum bicolor
  Clone ID: SORBI-28MAY03-CLUS107079_1
ctttcaaaaacaaaaaaagaacaaaaggccagttaattagcatatatggcaggagaagagcttacactgctgggtttgtgggcgagcccgttcgtgatcagggtgcgcatcgcgttcaacctgaaaggcctcacggcctacgtttacagcgaggagagcatctaccacaagagcgagcttctcctcaagtccaaccctgtgctcaagaaggtgccggtgctcctccacgacggcaagaccatctgcgagtctcagatcatcctccagtacgtcgacgaggctttccccaccgccgccggcgcgcccgtccttccctccgacccatacgaccgcgccattgctcgcttctgggcctcctacgtcgacgacaagttgttcagcgcgtggctaccggtcttcattggcaagacgg

SEQ ID NO: 5218 - DNA, 501 bp, Sorghum bicolor
  Clone ID: SORBI-28MAY03-CLUS107243_1
gcacgaggcaaaagtctgaacttgaaatagaaaaggaaaaatatcagcaaaaatttacagaagaaacataaagcttggtgctaccatgcaaactgttgggattgggaaattctgattccaatctaagagacattaggttatggatccatcaaatatgctttcatgatgtataataacttgctaacaaagttcatccatatggtcctcaactccacttaaggccttgtttggatgcatgtgtatctacttcaatccacatgtattgaagtggattggaatggaacttagtttaattcaactccaatctacttcaacacatgtcgattgagatggatacatgtgcatccaaacaaggcctaaatctagtccatctaaattactgtttccactcccaagtgatctcccaacttgtaaacaaatgtaatatatatatcttacaattttgcagaacaagatttagtacctaaatcctgagaagtcaggagatgaatatgtctcaag

SEQ ID NO: 5219 - DNA, 519 bp, Sorghum bicolor
  Clone ID: SORBI-28MAY03-CLUS107261_1
caactgtgaattgtggcaacaagaaagaattcgggactcgatgggccaaggagctgccaaggccaagcaagggggtgaggatgcagcgcagaagacccccgagaaggaggacgcgaagaaagcgcagaaatccagcgacgcaaacgcgctcatcgaattcatgaagaagaactacgacgccaaagtgaagaatgtgacggagttcgatgagttctaccacgccatttacgatcttatcgaaaaattttgcgagcagcgtgggcagttgcagtacaggataccatcaaaagacgacctcaagaaaaagtaccaggatttccacagggcaagggggaacgtgaccgcagaggaatttgagaaaatcgccagggaaattctcaagatagacagcttcaccttcggcaaggctgccagcgcttggctccccaccctctttggcgcgccggtgtgcgcgctcctcgccaagagggtcgtcccaggcctcaaggcgatctccgacgacatcgtcatcccggcggc

SEQ ID NO: 5220 - DNA, 684 bp, Sorghum bicolor
  Clone ID: SORBI-28MAY03-CLUS10887_1
tagggcccttttttttttttttttttctttagcctagcacttgcaaaaggtgccaagtcaataataaaggggttggacaaagttcacatgacattgatagagcacataatatatttcaagattccaggcaactatgctgaaagttgaaaacaaaaacaagatcaacaattttcagccgacatgactttaaagatcagcaaaacacagatgtcagccacaccagagttgcccatacagattatatactatcgactagaaaccaggacaaagcaccatccttcagagaaggagatgaccgtagtgacttaaacgtagacgttgatttatagcaagtaccttactaccaatctagtacttcttatccttaagggggccctttggaatctttgataggcacttctcatcgaaaatggcataatacttcttcagttcaatcatagccttctcaccaaaagcatcaaccttgtcctcatatttctcatacagaactggtatagtgtaaagtgccacaaagacaatatagaacagtgtcagaaagttgcagcagctcccaagaactgaaagaagccagagacctgcgataacaattaggaatttcttcagatcacggccatgtccaatctccctcaaggtagcgaagcccctgttgatccccggccggagttgcagcgcaacattaacagc

SEQ ID NO: 5221 - DNA, 900 bp, Sorghum bicolor
  Clone ID: SORBI-28MAY03-CLUS1089_1
gcacgagggctcctcttcctcatccgggtcctcgcgaagccgccgtggaaggacccccggcgatgggctccggcgaggaggacacaggaggcggaggaggggcggtgcggggtgcggtgctgaaggcgctcgtggtcgtcggcggcgtcctgctgctccgccgcctgcgccgctccaccacccgctgggaccacgcgcgagccgtcgccgacgcgctctccggtgagaagttctcgagggagcaggcgaggaaggatcctgacaacttcttcaatttgagaatgctcacatgtcctgccaccgagatggtggatggctcgagggtgctttactttgagcaggcattttggagatctccagaaaagccttttagacaaagattctacatggtaaagccctgtccgaaggagatgaaatgcgatgttgagttgagttcatatgcaattagggatgctgaagagtacaaaaatttctgtgatcgtcaaaaggatcagaggccacagccagaagaagtaattgcagatattgcagagcatctgaccaccatacacttgtcacgatgtggccgtggtaaacgttgtttatatgaaggatctaccccacctgaaggttttcccaacaactggagtggtgcatcatattgtacatcggatttgtccatccacaaaaacggtgaagtacatatctgggataaaggttttgacgacgaagggaatcaggtttggggaaccaaggttggcccttatgagttcaagcctgcccccaaatctaaatatgacgacatgttctcgccattaaatttctccgcccctttgtcactggagaagctggataaagcatatgtaatcgatgaccagtagagcctgagccctcaagtttgttcataggaacgcaataagt

SEQ ID NO: 5222 - DNA, 830 bp, Sorghum bicolor
  Clone ID: SORBI-28MAY03-CLUS10895_1
ggagaattttcctcaaaaggctatgggagttttgtctcaaaacgtgtgcacaagttgaacgagcttcagggtgaagataaagagcggtttgcttggatactatcctacatccagcatctcctatctttatttgcacggaatggctccatgtccaaaagccaacggaaatggagaaatgaaaaccagacaaaccgtggaccagcaaccccaccggctgtatatcacaggctgttgctgatgtttaccgaaccagggtccagagtcatgtcaacagagaaaaatgagcttctgaccaactacatattggtcctaacactttttgccgatgacttcagatctagtcctaacgacatatgtgaggaccttaaaatgacctaccaaaaacttaaaccatattatgaccagttggggtgcaaatctgtgtcattaggtcctttcaagggcagtgctgtgacgcttccagcccctctcaagttcccaacggatgtcacaagaaagcggcgacggcgatagggctatctcaaggagagaaaccaatggctattcatctcagaaatggcttgcattacatgaatggttggaaaaaagacctctgaattccagtactcccagtcaaagtcaagttaaaggaaaggatgctagaggcctgattttgcaatgtactggaaatgaaaagttgttcagtgttctatttcattttgtttttggttgcccatcgacattgttgtcaagaaaggaaacatgtcatctatgtattgataaatatttgctgacctgtactagtgaggccttgtttagtttgagaaaaattttggatttcgctactgtgc

SEQ ID NO: 5223 - DNA, 659 bp, Sorghum bicolor
  Clone ID: SORBI-28MAY03-CLUS109116_1
gcacgaggctggttttgatgttcttgtagacaatgatggagatggtgctgcttatttacatgacgaggaagagcacgagggagagatgtacccggtagaagattatgaatatgctccagctgattttgatattcgggcccatcatgaaagtgagcagttcaacaatggaatgggtgagaacggacgcattggacagtatgatggctatgagaggaaacgtcgtagatcctcatctgagaggagcttagacagaccttaccatccagatagaaggtttctccacagagagcttgatcgcgacaagatagatggatcagatctacgccatcagctccgcaggagaagaataaatgggccttcgacagccattagcccagaacaggctaatggggaccggcactggagggatgaacgctacagagaaaggccacatggtggtcaccacacacacagagatcgctaccagggcccacgaggaagcactctgagttcccgtctgcaggccagaataaagcttcctcgaaggtcacctgatagagttgatattcgcttcgaggatgaacgagacaggaggagactccgggatagattttctccagttaggcgtatggattttcatggaggtaggcatcgggagtctggacagaatcaagaaagga

SEQ ID NO: 5224 - DNA, 549 bp, Sorghum bicolor
  Clone ID: SORBI-28MAY03-CLUS109760_1
aagtgcggggagccgggggcgtacgcgtgcccggacccctccaaccactggagctggcacggcatccacctcacggaggccgcctacggccacatcgccaagggctggctctacgggccctttgccgacccgcccatcctcgacaccaagcatctcggctaacatccaccgtctcttctccaacaacggcggccgcggcagccggccggccggccagtacagattttatatattcgtctctacgcacgcgacgtcggagcgagcggggatattgatcgaactgtgaattggttggttgttatagagagaacgtacggaaacgaaatggggagtaggacacaataaggtctatgggcatactggccaacactctgtttagattaattaatgggtttatatacacataggttgtgttgtttctgttgttttgttaggcagatatgttttgtgacttaattgtttgtcgatattactgcactagcatagttgtactactgtacttctcatagtatatgatatgcatcaatgcatcaaaatacagtaagtttt

SEQ ID NO: 5225 - DNA, 888 bp, Sorghum bicolor
  Clone ID: SORBI-28MAY03-CLUS109809_1
ccagtgaaggcggaggctgaggccaaggagagctgcagcaatgtggctcatgtgcaggaaggtgctaagactattgatcggcagattcgggtatttgtctctgttcctgggagttctgtggcacaaaatgacgtaccagattctttttacaagcttagtggtgaggagataaggaatgaagcaaagatgaggagggaaagattagaacaatctcgattgctgataccaaagtcttacaaggagaagcaggcactggctgctcgacagaagtataaacaagcagtcattcgagttcagtttccagatagaatgattcttcagggtgtattcctaccaggagaggccactagttcactgtatgagttcgtcacatctgctctgaagcaaccaggtttggaattcgaacttatctctccagccattcctaagccacgtgtggtgcctcattttccaaacccgggagagcgggcacgcacccttcaagacgaggagctggtcccttccgcgctcctcaagttcattccccaggagactgattccgtggttttcaccggtttgcttgatgagcttctcatggccagtgagccgcttcctcctgcatcacaatgaactgtgtgaaaatagcactccatttggtgggctgctgacttctattgagttttctgcataatgtagatgatttcgttttttccctgccgagtttctcttacatcagacttgtaaaaacccagggttacttagataacaacacatccctgcattggctgacaatatcttgaggaaaggctactcgagaattcgttaggcccatgctgaactggatctgaactgggctgggctggactggactgtaaaactccaatacatggaaagattgattgatttggc

SEQ ID NO: 5226 - DNA, 562 bp, Sorghum bicolor
  Clone ID: SORBI-28MAY03-CLUS119405_1
gcacgagggttcatcagcgcgagaggtttaactagaaatggcggtcaagtttttagttcttctcagtgttgttctggcctctctcattgctcttccaggcaagtggcatatgctagagagcttaccgaggccaacgagactgaggggaagaacgttaaacaaggaggagcacctgaactaaaggatgagaagtggggaggtggatacaatggtggatatggacatggcggtggctatggtggtgggtatggacaacctagctatggtggtggatatgggcaacctggttatggtggtggctacggatctggatatggtggaggataccaccatggccatggtggagggtatgggcctggatacggtgggggttatggacccggatatggtggaggttacggatatggacacggtggccctggatacggatatggtggtggccacggtggccggaactaagaagcactactacataagtttctctatgtccaacaacaataagtgctgatgatacatttgaatgttgcatggtggtttcgtgatgcaaatcatgtctatatgg

SEQ ID NO: 5227 - DNA, 768 bp, Sorghum bicolor
  Clone ID: SORBI-28MAY03-CLUS10768_1
ctgactgggtcagggaggagagtgggaagaagattattttcacaccttcagtaatactggttggctttgctatggtgtaattctagagaatttgcaacagcaggatccttcagcagtggacagaattaaagcttgtgtagtagactcagcacctgttgctgcacctgatcctcaggtttgggctttgggcttctcagctgccctcatgaaaaaacgcagtgtcaccacaaagggactgggttcagatgattcaaggtctgatgtcctagttgtggagtctaacaaggagcccaagctgggagcaacagaggcggttctactgtcagctttggagagtttctttgacgttgttttgaactatccaaagatcaacaggaggttatctgacgtgatggagcttttgtcttctaagcaaccaaagtgcccccaactgtacatatacagctccgccgacagggtgatcccagcgaaatcagtggaggcattcatcgagggtcagcggaaagctgggcacgaggtgagggcttgcgacttcgtgtcatcgccccatgtggaccattaccggagcaatcctgggctgtatacttctcagctgggcaacttcttagaggaatgtgtgcttgccaatgatagtgagggtgcttgcgcatcatgattatcatgttgctgcggcaaatacaaaatgatcagttgtttccttttatttgtcccttttcttgaattggaatgcaccagggctatatacgtgggttataccaggaaaatcct

SEQ ID NO: 5228 - DNA, 578 bp, Sorghum bicolor
  Clone ID: SORBI-28MAY03-CLUS107731_1
gcacgaggagaaagccgaaagacagcaatataatcaagttgatgcttgtaaagcaactggtatatatataggccattgatacttgtaggctttgctgcctggctgactgttgcgtagctactagatcctgcagctttcattgttgcatcagctagcttacgaggaggagcagagcaggtgcctccatggatgcaagccaggatgtgtgggactgggaggtcctgccggaccacaggagcctctccatgatgagccatggcagcaagaatcttgatgatcaagaaacggaggaacatggtctgctgcctccatcaggagatgttgatgtgcatgagcctgccgacgagtgcaaggacatcggcgtcgtgccggatgagaccaaacaagtggccggtgttgctgatcggatggcctctgagggagaagaggaagagaagaaggcgttccagagcgctgatgccaaggagtccaccaccgccgacgacggcaagtttgctcaagaggaggaagaagaagatatcaagaaggaagacaagtttgctcaagaggaggaagaagaagatatcaagaaggaggac

SEQ ID NO: 5229 - DNA, 926 bp, Sorghum bicolor
  Clone ID: SORBI-28MAY03-CLUS1082_1
gcacgagggaggcgaggggagagaggagggaaacggaataaatcttcatcgagcagcaggaagcgagagcgagggatttaattttgtcttttttttgtcttctcttcctttccggcgacggcaggtgaatcactggccgggcggtgccggccaaggctagggttccggggatcgcgggcgcgggctcgactttcgtagcctagccgccggctgccggcgcgcgggaaccggatgctatgctgctgagctgcgggtcgctctcctcctgggtgcgccgcttcgtcgcctgcgttggaggttgttttggttgtgcccagcctactccgataatagctgttgatgagcctgcaaaaggtttaagaattcaagggcgttcagtaaaaaggcacaatttatctgacgacttttggagttcaagcccgcacgaaatggagaacagtgccttgcaatcccgacatagtatgtcttcaatcagcacagcagcacaacctaatgatcagcatgcttctggaagtagcagctccccaaatgattttgtaaatcaaggtcttctactatggcaccagactagacagcattggattggaaaacgaaggcgtaattctcagggtcaacaaagtcaagaaccaaaaataagtggtaatgctacatatgagagccttctgggaagctcgaaaccatttccacaaccgatccctcttggtgaaatggtggatttcctcgtggtcagctgggagcaggaaggcctatacgattagagttggttatgcgaagtgtgttgtttgtagccacgttatgattcgctgaaatgtaacgcaacttcattatgctgcgaaagcctgtgtcgtgatgaatgtggattcactggatgtctcggagacaggatggcatcccgcttaagcaaatgtaaaaattccctgtttttt

SEQ ID NO: 5230 - DNA, 503 bp, Sorghum bicolor
  Clone ID: SORBI-28MAY03-CLUS108169_1
gcacgaggctctttctcacacatacaaggcagcagagagcacctcaaagccaagccatagttccagagcaaggccacggcgagcggcggcggcgggcggcgaaggcggcatatgcagcacatgctccctctgctcaacaacatggaagctcctcccggccagagcagcaagcagcagcagctgatgaggacggtgtccatctccgtgctggtgatgtcgctgccggtgctctacgtctccttcctccacgtcccgccggccgcactcttcagggacaccaccttctggttcctcatgtccaactccatcatcatcgtcatcgccgccgactctggcatgctcttcttccgctcttcctcttcctcctcctcctcctcctcctcctcaacggacgacgatgatgacggcggcctctccttcgccgctgtctccgtctccgagccggcggtgaccgtctccgtcgtcgtcaaggacggccaccacgcgctaggtggctccgacga

SEQ ID NO: 5231 - DNA, 666 bp, Sorghum bicolor
  unsure (1)..(666): unsure at all n locations
  Clone ID: SORBI-28MAY03-CLUS1081_1
catccacctcctcctcctctcctctgctcgaccaccaccaccaccgtcccaggaggaggcccagcagcagcagcagcagcagcagcaggagctcctcccccgtcgtcttcctcctcctcctctgtcagggtcagggtccaggtcgggcttcctcccggccgccgcgccaaatcccgtctcgttcttccgcctcngctgcgcatcctcagcaggaatggaacccggcgccaccactgccctctaccctctgcaccgctgcaaaaccatttacctggtcaggcatgcccagggcattcacaatgtcgcaggtgaaaaggactttggtgcctacatgtcacatgacctcttcgatgctcagctcactcctttggggtggagccaagtcgatggcctgcgggagcacgtgaagaaaagtgggcttgcagagaagattgaattggttatttcttcccctttactgaggactatgcaaactgcagttggggtctttggtggtgaaaagtatactgatggtgtaaatgcacctccactaatggttgaaaatgctggacacaggggacgtccagcagtttcaagtttgaactgccccccatttattgcagttgaaacctgcagagagcacttgggtgtccatccctgggacaagaggaggagcataacagaata

SEQ ID NO: 5232 - DNA, 421 bp, Sorghum bicolor
  unsure (1)..(421): unsure at all n locations
  Clone ID: LIB3476-029-P1-K1-E6
gtcccagtggtgtgcccaagcagcagcagcatcagcagcagcaggatctcctcccccgtcgtcttcctcctcctctgtcagggtcagggtccaggtcgggcttcctcccggccgccgcgcccaatcccgtctcgttcttccgcctcgctgcgcattcctcagcaggtcagggaatggcccagggcaattcacaatgtcgcaggtgaaaaggcctttggtgcccaacatgtcaaatggacctcttcgatgctcagctcaactcctttgggaatgggccaagtcgatggcctgcgggagcaacgtgaagaaaagtgggcttgcagagaagattgaattggttatttcttcccctttactgaggaatatgcaaactgcagntggggtctttggtggtgaaaagatactgatggtgtaaagcacc

SEQ ID NO: 5233 - DNA, 1295 bp, Sorghum bicolor
  Clone ID: SORBI-28MAY03-CLUS11115_1
ctttactgtttttttttcagcatattgtgacattttatctgcaatccttccaagaaaaaacataaaaatttgaacatggcaacccaaggtttacacattaccactaggcgtaacagcacagttgaaacttgaaaaccatgttacaaaacctgctaacactactaacagatctacgataacattcaactctgaagagccgctcagatatgtacagtaacactcaactctggacagcaagcatgagttagctactccgacagcacgatctcgccataacagccagccaagctgcacaaaaagtgggggctgtgaagcttcctccttcataaagactaccgattgccgtccaatgtgatgaactcatcagcatacatataagagactggttttctcccattgtcttgcagagaactcattcttgagtccaaaacagccagctgagagatgacccagttggggttgttcctcccgtcaacccatagtgcttcaccagtgtgcttatgcttgaagtctggataccttgggttcttcttatttgtcctgttatcccaccagtcaagagggttagcaaagaacgcttgccacagctcttcagttgatcgagaagagctcatattatccctattcttatcctcagttgaattagaggtagagttaaaataatcagcacgccttccacctggggcatcctggcttgcctctggttcatataatcgaactggctgggactcgatgaaattcaactgttgaacttgtaataaacatgccgcttctcaggcccctcatcaacagtatctgacacaagccatccagaaacaaatatccggtcacccttcttaacgtgctcagaggcaacaatagccagatcatcccagaattgtagagttacccatgtagtttcggtggccgacttccatacggcgaggcggcccctcgcaacagcggagccgctgggcagctgccgcagctcgacttcggtgcccacagtcccaatgaggcgcaccgagttgcagagctccttgctccagggtatctccgccggccgcggcgtcgttgtcgacgtgggcggcgccgccgccgcctcactgtactgcgcggagcaccggaggcggcgccatcgtggcaccgggagcggaaggcggaggagggaagaggagaggcggatgcggctgtggtccgcctggctagggtttagggttttgagcggagaggcgacggcgaggatagccatggggatattttctccggcttccgctttcacctcttccggagattggaggcgttgcgagcttttt

SEQ ID NO: 5234 - DNA, 251 bp, Sorghum bicolor
  Clone ID: SORBI-28MAY03-CLUS111209_1
gcacgaggaagtgtttggggagtttcaacaatcagcgcaacaaaccaatcatgtaagtgctcagtttgagaccaactttgaggcatcaagaacgacatctgaatccaacgccccacctgttcccggatttccctggccacagggcattcatagaaaaggtggtatgctgttttcagatttctgacgcaaagctgacaatgagacataataaagcataacctgctgcaaaaaaaaaaaaaaaaaaaaaaaaa

SEQ ID NO: 5235 - DNA, 537 bp, Sorghum bicolor
  Clone ID: SORBI-28MAY03-CLUS110650_1
gcacgcgccacgcacacacacacacgacgacgacgagcagcgctcacgatcggctgctcggctccgaccatcgcgcgtctatggcgatgagtgacacgggctcgagcttcgcgcagtgggccgcgctctaccaccaccaccacgacgccaccggcccggccgtcctgcccgacgacgacgccgcggcggatgtcctcggcatcgggatcggcaccaccgctgcggccgccgcggtggcgagcccgacgtcgggagggtccagcggcggcggcgggagccccacaaaggcggcgggggtccagcaccagcagcagctgcacggggtggaggggccccggatcgggaagccggcggcggcggcgcggcggcggtcccgcgcgtcgcggcgcgcgcccgtgacgctgctcaacacggacaccgccaacttccgcgccatggtgcagcagttcacgggcatccccgcgccccccgccggcgcgttcggggtcggggccggtggggcaccgctcatcaacttcgccgccgactacgccttcc

SEQ ID NO: 5236 - DNA, 650 bp, Sorghum bicolor
  Clone ID: SORBI-28MAY03-CLUS11128_1
attttgcattccagttgcaccatcttcctgacgagagtgtttcaattatgaatgaaagggaccagctcctccgtatggtgaagggactccatccaaagctagtgaccctggttgagcaagatgccaatactaatactgcaccgtttctgccaaggttccgtgaagtctatgattactactctgcgctttttgattctttagatgcaacacttccaagggagagcccggatagaatgaatgtggagaggcaatgtcttgcacgagaaattgttaacatcttggcttgtgaaggtcctgatcgtgtggagaggtacgaagttgctgggaaatggagagcaagaatgacaatggccggtttcataccatgcgcatttaacagcaatgtcatcagtggaataaagtcgacactgaaatcatattgtgataggtacaagttccacgaggatcatggcgggcttcaacttcggttggggggggcagactctcattgtctcctctgcatggcagtagagaattagagctcactgagggtggctcattactcgcggcgtcttgtcggggcttctggcgctgtctgtggatagatgtgtccgctcggcccgccagctttgtgtataaaattatgctttagtgaactagaagacatttgt

SEQ ID NO: 5237 - DNA, 622 bp, Sorghum bicolor
  Clone ID: SORBI-28MAY03-CLUS11122_1
cgacgaaatcagacgccagccacgagcgaaccaagggagggagggagggaggcggatggggccgcgcccgtgtttcggcgggtcggcgcaggcggcggagcaggagcggcagcgggcggaggcggagcggcgcgagtcgcaggacgcccgcgccaaggccgccgaggccgcgcagcggagacagcaggagtatgagaaatcggcagctggaagggcagccaaagcacagatgaaggcgatgaaggaatccaagacatcaaaccatggaggaggagagccggttcttaagtggcagatggggtcataactttcatttctgttgatttgaatccctcagtgtacttttgatggcaaacaggaaattgattgcgactaatttctgataggatgcactgtgattgtgtgattatgccagtgaagtggacatcggtttttccatctgctatactgtacatgctacccatagactgcctaactttccagttacagcttacaagtttgtgttgtgtaaatgaagaacaaagtatattttttatgaacaccagtatactggtagcatttgcattgaggcttttaccccactttatatatttataaaagccatagtctgactacagtactg

SEQ ID NO: 5238 - DNA, 494 bp, Sorghum bicolor
  Clone ID: LIB3478-023-P1-K1-D6
atatccatccccacccaaagcaagcgagcagctcgaggagagagtcgagtgaagaagaagaaacaaaccacccaccacgacgaaatcagacgccagccacgagcgaaccaagggagggagggagggaggcggatgggcagtgcccgtgtttcggcgggtcggcgcaggcggcggagcaggagcggcagcgggcggaggcggagcggcgcgagtcgcaggacgcccgcgccaaggccgccgaggccgcgcagcggagacagcaggagtatgagaaatcggcagctggaagggcagccaaagcacagatgaaggcgatgaaggaatccaagacatcaaaccatggaggaggagagccggttcttaagacttttgatggcaaacaggaaattgattgcgactaatttctgataggatgcactgtgattgtgtgattatgccaagtgagtgtaacatcggttttccatctgctatactgtacatgctacccatagact

SEQ ID NO: 5239 - DNA, 820 bp, Sorghum bicolor
  Clone ID: SORBI-28MAY03-CLUS10878_1
taagaagcttcctcgccgtctcctctttctccgtcctgcccgaggcctccccgtaccgagagccaaagaaacaacaaaggcaggggagaggccggcgaactacgcgaggaaaaaaattttctttcccgggaggacgaagtcgggagtcgggacacgcgcggggtcaaaatcgtctccggttgttggtgccgctgccgtgccgctgcgtgctgctgtcggagccgagcaggaaggggagaacgaggcaacgagcttggagacagctcaagaaggagtgggacggggaggcggcagcctgcttgtgagaaggcacctgacacgtgaaggagcccgagcgagggtagggaggaaccggacgcgtgggtggactcggagcactggatctcgcgcctggccgccgccaagcgctactacgcggcgcagctcggccacgtcgacgatgtgcccgggatggggacggaggaggtggagatggagatggagatggaggacgacggcgacatggagatggagatggagatggagatggcgctggagctcggggacgcgacgtggccggaggttgcctgcccctactgctacgaggaccatgacgtcgcgtccctcttggtacacctcgaggaggaccacctcctacgagccccacgccgcgccctgccccatttgctcccaaaggattacaagagatatgcttaaccatatcaccatgcaacatggttacttgttcaagaatggtcacaggtctcgcatatttattattcctgagagagatgcgatttctttattgagccgagatctgcggggtactcatttacatgct

SEQ ID NO: 5240 - DNA, 482 bp, Sorghum bicolor
  Clone ID: SORBI-28MAY03-CLUS108811_1
taaggctgcttttcgtgcatctgctctcaaatggcaccccgacaaacatcaagggccttcacaggctgaagcagaagaaaaattcagacaatgcgtggaagcgtacaacaaattgacctttgccttcaagtcaagtggctaactaccatggggacatgcgaatacaacaaaatttttaattctaatgatgcgtggagctgctggtcttcaggacaaactactacaagagagtagcttcatgttgataacaacgaaatataaaagcacaatctgtaccaaaagcatagattaggtcagtcctgccaaatcttatgagaaagcaaattccaggctcatttgtatgatgatttgattccaccatcgcccatcgctgtaagtgtaaacactgttttttttttttgtcaaatttgatgctgcaaaatgtatcgttgagactcatgaaaatctcaaactcttgcagtgtcagcaaagggggggcccgg

SEQ ID NO: 5241 - DNA, 619 bp, Sorghum bicolor
  Clone ID: SORBI-28MAY03-CLUS108820_1
gtggatttgtgtcttggccaagaattgaagcaggggagttggattattcgtgttggtggtggtacacggtcatacatggcagcacggacagcagttcttggatctctggcggggaagatggcacgcgcacccctgacgcttgcgcatcgtcctcttgtcgcggcgcgtcgattccagtcggggaacccaagcggcggcggcggcggcagtggctcctcgccgccaactagcggagaggtatgtctccatctaggcaatattaatttccctcttcttcccttgtctgtgtgatcagccctaggttcaaaatctttcataggctgaggtagatcaaccccagtgcgtgcgctctgtctacgaattctctctctctaggtatatatgtatgtatgtatctacaaatctacaaccacttaattcttccacgattactaactgatcataacaacttaattaatcataattcaaacttcttgtccatgtaaaaaaacgcaaaaggattccaacctagcgtggttttgattgatcccaaaggcccaaaaccaatgttcaactagctgtcacctggagctaactctgtctccaacccatcactcctaattgtcaaaaaaaaaaaaaa

SEQ ID NO: 5242 - DNA, 757 bp, Sorghum bicolor
  Clone ID: SORBI-28MAY03-CLUS108842_1
gcacgaggatgacactatcaaattataagcaccgattatcgtctatgtacggacaacagagaggaagaatcgctctgaaggtctaaaaacttaccacattaactcaagaaaatatcatcattctcatgtacattctatatatcttaattatacttttaatctcgactatcattctatcttgtcatgcatgcaaaatgtccaattagcatccactaacggttctgttccaccatgccatccaaagggagccgaggaagacacgctagcggagcgagcggtcctagcatggatggttgggaagggggtagcgatccctaggcaggagtgaggctgtcatggcaaggtgtgcaaaggctgctagggtgagctgtgtgaggttgggctatgactgcaaatggaatgcaaatattgccgcaagggaacgagtttggtccggctattgtgaagggaaaccttgggatagtgatcgaataattttgccatagagcggtttctggaaccccaacttgtgagcttcatattatttgcaatatcatattgttgtttgatcttgtttgtgttcttcgattcacatactcctatagagatgaaagagtgacgggtatgtgcatggcagcagatagtctatggacggcggcacccgtgtgaacaaaagggttaacgcaaaaaagagagagagttgtgggtcatcatctttttgtattttaggtcttgtttagttcaccctgaaaccaaaaagttttcaagattattcgtc

SEQ ID NO: 5243 - DNA, 1046 bp, Sorghum bicolor
  Clone ID: SORBI-28MAY03-CLUS108866_1
gcacgaggctggaattggtggtccagagctggagatgaaaaatacccctgcttttcaagcacagttgcaatcagcaagtagtgatccaaggtttcagttacatgtacagccaaatgtgcagtctcatcaaaacctgagattctcagaccctatgcaggatggcttgaaccatatgaatgataattacctggcatccagatttttagctcagaaccatggtcctgtatccccttatgctcagattccgcaacaacccagaaactcccaggttacaaatggtcattgggatgggtggagtgattccagacaagggaataacactgctatgtcagacatgtcgaggatgttatatccaagtgacgtgaacaagttgcacatgctgggttcaaatgatatctataacagagcatttggaatgtgattcccttggataatgtgcgactttgtgctgacatgttcaaacttgggcattttgtggaagtaactggttgcaaaaacacatagtatacctgaggtgaatagtggtgttgtcagttgtgcttatgagctggtacatgagtatttattgctattggaattgaccaaaatgaacattgagttctggtccagccatttgaaattaccaggtgccattggttcattctcttctatgatttgagaagcttgagtgagaagaaaaattttgtgccgagaacaaagcagctgaagctgaaatagatagagatatgtctataatgtggtgtagtgacttgtgagtgaaagagattaagaagcttaggtgggcttggcttgatggtagtttgttttcttgtgtctgtacatgatggttttggtcggtgttgtagtaacttggtgatcggtggctgtattaacctgtagtggctgctcttgttccctcctgtttgtggctgcctgacgagttgcatgcgttttgcacagggaattgtgtttatttatgttaattaagggaattgaggcgaaggtttacaagaaagtcaaatttgtcagtgctacccatggtataatggtataattaatattatacg

SEQ ID NO: 5244 - DNA, 550 bp, Sorghum bicolor
  unsure (1)..(550): unsure at all n locations
  Clone ID: SORBI-28MAY03-CLUS112210_1
cagcccacaacacaaacaaaacaccgcggcgccggctcacagcttttgttaccctccagcatccgttttctcttttgctgtcgcgacgaagatcctcatcaaggccctgatggctccccgtgtcgtcgcctccgctctgctcttcgccatggcggccgtcctcgtggcctccgcatcggcgcaggagttcacggcgcctgcgtctgcgccggcgccgggaccggtcgctggagccgcctccgctccggcctccgctgtcgccgtggtgtcgtccgcactgctgtccctgcttgtggccaccctgatgcagtagaagcatatctatgtatatcatctaccgcttatgtatgctactatatacatggtcatggacatgcatggcatggagtagtagtaggttttgtttctagatttgagcgggaatttgatcgatcgatcgagtgtttgctgttcctcattctttttgtatcatatatgtctccgacatgtttatatatatgaataaagttggttgatctattgcataaaanaaaaaaaaaaaaactcgagg

SEQ ID NO: 5245 - DNA, 566 bp, Sorghum bicolor
  Clone ID: SORBI-28MAY03-CLUS112285_1
gcacgaggcccccagccagggacccgccttgacttttcacgttgcgtttgagcggtgctgctgatctgcgattcctcttctctccactccacacctgacctgaccacccgagagggaatcatcatccctcttgcccgcggcggcgttggcgttggcggcatctttggtctccgtgcgggtgtttctgtccggcgtttacttgccgggccagcgcggcattggaggaggaagagggagggagatcggaggcgtgatcgatggggaactgcgtggcgagcgggggcacgacgacggtcacggcggcaggtgctgcaggggaggacgggaggcggcgggggaggagatggaaggcgccgcgggaggagcagctcggttcggtccccggccggatcttctccaacgatggccgcagccgcaccgccgccgtgttcacgcagcaggggcggaaagggatcaatcaggacgccatgcttgtctgggatgggttcggcggggaggacgacgtcgtgctgtgtggggtgttcgacgggcacggcccgcatggccacctggtggcgcgcaggtcc

SEQ ID NO: 5246 - DNA, 826 bp, Sorghum bicolor
  Clone ID: SORBI-28MAY03-CLUS11222_1
gccgcccacgcgtccgcaaagcagctctcagaaagtacaggaaagctctgcgctacttggatgtttgctgggagaaagaagagataggtgaagataagagcacagcactgcggaagaccaagtcaataatactcactaatagctctgcatgcaaattaaggttaggagattcaaagggtgctttattagacgcggattttgcactgcgtgaaacggagggaaatgctaaagcttttttccgacaaggacaggcacacattgcacttaatgacattgatgcagcagtggagagcttcaaacatgcattggagttggagccaaatgatgctggaatcaaaagagagctggctggtgcaaagaagaagattgctgacagaagagatcaggagcgaaaggcatttgctaggatgttccacccttctggaaaatctgacaagagcaacgaagagaataattgatctacagtttctttcccccgtctgaaactttggttagcttaaatctgggacacgtattggaacaggagtaccatgggagtctgcactgccaaaaaaaaaaatgcagattatcgatcttagatagaaggaaacatagtggggggaaaggaaccttttgttttcttttactacagaagtatcagttcgtgcgtttgtcccggtgttagtttcttcaggaaacggacattgaacttaacagtgcaattttcagactttgcagcaagtgccatcagaccactccattttgtgtagactcggccctcaggacgttgtggccaacctgactattcacatcttttgtgcgccgcccgtttcactttcgtgggttc

SEQ ID NO: 5247 - DNA, 642 bp, Sorghum bicolor
  Clone ID: SORBI-28MAY03-CLUS11233_1
ctgcgcgggcgcccagcttccaagatacccactagctcccagcctcccaccgtgttctttccacccttggccttggctgatgctaggaagatggaatttttggagcttcaagacaaccacttctaatccctgcgcttcaggcgccccttgctccctccgtgttcttgtcttcttgatttgtcctcttttttctcgtgtttgaggtgatatctcgattctaaaaatctgcgagatttcttctccctgtttgtatggacaaatttgggaacgaaccctagtctgtgtctcaagcagccaaagtagtgttcttgcggagcaaagctaaagctgcagcagttggtgaggatacaggagaagggcttgttggattctgcaaagacactcttattggctgatttttttttcccataaactggggccggatttgcggaagtgcaaccctcttggattaagcaagaacaaagcctcgcaattttaggattcggcacaataccatccaatttgatcttggacatggacaagcaatccagcacccggcatggcaccctagagaaattgaagagcttccgggggatagagaagcagagaagcttcaagttcttgtccatggagaagcagcagagcttcaaaaggaacaaggac

SEQ ID NO: 5248 - DNA, 549 bp, Sorghum bicolor
  Clone ID: SORBI-28MAY03-CLUS112960_1
gcacgaggagtaacgataccacgagcggcttaattaattagcactttaggatatactttgtcacagtacgtcacactcgcatcaacaactgctccagctttcagatgcttccaagaggccgcaggcccgcggcacagcggaatcaacgacggtatcactcacacaggcggaatcaacgacggtagctatctatcttgtctacgctgccttggccctgctatagttctgcagcgcgaaggccagggccagcagcaggacgggcagggcgagctgcaggagcgtggcccaggtgccggcgctcgccgtcgtggtcttctcggacctgctggcggcgtccttggtgacgacggcgtgggtgagcttggccgggatggtagccgcgtcgacctcgccgacgcagtactgcggcatcagctccttggcggagtcggtgtggccgatgtcctcgaaatcggcggtggcgtcctttccgacgcacgccagcaggacctcgtcgccgcccgggtgctcctccatgaacggcgtgacgtcgtacaccttgccggcgat

SEQ ID NO: 5249 - DNA, 514 bp, Sorghum bicolor
  Clone ID: SORBI-28MAY03-CLUS112964_1
gcacgagggggagccgatccattcatccatccactgaacaccaccagctccgcgtcgcggaggccggaggtcttgcttgcttgggcgactacgacgaggcgacgtacaccaaggctccggagtccgccgatcgacgaggcagtcaggcaggaagcgagaagacatccattgggaatgggtgttgctagtgacgcggcggcgggcgggaagcgcggcaccggcaccggcacgcggtgcgagctctgcgggggcgcggcggccgtgcactgcgcggcggactcggcgttcctctgcctgcgctgcgacgccaaggtgcacggcgccaacttcctggcgtccaggcacctgaggcgccgcctgccgcgccccccttccgccgccgactccggggcccggcgtcgtccgcgtccagcagctcctgcgtgtccacggccgactccgcggagtcaaccgccgctgcgccgttggcggggagggctccggcgcgactgcggacgcgcgcggccgcggaggc

SEQ ID NO: 5250 - DNA, 688 bp, Sorghum bicolor
  Clone ID: SORBI-28MAY03-CLUS13031_1
ggcaaccgtttggatttacatgatcctagaatattggcaatggctgctgctcaacaccgtttacttgaagacgagtatgatgaatatactacaacaaacaacaatgctgctgcgttttgccgctctatatttctgattttgatggcccttctgctcctgaggcatacactgaccattactaacagtgatgatgaagatgatgcatcagctattttctcgctatttcttttgagggcagctggatttttgctgccatgctatattatggcttgggctattagtatcatgcagcgtcaaagacaaagacaggaagaagcaatgctattgccaaccgaagtggctatcattctgcaccggaacggaagaacgatgcaatttgcggtggcaccaccagaatctcctacctcacctcagcccgagccaatccaatagaatacatcagtgacaggctcacgagtgcataacagatgcttctcagcatctgggcttaaaggtggaaactcgaggacattgtgcaaagccctgttgcctcggccacctcgaatggctccatgttgcagcaaaaatgttgtgcctttcttggaattgagttaactttccagctgagattcaatgcttgtttgatgggctctcagcatcttctgtacataaagagatttcagtaataagtgaatataaatgttaaatc

SEQ ID NO: 5251 - DNA, 1144 bp, Sorghum bicolor
  unsure (1)..(1144): unsure at all n locations
  Clone ID: SORBI-28MAY03-CLUS13014_1
gcacgaggtgattgtaagaaaaaagttgagcctgatgattgggaagatgctgcagacatgtctactccaaagctgccatcagattctggaaaccaggctggcatcacccaagtgttagattcagatacaactgaagcaaacggcaggaagaaatactcacgggattttctgttgactttgcaacagcactggactggtcttcctgttggatttaagatgaatgaagctgtcaatgcaataatgaataatttggcaggaaagtcttatgttgttgaccgggaacctcaccctagtcctggaaggggtttggaccgcccaacttctcgtggtgaccgccgtggtgctgccatggctgacgacaggtggactaaggcgggtattcctctcagtcctggtcgtgatgttcacatggacctggcagctcgaccatcaattatcaactaccgtggtagctcaggaggtaatcatggtgttttaagaaatccacgtggccaaccatcaaatcagtatggtggtgggcttcttgcaggacccatgcattctgttggnacctcaagtatctcgcagtggctctgatgctgatagatggcagcaaaagggtctcatgccttctcctgttacacccatgcaagcaatgcacaaagcagagaggaagtatgttgttggcaaagtttctgatgaggaagaggcgaagcagaggcagttgaaagctattcttaacaagcttactccgcaaaactttgaaaaactttttgaacaagttaaggaagtcaacattgacagtgtagaaactcttactggggtcatttcacagatatttgacaaagctttgatggaaccaactttctgtgaaatgtatgctaatttttgctcccatctggctggtgccttgcctgacttcagtgaagacaatgaaaagatcacattcaaaagattgcttttgaataaatgccaagaggagtttgagaggggtgaaagagaagaagctgaagctgataaaacagaagaggaaggtgagattaaacaaaccaaagaagaacgggaggaaaagaggatccgtgctcgaaggcgcatgctgggaaacattangttaaattggagagttgtacaaaaaagaaaatgttgacggaaaggattatgcatg

SEQ ID NO: 5252 - DNA, 518 bp, Sorghum bicolor
  Clone ID: SORBI-28MAY03-CLUS130325_1
gcacgagggccgcgtccgccggctcgccggccgctcgcgccggtgccatgctcacgtgcaagagattcagggagctcgggcagaccaaggtggtgctcgcgcgggcgtcgccgcggtgcctcgcggtgcgcgccaaggcctggtcggacgacgcgcaccgcttcctgcagcgctgcgccgacgccggctacctcgaagcctgctaccgccccggcatgattcggttctactgcctgggagggagccgcgggtcgggcgcggcgctgatggcggcggcggcggtgggcgggcaccgcgaggcgctctactcgctggccgtgatccagttcaacggcagcggcggcggcaaggacgaccgcgacctccgcgcgggagccgcgctttgcgcgcgcgcggcgtcgctgggccacgtcgacgcgctccgcgagctgggccactgcctccaggacggctacggcgtgcgccgctccgtgctggacgggcgccgcctcctcatccaggcgaacgcgcgcgagctc

SEQ ID NO: 5253 - DNA, 755 bp, Sorghum bicolor
  Clone ID: SORBI-28MAY03-CLUS13050_1
ctgaactggaggatgccattgccaagggcaagaggagggctggccttgtctacaagctgcagagagacaaatagaaggagaagcagaaggagaaagaagcaatgacatcaggaaacactcatgctggtagtggagatttgatgaagaatcaggtggtcgtattcaaactgctaaaagatcctagttgttctgtactagaaccataaggccaaagtgcatgaatttttcatttgcagacaacagaggcaagaaaaatgagtcagacagccctttatgtgacttgagaaggaattgaggacaaggcacatagagaaggatgtcattacattgcaattgacatattcagtttgattattgtcctactgatgttttggtgtcttaaatggaccctgttagaagttcaaaatattccaactgcgaataactggccttttgcagccaggaagatgtcatgtttgtggatgaaccctcgcgaggccacctaattgttacttttatttcttcccttttttgtagaaaaaggtcaaggccatctaaatgttatttctgcaattgttggagttgatggagatctgattggttttgtcaatttggccagtcggtcgtgtactgcaaactcagttgggtactgtaaatgttatgttgataatggtacatcagttgctgtacaagttgggttggtatcgtgttggcattatttaaccaagtgttccctgtaaagtttcaataatggtaaatgctgttaggtggttttc

SEQ ID NO: 5254 - DNA, 1056 bp, Sorghum bicolor
  Clone ID: SORBI-28MAY03-CLUS113324_1
gcacgagggtcatatgcttgtctcaaagattaagccatgcatgtgcaagtatgaactaattcgaactgtgaaactgcgaatggctcattaaatcagttatagtttgtttgatggtacgtgctactcggataaccgtagtaattctagagctaatacgtgcaacaaaccccgacttcctgaaccctgaaaggattcaagatgtcatctgcagaggggcggatctttttgatatgcttccagaagagtacacattccaagaaatcattgccaagctggggccgatcccaagcacatattctggtgttcatcttccaagttatctactaaagaatgtcgagcggtttagataccttctaccgggcaactgcaggagagaaagtggctaggttttatggtcctaccctgcaatctgctgtgcatgggtgggtgccactgcaaagttgttgtccatgggatgcctgtggcagttccacctggtatgattgcctaacatagctggacaattgcttggggaaaatttggttcatggacgggtgagctcatctgctcatggttctgtaatgtgtaatagaacttgggaagggggatctaacagcatagcgcatgcttggtcctggctggctgtcccttccagacgagctgagctgagcagtttgtgcttacatccggatgtcattgtcattcgttacttccctgattgatatataaaactcaaaaggtggttgtagtttgcaaatcaagtggtatttcagaggccttgctctgcagataattcacatatgcatttgctcttacttggtgttctgttttgtccatagtggtgccagaatgctagatttgtgaatttctttgagcaaaaatctgtcttccacggcgccagcggctgagcaaccagcattgcgctagcgcattgtactttcctgtttaagctgtatggtgctgcactgttgtgcaacgaaagccacgtatgtaagtgagatggcaatgggtacaaacctgctgggttttgctattccaaaccagtaccaataaacaaaaaatctacctattctacct

SEQ ID NO: 5255 - DNA, 760 bp, Sorghum bicolor
  Clone ID: SORBI-28MAY03-CLUS11335_1
gaaatagagaaagctcatccagatattttcaacattcttctccaagtatttgaagatggacacctgacggactcacaagggcgcagagtttccttcaagaatacgctgattgtcatgacatcaaatgttggttctacatcaatctcaagtggaaggaggagtataggtttctcgacacaaaaggatacagaggaaaccacctatgctgtgatgaagtcccttgtgatggaagagctgaaggcatttttccggcctgaattgctcaatagattggatgaagtggttgtattccgtcctcttgaaaagactcagatgatggctattctcaacctaattctacaagaagtcaagagtaggcttctagcccttgggattggcctagagatatcagattcaatgaagaacctgatttctcagcaagggtatgacagaagctatggcgcacggccacttagaagagccgttactcagctggttgaggatgttatcagtgaagcaattctctttggacagttcaagcctggtgacacgatattgatggacactgatgccacagggaagccatgcttgagccggctgaatgatcagaccgtccaattgtctgaccccgctccaacaatgtgaacatcccagcaccctgtgtatatagtagcagcttacacatttattccgtacataggatctcccatctcagctgtgtacataacctttccagttgttggtttctctgccacaatattataatgtaaatttgattctt

SEQ ID NO: 5256 - DNA, 466 bp, Sorghum bicolor
  unsure (1)..(466): unsure at all n locations
  Clone ID: SORBI-28MAY03-CLUS113371_1
gcacgagggcctcctctcacaagcgcgacaccgaccaacttgtttctcatccatggaccacatgcatcggcgtgccgaccacggccacggcggcgacgcgccggcgagcgcccacgcccagcaggccggtgtagacaagaaccggcagcaggagcatcagccgccttcttcgttgaacccgacggcggcgaggctcctccgcgaggccatcgtctcccagccggacggcgagaagccggctgccgcgacgggcttctcggacatcctggcctttgcgcgctccgttgaccgggtcgactctcctcttgagtagcccttgagcttccgcagtcagctcactagctttgtttcttttttttcttttcttttctttttccatttccccatcctgtactctcgccgcaataaaaaaaggtcaacaccttcctcccttnnnaaaaaaaaaaaaaaaaaaaaaaaaaaaaaa

SEQ ID NO: 5257 - DNA, 739 bp, Sorghum bicolor
  Clone ID: SORBI-28MAY03-CLUS11343_1
atttgactttgcacagtactatgcttttgacattactatatttgccctcacaatgatctactccctgtttgctccgctcgtggttcctgtgggcgcgacatactttggctaccgttatcttgtggacaagtacaacttcttgttcgtttacagagttagagggtttcctgctggcaatgatgggaagctgatggacagagtgctgtgcatcatgcaattctgtgtgatcttcttccttgctgcaatgctgctcttctttgctgttcagggtgattcaatgaagctacaggctatatgtactcttgggatgttagtgttctataagttgcttccttctagaagtgatcgcttccagccatctttgttagaagggatgcagacagtgaatagctttgtagatggtcccacggattatgaagttttttcacaacctgacctggattggaatctgtatcaatcctgaagatcaatacacacttttgttcattacaacatctttcatgacttgaaatacctgatcgcgaccctggtgtatcaaagtcattcattcttcttgtacagctatgtagattaacttttatctccttagatgtatttgttttgtcggatatgacaagcagatacagttttgatgatgaacatggtctatcaaaaacttactttaaattatacatgatgtagtcatttcatttcttttttgttaataatcgaaggtcctataaccagaaaaagttgtcat

SEQ ID NO: 5258 - DNA, 1016 bp, Sorghum bicolor
  Clone ID: SORBI-28MAY03-CLUS11338_1
tcgcaatccccgtcgccgcaaacgccttcaggacaaacccaagggaaagcagattatacatcactgagtgaagaggagtggaagaagcgcctgactaaagagcagtattatgttactcggcagaagggtactgagagagcattcactggggaatactggaatactaaaaccccaggcatttatcactgtgtctgctgcgacacccctctgtttgagtcatcaaccaaatttgatagtggtactggatggccatcctactataaaccaattggcgaaaatgtcaagagcaagcttgatatgtcaatcattttcatgccccggaccgaggtgctctgcgccgcctgtgatgctcatctggggcatgtctttgatgacgggccaccaccaacagggcagagatactgtatcaacagtgcatctctgaaattgaagcctcagtcgctggatcctttaggaagaagttaagtataacactggcccgcccaatgtaaactgtgggtttgtatataaactattcgagttgtaccatatttattattcctctattatgcatatcaggtgcacaaactgatgaacctctagggtgtgtgtgttttcttacgcctctcatctagctacagctacagttatagcatacgtgcatggcacttgggacctacaaccagagtagaagactgtgtcctttcagagaccaccggctgaaaccattggagcttacatgtatgtgatgggaacatcacagtttctctgtggcaccatgcgagtgaggttgtagaggggagagatctgatttcaggaatctaaccctgactggttgtgtggccactggccagcgctcggtcctgaatttagggtgaaattggttgcattgcccgcatcttctccgtcctaaaatacgtttgaatctcggtctcgaatctagggtggaattggttgcactgcccgcatcttcttcatcctaaaatacatttggatggttgtttttatattgttccaactcgatgaaacacgtttgg

SEQ ID NO: 5259 - DNA, 558 bp, Sorghum bicolor
  Clone ID: SORBI-28MAY03-CLUS114093_1
tgccacccagcatagctcgctcgctccagcgccctgcgagcagcagcagcaccctcgcccagcccggctgcaagaacatgaacccgtcaagatcaggccattgacccaactggcggccatccgaagctctgaggtcgacctctgacgccgcgaccttgggtgcatccccaatgcccgcgcccagggcgcctccgacgaatctgccactgctaccacaacctcctcctcgtctagccccaacaaccttgggcgcatccctgacgcccgcgcccagggggcagcctccgacgactccgcgccgcctcttcgtctgtcccagtgccagccccaatgtctcgtcccgcgacgtctctctcgacctcctctccggtgtcttccctaacccagccccagcgcccaaggagagagaatcaggccacctgcagcgaggatctcctcaacaccaagtccattgagcatccaggaggaatttcctgaacgttcttgactttctatagaaattcaacacaagtaagcttttgtctcggggatctaggacataatggctgcacaacaagt

SEQ ID NO: 5260 - DNA, 331 bp, Sorghum bicolor
  Clone ID: SORBI-28MAY03-CLUS113741_1
gcacgaggaagacggctggccagttgatgcattgatgctttcgttgtgaagatgagcaccaagtacaggaaggaacatcttttgaagtgctggcatcaggggaactgaagacattgttaatgtaaaaggaaacaggtttgcctgaaatcgtgtttctgtgtttaatcaacattggcgagtgataccggcacctgttgagtgttgacaaattgacgaaggctaaacttgtggtatcggtgtgccaatgtgcactgtaactcgtatcatgaacaccattggctgcagtgcactgattattggtcccttataatttaaaaaaaaaaaaaaaaaa

SEQ ID NO: 5261 - DNA, 939 bp, Sorghum bicolor
  Clone ID: SORBI-28MAY03-CLUS11135_1
gcacgagggaccgccccgccggcgccggcccccgaccgccccttctgctgtcgggagctcttctgcagccggcaggcagcaccccgccccattttgatttgattttccagggagaaaggcgagtccttttgcgcctaagcttggacgccagtcttgagttcgttaaggtcgacctcacaccagcgaggccaaggcgtactgcatacatcacacctcagaaatcagacctcaaaggcaacttggaagacaagcagggttgcaccctgcaatgtcagccctcaacagtgatagcaacatgcagcagctagtccctatagcaccaccaggagaggcttcttgtggtggtgacagtgggaaggagctggttgtggtggatcctgcaggaaagagttcaacaggttctaaactgcgagaggacgaggaggacctggaggtgaagctcaggcgcatcatggagaatgtccctgtgcgtgtcagtaacacatcagggtcctctgctggctctggctctggtgatttccaccagtatcggcaaatgcggaggagagagcaggaccggctagctcgaatggatgctgactaccagaagagaaaagagatggctgagtttgaactgcggagggaggagaggatcaaagctgctgaggagcggacagccaagaagcgcctgaaacggcaaaagaagaagcagcgtaagaaagagaagcgagctaaaactggtaataatggtggtgaagatcctaacagagtggattcgtctgatgatgatgaaggttcagatgacgatgacaagtccaagcaatgacacgccaatttgcatctgaagatgatttctctctctgcttgtctgggcaatgaactaacttgtttttatatatttttatgaaattattctggtgctgtatctgttagaagtgtcatttgagcagagatggagag

SEQ ID NO: 5262 - DNA, 632 bp, Sorghum bicolor
  unsure (1)..(632): unsure at all n locations
  Clone ID: SORBI-28MAY03-CLUS111762_1
gcacgagggagagacgacccctcaagacgagcaaggcacgagcgagcgagcgagggtgcacgccgcacacactagcgcagcgcgcaggcaggcagaagcagagaacaatgtcgggagcacagggcgcgcacccggtggggcagacgacgccgacgacgtacgagtcggtgggcggcggggagaaccgcacgcgcacggacctgcggtcgcgggaggaccagggcgccatccagatcgagaaggtgcaggacaaggtcgacgacgccgcgggccgtggagtggaccaccgcaccttcggcgccaagaaggagcgccccgacgacagcgccgatgccggggcaaccggcaccggcggcactgccgcgtgattgtgctgggcgacggcgatggtttgtgtgcggcaccgtacgtgtgcgtgcttttgtgtgcgctgcttggctgctctgtctacgcgcgcgtggactgtgaagccaaccagccagtggtagtgtaactgtgtaagatagattgcaataaagtaaaaggaccgtctgatctgaatactatacataggccttgtttagtttataaaaattttcaaaatttttcgttacattgaaatttttcatggagtanaaaaaaaaaaaaaaaac

SEQ ID NO: 5263 - DNA, 619 bp, Sorghum bicolor
  Clone ID: SORBI-28MAY03-CLUS111974_1
gcacgaggagcgacgccgtcggagagaactacatgaggggcctctacggcgacgacgactacaacgccagccactacggccagcagcagtcagctggcacggcggtggccaaggcgctagcctcggccacggcggccttcaccttgctggtgctgtcggggctggcggtgacgggcacagtgctggcgctcatcgtggcgacgccgttgctggtgatcttcagccccgtgctggtgccggcggccatcacggtggcgctgctcacgacaggcttcgtctcgtcaggagggttcggcgccgccgcggtggctgtgctggcgtggatgtaccgctacctgcagacgacgacctcgtcgtcggatcagcagcagcatcagcatcagctgtccggcaaggcgcacgacgtcaaggactgggcgcagcaccgcctggagcaggcacgcgcgcactgaatggaaaaaaaaaatgcccatactggagctagcctcgaggtcttaattatactgtcactcacgtcaatcgcacatatgccgacatgttatgtaatcttcggttggcagcaaaaataaagagcgagttcctgtcgacctctataatgaataaataaatacaatacttt

SEQ ID NO: 5264 - DNA, 617 bp, Sorghum bicolor
  Clone ID: SORBI-28MAY03-CLUS11217_1
attatacatattatcacaaacttcagtaataatcgtgagtagttgataggtacattgtgcaagattagtagggcgcaaacgcgatattacaataggttttggcagtgtcgaactactatagtacatgagagcggcagacatgcttgtaaggatggttattttttgctggtcttcaagctggatttatgctggtcttcaggttggatttctgctggacttcaggttggtcgcgacgatgatcagtaattcatgctgcggttgaattcacattcacattcatgttcgcttgagttgtgtacaatcgctcgagtgacaatcgctcgatgtcttgttgttgaagaaaatagattgacgcatgaccaatatgggcgatgccatgcaagatatccgagcagggtgccaacaagcagcaacaccatatggtccatccaaaaccgtgaatcctctcaccttttgccgcggcacgcacaggtcgactgccggcggccgggcaccgtgcacgggcggtggatccatccttgcgccgcctccgatcacaagcttctccttccatcaattaagtcatgtgttggcaaggaagtgtatgtggtatgatccattaggccttttgagagaat

SEQ ID NO: 5265 - DNA, 837 bp, Sorghum bicolor
  Clone ID: SORBI-28MAY03-CLUS1120_1
gcacgaggcagtcatcagttgccactagtggtgcaattaagaaggattatcaggagggaagcataaacacatcaaagggaaaaggaaaagctgttcttaaatcgagtttggatgaacctaaaggcccacatactaggaatgctgaacgaagaaaagctgcttctgagaaagatgttgaactgaaaccatctcatgatcacagtacttcagaggatgaagatcttgatgcttctccagttgagattgatgatgctttaatgcttgatgatgacgatgaggatgtctccgaggatgaagatgatgatcatgaggcggttctccgagggtctcttcctcgacccgcgtctgagggagtgcatgatgtgaaattaggagatgctgatgattctagtgttgcctcattggcaaatgataaccaggcacagccctcatctggttccagtacaaaaaatgcgtctggcaggggattggatgctgctgaatttagaagtccaagcacatttggttcacggggtgcaatgtcgtttgctgcagctgcaatggctggattaacttcagtaggtagtcgtggtattagaggtagccgagatcggagtggccttccattgggtgctcgtacaaccgagcattacaacaaattgatatttacagctggtgggaagcagcttaacaaacatttgactgtatatcaagctgttcaaaggcaagtagttcatgatgaggatgatgaaagatcagttaggtggatccgatttacctgatgatggtaaccacttctggggtgatgtattcactataacatatcagaaggctgataacacagcggagaaggggtct

SEQ ID NO: 5266 - DNA, 988 bp, Sorghum bicolor
  Clone ID: SORBI-28MAY03-CLUS114288_1
gcacgagggccgttactaccggtggccctcgcgatggcgtcggcgtacagcgccggttccggcgcggacaggaggctgctgttcaggcagctgttcgagaaggagagctccacgtacacctacctcctcgccgacgtcgccgaccccgacaagcccgccgtgctgattgaccctgtcgacagaacagttgacagagatcttaatcttatcaaggaattgggcttgaagctcgtgtatgctatgaatactcatgtacatgctgatcacgtcactggaacaggactaataaaaactaagctacctggagttaagtctgttatttcaaaagctagtggagcaaaagctgatcattttgttgatcatggggacaaaatacactttggcaaccttttccttgaggtgcgagctactccaggccatacctctggctgtgtgacgtatgttacaggtgatgctgatggtcaaccttcaccaaggatggcttttactggtgatgccttaattatccgggcatgtggaaggacagatttccagggaggaagttctgatctgctgtatcagtcagtgcattcacagattttcacattgccaaaggatacactggtgtatcctgctcatgactataaaggtttcacggtaagtactgttgaagaggaggttgcctataatgctcgactcacgaaagataaggaaactttcaagacgatcatgagtaacttgaacttgtcatatccgaagatgatggatgtagctgtacctgccaatttggtctgcggtatccaggatccgccaccgaagatctgagctgttccagtggaagcctgcagctgcacttctggttctttatgaactccgaatcgacaccagagctgagttgttcattaaataatttgtttgctgcagcctgtcaatggccggtgtagcctctggttgtatgtggcaaggcactactgtttggtgagatcaaaaggaacaatactaataataa

SEQ ID NO: 5267 - DNA, 690 bp, Sorghum bicolor
  Clone ID: SORBI-28MAY03-CLUS114361_1
aattccactccggatccgagctcttcacaatcctatacgccgggttcatcgcgtcgggggtggcgttcgcggtgcagatctggtgcatcgaccgcggtggtccggtgttcgtggcggtgtaccagccggtgcagacgctggtggtggcaatcatggcgtcgctcaccctgggcgagaagttctacctgggcggcatcatcggcgccgtgctcatcatcgccggcctctacctcgtgctctggggcaagagcgaggagagggcgcgcatcgccagggacgccgccgccgccctcgtcgtctccggcgccggcgaccgcgaggggctccttgcggccggcggcggcggtggtggtggcatccggagcaaggcggcggcgtcggcggccgtcacgcagcctctgctgctgccgtcctccacctccaccgacaacgtctgacctatcgagatggatgaatcctaaatttgtggtgcagcatggagagatcagaggctgcatgcgtacgattcatgaggctgccatgctgcggctctgcacgaactcatcatggattggagcagccataagatccgatccagtattattgtcagttagtcttcttttgaggttttccttgttgatttcaggcatgtatgtatgtatgtatgatgatacatacgtatatgcattagtaatattgtgtgtgtgtgtg

SEQ ID NO: 5268 - DNA, 785 bp, Sorghum bicolor
  Clone ID: SORBI-28MAY03-CLUS114380_1
gtgtcgctatcggagcagcaggtgctggattgcgacaccgacgggaacaacggctgcaacggcggctacattgacaacgccttccagtacatcatcagcaacggcggcctcgccacggaagacgcctacccatacgccgctgcacagggcacgtgccagtcgtcggtccagccggcggtcaccatcagcagctaccaggacgtgccaagcggcgacgaggcagcgctcgccgcagccgtcgccaaccagccggtggccgtggctatcgacgcgcataacaacttccagttttacagtagcggggtgttgaccgcggacacctgcggcacgcccagcttgaaccatgccgtcacggcggtgggctacagcacggcggaggatgggaccccgtactggctgctcaagaaccagtgggggcagaactggggagagggaggatacctcagggtggagagaggcacaaacgcctgcggtgtcgcccagcaagcctcctacccggtcgcacgatgaacaaactacctaaggccacgttcgtttcaccgggaatgagctccgggaagaattcctggctggattgttattgtaatttatataaacttttacaaccggattaattccaggcctgtaaatgctgtaaccgaacaagccctaaataacgtacggatcgctattctacgtacatgaaggcatgcataagaaagactaataaggaaaataaagcatgcacacatattgatagtacatacaaacacaattgttatgcaacactccaaatatacatgaac

SEQ ID NO: 5269 - DNA, 486 bp, Sorghum bicolor
  Clone ID: SORBI-28MAY03-CLUS114457_1
ctcctacgtcgacgacaagttgttcagcgcgtggctaccggtcttcattggcaagacggcccaggagagggtggaggcggcgacgcaggtcctcgccacgctggacacgctggagcaagcgttcgaagagtgctccaaggggaaggccttcttcgcaggggacaccgtggggctcgtcgacgtcgtgcttggcagctttctcgggtggctgtacgccaccgaggccatctgcggggtgaaggtcgtcgacgccaccaggacgccgctgctggcggcgtgggcggagcggttctgcgcgctggatgcagcgaaggggctgatcccggatgtggagaggcttgtggagtataacaaggccaggcgggtgttccttggccttccgctcctaccttagcttattattagctaggatgaatctaatatatacttctgtataatggatcgaataatagttcgaacaggccgttttttttttaatacaaattc

SEQ ID NO: 5270 - DNA, 953 bp, Sorghum bicolor
  Clone ID: SORBI-28MAY03-CLUS114503_1
ttcggcacgagggcgtcgcgggccgtgacgggcgtcgctggagacggggacaagaatggctgccgtggcgcgcgggcctgcgatggccccggtggctgtgcaaggggcgagggcggctgctgctgctgccgcggccgcggccgctgcggcggaggagatgcggtggcggcagctagacagcggcgtgagcgcggtgtcgttcgggttcgtggccaccgccatcctcgtgtccatgttcctcgccatggccatcctcgagcacttcctccggcccccggcacacgcgcccgggcacgggaacgggcacgcgccgccccgggggatcctccgccgcctccgcctcttcctcggccgcggcggcgagcgcggcgccggccccggcgcggatctcgaggcgtcgaggaagctccaaggccacgcgcccctcgagatacctgtttaccccaaaggcgtctcagttctgatgccagggcaagacatgccaacgttcatcgcgcatcctgcacctgctccctgcccaccagagaggatccaatggccatcacaccagtctcctcctttcgctggctccttgtcaaaccctagctagggttgctgtagcgcacacaccacattcagagggccggctgctgtcagtcacccaccaaagtatgtagaggagcagccgtgtgctctgtggctgtgttgccgatgatccactccgtctctggtggctcgggagcatgacagccaagacaggctctctccttccccctgtctgtatctgtacaggtttaggtcttgttctgaagcaagttttatgctgctgccccctgctgctgcattgtggcgggcgagcggcggctggtggatccgtggagctattgttgctgatcccacttgctgtgtgttcgtagatgcctgatgcctggtggagcatgtaatgtaaacacgcttggcaaatgtggaccccc

SEQ ID NO: 5271 - DNA, 633 bp, Sorghum bicolor
  Clone ID: SORBI-28MAY03-CLUS11300_1
gtagtcgattttatagatgatggcagtaaggttactgccatattggaggacggtagaaaatttgaaggcgaccttttggttggtgccgatggaatatggtcaaaggtgaggaagacactattcgggcattcagacgccacctattcaggttacacttgctacacagggattgcagattttgtgccacctgatatcgatacagttgggtaccgagtatttcttggtcacaaacaatacttcgtctcttcagatgtcggtgctggtaaaatgcaatggtatgcttttcacaatgaagaggctggtggcactgaccctgaaaatggcaaaaagaaaagattgcttgagatatttgacggatggtgtgataatgtcgttgatttgataaatgcaactgatgaagaagcggttcttcgccgggatatatacgaccgcccacctactattaattgggggaaaggtcgtgtcaccttgcttggtgattctgtccatgctatgcagccaaatctgggtcaaggtggctgcatggctattgaggatggttaccagctggctgtagagctagagaatgcctggcaagagagtgtcaagactgaaactcctatggacatagttgcctccttgaggcgttattat

SEQ ID NO: 5272 - DNA, 1169 bp, Sorghum bicolor
  Clone ID: SORBI-28MAY03-CLUS113154_1
gctgcgacctccaatcccgcctccccctttgggcggccccgctgcggctgttgccctcgtcgtccccgtcagccctcctccccttcacctgagttcaatgtcgccgagtcggattctcccttggcgccctttcctcgcgctctttaggatgcctgcacgctctacgaaagccgcgcgcgcagcccctgccccgtttgcacaccctatgcctattgccccatcgagttgggatttccctgcgccacggctagcggctgcgccgccgctggcggcgggagggacgttcccggcggccgaaatgagccgtgtggcccttatgggtgcggcgtcgcttgccgttgcggcgtggattcccctacgcttcgagactctccggctccccgaccccttctgcattccctgcctcgtcatgggtgtccgtgtcggggtgtacttggcgtgggttcgggtttccgcagtttgtggccctcgcacttatgtggtcttcttgtcttgtcgcagcacgccctgcagggccataggtctcgatgtcgggatgaacatggcatggatttgtgattctgcagattttgaccctcacacacataaagacttcatgtcaattctcattacggcagccagggcctatgtcctggttcacaaaggaaggcatgatccaggtctggggagccacttgtgtttcaaatctctatgttcgtttcccaagcaaaggccagggagtctccattgtggatactatgtatgtgctttcatcagtaacacaaaaggctataggagacaccctgaattgtggaaagaagaaaaagcactaaaaagggatgtctacagggatgatgacctcttagagattgtcggtgacctttgcaactttataatggaccatgttgtttattacaaaggtgattaccataacccacattccgacttaggtagcaatcctctttaccagcacctccgtcagtgggataggctatgtctaggtcgttgattacatgtgaacttattggaatggactgtgatcgatttgtattagtacttgaaaaatttcggactcttttggatggatttgtaatggacttgaaacattttggacttgaaatgtggtgctgtgtatatgtatggatatttatgttgtgaatctgtgatgttgagaatctgattatatatgt

SEQ ID NO: 5273 - DNA, 606 bp, Sorghum bicolor
  Clone ID: SORBI-28MAY03-CLUS11323_1
caaattttcactattataactatcgatgatcaccaacatccgaacaattccccacagctgtaaaacagatgctgaaccgaacaagggacagcctgagtgagcagcacaacagcgagtaagcaaagcatttgccatgcatgcctcacgagctcctacaccggaacaatatagacaagcgaccgccggcggccatgattattctataagaacggcgctcgccgcttactcgtcggacgcactccaacgccgtcactcctcatcgacgaactcgaactcgtcctcgcggaggtgggtgaagaaccggacgggcttgggctggccgtagacggcgagctggaactcgagactgaaggggaggttggccgtgtcgcgcttgcccttccccacgctgacgtactgctttcagacggcctccatgccctggatgtccaggtcgggcgccttgatgacgtggtagacgcggagcggcgccgtgacgcgcacccgcctgccgatcttgggcgcggccgcggcctcctcggccgccacgtcgtccgactccgaggtcaccgcgttggtgagcgcgacctggaggagcaggcgcgcgcggcgcggggccgggggcgg

SEQ ID NO: 5274 - DNA, 731 bp, Sorghum bicolor
  Clone ID: SORBI-28MAY03-CLUS11499_1
ctctgctcatcatcaactccacaatcagcttcattgaggagaacaatgcgggcaatgctgccgccgctctcatggcgcgcctcgcccccaaggccaaggttctcagaaatggccggtggaccgacgaggaatcggcaatccttgtgccaggggacatcatcagtgtgaagcttggggatatcattccggctgacgctcgtctgcttgaaggggatccactgaaaattgatcagtctgcactcaccggcgagtcccttccggtgaccaaaggccctggtgatggcgcgtgctctggttccacttgcaaacagggtgagattgaggccggtgtcattgccactggtgtgcacacattctttggcaaggcagcacatcttgtcgattcaacaaaccaagtcggtcatttccagaacgttctcactgacattgggaacttttgcatctgttcaattcccacgcgtccggtcgtggagcttatcgtcatgtaccctatccaacacaggggttacagaccaggaattgacaacctgttggtgcttctgattggaggaattccaattgccatgcccactgtcctttctgtgactatggcaattggggctcatcgcttggctcaacagggagcaattactaagagaatgacagcaattgaagaaatggctggcatggatgttctttgcagtgacaagactgggacattaaccttgaacaagttgactgtggacaagagt

SEQ ID NO: 5275 - DNA, 533 bp, Sorghum bicolor
  Clone ID: SORBI-28MAY03-CLUS114990_1
ctgaaggccatcctcggccgccgcagccgccgcgtgtacaacctcccgcccggccccaagccgtggccgatcatcggcaacctcaacctgatgggcgcgctcccacaccgctccatccacgagctgtccaggaagtacggcccgctgatgcagctccagttcgggtcgttccccgtggtggtcggctcgtcggtggacatggccaagttcttcctcaagacccacgacgtggtgttcacggaccgcccaaagaccgccgccggcaagtacaccacctacaactaccgcgacatcacctggtccccctacggcgcctactggcggcaggcgcgcaagatgtgcctcaccgagctcttcagcgccaagcggctcgagtcgtacgagtacatccgcgccgccgaggtgcgcgcgctgctgcgggacctgcactcggcgtccggctccggccgcgccgtcatgctcaaggactacctgtccacggtgagcctgaacgtgatcacgcgcatggtgctcggcaagaagtacctggacaa

SEQ ID NO: 5276 - DNA, 477 bp, Sorghum bicolor
  unsure (1)..(477): unsure at all n locations
  Clone ID: SORBI-28MAY03-CLUS115025_1
ccccnccgccggcgcgttcggggtcggggccggtggggcaccgctcatcaacttcgcccccgactacgccttcccgccttcctcggccgtcatgtccttcgaccaccaccagcagcagctccaccggagccaacacgttgcgccgccgctccaggagcagctccggaggcagcagcagtacacaggcgcgtcgtcgccattcggctacggcaacagtttcctgcaaggcggaggcggcggcggagacatcttcgcctcccacggcggcgggttcgcggcgtcggcggaggacaggatgctcctgcagagcatccaggcggcgcagatgccgccgatgtccgccgctaacaccagcactaacggcttctttgcttgaataagtaagtagctgacctacggccatccatggtacatgcatggaagctagagatcatggagagggaacggggaagaagtgaagaccagattagcagcagc

SEQ ID NO: 5277 - DNA, 797 bp, Sorghum bicolor
  Clone ID: SORBI-28MAY03-CLUS115039_1
gcacgaggcgactactgccagccccggccggagtggccctgcgcgcccggcaagaagtacttcggccgcggccccatccagatctccttgtaagcaaccaaacatgcacgcatttcactcgtcatctttgcatcattgcatccatttctgttgcttgatgtcgagctcatgcatgccatggcatcagcaactacaactacggcccggcggggagagccatcggcgtggacctgctgaacaacccggacctggtggcgaccgaccccgtggtatccttcaagacggcgctgtggttctggatgacggcgagggacaacaagccgtcgtgccacgcggtgatcacggggcagtggacgccgacggcggcggacagggcggccggccggggcgcgccggggtacggcgtgatcaccaacatcatcaacggcgggatcgagtgcgggcacggggccgacccccgggtgacggaccggatcgggttctacaagcgctactgcgatgtcttccgcatcggctacgggagcaacctcgactgcgacggccagaggccgttcaatagcgcggtggccgttgagcagctggcggcgcagtgaaaacgttgttatagagagtggtgccagtgtgatcaccagtaatcgacgagcttgctacgttatgggtggtgtgagcgtcatttttcaccaatcggcaaaaccacggatgcctgaataaaagtttatgtaaaaactggtgcatgcctctcacccactcttcagccttgtttagatgcacccaaaattctaaaaatttacaagatt

SEQ ID NO: 5278 - DNA, 750 bp, Sorghum bicolor
  Clone ID: SORBI-28MAY03-CLUS115097_1
gcacgaggaaacaaagcaccgccggctgatgttgttgtgtctctgtatgttgccatctttgatgctgcagcgacgacgcccaagggagagggctggaagaagctgcgccggaaaggcaggatggccaacggcggcgacgcccccggcacgccgaggagccccaccgtctacgactgggtggtgatcagttcgctggaccgctgaagcggccgggcccaaggccaacctgcccaagatgagaactccgacagccacaaggagaccatcaacagctagcgaactgcaacgaggatcagaacagagggacctcttttcagagcttctggtgacggttctgttatagtgtatacgttaattaacggtgtatatatgtcatcttcctgtaaatctccgtgtgagtgagctgctggcctgctgctgattttgtaagctaaagctactactactccgtactacgctgggcatcagctcgtgcatgtcaccgtactcgtgtacatgtcgtgaagggggaggcgggcaacacaacacaagcagcaacagtagtgttgaagagagtactgatactcctactccgtagtacttatgtggctatgtacactaatcctgttggctgttgctgtacgagtgactagacgcagcctcccctgcttcctagtagtctgtagcacagggtactcctccgtatggtttctgctgctgtgtataatgtaaaatgtataataatcctactacgcgcgcaacaaataatgc

SEQ ID NO: 5279 - DNA, 572 bp, Sorghum bicolor
  Clone ID: SORBI-28MAY03-CLUS11350_1
gcacgaggctaaacacaatgtggatggtctatacaattccaagtggcctcagcagtgcaataagtattagagtgtccaatgaactaggtgctgggaacccacatgcagcacggctatcagtttatgtttcaggaatcatgtgcctagctgagggcctttttgtagctatcatcacagtattagtgcgagatgtctggggttatttgtacagcaatgaagaagacgtagtgaagcatgtatcgattatgatgccaattcttgctacttctgacttcatggatggaacacaatgcacgctatcaggcgcggctcgaggatgtggctggcagaaagtatgctcggttatcaatctgtttgcttatgcttattatgctattggtctcccttcagctgttactttttcatttactctgaagattggtggtgtgggcctttggctgggaatcatatgtgctaggcagtgcaaatatttgctttggtcatgatgatgcttcgaactagctagaatgaagagatgcacaagaagaagagtttgcaatggaacaatggaacaaagaggttgagttttccca

SEQ ID NO: 5280 - DNA, 678 bp, Sorghum bicolor
  Clone ID: SORBI-28MAY03-CLUS1142_1
cggtcgacccacgtccgtgactgctggcgtcagtactgtgatccaaatactggatgtaatagcagctacctgtattgcagtaataatcatccgggcagctatactagttggcttaatagtaatagtactcaagtattcagcatgtgcaatggcaatcaatcttatgctttcaactttggcatttatgagcaagcactggtctctggaatacttggtccaggaaattttatctcaaaattatgttattgcttctggtggggactgcaaaacctgagtacacttggtcaagggcttatgacaagcacatacactggagaagtgttattctctattgcaatatgtgtccttggactaattctttttgctctcctcattggtaacatgcagagctacctacaatctgttgctatacgccttgaagagatgagagttaagaaacgtgatgctgagcagtggatgcatcaccgttcactgccaccggaaatcagacatcgggtgaggaagtatgaacgttatcggtggttggaaaccaggggagtagatgaagaaagtttggttcaaactcttccgaaagatcttaggcgggatatcaagcgtcatctttgtttgggcttagtgaaaagggtgcctttgtttgaaatatggatgaacggttattggatgcaatatgtgagcggt

SEQ ID NO: 5281 - DNA, 641 bp, Sorghum bicolor
  Clone ID: SORBI-28MAY03-CLUS11420_1
ctcgtctactcctgcgtcctgccagtaatggcttcagcagctagcgagatggaaggcgaaggcgccggcgccggcaccggcactggggaaggagcgccaatcgcgccgcgcaggccggccctgccgttgaaggtgcggttccagctcctgtgcctcgacgtcgtcggtggcctctcgatgcgtcgcgacggcaccatcaaccgctccctcttcagcctcttcgaccgccgcgcccgcgctagcgcgcgcccggatggcctcggcgtccggtccgccgacgtgcacgtggacgcgtcgcgcggcttgtgggcgcgcgtgttctcgccgtcggaggcggccgggtccccgctccccgtcgtggtctatttccacggtggcgcattcgcgctgctctccgcggcctcggtcccctacgacgccatgtgccgccggttctgccgcgagctgggcgccgtcgtcgtgtccgtcgactaccgcctcgccccggagcaccgctgccccgccgcgtacgacgacggcgtcgacgtgctccggcacctcgcctccacagggctccccgacggcgtcgccgtgccggtcgacctctcccgctgcttcctcgccggggacagcgccgggggcaacatcgctcaccacgtggc

SEQ ID NO: 5282 - DNA, 551 bp, Sorghum bicolor
  Clone ID: SORBI-28MAY03-CLUS114253_1
gcacgagggcgaggggggaactcatggaggacgacgatattcagctgctgggcaccaccaccacggcgaggaggaacgacaacgatgggcagtacggaggcttctggctcgccgacatcatgcagaacgccgtcgccgccgctcgcacacgcatcaagtccaacccaccagacatcttgctggccagcttgccgaaatccggcaccacctggctcaaggccctcgccttcgcgacgctcaaccgtgccacgcactcgccgtccgacgcccaccacccgctccggcaccacaacccccacgactgcgtcgccttcctggagatgatgatggtcacccaggacgacgacaacgacgacggcgacggcgacgaggccctcctccgtcctcctccatcacggcggccactgctggtacagacgcacatcccctactccctgcttcccgatgccatcacggcggagggctccgggtgccggatcgtctacgtgtgccgggatcccaaggacatgctggtctccttctggaacttccacctcaaggagggaccgact

SEQ ID NO: 5283 - DNA, 619 bp, Sorghum bicolor
  Clone ID: SORBI-28MAY03-CLUS115539_1
gcacgaggcctttcaccactaccacacaattgtgaaaaaattgtgatcttgttccaacttccaagaacagagcttcttcagaacttcaccaatacaattctagctcctttgcagctatcttggatcatcagccatcatcatgggaaactgcctggtgattcaagacaggaaggagatcaagatcatgagcgtcgtggacgacggcggcgaagtcctcaagatgccatccccggtgggcatgcgcatgcgcagcttgaaggtcccggccgaagccctctgcgagcgcctaccggcggcggcggctgctgctgccggcgtcgacgaccctgctgctggcgccgccgtcagggtgaagctggtgatcagcaagcaggagctgaagaagatgctcgacaaggagggcatgtcgctggacgacatggtgtctctcatgcgcaaggaggcgagtggccgagaacaggaggaggagttctgctgtggagggtggcgaccggcgctggagagcataccggaaggcagcgatctctagcacgtacgttatactgcctggcatcgttcttcgatcatcgatcaagattcttgtgaaagtcacaggatcagtgatcgtgcctacactaca

SEQ ID NO: 5284 - DNA, 588 bp, Sorghum bicolor
  Clone ID: SORBI-28MAY03-CLUS115542_1
ggttgttgactccaaacacagttcgtcacggccggattcccccaattcccacgattccaagtcccaaatctcacgagagcatagacatggcggtgaaggtgtacgggtgggcgatctccccgttcgtgtcgcgggtgctgctgtgcctggaggaggccggcgtccgccgccggctccgcccccggccccgcgcccccccccaccgccgccccccgcccccccgccccccgcgcccggttcccggtggggccggggcccggggccggacgacgcacccccctccctccgtgcgccatccttccatttgttccgctgctagggcacttcggctcctgccctcgcttccatccacgagtctctgttctttttttgtccatcttcacgcccatgtcccgttttggtccgccgctcggctattcaggctggatctgacagtgcgaatcataaataaatgttctttttaataccaacatcacacccatgacccttttatgtgttgcaaactgcaattcattctggatgagaaatagcgtgggtgcatccatgcataaaactccaaagcaggatcttttttctaattcaaaataa

SEQ ID NO: 5285 - DNA, 672 bp, Sorghum bicolor
  Clone ID: SORBI-28MAY03-CLUS115657_1
gcacgaggagcaagtacgcaaagcatcttacaagtggctcttctagctcactgtcatctcctataatttttctcttccaacaagtcgatcttaagttccttttttcgcgaagccgatcgcgaagatcatctcatctagctagcaatggaccgggtgacaaagctggcttctcagcgtgcggtggtcatcttcagcacgagctcctgctgcatgtgccacacggtgacgcgcctgttccgcgagctcggggtgaacccgacggtggtggagctggaccaggaccccagggggaaggagatggacaaggcactggccaggctgctgggccgcaaccccgcggtgccggcggtgttcatcggcggcaggctcgtcggctccaccgacagggtgatgtcgcttcacctcagcggcaacctcgtcccgcttctgcgcaatgccggcgcgctctgggtgtagccgtgtagcatatactatatatatatagagctccggcggctgctctgatggagtcacctgtccatgcatgcatgcatgctttctatcaggagacacacggagcaaagtagcaataattaattaagcaggcctttttttctgcactgtaataatgatctatatatagaggggtgagtgtcgaatcagggcttttgcgccgtaatataatactaatac

SEQ ID NO: 5286 - DNA, 713 bp, Sorghum bicolor
  Clone ID: SORBI-28MAY03-CLUS115784_1
tacggatccatcaatgacacggcgatgttctacgggctcaagtacttcaacgaccacctgatgcaggcggggccgtacgggaacgtgcagtcggaggtgctgatgcgcaaggacgccagcaccttcaccttcaggcagggctgggcgttcccgcgcaaggtctacttcaacggcgacgagtgccagatgccgccgccggacgagtatccctacttgcccaactcagccctgccggcagccgcggcgtcgtcgtcgctgggcgctgcggtagcggccgtcgtggtgctcttggtgatgatcgtggcatgagagaaacaccggagatcgatcagagcctaatgctagaaccggcagagagagatggaaaaagacgttggtttgatttgtagatagagacctcggtatgggtttcaggaatggtttggatgcttttcttccatagatgggcaaagccatgagcatgattttggaacgggccggacatgtgcatttctcgtcagataactcaagtgtcaagtcatacagcgtgtacaatgcctctatatgcttgttacatctagggatgcaagttaggttgtcgacgaaccaaaaatagacttaatttttatagatgatccaccaaccactgaggttctatatcgaaatatcgaatcatacggagatattatcataccatgtttcacaacagctacagcaaaatatgccaaaatatt

SEQ ID NO: 5287 - DNA, 660 bp, Sorghum bicolor
  Clone ID: SORBI-28MAY03-CLUS115792_1
cgccggcgtcgcggtgctcgcgtgggtgttgttcttcaccttcctcccggagacccgcggccgcacgctggaggcgatgcacaagctgttcggcgccaccgacgacgacctgaaaccccaggacggagccacgaaagacaagaagctcgaaatggccgccaccaactaatcacttcaaaatagagggtcttattgagggggttcatgcgaagaacttgagcagtaggcagctagctagctgccattgttgccatatgagatagctagggtgaagtaacgtgggaagattcgctcgctggtccggtgcagctggagaacgacagccagcaaagctcgatcaggccggccagctcgtggctcttaaagcttcttaattcatttctaagtacatgccctgtgtttcgtgctttgttttgtccgtaagatgggtgagctagctagcaagttgttggagtcgctgtggccgccaatggcatgttgccgggtgtgtagtgtacattactagaggtgtcagtcacgttagttcgtcctgtaataactatataagctgtgtgtaacgggtggtgctgttgcctcgctgcacgagtcatggaggctagaaaattggtagtggtttactgagggagtcaagcaagccatggagaaagtgtattaaggaaa

SEQ ID NO: 5288 - DNA, 580 bp, Sorghum bicolor
  Clone ID: SORBI-28MAY03-CLUS114613_1
gcacgagggccatcgctctggatacttgatacaagcggaatactggtcgaggatctggattgtgcaggaattcttgcttgctaaagatctgactctgttaatgggaagtcgcaggctttctgcccgcagatttgaaatcattatgcgccattggactgaaaacccaccagatggaataaatctctccaatgcgtcgtttttggtttccttccggcgaggacacctttctcgagagtttgagcagatgttcacactttttgccgacatgctatgctcccttccacaggacgccgtatttgctttactaggccttgttggggaacggacaaaagacacggagctcattggtatgattgattacagcttgaccgtatggcagcttctccagtgcatcctggcgcgcgatattattgaatacccgctccaatttgcataccattattgggtcgaaatactcaggaaccaagaagacaaagatacgcatatgcacgacgttcttaacgtgcaactacggcatcaggcgcatttatcgcttcgcgatcttgatgatagtcgatatacgaatcttgacggattatcc

SEQ ID NO: 5289 - DNA, 480 bp, Sorghum bicolor
  Clone ID: SORBI-28MAY03-CLUS114619_1
gcacgtgcggcagtcgcagtctcacactcacacatcacgagctatctccggctcccattaatccgccagccaagctccgtgttcccaccctccctagatagatggaagcgtacgcggcaatggcgtcgcctccgccgcccaccacgacgaaggccgtggtggacaagctcagctacgagatcttctccctgctcgagagcaagttcctcttcggcgccggagccgggtgcctgtcgtcctccgtccccggcacgccggcgcgggcgcttcttgacggcggccgcgtgcgggtgctggcgatcgacggctgcggcgcgggcgccgaggacgcgctcctggccgccgccgcgctcgcgaggctcgaggccgggctgcgcgaccgcacgggcgaccctgacgcgcgcgcggccgacttcttcgacctcgccgcgggcgccggcgcgggcggtgtgctcgcggcgatgctgttcctgaggggcc

SEQ ID NO: 5290 - DNA, 293 bp, Sorghum bicolor
  Clone ID: SORBI-28MAY03-CLUS114853_1
ctccactctccactccgagccgcgcctgacaacaacccgcgcgcggccgccggccgcagcccacctcggcatctccacgcatttttattttcatcaatcaatcagggagctgcccgcgccccgccgcgccgtcggccccgtaaatccatagcgcgagcgtcccgtcctcccccaccccccaacgatgcgccgctgccggcgctcgtgatccatggcctcactccccgttcctcgcacgctcccgcgggcctcgccaacggtggtgggcgccgcgagggggaggagggggaggg

SEQ ID NO: 5291 - DNA, 836 bp, Sorghum bicolor
  Clone ID: SORBI-28MAY03-CLUS11497_1
gcacgaggagcaaacggacaaaagaccccgccgccccgcgctttctccagttccttctttcccctcaaaccccctacgccgggaccggagagaagggggggagccagagccagacctggcggcgctcggcatccaaaaacgacgcctaaagatccctccctctcttgtggcgtccatcgacctgaccgcggcggcgcgtgctgcttctttccgctctccaccgtcatgaagagtcagggaaacttgcatgtttgatgtacccagctgctttctgtaacaaaaactcttgcgatcaaatttgttgaatttactcactatcagggaggaatctattttgtcagttgtcggtattaaggctgctgaacgatatctgcagaataaatgggagaagcacactcggatgaattttgccactgccaagggtgtgctggcaagtatacactgctcagagatgaagaaaacccacggttggcaatctttgagaggcggcttccttgctgtggttgtgggataggatggtcttcttttcttttaggtttcttgtgtcctttgatttggtactttgcagccactctttactgctgcaagtactacaacaaggatcctcgagagcgccctggtctagctgcatcagctgttgcggcactcatcttcacagtcctggcaaccatcgctctctctgtggcactgataatctgtgtatacaagtagtacccaaagcgacgaggaaaacgcggtagctggacctggcattcagaaggaacttgtaatttcagtgatagtagcatgtctttgcagtcatccttaatgtatcactatagcaagttgtggattta

SEQ ID NO: 5292 - DNA, 906 bp, Sorghum bicolor
  Clone ID: SORBI-28MAY03-CLUS114834_1
ccgcctcctcagccagcgtacggcgctcctcccgtcgccgccaccgccgccgcatacggcgctcctcctgtcgctgccaccgccgggtacggaaccgccgccgttggtgccgacggcaagaagaagaacaagatggggatggggacgggactggcggtgggcgcggcggcgggtgtgctcggagggctggcgctggccggcggggccagctacctggaggacaagttcgaggagcgcgtgtcggagcgggtggaggagaacctggagagggaggactcgtacggcggcggctatggggcacgaggcgacgacttcggcggcgacgacgactactgatcggactacctgatggatcctccaatcatttggccagctgctgcgccttgtcgatcatctacccttcttcaccttcgtcttggtgttctaaatatattttctttatgatgaactgcaaattagatcatgttctattctatttctatctccctccatcggttgctgttgagattgagacttgagatcctcatctgaggagttgagaaatgccgagttaattaatcccatcgctatgtgtattttattggattggatcatacatcgagctaagtttcggttgattcacggatagatagattgctagctgcggagtagagtatcgatctgcgttgatcggcaacaacgggccgggatctcttcctcggccgccattgactgctctaccctcctctcatcgctgcgtaatggcttgtgtaccgaagacgacgaccaggcgttcaggccagagtgacagtgatgactcgatgggagccaccagtccattttcattgcttccgattggatggagtaagcggcgagatgccgtgccgtgacctctattcggcatatgattttcccagtcggattgta

SEQ ID NO: 5293 - DNA, 641 bp, Sorghum bicolor
  Clone ID: SORBI-28MAY03-CLUS116383_1
ccaacatggcctacctgagagctgtgataaaggagtcgctccggctacgcgccgtggcgccgctgctggcgccgcacctctccatggcccgctgcaccatcgacgggctcgccgcggtcccggccggcgtgcgcgtgctcatcaacgcctgggccatcgccagggacgcgcgcttctgggggcaggacgcggaggagttcgtcccggagcggttcctcgacggcggcagcgcggcggacgtgggcttcaggggcaccgacttccagttcctgccgttcagcgccgggcgcaggcagtgccccgggatcaacttcgccatggccgccgtcgaggtgatgctggcgaacctcgtgcgccgcttcgactgggagatgccggcgggcaaggcggcgcgcgacatcgacatgtccgaggtgttcgggctggtgctgcaccggaaggagaagctcctcctagtcccgaaactgtgcgcgtaggataggaggcgtacgtagctccgtactgcgttggtagtgatactgatacgacaggaaataaacacatgggtggagtatagcatttctgaattccatatatggtgttttaatttgtgccccatggccacacacgcatacaacagtatatatagtttacattttccc

SEQ ID NO: 5294 - DNA, 501 bp, Sorghum bicolor
  Clone ID: SORBI-28MAY03-CLUS116386_1
gcacgaggcccccccgcacgcacacgcacacgcccaaacgctgcccacgagcacggccgtcagaggggaaacccagcagctttgtttggttgccctgccggccgtcagagggaaacccagctctaactgaagtggcggctagctacatactgctagctagctcgtcttctggtcctgaccgcacgccatggctcaggaggacgtccaccacctggacgatgccggcctggcgctgggcctgtccctcggcggaggcggcgcctccgatgcggtgcgccacggtaccagcagcagccggctgagcatggaggcggtggcgcggctgccgtcgccgcggccgcagctggagccgtcgctgacgctgagcatgccggacgaagcgaccgccaccgcgaccgggtccggcggcggcggcggcggggccgcgcacagcgtgtcgtcgctgtcagtggcgggcgtgaagagggagcgcgtggacgacgccgagggcgaacgggcgtc

SEQ ID NO: 5295 - DNA, 1296 bp, Sorghum bicolor
  Clone ID: SORBI-28MAY03-CLUS11648_1
gcgagaatcactccacaacttcttccgcttcaccttcaactcatcatcaatccggacaaattccaaggagctcgcgggggcgattcacgacggaaccctatccctaccgcctccgcactctcatggcggcgacagccgtggcagcaagtcggaagaagcgagggacggccgccgccttcctcgatgaccccttctcgttccccgccgccgacctgccgctcctgcagaccaagcgcggccggtgctcgtcgtcgattgtcgccgcggacctcggcctcagcttcccacttgagttcgaccccgtcgaggcgctccatctcatcttccccggcgaggatccgcaggtcctacaaaactatttacaagcgtcaggaaatgtcctggatgctgcaatcagggcatacaaagattatttggcagaaagaagcacagaatctgcttctgccataaaccatgttccatctgacaacgaggaaggcgatagcatcctatctgaatctgatgctgacctgacagtggaaaccatccccaccaattgctctggatgggcagagctcattgtcaaggagatgtcctctgcttcggatttgactgatgccaagaatcgcgccttcaagatactcaacctgttggaaaaatctgctgccaggagtagccccgatgaaaagagcaaagtgaacaaggagcacaagatagtgaagcagatgctgggatccctgcttcaccagaacggcgttctgaagcgcgcattcctcatacagcacaaccgactcaaggagtatcaagagatggtgcaggagcgatctcagttcaaccagattctcgagaagtaccagaagcagatcaaggcgttagaggagaagaacaatgccttgtcgtttcatcttcaaaatgcgaaccaatgcagaaacacctattggcatcgcaatcctgatgtcttctaatcgatacggttgtcagaaaggacatgtcctctaatcactacatactgctgctacagcctacgggtcaagcaccaggttaatccacaagatcctgaaactgctctctcttccagctaaggaggaagatgatcaaaggacatgtccatgtagtgttgcagtcagcttatgttagtctggattgtctgtagagggagataatcaaagaaaggacatgttcatgtgttctattgcaatcagtttgtgttagattatagttgctctagatgcaagtgagcgaaatttgacgagagttcaaatattcatgtaccatttgttttcaattatcgatcgaactgagactttccccatcaaa

SEQ ID NO: 5296 - DNA, 547 bp, Sorghum bicolor
  Clone ID: SORBI-28MAY03-CLUS116500_1
gcacgaggttgagaagatgctcctcgacaggctcctgatatttgtcagactggagagcatgatggatggctactctgactccgaggacttcaccattatggagcagaaggccgagagatccagcagatcacttcagctgatcgagaaggctgggggcaacacactgagctccatcggtgacctgagctactcatcacaggactccatcgttccagccaagtcgcccctgacagggaacagcctgacaaggtactcaagccagacattcggcgacgagctggagttcctgaaccggtgcaaggacgcaggcgtcgtgcacatccttgggaacacggtcgtgcaggcgcgcagggactcggggttcgtgaagaaggttgctgtgaattatgtgtatgccttccttaggaagctgtgcagagagaacagtgtgatcttcaatgtcccacatgaaagcctcctgaatgtagggcagatatactatatatgaacatttttgtttcattcttttgttcggttttgaagtgagagcagttatgacctgctgctg

SEQ ID NO: 5297 - DNA, 450 bp, Sorghum bicolor
  Clone ID: SORBI-28MAY03-CLUS116533_1
tggcacgaggggaagaagcgggttcgccgcctcaagcgcaagagaagaaagatgagggccagatccaaataaacacctcgcacctcaacctgacttgactcatctcgcatgatgttacgacttcacacgcacaacgatactctggccgaagatgcgaacgctactatggcgcctctgggatgtcccgcaacgttacgagctgggatttgactttgggagctacgtcactgtggtggaaccccgcacttgagcggctgttgggcacgcaatgaacattacggggatggggattatgacaattggacggtcaggaaccaggcggtgttagtattaaagaccatcagtcatgctcgcaaaagacgatgcaaccagaacttgaatggcagttctaagacaaagaaatacagagtattcctctgaaaaaaaaaaaaaaaaaaaaaaaaaaaaaaa

SEQ ID NO: 5298 - DNA, 1004 bp, Sorghum bicolor
  Clone ID: SORBI-28MAY03-CLUS115222_1
gcacgaggctctcttctccccttcttcgcttggcggtggtggtgcggtggggatgcggcagctatggcggtggtaccagcagtgcctggccacgcacccggtgcgcacgcaggtcgtcagctccggcatcctctggggcctcggcgacatcggcgcccaggccgtcacccactactccgcccgccccgaccgccgcagcagccctcctgaggataaagataataaagacaataaagagtttaaagttgattggaagagggtgggcgtcacaagctccttcggatttgcttttgttggtccagttggacattactggtatgaatacctggaccgcttcatccggcggagatttcagcctaatacgttcaaatttgttgcctcaaaagttgccgcagatggtttcctctttggaccattagacctcctcctgttcttctcatatgttggtcttggtcaaggaaggagcgtagagcaggtgaaggaagatgtgaaaagagacttcattccggctctggtgttaggtggaaccatctggcctgctgtgcaaatcgcaaacttccgcttcatccccgtgcggtatcagctcctgtatgtgaacttgttctgcctcttggacagttgcttcttgtcatggattgagcagcagggagacgcttcctggaagcagtggttcacatcgttccagaaaatcgaagaccagaagagtaaggtttgatttggctactttgagtcatgtgtggttcgttgtctggatcaatacctctaaactctggttgatccaggaagataatggtaaaaaggagaagtatttggcagcagctgttaaagcgaaattgtgatcccagcaaagctaaacattgatggcgttgtagagaattctttttaatctttgacaggaggaaacggttgctgaattgctctgttaattcgagtgatgtgttaactttcgtgtggagtgtatgttgatctcgaattgatctcaaattgggtaagctgaagatgct

SEQ ID NO: 5299 - DNA, 571 bp, Sorghum bicolor
  Clone ID: SORBI-28MAY03-CLUS115279_1
gcacgggtcagccaagcaaggcaaggcgcagcagcaacaacaggggagcttgcttacctggtccccaatccccattcccatctcctcccggccgcctgcctcttcccttcttccttcaacaatccttcaccaactccatcccgtgatccatggcggcggccaagtccatcgaccggctgccggcgcgcctggtggttccggccgagccgacgccagccggcccgctccacctctcctggctcgaccggtaccccacgcagatggcgctcatcgagtcgctgcacgtcttcaaggcggcccccgccaccgctaccggcggcattgacggcggcgccgccgccagcccggccaggaccatcgagcgcgcgctggcccgcgcattggtccactactaccctctcgcgggccgcctggtcctgtcggagtccggcgcgcagcaggcggtggactgcagcaacgccggcgtgtggttcacggaggccgaggccgcctgcaccctcgaggacgtggactacctggaggccccgctgatgatccccaaggacgacctcctcccgcccacccccgccgc

SEQ ID NO: 5300 - DNA, 956 bp, Sorghum bicolor
  Clone ID: SORBI-28MAY03-CLUS1152_1
atctactccatcaaacttcattttttagaagttttttgtcattggacatgaacacatagcaaaatgactgcttgaactggtgaaaacatattttattctggccatgcttaaatctggtgtcatggatataggcctaacattaccaaggagctaggccagagtttttttcttttcttttttaatttcatttttttctataatctggcgtgcagtatgtaagtgtgttatttacaatagctggttttcaaattttcattctactgcatgcactttaaaatgctttgcttttggcttatgttatatgtctgcaattaaactatagaaatggcaaagaaacttcctaaggaagtggtgatagatttgcttgcaaaactggaagtggggtcagcctgtagcttatgtgatgacacacctgaggatgctattgtgacaatttgtggtcatgttttctgctatcaatgtatacatgaacgaataacgactgatgagactatgtgccctgcccctaattgcagtagaacattaggttttgagttgttattttcgtcaggagctttaaagatttccatctctggcgaatccagttctgcaggagctagttcatctgcagataacgagtcatcttcaatcagtcaaatcagctttgtctcattcaagatacaagcagccattgatatactgaattcaatcattaacttgaatgcccttactgaaagtgatacaatggaataaaaccgaagtggagtagcccctgtgaaagccattgtctttttccagtggactggcatgttggatttgctggagaattcactgaataccaatcttatacagtacaggagactagatggaacaatgtctctcaatttaagagataaggctgtgaaggattttaacactgacccagaggttagagttatgattatgtcactgaaagctggtaatcttggtctcaacat

SEQ ID NO: 5301 - DNA, 560 bp, Sorghum bicolor
  Clone ID: SORBI-28MAY03-CLUS115395_1
gcacgaggctgaccgtacgtcgtcggcgacgaagcatcgatccggccggccggagaggttcatcattacacagctggatcggaggagctagctagtaggaagcagagcaggcatggatcagctggtcaccatggcgatggccgctcagccggcgagccccacctcgccgcacgtcgcgcacaagatccccgccggcgacgggccttacgctagggccaagcacttccagctggtggagaaggacctggacgcgtcgatcgcgtggttctggaaggcgatcagcacgggcgacaaggtggacagcgcgctcaaggacatggcggtggtgatgaagcagcgcgggtacctgacggaggccatcgacgccatccggtcgctccggcacctctgccccaagcagtcccaggagtcgctggacaacatcctcctggacctctacaaggccagtggccggaccaaggaggagatcgagctgctcaagcagaagctccgcaagatctacctcggcgaggcgttccatggcaagaccaccaagcgcgcccgctcgcacggccgcaaga

SEQ ID NO: 5302 - DNA, 491 bp, Sorghum bicolor
  Clone ID: SORBI-28MAY03-CLUS115448_1
gcacgaggcactgttgcatgcctgcctgccgatctgtctttgcatctacctgagcctaacatgcatctgattgattgattgattgattgattctgctgcctgccttgtcttcagcttgagctgctgctgagctcatccagcttgtgttgcccacttgcagtatagtagcatgcagcagcagcttgaattgaattgcatcgattcagcttcacttgttgccttgttatcgatcagcatcctcttcatctcatctcatcagattcagatgctatttatcttctcatcagcaacatgatttgatttgttcacgcagcaagacaagaaggcgttgacagatgatggatcgacatatggaggactccagcacgttcctacagtgggcaatgaaccatctccagcaccaccagcacccggccaccgccgccgccgccgccgcataccagcaggaaggtggcgctggtgttggtgcccgcatcagcggcggcgccgga

SEQ ID NO: 5303 - DNA, 460 bp, Sorghum bicolor
  Clone ID: SORBI-28MAY03-CLUS117397_1
ctgcgctcgctgctctggtcggcggacggcaccgtggcgaccggtcggaccggaccgccgttcgccggatcatccctgttttctcttgcgtgcttctctcgtcatcttgtggcgacgactgggcgactgccgacggccgctgcttgctggagacgagcacccaacagatcgttaaggagaaccagaagcttcacaaagtcaatattgagattgaagatgagatttcagaacagaagggcgaaatactgcaggtcgaggaaggctttagagggactcttttgacatcaagtgtttcaccacagctttgttaggatacctgattgcttctgagggtatactgaatcatgtcggttctaggagcccgggtgttttttttttttttggtctatccttctctcgatgctgtcacacttaaggatgtcagatgtatcctcgcttgagtgagggaaacagaagaagg

SEQ ID NO: 5304 - DNA, 591 bp, Sorghum bicolor
  Clone ID: SORBI-28MAY03-CLUS117414_1
gcacgaggatttgtttcgctctttgcatcatatcatcaggacagctctgtatttaatgacatgaagtacttacagtctcctggaactacagatgatgcaaaacctattactcatctacttgctattgatctttcatcaaaagttggaacaaaattgctttctgaggccatacgttacctgatggatggatctgatagagctcgtgttggtctgctactttatgtccacactggtggttcatcacctattttacttctgaaagatatcttcgatagaactatttattctttcagctataaagaaaaggtattggtcttcctgcatggactcttgaaattttatgaagcccaacctttgcctgcctcatctgttgctgacgattggactagaaatatgatggaaaaggtctataccttacctgctgaaactgctttgcctgttgatgactacaaagcatggttcaaaagtttctctgctgatacaggtctcaaagggattgataagttatctgacttcttatttgggcaattggggcttgtgtttggtagaaatgctgtgatcaccaatggacgggtttttattatgaatgaa

SEQ ID NO: 5305 - DNA, 552 bp, Sorghum bicolor
  Clone ID: SORBI-28MAY03-CLUS117406_1
gcacgagggtgctcgggagcatcctggagcggcgcctccagaaggacagggagagcggcaagcccggcaggtccgtcgtccggatccgcggcgtcaccgacgacgccgcggccgccttcgtccgcctcctctacgccggcaggtgcggcgacggcggcgaggaggaggaggaggatgacgccatggagaagcacgcggtgcaggtgctggtgctggcgcacgcgtaccaggtgccgtggctgaagcgtgcgtgcgagggcgccatcggcgcgcgcctcaccgcggactcggtggtggacgtgctgcagctggccgacctctgcgacgcgccgcgcctgcacctccgctgcaccaggctgctggccaaggagttcgccgccgtcgagcgcaccgaggcctggcgcttcctgcaggagaacgacccctggcaggagctccacgtgctgcagcgcctgcacgaggccgacatgcggcggcgcaagtggcggcggaagcgcgcggagcagcgcgtgtacgtggagctgagcgaggccatggactgccttgaccaca

SEQ ID NO: 5306 - DNA, 624 bp, Sorghum bicolor
  Clone ID: SORBI-28MAY03-CLUS117605_1
ccgccgatgtcaatccctgcacacacttagcataacaagatgagtcaccgatattagtcttttttcagggtcctccgcacgcaggctccctgggtgaaggatatcctccgacgcttcaggggtcggaggttcctcgggtgaagggcatccttagacgccaccagggggaaggatgcggccattccacaacaatcactaaaaattttaaaagcaaaatagctagcaaaggactaaaccataaaatgttttgtctttgtaagattgttgaaataaagatcctctaaggccagtttcaatggacagtgtcattgcacggttttacatagcaacacgtcatcgaaattgaaatgaaaccatctatgaaattgaaaagatggttatatttaggtcatgggtgactttgtgatatttctagtttaaagaacttgtaaattactttagttttgtagaaaaagtttatgtggatgttatatagattggtaggagctaatttgatgaaagatggatatttattttaaaaaaattaatagtctagtttaatcttttgaaggttcataattaatttattttaaattcaaaaatggagcttgctatatttttgttttacaaatattatccatccat

SEQ ID NO: 5307 - DNA, 546 bp, Sorghum bicolor
  Clone ID: SORBI-28MAY03-CLUS11775_1
gcacgagggcaacacaacgctggatacaaacacaaggcgaatgttcgaacctactatcagcaatttgaggagcagcaaactcaaagtttaattgatcaaagaatcaaggagcatcttggacaagctgcagctttccaggcaggtgcccctttcaaccaacatatgctcacattcccaggagctgtggcccgtcctcgtcttccaattctgccaacccctggcatgcctcatggattccctcaagcacctggtgccccattgatgccaggagttagacctccgattttaccagctccaggtgttccaggttatcctggtggtccaccaaccatgctgcaaccaggcgccccacctggctccatgccacaaccaggcgccccacctggctccatgccacaaccgggcgctccacctggttctatgccgttcctcatggccccactcccaaggcctccaacactaccacctccaacatctggagtcccaggtgcccccattcctaacagtgcagcacctccagccatttaccaagcgaatccaccagca

SEQ ID NO: 5308 - DNA, 702 bp, Sorghum bicolor
  Clone ID: SORBI-28MAY03-CLUS115982_1
gcacgaggcccgtctccggcagcgcacggctcaggcaccttccgtctctcaggaggaccttctcgttgtacgaccagatcaacctcatcgacagcgtccccgaagacgagctccgattccagtcgtatgatgatactggattcaaaattaacaatgtaaaatatgaaggcagcttattgattgtagagaacaagataatgacatgggcacccaaaacattctcagagatgcccgcggaaagcttatcaatcttcaaagttgtgcaccctatcccagagatcttgattcttggttgtggaagacacatccagctggtcagccctgaactgcgaaagttcattcggtcaactggaatgaaactagaagctgttgattcaaggaatgcggcttcaacatataatatcctgaacgaggagggcaggccggtggcagctgcagttcttccctttggagtcacatgctaatgtttttattatcaccttttataccagttgggcaggcgttttctctttcgaatcgatgatagccaactgagctgaattgtcagtatccgtctcaaccatcgacaatgctgttttggtgtctaggaaggaaagggccacctaggttttgtagcatattgtcctctttgtaatcgcgggctaacagaagattcacgcagtgtacactacaccgaaataagagtgagtggtggttcctgtc

SEQ ID NO: 5309 - DNA, 805 bp, Sorghum bicolor
  Clone ID: SORBI-28MAY03-CLUS1161_1
ctactggactcatcaggtcattactattgcttcgttcgtacatccagcgggatgtggcacaatcttgatgataacaaggtgcgccaagttcgtgaggcagacgtattgaagcaaaaggcttatatgttattttatgtacgtaacagtattggaaagtcagtggcccacaaagagaacatcactgctaatttgcccatgaagaaaacccctgaaaagatctcaagtctgaatggtattacccaaagcagtgtaaaagcacaacggacgcgtggggtgtctcggtttggcgataaggcgcacaacacaatcattggctactctacaattttcagcaagactacaacaggccattgttcaaagaatgaggtcaaagctgaagatgctccagcctctcaaaacaatgccctgccttccagacaagcccctggaactcaaaatgatggtggtaccttgcgaactaaaccgatgcagtttgatgtaaatagtcaggagacagcttcctcccaccaacctgcaccatttacaaatacttgtggtgaacaaacagttgttgggaagccctcgcaggagatggaacctaaggctggtgcggggaaagatacttctgttgtctctgccattgctaatggtgccgctacattgtccaaggcagacaaactgacttctcagcctcaaacaactccattttccgaggtagctccccatgtaaatggcacagctgcagagtttgctgcacggctttatcaaagaaggattctgttgtttcaaatggtgttggcctggcattgatgtctacttcagtgag

SEQ ID NO: 5310 - DNA, 926 bp, Sorghum bicolor
  Clone ID: SORBI-28MAY03-CLUS1162_1
gcacgaggcattcaagagaaacaaccaagagcccgcactctcactgtgactccgtgagcacactctccgcaccgcgtccgcccacgcgtccgggctcgcccgggtagtagtgccgctgctcccctcctcctgctgctcgccgccgcggcggcgtcgatcctggcagcggcagccgcgtcgccggcgccgagcgacttcgtccgcaagtcgtgccgcgcgacgcagtacccgtcggtgtgcgagcagagcctggcgtcgtacgggggctccccggcgccgcggagcccgcgggagctggcgcgcgccgcgctgtcggtgagcgcggaccgcgcgcgcgccgcgtcggcctacgtgggccgcctgtgcggcggctccagcagctccgccggccacaagaagggcgctgctgcgaggaaagggcggcgcgcccgggtcggcggcgggacccgtgcgcgactgcctggagagcctggcggacagcgtgggacacctccgcgacgcggcgcaggagatgggcggcgccgggatgtcccgctccgggacgcccgcgttcaagtggcacctcagcaacgtccagacctggtgcagcgccgcgctcaccgacgagaacacctgcctcgacggcctctcctcccgcggcgtcgacgccggcacgcgcgccgccatccgcggcaaggtcgtcgacgtcgcgcaggtcaccagcaacgccctcgcactcgtcaacaaggtcgggccagggtactagcccaggcccaggcccagcccaaatagccctcgctacttagtccatacacgtattatacttcggtgcgtcggttaagtacgtagaccagttttccacgtgttgcttctgcttatgattcctcgtgtttgtaagatgtcgttaagggcgacaatgataaagcttgtaatattatggacttatg

SEQ ID NO: 5311 - DNA, 755 bp, Sorghum bicolor
  unsure (1)..(755): unsure at all n locations
  Clone ID: SORBI-28MAY03-CLUS116284_1
ccgccgtccatgcgcccaaatccgtctccctctctcctcccgccactcgctccggccactgtaccttccgcgccaacgccatagaaaccgctcccgaacctcctggaagcccccgctggccgccccgcctagcgcgcatagcgcgcgtgggattgtagccgccgccgggcccgagcgcgtcgactgcggtgacgctcgcgatccggtcatccaaggccccaagctgcgaagggactggcaaccggcggtgagaagcgaagcggcgaacgtagagcttctccaggtgtgtctcgtcttgcactcgccctactctcgcacacgggactgctggtaggattacaccatcgtcggagaagcccaattagatgcacagaagccgcataacgtaggatccgtctcctccctccaggtcttaccactgttacaaaatccttatgcgtgcttgctgcaaattgggtttcgttggtcagtttgagtaacatccatgttattaattgcactttgttgctgggaattgtggaagcggaagaatggtgtgatcttcagaggggaagaagcaaacctcagggcaaacaatggtggcttgcaaaactgatgcaaggctatgggcacatcgtttgccgaagcgggacaagaacataggagaagattgtatttttgcttcgagctatgtaactacagatcatgtaaaacaatgtaaccttcacaagtactgatgggttntgtttgaactagatcaatgaatgaatgnactg

SEQ ID NO: 5312 - DNA, 735 bp, Sorghum bicolor
  unsure (1)..(735): unsure at all n locations
  Clone ID: SORBI-28MAY03-CLUS116313_1
cgcgntgggacagcccagcctcacagacatgcccctcgcgaggaaggtgtcgctcaagaggttcctcgtcaagaggaagaacaggctctccgcggcggatccatacccggcggcggcaagtgagtcgtcgaccaagcagcctcctcctgttaaggaggagggcgcgccgtggctcggcgtgagctccgcgctcagcctcagctgaagaatctgatggaggacagcaagacacctcctccatgggggactacaaattactccagtaattgctactgcgtactactagtatttttttttcaggccgtaaaaatatgtacgtgtttcaacccttgacatttacaccagttactggttgcttcaggggaattagctagccagctaattagtgtattatgattggttaattagttgtctgtttgagaattctttggcgacaaaagaattctttccttcctcgatgatattcatctgcaaggatatgacctaattaattaaatctagatgatcgatttcatacatatacagtgtgtaaattcggctaagctgatggaacgccttggttccgctggctgcgcttcctctcctgctgggggcatcgctgctgctgctgctagccccttgcgacggcagggagctgaaagcgagcggtgcggcggcatcgggcggtgccgccaacggtggtagtagcaacggcagcgaggaaaaggccacggggttgccgctgatcccgccgct

SEQ ID NO: 5313 - DNA, 423 bp, Sorghum bicolor
  unsure (1)..(423): unsure at all n locations
  Clone ID: SORBI-28MAY03-CLUS118313_1
ttctgctgcctaggcacgcctccaagctgagccatctccttcagtcatcgccatgctggccacccntaacacacacacacactccgcccccctccgccactcctccctctgggaacgcgtcgccgccgctgaacacacagctccaaccaagcgcgagcgcacctcacaagcacgtgccgccacccttgagcgtgctaccgccaacaaacgagaggccaaggtcactgctgcggagcggctcacggccaaggaatacgatcgtgcggacgctgcatgggctgatcccacacgtgcgccccacccagccctagacctcgctccgcactccctccacgacacgctgcttctccatgaagccacggtccttgtcaacctccactcgcaggccgtcggtgtccaaaacatccgcactcttgtgcccat

SEQ ID NO: 5314 - DNA, 410 bp, Sorghum bicolor
  Clone ID: SORBI-28MAY03-CLUS118364_1
ggacaacctcgagtgggatggggaagaggctggccaccacccttcccagtacaagcccacctattcatcagcctactacaagaagaaccagctccgagcctctgtgctcaggtagtaatcccctttatggaatggcttggaatggttcatcatgaacaggagaagatcgagatatgctatgcttggattgctctgcttccgtcgagtcttcaacaactctgttctatttgcttgtgtgtgtgtgtgtgtgggcttcgtttgctagtcagacaacttgcctgatcaatggtaggcactcctctgctgctttttcttgatatttcgtgtggcagagatgctgggtttaatttcgtgtgtgtaatcggtatctgcactgcttccgatcctttgcatggatcctgtttggtttt

SEQ ID NO: 5315 - DNA, 636 bp, Sorghum bicolor
  unsure (1)..(636): unsure at all n locations
  Clone ID: SORBI-28MAY03-CLUS118686_1
tcgccgtcctcaaggtgctcgagaaggagaagctccaggagaacgccttcgtcgtcggctcctacctcaaggatcgccttcgtggtctccaggagaagcacgacatcatcggcgacgtgaggggaacaggtttcatgctcggtgtcgagctcgtcaccgaccggcagctcaagacaccggcgaaagatgagatctgccatgccatggaacatatgaaagatatgggagtcttggtcggcaaaggcgggttttatgggaacgtcttcaggatcactccccctctatgcttcaccaaggaagatgcagatttcttcgttgaagtgatggacattgccctgtcgaagctctgagctgagaccccagacggaggggcggtacggtgtacagatggaaggaatccttgctgaagtttcagctgcatcagagttctatgatctcaacccaagagaagggggaaaaaaacttgcagctcgtaactccagtccatgataaatgaaccaagcagaccgagttggcttatcgatcgctactcttctagcttcagcttttatctggagatgacctgatatgcttgccatgtaacgtgccggatataatgactggggtgtggggtnccagttaaccttatatttaagt

SEQ ID NO: 5316 - DNA, 704 bp, Sorghum bicolor
  Clone ID: SORBI-28MAY03-CLUS118761_1
gcacgaggggcccttgggcgccgaaacgaaccctccctctccccgttaacccgcgtcgccttgaaccctaacctcctggtggaggatccgccgaacggccggaccacttaaccctctttgcgcggcgccgtggagtagaggaggatggagtcggaggtggtgaggacggagatggtgctggcgccgacgctgccgttcaagaagatgcagacagcggacaagtatcccaaaggccagtcccggggccgccagtggaagcacctgcgccacctgctccagtccgctgacgcatcctccatgccaccggaccgccccaattatatgaatatccaatcgcccccatccatttacccaccaaagagatactgtgacttaacaggttttgaggcgccatatgtggatcctaggacaaagttgcgctatgctgatccagaggtgttcaagcagatcaggatgcttcctgatgaatacgtccaaaggtacctggccttgagaaatgcagcagttatcctgcgataacaatacctgcttagggataacagtcttgttgcctaaccatgctgcagtactcagatgtatactctgattgtatggatgatccttttaaacagatctttcttcctcttgtatattgatggattcgtctatacgtgattagagacattatgctgtatattttatgtgctaacatttgcgaattgatg

SEQ ID NO: 5317 - DNA, 862 bp, Sorghum bicolor
  Clone ID: SORBI-28MAY03-CLUS118774_1
cgaagccagacaaggccgagaagaaggaggggggcaaggacgggaaggcggaggcgaagaaggtgaagttcgacctcgatggcggtgctcccgcgccggcgtcggacgcgaagcccggcaaggcgatggtgatgccgcccggcatgaccaaggccgacctcggcccgctgctggagaagatgatggcggccaaggccgggtccgagccgccgcgcggcgagccgatcgcgccgccgccgatgatggcgccgggcgccgcgcagggcgtggccgtgccgtccatctggcccgcgcccgccgggtccgtctccggctacggctacaacccaggctacgactacagcgctggcgctggcgggtacggctacggctacggctgcggctgcggcgggtacaacggctactgccggtgcggcaagccggccgcgcccggcggctactacggcgtccccgtgtacgacagccaggggtggtactacggcggcggcggcggcgcccggcagccgtactacccccagcagcagcagcagcactactgcgaggaccccaatgccgggtgcagcgtcatgtgatggcgatgcccgtcgtcagcccgtggacggatggagagacagaagcaatcagtgtgtggtcacacacactaccatggtcagtgccgccgtgctgccttgccggggcgagagaaaaaaaaactcttcttttttttcttttccgtgtgtccccttgttcttgtttatgcctgtggattttgttaatttatttagggagttgagttgtgcatgtgaacagtgatggagctgcgtgcgacgcttatatggtgactagttgtgtatgtgataaagtataataagaatacagtact

SEQ ID NO: 5318 - DNA, 1156 bp, Sorghum bicolor
  Clone ID: SORBI-28MAY03-CLUS11905_1
gcacgaggcaccggccgcatacttctcggagaccgacgatgataagcttcgtgctggtgcgtcgttgttgtgcagcgacgaccaagaatggtcactagtcaaggagtcgtacatggaaatgaccgagcgcatcgactctgcggtcatgctggccaaggttcctgaagaaatcaaagcaatgcataggggattttacgagtgggattcttcagaagttacctcgctaaatcaccagccgattgttcaggttttgattgatgggaaggatcggagcgtagttgacaacggaggaagcatgctacccacattggtgtacatggcgcgcgagaagaggcctcactatcaccataacttcaaggctggggcgatgaacgctctgataagggtgtcatcggtgataagcaacagccctatcatcctgaacgtggactgcgatgtctactccaacaacagcccttcgggcagagatgcgctgtgcttcttcctggatgaagaaatgggccacaaggtcgcgtttgtgcagtaccctcagaactacaccaacttgaccaagaacgacatatatggtaactccctcaatgtcatcaacgaggtggagctgagcggtctggacacttggggcggcccattgtacattgaaaacactggcttccatagaagggagaccctatgcggcaggaggttcaccaaagactacaaggaagactgggacagaggaatcaagacagagcacagctgcatagaaaagactgaagagaaagcaaagtcattagcaacttgcacttacgaacataacacgcagtggggagatgagatgggactgaaatatggctgcccagtggaagatgttatcaccggactggcgatacattgtagaggatgggagtcggtctatagcaatctcccaagatctggatttatcggtgtagggccaacaacacttgctcagacaatactgcaacacaagcgatggagcgagggtaatttcagtatttttctttcaaagttctgccccttcttgtatgggcatggaaaaaccaagttaccccatcaaatgggatactcaatctatggtttatgggcacccaactcactgcctacactgtattatgttgtcatcccttcactatcccttctcaagggcatccccttgtcc

SEQ ID NO: 5319 - DNA, 500 bp, Sorghum bicolor
  Clone ID: SORBI-28MAY03-CLUS117264_1
gccccacgtagaaacgtctgctgcattccatatagatagccgactagtacgtctggtacttgcaactagctaatcatggcgtcctacattggcaacaaaaccatgatcacattcacagcggcagccctgatgattcttgctgtgatgaccatggtggtcgaggctcgagacctgtccacctccacaggtggctatggcgaggaggccatgaaagtgaggcaccagcaatggatggcggagcatggccgcacctacaaggacgaggccgagaaggcgcgccggttccaggtattcaaggcgaacgccgattttgttgacaggtccaatgccgcaggaggcaagagctatgagctggcgatcaacgagttcgctgacatgaccaacgacgagttcgtggccatgtacactgggctcaaaccagtgccggcagggccgaagaagatggccggttttaagtacgagaaccttactctttcagacgtcgaccagcaggcggttga

SEQ ID NO: 5320 - DNA, 624 bp, Sorghum bicolor
  Clone ID: SORBI-28MAY03-CLUS117201_1
gcacgagggtcgtctccttcctctggctcaggcgtgcagttttgggccgtcgaggcggcggtccgcggctgctaccgtcgccatgggcgctcccagtgatcgggcacctgcaccacctcgcgggcgcgctcccgcaccgcgccatgcgtgacctggcggcgcgccacggccccgtgatgctgctccgcctcggcgggctccccgtcgtggtggcctcctccgcgggcgccgcgcgcgaggtgatgaaggcgagggacatcgaattcgcgacgcgccccgtgacgcggatggcccggctggtcatccccgagggcgcggaggggatcgtcttcgcgccctacggcgacgggtggaggcagacccgcaagatctgcaccgtcgagctcctcagcgcccggcgcgtccagtccttccgccccgtccgcgaggacgaggccaggcggctcctccataccgtggcgtcggcgccgcgcccgcgggcggtgaacctgagcgagctgctggccgtgtacgccgccgactcctcggtgcgcgccataatcgggagccggatcaaggaccgggacacgttcctggccttgctggagcgcgggctcaagctgttcggcagcatgagcttgccgg

SEQ ID NO: 5321 - DNA, 284 bp, Sorghum bicolor
  Clone ID: SORBI-28MAY03-CLUS117301_1
cggacgaggacgaggacgagcacgacctccacctcccgcaaccctccgaaagctaaagcggaagccgaccactatagcacgaggcccaattatattcatccatccacaagaacaaaagagaggtccgaaccgaaccaaaccaagctagaagaagaagaagaagaagaagagaagagaatacaagagacgcagcggcatatactcgtccactgaaaccagaccagaccaaccctgcaaagcccacagcagagggggaaacagcagagagttgcaacaaaaagttc

SEQ ID NO: 5322 - DNA, 564 bp, Sorghum bicolor
  Clone ID: SORBI-28MAY03-CLUS117307_1
gcacgagggtcactcttttcggctttcagcctaccacactcttttttatacttaataattttaggttgctttacagcttcttattatccaaccccgtctatcctttttcttcgatacaattactatataccgtaattcctaaatccagccttcaagatgcagttcaccatctccgccgctgcccttatggccttcgccgccaaggccctcgcccaggtcgccgacttcgaccccgttctcactcccaccaactgggaggaggtgtccgctggcaagaccctcgagatcacctggcaggccaagcccaagtactccggcgagaagatctccatctctctgatcggtggtgctacccagaacacccaggtccccatcaagaccattgccactggcattgacaacgacgctgcttcctacagctgggccattgactccaccctcggaaccgagaacgtctacggtctcgtcctcaagctcgagagcaaccccgaggttttccagtactctttccccttcaagatcgagggtgccaagaagcccgaggacaagccctctcagaccaag

SEQ ID NO: 5323 - DNA, 793 bp, Sorghum bicolor
  Clone ID: SORBI-28MAY03-CLUS11693_1
gcacgaggctgctctcagccgtcacatacagagacagaaaaatggaggagctcaggggcatcgcccggccgacagatgcggaggtctcggctcggtggcgctcggtgacccgtggccccagcgcgcgagcggcaggcggccccgcggcttcggagagctccgtgccccggacgcgcacggtgagtcgatgcgccaggcggcgtcgctcctcgccgacaacgaccctccgacgacgccacgccgcgccgccccaccactttcctcaacgtcgtcgccctcggcaacatcgtgactatcggtcgcccccccaaccccacgagacccctcgcgatctgctccttctgctattgtgctgcactgctgctacttgtgtgacccgatctgatctgttccgatccgtttgtccgtgcagggcgctggcaagttgggcgtgctgaacagcctcatcgggcacccgatcctgatccctcattaaagctgatagatttatctgggatagatcagcgagctgttgatgattccatgtaatatccacaatgaactttcatcggagtgaaagacaagctctacggagatgatggcggcaaaggacttcagccctaaagcatgttgaatgtttgatgttggatgctcgattagtacaatttgttagatgatggatttgttggactcctttgtcatggtttatgtgatatatatgtggatttgtgtgatatatatgtggatttgtgtgatatatatgtggatttgtgtgatatatgtgaattcccagttatataatcatatttgtgat

SEQ ID NO: 5324 - DNA, 451 bp, Sorghum bicolor
  Clone ID: LIB3478-032-P1-K1-F11
atccctgctctcagccgtcacatacagagacagaaaaatggaggagctcaggggcatcgcccggccgacagatgcggaggtctcggctcggtggcgctcggtgacccgtggccccagcgcgcgagcggcaggcggccccgcggcttcggagagctccgtgccccggacgcgcacggtgagtcgatgcgccaggcggcgtcgctcctcgccgacaacgaccctccgacgacgccacgccgcgccgccccaccactttcctcaacgtcgtcgccctcggcaacatcgtgactatcgggcgctggcaagttgggcgtgctgaacagcctcatcgggcacccgatcctgatccctcattaaagctgatagatttatctgggatagatcagcgagcttgtgatgattccatgtaatatccacaatgaactttcatcggagtgaaagacaagctcta

SEQ ID NO: 5325 - DNA, 835 bp, Sorghum bicolor
  Clone ID: SORBI-28MAY03-CLUS12009_1
ggtttgtgttgcaaaagacaataattatgagttttcgcactatatcatactgatggtttgagcatctgtttgtcgaaagacacaaggatgaaactggattggatgggatatattgggaccaatgcattcttcagtacactagccttgtacaggagccgtagagcttgctacgaagccaacctgatttagcatggtaactcgatgtcgctgacgcacgaagtatactagcaacaaagcaccaactaccgactatacgcgactgcagcagcaatcgagaaactcaggtttgaacagcaccatggcaagcgccaaagatctgaaccgagatccagcagccggaacatgacctagcaggcgcaatcaactgagcgggagctgcctcggacctcgaggagcatgaccttgttaaggtcgttgatgcccttgcagtgcctgacgggcgccgcctcttgcttgttctcctcgcccgccagcagcgacgatgctgaggccgacatggtgtccttccgctgaaaaaccaagcagcagccaacacggctgcacgccgaggcgagcagagcggggggagctggagagcctggaagaggaggcagatgggctgggtcgaggtcgatttgggcgaatttccggacagcgcccttgtgagtgcgacgggaggtgcggaggagctgccgagctgcgaggcagcgcaggggagtggagcggcatcggaccggccggcaagggcccgtgcgccgccgatcccccacgccagccagaagccaccgggggccacacgcgccatcagccaccgagggccgccgctcaagaagaagataagagagacacctcgtgc

SEQ ID NO: 5326 - DNA, 961 bp, Sorghum bicolor
  Clone ID: SORBI-28MAY03-CLUS120253_1
gcacgaggccgtggtcgaggccatcgccgagaaggacgacgacaccaccacggaggacgacctgatggtggtgagcgccgaactggagaaggtcctcggtggccgcaacagcggtgccgccggcgacctgatcgcgtctgcgcgggtaagcttcgccatgggcgtggactgcccgctgcagggcttcctgttcggctctccggtgagcgatgccgccgaatcgcgcctggagcagccgcgggacagcaatggcggccggcgcacctcgctcggcgagctgttcatgcgcacgcgcttcgccgacgagaaggtggccctcgtcgccgtcgaggaaggcgaggacggcggggatggtggagccgccggtggagaaagggacgacgggaaagcagggaaaggcggcggctgccacaagacaacgaagaagaggagggtgaaagatgataaagtcgccggcggtgatggaacgccggcgagtgcagcggtgaccaagagcaagtttcagaagaccctccaaatcttccacaggaaagtgtaccctgagagcgcggccctggcccggaacctgaccaagaagagccgcaagcgcggcagcggcggcgccgacgagcccgccgagccggcgtcgtccaacaagctccggtgccgcaaggagcagcgcgcgccggggttcggctgctgcgccaaccgggcctccttcggtggcgccgcttctcccatccacgacgacgacgacgacgacgagctcaacggcagcaagagcggccactggatcaagaccgacgctgaatacttggtgctggagttatagaacgagaaacaacaagagagagtcagaatctgttggctggtcaatatcatatatagtgagtatattgagcatgttacttgcgtacttatgtttgtgtgcttgcttgttcttcaccaaaaaaccttgttatatacacatatatgtttgttc

SEQ ID NO: 5327 - DNA, 1030 bp, Sorghum bicolor
  Clone ID: SORBI-28MAY03-CLUS120388_1
cgacgactcgggggttcgattccgatggcggcggccgcaccaacccacgcacccgtgtgctcctcctcagcgtgccgcgcgggaatctgctctagcgggacacccttccccagttttcgctctgcggaggcttcggcccctgggtggcggcgcacggagccgtacccggcagtctccgtggtgccgggctccgcgccaggagctgtggccgtcgacaccgatgttgacacattactagacagtgtgaagtgggacagcaaagggttggctgttgctattgcacaaaatgtggatactggagccattcttatgcagggttttgctaataaagaagcccttgcaaagactatatcaacaaggaaagctacattctttagccgctcaaggtcatccttgtggacaaaaggggagacatcaatgaacttcattaatgtgcatgacattttcctggactgcgaccatgattctataatataccttggaaagccagatggacctacctgccatacaggagcagaaacgtgttattatacttcagtttatgatgctctacaaagttcaaagcctaatgaaggcaggcaggttatgacaaccctatactcacttgaagatacaattagtagacgacaggaggagatagttactgaaggaggtggcaagccatcatggacgaaaaaactactgcttgataaccagctactttgctcaaaaatacgtgaagaagctggtgaactaattcaaacgctgctcgagaacgaggaccaatctcgtgcagcttcggagatggctgatctgctgtaccatgctatggtgctgctcagagtcaaggatgtaaagatggaagaagtccttgagatcctgaggaagaggttttcgcagtctggtatcgaggagaaggcgagtcgcaataaatcttagcgtgattggttaataatgccttgatggtggatgacttatctgatttactatcgatttgccgagtttgaactatggcagaattttgtgtttgatgatcagttgtggctatttt

SEQ ID NO: 5328 - DNA, 588 bp, Sorghum bicolor
  Clone ID: SORBI-28MAY03-CLUS120398_1
gcacgaggattgaacccaactggagtggacatagggctaaaagactcagatgggcttattccaaataatggttcacagcaagggagtaacatcattccaaggtccgttggcaactttcttgcagacaggatgctcatggcgctatctttgttcaggaagtcattgagcgatggtgttcttgcgcaagtctggatgcccattgagcacaatggtcgtgtcgtgttgagtacatccgagcagccctatttacttgaccaggatcttgcaggttacagagaagtttctagaagtttctatttttcagttaaggaggagcctggtctgcacctagggcttccagggagggtcttcatatccggggtgccagagtggacctcaagtgttatgtattacagtaagccagagtatttgagaatggagcatgctcttcttcatgaaatacgagggtcacttgctatgccagtttatgatcccagcaagggctcttgttgcgctgttctagaacttgtcacgaacaaggagaaacctgattttgatgcagagatggacattgtctgcgatgccttgcaggctgtgaacttgcagaca

SEQ ID NO: 5329 - DNA, 715 bp, Sorghum bicolor
  unsure (1)..(715): unsure at all n locations
  Clone ID: SORBI-28MAY03-CLUS12053_1
actactgtcctgcaacccatacgttcgtttcggcaccagcccagcccagccccagcggaggaaagagtgcggattgcggcgccgccggcggacgaaacaatggcgccggcgagggacgagcacctggacgcgattcgcgcgctgatggcggtccactcgccgccgctccacgcgctggtcgtcccctccgaggacgcccaccagagcgagtacgtgtcggagcaggacaagcggcgggagttcatctccgggttcacagggagcgctggcttggctcttattaccatgaaagaagcatttttgtggacggatggacgctacttcttgcaggcgacacaacaactgagcaatcgttggaaacttatgcggatgggagaagacccaccaggtgaagcatggatagctgataatctggctgctgaagctgtcattggaatcaatccatggtgcatctctgttgattcggctcaaagatatgagcatgcattttcaaagaagcaccagactttgcttcagctttcttctgacttggtggatgaagtatggaaggatcgcccgctagttgaacctaggcctgtaattgtacactcagtggaatttgcagggcgtagtgtaccanaaaagttaaaggagctaagaggaaagcttgtacatgaaaaggctactgccattataataactgctcttgatgaggttgcttggctgtacaacattc

SEQ ID NO: 5330 - DNA, 667 bp, Sorghum bicolor
  Clone ID: SORBI-28MAY03-CLUS14548_1
ctcccacctcccccgccgcccgcgtcgcggcacgaggccgagcccgccaagtctaaggccagcgtcttctcccgcatcagcttccccggagacggcgccaacccttcggacgccaagcgcagccgcagggcctccgacaagcccccagcgcactcctcttcctcctccaagaagagcgccgcggcagagggcggtggtgacgcccgcggccaccgccaccaccagcagaaccaccgtgagggcgcggcggcagaggaagagaagcgtaggcctggtggcgagtactacggcggcacggacgaagaggaggagagcgaggaagaggagcagcacttcaagcgacggccgtcctcgtcctcccggcgtgagcgcgagcaggaggcgcaggaagagcagccgcggcactcgcgacggtccagggaccacaagcgccggtgagcgtcgccccgtccgtctgtaccaaaaccttagaagcttgattgagttgggaggtggtcgccggacgcgcgcgcctcccgagagcagattgagcctgcgcgctctgtttctatttggcgtcgagtttgggccctgtacattgttgcgaatattctgttttgcttgatcgaatcggatcggatcttaatgggaattatataatattctaataagaagtttgatttgatgg

SEQ ID NO: 5331 - DNA, 626 bp, Sorghum bicolor
  Clone ID: SORBI-28MAY03-CLUS14622_1
ttacaatagacttggttgagatggtgtttgccaaaggtgatcctggtatagcggctctgtatgacaagcttctagtttcagaggatttgtggtcatttggcaagcgtcttagagccaactatgaagaaacaaagcaacttcttctacaggttgctgggcacaaagaccttctggagggcgacccttacctgaagcagaggctgcgcatccgtgactcttacatcaccgcgctgaacgtttgccaagcttacacgctgaagcgcatcagggaccctggcttccaggtgaacccggggcctcacctgtcgaaggacgtcatggacattggcaagccggcttcagagctcgtgaagctcaacaccacaagcgagtacgccccggggctggaggacaccctcatcctcaccatgaagggcatcgctgccggaatgcagaacaccggctgaaagaacaagaatccagagtgcctttctttattctgagttgatgtatctatcgtagcgtaggggatcatggcgtgagccggttaacaagacgtacggggtgcacacctggatatgggattactatatgctatttgctatatcgaactcctatgtatgcatatccatgttgcttgagcctgc

SEQ ID NO: 5332 - DNA, 645 bp, Sorghum bicolor
  Clone ID: SORBI-28MAY03-CLUS14603_1
gttctagatcgcgagggccgaactttttttttttttttttgaactcataattctgccgacagtagtatgttgatcctgagcgacaagacagggagaagcgttgattcttgctagaaaaaatctttctcaaacaacaatagtacaatagacatattgggtggtggcagcccgttctctctcgttttatttcgacagagcagagcagagcagagttgtgttgatattcatcagaattcgtggcaaatgtaggcggccaactcggctccaattccagtcaattcttggtggtttcagcagccgtgacggacgccaggaactccttgaggagacggttgtagacgcagggcctctccaggtgcaccaggtggcctgccttgcttatgctctgcagcatcgtcttctcgccgagctgctctttcatggtcttggcgagctcaatgttgaaaatgttgtcgttctctccccacagcagaagtattttctgagacaggacgggcacggtggcgtctttgttgctgaccaccaaaccttccagcagctcggctctctccttgcggttggtgaacatcacctcgaggaaatccctgtgaaggcggtcggggaaccagagcttgcggtaggcagcgacggagagcagcctcgtgc

SEQ ID NO: 5333 - DNA, 611 bp, Sorghum bicolor
  Clone ID: SORBI-28MAY03-CLUS14636_1
ttgtacgggaagagatgaaccttttggcagaagttgatcaaccaggtagcctgattgacaactatgtgacccaactgagctttttgctgtcacgcaaggctgcaggcttggtcagcctccaagcacgcttggcacggttccagcaccgcctcaaagagcaagagatccttagccgcaagaaaccttccagatagtatgatcagtgatggctctggccttttgcctggtaatctgattgctacagctcagttgtggtccatcagttgttttttttacctgtgctccagcagtaaatgctagccccaagcaacgcagtgatagaagacacatgggagtgtcttgggggcggttttgatggccgtggacaatttgggtttgtcagggttggtaaccagtttggtaatagtcctttttacagtggggctgcttgggtgggttttttttttttggcggatgtatggcttgcccactttgtctttctttttccccattttgtacgaggagaaattggaactgttgtttgcagatatcagtgggtctgattttcgccgtggggtcttttgtggaaacagatacattgttgttgtatattcattactgatattattgcc

SEQ ID NO: 5334 - DNA, 750 bp, Sorghum bicolor
  Clone ID: SORBI-28MAY03-CLUS120919_1
gcacgaggccaccgtcgtcttcctcgccatggcccccgcggcgagcgcgaggttcccaccggtgtcatcctacgacgcgtccgcacgcacccgccgaaccgccgccgcggacctggacggcacgctgctcgcgtcctcctcggcgttcccctactacttcctcgtggcgctcgaggccggctcgtgcctccgcgcggcggcgctcctcctcgtggctccgctcctgctagcgctctacacgctggtgtccgaggcggcggccatcgcgctgctggcgttcgtcacgttcgcggggctgcgcgtgcgcgacgtcgaggccgtcgcccgcggcgtcctgccgcggcactacgcggccggcgtgcgcgccgacacctggaccgtgttccgcggctgcggcgaggggaggagggtcgtcgtcaccgcgtcccccgccgtcatgggtgggcgagttcgtacgcgagttccttggtgctgaggtcgctggcaccgagctcgggttccagtgcaccacgctcaccaggaaggacaagtacatgaagctcgccggcaacgacggctcggtcgccgccagggctaaaaaggacgccgccgatgataacgcttgccacgagtcaccaccaccaagaagtttgtatgaagagatcgattatatatattggcaacctagctcgaatatatcggagcagcattgtactgacgtaaaaaaaaaaaaaacatgcatgcacaaaaggtatagttaggcttatgtat

SEQ ID NO: 5335 - DNA, 1071 bp, Sorghum bicolor
  unsure (1)..(1071): unsure at all n locations
  Clone ID: SORBI-28MAY03-CLUS12119_1
atgattatgagtgcacattatgctttaagctattgtatgaacctgtcactacaccatgtgggcattcattttgtcgctggtgtatacgatcagtcaatggatcatggaaataagtgccccatgtgtcggacagtgctatttattggtccaaggacataccctttaagtgtaacattgagcaacataattcagagaaattttccacaagaatatgctgagaggaggtcagaacatgagactatgacatatgccggtgttgatttgatgcctctctttgttatggacgttgtacttccatcccaaaagatggcactgaacatatttgaacctcgctacagactgatggtacggagaataatggaagggaaccatcggatgggaatggttactattgattcagcaacgggtactgtagcagattgtggctgtgaggtggaaattttggagtgtgaaccacttccagatgggcgcttttatttagaggtggaaggcacacgtcggtttcgtatcttacgatcatgggatcaagatggatatagagttgctgaagttgaatggttgcgagatagacctctgccagaaggatcacaagagagaagagaactaatggaaatggccaatgaagcttcagagatggccagggcatatattagacgtgctagagaaaccatacggactgcaaggcgaacaagacatttggatcttgagggcatgcctgggccacaggatcctgaaaaatttagtttctggctagtcaacttgataagtttgaggccctcggatagactagatatgttacgccttcgtgacactagggagagaatttctagtagcatcaggttgctgagtgatgccgaacaaggttgccgtgtacaatgacagaaacagaactacagtacaagaattgtttccacataccaattcgtttttaggggtatatatataccgagcagctcctatatgtatatcgatttgtagcatatatttctcatagttgtcatttaattgattctgttctatgtgatttcctcatgtaactgtcaatggaaanaggtatatcattacttcctc

SEQ ID NO: 5336 - DNA, 750 bp, Sorghum bicolor
  Clone ID: SORBI-28MAY03-CLUS121279_1
tggtggcgagagggaggaagctttaagcctagtcgtctcctccgtcccctcggctggctcttacttgcatggtcccccggccggccctcctcctcttgctctccgacctcaccgcagtcacggcgcccatcccggccccttaaaaccgcaccaactcgttgccaaattcttgagctcacacgcacgagggcggaaacatataccaagcttgctggtcgcctcacaacctacgacgaaattaaacaagctctagccagctagaattcttcttgggggctcgctcgcagccggccatggcgaagccgcaggaggtgcgcagcgtcgactccttctcgcagctgccgttcatccggccggccccggcgccggcgcagccgagggacgccaccatccggctgttcggctgcgacttctccaacgaccagcagcggcaggccaagcagcagcaagacgccgcgtccgactcccccgacaacgccaacggcagcacggtcacgtccgagagcaacggcggcgccaagagcggcggcgcggctgcggcggccgcggccgctgcggccgccgagaggaagttcgagtgccactactgctgccgcaacttcccgacgtcgcaggcgctgggcgggcaccagaacgcgcacaagcgggagcggcagcacgccaagagggcccacctccaggcctccctcgccatgcaccgctacgtgcccggccacatgtacggcctcttcaactaccaccaccaccacc

SEQ ID NO: 5337 - DNA, 621 bp, Sorghum bicolor
  Clone ID: SORBI-28MAY03-CLUS12102_1
gcacgaggctcaagccgtttggtgccctaaaatccgccctgcgagcctatcggacattgcagtcaagcagatcccttccgccgccgtgggggtttgtggttctcctctgttaagccgaaactgagtggtggtcaagtttcgcaactaggaggtctcccgtccgccaattcgcgtggcccgcgttatccgaggtctctctggtcgcgttgagggctcagacgatgagcaatccttggtgaaccggagtgcttcagtgatcaagatcaaagccttggcaactagtaagaccagcaggatcaacaagagcatttggatcaaggagaagtttaggcgtgtgatcaaccagtcagttggatcttgttgagtgaagttaatacccgaagtttggagttgtctatccgttgtttgctatcaaagatgtatcgcgctcggtggcacagcaccactactctgtcgtgccagactgccagtacatgtggtgcgacaagggctgccatgctagagtggaccactaaccagatttgacgtggcacatgatgaggctcgccctctcatgctactaactccgtccctctcttctctcttatgttcctcccatcctctctctttgatcacgtttgc

SEQ ID NO: 5338 - DNA, 364 bp, Sorghum bicolor
  Clone ID: LIB3478-038-P1-K1-F4
gtgaggtgtcatgcaggtgcggcaggcaagcttcggcgtcgttgtcctcggctctccgccgcactgccaccaacagccaccgcgctgtcggtcggcaattcgtggtgatcaagagtgcttcagtgatcaagatcagagctttggcaactagtaagacaagcaggatcaacaagagcatttgaattaaggagaagtttacgcttgtgatcaaccagtcagttggatcctgtagagagaagttaatacccgaagtttggagttgtctatccgctgtttgctatcacaggtacaggtggagttctcttaattttggtgtggtctcgacgcctggtaaaagttgtctctgggaaggtaagataacaaa

SEQ ID NO: 5339 - DNA, 739 bp, Sorghum bicolor
  Clone ID: SORBI-28MAY03-CLUS12139_1
tagagaacttctgcaagtccaatgatgtcccagtttaccggcgcgatccagatgatggcattgacaatattggcaagacaggtggaaaccatgccgtttctggacttaagttccgcatattgagggaatttttgcagcttggatacagtgttctcctctctgatattgatatcattttcttccaaaatccatttgatcatctttacagagattctgacgtagaatccatgagtgatggacacaacaatatgacagcttatggattcaacgatgtgtttgatgagccatcaatgggctgggcaagatatgcacatacaatgcgtatatgggtttataattccggattttttttcataaggccgacaattccttcgattgagcttcttgatagggttgcttaccgcctttctcacgagcccaaatcatgggaccaagcagttttcaatgaggagctgtttttcccctcacatcctggttatgaaggtcttcatgcatccaaaagaaccatggatatgtacctcttcatgaacagcaaagttctcttcaagacggtgaggaaagatgctcatctgcggaagttgaagccggtgattgtgcatttgaactaccatcctgataagtatgatcgcatgaaagcagtgattgaattttacgttaacgggaaacagaatgcccttgaacgcttccccgatggatcagaatgaagacaccagcttttgtagaacagaaaatgacaact

SEQ ID NO: 5340 - DNA, 783 bp, Sorghum bicolor
  Clone ID: SORBI-28MAY03-CLUS12177_1
ttgatcttgatgctgagaagaaggtagggccttcaagcacttctgttgacccttgtagtatgcctcctgcatatgtgccatctcatattggcaaccaaccgatgatggagaacatgaggccacctgtctcagagtttgaggaaccgaagtttgaagaggacagaactgttattccagtcatggatgcatctctccgagatattgattttgaacacttgcagattatcaagaacggagacttagaggagcttagggaacttggttctggcacttttggaacagtgtaccatggaaaatggaggggaagtgacgtggccattaagcgtataaagaaaagctgtttcacaggccggtcttctgagcaagaaagactagcacatgagttttggagggaagctgagattctgtcaaagcttcatcatccaaatgttgtggcgttttacggtgttgttaaggatggtccgggtgggactctagcaactgtaactgagttcatggttaatggttcacttcggcacgtcttgcagcgcaaggacaagtatcttgatcgccgtaagcggcttattatagcaatggacgcagcctttggaatggaatacttgcattcaaagaacattgtgcactttgatttgaagtgcgataacctactggtgaaccttaaagatcagacacgtcctatctgcaaagttggtgatttcggcttatcaaaaataaaaaggaatacattggtttcgggtggtgtgaggggcaccttgccatggatggctccagagttgctgaatg

SEQ ID NO: 5341 - DNA, 639 bp, Sorghum bicolor
  Clone ID: SORBI-28MAY03-CLUS119415_1
gcacgaggctccgtgcctcgtcggccccggcctgttcgcgacctgcgtctccctccttgcggccgctcccaacaaagcacgagggaccatggctggcggaactggagccccgcccgaccagcgcaagcgcaaggctccggcccccgccgcaggcgccgaggacgaggaggaggtggaggcggaggtggaggagctggagagcgaggtagccgatctggaccgccggaccctcgagcacctccgccgcaccgccacgcgcctctccgacgctgccttctcccgcctcgccgcgctccgccctcccgcacgcctcgaagttccagctgtctcggaaacatcagttgctgaagatgaccaagagcttgagaaagtgaagatcctcaaatccaagatcaaagctaatattgacgatttgcccaaggtacttgagaaaataaatgaaaccattgctcggtgtgagaagttttgttgatatgcatccagtgtttcgaagaaactgtagagattgacacgtctaaagcagattgtgtgcttgttcatggctagtttgcatcctgactttttactgaattatatgtctagagcagattgtgtaatgtttgtaatctatagtagtaactcatttcatcatgaagacag

SEQ ID NO: 5342 - DNA, 706 bp, Sorghum bicolor
  Clone ID: SORBI-28MAY03-CLUS119596_1
cgtcaacacctgccgcgcgctcgagggcgacttcctcgacgcgctccaggggatcccgtcctccgacggccaaaggctgttcgccgtcgggcctctcagcccggtgctcctcccactccccggcgccggcgcgagcagcgggacctcgcggcggcacgagtgcctggactggctggacgcgcagccggcgtcgtcggtgctgtacgtctcgttcggcacgacgtcgtcgctgcgcccggagcaggtgcgcgagctggccgccgcgctgcgggacagcggggcgcgcttcgtgtgggtgctgcgcgacgccgaccgcgcggacctgcgcagcggcggggagggggatgccgcggccgagaccctccgtgccgccgcggcgtccgagctcggccccggcgcctcccgcgctggcgtggtggtcaccgggtgggcgccgcagctggagatcctggcgcacggcgcgacggcggcgttcatgagccactgcggatggaactccaccgtggagagcctcagccacgggaagcccatcctggcgtggcccatgcacagcgaccagccctgggacgccgagctcgtctgcaagtacctccgcgccggcgtgctcgtgcgcccctgggagcggcgccacgacgtgatccccgcggccgcgatccgcgacgccatcgacagggtcatggcctccgacgaaggcgcggagatccga

SEQ ID NO: 5343 - DNA, 589 bp, Sorghum bicolor
  Clone ID: SORBI-28MAY03-CLUS119765_1
gctcgccgtcacgggcctgccggtctggatcacggagctggacgtgtcgcccgccgacgagtccgtgcgcgccgacgacctggagatcgtgctgcgggaggcgtacgcgcacccggccgtggaggggatcatgctgtgggggttcatgcagggacacatgtggcgctcccacggccagctcgtcaacgccgacggcaagtacacccaggccgggaacatgttcgcgggcctccgccgggagtggacgtcccacgcgcgcgggaaggtggacggcaacggcaacttcaagttcagagggttccacggcacgtaccaggtgctgcttacgacggccgccggggaggtcaagaagcgcaccttcgacgtcaacaagggggacgcgccgctcgtgctggacatggatttctaagctttgtattacaacgtacgtacacattggttggatcacgatttattacgacaaggattagtacgatcatgtagtagtacttatatattcgtacagattaagtgtggtatatattgggattggggtgatgcgtagacattccagtggtgaagaaagtatgatgaatgttaagtacccgga

SEQ ID NO: 5344 - DNA, 513 bp, Sorghum bicolor
  Clone ID: SORBI-28MAY03-CLUS11993_1
gcgggaaaggacaaaaggtatgcataggggttgcaacgcagcatccacctcaaataacagaacaagagagaggcactcatacaattcttgcagctgtggccatccggaagactctggagttatggacagctgtttcttgccaatagctagatctggcagagagatgaagatagcaagaaaatcaggagttgagaaacctaggttgcagtaccaccgatgctatacattggataactttatagtgtcaaaaggaaaccgtgctggttgtacacagaaaaatgctatcccaaagcaagtatgggagcctatggatgctcgaaggaagactaacttacacaacacagttcatgattcaggtcaataaacaatgttgatccactgaaacatgtggtttttgataacagcagatctcaaaagttcggcgtaggatgtgaatcacagcctcaggcttctgaaagtaccagggatgtttgtgattcagatcaaccatgtgcaaatggtgggacaaatcaa

SEQ ID NO: 5345 - DNA, 1048 bp, Sorghum bicolor
  Clone ID: SORBI-28MAY03-CLUS122303_1
gttccatgtgaacagcagttggacatgggttagtcgatcctaaggcatagggaagttccgtttgaaaggcgccctcgtgcgccgtgtgccgaaagggaagccggttaacattccggcacctagatgtggattctccacggcaacgtaactgaacgcggaggcgtcggcgggggtcctgggaagagttctcttttcttcttaacggcctatcaccctgaaatcggtttgtccggagctagggttccacggccggcagagccctgcacctttgcagggtccggtgcgcccccgacgatccttgaaaatccgcgggaaggaatagttttcacgctaggtcgtcatctctccttcctacctgcatctcctcctcgtccgcgagaacctccgcgagggcctcgaagttgcctcccagaacgtctacgacaaacccaatggcgctttcaccggcgaagtctccgtctcccagctcaaggacagcggcatcaactggaccatcctgggccactccgagcgccgcaccatcctccgtgagagcgacgaggttgttgccctcaaaaccaagtacgccaccgagaacggcgtcagtgtgatctggtgctgcggagagtccctggaggagcgtgaggccggcaagaccatcgatgtcgtcagcaagcagctcgccgctctcaaggcccagatctccgactggtctaagatcgtcatcgcctatgagcccatctgggccattggcactggcaaggttgccaccactgagcaagctcaggaggtccacaaggccatccgagagtggctcaagaccaacgttagcgacaaggtcgctgacgagacccgtatcctctacggcggcagcgtcaacgagaagaactgcggcgagctcagcaagcaggccgatattgacggcttcctcgtcggcggtgcttccctcaagcctgcctttgtcgacatcatcaactgcctgaagcagtaaatgggttctcatttatagggaaaacagaactcggtagaaaaataaaattgtgctgcggaaaggaaaaaaaaaagcaat

SEQ ID NO: 5346 - DNA, 597 bp, Sorghum bicolor
  Clone ID: SORBI-28MAY03-CLUS1224_1
gcacgaggctgcctccgaccgcccgagcgaatcggatcggggtctagggtttcggcgcgcttctccaaccagacgcgagggctaggctgagcatggagggagcaggcgcggcccggaagaggtcccggccggagtcggcgaacgggtatgccgccggcgggaagcgctccaaagacacggagtcatttcaaactggtcaatcaagcaaatcgaagccttgcaccaagtttttcagtaccattgggtgcccatttggtgagggatgccattttctgcactttgtccccggtggttacccagcagttgcaaaaatgctcaatctaggtagccctgctgtatctgcgccatcaagaactcatgtggatcatgccgctcttactggcgcctctcatcaagcttcgatgggcaagacacgcatgtgcaccaagtacaatacgacggaaggctgcaaatttggtgataagtgccactttgctcatagcgaaagagagcttgggaagccagcctacatgtctcatgaaggacctcctatgggtggtcgatatggaggccgacctgaacctctgcaacaagcttccatgggtcctccagcaggaa

SEQ ID NO: 5347 - DNA, 696 bp, Sorghum bicolor
  Clone ID: SORBI-28MAY03-CLUS122438_1
gcacgagggccaaaacctcaccccatccgtcgagaaggcgacgagaaccacagccggcgggcgagctccgcgatggcactgcggctcgccgtacaggcgctgtccgcaaccctgctgtcgcgcgcagaaaccacgtcccccagccccaagccaccgagcaagagcaacaacagcaagcagcaatcccaaaggccagctggggcagccgccgccgccaccaccaccagcgggaggcggctagcaacggcgtcggtggcggcggtcctggcgtcgcagctactgccgcccgtggcgagcagcggcgccggcacgttcgacctgcggctgacgctgccggagaagtcgagcgaggaggccgaggccgtggtgcggacgcacgcgcgcaacctgctgggcgtgaagcgcttcatcgacgccggggcgtggcgggagctgcaggcggcgctgcgcgccagcgcgtccatcctctagcaggacctgtacgccatcatacaggcgaagcccacggggcagcgccccgagctccgcaggctctactccgacctcttcaacagcgtcaccagcctggattacgccgccagagacaaggaccaggtccaggtgcaggagcactacggcaacatcgtctccgcgctcgatgagattttcgccaagatcatgtagattttgctcatatatgtttgagaggtttcttat

SEQ ID NO: 5348 - DNA, 830 bp, Sorghum bicolor
  Clone ID: SORBI-28MAY03-CLUS122747_1
gcacgagggccgtctagggttggcatcgccaccgacgccgcgagaggcctcagctacatgcacgacctggccatcatccaccgcgacgtcaagtccagcaacatcctgctcgaccgcgactttgaggccaagattggcgatttcggacttgcccgggttcttgccaagcctggtgaatcggagccggcgtctgtcataatgggaacacccggtcatattgctccagagtacctccgtgatgcagaggtgagtgagaaggtggatgtctacagttttggtgtggtgctgctggagctcgtcacagggaagcaaccacatgatgctggtacaaagccaggcgttggtctagcgaaatgggcatctcaacaacacaggaacagaattcgatgggatcacatcatcgacaaggatattcagaatccagcgtacgaggatgacatgaaggccgtgtttatgctcgggctccgttgcacaagtgaggacccactcaacaggcctgcgatgaataaggtcctcgagcagctcgagcagctcctttcgtgtgacccaagcagggttaaacatcgcgggtcgtttcttgcgaaggtttacaggaaaattcaagacaaaatcttcagacaaggtcaatcagcggtatccatccagtaaatttgtccttgaccagagagcgtagtgtatgtccatctgccagtgatgagaagtgcatgctggaaaggtcccaagaacttagcagtataaatatatagttctgctagcgggtttgcatgctaaaaccatgtgtgaggtcatgaaatcctcagtgataactacttggagcaatttgtagttgt

SEQ ID NO: 5349 - DNA, 766 bp, Sorghum bicolor
  Clone ID: SORBI-28MAY03-CLUS123169_1
tcggcacgaggggatagaccctcttcccctatttttattttgtgtccatctctgtctctgaacggtttcatcaaccactcgttcgttttttcgcattgagagcaaacggttctacacacgggccctcagccaccatttaataatccatatctaatcttgtcgcctttgctcgagatttctagcacaagcatatcaaccaacaccaaagccatcagcacaaggcaaatacaacaacaaaaaacaaagatgtattctaagaacctcgttctcgccgtcatggcgtccgcagcaaccaccgctgtcgctgaattcgcaatcatcaccacacccgtacccaccaacctcgctgtcctaacagatctctccggctacaaatcctccatcctggcccaagtctcctcgggcctatcttctctaactggcgacccagcaaacatccgcagcgcctcatccgcgcacaaaggtcttgcctctttcgtcgccacagccacctactcgatcccgcccaaggtgaccgaggtgaatgccctggaaacattctccaccacaccagtgtggtactcggcgctaccaaccgacgtcaaggcctactacgacaagttcaacaagggtgtccaggatctcgttgaccaggcaatcctgggcgagacgaaaaacgcgacttctgacagtggtgcaaaggcgacgggtgcaagttcgaagtgcgcgaccgaaggagacgggaggtgccatgcaaaatacggtggggctcatgggcgcgggtatt

SEQ ID NO: 5350 - DNA, 878 bp, Sorghum bicolor
  Clone ID: SORBI-28MAY03-CLUS123182_1
gcacgaggggcacctcagccatggcgcagcagcagctgctcctcctccccgcccctcccagaaccttcttgaagcccctctcctctcccttcctctcctccctcccccggcgccacctcgtccccgtctcagcagttcgcgtggcacccgccgtccggcggggcctgctccaatacgcgacgaagcgttcaggtttggttgaagagctggagatcgccagggacaagcaaccgcggagcaggcgcgccaatggcatcttctggatcttgctgctcaatttcggcatctacgtggccgaccacttgctccagatacgacaaataaaatcactgtacctgtatcatgcattccctacatggttccagtttgtgacatcaacattttgccatgccaattggaatcatctttcaagcaatttattctttgtgtatatctttggtgagagttgattgctaaaaatgaatgctctgcttggaacttataattcagttaaaggatgcctagtgctgatctaaatatacaggaaaacttgttgaggaggaagagggtaactttgctctgtggatgtcttacattttgactggtgctggggcgaacttgatttcatggttggttcttccaacatcctctgtgtcacttggagcatctggtgctgtttttggccttttcaccattagtgttctagttaagatgtcatgggattggagaaagattcttgaggtgcttatcctgggacaatttgttgttgacaaggtcatggaagcagcacgtgcaacaacaatcacagggcaatcgtttcagagtgaacaacattgctcatgtatcaggtgctttgataggtgctgcgttggtgtttctggtcagcagaatcccttttt

SEQ ID NO: 5351 - DNA, 949 bp, Sorghum bicolor
  Clone ID: SORBI-28MAY03-CLUS123187_1
gcacgaggcaggcaactttcatcaagcctacttcgtaactcttgacatacctatccttccaagaacttccaagtatctcttgtccgtcctgggcgacgatattaccgtttcatttgtctgctcaggccttggcaaaccaatctatcaacgttaacctcatctccgagcgatcccgcgaccatggccgattctgccaacgcccccaagcccagcagcagcgtcaagctggtgcttctcggtgaagctgccgtcggaaagtcgtctctcgtgttgcgcttcgttaacaacgactttcaagaaaacaaggagcctactattggcgctgctttcttgacccagaaatgcaatctcccgacaaggacaatcaagtttgagatttgggataccgctggtcaagaacgatttgcctccctggctcccatgtactatcgaaatgctcaggccgctctcgtcgtctacgatctcaccaagcccacgtccctcatcaaagccaagcactgggtcgctgagctacaacgacaggcttctcccggtatcgttatcgcattggtaggcaacaaattggatcttacgggcgattcctccggtgccgcagatggcgaggaaggggatgagggtgatgactctggcgatgcccgcaaagtacctacagaagaggcgcaggcatacgcggaggaggagagtttacttttcttcgaaaccagtgccaagagcggtcataatgttactgaggtattcactgccatcgcaaacgcgatacctgagacatcgttgaagagcgcgaggggagctggcgcatcaaatgctgctagccggggaggagaagagcaaagagtgaatcttggaggtcccaaggacgttggcgctaaaggaacagctgtgcttgctagacaaacttgaaaggagacatgcattgttggtgagaggatgaagtgggaggtacagatga

SEQ ID NO: 5352 - DNA, 517 bp, Sorghum bicolor
  Clone ID: SORBI-28MAY03-CLUS12046_1
cggacgcgtgggcggaggagtactcgcacacggccgtcaacaagttcgaccgaggcccggagtccatcccggactggctcttcgacttcatgcccacccgcggcggctacttcgtcggcaacgtcagccccgcccggatggacttccggtggttcgcgctcggcaactgcgtcgccatcctcgcgtcgctcgccacgcccgaccaggccgctgccatcatggacctcatcgaggagcgctgggaggacctcgtcggcgagatgcctgtcaagatatgctacccggccatcgaggggcacgagtggcagatcgtcaccggctgcgaccccaagaacaccagatggagctaccacaacgggggatcatggccagtgctgctgtggctgctcacggcggcatgcatcaagaccgggaggctgaagattgctcggcgcgccatcgacctagccgaggcgaggctcgcgagggacggctggccagagtactacgacggcaagctgggccgctacatcggcaa

SEQ ID NO: 5353 - DNA, 704 bp, Sorghum bicolor
  Clone ID: SORBI-28MAY03-CLUS120564_1
ttgttctgccaaaccccaatgcaggcccttcgtatactataagcatccaaccagaggtcatgttgtatgagcaatggaaggatctcaagacagactcaaagagtggactctcagcatggattaaaggtgcatttactggaagcaaaagtgacatgcaagattcagtactccagaatctacattttattctcagctcatcgcctatgtgggacaggttggaactcagaggagacaaaaatgttcttggtgaattcattgagttcaaaggaaggcatgaggacattcaacttctcaaaaatctcaagaggtcaaaagtcagtcgattcgtcatccagaagtcaactctttttggtggtttcggcaggtcacgagttcaaatattgtattctcctcgtgattatcgagctgaggggacttcatcttcagagtggaaagagatttctgtgaagcaatatacagagattgttttccagccactgcattccaaaaaggctcggaagttcaagctgtccagtgttgtttctgtcacactgagtgcctagcaagcagaagtttgcctctcaaatttaggctagccacaaactcatcaattgtgtgctgctctgtttccacctgtaattatgtgtctgtttttgatgatgagggaagtgacttatagcgacgcctaactgcttcgtactgttgcctgactgtgtgtgcgacta

SEQ ID NO: 5354 - DNA, 682 bp, Sorghum bicolor
  Clone ID: SORBI-28MAY03-CLUS12059_1
gatgtactctactccaatccaagcaatggcaaagcaaacccagccaggaacaagaaaactcagaaatgaggaattcgaataatagtagatcccagtagtaaatcctccgccccctcccctgctggctgctgcacctgttcctctccctcgttccgccgtccaattccaaaccccatcgcgcacatcgccggtcaaagcaaaacactgaaacctcgattccaaatcgaaccccgagtccggactccggaggcttcgtttcaaatgcgcgaggcgcgtactgccgccgcacgccaccgatgaccctcgacgcgacggaagccggcggcggcggggacctcttcgccgctaacctcaagggctcgctcctcgccatcgcctcctcggcgttcatcggcgttagcttcatcgtcaagaagaagggcctccgacgcgcgggtgccgccggcgcccgagcaggtgtcggagggtatggctatctcttggagccactctggtgggtcgggatggtcaccatgcttgttggagagattgcaaatttcattgcttacatgtttgcgccggcagtcctcgtcacaccgctgggcgcactcagcattattgtgagtgctgttctagctcatttcacactgaacgagaagttgcatcgggtgggtgtgctgggctgtggtctctgcattgttgg

SEQ ID NO: 5355 - DNA, 528 bp, Sorghum bicolor
  Clone ID: SORBI-28MAY03-CLUS120624_1
gcacgaggccccgattcaccaccgcaaccatgtcagaatctcgattgagagtcccagacaaggtcaaggaagtcgcaaaagaggactttgaccagtacaagcagctcgcctcagatgctgtccgctctgccgcctacctctaccccttcaagggcattgtctactttttcacccaccgagcactatggaagcctctagctgcaaagctactgccaaccgcgtcgctcggagtgggaacgacagtcttcatgtttatggtcacatacgtgccgcaggctgccattctgtccatcttcaacggtccgctcgcagtcttcaccactatcctactcgtccttagcgaatcctccaccatcttctcagtcctcagcaagaactttcttattgacgatgccctcattgacacttttgatggcaccctcgtctgccgaaaccagactacactcgtgtctaacgagcgccaggtcaggtccggaagcgaccccattggaaagttgggcaagctcgtcagcaagccgtttgcaaggt

SEQ ID NO: 5356 - DNA, 682 bp, Sorghum bicolor
  unsure (1)..(682): unsure at all n locations
  Clone ID: SORBI-28MAY03-CLUS123446_1
acacctacgccactggatgtttctgaccagaagctcctcaatgagctgagtgagctcgcggtgttaaaacgggcaaggattgagcgaatgaaggctttgaagaagatgaagaatgccaagcaaggggcctcgggtggcaatttgtgccccctgatcattaccatcatcttctgcatcgtcatactctggcaaggtttcttctcgggacatgggtcggcggtaagtttccatggatcgcctgaatcggcgattagggcgcacagcagtctgatctccatcaggttctacaagaaccattccaatgtgagaccacccagtgagaacactgcagctcctgataacgtagagaccgattctgttttgaggctcgggaatcgtaaccaagcgagaaggctagctcggtgatcgcccatggtggaggtggtcaccgccacacacctgaaaagctcgccacattttgaagcctcaccttgacgacccgggttatgtaaatcttctcgagccccccccctgctccttggctgctgtaaaaatgaatggactcctagtgtgttgtgcgcctgggtcgtacgctaactagtgaatctgttggccgtcgtgccacacaggccatggctcttctagtgaagagagcaaacgcaagcatgcaagctgttctgtattcgantgattatttacaaat

SEQ ID NO: 5357 - DNA, 630 bp, Sorghum bicolor
  Clone ID: SORBI-28MAY03-CLUS12355_1
gccggccgggttcgcacgctcctcgcctcctcgcccattccttccgcctccctccccgcgccgccgctcgccggagccccgcgtctccgccccagcctcgccgcgccgcgtcctgtagcaaaaatgacggctggctacattgttggctcactggtcggatcctttgccattgcatacctgtgtgacacatttgtttctgacatgaaggcttttggaggttccacccccaagactgtctctgagaaggagtggtggcaggccacagacaccaagttccaggcctggcctcgcactgctgggccaccggttgtcatgaaccccatcagccgccagaacttcatcgtcaagtccactgagtaggctggagaagttggttcagcaacgtgttgccaccatgaagctaaagttccttttctaggtcttaattgattgtaataaaacgaactacagtcaggctttttgtgattttcactcccatctgtgaacaaacactggggctttcagcttacttgtcattcaatgggttctgttccttggtgaaatttcccgccaggcagtaaagaattgcaacgttttctataatatatgcttttgctattttgcgaaaaaaaaaaaaaaaaaaggccccta

SEQ ID NO: 5358 - DNA, 708 bp, Sorghum bicolor
  Clone ID: SORBI-28MAY03-CLUS12348_1
gccggccgggctggggggcggctagagacttccttccgagttcatcttcctcctccgaccccttgagcctttcgcccttgtcgttgcgcaccacaggcaactcgaccgctcgcggtgaatcgaagcatggaaggagggggtagcaacgcgcccttctaccgcggcagcaccaccgccctcgccaccaacccttctgctgcgaatggggcacaaaaaggggatagggaggctgccatcgatgccgagatagcgagggttaacaacctaccagctcgaagttcctacgcgatacaccgcatgaaagtgctaaacaaacttcgccatctgatgtccatcaagaggactacgtctcaagatgaggagctagaacttctttttgcaagcctttcgatctaaagtgtatccttgataagccagtattttaaccctgctaaggggagcccactattcttacatctccagtattctgtcgttagctcccattagatgcttcctatagtgttaaagtgcaaggagatcccgttacttctctgtatcataagttgttgggaaactttgtgtgaggatgtggaagggtgataattgataaccttactattgtgttgtacgcgaatggaccgttgtaaccataagtgaacttgctgtctcggacaagaatcattagcaaaaaaaaaaaaaaaacaggcccctacaaaaagaatgccccta

SEQ ID NO: 5359 - DNA, 1177 bp, Sorghum bicolor
  Clone ID: SORBI-28MAY03-CLUS12358_1
acgtacaacaccacctcgacggtggagcacatggtgcgcaaccagcccgacgtggtgctcctcctcggcgacgtctgctacgccaacctgtacctgaccaacggcaccggaaccgactgctattcctgctcattcgccaactccacgcccatccacgagacctaccagccgcgctgggactactggggaaggtacatggagcccgtgacgtcgagcattccgatgatggtggtggagggcaaccatgagatcgaggagcagattcacaacaagacattcgcgtcctacagctccaggttcgcgttcccgtcggaggagagcggatcgttctccccgttctactactcgttcgacgccggcggcatccacttcgtcatgcttgcgtcttatgtcgactacaacagatcaggtgcgcagtaccgatggctggaggaggacttggtgaaggtggacaggtcggtgacgccgtggctgatcgccggctggcacgcgccctggtacaccacgtaccaagctcactacagggaagccgagtgcatgagggtggagatggaggagctcctctacgcctacgccgtcgacgtcgtcttcaccggccatgtgcacgcgtacgagcggtcgaaccgggtgttcaactacacgctggacgcgtgcggccccgtgtacatctcggtgggcgacggcggcaaccgcgagaagatggcgacggcgcacgcggacgacccgggccactgcccggacccggcgtcgacgccggaccccttcatggggggacgcctctgcgcggccaacttcacgaccggacccgccgcggggcgcttttgctgggaccagcagccggactacagcgcgtccagggagagcagcttcgggcacggcgtcctggaggtgaagaacgacacgcacgcgctctggcagtggcaccgcaaccaggccctcaacgccgacgtcgccgccgacgaggtgtacatcgtcagggagccctacaagtgcctcgccaagtcaaccagattattggcctattgatattgaggattattgttgcttctagctactctagctatttgcttgctagaggagtagagttactaaagtattactagtaattagcaggagtagtcactacagtattaattagcttccagccaggcagccgggccctttttagttaaaaaaa

SEQ ID NO: 5360 - DNA, 791 bp, Sorghum bicolor
  Clone ID: SORBI-28MAY03-CLUS123878_1
gcacgagggtcatgcggtgtgaccctctacgtgatgctggttggcgggtatccttttgaggatcctgaagaccctaagaatttcaaaaagacaattcagaaaatactgggtgttcagtacgcgattcctgactacgtctgtgtatctccagaatgccgggatctgatatcaaggatttttgttgccaacccagcagataggatcacgatgcctgagatcaagagccatccatggttcgtcaagaacctcccagctgacctcgtgggcgacggcacggtgagctacgaggagccggaccagccgatgcagaacatgaacgagatcatgcagatactggctgaggcaacagtgccggccgatggcgcccgtggaacgacccagcttttgtgcgacgaccttgatgactttgacgacgatatggacctggactcggacctggacctcgacatcgagagcagtggagagatagtgtatgccatgtaatcatgcatgccaatgatttctggctgtccttgtaaatcagtctgtccgtcgagagttgctgatgctctggatgcaagagctcaagcttaaggagcgatctgtgttccgtggcatggtgatcgttttgacaccctgattctagtcgttgatccatactgaaccgctgtctattgtgtagtatgtagaactttatcttgtacatattgttttttcgtcgcttggttctctctttgctgaaactgaaaaatggaaacgctgctaatgtagttgtatctttagccccatttgtatggttgtgttttgtgccc

SEQ ID NO: 5361 - DNA, 1173 bp, Sorghum bicolor
  Clone ID: SORBI-28MAY03-CLUS124_1
ctcgaggccacctgcaagaggaacgggtacaagcaggccatgaagcttctcgatgagatgcgggacaaggggtgcgccccggacattatcacctataatgtcgtcctcaatggtatctgccaggaaggccgggttgtcgacgccatggagttcttggagaacttaccgtcctatgggggcgagccgaacactgttagctacaatattgtgctgaagggcttgttcactgcagaacggtgggaagacgcggagaagctcatggaagagatggcccacaagggttgccctccgaatgtggtaacatttaatatgctcatcagttttttgtgtcgtagaggattggttgagcccgcaatggaagttcttgagcagatccccaagtatggatgcacgcctaattcattgagttataacccacttcttcatgccttctgcaaacaaaagaagatggataaagcaatggcatttgtagaactaatggtgtccaggggttgttacccagacatcgtttcatacaacactctgcttactgcactctgccgcaatggggaagttgatgttgctattgatttgcttcatcaactcaagggcaaaggctgtagcccggtcttgattagttataacacggtcattgatggccttactaaggctggcaaaacaaaggaagcattagaactgttggatgagatgatcagcaaagggctccaaccagatatcattacttatacaacaatagcttctggtctttgtagagaagacaaaattgaggaggcgattagaacattttgtaaagtgcaagatatgggtataaggcccactgtggtgctgtacaatgctattcttcttgggctctgcaaaaggcgtgaaacacataatgctatcgacctgttctcttacatgatatcgaatggctgcatgccgaatgaatcgacttacactatacttgttgaaggcttggcttatgaaggcttggtaaaggaggcaagagacttacttggtcaattgtgctctagaggagttgtaaataagaaatttatgaagaaaggagccgttaagatgctagatggacctacacaaacttaggatgatcagttagtgtatgctatatgaacttcttcggcaggggactttcttgacagtacgattgcaattgcttaactgatgctctttctt

SEQ ID NO: 5362 - DNA, 994 bp, Sorghum bicolor
  Clone ID: SORBI-28MAY03-CLUS121785_1
gcacgaggatcatcatcacgaggcggacgcggtggcggcgccccacttcaggcgctcgttcacggccggcgcgcgggcgctgccgccgccgcacgcgtggctagcgatcgaggacacgaggaagcagcagaagcaggagcacgacgacagcgacgagcagtgggcgcgtgtcttccatggcggcgggatgcatcagcagcagcagcagcagcagtttcagaggcggagcagcttcagcgtggtgcggcgggagcgcgcggcgcgggaggcgtggctggaccgggcgtgggagatgaagcggagctggcaccagcgcaacggcggcgcccccgacgcggacacccccgtcgtggtggtggtgggggacgtcgccgagggcgtcgtcgtcgtccgactcccagcagcagcatccgcccatggcgtcgggcggcggcggggtggccatggacgtggaggaggtccgcgcgtgccgggaccttgggctggagctgccctccgactgcaccgtcgagatccagtgctacgggctgtccggcggcagcagccccacccacaccgccacccccggcagcggcgccgactcaccctccgccctctccagtcttcctggaggagcagcaggaggaggagcggatccgatggacgtgaaggctcggctcaaggtgtgggcgcaaccggtggcgcttgcatccaccacccatctcagttcatgatatatacggaatacgtccgggcctgcaaagtagttgaacaaattggagtgttccataataagttttttttttatttatatatagtcatcatatatgtaagcaaatgcgtcggtgcatcttttcttttcttccaaattaaatatacattctagatagctatagtctatataagtagtatctaattaatctccgcgtgtaatgtactagtctacactaagtagagtacttattactcttcgatttggaataatgtgtaaccgtcacagtgtgtgagagaccat

SEQ ID NO: 5363 - DNA, 1085 bp, Sorghum bicolor
  Clone ID: SORBI-28MAY03-CLUS12195_1
gtttatctgctttgcaaggagggttgcaagtgttgtccagcatcttgcagaagtatttggaatttcctttcgtggttcccaagtactttttcagagtaaggccttgccttggtgccgaactttacatgtttggttcgaatcctgtgaatgaaaaaggaatgtcaatagagcctggttccctattgtctctaaccctctgcatgaagtggaagcgcatgttagaaagaagcgccattcgcgccgtgaaattgtactgcattctagccacaagcttagagacctgcctggacgcagcaggaacgaggagcaagcagtttgatccacgtaggaccactgaaatggtcgaactgaattccaagctgctgcagtacataaagagtgatctgaggaaggccaagaatgaaacgaagaattcccattgtggcatggacatggtgactgcctttgcctgctttgaaccaaccgatagtgggcaggggttctcaggctgcctgctggatgtctcctcgttccctgaaggctcgtatcagataaagtggcacgcgtgctgtctcgacgagaatgggtcctactttagcctcctgccgctgaacgatggttccatcttctctatccggaagtcctgacctaatggccgctgcagtgatgggaatggaagatggaacacactttcttgtgttcatttgattggacccagaggcttgttatctgatctgggttgacatgttcactctattgcttgtgttgtgggcttgtggcagtaaattacagaggcctgtagagagcatgagctcatgaatgagccgaattcgctgccgatcttcaccttcctgctatcctgaacagaatcaacacaagcagataacatagattgctggatgaaacacaggtgtagctccagctttttctattctgaatctgacttcctcagggctttagttgagtttgaacttgtgtagaagcagtacaggttccagttcctctgtaccttttttttagcaacagttcctctgtaacttgtactctagagaaagatagtatagtgctactcctacaaggctagtacaataatacaaggcaatgag

SEQ ID NO: 5364 - DNA, 452 bp, Sorghum bicolor
  Clone ID: SORBI-28MAY03-CLUS12224_1
tggtaatcttgcgaagaatgtaacaacggaagttcttaaaaacttcttctctgaaaaggggaagatcctcagtgcaacagtctcccacattccggggacctcgaagtcaaaggggtatggctttgtcacattctcttctgaggaagaagttgaagctgctgttgctactttcaataacgcggaattggaaggacaacccatccgtgtgaatagagcttagattatcagaaatttgcaggagcactgaaggagggggagtatcttggcgaatgcatgtagtacgagggatacttagaggctagattttgataacaaagtgatcaattcgatatgtcaaacaatttttgtaccataacagtgtatgagaaggattttgcttgttcatatgattacatttttcttaccggcccttatatatgataacccaccagcagcatggtttcgtttcagtt

SEQ ID NO: 5365 - DNA, 730 bp, Sorghum bicolor
  Clone ID: SORBI-28MAY03-CLUS122093_1
gaacaccttcctgttcattgccaagtgcgacagcaacaccgactcttcgtgctactgccccagcgagatcttcatcaagtcggtcttcgactgcgtctgggcccacggcgagagcgacgagatcgtctccgagtccatcatctacatccagggtctctgcgctcctcacgtccctgagaacccggccatcgccaccggtgactccgttggcgtcgtccccgttacttcctacactgccgtgcccaccaccagcgttgccgccgtcaagaccaacgctaccgtccccagcagcactggctctgcccgccccaccacctccgttgtcatcagcaacggtgccggccgtgttggcgctggcctcagcgtcatccttgccgttgctggcctcgttgctgccctataagcaaacctatctactctggtagcctaggggagtcgacgagccatctagcttgtcggcagtggggagcgccttattttccttgtttgtattcaaccctccgtatacatagaagagaaatgggctgtgtaaaaaagcgaaggatgaggtaaccatagcggaaaaaggggtaaggggccagcggtgggcaagttggtcattctccttgcccattcgcactccttggggtgggacagacagacagtacaggcttggttccgatagtcaaccaatgatctctgattcttacgatccttacgacgcaaaaaaaagcattttacggttggcctt

SEQ ID NO: 5366 - DNA, 729 bp, Sorghum bicolor
  Clone ID: SORBI-28MAY03-CLUS12007_1
gcgcgaaatgttgcttaaagcaaaagcaccaacaaaggtggttgaggatttcattcaaacagtttacagctcagatcgatcagattcgatgcagacaaccttaagctagatcagataggcaaaggctcattgtttattgaaacacagaaggcattacaatggacttcagcaaacaaccatgtatatgagatttgatctgagtgattggtgcatgctaatgaacattggcagtggggtgagggcatatcttggcaaacacatgaacattcaaaattccaatccctttgccaaaaggaaataaaagagatgtgaagaggatgttgaagtcagtcggattcatggtgttggcatatacagtttggtgacatggtgtcatctatacactaatgaagctacaaaaggaaaccataccagcttacgtatacagcagtctgtgtgtggcataagttacccctgaagaatgcacacatgttttttttttaccatgatgcatttcccctttcccgggagttgcattctgtaactaaatctacgaaaacaacagtttgtgtgtggcagaagtgaaagaaattgatacagttgtgttgtacggttgtaccaattattcctgaaatattctttgacgttataagtgtatccttgttgagggcgaatttcacgtttcatccgccattccctgagtgcagctttaaagcttctcagaccccattgtatgaatattatgtagac

SEQ ID NO: 5367 - DNA, 619 bp, Sorghum bicolor
  Clone ID: SORBI-28MAY03-CLUS125416_1
agtcccgaaggagatcaatgacaagcgccgcgaggaaaatgagcgagcggccgagttgcacagttcctttttgatgaagatggctcgtcggctatacaagatgcatcaggaaaagctcttgacccaccacaacgacgagactgattggaaccggtggaaatatgctgaatctctccgtcggaacttcttctttgttaacatgataaacatcctcggggcaaaggcccgtttactcaatgaacagtactttgaaccccttggcgacgacatcgtcctccaacttccccttccagccacggagcatatgtggcgctgttgcgacgaagaggagtgggcgatagctcgtgagcacgcaatgcgtcggccggccaacagtcctcctgtggcccgaacattgcgcgagctgttagagcaagacaaggcagggaccttggatgcttctacgctgttgcccgttactcgactgattttcgcatgtgctaaggttgccccgaagggtgattcccttggtgatttatgatttacggccgcactatactagctttctttagttgtctcgaattttgcatcatggatatacacggtttcatctgtacacagatcgatgaatagggcggag

SEQ ID NO: 5368 - DNA, 491 bp, Sorghum bicolor
  Clone ID: SORBI-28MAY03-CLUS12544_1
tggagggatgaaagaagaaactttttgaccaacttcagaaaagaattccagagagaatcgtcgagcatgcggttcgtgggatgctccccaagggcaggctgggaagaaggttatttacccacctcaaggtatacaaaggggcagaacatccgcacgaggctcaaaaacctgtcccactcccaatcagggataaaagaatacaaaaaactggctagagaattccatcggttgaaaaggatgcagtgacgatttcctccccagaaggttttgccctttgttttgaatgtcatcttcataatcatgcctctgaccaggggggagtataaatcctctttgtaatttggatgtttaccaaagcatgaaattcagtcatatttctatcaatgagtagtcatgtaatctggtacagtttaaatcaacgtgaaatctctatttttctagttgaagtttgtaattttgccctgacatgatatgaggtggtagattgtttc

SEQ ID NO: 5369 - DNA, 729 bp, Sorghum bicolor
  unsure (1)..(729): unsure at all n locations
  Clone ID: SORBI-28MAY03-CLUS12550_1
ctactgggtgctgtccgcgaggctgcagtccttttctccacactccgcccgcgcattctgtccaacacctcgtcctctacatcctcatccccgccttcccaatccagaactcctaaaccctagcccttcttcccgccaccaccatccatccacaatcccaagcgggccatgcggaagaggtagcctccgccgatggcctgctgcttcctccgcgtcgctgcggcgccccgcctcctcctctaccgcgccgccgcttcgcggcagctcccgtcgccactcaccgtattcaggaagggtttttcggagcagtcagctctgccagtcacagactcgtctgagtgttttcaaggaccatcagtgcagaatactccacggattccactgtatgatgacagcatatcctcaagcatattagacacattgtcgaatccgactgaggttgtccctcatgctgatccttcaaagagcagaataatgctagttgacggaacgtcggttatgtacagatcctactacaagatattagcacagctgcagcacggccagttggagcatgctgatggaaatggggattgggttttaactatattcaaagctctatccctgcttcttgacatgctggagttcattccatctcatgctgcggntgtgtttgatcacgatggagttccatatggtcattatactggcatgccatncaaagaatgtcacatggcaaaagggatgacc

SEQ ID NO: 5370 - DNA, 627 bp, Sorghum bicolor
  Clone ID: SORBI-28MAY03-CLUS1258_1
cggcacgaggacatcatctacgacggccttggcctggagccacccatgctgcacgcgctggccaacgacatcgacgtcatcgtcaacatcgcagcaaccaccaacttctacgaaagatacgatgtgtcgctggatgtgaacgtgatgggagtgaagcacctgtgcacgttcgccaagcagtgcgccaggctcaagatgctgatgcacgtctccaccgcgttcgtgtcgggcttcagggagggcctcatcctggagagacgcatcaagccggtacagtccctgcgcgagggcacgtacctggacgtggacacggagctgcgcctggtcaaggaggtgaagaagtcgctggccatggcgaacgctggcgacggcgacggcgacgcgcacaccgacgtcaagatgacggagcggaaggcgatgaaggagctgggactgcagcgggcgcggcacttcgggtggtccaacacctacgtcttcaccaaggccatgggggagtggtcctgggccagcagctccgcggcgtctgcgccggcgacggaggcgacattccccgtggggtgatgcggcccagcatcatcaccagcgtgcgggacgacccggtgcccgggtggatgcaggggacgcgca

SEQ ID NO: 5371 - DNA, 787 bp, Sorghum bicolor
  Clone ID: SORBI-28MAY03-CLUS12600_1
ataaacgtcggatccttgtacatgaagcagggcatcttcttactgcctatctaatgggctgcccgatacgaggagtcattgtggatccatttgtggcattgcgaatgggcatccagggccaggcagggactcagttctgggatgaaaagatggaaaaagaactagccgagggtcatctatcaagtactgcatttgacaggtactgtatgattctgtttgccggaactgctgctgaagcacttgtttatggggaggcagaaggtggagaaaatgacgagaacttattcaggagtttgtgcattctactgaacccaccgctttctgttgcacagatggcaaaccgagctcgttggtcagtcatgcaatcttataacctcctgaagtggcacaagaaagctcatagagctgcagtcaaagcacttgaagacgggcatagtctcagcattgtaatcagaaggatagaagaagccttcgcctctgaaagaaaatacgacaattaatcctttacatgtgttcctgccaatcaatccttggcacctttcacaagatgcagagaagggcttccatactttgcacagagttttttttttctttttttttaaggtaaagcacaaagggagggttagtgtcatagtgtatactggaacagaaatgacgcttttgaaaggaaggcgaccgatccttgaagttaatagtgtagtggagagtggagacctgagcatatgatggacggactaaatctactgatgcattcgttggagattccaaggaactcaaaagttatgaa

SEQ ID NO: 5372 - DNA, 489 bp, Sorghum bicolor
  unsure (1)..(489): unsure at all n locations
  Clone ID: SORBI-28MAY03-CLUS125617_1
ctggacgccgccgtcacgtgcgacgagcggtacggacatgtcagggaggtcagcctgtgcatggaggacgccgagggcggcggcggcgtcagcggccgggatgggctggccgtggtcgccgcggccatggcaggcgccagacggggacgtggcgctgaagaggacaccagggtgcggtaccaagagttcgtgaaggggagggcggacaggaaggagcggaaggcccgccgggagggcatcatcgacctctgctgctccggcgtcggagcggcggcgttcgtggggttcctggtcatgctcacattccggtgaccgccacgaaagtgtacagcacaactgcacgagcaatgtaaatagtggaaaagggagagagatagttgacatgcgaactccacacatttgtaatttgtaaatagcacgtacataggccttgtttactttttaaaattttttataccaaatataaatagtaccaatttcgtttgtntt

SEQ ID NO: 5373 - DNA, 396 bp, Sorghum bicolor
  Clone ID: SORBI-28MAY03-CLUS123217_1
accaccaccaccaccaccaccggcggcggcggcgacagggagccggtgctgctcaacctttttgcctgatcgtcgaggccgccgatagatggatcgacgtgtgatgcatgtcaggacggcgggcggtttctttcttgaccaccgtgtgatgtttgtccgtcaggacgatctatctatcccggcggtcaggtgtttttctcttgtcgtcgccggcgaccggcgaccggcgacggcaacggcgaggccaattttttttgcccccttcgtttattagatttttgttgtgtagtagcagcagtagaaaagaaagtactagtagcagccggcctggaagccccgtttgcgtgtgggcgagatgagagcgccggtggccacccccaccccagtaactatttt

SEQ ID NO: 5374 - DNA, 545 bp, Sorghum bicolor
  Clone ID: SORBI-28MAY03-CLUS12322_1
gggatgttgaccacaccttcagtgattgtttccactggttcatctaatatgccagctgattccgggcagagcctcaaatatggtgggccgctggctgcagattggacacagcttgagcttgaaattctgagagatggcatggatgaatatgttcatgaacaaggcatcatgaagtatataaagatagcagcatcgttaccgaacaagacagtaagagatgttgcaatgaggtgccagtgggtgtagaagaaagtaaatacaagacgaaggaagccccaagaacaccatactgggagaaatacaaaagaaagaaaggataaatttgtagagccagcaccgtggggagcaaatcatcctcttcaaacaggcatgagagcctcttcatttgtgccgcataatgttcaaatatctggagcatgtgagatcgatcgtccagtgcagtatctaatcgaagttgttgcttccatatatcttcttttgttcttggtatctgctggtaacttgctagtgcaattataaaatattatgatctggcatttgaaaat

SEQ ID NO: 5375 - DNA, 643 bp, Sorghum bicolor
  Clone ID: SORBI-28MAY03-CLUS12344_1
ggcatttgcttgtgtttcaacaggccatcggttatttcaaaaaaaaaaaaaggccatcggttagctcgggttgctgaaattgcttttcgaaagggccttcagattcgccattacttttaccttagacgtcagaaagcgagaagagttcgtctgctggttgcaaccgagcacgatgctgtcattgcccagaacggcggcggcggtgacggtgtatgcgctgctcgctcttatcgccagcgccggcgccgccgctgcgggaggtggcgtgcagccgctgtcgaggatcgccatccaccgcgccaccgctgcgccccagccgggtgccttcgtcgacgcgtcgccggcccttctcggcctggagggggaggacagagaatgggtgaccgtcacatatagtaaccccaggccttcgaaggatgactggattggagtcttctctcctgctaatttcaatgattccatttgtccacaagagaacgaatgggtggagtcccctcttttatgcacagctcctatcaagttccaatttgcaaactacacgaatcgtgattatggaaacactggaaagggatccttgaagcttcagctgataaatcagagagagggtttctcatttgcattgttctctggaggcctgtcgaat

SEQ ID NO: 5376 - DNA, 840 bp, Sorghum bicolor
  Clone ID: SORBI-28MAY03-CLUS127183_1
gcacgaggctgctccggcctcgccgtttcacgctcggggtgaggttgtctttgtgtggatacgatacgataccaacgccggcctgctgcttgcggtgctgctccgacttccatttggacgggagcaccagagggttgcttcatcagggagccaagatgccggccggagggttctcggtgtcggcgccgtccggcgtggagttcgaggccaagatcacgccgatcgtcatcatctcctgcatcatggcggccaccggcggtttgatgttcggctacgacgtcggcatctcaggtggtgtgacatcgatggacgacttcttgggcaagttcttcccggcggtgctgcggaagaagcaggaggacaaggagagcaactactgcaagtacgacaaccagggcctgcagctgttcacgtcgtcgctctacctcgccgggctgacggccaccttcttcgcgtcctacaccacgcgccgcctcggccgccgcctcaccatgctcgtcgccggcgtcttcttcatcgtcggggtcatcttcaacggcgccgcccagaacctcgccatgctcatcgtcggcaggatcctgctcggctgcggcgtcggcttcgccaaccaggcggttcccctgttcctgtctgagatcgcgccgacgaggatccgcggcgggctcaacatcctgttccagctcaacgtcaccatcggcatcctcttcgccaacctcgtcaactacggcacctccaagatccacccgtggggatggaggctgtcgctgtcgctggctggcatcccggcggtgctgctcaccctgagcgcgctcttcgtgacggacacccccaacagcctca

SEQ ID NO: 5377 - DNA, 745 bp, Sorghum bicolor
  unsure (1)..(745): unsure at all n locations
  Clone ID: SORBI-28MAY03-CLUS127258_1
ggaagagcttgagttggagtttaaaagggaagctacacaattagctagagctcgtgaccaagaggaggatgaagagaaccacaggcatcgagagtcgctgagagtgattagagaaaattacatggagagagtgattaccatgaggaatttgcattcaaggaagtgggaagaatttcttgaacaaacctttaaaaggcaacaagcacagccttcgtacacacaaactggctatccaggttttgagcagaggacgacacatatctcagctacacatcaaccaatggattcaaagagaacatatccatatgcttctgatagctattcagccccaaaggctcatgctgcatatggtgagtttcagcatgagaggcatgatgatcttgggaggacctatgggcgatattaactgtttaatagtgggtgattgtgtgaggaatcagtgtcaatggtgttctacttaggccctcttagcacctattgctgttatgtagcttgagaaggtaagaattcatatgtaggcagaactctcttccagttgcttcttttgcagcgtctacaaccacaacggactgtggagctgttcccatggaattcaggcattgtaacaagctgctttgcaatgaactacactgaaatgctataacaaaaatattaacctgtgtgactattttatctgcttagcagaaatctccccgaattggcgtttgtgtgaacctagtatttttttcgctaacttgcacatgtn

SEQ ID NO: 5378 - DNA, 596 bp, Sorghum bicolor
  Clone ID: SORBI-28MAY03-CLUS127272_1
cgtcgcgctcaagtgcaccgcgcaggcctcggcgcaccgccccccccatgaccgacgtcgtggcgcagctccaggagtgcctccagctcgaggaggctcgcgccgccgccgccgccggcgacgtgaacggcggcggctactacaccggcggcagcagcagcagcgccggcggcccatactccggttacaatgcgtacggcgccggtgagggtggcctgtccactgacgtgagccagagcagcaccgggtttgaggtggagcacaattttgggagggtgccgacgatgcccacgggtcctgccgcgcggtagaggcttcgttgcccgtctgctcgtccaagccgctgtcttgtacgtacgtattttgtttttttgcttcacgaaatcatcgcgagctttttaaggacttcgtcaagtatcgtaaacgcgtgtgtacaaatgttcagacatttgaagtttgttcagttgcctttttttcttcggcatcgatgtactactactactacaatgtaatactgtatgtattggatctttccgctgtaattaggacactccgacgctttcttcggtcagtgcatgtgtatacgttcccattgt

SEQ ID NO: 5379 - DNA, 554 bp, Sorghum bicolor
  Clone ID: SORBI-28MAY03-CLUS127697_1
gcaacgaggggcgatttgacccaggcgtgtggtctactgctactggtatttgcttcattcgcatgcgatggaggtgaaggatgctgcgaagccgaggctgccgccggggttcaggttccggcccacggacgaggagttgatcgttcactacctccggcgccgcgcgctggcctccccgctgccgcccgccgtcgacatcccggacgtccgcatcctggcgcacgacccttccgacctgctgcccccagggttcagcgagcaggagcgctacttcttcacgtgcaaggaggccaagtacgtgaagggccggcgcgccaaccgcgccacgggggccgggtactggaaggccacaggcaaggagaagccggtggccgtggcggtcccggcgactcggggcggccagggccaggccgtgcttgtgggcatgaagcgctcgttggtgttctaccgggggaagccaccgacggggagcaagacggactgggttatgcacgagtaccggctcgcgggcgccgggctcgccccgtgccgccgcgcgacagcgcagcaggacg

SEQ ID NO: 5380 - DNA, 1103 bp, Sorghum bicolor
  Clone ID: SORBI-28MAY03-CLUS127690_1
gcacgaggctggaaggaggttgcagatgtgtatgaaacctttcttgttggttcttgtggacgtgtgttgtcatcagatgttccttcagctgactatattacagctgatgacacccttgacatgagtgtcctcactgtctttggagatgatattctgaaattgcaaaatgatgctccacttgaggttttgcaaaggcttgtgaactgtcttgatcactgtgcctcacggacaggatcgctgcctgttcaaactgttggccttttacccttacactgcagcagattttcgctgagctgtttgcagatgatgttttctttatgcagttctatagcaaagacaaccttgtgtgctgcagcatcagaaaccagcaaagtttcaatttccattcttatgaagcgatgtgagattatactgggtcaatttttagccgatgaaaatgatctaggagaacatcctttgcctagtgtgagggttgaagaaacgatctgtgttcttcaagagcttgctagactaattatagacattgatacagctagtgcactcaacatacctccatatctgaaacaagctttgggggaaaacaaatcccatggacgggctcatttattgtctttgcttcccactttttctgaacttgttatctcaagagaagctagggtgcgggagcttgtacaagtgctgctcagactcatttcctcggagctaggactgcatcggctgacataacaactaacgatgaaactctgtttctattcttttgctggaggagaaccatatagctttgtcagtattttccccttctcttacaaaattgattttgtatatccatcatgacaggcaaattaggtgcttgtcacatgtatctaggaacagagttgtgtatgtaacattttgttgggaaatatggtggctgtttctggagtcactaggtgtacagcccattctttcaacgttttctttagcgaggaatccatatgtcactcatgtaaaaaggttgtgccattcccctgtacggctgtatcttttgacatgaacaaaggttggacttgtctaagtacagaaacgcttgcccacgcggatcaggccttgcaagtaaatcaggc

SEQ ID NO: 5381 - DNA, 755 bp, Sorghum bicolor
  unsure (1)..(755): unsure at all n locations
  Clone ID: SORBI-28MAY03-CLUS12737_1
gagcacttttacgtgaacagtgggagagtctgttttcagcaaatgggaagcttcgtgatggtggaaaggcgcgtcgcaagaaagttcgcagtggtggcattgaaccaagcattagggctgaagtttggcccttcctactaggagtctatgatctgaatagctctgaagaggaaaggaactctgtcaagatcaagaaaaggaaagagtatgaaaagctgaggaggcagtgccaacaaattctgaatgggtgcaagggaaatgggttgaaggcaataactgaagttaataatgagtgttctagtttagaaggtactgccgaaggatcagaatcaccttgtttcgaagatggcaatgctatacctgctcctgtttcactcgaagagctgaaacctgaacagaatgaagctgaccaaccagagagcattccctgtgctgtcgttgaatgtatggaagaagatgcagatgagttagcttatgcatatccatgcatagcagagtcagaatcatctgattctgaatcatccgatgaggatgaccctggaaggatatctgtatctggcgaggagaactgtgatccagatcctaaatataccaggagcacttcattcaaggcagacttttttaggtctagcagaacctcagaggactntgccacatggcagcgcattataaggttggatgctatccggtcaaacagtgaatggattttgttctctcgcaaccaacctgaagttcccaaggagagagcattgcag

SEQ ID NO: 5382 - DNA, 1175 bp, Sorghum bicolor
  Clone ID: SORBI-28MAY03-CLUS12434_1
attgtataactcactgattgttgccaggccatctattgcttcagaaataaaacaccttggtcttttggctgaaccaatgccatctgtggatgacttagtggcaaggcagaatattcatgttgagggcttgcctgctacaccatctaaaaaacgtgatgctggtccagatgacaatgctgatcctcgatcaccaaagagatcgtgcaatgaatctaggaacacagtggtagagcacaatttgctgacacctccacccaagcaccacatggtgtcgactagtttgaaagcaaaatgccatccactcgagtccacatttgcaagtccgactgtcagtaatcctgttggtgggaatgaaaaatgtgctgacgtggcaattcagatattcttttccaaaattcttgatcaacagacaacattattctttaatagacacatcgatcaacttatcctttgctgtctttatggtgttgcaaaggcttgtaaagtagaactctcattcaaggagttactcaactattacagaaaagaagcacaatgcaaaccagaagtttttcaaaatatctatattgggagtaggaatagtaatgacgtattagtatccccccgggttagtatcattagtttttacaacgcggtgtttgttccagcagccaagcctttcctggtgtcactaatatcatctggtacttgtccagaagacaagaagaatgctagtggcccaattcctggatcacccaagccatctcctctcccaaataatttaccagatatgtccccgaagaaagtttcagcatctcataatgtatacgtgtctcctttgcggcaaaccaagatggatgcacttctgtcaccaagttccaggagtttttatgcatgcattggtgaaggcacccatgcttatcagagcccatctaaagatttggctgctataaatagtcgcctaaattagtatgaatctcaaaatgacactttccttcctacaacatggtttcatgtctacaacactaatttataccactccatttcttgttaaatttgcagtagcggccggagaataaacagtcgattaaactttgacatggtgagcgactcagtggtagctggtagtctgggccagccaaatggtggttctacctccttcaatcccgcagctgcatttagccccctttcaaaga

SEQ ID NO: 5383 - DNA, 838 bp, Sorghum bicolor
  Clone ID: SORBI-28MAY03-CLUS12443_1
ggcgaccgtggccttgctgcgctttctgcctgtcccaatcttgaggttctgttccttgtgaagacccctgagtgcactgattcgggcatcattagtgttgccgagaagtgccacaaactccgcaaactgcatgttgatgggtggcgcacaaaccggattggggatttcggactcatggctgtggcacgaggatgtccagatctgcaggagctcgttttgataggggtcaaccccaccgtgctgagcctccggatgtttggtgagcactgccggtcgctggaacggcttgcgctttgtgggtgtgaaactgtgggggatgctgagatcatttgcttggctgagcgctgggctgcgctcaagaagctctgcatcaaggggtgccccgtgtcagatcgtgggatggtagcactgaatgggggctgccccagtttagtcaaggtgaagctgaagagatgccgtggcgtgtcatatgagtgcattgagaacctgaaggttactaggggggagtcattttccatcagcttggatattgtgttggagcatgaagctgggagtgctagtgaaaatggtgtgcaggagaatggacaggcacaagttgctgagctgaccgatcaaatggcaggcatggaccttccggccaatgccgctggcgcacaatcatcgactcacaccattaacaggatgaggagtgtcatgtcagcgatccggcgtaggtttggcaatccgccgcccccatgatgtgagatggaaattaataactgtttcttacagcttttatctaatcatacattcatgtttcctaagcttatttcattgcaatatctggtccgtgcaagat

SEQ ID NO: 5384 - DNA, 677 bp, Sorghum bicolor
  Clone ID: SORBI-28MAY03-CLUS12513_1
cccccataccaatgaggatcaacgcaagcaattgctcagttttgctcaacgcactgtgcctgttggcacccatagttctcacgggtctggtagtggacccatgacataagattctcagaagaaatgagtggaagcatgagttcttattagtactgagtacttgctaaaaatggctctttaagggggtctgttatgctttcccctgaaagaagagaaggttaaacttgtcactagtactatgaatatcaagaaacaagagtaaagatggctggagcatcaatggtaatacacagcttcaaattttgtgtcactcaaacatgtctgtaatgattacttttgtagggtagccagatgtcggcatcaattttgccaatacctgtgttggttattgcaaaatgattcctgtgggtctgttgctctttagaggaaaccccaattggtctgtagctgttacttgaagacactgtttaattgctcttcaaggtggttcttttcaaggagtagttgccttggcctcaagatgtggaagttggcatagccacaacacgtccgtgagtcattttagttcttcaggaacaatgcggttgctatggaagttgtaaaatggttagtattgttttggtacggccttttgctttttgagatcctcattacaaccgaatgttgcccgtttctct

SEQ ID NO: 5385 - DNA, 550 bp, Sorghum bicolor
  Clone ID: SORBI-28MAY03-CLUS125245_1
cgaccatggccgcgcagagggagaagtccgcggtcgccgcagcggcacacggcgctgcggtgtcggggtctccttctccttcgtcctcatccggaggtccggcggcggcgtcgtcgggagagcggtggagcgccgcgatcgggaacctgggggagctcggcgccaacgtggacgcgctgcagaagctgctcgggcggaaggccgtcttcgtcgacgacgacatcttctccaaggcctccctcgccgccgaccaggcccgcaccattaaggtccttgaccagagggtgcagtctctggaacgcgaactcgatgctgccatttctgcagcagctcgagctcgtacagagaaacgtcaggccgaagctgcacagcgagctgcagagttacgcacacaggaggtcacaaaggaactggagaacactgcgagagtgtttgagctgcacatggaggagttgcggctgaagcaagaggagattgcgaagaaagatagcgatatcaaggtgttagaagcgataatacgaacccttagtagcaaagatgacacccttag

SEQ ID NO: 5386 - DNA, 895 bp, Sorghum bicolor
  Clone ID: SORBI-28MAY03-CLUS128596_1
gcacgaggagagacgaaatagagatttgctttgctccaagatcaagcctatggagtctcaacagcagcctaccattggccatatggctagcaaatctcctgaagaacaacacgagctgcaggaaggccaggctgtccagaatcctagcgcacttcaggttcaggctgacctcctatggaaactgaggaagtacttgatgctgctggctatcctagctgcagccatcacctaccaagcagggttagctccgccgggtgggttctggcaagacagcctggctcgtcgcatccctggtgatattgtgctaagagttagctaccccaagcgttactatgtgttcttctactgcagcacaacagcgtttggggcatcactcattgtccttatactgctcctggtcagggaattgagccgcaatgtggtttggcttggggcactacaatttgcaatggtactgggcctgcttgggctcatgggtgcctatgctgcagggagctgcagggaggtgaggacctcagtttacatttgggtattacttgttggcatatttgcatatatcacagtccatgtcatattcttccggcatctggcacctaaatgtctgcgggatatattcatgaatatccggaaatactggaaggatatccttgcaaccattttcaggaaaacacagagcaatgagccacaaactccaatgaatgatcgggaggctcatgatgagggggaagaattggagcggaatcgcagtttcttgctggttcttgccacattagcagcgacagtgacatatgttgcagggctaaccccaccaggtggcttctggcctgatgatgacaagcctaaccaccttgccggtgatccagttctgcgagatcattacccccgtcgattcaaa

SEQ ID NO: 5387 - DNA, 599 bp, Sorghum bicolor
  Clone ID: SORBI-28MAY03-CLUS128674_1
gcacgagggctccatctgctagctgctgatccatccaccacccatccatccaccggccatgagctaccaagcaggctacccgccgccggccgccaccgcgtacccaccgccaggccagcagcaggcctacgtcgcgccaccgccggcgtacccgccgacccaggacggcggcgcgtacgcctatggccagcagcagcagcagaccaccaccaccagccgcggcggcgacgacggtttctggaaaggatgctgcgccgccatctgctgctgctgcgtcctcgacatgtgcttctgaggacgacgacggcggcgtcatcgatccaccaccggggaagctgctagctgtcgtgctccatcgccctgtcctgcagggcagggcatagtagctatagctagctggtgaccggcggttgatgaccatcatgtgctgctcttttgtgtgcctgtgtctcatttatatacatatatgtatattctactcgtcgtagctactagagagtatactcgccttcgaattcactcctgttgttttacccgtgtatgaacgcatgtgttgggtatttgttgagccattcttaatatataatcttctgctttgc

SEQ ID NO: 5388 - DNA, 1087 bp, Sorghum bicolor
  Clone ID: SORBI-28MAY03-CLUS12888_1
tggatgatttttctgggtccaaatctgcctccgcagaagagcaaaggatccccatctcgcagtccgtccccgacccctcaccgttgcttactgatgatgcgtcgattctgttgtgtcaggcaggtgatccgatcgatggcatgcctccccatcaagcccctggacggcgccggcggctacctgcggtggaaagaatcgttgctcctccgcgtgcacaccctcggcgtcgcctacgtgctctccgaggcccctcccgccggcgccggcggccacgacgccgccgccaagaagtgggcgcgcgacgacgcggtgtgccgcggccacatcctccgcacgctctcggaccgcctgctgccggactacgcccgcttcgccacggccgccgagttctgcttcgacacaagcaccggagatgtcttcctggagcagctcgcgcacgcggaggctctgggcgccgccgcagagctcagcgatggcgccgtggccatattgctgcgtagaaagatcccgtcggggatgagcttgacgaccttcaccggtgatgggaagaaggcgttggagtcaatctgggaggtcgcacggagggctgcggcggccgggatggatccttggtacaaggagaaggagatggaggacgactccgacgatggcgatggtccaccaatacctgagcagaccaggaagcgtgccatgtctgaacacgttggcaggcgcagggcttgatcatgggcttccccaacgctagctgtggatgccaggcgcagggcttgtaggagttttctgtaatctagatgctagactgaattaaattatgcctgctaaatgctcgctgacgctatgcataatgcacgtccgcttgagatgctatcatgcattttcaggcatgtttagtcaagaatcaagaccagctaggaacctagctatggacttgcaagaaaacactgcaaggatgatcctatgtctggatggaatgtatgctatttccttgtgtagaatatggtcaagcagcgatgactaagattaaatcaacggagatgctgtcttggtaaatttgttgaactcacaaattatgccaagttgcataaca

SEQ ID NO: 5389 - DNA, 771 bp, Sorghum bicolor
  Clone ID: SORBI-28MAY03-CLUS129776_1
gcacgaggctcccgtgcttttttcctccgagcgcagagccgccgccgccgtagaggaccaagccaccagggcgacggcgagcgccgtcccgttccgcccctttcttgctgcaggcgaacgccatcccgtctcttgctgatgcagaggagccgacctacggctgcgacgccgagctggagctggaggccacggcggtttcacggagcaacagctggggtcatatcggccgcggatgcggagtaggaacagccggtgcctaatcggatcccgtcatatgtttccaaccgggacagaagagtcccaaatttactctccttcccgccgatgcgtattcggattctggttcaatcatccaatccaaatctagcgcgcgagggaggtggtccacaaatatatatatatacggaggctactacgatgattgatgtgtaaacagatagcatcgcagatctgcaggagaacggaaactccacgagagatctcggggagggtggtgtacttcgtgtcgtcttccactcgtaccatgtggattcagagcgagacccaggagcgtcagcaagccacctcagcccggaatggatccgttgctacggtggacgaaattaaggactcaccctgtcaaggacatggtgatggcaattctcaagatggacaaacattcggatattccatcccatgccttcctgaggatatcttgcgtcatattcattctttaatgccaatggatgctgctgctcgtgctgcttgcgtttctcgcacctttctaagctc

SEQ ID NO: 5390 - DNA, 540 bp, Sorghum bicolor
  Clone ID: SORBI-28MAY03-CLUS128959_1
gcacgaggctcagcccatcagtagcagttcccatcaatcttcgatccatcgacatcgttcttcgaccggcattcaacatgaagctctctcttctcatctctcttctgccagtggcgcttgccctgcctgcgccagtcatcgttccccgtgctggcactcctattccaggacgttacattgtcaagatgaagaaccagaaccttgagaatctcatcaacaccgccttgaagcttctcaggaaggaccccgctcatgtctacaacttcggtggcttcggtggtttctctgctgacatggctgatgacattgtcgagctcctccggaacttgcccggtgtcgactacatcgagcaggatgccgttgtcagggccaaccttggagagatcgagaagaaggcttatgtcacccagtcctctgctacctggggcattgcccgtatctccagccagagccccggtggcagcacctacacttatgacagcactgctggtgccggtacctgcgcctacgtcatcgacactggtatctacactgcccacc

SEQ ID NO: 5391 - DNA, 443 bp, Sorghum bicolor
  Clone ID: SORBI-28MAY03-CLUS1263_1
gcacgagggcgagacagaggagatcaatcaatgtattaccagccgagctgagctgagctgagctgagctgatcaccctctctccttcccccaccgtccccgttctctctcacaagaatcactctcctctcagatctcacagccaaaaagagaggagctttaaccgccgggtacggtgggctcaaaggtagccatggccaggcggcggccaccacgattccacgcccgtgtcgccgccgccgtgttcctgctgctgctgctgacccccgccccgacctcccagctcggcctgggcgccgccattgccgcctggatccacggctcgccgcctgctcctcctagccctagcactgacgacgacaccgccaccgtcttctcctcgggcgcgccggccagcagcccacggagccaggagtacgcggcgctgcaggcgctgaaggcggc

SEQ ID NO: 5392 - DNA, 695 bp, Sorghum bicolor
  Clone ID: SORBI-28MAY03-CLUS126780_1
cccaatccctattttattcctacaaatagaacatagctatatgaaatgatctactaactcatctcagatgcaagtccactttcaatatatctctgtatactgtatacacggatacagaatccgctatatccgtttgtgaaataaaggctaaatcccctcccctcaactccatatccaaataaaagcggtaaggaaaaagttttaataaaaagaagaatcaatggattcatgattaaacccctcctacttcttgtattttcgtacaattttgattaagtgagggatcaaatagaaatatgtagtcaactttatttgaaggtagtttggaggatcataaatatgactattgctttccaattagctgtttttgcattaattgcgacttccttagttttagtaattagtgtaccccttgtatttgcttctcctgatggttggtcaaataataaaaacgttgtattttccggtacatcattatggattggattagtctttctggtagctattctgaattctcttatttcttgaatttgtttagtatttagtaacccgatacaaaataaataaaaagaaaggcccttttttcgaaaaaattcggatttttatacacattaaaatgctattttcgttccgaattattacctattctctttccattattatgaaattctattgccattagaatattgattgat

SEQ ID NO: 5393 - DNA, 526 bp, Sorghum bicolor
  Clone ID: SORBI-28MAY03-CLUS126977_1
gcacgagggtcattcccttcttagaggttctgtctcaaggaagttccatgacgaccccgtacagaactctgcttcacgggcagaactacacaggcaaaagcatagcacaaatgaagatcaatacgcaggctgttcaagatatgcagatatatgctgatccttcacgtgttcctgttgttcttatagaacaacatgtcatggttgttccacagcatacttccagcaaggatctggcttcgaatacttctgaacaaaaggatactattgtgctacctaaactacaaggagagtctctggtgcccaaaagtagtgctggtaaaaaaagtggacgcatcttgcgagctgtcatttttgtgcatggttttcagggtcaccatttggatttacgtcttgctagaaaccaatggcttctattggatcctggagctgattgcctaatgtctgaggctaatgaagataaaacatctggagacttcaaagaaatgggtagcaggttggctggggaggtagctgccttcctgaagaa

SEQ ID NO: 5394 - DNA, 1054 bp, Sorghum bicolor
  Clone ID: SORBI-28MAY03-CLUS1271_1
gcagaatcaacgagttcttctcactgatgtcaatagagctaagtacagtttccagctacagaaatactaatttgcagtaccattaaataattctaacagcaactcataaacaacaccaatctgtccaaaattcagtaccaccatgcttgttcgcttgagtttgtcagccaaatttgctagccattcagcaacttttttttttcataacaaatcagccaatactttctgtttttcataacaaatcagctgaacctgatcacatctccagaccagttttattcagcagatgaaccttgatgaactcatgcacttcagccaaccagcctccatatcagaattcacagcctgaggttcaagtcgatcttactctgctcagacgcttgctcatgctccgacgagtgttgtgctctcagtctgaagctcccaggccacgccgaactgggcgccacctcctcgcaggcgatcgtgccccaggcggccgccgccacgccgccgccgtcctcgaggaacctcgccggcgccgttctgatcggcgccgcctgcttgtggatcgccgacgaggccgggttgacccggagcgagtgcatgagcgcggcgtgcgcgtgcagcggcaggcccacgatcatccgctgcgcgtggtacgaccgcttggcggcgctccgctcccgcttgtgcgcgttctggtgcccgcccagcgcctgcgagctgaagaacttgcgcaggcagaagttgcaggagaacaccttgtgcggggcggcgccggcggcggacggcttgttggcgccgggctccgacccggacccggacccagactcggcggagcagctcgcggctgcagcagccgccgccgcgtccggcgagggcgattcgctcgcgcccagcgtgaggttcagccacgtcgcgccgtcttcgtccctggtaagctgctgctgctgctctgggctctccttgttcactgacgatgcctcgtctccttgctccatctctcttgatttgctctggaggtcgctctgcaaggttgaagcttgttcttgctttaggttgcccctcgtgc

SEQ ID NO: 5395 - DNA, 1281 bp, Sorghum bicolor
  Clone ID: SORBI-28MAY03-CLUS13093_1
gcacgagggtgcctcacaataatggtgcaggtctgctgtctccccgtgcctcttcatccattgacatgactgctgctgctgctcttgggcttctacctggatctcctactaggcactttgtgccaccaccgctgtcaccatctgccgccaacaatggtggaggtgctgctgctgctcattggctccaaggcagcaggctacgatcttctttcaatgcaagggatgcacaggttgatgaccttggcgcgctcctggaatgggaatcacaataccttggagcgctcagcctcccacaaagcagccgatcccagccccgtctttctactggtctgagtattcgtccaacaggaattgctccatccaaccttgaagagatgtatgcttcagacatggctatgtcgccaaggttcaccaatgaccaaggtcactcagtctactcaccagcacacaaatcagcccttctaaacaagtttcatcatcagcaaaagggccttttgtcgcctgtcaataccaacaggatgtactcacctaagggtcttgatccatcaattctccattatccatatggtggcatgtctcctcggtcccctcggactatggagccaacatctcccctaagtgtctgtgttggagcaactgttacacagcgtgatatgttggatcagttctcttcactgaataagcatcaagtgccatctgtgggatcgccacggaaccttaatgcctcatggggcaacattggtaccccaaagagtaaggtcgactggggtgttgacgacgacgaactagtccgtttgaggcaccctgtgcaacctggaaatacagcagaggagccagatgtgtcttgggtgcagtcactggtgaaccatgctgagctgaatggcaagaggggtgaaatggcaggtatggcttctcgatcgattaacaggcctgacctgagcagtcagggtgactcactggatcagagtgttattgcttcttggcttgagcagcagatgcacttggagccgaagtaaagaggccttttgctctcaaggtggacgaaaccatctttttgccgagttagtttccgagaagaatagttatttgtcctagtaaataataatattcttttttattcttgaaatttttgttcgcaaagtcagagatggtggtcttcaggaaaagcattcgctcacagattggtagctgaaagcagctgtcgagaattggtaaacagcctcgttaccttggaggtcctaactagtattcttttgattagttcagatgaggtaaaaaatt

SEQ ID NO: 5396 - DNA, 576 bp, Sorghum bicolor
  Clone ID: SORBI-28MAY03-CLUS131383_1
gcacgaggcgacctctccgccgccgggcccatcgtccgcgtccccctcccggagctcaaggaccactgcgttctcgactcccccgatggcctgctcctcctgcagcacgacggggacaacgccatccgcctgctccacccgttcacccgcgacgtcgctgagttcccggacctcaagtgccttgcccatcagctgtcagggccctgtcagctgtaccaaatggattacgagttcatcgtcaatccctggtacaatttgaatagctggctgcagagcaccgcgcgatgcttgtatcaagcccgcaagctttgtgctgctgtcgatgtcacccccacgggggccatcacggtgatgctagcccttcatagcatccggcgtgtggcatttgcgtcggctggtgatgctggatggacagtcagcagctggaagatgaaccaactggacaggcactgtcgttccaggggaagctctatgtggtgaattgggaagatgggctaatacatgtcttgcagattgacccgccacaactggtagcacaatgcgaaggggaggattcttcacctgtgctagcattcc

SEQ ID NO: 5397 - DNA, 712 bp, Sorghum bicolor
  Clone ID: SORBI-28MAY03-CLUS131091_1
gcacgaggccttgcttgccgttctcgccgccgccgccgcactgctcgtggcgccgcccgtcgcagcttacccgtggccagtgtgcggccagagcaactacttcaagcctaacggcacataccaggctcatctcgacttcgtcgcggccacgctgcccaagaacgcctccgcgtcccggtccctcttcgccaccaccgtcgtcggcaccatcccggagcagctctgggccatggcgctctgccgcggcgacgtcaacgccacggactgcttcacctgcctgactcaagccttcagagaccttccgaacgactgctcctacgacatggacggcaccatctactacgaccgctccagcctccattactccgacgtgctcaccttccccggcgccggcaccggcccgacgaccgacacgtacgccgtcaacttcaacacaaatgtcacgtcggacccggcccagttcacgagcctcctggccgccctcatcaacgccaccgtcgcgtacgccgccgacaactccacgcggctgttcgcgacaggggaggctgacttcaaccacgagttccccaaggtgtacagcctggcgcattgcacgccggatcagacgccggcgcactgtcggaactgcctcgccaaggccgtagcgaagtaccaggggtcgttctatgactacatcggaggcagggtgcttggcatgaactgcaggtaccgg

SEQ ID NO: 5398 - DNA, 707 bp, Sorghum bicolor
  Clone ID: SORBI-28MAY03-CLUS13157_1
ggcaggcagtacggcacgcctcaagcgcgcgcgagaggcctgagccggagccggagctggagccgcctgcctgcctgcctgcctgaacgcctccctccctccagtaacgctgcctgcctcacacttgccctctcctcctcacactttccccacccccgtcggcgccggccgatccaccgccaatctaatctcaccgcgcgcgcgcatcctcctcctccccctcgccgtcccgttccaagagcggcgccggtccgatgggtcgtccgccgagcaccaccggtgctccggcgttccgcttcctcccgtccgaggtggcggagatggaggcccgcctgcagcagctcaacaacggcatcccttcccgcggcgtgctccagaccctcgccgataagttctccgcctcgcctgagcgcgccggcaaggtggccatccagcccaagcaggtgtggaactggtttcagaacaggcgctactcgcaccgtgccaagtccaccagggccgtgccgtcgccgccggctaagatgacgccctcgggggccgatcaccaccagcacgccgccaacgcctccgccttcagggccgctcagccctcttctgtcgctgctgctcaccatggcgcctccccaacagggaagaaccctgtggaaggtgtctcggttgagtttgaggccaagtcagcccgtgatggtgcatggtatgatgttgct

SEQ ID NO: 5399 - DNA, 1029 bp, Sorghum bicolor
  Clone ID: SORBI-28MAY03-CLUS13170_1
aggcggcgctcgacagagaacaacacggcggcgaccggatctcgccggaaaattgaggggtgagggttcggagtttggtaggacctccctaccgccccttttagtgggtccgccgctgctccaacctccaggtccaggcactaggtcgctcctcccttctcttccccacggcaccttgtccatcgtagatagcctccacttcaccgaggtcgccacttccacgtatccttctcgcctagttgccgcagtccttctaccctgcttggcccgaggggaatggggatccatcctgacctgagtggattcttctttttttggtagtcgcgcagatttggtagccgtgtgacgtcgttgtgcttgagtccattcagacattgttcttatttgatcagcactccttatttagtgcacgcaagttcgagatcgacttgactctataagacgtattggggtgtcttttactccaacgtcagactgggagtgaatccgcatgccccaagaccgcccttccactgaactgaactagacatcctcaagcatcatcaattctaatggatgatgcagcaggaaatattcttgcatcacttggccgcgtgcatctagttgatctcatggcctctgagggcctgccttctgacagctataagatgtgtgtatcaacaatgatgcagtcactggctcagtattcggcagtcatcattcagctgtcaccagctgatggtgccttgttgaggtcaggtttggactcggctcgctttttcttccaccagcgagggtataattcgaacgaggctgtccactcagatgattcccgtgaatggtgtaagacctctggttactatgttgatcatcagatgtgtctggaaatgtatgattacaggcctggtattactgcaacagatcccaacggtgaaatggaattgcctccgtcaggtttgcctgacatattttcggtgctgggtaaagtttctcgagacatcttggatgcaatcagtttctcattgaatttgcgtagctgtgcattctctg

SEQ ID NO: 5400 - DNA, 724 bp, Sorghum bicolor
  Clone ID: SORBI-28MAY03-CLUS13182_1
cctactgggtgctcggattcccccctcttctctcacctctcttccatgcgtggtcgctcttccgtctctcccagtgcagcagtcgtcttctctaccttcctcgcctatccagtgctcctcatctaacaactgtactaaaactagcagcaagactgcttctgcttgtacgatagcctgtacctgtactgtgctgacattatataccctccccttcttgctcgtgccaatcgccattgccaaccaccacgtagagctgcattgctttgagggatcaaggccatgggaatcgcaacaggagtttgcttcgtagttcttgttctgatctgtacatttctcagagaagggagagcggcgacattcacgttcgtcaacaggtgcacggggacagtgtggccaggcatccagtcgaacgccgggagctctcggctggacccgacgggcttcgtcctgccgccgggcacgtcgcgcgcggtccaggcgccgtcagggtggtccggccgtgcctgggcacgcacgggctgcgcgcaggacgcgagcgggaaggtggtgtgcgccacgggggactgcgggtcgggctccctggagtgcaacgggcagaacgcggcgacgcccgcgacgctggccgagttcacgctggccggcggcggcggcgacgacttctacgacgtgagcctcgtggacggctacaacctcccgatcctggtggagcccgcgggcggcgcca

SEQ ID NO: 5401 - DNA, 1039 bp, Sorghum bicolor
  Clone ID: SORBI-28MAY03-CLUS127702_1
gcacgaggggccagtgctggtgcttgtgctatgtatgtgtgcttgagctcaaccccttcttctacctccagccatagtgagtgagtgtgtgggtgtgctggtaagctaattgcttacctgggcaggatcccagggaccaacaagtggtatcggagccgtacagctgcgtcgccgaactaaccgccggcgatggcacctggctcggagacagctgacagcaacagtgctgctagggctgcccagccacgacaggaggtcgttgtgcgcacggtgtgggaggtcagcagcacatgttggccgatgctaccttaggtgagcttgggttcaatcgctgcgccacagagcatgcgctctaaacgcagcgacgggggaaggaggagctcgtcgtctgcatgtatgtggatgatttgatcgtcactggagcgcgagcggaggacattgatcgcttcaaacgcgagatggtagctcgcttcaagatgagcgatctcggcatgctctcctactacctcggcattgaggtgaggcaggggaaggagcacatctccctgttccagcgtgcctatgcagagaagctattggagcacggcggcatgacagattgcaagccatgcacgactctgatggaggagcggctgaagctaagcaaacacagcaccgctgcaaaggtcgacgcaacgcgctaccggagcatagcagcccactaatgttatccctccattttttgtccgaaacccaagtgttgcatgacctcaagtaagaagggccaagcaaccgaatcaaaagcctttgagatgttaagtttcagtaacactgaactcctgcctcctttgctttagagaagtggcaaagcctgaccaaataggtggtaacttagcgataatactgcgagccacaaatttgtcagttaactcacactcattattcttaagctgtttaaccagcatatgtatttcatgagccattctactatagatcggtcatcgaccatcttgtagtcatacaattgctccatgatgtacagctcactgccagcatcagg

SEQ ID NO: 5402 - DNA, 631 bp, Sorghum bicolor
  Clone ID: SORBI-28MAY03-CLUS128101_1
cagctggaagagctgcaggatgattcaagccccaattttgttgaggaagttgtggctttgttcttcaaggattcatcaagactgctgacgaacatagagcaagcacttgagaagtaccctcaggatttctaccggttggattcgcttgtgcaccagttcaaaggcagtggatcaagcattggcgcactgaggatgaagaatgagtgctccatgtttaaggcccactgcaacgacaggaatctggaaggatgccgccggtcactccagaagatgaagagggagcatgccactctgaagcagaagctggagacatattttcatttgctgaggcaagtcggtcctccagaacgcgcggtgaattcatggaagtaacaagaatagctagcatgggaggcagttccaagggtgggctctctctgctcctttggaagagtattgtagactcctcaagttttgctcagttactggtgtgcccttttgctgctaatggtgtatgtgtctcgagtgtctctgtctgtgcgtgggttctgtaccgtctggtgtctgtgcgtacaatttgctcgctcctttggttgtcgatggagcgtcacagtgcttcttctctactctgaaaatgtaatggcatcaatat

SEQ ID NO: 5403 - DNA, 600 bp, Sorghum bicolor
  Clone ID: SORBI-28MAY03-CLUS12836_1
gcacgagggtcatatctcactcccaggactttctgaatggtgtgtgcactaacatcatccatatgcagaataagaagctcaagttatatactgggaactatgaccagtacgttcagacccgttctgagcttgaagagaatcagatgaagcagttcaagtgggagcaggagcagattgcatcaatgaaagagtacattgcacggtttggccatggatctgcaaagcttgcacgtcaggcccagagcaaggagaaaactcttgcaaagatggagcgtggtgggctcactgagaaggttgttagggataaaatactggtcttccgcttcacaaatgttggcaaacttccaccaccagtgcttcagtttgttgaggtcacgtttgggtacacaccggataatctcttgtacaagaagctcgactttggtgttgacctggactctaggattgcactggttggtcccaatggggcagggaagagcactctcctgaagctgatgacaggtgagctggctccattggacggtatggtgaggcggcacaatcacctgcgcatcgcacagttccatcagcacctggcagagaagctggacctggacatct

SEQ ID NO: 5404 - DNA, 1312 bp, Sorghum bicolor
  Clone ID: SORBI-28MAY03-CLUS12843_1
gcacgagggcttttcttgccatggctgctgcagctgctgcttccatcacacgatgtaacggcgttccgtttcacagtggatgacttccctgacggatttgcgtttggagctgggactgcagcttttcagtatgagggtgcagtggatgaggatgggaagagcccaagcatttggaacacttatgctcactcagcaagaaacccgaatgagcacagtggtgattttgctgctgatggttatcacaagtataaggaggatgtaaagctaatgaaagacataggcctgaaggcttacaggttcaccatatcttggtcaagactaattcctaatgggagaggagcagtgaacccaaaagggctgcagttctacaacgatatgataaatgagctagtgaaagaaggtattcaggtacatgctgccctttaccatctagacctcccccaaattcttgaggatgagtacaatggatggctgagccccagaattgtagacgacttcacagcatatgcggacgtttgttttcgcgagtttggcgatagggtggcacactggacaactatgatggaaccaaacatcattgctcaaggttcctatgatactggaatgcgggcccctggacgttcgctcatatccatccggccatgattgcacagctggcaactccagccgggagccttacctgtttctacactacacactgctagctcactcctcgggtgacaggctataccgggagaagtaccaagctgtgcggaagggctgtgcgggcataaacctctactgcttgtgcatctactcattgacagatttagctgaagatatccaggcaacggaaagagccaacgacttcttgtttggcagcatcctgaaccctttcttatttggagactacccggagagcatgaagaaggctgccggtgcccgccttccgtccttctccagctatgaatccgagcttgttaccggcgcatttgacttcattggactgaatcactacagctccatatatgcgagcaacaatcctgatgcgtcaaagatgcctgtgcgagatcaagctgctgacgttggagctttgttcagaggttaaagctgctgtaaacttctacaccagggacgggccagctgctatacagtatccagcaggcacaatggttgatcctcaagggctagagcatgtactcaaatacattcgtgaaaagtacgggaacatctcaatttatatccaggaaaacggaaggcctgatgacagcctgatggatgtagacaggaatgacttcctgaaggtgtacattgcaagcacattgaaagccat

SEQ ID NO: 5405 - DNA, 726 bp, Sorghum bicolor
  Clone ID: SORBI-28MAY03-CLUS12852_1
gttctagatcgcgagcggtcgcccttttttttttttttttgacaattcacatcaagcacggtaaaacttattgaagccgacatacgcggcttattctgtctcggtcccaaatatttcgttgctcagtgaatgatgacgatcagaatttggcatcggtttatttgctagccacagaaaaattaagcaaacgggttgctaaatgctactgctatagattggcaggaagacatgcccgtgactcctgctgcttgatgctgtctgcaacgtgcgcgataacaccagcaccagcattgtgaagccactcgttctttacatgtatgttgttgtgagcagagtaaggccagaatgatgaatggaagttgacgtccaccttcttccaaccaaccttctgcaagccatggatcatctcctcctccatcatttggtggtatccttcggtattttccctgtttggcgttcgctgtgcagcttctttagctctggcagccttggaaggaaaatgagggccctctgatgatacgggtgaacagtattcaacattcacaatgtgcttatagccatccagtgaacgatgcaagggctttataagatctttttctctccttaatgaagatgttcgccagccgaccatgtggtcatatgaaacgttcgcatacaggacacggttcttaaaagctgctaaagctaatatgtactttttgtcatcacagtcagatgccatttgta

SEQ ID NO: 5406 - DNA, 1027 bp, Sorghum bicolor
  Clone ID: SORBI-28MAY03-CLUS13303_1
aggaagcagcaagtgagcaagcatagtagctagtacgaagcagctggaaccagcaggtggacatgtcgtctccgccgccgccgccggtgaagctgatcggcttcttcggcagcccgtacgcgttccgcgcggaggcggcgctgtgcctcaagggcgtgccgtacgagctcattctggaggacctcttcggcaccaagagcgacctcctactccaccacaaccccgtccacaagaaggtccccgtgctcctccacggcgacgacagggccatctccgaatccctcgtcattgccgagtacgtcgacgaggtcttcgacgggccgccgctcctccccgccgacccctacgaccgcgccaccgccagattctgggctgacttcatcgagaacaagctcaccaagcctttcttcatggcgatctgggtggaggagggcgaagcgcggctgcggttcgagaaggaggccaaggagctggtggcgctgctggaggcgcagctcgacggcaagaagttcttcgccggcgacaggccgggatacctcgacgtcgccgcgtcctcgctcggcccctggcgcagcgtcatcgaggagctcaacggagtgacgctgctcagcgaggacgagcaccccaacctgtgccggtggagcagggactactgcgcctgcgaggatctgaagccgtgcatgccggatcgggagaagctgctcgcctacttcaccaagaacttcgacaggtacaaggcggccgtcaatgcgacgttatcgcagtcgcagtagtgaaaagtctgtaactgggtacagtactacacctacacgtcgtctctgcgcgtgtacggacacgaatggcgcgcgggcttttcttttcagaataacgtagatgtgcccagtgaaattcggagtatagtagtactgatgtaccgtagttccaagttttcaattctgcaaaccaacaagttatcactttttttatttactgttgtacctgagtaccgctgtaccagtgcaattgtatgcagagttcttatttcacc

SEQ ID NO: 5407 - DNA, 585 bp, Sorghum bicolor
  Clone ID: SORBI-28MAY03-CLUS133192_1
gcacgaggcgctcctcggcgagcggaggctcgagccgccccgcctgaaggagaaggaccccgcccccgcccccgcgcccgagccgagcaggcgctacgcggaggtttcgcggctgcttatggcgggcggggcccgcatccccggcgtcgtcaacccgtcgcagctcggacactggctccagatcaaggagtgaccgggtggccatgccgctggaggtcggctgcacgcgacggcatggccgcattgcctactgcttcgcctcggcggcgaccgacgatcagaggaaccgttgcttttgaacatagcaggcggaaatttagtgtagttgttggacgagaaactgcaggcactactactactgctgctgctagcttttgctgcgtcggttcacattttctctcccgctgaaatcctctgcatcggcaaaaaaaaaacctgtaatgcatggcgtggatgaatccacctgtacgtacatgataatgcttagtactagcttggtactgttaccagtaaggattaattaagcaccatcaatgctttctgtgactaaaatccaaatgcatgtggttctcgtatttggtggag

SEQ ID NO: 5408 - DNA, 740 bp, Sorghum bicolor
  Clone ID: SORBI-28MAY03-CLUS13384_1
gcacgaggatcgaattgatgctggagaaggagagcagttgaagaacttgatactgagtgagagactctcggaacttgttcctaaactgaaatacagatcttttgctagttcagtcttgaaaaagcacgcaatgcgtatcataatatggtttcttgtcttgtttggtgtttgtttgaccacattctactacagtaaaaataatatcaattcaaagtattatgagattctagactgtcaagatgtactgctgtttatatgattgtgtactagcgtttacatgttaatgtagcgttcccacttctgcaactctccagagttccgcgatacttggacgtttgtgaaccgcagaataaaggatgctcttgatcttcagaaaacattccaagaggccgcatacctggctgaagccgtgggagcaggcatgggcggcaccgtgcagggtgttctcaacagggtcttccagaaacgtagtggatgaagtttttctttcccaaacacgtagtggatgaagcacattttcccgttcaccaactggcgtatgtctataataaagcaaatggtgatgtggttgagatgcatcacgttagggtagaaagtgaagatgtgtttgctggtggtgatgtttagctgcaggtttttcaaatgagtgctcagatcgcgcaggctcagtccacatgcatgtctggcgctggtgagcgacatcaacgctaaacacaacattttaagtgaaattttatttt

SEQ ID NO: 5409 - DNA, 348 bp, Sorghum bicolor
  Clone ID: SORBI-28MAY03-CLUS134391_1
gcacgagggaaatgattgaagtttttctatttggaatcgtcttaggcctaattcctattactttagcgggattattcgtgactgcgtatttgcaatacaggcgtggggatcagttggatctttgattgagtaatatttcttttttgattgacctcctctctggtctggaggaggtcaaattggagttgcaattctactttgtttttttttttaagttattttagtttcgatataagatatatggaatcacgctctgtaggatttgaacctacgacatcgggttttggagacccgcgttctaccaaactgaactaagagcgctttcaaaacaaaaaaaaagaaaaaaaa

SEQ ID NO: 5410 - DNA, 671 bp, Sorghum bicolor
  unsure (1)..(671): unsure at all n locations
  Clone ID: SORBI-28MAY03-CLUS13472_1
cgaagaactcaggaagggactgcgattgatcgggcacaatgtccatgacacagatgtggatatgctcatggaagctgcagacatggacggcaatgggaccctggactgcaaagagtttgtgacagtctccattcacctgaagaaaatccgcagcgaggatcacctgcccaaggtgttcagctacttcgacaagaatgggagcgggtacattgagatcgaagagttgaaggaggccctctctccaagaggtgacgagaaggcgatcgacgacataatcctagacgtcgacaaagacaaggacgggaagataagctatgaggagtttgagctgatgatgaaagctggagtggactggaggaatacgtcgaggcagtactcgagagcggtttacaacaccctgagccgcaagatgttcaaggatgtgtccctgaagcttgacattaacaatggcccccttgctgcagccgtcaaagaacaacaagcggttgattgagtgatgtctctactagctacctgcaagctcaactaaaaaacagagaatccgaccactgtccccagttttccatgttttgtgtataggtcgccacattttggcaagcaaatgtatcaggggcggtcaattgactcagtttcaggtgcatagtcnagggcactcccagaattacaccatt

SEQ ID NO: 5411 - DNA, 608 bp, Sorghum bicolor
  unsure (1)..(608): unsure at all n locations
  Clone ID: SORBI-28MAY03-CLUS17177_1
gccggccggngtgcaaaagacgagagctaaggccggcggcacctcaccttgcctcatgttcatgttttgagcgtgttagcagagtgtttccagtgcatgacttcagaaatggggacgctgccatgcccatggagatctggccacctctttgctttcatcaccttcgccttgttgttctcgacttcatttgctgggagacactacagtttcttgacggatcaaggtgccctacgtcaacaaggagaggcagcacgaaaggaagcactagtgccattggtgcaagttcggaggctcaacgtcaagacgaacgattacagcagctatgacccttccccgtccatggacaagccacacttcaagctcataccaaactgatcaatcatgtatatccaggttgcagcaatggagttgccgatgaggaacttaattaacagcttaaatgtgtgcctgatttataaatacagaggcattactaggcttgcttaaactgttcccataacatttaatatcttattatagatgtgatatataaaaaaaaaaaaaatctttgcactgatatatagtcacaggctttgttgtggtaaaaaaaaaaaaaaaagaggccccta

SEQ ID NO: 5412 - DNA, 681 bp, Sorghum bicolor
  Clone ID: LIB5052-002-A1-XP1-G5
ctgtgcggcgctcgaggcggccgggtttcggggcgaaaactaaggcctgcttcacctcaccttgcctcatgttcatgttttgagcgtgttagcagagtgtttccagtgcatgacttcagaaatggggacgctgccatgcccatggagatctggccacctctttgctttcatcaccttcgccttgttgttctcgacttcatttgctgggagacactacagtttcttgacggatcaaggtgccctacgtcaacaaggagaggcagcacgaaaggaagcactagtgccattggtgcaagttcggaggctcaacgtcaagacgaacgattacagcagctatgacccttccccgtccatggacaagccacacttcaagctcataccaaactgatcaatcatgtatatccagagatggtcgatactcttgaaggaaagtgatagatggaaggtgctgcaagcgaaggacggtttgatctgctggatgaggagttttgatccaagcttagtgatgtccacagatgtgttcgagctttgatattttggtttagactgtggctttgtaatagactctgtttagtatcctttggttcattgagatactggcttcccagtttgtatccaaacttggtgctttataaaagcagaggttttctctttaaaaaaaaaaaaaaaaaaaggccccta

SEQ ID NO: 5413 - DNA, 970 bp, Sorghum bicolor
  Clone ID: SORBI-28MAY03-CLUS1724_1
agtaactgcattgcgcccaacatttggaacagttgcactaactgatgttatgagcatttttgattcggcaagaggcttggtcctttctgcagaagtgcagtagattgtgctattgtattagacgcaattcgtggaaaggatgcatgtgatccgtcgtcttgcgaggttgctttgggtgatccatttcatgttgacatcaccaaactcaccgttggctatcttgatgacgctgagatggaggttgtccatgtccttttctttaaaggtgtcaaactggtccctttaagctgaactacactgtcgaatcagttcagtccatcctgaacataacaatggacactgatatgcttgcgcacttcgacaactggcagcgggaaggacatgatgatgactatgaggcgcaagaccagtggccagtagagcttcgtcgtgcgcggttaatcccagcagtggactatatacaggcgcagcgagcacggggcaagttgatcagagaaatcaaagacagtttcacagttgatgcatttgttggcaacgtgaccgactgggagcgcgtctgtctcgggaaccttgttggtatgcctgtggtcgtggtgccgacgggcttgaagagcattgaggacccaccgaaaggcggtacaaagagaagaaccacagtgacgacaggcatatacgctcctccagaccacgaccacattgctctggcgctggcaatggcgtaccagtctgtcactaatcacaacaaacagcggcctccgatcgatgatctggggccaaatgacggcatacataggtagagcaagctgctggtgaggtgcgatgatgatggtagcacaagggtcattatggaagctgaagttgaagacgatcagtgggcctgaattttttttatatagtttgagggtgaggctctagatttagggcctattgggttccttgctaaattttagtcactttagtagctaaactc

SEQ ID NO: 5414 - DNA, 642 bp, Sorghum bicolor
  unsure (1)..(642): unsure at all n locations
  Clone ID: SORBI-28MAY03-CLUS17272_1
gccnnggccgggcttgggnaaaaaaaaaaaaaaaaaaaaaaaaattttaaaacacggtctcggagaggtccttgcggcattgttggccgcctcgtgtcttgccagccgcgccgggagaggctaggctagctaggggccggggaagaccggaagaggccgccggcagatccgccatgagcagcgatcagatgagcgatgttcctggaggctacttcgtaggccgtccatccaaccacgccgccgacaagacggaagagccaccgcacgccgccggcgagcagaacccggcgaccgcgcaaactcctggcgattacttcgttgggcgtccggagagccatcacaagcagcaaaccaccactaagcacagcacaccaagcttcttggccaaatgctgtccgtgcctcgccggcggtggagctgcggaatagatcaagaaccgcctcctgcagccctgctatgaactctgcacaggagggttggagtaaatttgggatgagctctacaaatcaaatcaaatgtatcttaattgcaacttcttgtgctctggaagctcctcttgtttgctttgttagaaatttagacattttaatgtttgatttaatccagaaaattacagaaaaaaaaaaaaaaaaaaggccctaa

SEQ ID NO: 5415 - DNA, 1238 bp, Sorghum bicolor
  Clone ID: SORBI-28MAY03-CLUS17362_1
gccggccgggccgggccaaaaccacgaacatcccaagtccgcaaacaagaaaccagagagagaggaggcagctggagccggccgctccagcctccagctgagagcctcgagagggagggggatcttcggatggcgatgggtgacgcgaagccgtcggtgctaatcccgatgcccagccgcgaccgcgaccgggaccgggacctgctcgtgccgaccgccgccgtcgccacccatgcgtccccgtccgcccgcgccgtcgccgactccgacgacgacgagagcaagccctcctctgcctccgccgccgccgccgccgcgcagaccggccgcgaggcgttccataaggttgtgcatagctgggcatccaagaagttcatgaccggatgtgtcatcctcttcccaattgcagttacattctatgtgacatggtggttctttcgttttgtggatggctttttctccccaatatatgctcacttgggaatcaaaatatttgggcttggttttgtaacatcgatatctttcattttcgtggttggtgtattcatgtcatcttggctgggggcatctatccttggtctcggagagtggttcataaaacgaatgccatttgttcgccatatttatgatgcatctaagcaaatcagtgctgccatttcacctgatcaaaacaagcatgcattcaaggaagtggtcatcattaggcacccaagaattggcgaatatgcatttggatttatcacttcggaagttctacttcagggttattctagtgaagaaaagatgtactgtgtttatgttccaaccaaccatctttatattggggacatatttctggtcagctcaagtgacgtgattaggccgaacatgtctgttcgcgaaggcattgaaattgttgtctctgtgggcacgacgatgcctcaagtattatcgattctggaaactgagccaaaccagttgaacaggatcagatccactcgaagctgagatgactttacattttgtaatttcgtgttccagagtccttgtttgtgtaagtacaggagtaggttctgacagattgtacagttctcctgggtggaaagcaaaatctgtttgtggacacatgtcacctgaacgcgattgcttgtatggcagtctcagcttcttcagaaatgtaacttagcagttgaagtggagttgacctatgtcaagaattgtcaagttttgccgtggaagaattttttaacccattgttc

SEQ ID NO: 5416 - DNA, 421 bp, Sorghum bicolor
  Clone ID: SORBI-28MAY03-CLUS13608_1
gcacgaggggagctgaagcagaccatggacatgtacagcacggcgtgcaaggaggcgctgacggccaagcagaaggccatggagctgcagcggtggaagatggaggaggagcagaagacgcaggactcgcggataacggaggactcagccatggcgatgatcgagcgggagaaggccaaggcgaaggcggccatggaggcggcggaggcgtcgcagcggatcgcggagatggaggtgcagaagcggatcagcgcggagaagaagctgctcaaggaggccgaggagcgcaagaaccgcggcggcagcggcatgtcccacgaggtccggtaccgccgctacgtcatcgaggagatcgagcaggccaccaacaacttcgacgacacgcccaaggtctgcgagggccggtaccggcccgtgtaca

SEQ ID NO: 5417 - DNA, 870 bp, Sorghum bicolor
  Clone ID: SORBI-28MAY03-CLUS13617_1
ctttatggtgatgttgctggtggcggcggtcttgttcttggtgtgagggagtaggacaagaggcggtgtgacgaggagcagcaaaaaattgccatggtaaatggtatgattgaaagattccaatacgaatggttctcaaagcttgatgagtggggactttctgtcaactcactgtggagcagaatggaaggactctataaggagattgagcttctcaaggaaaacagaagagcaagatttgctaccccagttacagaggaatcgaccctagctacagaggaatctatcccagctacagaggaatctatcccagctacagaagaatctatcccagctacagaggaatctatcccagctacagaggaatgagttccctgacagtcagaggttcagatgtgatgtgaagatgactccctgttactgccctaccctctgctggatattttgacgtcaacggccatacacgagcagttgtggcttggtggtatatactgtagtaagatataaatagcttcgcttgtaactgtggttgtatccacatgtggggacgttttgattattagtgcttaatttaggtgcatttagggtttcttaatctatatcaaagcgtgcattcatatcctttattgcgctttgaattcctgattatgcactggtgatgtgtgcatagaatgcaaagacttcatgctagtgacttgagctttactgctggtagtggtagtaacttctgcccctgactagtgagcggatactgctaggtcatgaaccaagtttcaggtaccatacgcgatgtactagttgcatttggctccagtggtttgagcggtaatctcttactgaaatactagcaaaaaaaaaagtggatttctg

SEQ ID NO: 5418 - DNA, 799 bp, Sorghum bicolor
  Clone ID: SORBI-28MAY03-CLUS13621_1
accccggcgtgaccgaggaccccgcctgcggcccgctcatcgactccgtcgcgatcaagacgctcaacccgcctcgccggaccaacatgaacctggtgaagaacggcgacttcgaggagggcccgtacatcatcccggggacgaaatggggcgtgctgatcccgtcgagggtggtggacgaccactcgccgctgcccgggtggatggtggagtcgctcaaggccatcaagtacatcgacagcgacagcttcgcggtgccgcggggccggcgcgccgtggagctgctggccgggagggagagcgccatcgcgcaggtgatccgcaccgtgccggggcggcagtacgcgctgtccttcaccgtcggcgacgccagcaacgcctgccgtgggtcgctcatggtggaggcatacgccggccgggagtccaccaaggtggcgtacgagtcggcggggaagggcggcgtcaagcgcgccgtgctgccgttccgcgccgcgtccgcgcgcaccaggctcgtcttcttcagctcgctctgcgggccagtgctcgacgacgtcgccgtcgtcagcgtgcgcactaccaagcgcggctagagagcaaaagtccggtggtcggtggagctcggccgggcgtgcgagagggagacggagtaactattttcttgatgttgttaccgcacggttgctttgccgtgattgtatgtagctgctcgttgtcgttgggggcatcagaaaatttgttcgaaccatggggaaactggcgtgtcagatagtactagtatatggtttctacatttccacta

SEQ ID NO: 5419 - DNA, 824 bp, Sorghum bicolor
  unsure (1)..(824): unsure at all n locations
  Clone ID: SORBI-28MAY03-CLUS13666_1
cggatttctgcatacgacgtcctcaatcacccgtggatcaaagaagacggcgaggcgcctgacacgccgctggacaacgccgttctcggccggctcaagcagttcagagctatgaaccagttcaagaaggctgctctgagggttatcgccggatgcctgtcggaggaggagatcaaggggctcaaggagatgttcaagagcatggactccgacaacagcggcacgataaccgtcgacgagctgcggcgagggctggccaagaagggcaccaagctcagcgaggctgaagtccagcagctcatggaagctgccgacgccgacgggaacgggacgatcgactacgaggagttcatcacggcgacgatgcacatgaacagaatggaccgggacgagcacctctacaccgcgttccagtacttcgacaaggacaacagcgggtacatcacgatggaagagctggagcaagccctgagggagaaggggctgctcgacggccgagacatcaaggacatcgtagcagaagtcgacgccgacaacgacgggcggatcaactacaccgagttcgcggcgatgatgaggaaaggagacccggagccatccaacatcaagaaacggcgcgacgtcntcctgtagaggccggagctagctagtgcgctgcgcacggcggcgtggagctctcatgaacagatcgatcgcacggctagctgctggcaggaatattcatggtggcccgctgcacggagagacaaacgcgtacgtgcgttctatctctctctgcacagatgtatgtatagcgcgaatgcccgcgattggaaagggggggg

SEQ ID NO: 5420 - DNA, 723 bp, Sorghum bicolor
  Clone ID: SORBI-28MAY03-CLUS13639_1
tggcttcaatcatgttcttatatctacagcattcaaatgagaaagttacaagtgcttcacactctgtgatggcatcgttctcatcatctggcagtgatactgatcaggatgcccgagcagctttgaaagagcaacttaccttttactacatcaagagatctttggaggcttatcctggggtaacaccatttgatggattagcatcaggagttgcagcacttgttcgacatcttccggcaggcagcgctgccattcttttttgtattcatagccttgttgtcaaggctaaagatctctgtgaggttgcaaaggctcagaacaaatccttgtggagatcatgggaagagagcacagatccatgtaagaaaatgttggatctgttgctgagactgatcttccttgtggatattcagtcattcccctacctgctgaaggagctggcagaattcgtgaccctgctaccaaaggaaggccaggatgcactgctcgatgacatgcatgcccatgtcgctgagtctgacgatgtcactcggaagccagtacttgtttcgtggctgcagtccctctcctacctaagctcgcagtcgagccgtgaatctcacagcaaggccatgagtgctgctgcatccgtagcaagcgatgaactgaccctgaacagagccatggcacgcttgtgataccaatgcttgtaaaactagcagtacataatacggaaaacggttg

SEQ ID NO: 5421 - DNA, 1014 bp, Sorghum bicolor
  Clone ID: SORBI-28MAY03-CLUS13665_1
caactagctactgctggtaaagtgaagaagatatttgctcattgcttggataccataaaaggaggtggaatttttgctattggagatgtggtgcagccaaaagtaaaaacaacaccattagtagccgacaagccacactacaatgtgaaccttaagacaattgatgttggtggcactacactagaactcccggcagatatttttaaaccaggagaaaaaaggggtaccataatcgacagtggtaccaccttgacataccttccagaattggttttcaaaaaagtaatgctcgcggtatttaacaagcatcaggatataaccttccatgatgttcaagattttttgtgtttcgaatattctggaagtgtagatgatggattcccaacactcaccttccattttgaggatgatcttgcgctgcatgtgtatccccatgagtactttttcccaaatgggaatgacgtatactgtgtgggattccaaaatggtgcattgcagtcaaaggatggaaaggacattgtgcttatgggagatcttgtactttcaaacaagttggttgtctatgacttggaaaatcgagtcattgggtggactgactacaactgttcgtcgagcattaaaattgaggacgacaagacaggcacaccatacactgtcaattcacatgacatctcctctggatggaaataccactggcacaagtccctggttctgttgttggtaacaatggtgtgcggcaatttaatacgctaactctattgtacaacacgaacactgaccgaaattcatttgattggtattcttttcacaaaaaggaaatttagggctttaggctgtgttttctgaccaaggaaaacaatgaaaacaaaaactttgtatgccatacaatgagcctatgtgtggctagtgtaatgctgagctgaggaatatatggccgcacgtaacttgagtttccgtaaaaaaaaaaaagttatgtgtgtaaaataagaatctcctttgtttgcagtacagcaa

SEQ ID NO: 5422 - DNA, 771 bp, Sorghum bicolor
  Clone ID: SORBI-28MAY03-CLUS132182_1
gcacgagggtacctcattgtgattgatgatctatggagtagcgaccaatggggaataattaggtgttgttttccagataacagtcttggtagtagtataatcaccacaacaaggaatgatgcgttgcccaccaatcatcattgcggttcaagcaaatttgtccacaaccacaagatcagccttcttagcgacaatgaagccaaggaattgtttctgaagaaagctttcagcagccggaatgactatccacaacatctggaggatgtttttgccaaggttctgagaagatgtggtggcctgccacttgctgtggttagcatagctaccaagttagcacacaagcaatcaagagatgaatgggaaaagcatggattgaacttgctatacaattcacgtccagaggggttagatgggctgaagcaaatactcaatcttagttacaacgatctacagccacaactcaagtcctgtttgctgtatctgagcatatttcctgagaattcagagattgagacaaagcgcctagtgaggcgatggatcgctgaaggattcattgctggaactggaagcaaagaggaaacagcaatcagttacctgaatgagctaattggcagaaacttggtacaaccattggatctgaaccatgataatatcccaaggcgttgcacagtccacccagtgatatatgatttcattgtttgcaaatccatggaagacaactttgccactctgacggatgctcaacatgtcccaaacaacaacataactgtc

SEQ ID NO: 5423 - DNA, 731 bp, Sorghum bicolor
  Clone ID: SORBI-28MAY03-CLUS132149_1
gcacgagggggttctttgccagttccatctaaggctaatgctttagagcatctactggtgtattcgccatctggtcatgttattcaacatgaacttttaccttcttcaggttctgagtccactggtagcagcccgagagttggttcagctcctaactcgcaactccaagatgatgagatgcatgttactgctgaaccaattcaatggtgggatgtgtgcccgaggacaaactggccagaaagagatgaaaacattgcaaacattgtattgtataaccaaagaagcagtataatggctatggatgcttctgactgtgaagatagcgagcattcagattccactgcatcaaatgatggtatctctgggaaagagattatgagagtccgagaaaggtcaagctggtatctatctaatgcagaagtacagataaactcgtggcggattcccatctggcagaaatccaagatttgcttctatgtgatggaccatcctgctgcagagtcggtcgaatcagttagtagcagtggtggagaaattgagattgagaagttacctcttcacgaggctgagatcaggagaagggaattgctccctgtattcaagcagttccaatattctgagcgacattctagtgataggaatgttgcaaatggaagaagtattgcaaatggaagctttcagaatgccttgtcccacatcagtgatgcacagtacggctctgtaaaggataa

SEQ ID NO: 5424 - DNA, 821 bp, Sorghum bicolor
  Clone ID: SORBI-28MAY03-CLUS13240_1
cataagtacatggcaagcagcaaccatgttcaagccgagacttgcagctttgagtgacataatcataacagtaacctctggaaccgtattgaagtctttcacggctttatcccgtgcggcaacagacattgttccatcaagccttcgatatgtcacatgagaagctttcaaatggacttcaagcaagtctagcattctagtccactgagagaaaacaatggccttctctgtcaacttggtgtcaatttgttctgaagtaccccttccatcaaacttctcagattcaagcccgattgaacatttgctatcagtcatttgggtgggatctattctgggcaacgagagaagaatatctagtgcagctctcacttttgaagaagcgtaggatgaatctatcccagggcgcttttcagcatgtatcatttccatacaggtatcatcatcagacttgaaatcacaggtcaatctactcagagagcattcaagggtgcctctggagaatagtgaggttgtatttagtcggactctgcaattagacactgggcatacgctatcgtcaccagtgagttgctccagtatgcactggttgcaaaaaacatgaccacatatagtgacaacaggatcttctggcgcatcattgcagagagcacataacgcagaacaagattgcaagcaattaagtaattcatgctgtcgttccatgggaagtttctttgccatctccaacgaagacatccaactagaagaggagttatagcctctaactaggtgagggtgatcgcctcccgctcttagccgtaaaagcatcaatagcagtaggc

SEQ ID NO: 5425 - DNA, 1135 bp, Sorghum bicolor
  Clone ID: SORBI-28MAY03-CLUS13251_1
gcacgagggtctcatcgaacagtggtgataattcttccaatcccaactccaagccagcaagccctgccattgccacagctgctgtcaaggtgataccatccacagcaccaagtgccagtcaaacagtaaggaagtcactttcatacaaggaggtagcaatagctgcaccagggactcttgtcaaagcatttagtgatgtacacacagaagaaaaagatgcaggtggccgaggtgcaagtcctgaaagtgccaagtcccaaaaagaaatcaatggtcacccttctggagagaaagatggggcaatagaagtgtcaccaaaggctgatacttcacaagtgactaaatcatctgatggaggtaaaccagagcaaactgatgttttgattggttcaaatcaaccagaaacaggacataaaaagacctcagatccagcagagacatctgtagcacagaagtacacagatcttcctgccccggtcacatcatctgcagcacaaactgaggaggttggcaccccaaatgaggaagcaccaactgtacttgaggcaaatgattcttcctccaatgacgatgaaagagattccggagaggatacaccaggacagctgtcgagtggaggtgaaaatgagaaatcttcactatctgagagtgaaaagaatgatacaccaagagaaggtgctaaagagacaagtaaactttctgctgctgcggctccattcaatccatccactgtaccagcttttggttcaatggctgtcccaggtttcagagaacatggagggctgttgccatcaccagctaatgtgccccctatgctgtccatccctctccgtaagcaccctcaccaatctgcaactgcaagggtaccttatggtccacgtctggctggaggctacaatagatcagggcaccgaggacttcgtaagaagcctgtgttgacaagtggtgaagcccctacagaaacaaacacgtctgcccccaaggttatgaaccctaatgccccggagtttgttccaggtcaatctcggagtcctaatggtcatccagcatctccaaatggtcctttatcatcaccaggtggtattccatcttcaccacaagaccttctatcatctccagatagtactgtggagtc

SEQ ID NO: 5426 - DNA, 521 bp, Sorghum bicolor
  Clone ID: SORBI-28MAY03-CLUS132934_1
gcacgaggtgaaagtaaaataaatttggtgaggtcatcgtctggtggttttaccaactcagaaaatggcatcaaactagggcatggaagccattcgagggaccggctaatctatgttctaacacaacttattgggcatcatgtggacgtgcatgtgaaaaatgggtctataatctctggaattttccatgcaacaaactctgacaaagactttggagtagtcttaaaaatggctcaggtcataaaggatggttctgccagaggacaaagatattctgatgatgttgtaaagaaacctgagactatgataataccagcaagggagcttgtacaagtcttcgccaaggatgtagcacttggcggtgacgagctggcaaaaggtcctggccatgacaaaaggaaggacttgctgattgattctgctatttcccgctctcattatcttgaagagagggaacttgagcgctgggcaccagatgaaggagattcagagtgtattgaactggagaagtatgacagaaa

SEQ ID NO: 5427 - DNA, 928 bp, Sorghum bicolor
  Clone ID: SORBI-28MAY03-CLUS13783_1
tttgatttatacatagcttcttttatttaggcaagcctgaacatactaagaagtgttagctgtggcactgtgctcaagacaattttacatgttgggctacgttctgaagaaaatgttttatgatagcatataatcatcaactaaattttttatgttacttctctaggtttcagctcacttattcttacgtaataattccgatattgctcttcatcatctattcaccatattctctcagtgtgatacttagttttgatgcattctcagtatatgacttccaatcagctttgtagtttgccatgcattttagtatatctcttattgcttttctctattccacattttaggttccatgcctttgtacaatgaagcgcaaaatttatttcctgcgctggctgcttcccctcatgccgcttccttcctcgggtcttctcgggctctttgctccgctcagtcttgtttcgcgccatgctattgcgggcgccctcggcgcgcctcggtctcgcttctccgcttggtcttcgttttctgattgatgtaaacactaaagttcgtgtgattcgccatatcggtctttaagaacttcgactctacacggattttggatgttgtagtcatccattgtttattgttggctacaaactgctcgttagaaggcacatatcggaactctttttacgtgtgccttcataaccataaatgtaggtgagatagacatgcgtagctaatttaacatattttgagggccttttgtattatgaaaggaattctgcttaccattttggagatttcccctatgtagattagttcgccattcgtcagtgctttgttgtgattatatagtcaaatatgagtaaaggatccaatattttttttctaagtcttcaatttctaaaagaaacaaacaacactaatatgaacatataag

SEQ ID NO: 5428 - DNA, 780 bp, Sorghum bicolor
  Clone ID: SORBI-28MAY03-CLUS1380_1
gattccggtcgaccacgcgtccgcccacgcgtccggcgtgaggtaggggagaacttttatacttttgagacatggggagaacagctgaatacattttgtgcggaagtggtgcagagtgaagctttcttcatatgcaattcaattggaggggttgttggtctgcaggcagccgttatggaacctaaaaaatgtaagggaattgttttattggatatttcactaaggatgcttcacatcacaaagcagccatggtttggaaagcctttcatcaaatcttttcaaagtctcctaaggaacactattgttgggaagctattttttaatgctgttgctacaccagaatctgtgaaaaatattctttgccagtgttatcatgacacatctgcagtgacagatgagctagttcagattattctacagcctggtcttgatcctcgagcaccggatgtcttacttgcgttcatttgatactgtggaggacctgtacctgaagaggggcaccataggttaagcgtgcacttttggtagccaggggggagaacgacacattgaagcctgttgagctctgcagagcttatgcatctttggatacaagctaagatgtggctgctatgccagatgtggcacactgtcctccggatgaagcaacctgccttgtatgtacacttgtctaatgattaggccaggcccatacttactacatgggtgagtatttctctatgtgtatgaatgccctgtcccagtgcggactcaatctgctggaacatgggtatgctcggc

SEQ ID NO: 5429 - DNA, 470 bp, Sorghum bicolor
  Clone ID: SORBI-28MAY03-CLUS13827_1
cgtattatgaacaaaggcaagggtggggagagtgggccgtcagtcccaaagattgctgacagaagccgagaaggtgatatctttcctgctgcatcacttgatgaatacgccgaacaagctagagagcaagaagaggaagactcagatgaagaggctggagattttgtggaagattaagttgggaatgctttatgctgtaaacatactttcttggtgtaatgagatggtgcttttgcggtcttaaaaaaaacgctgtagaaatactatcgctctgtatcagatttaatattcatctggcggtggtaagattgctgcacattcctgctgtaatgctccagagcttggaattggaagatgctaaactgcgttgatttaattgaaaatggttgtgcatgtctttccgggccgttttggtgggccaggttgggcgccatcattcacagcggttggttggtgggttcggatcggat

SEQ ID NO: 5430 - DNA, 911 bp, Sorghum bicolor
  Clone ID: SORBI-28MAY03-CLUS13761_1
gcacgagggtgagagcgagcggctcgtgcggagagcgagcggcacggcgctacacagagacgcggaccgggtcgccgtgcgccatggcaccgccgtcgctgctcggcagcaccgacctctggcggcccgttgccgccgcccgcgggggaggctgggccacggccgccgcgctcctcctcatcctcgcctcccacctcgtcgtcctcctcgtccgccgccgcctccgcctccgcctccgcggcggggggcgaatcgcgcaaccggaggccgccgtggcacccgcgcctgcctccgcgtccaccggttccgcctcagggttggtgacccgtactgccttcgcggccgtgggttttccgatcgaaaaatgcgtgtcaactgggcgcggctggatgatttctgattgtgctgtgtcttccctttggttggtgacagaatagagggactagtgacggagggcgatctgaggcagctggtgggcagtctgggcttgagcgcgcgtgagccagagacgcagggctgggagcacgtcatctccaagagcaacgacgacgtctcctacaaggcctggtgcgacaagcccacagtatggctagcttcatctcgctctcgcctcgttctgagaatacagtgtactctgtgaaagctcgtgttccgagcaattagataacgccagttggatcatgagattctggttaggtgcgcttcatatactggaactgttttgacttgtcaatttaggcgtggaaatggacccttatgatgttattgtttgcaattcctcatagttcagaacggttgtaatcgtaattggtaatcatgtgcttttgtctgttcaactttactagaggtcatggattgtttctggatgcttagtaagagtctgccacgattaaatgtttgttgttgttgct

SEQ ID NO: 5431 - DNA, 370 bp, Sorghum bicolor
  unsure (1)..(370): unsure at all n locations
  Clone ID: LIB3480-006-P1-K1-E4
ccgactccgcctccgcggcggggggcgaatcgcgcaaccggaggccgtcgtggcacccgggcctgcctccgggttcaccggttccgcctcaggaatagagggactagtgaccgagggcgatctgaggcagcttgtgggcagtctgggcttgagcgcgcgtgagccagagacgcacggctgggagcacagtcatctncaagagcaacgacgacgtcttctacaacgcctggtgcgacaagcccacggctggccctcctaaatatctgagtattacaacatacgagagatgctctactgtgcagttgagggacttgtacatggataatgagtacagaatggagtgggataacactgttacaaaacatgagca

SEQ ID NO: 5432 - DNA, 562 bp, Sorghum bicolor
  Clone ID: SORBI-28MAY03-CLUS13861_2
caacaacaaggcccaccccgttcgacgacatggcccgcctcggcgccggcgccctgttggcgctcctgctggcggtggcggcggtcgcgttcctcgcggtgccagggtcggcgaaggtcggggacctgagcgcgatggacttgacggtggggaggagcagcaagtgctccggccccatgagccagtgcgacgtggacgaggcggaggagctcgggctcagcggcggcggcttccccgccggcgacacgatccggcggacgctggcggcgcggcagcccaccaaccggtacatcagctacgccgcgctgcgcgccgaccaggtgccgtgcaacaagcgtgggcggtcctactacagcaactgcgcgtcgcagcaggccgccaacccttaccgccgcggctgctccgccatcacgcgctgcgcccgcaacatgaactgagcgcgcgcgcggcggccggcgggcgcgccgtcgagccggtcggtctgatctgcctctgccggccggcctggctgggcacgcagatagcctggctcgatcgcgcaccatgcattggcgacgtcgtc

SEQ ID NO: 5433 - DNA, 451 bp, Sorghum bicolor
  Clone ID: LIB3480-013-P1-K1-E7
gtcctagatcgcgagcggccgctcgcgatctagaactagcggcgggcgctggcagcgcggcagccgaccaaccggtacatcagctacgcggcgctgcgcgcggaccaggtgccgtgcaaccagcgcggccgatcctactacagcaactgcgcgtcgcagaaggccgccaacccctaccgccgcggatgctccgccatcacccgttgcgcacgcaacaccaactgatccatatcatatatatcattcgggcctatatattgatgctagctagctaatcaaatatatttgcatgcatccaagaagatgcagccatggcagatgcagatcgatccacatattggcgtgcaggtgtgcatgcatccagggtggaggaagacagggaacatatattcaagagtggtagtgtttgcattggactgatatgcatggttgacctggggtaatttttttc

SEQ ID NO: 5434 - DNA, 983 bp, Sorghum bicolor
  Clone ID: SORBI-28MAY03-CLUS14188_1
gacggaggccgacggccaggtgaacgtcgacggcggcggcccaccggcagatctgctgttcgtcaacccgagcaaggaaaccaaggtcggcaacgaggtcgggtaccggctcgtcccggcgggggcgaccggcgcgtcgctgctggcggacgacgactacccgcagcgccgcgccagctacaccaagcggcaggtgtgggtgacgtcctacgataggtcggagaagtgggcgacggggctgtacgcggagcagggcaccggagaggatagcttgggtgcatggagcaagaggaacagaggcatcagggacagggacatcgtgctgtggtacaccgtgggactccatcacatcccctaccaggaggactttccggtgatgcccacgctcagcggtggcttccagctgcgtccggccaacttcttcgacaggaatccgttgattcggaccaggccaccggctgatcacaataactacccaaactgctcatgtggcgtcgcgtccatgtgataagtaaggctatgtctagttatttacatgatgaggtgggaactcactgagattgataattcatgtaggattacaagaatattttaaataaatgcatcacaagcaaaaacttgtagagtaaaaaaaaaaaaaaaagggcggccgccctttttttttttttttttttatatctatcagtttcttctcaatagcaaaattgtaggaaaatatatcatcacaccggggcaggtgaactttgcagagctgcgaagtagtcatcttcaacattctttagcagacttcactgcttaagctgatacaccatatagacccttatgcactggccaaggcaacaaagctgaaattggcacgaaagttttgcacagtccaagccttgttatcagatctacttgtacagttacaagaaaagttgtactcatcatccgtttcaagctttcagcaccagcaaacaacgtgtgcatgcataggggaacct

SEQ ID NO: 5435 - DNA, 973 bp, Sorghum bicolor
  Clone ID: SORBI-28MAY03-CLUS13549_1
gcacgaggctcgtgtccgtgcaccaaccgccgtcgggcctcgctggcttcggccgcggcgcgccgtccgtgcccgcgcagctcggcctctccaaattctcctactgccttctgtcccgccgcttcgacgacaacgccgccgtgagcggctcgctcgtcctcggcggcgacaacgacggcatgcagtacgtgcccctggtgaagagcgcggcgggcgacaagcagccgtacgccgtctactactacctggcgctgtcgggcgtgacggtgggcgggaaggcggtgcggctcccggcgcgggcgttcgcggccaacgccgcggggtccggtggcgccatcgtggactccggcaccacgttcacgtacctcgacccgacggtgttccagccccgtggcggaccgcggtggtggcggcggtgggagggcggtacaagcggtccaaggacgtggaggaggggctgggcctgcacccctgcttcgcgctgccgcagggcgccaagtccatggcgctgccggagctgtcgctccacttcaagggcggcgcggtgatgcagctcccgctcgagaactacttcgtggtcgcgggccgcgcacccgtgcccggcgccggcgccggcgctggtgctgccgaggccatctgcctcgccgtggtcaccgacttcggaggctccggcgctggagacgagggcggtggcccggccatcatcctcggcagcttccagcagcagaactacctcgtggagtacgacctggagaaagagaggctggggttccgccggcagccatgcgcgtcgtcgtcgtgagcgacgtggatcggcatggcgggatcggagtggaggctattaattactccagtccacgtagcggcaatggtaaatgcaaaagctggctgtttgctcttttactatcgtgctttgcggattgtactggtaataaactaaatttactatcgtgtaagattgaaaaaaaaaatt

SEQ ID NO: 5436 - DNA, 855 bp, Sorghum bicolor
  unsure (1)..(855): unsure at all n locations
  Clone ID: SORBI-28MAY03-CLUS13512_1
cggacgcgtgggtgggatcctagcaagagaccaaaggccacagaggtcctccagcataccttctttcagggttgtacatctgttccacttcctgtccgtccaaaagctcctaaaacacctccatgtgttggagcaaaaggaatttcagagaacagtgtcgctagaagattctcaactggaactctatcaacgttgaagtctcatagcaatgcatccgcaaaattaaacagtttatctaagactggtgtccaacgaaaacttcacttggatcggcagtcatcacataagagtacaaaaccaaccgagaatagcaataaactaactacaaatcgggtaccagctcggaatagcccagggaatcctgtacttaggcattcacgcagcttgcctgaaactggtcgaggaacaatccaaaaggtctcatcaattacagagaaactatcccagatgtctgtgacctcgagaacacgaagcactgtgaagcctgctgccccggtgctgaaggccggacatggtaagtcggactttcttgggaagtctgacgatatccctccagcaaagaggccgacaagaaaattggtcagctaaatgaggatatgtagagtgaaaattcgatcagctgcaggaggggaatagtgtatagtgcgcagaaaccagtgtgcccaagaggatagctcagcctgagtgtttgcctgtttacggttgtgtggatttgccatcgccacagttttgctgcgtcgagacatcttanaatgggtttgcaaatcctttgtgaagtgctagagcctgcatcaagccttcccctcttccgggccgatgctgatctgcttgttgcccgaacccagcttgcccccc

SEQ ID NO: 5437 - DNA, 880 bp, Sorghum bicolor
  Clone ID: SORBI-28MAY03-CLUS13571_1
caagaagtcaatggctgctctttacaaagagcttgaggaagaacggagtgcttcggcagtcgcagctagccagacgatggccatgatcaatagattgcaggaggagaaggctgcaatgcagatggaagcactgcagtacctgaggatgatggaacagcaggcggaccacgaccacctagcaatacaggatctacatgatttacttacagagagggagaaggaattgcttgacttggaagctgaacttgcacagtgcaggaggatcctgcagaacgatccattcaatgatgacagacttaatggcactgatacaatgaacaatacggattttgtggggagcgccatgtcgcattttgaacatgataaggcatacattttggaatccttgagcagattggaggaaaaccttggcatttcgacaaacagacttgcttttggtgacgccggaaatagtcaagaagacatactgtttgaagatcatacaagagctgatggatctccttccaacagtgacaagttgagtggtgcagcaagtcttaagattgaaatttctctgttgaatataagaatgagggcacttgaagaggatcaggagtttctcaagcaggtattgagttccctccgatgtggtagtgatggactgcagtgtatacatgagataaccagccatttggcagagttacgaagagctgtgactcattaaggaaaatgtttttgccccgagttcacactatttggccatcatgaggtcttctcatgcagatatatgcaggctaaagagagcgcttccagtgagtgcccacaatgccatctatcttaaatcgtacaaacctgaagactgatgccattgcaggaatacccatgctgttcactcctgatc

SEQ ID NO: 5438 - DNA, 807 bp, Sorghum bicolor
  Clone ID: SORBI-28MAY03-CLUS13600_1
cccacgcgtccgcggggattccacctacgttgctctgctgccatctgggtttgccatcctgccggacggtccaagcggtgtcggcgctgagcataagacaggtggctcgctactcaccgttgccttccagatcctcgtcaacagccagccgaccgccaagctcaccgtggaatcagtagagaccgtgaacaaccttatatcctgcaccatcaaagaagatcaagacagcgctgcagtgcgacgcttgagtgtcgccgtcgccgcaggggggatggtcgtcgacgacgagcctgagtcaagaacgaacctcgtgctggaaagaaacctttgctaggtgataaggatccatctcggacaggtccttagcacagagcaatggtggtggttcgggtattgactcggtctctatcgtctgcttgttctccctgccaacctggctgtttgatacaggacctttgcatagtggacaataatggttagatggctaatcttatgtttcagtcccgtcgtttcatcagggaatcaaacgttgagtttttggccgggtcgttgttagttattacgtataatatactgtccattatcccctgttgtgaggagctatatgttatatgtaaacttgagagcacagaaacgttgggttgtagtggtgtcgtccataggtcatggtagcatgcataagtgtagctaggcatcaaactatcagccaataatgtctgatcgataaagtggtgtagtggtttacctggaaatgcttatttagcttcatcaattattaaaatttattctgcaaggtatatatgtagg

SEQ ID NO: 5439 - DNA, 549 bp, Sorghum bicolor
  Clone ID: SORBI-28MAY03-CLUS13561_2
cgaaaaagcaagcagctaacattacaacagcacctcgagggacggcgatgggcaaggcatcatggaggacgccgtccttggtcgcattggcgctgctggtggcgctcctggcggcagcaacggtggctgccgcggccgaggaggaggggtcgtcagcggcgccggcgccggcggttgcggatgctgatgcgccggcggcggcagacgaggacacggcaggcggcggcggtgacggagctccggcaccagcgccggtgagcgaggaacccagccacaagacgataggcgccaaggccaaggcagggctgcacaccgtcatggcgagcatctccaagggcaagaacaagttcgagtgcaaagtcctgggccgccattgccccgcctctgaagctccctccgcccagtgattaattaataattaattaaaacaacaacaacaaaaagccatccatcagatgatcatatccatccacaccacaccacacattcttcatttgttcaatgcagtgatctgcaatcttatctgtatgaatgtatgaattattatga

SEQ ID NO: 5440 - DNA, 625 bp, Sorghum bicolor
  Clone ID: LIB5047-008-R1-XP1-E3
gccggccgggccgggatcacttccggtgatcgaaaaagcaagcagctaacattacaacagcacctcgagggacggcgatgggcaaggcatcatggaggaggggtcgtcagcggcgccggcgccggcggttgcggatgctgatgcgccggcggcggcagacgaggacacggcaggcggcggcggtgacggagctccggcaccagcgccggtgagcgaggaacccagccacaagacgataggcgccaaggccaaggcagggctgcacaccgtcatggcgagcatctccaagggcaagaacaagttcgagtgcaaagtcctgggccgccattgccccgcctctgaagctccctccgcccagtgattaattaataattaattaaaacaacaacaacaaaaagccatccatcagatgatcatatccatccacaccacaccacacattcttcatttgttcaatgcagtgatctgcaatcttatctgtatgaatgtatgaattattatgatcactcccctgccctcttggtctcacaatgcgagaagagagcagatgagatacctaataatgcagccaaacatgggtacattaagaatttattggcgaaaaaaaaaaaaaaaaaggccccta

SEQ ID NO: 5441 - DNA, 505 bp, Sorghum bicolor
  Clone ID: SORBI-28MAY03-CLUS13904_1
aatccgttgatttctccccgacacctcgcgtcttctgctcccaaactaactcctgttgtcccaactgagcggtaaggacattaccgagctcattgctgcgggcacgacgccaccccgctcggcgcgccgctgctccggccagccacctctccccgccacagcggtgccttctccaccttcctgcggtggcggatcccccaccttcccggcgatgcggcggcccctccaccttcctggcagccggtcctccacctccgcgcgcagattgcgtccccatgggcgcggcggcttcgcatccccaaccaggggcggatgccgctcccggcaacggtatggcttaccctgccccttcccgaaaccggcggcgcgcggcttcccctcgtggtcctgtggccatgcgactcacccggccccttgcatatgccctcacggcggcgctcattcatcatgtggcagtggcccggcacctgtcgtatcttcggcggtgacagtatcttgagaaaag

SEQ ID NO: 5442 - DNA, 703 bp, Sorghum bicolor
  Clone ID: SORBI-28MAY03-CLUS13910_1
agggtcacacgcatctcccttgtcctgtccatgtcttggctctccattcacttcaacctcacaggcaggcctgtcaaccaggacctgttgctgatgcgtgctcttgcactccctcccgcgttggttttgccccacaagctgctgtcgtccctgcttggctcgatcggaggcagtcacatcttaatgtgggcggtcgtcgcaacgggctggccgctcccgcccgggggtcatcgttctcgctagtaccctagctgtctgggctccgccaagtgtggagctaccctggtagctccaggccaggcttccatgtggtgctgccgtcgcctgctctagcacgccccactgcttgtgcgttactaccctggtggctgtcgtccctgccattctgggccgggcgctctcgctgcaatgagtgggggtgcgacgcacgggccgggtggcccctgtgccgggtcttcatctgctctcaggaggcgccgccctagttcgaaaataccatggtgtgtttcaacaatttcatacagtgcagagcactctggttgcaatgagtatttgtgaaatatactagctgagtgagcaaaatggcttgtgtaaataatgtcacatgaggctcctccatattgaagatacactgggtttcactttggcatttgcatcatgtatatgtacttggtttccactaatgactgaactttgcaataag

SEQ ID NO: 5443 - DNA, 1041 bp, Sorghum bicolor
  Clone ID: SORBI-28MAY03-CLUS13957_1
ctgtctggatctgctccgaggtatcgtcgtctgcaccaacccttgggggccggaggatccagagctccgcttcatccctttgcccgacgggtgccccgcggtcagtgcgaccgactacccgtaccgcccgcgtgcggaggaggaccgctccgctgcctgcgttgacggccgcatcaagttggtcgccatggtgggcatactggcaggctggaacgctcaccagttcaggctcaccacctggaccctgtcgcctgacctcagcgggtggcagcaagacggcgtgttccccctcaaggacctctgggcgactgaggagtaccgcgtgctcaacctgcggcagtacactcctgtctgccccgtgctgagcgcacgtgaagatggtgttgtctacgccatcgtcaacgatatcgaggaacgcaccatctatcggggtcgtcaggttgatccgggaaccgagctgcagttcaaaagccagtatgttattggaatcgacatgcgccgcaacaagatcgtctccaccagctctggtaatccgccggaaagcctgatgcagatgatgccccgcctcctgtctattgatttctgcgcttcttccctgcacggcggtgcaaaggaccggcagagagaggtggaagcaagccaggttggagacagcggaaagaggctgaaagtttgactgatccatggatctcggcagcatattagcaccgtggcagggctgatggctgcaagttaattatcatgtagaattaacattatggctttgttctgtcgagcagagtagacatgtagaacctggcagaatgtgttaagtttaactactagatgtttgaatcatttgtggtaacctagtgttatcagatgctgcttttctcatctgagaagtggcctggtaactagtaccagtacgttctagacaatggtggattcatcctcactgtgatggcaccttttggaagattgttctgcttatgcagattatctatgtgtgaaccatcatgaagttatggatggtgcttatgcagactattgtcattatgt

SEQ ID NO: 5444 - DNA, 491 bp, Sorghum bicolor
  Clone ID: SORBI-28MAY03-CLUS13918_1
gtcgaggaggcgctcggctacgccaagctcgcgctcaagtgcacggagatgcggcggagggaccggccggacctcgctactgtcatactgccggagctcaaccggttaaggaaccttggccacgcgtacgaggcacgcatgagcaccgccggggccaacggcggaagtgccgaaaacggtgacctggtcagcgcgacctcgacgacggtgggtggttcttggaaaacggcggagagctagcgggaggtccggtgtggccctgtgtcagttagagagcgagcttttgtacggagaggagaagtgtccatggaacttaacgttctttttatggatggagatcgagttttttaaaaaaaaaccaaaaatcttggtgtatgtacagtcttctgtctatgagaaatactaacacgtcttgcagcgctgctgcctctaatcattttgacttctgagggccatccatgaaccaaaatttcctgttctgttggcttgtt

SEQ ID NO: 5445 - DNA, 452 bp, Sorghum bicolor
  Clone ID: LIB3480-017-P1-K1-E7
cgagacgcagacgaaccccatggatcagtcagtagcacagctccttctgcagaaaccctcttaccggagggaccggccggacctcgctactgtcatactgccggagctcaaccggttaaggaaccttggccacgcgtacgaggcacgcatgagcaccgccggggccaacggcggaagtgccgaaaacggtgacctggtcagcgcgacctcgacgacggtgggtggttcttggaaaacggcggagagctagcgggaggtccggtgtggccctgtgtcagttagagagcgagcttttgtacggagaggagaagtgtccatggaacttaacgttctttttatggatggagatcgagttttttaaaaaaaaacccaaaaatcttggtgtatgtacagtcttctgtctatgagaaatactaacacgtcttgcagcgctgctgcctctaatcattttg

SEQ ID NO: 5446 - DNA, 1049 bp, Sorghum bicolor
  Clone ID: SORBI-28MAY03-CLUS13919_1
gctgtttcccacactgcagtggcctggccggcgtcctcctccccctccctctgtctcgcccctctgtcctctccacttgagaagaacacaattagaaaaaaaaaaaggcaaaaaaacatttacctttttttctatctatattatctgaataaatcaagaagaggaagaggggaggggagagcagggagggggaggagcagcaaatctagacgccatagcaataagctcgcgagaaggggaaggggcgcgagggagcttcgctggtgtattgattgctcgctgctgctccagtcctgcattcgtgccgtttctggcaagtaggtggcgtggcaagcatggtgccgggctatgactgcgctgcctccgtgctgctgtgcgcggaggacaacgctgctattctcggcctggacgaggagggggaggagtcctcttgggcggccgccgctacgccgccgcgcgacaccgtcgtcgccgccgccgccaccgggatcgccgtcgacgggttcttgacggagctccccttgctctcggatgagtgcgtggcggcgctcgtggagagggaggtggagcacatgcccgctgaggggtacccccagaagcttcagcgacggcatggggacctggatttggccgccgtcaggaaggacgccgtcgattggatttggaaggtcactgagcattacaatttcgcaccgttgactgcagtattgtctgtgaactacctcgatagattcctctccacgtatgagtttcctgaagacagagcttggatgactcagctcttggcagtggcatgcttgtctttggcttcgaaaatggaagagacttttgtgccactccccttggatttgcaggtagccgagacaaggtttgtttttgagggaaggaccataagaaggatggagcttcatgtgctgagtaccttaaagtggaggatgcatgctgttactgcttgctcatttgttgaacaatttcttcataagttgagtgatcatggtgcacccttcttgctcgcacgctctcgctctttcgatcttgtcttgagcact

SEQ ID NO: 5447 - DNA, 775 bp, Sorghum bicolor
  Clone ID: SORBI-28MAY03-CLUS13668_1
gcacgaggcatatgcttgtctcaaagattaagccatgcatgtgcaagtatgaactaattcgaactgtgaaactgcgaatggctcattaaatcagttataggggcttcgggcgcccgtccggcccccgtccccgtcggcatcccacccccaaccccgccgccgcacccccacgccccggcgcccccccgtgctctgccctctggccctccccggccctgctccccgtccccttccgccggcttccccttccccgatccccttcctcctccgatccaattccgcaccccgcgcctcgccgccgccgccggccatgtccaagtacggcaccatccccacctcatcctccgcgggcggcggggcgccactcggcggcgcctccccgctcgacttcatctcacgcgccaaggcccggggcgcctcggcgctggcgacgcgccggccctggcgcgagctcgcggacgtccacgccgtcggcctgcccccgagcctcggcgacgcgtacctccgcgtgcgcgccaacctcgcgcacttcgccatgaactacgccatcgtcgtgctcgtcgtcgtcttcctctccctcctctggcaccccgtctccctcatcgtcttcctcgtctgcatgctcgcctggctcgtcctctacttcctccgcgacgagcccctcgtcctcttcggccgcgtcgtcgccgacggctacgtcctcgccgcgctcgccgtcatcacgctcgggctcctcctcctcaccgacgccaccgccaacatcctctcctcgctg

SEQ ID NO: 5448 - DNA, 663 bp, Sorghum bicolor
  unsure (1)..(663): unsure at all n locations
  Clone ID: SORBI-28MAY03-CLUS13681_1
cacaacttatgaagaatatcagattcaaatatacgagggagcatcaacgttgtatggtcctcacaccttgagcgcctacattcaagaattccagaaacttgctacatccatggttacaaacaaggaggttgttccaacaaatctgcagcctcctgatctactaaaccggcaaattggtctgctcccaggtgtcatagtcgacgagacacctcccggcgtcaagtttggagatgtcaggtcagacgtccctgcgaactcaaccttcaggaagggcagcgttgtgaacgctacattctactcggcctgcccaaggaatgatctcctcaccgacggcactttcgcgctcgttgagaagctggatggcggaagcgattgggttcctgtctatgatgacgacgattggtcgctgcgcttcaggtggtcaaggccattgccggtgagtccaatgagttttgcaacgctggagtggacagttcctgaagatgccacatccggtgtttacagattgagacattttggtgcctctaagccgctgattgggtccatcaactatttcacagggacctctagcgcatttgtagtacgttagtacacctataaaattcacatcatccaagcatgtactccgtatcgtacaatgtttttnccttgggtttttacaat

SEQ ID NO: 5449 - DNA, 694 bp, Sorghum bicolor
  Clone ID: SORBI-28MAY03-CLUS13702_1
gtgatcttctcagggaaaaccttgatatgagggttaggttggtggttaactacaatggccttagcgttggtgcagtacgagacgtgtttgagaagtcccttggcctgcgtctgcagaagataaatcctaacactgactttcactgcttgaagacctttggttctcacttcacagaagatatcgccataccttcgggtacaaagattgacttctgtcaaacatcagatgggaaactaataacagaaattgatgggaaacaaatcggtgctgttcagagcaaagatctttgcaaggctttcttcgacatgtatattggtgattcaccgatttcaatggaggccaaaaaagttgttgcccagaacgtggccggactcattggaagacgctgaggaaagggaaagatgattatttcattcttctgtacagttagggaggattcgtatgagcgggaaaataggcgagaatcattgcaagtatatagagtgatctgtgtcttgtaaagaaagcaggcaaaagctccaatgtatatgtggaagatagcatcttcagttgtgctaggcccccccattctttttttttgtttggattggatgggccttttgcctcttcgtagctgctgtatcatgtaaatgctcccattgagccaggagttgtaaaatattaaattgaatatgcttcttccataaaatgatgc

SEQ ID NO: 5450 - DNA, 885 bp, Sorghum bicolor
  Clone ID: SORBI-28MAY03-CLUS13730_1
gatgtctcgagaccaccgcgcaaactatgtcgaggagtgcgagagggtcgcggcatccggagggtgcattgaggatggctacctcaacggggtcctctcggtgacgcgcgccctaggcgactgggacatgaagacgcccgacgcgtcggtgtccccgctcattgcggagcccgagttccggcaggcgacgctgggcgaggacgacgagttcctcatcatgggctgtgatggcatctgggacgtgatgacgagccagcacgcggtgagcctcgtacggcggggcctgcggcagcacgatgaccctgcccggtgcgcgagggagctcgtgatggaggccaagcggctggagacggcggacaacctcacggtcattgtggtgtgcttcgcatcggagatgggatcacaacagcaggagcagcccgtgaggcccaggagctgcaagggcctgtcgacggaggcactgtgcaacctgaggagctggctggagaccgaccaccgctagagggagaacctgaggagctggctggagaccgaccaccgctagagggagaacctgaggagctggctggagaccgaccaccgctagagggcggcggcagcggctgcttgagtgtggaggaggttgggttcgggatgtgtaaatactatgctgacaacactggttgacgcatgatgagcgctgggccatttgttgagaggcggctgcggattacgtaggcaggtcagctgtagcagcagccagcagttttgtaggttatttttcactttgttctttctttctttctttcatccttgttatttagtcgttgatgttattgttagcaccacctctctgttgtacatatatgtattgatgatgatgttgatggcatgctccattgccac

SEQ ID NO: 5451 - DNA, 678 bp, Sorghum bicolor
  unsure (1)..(678): unsure at all n locations
  Clone ID: SORBI-28MAY03-CLUS13715_1
tgactgcccgtgcgtatgtgcgtgactacagacctctctcgaagagccgacctctccagaagcggacaccgcgggcagcactcctccaggtgccgccaccaggggcgaccgcgacggcgatgggcgcgaccggcgcgccacggccgccctcctcctcctctctctctctccctttccctcaagcgttggcggcggggcaccaggcgacggcgtggcctgcaggcggggcgacgatactggtctaaaacatctggaatcgagatttcggtcatctgccttgtggcgtcggcgtcctccccatcccggccccccctcctcccctctcgagtcgacgaacgcggcagctgcttcggttatcttgtatcagtctacagctactccccctccccagccctcagtcccgccaccagaagccctcagtggcccggggtcgctgcaacatcgattctcttccgcccgccctccctcccagttccgctgcgcattcggccggccactcccggcggccgcgccgcagcgctccaccggcggggggcccgcgctcgccgcccgccggcgttgcggcgccgccgtgcgggcctcggccccgctgggtcctcttctccctttctctctcgttctctccgtccctcctgatgtggcggcgtgccagtgactccnatgttgctccctccctcg

SEQ ID NO: 5452 - DNA, 875 bp, Sorghum bicolor
  Clone ID: SORBI-28MAY03-CLUS14096_1
cgaagcggcggcggatcctgtggggctgggccaacgagtccgacaccgccgccgacgacgtcgccaaagggtgggctgggattcaggcgattccgaggacggtgtggctggatcccagcgggaagcagctgctgcagtggcctatcgaggaagtggaggcgctcagaggcaagtcggtcactctcaagaacagggtgatcaagccaggacagcacgtcgaggtgaccgggatacaaacggcacaggctgacgtggaggtgagcttcgaggtgccgagcctggcgggagcggaggcgctggacgacccggcgctcgccggcgacgcgcagcggctgtgcggcgccaggggcgccgccgtggagggcggcgtcggaccgttcgggctctgggtgctggcctccgccaaccgggaggagaggaccgccgtgttcttcagggtgttcaggcccgcgcgcggcggcggcaagccggtggtgctcatgtgcaccgacccctgcaagtcatctctggacccgaacctgtaccagccgacgtttgcaggttttgtggacacagacatttctaacggcaagatctctctgagaagcctgatcgaccggtcggttgttgagagctttggagccgggggcaagacgtgcatcctctccagggtctacccgtcgctcgccatcggcaagaacgcccgcctctacgtgttcaacaacgggaaggcggacgtcaaggtgtccagtctcaccgcatgggagatgaagaagccactcatgaatggagcttgaaatgtttacatgtatacgagcttcaattggttgtgcgtgatggatttttagaaaagagaattatattgatatcctaattaattagcttctgtatggatt

SEQ ID NO: 5453 - DNA, 712 bp, Sorghum bicolor
  Clone ID: SORBI-28MAY03-CLUS14109_1
gcaccacgggcgtccaaccccgttcgcatacagtgcgcagcagcatcccacaccgcgcaaccgcgcgctcgcggtgctccctgctgagtgtcttccatggcctgcgtgcacgcgcagcccgcgtgggcgctggcgctcgcagcgctggggctcgtggtgtcggcgcgcgccgcggcgcgcctcgcgctgtggctgtacgcggcgttcctccgcccggcgaagccactgcgccgccggtacggcgcctgggccgtcgtcacgggcgccacggacggcatcggccgcgcgctcgcgttccgcctcgccgcggccgacctcggggtcgtcctcgtgggccggagccccgacaagctcgacgccgtcgcggccgacctcaagtcgaggcgccccggcgcgcaggtccgcaccttcgtcctcgacttcgacgccgacgacgtcgccgcgaaggtggacgcgctcggggagttcctccggggactcgacgtgggcgtgctcgtgaacaacgtcggcaggtcgtacccgtacgcgcgctacttccacgatgtggacgaggcgctggcgcggagcctgatacggctcaacgtcgatgccgtcacgcgggtgacgcacgccgtgctccccggcatgctggagcgcggccgtggagccatcgtcaacatgggctccggcgcctctgccatcatgccgtccgacccgctctacaccgtctacg

SEQ ID NO: 5454 - DNA, 811 bp, Sorghum bicolor
  Clone ID: SORBI-28MAY03-CLUS14173_1
gcaaaccctgctcgtccctcctcccccgctttgcggcgcgccacatcgaactcgccgacgcgctccagagacccatggatcgtcgcaagggcagcaaccgcgacgccaacggcggcctggcggaggccacggcgtcgcggctgaggttcgacaccgaggaagaggcggaagaggtgggtatggaggtggaagagagcctcgacgcggagggggaggacgggcaggcgtcggcggaggtgattggaagcgaaaagaccagcgccgactactacttcgactcctattcccacttcggtattcatgaagaaatgctaaaagatgttgttcggacaaagacatatcaaaatgttatcttccagaacagctttcttatcaaggacaaagtagtccttgatgttggtgctggaactggaattctttcacttttctgtgcaaaggcaggagctaaacatgtctatgcgattgaatgttcccagatggcagacatggcaaaggaaattgtgaaatcaaatggatattctgatgtcataactgtaataaaagggaaagtggaagaaatagaacttccggtcccaaaagtagatgtcatcatctcggagtggatgggttattttctcctgttcgagaatatgttgaacactgtcctatatgcacgtgataaatggcttgctgatggtggtgtggtcctgccagacaaaacttctttgcgtcttactgcgattgaagatgctgaatataaggaagacaaaattgaattttggaataatgtatatggatttgatatgagctgcataaagaaacaggcgatgat

SEQ ID NO: 5455 - DNA, 865 bp, Sorghum bicolor
  Clone ID: SORBI-28MAY03-CLUS14111_1
agctaatcccgcacaacttatattttgatggtggatcagtatgtgtgtatgactcagtgctaccaggaaagatttggctaatgattgatagagagatggtgatgcaaatgttatgcaatctggggagcttgggctggactccggagcctgaattattggtggtgctggctggtgctgctacaggggcctagacagaagatgtgggcgtgcatgtggcaggggagcatatgttgtggtgtttactatcccaatattgacttggagggaaatgtgtgcctgaacattttgcgtgaagattggaagcctgtcctgaacatcaacaccattgtgtatggcttaaatcttcttttcacgcaaccttatgacgaggaccccctgaaccatgatgcagcagctgttctccgcgacgacccgaaaaagtttgagaaaaatgttcgaatggcgatagctggaggctacgttgatgaaacccactttcctcgttgtatgtaaggcctgatgaagatggtgaccggtatctgaccatggctgtttctgatcatagcagactagctgtgtgtgttatatgaaacataagatgcccagagaaaaaacgctattgaagtacacctgtaatgtgagataagttgatgtgacagtcactgaactcatgctaccttctagccgttagcagggttcattagggatggtaatgatgcatgtgattcttttctctgctttggagaaaacactcaacacgttgcatgttaagtaacagaaagctttggcaggattacgtgcattatatgttagctagatctgttctttcttatttccaaacgatgaggctttcttgaaagcccttcatccaaaaaaaaaaaaaaaa

SEQ ID NO: 5456 - DNA, 699 bp, Sorghum bicolor
  unsure (1)..(699): unsure at all n locations
  Clone ID: SORBI-28MAY03-CLUS14187_1
cgtcgcgctgctctgcctgtacaaccacctccacctctccctctccgacccggcatccgtcgtccccgtccccgtccccgccgccgccgtccgctcgcaccgccgcgccggtggccaccgtaccaacaccactccgtccgggtccggcaacatcgtcctccgcttcggcatgtccgggcagccgctccgcgtctactcccccgcccccacccccaccgctggcggcggcatccctgacatcgacacgttccgcgacaagctcgaccggctgctgcccgactggtcgcgcttcgacggcgagctcggccccatgcaccggtacttcgggctggacgggccgctggacgtgcgtcagcggctcgcgtacctgttcgtgatccttgaccggtcgcctagggacggaggcgtcggcgtcgacgagctggaggcgtggctgcgccggcaggccgtcgcccggctggacgccgncacgcggagggagatggcccggcacgacagggaccgcaacggtgccgtcacgctgcgcgaattcttcgcagactggagcaacatggggcatggcaaaatggcgaggtggatggacaagtttgcgagcgcggacagaaacggagacggctcgctcaacgccgtcgaattcaacgacttcttgcatcctgaagacaccagccaaggagatgctcaatgtccgacgctagaaga

SEQ ID NO: 5457 - DNA, 705 bp, Sorghum bicolor
  Clone ID: SORBI-28MAY03-CLUS13863_1
caggatccaaacaaaaaaaaaaaaaaaaaaaaaaaaaaaaaaaaaaggggcggccgctcgcgatctagaactgctgtgtcctctgctctcccaaatcaattcactaccgccagcgccggatccaagaggagttggaggaagatgactgtgggcatgatcaacgcaaacccggtggtgcacgagcggccggagcgcgccgcgcacccccacgccgccgacgcgctcgacccgctcgatgtctttgatacggtgcgggatatcaaggacccggagcacccgtactccttggagcagctcagcgtgctgtcgcaggagtccgtctccgttgacgagaagctcggacgcatccagataaccttcaccccaaccgtgcagcactgcagtatggccacagtcattggtctgtgcctccgacttaagttgatgcagaacttccctccgcatttcaaggttgacatcaaagttgctccaggatctcttgctaatgaagaatcagtaaacaagcaactgaacgacaaggagagagttgcagcagctttggagaaccccaacctacgccagttggttgatgaatgcttatgcttcaatgatccatactcacgttaacttgttccatgctgcttcactagtcacaacctgcctgctgtgctgtacagttgtaaccatgcatgctgtagtttgcccaatatgttaaactgtgtatac

SEQ ID NO: 5458 - DNA, 717 bp, Sorghum bicolor
  Clone ID: SORBI-28MAY03-CLUS13865_1
tactaatagctactcacaagcccatcagggacagacaacgcggaagcaagcgcacacgtacacctacacctacacctacctcggcgagcaaaggcaaaggctgatcggagagccatggccacggccacggccacggcggcgccccgccacgccgcgctcctcctgctcctgctggtcggtctccacgccacggccaccgtcgccgcgcgcgcgggcgccgcgcatgatgccgagctcacgtccaagccgtccccgggcactaagaagcccagcgtcaagccgcctggtaagcccagcgtcaagccgccgcccgtcggccccggcgcgggcgcggggggcgtcggcggcgcgatcccgaccatcccgggcttcggcggcggcatccccgggatgggcatgggcggcggcgggttcggcagcatccccgggatggccggcgggtggggcggcggctacggcgggccttccggcggctacgcccgcggcggcgtggtggcgcccacggtgacctgcaccgagaaggggccctgctacaggaagaaggtcacctgccccaagaagtgcttctcctcctacagcggcgccggcaaggggtaccgcggtggtggcggcggcggcagctgcaccgtcgactgcaaggtcaagtgcacggcctactgttgattcacctccgcccgccgtccgctggcgctgagcagttagctggcagtagtggtg

SEQ ID NO: 5459 - DNA, 699 bp, Sorghum bicolor
  Clone ID: SORBI-28MAY03-CLUS13878_1
gcacgaggcccaccacggcgtggttcgacccgtcggacaacacctggcgcatcgtcatcgggtccaaggacgacgccgagggcgaccacgccggcatcgccgtcgtctaccggaccaaggacttcgtcagcttcgagctcctccccggcctcctccaccgcgtcgcgaggacggggatgtgggagtgcatcgacttctaccccgtcgccacccgcggcaaggcgtccgggaacggcgtcgacatgtccgacgccttcggcaagaacggcgccattgttggggacgtcgtgcacgttatgaaggccagcatggacgacgaccgccatgactactacgcgctcgggaggtacgatgcggccaccaacgagtggacgccgctcgacgccgagaaggacgtcggcatcgggctccggtatgactggggcaagttttacgcgtccaagaccttctatgaccccgccaagcgccgccgcgtgctctggggatgggtcggcgagaccgactcggagcgcgctgacgtctccaagggatgggcatcgttgcagggtatcccccggacggtgctgctggacaccaagacgggcagcaacctgctgcagtggcccgtggaggaagcggagacgctgcgcaccaactccacggacctcagcggcatcaccatcgactacggctcggcgttcccgctcaacctccggcgcg

SEQ ID NO: 5460 - DNA, 596 bp, Sorghum bicolor
  Clone ID: SORBI-28MAY03-CLUS13881_1
atcttggagcagatcctcgcctgcacgtcgcaagagcacctgctccccgacgtggtcacgcaagaaccgccccgcccgtcgacggccggtgcgcggtccaaggccgtcctgatgaccggcctcagctcgtggtactacgagaacatccggtggaagtactggcagtcggcgacggccaccggcgaggtcgtgagcgtgtaccagccgagccacgaggagcaccagctctccggctacacgacgcacgacatgaaggcggtggcggagatgtacctcctgggcatgacggacaagatcgtcaccagcggctggtcgacgttcggctacgtcggccacggcctcggtgggctcacgccgtggatcatgttcaggcctgagaaccacaccacgccttacccgccgtgccggcgggccaagtcgatggagccgtgcatgcacgggccgccgttctacgactgcagggcgaagcacggtgccgacacgggaaagctggtgccacatgtccagcactgtgaagacatgagctgggggctgaaacttgttcaccccgagtgaaaacaacaataatgaaaagaatattttcctttttcatgact

SEQ ID NO: 5461 - DNA, 608 bp, Sorghum bicolor
  Clone ID: SORBI-28MAY03-CLUS13903_1
gcacgaggcccgcatccatcccgtcccctctcagccggcgctcgcctctggtcgttctcgcccgccgcgccggtccgccattgttttgcccgtctcttcctccctctgcgtgtccggtggacctccgtcgtagctggtgctcgtgcggggggctgccgctgcacccccccctcctccgtcgtatttgcgtcgatgtttgctccgacctaggttttggggtttccacaccttcggcgccgccggtgtccgctgccctttcagtcttctccggtccattgagcttcttggtatgcctctgccccatgtgttttcccctatcttcgcctatgatttgtttcgtttgctttggtgtttgctccgacctaggtgttggggtttccacaccgtcggcgccgccggtgtccgctgccctttcagtcatctccggtccattaagcttcttgttcaggtttcagctctgaaggtccgcggtgccctgcatttgtgcctggttgggtcgatctccatctaggtgcttccactcctgcatgctcctcagtatacaaatggatccgcagcttggtggtggatacaaatgcccaaaaggtcatggcacaaatgcattacct

SEQ ID NO: 5462 - DNA, 734 bp, Sorghum bicolor
  Clone ID: SORBI-28MAY03-CLUS14267_1
cgttcccctttttccgccgtgcctccctcccactaaaccctagatctctcttcctctctctcgaggactaggaaggatgccgccgtcttcggctctgagcaagcgcggcggcggaggggacggcatcctggccgccatctcgcggtcgcaggtggcggcgcacgggcgcgaggcggcggccatggcgaagaagctgctgcggagcacggggaaggcggcgtggatcgcggggaccaccttcctggtgctcgtggtgccgctcatcatcgagatggaccgggagcagcagctcaacgacctcgagctccagcagcagacgctcctgggcggaccgccgccgccggcagcagccaagtagatggatcctccatggatcgacccttttgttcctctctctctctctctctctctcccttcctctaggtgtgaggtgtctgtcgctatcaagttcatcattcgagttgagaggagtttcagagggagggagttatcgagtcggcctgttgtcggtcggtcgtaattaaaggtgaaaaaaaacctgttttgttcatgttcgttctcgatgcaacactagtttagtttccctttctatgaattgaaacggattgatgagataagttgtgctcggtcgctgctgctgctgcttgttcttgttatatctgtctgtgttagcgattttaatgactaataaatctgcttcttgcagttattctggatgaagaggcaagcaaagc

SEQ ID NO: 5463 - DNA, 417 bp, Sorghum bicolor
  Clone ID: SORBI-28MAY03-CLUS14298_1
ccttgggggttacttattactttcattgaattgataaagaatccgcgttacaacttttggaaccggtcttttacacactgtgcacctgagattgagaaactgtttgagtcggtggcaaggtcctgcggtgcaaaagctgtagacgaaggaatcagtgtgcatgatggcagtcactaaagttatttgctttgttgaagtgttgtttttgtactatttcttctgtctggcactgtaaatatttgcgtgctgccctatctgtgcttgtacagatcgtctgaatagtaaataaggctggaaaactgtagtgcgtcttgtcagcgatttgggtgcctgtgcttttgcctggcagctatggaattactattgattgcaagatgctccaggtgcaatattttctgtggattggttgccctttcc

SEQ ID NO: 5464 - DNA, 703 bp, Sorghum bicolor
  Clone ID: SORBI-28MAY03-CLUS14336_1
ctcacggcgagaaccgacctactcgacccttctgccggcgatgcgctcctggccttaattggccgggtcgtgcctccggcgccgttactttgaagaaattagagtgctcaaagcaagccatcgctctggatacattagcatgggataacatcataggattccggtcctattgtgttggccttcgggatcggagtaatgatcatctgggacgggccggggcttgcctacttcgtggtcggacgtgctgttcccggctttttgtttgccgttcagctgcgatagcggttgcctggcacgttctcattattccacctcgcaggttcgggccccgtagacggttggcccatgtcgcgccggagggttgtcccaaggtaagcgtaggatggatttcacaagcaaattcagagctgtgggcaccttgcaaactcatccttttgctgcttcatttcaagtttagaccaacttctgtagagaacttttagcacagttaactagaagtcatattgaggtgtcattcatttggagttctcatttagacttttgtgtagtattcattttttcattctaatgccactcttttgtgcagtattcttttttttattctaatgccaataacttgatggatggatctgaactgtatgtataaatcatacagctgaggttgtaattaaggatgaggtctgctgctgtaaattattttttt

SEQ ID NO: 5465 - DNA, 872 bp, Sorghum bicolor
  Clone ID: SORBI-28MAY03-CLUS14345_1
gtcgacgccggcctctaactcggagagtcggagcccggcggccggagggcgacgttcctaacaaataataatttattattattacacagctaactaataagccatgggtaagcgcagcgtccctcggtaccctgaggacgaggacaaaggcggttgctgtggctgcctctgctggtgctgctgtttcctgttgctcatcgtggcggtgctggccggcacagccgcctacttcttcttcgtctacaagcccaaggcgccgtcctactccgtgagcaacatgtctgtctcccagttcgactttaaatcctccgacttgacgctctacgtcaagctcacggcctccgtgcgcgccgagaatcccaacgagatgatcaccatcaagtacggcgaaggctcccacaccgtggtctcctaccgcggcacgccgctgtgctccgggaagctcccggccttcttccagggctacaagaacgtgaccgtcatggacatctccatggagggccgccacggcttcggctccgggctgcagcaggcgctggaggagagcgagaaggccggggacatcccactcgacatcttcgtcagcgtccccgtggagctgcagctcggctccctcgacctccgccaggttaaagtcaacgtgcactgcgcgctcgtcctcgacagcatctcacccaagaagaagcccaacatcaagtccgcaacctaccaggccaacgtagagttttgattgattgttcacaatcatatatatttattatttattggatcagagttgatcaatccagggaacatatgcatgccaattacgtatgcatattatttgtctgcactgattgctcggtcgctaatatatttagggggtgctgggg

SEQ ID NO: 5466 - DNA, 935 bp, Sorghum bicolor
  unsure (1)..(935): unsure at all n locations
  Clone ID: SORBI-28MAY03-CLUS14356_1
gccggccggccgggccggggatagtagctcatgtaattgcaatgtcctatcacacgaagaagaagaagaagaagatgccaccaccaccatgctattgctcctccctgataacaataacaataatcctcctcctacaacaacagaacaatccctggactacagctgcagcagcttcagccatggccaccaccaccaccaagcttgggtcgtcaccgttgtctgacgtggtaaaggacacctgcgagagatgcaggcagggcaacccacaggtgaactacaccctctgcgtctcgtctctgtcgtcggaccccaagagcaggcaggcggacctccacgagctcgccatgatctcggccaagctggtgaggtcaggcgcagtgggcatggaggccaagatggcggagctcagcaggaaggagcggccatggtctcgccggaggtcctgcctggaggcgtgcatgggggtgtaccacaactccctctatgacctcgacgcctccatcgcagccatccaggagaggaggtatgcggacgccaagacgtccatgagcgccaccgtcgacgcgcccatcacctgtgaggatgagttcaaggagcagggcctggagccacccatgaaagcagagagcaaacgcctgtttcaacaggcggccatcaccctcgccatcatctcccttctatgatagtattgacatgatccatctccctccctgcgatacagtacagctactgcttgctactagtgtgcaactagctagctatagatagtgcacactccaatatactngcatgtatggcatcatctatcgctccatgtttgtttatctacaatatatatgcaatccggcattgtcaaannaaaaaaaaaaaaaaaaaaaaaaaaaaaaaaaaaaaaaaaaaaaaaaaaaaaaaaaaaaaaaaaaaaaaaaaaanag

SEQ ID NO: 5467 - DNA, 701 bp, Sorghum bicolor
  unsure (1)..(701): unsure at all n locations
  Clone ID: SORBI-28MAY03-CLUS14346_1
tntnnnntnntnnnnnttttgcaacacttaaatcgattaatattaggttgggatagagaccagtctgatagggatccaaaaaaggaacaagatgttcttgaatgccttaagccacacaataatcttcaacaagtgtgcattagaggacatggaggtcacacataccctacttggctatgttcagaccactctgctaagaaattggaatgcctttgtctcaaaggtgtagcctggaaaagtcttccacctttgctaggagtgttgttggtggtcggcgaagagcacccaaatgtcacaggccaaatcttcgagaatagagttgccatctccgcacatgtttcccaacgtacaggagatatacatttcagagtgtgaggaattagtgtcagtgccaccaattccttggagtagttctctgtccaaagccgaattgatgtcccagagccttcgcagatgtgcgaacaagttcttccccaacatagctccaggctgcaggcgctcgaaacggatggggaagctggaggcgccattgctgtgcccgtcgggggccacttctcttcctctctcaccgagctatgccttggtcggaatggcgacttggagcacttcacaatggagcaatcggaggccctgcagatgctcacctcccaccaggttcttcgaattcagtgttctgcatccggccgcctcgagcgccgcac

SEQ ID NO: 5468 - DNA, 475 bp, Sorghum bicolor
  unsure (1)..(475): unsure at all n locations
  Clone ID: LIB3480-017-P1-K1-C11
cggacgcgtgggcaataatcttcaagaagtgtgcattagaggacatggaggtcacacataccctacctggctatgttcagaccactctgttaagaatttggaatgcctttgccttgaaggtgtagcctggaaaagtcttccacctctgctaggagagttgttgatggttggcgaagagcagccaagcgtcgcagagcaaacctttcagaatctaaaaattctagaacttgtcaacatagcaactctgaaaaaatggagtgtagatagccctttctctaagctagaggtactcactgttaagaattgttctgtacttacagagctgccatttgcgcacatgtttcccaacgtacaagagatatacanttcagagtgtgagaaactagtgtcagtgccaccaattccttggagtagttctctgtccaaagctaaactgcagagagtgggtaagattattgagaacttagattacagc

SEQ ID NO: 5469 - DNA, 589 bp, Sorghum bicolor
  Clone ID: SORBI-28MAY03-CLUS14777_1
gggaactgggcctcgtatttctgtaaataaaatgtaaaattccaacagtgcaagccactacagctaaaccctcaggcagctggaagaaaatgaagatggttaacatatagtcagagaaagaaaaaaacagtgcgaaaagaatctgtatctatttacgtttttatttcctaaacacaaactaccaaactctacttaaaatacaagtgtatgtatcgttgtgtcccatatctgtacaattgtccattactagccccgaaggcccaagccgtttcgtcgctaccagtacagtcagttccctttgtcagccgctccattacattctgatgaagcctcttccacgagccgaatttgtacaccttaccaaattttctcctcttcgtataatcaaaatttcaacaaaaatcagctcaacaaatgaatcaacacagcctcaaattcagattgacaaaataactgtgtgaaaccgttgttagctgatgtcacccgcgtgccttgaacccaactgctggggcagctttttaaaaagctcaacttctcttgctatttgaatatcagatggcctaaaggtctgatatactactttacaaag

SEQ ID NO: 5470 - DNA, 693 bp, Sorghum bicolor
  Clone ID: SORBI-28MAY03-CLUS13989_1
catgagtgagcaggctgcaggagatcgagccaatagctcactaactagtaagtaactactactactgatggaatggttgcctctgttcccgtgttcgttcttacagccgcgtggtgttgctcggcgatctcaactaccgggtcgccatggacgacgaggacgaggcacggcagctggtgacggccaggaaatggagcatgctgctggagaacgacgagctgctgctggagctctccaagggccggcgattcgacggctggcacgagggactcgtcaccttcgccccgacatacaagtaccaccgcaactccgacaagttgtactggtgggcggacggcggcgccgacaggggcggccatcggaattcgaagcagcaccgcgcgccggcatggtgtgaccgtatcctctggcgcgggaaggggatgatgcagacacggtacgagagctgcggcggctaccgcctctctgaccaccggccagtgagggcggtgtttcacttccacgccgtgtgcgaggtcgctaaacatgtatagatactaagatagttatatatatgcaagcagatattgtgtgctttgaaacatagctataggcctatagctaaccaaggaggcatcgacacattgtaaatctaaggggttgccttataaacaaaaatattacagacattcttttacgggaccgaaacagctc

SEQ ID NO: 5471 - DNA, 546 bp, Sorghum bicolor
  Clone ID: SORBI-28MAY03-CLUS14037_1
gcacgaggctcaaactcaaactcaaagacgacggggaggaggaggagaagacggttgagagcaaaaacctcgaagaggaggagcacaaggccacgtcgcctgctcctacaaatgaggatggggaatcagctgggcagatgcagaacaccacggaacccgtggaggccaaaccggcggtcgatgagcacaaggcggaggaggcggccgtcgtcccagcaccgccgtcggcggaggagaagaccaccaccggcaccgacgaacagaccgctgccaccgtcgtcgcgagcgaagtggccgccaactaatcaacacagattagaaggaggccgcgaagatctagacgacgtgcgtgcagcgcgcgcatcgatcatgcatgcatgcatattgctgaattcgggcgggttgtgtgtctgtcactctgtctgtctgtgtttatcgatctgatgcatgatgatgcatggaatgcgttcgttgtacgtggggtggacttgaatattaatgtgctcgatcgatccaaaccattctcgcgaagccaaaggcgcgtcc

SEQ ID NO: 5472 - DNA, 656 bp, Sorghum bicolor
  unsure (1)..(656): unsure at all n locations
  Clone ID: SORBI-28MAY03-CLUS13968_1
gccggccgggctgcgagaactcttcgtcagccctcacatacagttgggaggaggagcacgatcgagagccctccggcgagacgacctccctctccgtcctttagcgcgcgaccgaccagtgcgcgtgagatcagcggcccgggcgatccaagatgtcttggcagacgtacgtggacgagcacctgatgtgcgagatcgagggccaccacctcacgtcggcggccatcgccggccacgacggcgccgtctgggctcagagcgccacattccccgagttcaagcccgaggacatgaccaacatcatgaaggatttcgatgagccggggcacctcgcgccgacaggcctgtttcttggagccacgaagtacatggtcatccaaggtgaacccggcgctgtcattcgtggcaagaagggatcaggaggcatcactgtgaagaagacagggcaggcactcatcattggcatctacgacgagccgatgactcccgggcagtgcaacatggtggtggaaaggctgggcgactacctggttgaacagggcatgtagccttcctggatgtcgatatatggcttggctcagntcagatttctttcaataacaaagccaacaagacctttgcatggttccctgtttgcttgcattggctcttcttct

SEQ ID NO: 5473 - DNA, 433 bp, Sorghum bicolor
  Clone ID: LIB3480-010-P1-K1-B1
gacccacgcgtccgctagttcttagatcgcgagcggcctcccttttttttttttttttttgttttttttttttttttttttgggcgactacctggttgaacagggcatgtaaccttcctggatgtcaatatatggcttggctcaattcaaatttctttcaataacaaagccaacaagacctttgcatgtttccctgtttgcttgcattggctctttttctccaccgccacaagatgaaaatagtagctgctccgctggaagttttcaattttggctcactccctgtagtttacattcttgggttgcttcgatcatttggctgtaacgtgaataccatggaggaatgccctatatactaagcaagcactcatatatatatatataaaatccttttttccgcaagaaaaaaatatgtcaacctaagtttccttgt

SEQ ID NO: 5474 - DNA, 654 bp, Sorghum bicolor
  unsure (1)..(654): unsure at all n locations
  Clone ID: SORBI-28MAY03-CLUS1404_1
ccgaattccgccggccgcacgcctcctcgctcaattggcacagagtacacacagcgcagccaaccactccagaagctccgagaacctagggtttccccacctccatggccatcgccgccgccgccgccgctgcggtgcatccgttgccgccgccgctagctcggcgtaccgtggcgtggttggtgtgcacccacctcgcctgggccgccgtcgacgccgtcatctgcttgttcctcgcaagcatgtggcttttcttcttgggcctggccaccaatgaaatcgggcggctcgcctgcggtgagggttgcgctgtggtcaccgcggcgtacaacctcgtctctgtagcggcgggggtcaccgttgtgctcgtcctccccttcagcgtgagcgtgctactgatggcatcgatgatggcccgcgcgcaggcggcggcgacgacggccactgacattgaggcaacgaaggaacctgctctgaagacatcgtatgcggcagtgcgggagacgctgtgcgactctctcgctcttggagttgctgcgtcaatggcgttcaccctgctcatgctcattggtgatctgggtgaagtgggactcgcncgtgatgnggtctcgtcggnnagagagtgggttcagtgatacatgacgtgngagcatt

SEQ ID NO: 5475 - DNA, 863 bp, Sorghum bicolor
  Clone ID: SORBI-28MAY03-CLUS14049_1
gcacgaggccaccccactccgccccacctccgcgcctcagatccacccccaatccggcaaccctagcgccgggttcctcctcctcgtctccgaccgccgcctccgccgcgccgcctccattgccagaggtgatcgagggggagagggacacagagcttgggtggtcggattaggggcacggggagggaggggaggatgtccagaaggtcggtgaacccgagccggcgggtgtcggacgggagtctgccgtccgtcggcggcctgttccaccccaagtcacgctcgcctcccgtgctcaccattgccctcgtcgtcctgggtgtcattcttctcatcgcctacttcaacagcagctcaggtgtaactgttacaagcagagagtctgtgaccaggtctgaaggttcttgcacatcagaagttatgcgggcgcttccatatcttaaaaaggcatatggcaatgccatgcaaaaggttctccatgtaggccctgatagttgtacagtagtttctaatttgttgaaagaaggaaaggttgaagcttggggagtggagccttatgatttggaggatactgacagtacttgcaaaagcctcgtgcgcaagggcttcgtccgtatgtctgatattaagttcccccttccataccgtccagattcttttaatcttgttgtcgtgtcagatgctttagattatctgaccccaaggtatgtgaacaaaacacttccggatttagcaagggtttccacagatgggcttgttatttttgctggcaatccaggggagcagaaagctaaggtctcagaactaccaaaatttggaagaccggggaaattgcggagttcttcatgggggacacgatactt

SEQ ID NO: 5476 - DNA, 706 bp, Sorghum bicolor
  Clone ID: SORBI-28MAY03-CLUS14431_1
gaagaacctgagcaagaaccagaacctcagcctgtgcctgatccagaaccccacccacagcaaacaactggagatctactaaacctggatgcagaggtgaatccttcagttgcagaactcgaagaaagcaatgcattggcgcttgctattatagcaccaggtgactgcaaggcgtcagtatctcaaagtatgtttgatgtcaactcgtctgggtgggagctggcactggtcactgctccaagcacccatacaagtcaagcagttcagaccaacttggctggaggctttgacaagctgttacttgacagcctctacgaagacggggcaaggaggcagcagatcgccagtgtgacctacacaggtagcctaggagcagccaaccctttcagcgtcaatggcaacgatccgttcgccatgtccagcagcttcgcaccaccggctaatgtgcagttggcactgatgactcaaaaccaacagcagtactaccaggcgcagcagtatttccagccacagcagcagtattttcagcagcatcaacagacgtcggcaatgccaacacaaaacatgtaccaccaccagtatcagtactctgtgcctccatctggagctccaaacccgtttggtgatcctttcagtgaccttgccccaatgggtgctcctggaaaacagagcaactcagtttttctctgaactggttgtcacttct

SEQ ID NO: 5477 - DNA, 633 bp, Sorghum bicolor
  Clone ID: SORBI-28MAY03-CLUS14485_1
ctgcttcggctgcagcctgggcatccaaaaaggagcccccgggtgcagctgcagcagcagcaacagccaccaccgcttcttggggctccggtccggcttgctcgacttcagaggcctcgagatgaagtgaatgaataagccgcccatggccatacgatcgatcgaaatggccagcagccgaattcttctccttcgtttggtttggttcttggcttgttggatttgggtagggtagctagtagttggctagctgttggttttttagtaggaggatacaggatgagaaggagaggcaagaacggcgaggaggattcgtagctcgtgtcactactcactacctcatcagagagcatagtggtagtagagaataaatcctccctgctctcttctcttccattttgtgtttttttttaaaaaaaaagtcccctggctgcctgaatgaatgtcaggaataatcacatatagtataatctgatgctagctagcaggtaattagtacatgtgtaaattttcagcctcaacgtcttgttttgtggagaacatatgaagtattcagagtcgatagagtgcatatgctctgttctctgaatacctgatcctctgttttgtggagaagataaagagtattacagt

SEQ ID NO: 5478 - DNA, 717 bp, Sorghum bicolor
  Clone ID: SORBI-28MAY03-CLUS14496_1
gccggccgggctgcgaacacaatcaccacacatatccctacctcgcaccctctcgatccatcaggaaatagggtaagttactcctactgagttattaggtcaccaatggcatcctcgtcctccttcctgctggccatggcagcgctggcagcattgtttgctgttggattgtgcggcaacagtgtgaccttgacggtcggcaagggcactacccccacgtacacccacctagtccttgtcgccaacctccccatccatgagctggccatcagagaaaagggcgccgcggaatttttggatgacatgaaggagtcaccagccaagacctttacacaagacagcaaggcaccactcaagggacccctctccgtccgctttgctgtgaagggtggtggctaccgcaacagggatgagattttccctgttggattgaagcctggcgcagttatcaacactaacatcccgtattgagtaatcggcacacatctggtctcgcattgagtgaaatttttttaccattatatattctgtaagatagattgaggatataaataagcaggccagtaattcatttactgtggttattttgtggtaatctaccgcaaaataaagtatactagcttctcctcctgcatattgttgtggagctatgtatacacacactttacgatattatttttatatggcataagatatcgagtaaatcattgtcgcggc

SEQ ID NO: 5479 - DNA, 926 bp, Sorghum bicolor
  Clone ID: SORBI-28MAY03-CLUS14503_1
gcaggtggtgccatcagtagccataggatttactgtttatgactcaatgaaggtctggctaaaagttccatcaagggaggatactgctgttgctgtcttgacagatgaacgaagtaatacagctcctatcccctccagttagaatgaggcttaactctcttggtgatgtgatgcgatgctcctttctgccttaccattcataaggcgtgtagcatagcattctttgttggagctgcatcaccatagctactagtcttctccaatgcattggaggaaataaattcgaccattatcaataagtgccataagcaagtcgttgatgccaagaaaagcatcggcatttaacaggaggaatagaattccaggtggattagcgagttctttgtggaattccaccctgtacagcagactctgtatatagctgaatagtttgtgtcaaacagagaggctcttggagaaagtcagaattcagagcgaacattgcttgtgttcatgctttggatctcctataggtagcttcttacagtaggttggagcctgcaggtttcgacatgtatgcgtctcccttttgcaatgagtacaaagaatctatgccttgcattccccacactattggattcttgcgggtcccacaacacggcatctaggattttggtcttttccccgcaaatttttttttccttacctctatgatctacaggaagtagcctctagcctgtactggttctctggattctttccaaatcgaattcacattcacattttacagttaacttgggtaaggaaagttgtgttctgctccactacatttacgattgaaaaaaagagagagaaaggtttcagctttgcatactgtggacttcagaattgtatacctgacatattgaccacaactgcctttgtattgtggttactagatgttctgt

SEQ ID NO: 5480 - DNA, 771 bp, Sorghum bicolor
  unsure (1)..(771): unsure at all n locations
  Clone ID: SORBI-28MAY03-CLUS14522_1
gactcttctaggtgatatgtttggtcttatgtcagcaatcgcntatggcctatttactgtgctgcttaaaaaattttgtggagaggaaggagaaaaggttgatgtccaaaaactgtttggttatcttggactttttacccttgttgctctctggtggattgtctggccattaaccgcactaggcattgagccaaagttttcaatgccccactcagctaaagtggatgaagtggtggtggcaaatagcctaatcggaagtgtactatcagactacttctgggctctttctgttgtttggactactcccttggtggccaccctaggcatgtctctcacaattccgctagcaatggttgctgatatgatcattcacggccgtcactattcagcagtatatattcttggttctgtccaggtattttcaggatttgttatcgcgaaccttgcagatcggttttcacgttctctagggctattatagtttcataaaccaaaacaggtccttattagagtgtacatctggaagctcaaagattgggttggtttgacaaatacttcagaaaacgtgggttcttttccctttgctcctttgaacataggggcggtgaattttgccgtggtgggtagtgaaagccagcgttgtagcacccctttgcaactgtaaatcctcaactgcaaattgcgcgccagtgtaaactgccgtcgttttcggccatgtccacaggcttgcacgcttgtaaatttgcaatgcccctttattccttttggccc

SEQ ID NO: 5481 - DNA, 635 bp, Sorghum bicolor
  Clone ID: SORBI-28MAY03-CLUS14523_1
tactgggcatctgtaaagccccccttgtcgccgctccggcgtccaccccgcccccgcccccgcgcttttattccccactgcaccgcatctccccctcccctacgagcccgttgcgcacctcctctctcaccgccccgagacctccacgcttccctcaccgccctgaaccgtggcgcctccccccgctgcctccgccgccgcgatgctgctcgcggcagagcccgacgacgctcatgaggaaggggagaatcagcagctgctaatcacgacgaagggagggcccgggcttgagggactggtggtggggagctactgccacgatgtgctgatccggggcgggcgcgtagtgggggagacgctcggcggggctgcggccttcgtgtccaacgtgctcgacgccgcctcgccccaggacgctgcgctcaacgggacagcccccttcgtcgtcgtggccaaggtgggccacgacttcgtctacgcctccgcgccggcgcccgcgcggcatccgcctctgctctgcgcgtcgccgaccacctccttccacgcccagttctcggagaccgccgcctcggcgcacgcccccgaccggggagctccggcgcgtgcgcgcctgcgacccgatctaccccgccgac

SEQ ID NO: 5482 - DNA, 508 bp, Sorghum bicolor
  unsure (1)..(508): unsure at all n locations
  Clone ID: SORBI-28MAY03-CLUS14213_1
cttccccaaacttggcaaacaacgcaccatccccgaaaagcttctctcccgttaagccaggccggcgaggctgcgtgcgtgcatgcatgcggcgacgtcggccggcggctgcagcatggccctgatcgacctcgggcgaggaggcggcggcggcggctcaggcaccgcgccggccaagccccggctggtgatgatcgtcgccgatcccggccgcgagtcgacagcggcgatggagtgggcgctctcccacgccattgtcgagggcgatgacatcatgctcctccacgtcaacatgccctacccccacaacggggccgccggtccctcacgctcctcgtctggcgggagcaccggttccccgatcgccgcgctcctaggtggaggtggggctcgggcgccggcggcgcggatccggtggatttcgtggaggcgatgcgcggcgcgtgcaggggcgcggtacccccgcgccgcgggtgcaacggngaaggcgcgtcgagcccgctaccga

SEQ ID NO: 5483 - DNA, 597 bp, Sorghum bicolor
  Clone ID: SORBI-28MAY03-CLUS14242_1
tcgcgcaggcggcgctgtccgcgatcagcgaggaggagaccgcggccgcggtgctggccgcgctggcgaagcgcggcggcgcggaggcgatcgtgggcatcgacggcgccgtggcgcgtcttgtggccgagatgcggcgcggcacggagtggggccgggagaacgcgacggcggcgctggtgctcctgtgccggcggctgggcgcgcgcgcggtgacgcaggtgatggccgtgcccggcgtggagtgggccatctgggagctgatgggcaccggcacggaccgcgcacgccgcaaggccgcgtcgctcggcaggatatgccgccggtgggccgccgcctcggccgccgacggcgagcggggcagcgtgtgcccggccgccagcaccgtcgtgcctccggccatgatggcgtcgtaatcaaggctagccaagggcaatgccggataggatattaaagctcattttttcccctctcttctcctcctcatgatgtacaaagtttgcttaggctgtcacgattctttgatcagagagtgataatggtgagtggttgatcaactgtgcatacacggagctcttactgtaccaatgtagtttt

SEQ ID NO: 5484 - DNA, 509 bp, Sorghum bicolor
  Clone ID: SORBI-28MAY03-CLUS14260_1
gctaggtaccctgccggctggtcttgtaaccttctggaaccgcacgttccctcttgatcattcgtggcatcaattacgacttgggtacaacccaaatgtcaacgaaaaggatatcaggcgagcggctgtcatccactacaatggaaacttgaagccctggcttgagattggattgcccaaataccgcaagtactggtcagcacacgtcaattacgatcaagtgtttctacgggagtgcaatataaacccgtgaacagcaaatagtggtctatggtgtatccttttcttttcgattatttcttagaccgattctttgtgctctaggtaaattaaattgcctagagtgcttattctttgtaactgatgtctttcctgatgtaaaggtgccagcaggttggtggtaggcttagatcatacaaacagttagtagccaaggcgtatttcattttgtgcttataaatgctaatatagtagataatttttgactgtatgaatcgaatgctatgtta

SEQ ID NO: 5485 - DNA, 817 bp, Sorghum bicolor
  Clone ID: SORBI-28MAY03-CLUS1426_1
gcacgagggctcggaactcgacgggggcgagccttgttggagagcgctgcggcttccgtttcgccccgtatcagttctacaacggcgacatcatggtgcagctgcgagttggtgagcctccagcaggaaaaaagacagcaacgactctagttctagcaatagtacttgcagtactgggtggactatgttcactcacattaattatattttgccattggaggaagataaggtcaccaagaaaatcgtcactcttcataaatgtagaagacatagaaagttttgagtccagccttatcggtctgtccgtacttcggtcagcaacaagcaactttgatgaaaagaacaaacttggtgagggaggattcggtgttgtttataagggtgccctgccagatggccaagaagtagcagtgaagagactctctgagaccacaacgcaaggactaggacagatgacgaatgagctagctttgctagctaagctgcagcacaggaatcttgttaggatcgtgggtgtttgcttggaggaaggcgagcatttgcttgtgtatgattacatgcccaacaaaagccttgataccattatctttgatcctgataaaagcaggcagcttgactggggggcgcgattcaaaataataaatggaattgcccgatgcatgcagtacctgcacgagcattcccagctgaagatagtccaccgtgatttaaaagcgagtaatgttttactcgatgcagacatgagacccaagatttcagattttggtctggcaaagatttttgaggacatcaaaccagacatgtaacaagccgatat

SEQ ID NO: 5486 - DNA, 813 bp, Sorghum bicolor
  Clone ID: SORBI-28MAY03-CLUS14661_1
agaagaggcctcccctgctccgcgtcccccagctgcgccagcgccagcggcagcggtaaccccacccaacccctctgagctgtgacacagctgtcctcctctccccacccccttcccttccctccacaggaatccgccgccacaatcccctccgcattgccggattgcgccgagcaccatcctcccttcttctcccgctctggttcggtggtggtatggtgggatgatgaccacggcggcggtgctgttgtctctcctctgctgcctcgccgccaccggccgcggcgaggcggtgtccgtggcgggcgagggcgaggcggcggagctggcggcggtgtcggtggacccgtcgtggcggttcccgaaccagcggctgcgggacgcgtacgtcgcgctgcagacgtggaagcagcaggccatcttctccgaccccaggggcttcaccgccgactgggtggggccaggggtctgcagctacaccggtgtctactgcgcgccgctgccgcgcggggtgccgggcgccggggacctctccgtcgcggggctcgacctcaaccacgccgacatcgcgggctacctcccgtcggagctcggcctcctcgccgacctctcgctgctccacctcaactccaaccgcttctgcggccttgttcccgacacgctccgccgcctccgcctcctcgtcgagctcgacctcagcaacaaccgcctcgtcggtgccttcccggccgtcgttctcgacctcccgtcgctcaagttcctcgacctccgcttcaacgacttcgagggcgctatcccgcccgcgctctttga

SEQ ID NO: 5487 - DNA, 527 bp, Sorghum bicolor
  Clone ID: SORBI-28MAY03-CLUS14709_1
aacacaatcaaagagctgtagttcttagatcacaggatacatctaatgtactggctggaaatgagttgatgattgttggacctcgatcccacgcgtccgtgccacccattgcaacaagaggtgtggaaaactgcaaggagaatggtggaaggggcttcaaacccaaaccttgtgacaacgttgttcataatggctcttcaaagcctgaaagggaaccgggcaattcgtcaaacaaaagaacatctggtaaaatggaggaccttggccacaaggataattcctctgaagtgtcctatgagtactgtgtaaaggtggttaggtggctggagtgtgagggctatattgagacaaacttcagggtgaagttccttacatggtttagcttgcgtgccaccctgcaagagagaaagatagttagtgtctatgtggatactcttattgatgaccctgtcagtctttctggccagcttgttgacagcttctcggagaggatatatagcaaaaagcggccttccatgccttctggt

SEQ ID NO: 5488 - DNA, 681 bp, Sorghum bicolor
  unsure (1)..(681): unsure at all n locations
  Clone ID: SORBI-28MAY03-CLUS14635_1
cgaagctttctcatggcgtttgatgatcatggaccatatggacggngaagatacaactggaatatgacccccgaggttgaacttgaccaatggcgcaaaggttcacagtggttcgaagtacacagagaacttgccattgaaattgtgaaggacacagtctactatccaaaattcaaggagttctgcaggccccattgttatgttgatgagcactatttccctacaatgctgacgattgaagctccgaacagcctggctaacagaagtgttacttgggtggattggtcaagaggtggtgcacatccagccacgtttggcaggggtgatatcacagaggaattcctgaggagggtccaaaagggacggacatgtctatacaataaccagaactcaacgatgtgcttcttgtttgcacggaagtttgctccaagtgcattggagcccttgttagagctagcgcctactgtgctcggttttggttgacgactagtgtgtttgaagagtctgtaattttgatattattagatcattataggattacacgcttggaggcatggctcagattgatggatggaatcgtggaaacgtacacagtgccccctccgcttgtgcattatacacaaacctgtattgttttgtatagtaaactgaccctggatcaggaaggaattttctctagga

SEQ ID NO: 5489 - DNA, 431 bp, Sorghum bicolor
  Clone ID: LIB3480-052-P1-K1-H11
gactagttctagatcgcgagtggccgcccttttttttttttttttttttttttttttacatcaaattgaaaccttttgcctctgctaccgacccggtcgcgcgtgtgtgtacgcagctgggctcaaaactcattagcatgcagtaaccaacgagggactactaataattaatagacctagctagctataacttaactaacaccgttgctatacgatccatatccggttgatgagcggcggcgatccaactagatcatcctccggcacggccgcacggtggtgatcgatctctgtatgtatctgtgggagttctgcaggccccattgttatgttgatgagcactatttccctacaatgctgacgattgaagctccgaacagcctggctaacagaagtgttacttgggtggattggtcaagaggtggtgcaca

SEQ ID NO: 5490 - DNA, 387 bp, Sorghum bicolor
  unsure (1)..(387): unsure at all n locations
  Clone ID: SORBI-28MAY03-CLUS14734_1
ggatgcggcggcagcgcgggatttcatccactccctctgcaatgcgacatgtcccgtgcccgtgtgcgtcagggaatgcttcaacctcctggcgccctacgccgtgtccatcaacggcagcaacaccagggccgtccgcagcggagtcaccgtcgtggttgccgagctccaggccttggccaagagtgccatcgacttcaacaaaaccaatggccaggactacgagctgggtccgtgcatccaggtgatccaggaggccgccaaagggggcgaggctgagctccagctcaatgccgncgacgatcagcatttttccaaatggtaccaggacgccaagaacaagatccaaaaatgcgactatgacatcgccgatgtgcccaggagcca

SEQ ID NO: 5491 - DNA, 767 bp, Sorghum bicolor
  Clone ID: SORBI-28MAY03-CLUS14759_1
gaccagtccacagttcgctgcaacacccacgcaccgccatggcccctgctgccacgggcgtggggagcctcgccgccgctcccgtcgccaagggctacaccacctacagaaaggccgccgcacgctccgtcgtcaggctggggctgcccgcgctgccgccgctgcccggcctcagactcgcggcgcagggccaggcatccttctgtgagtgcaagcggctggcgaggaacgtggtggccatggccacgggggagcccaccgcggcgcctgtggctgacaacgaggagctcaccgagttcgtcaacgcgttgaaaaaggagtgggacaggatcgaggacaagtacgcggtgaccacgctcgccgtcgccgccacgctcgccatgtggagcgccggtggagtagtgtcggcaatcgataggcttcccttgattccaggtctgatggaggctgttggaatcggatacagtgggtggttcgcgtaccgaaacttgctattcaagtctgacagggatgctttctttgcaaaggtccgggaggtctacgaggatataatcagaagttaacagatggagcactattgcaagctcatccaaatcaagttcactttaagagatccttctagtttgctgccgttcagttgcttttgctagctgtaatatatttcagtatagcatctagtttgatcctcactcaatgcatgtatggataaacattttttataaaatgcaatctatcgatgctcgttttttttttcgtattagtttttc

SEQ ID NO: 5492 - DNA, 797 bp, Sorghum bicolor
  unsure (1)..(797): unsure at all n locations
  Clone ID: SORBI-28MAY03-CLUS14366_1
gccggccgggtcccgggagaacagagagcgcgcggttctacgtccgagtcgtcgcatcgccctgttccctcgattcgccggcggcgccacctaccaagctcatacacccagattgactagtcaaacccagtgatctctttggggactaatcaaactcaagaactaagtttcatgtctgatctcgacgtccagcttccatctgcttttgatccgtttgcagaggcaaatgctgaggactccagtgctggtgctggatcaaaggactatgtgcacgtgcgaattcagcagcgcaacggaagaaagagtctgacaactgttcagggcttgaagaaagagtacagctacaacaagatcctcaaggatctcaaaaaagagttctgctgcaatggtactgtagtccaggatccagagctaggccaggtcattcaactgcaaggtgatcagcgtaaaaatgttgcaacttttctagttgaggctggaatagtgaagaaagagagcatcaagattcacggtttttagattgcaacgtttaagtgtttgtgagtgctatcatatatgataccaagtattgaagtttctgaagctccttcacaatatcagtagtagttattcatctgaacctgtgtcactatttgatttgagaagactggtattgatgcaagttgtacttgcagtatgttttctaagtgttaccttcatgaaagtatcgtttgtctggggaaccgtctactgatattgaataacaagagagattgctgtttgggttcgtacaaaaaaaaaaaaaaaaaggcccctan

SEQ ID NO: 5493 - DNA, 1464 bp, Sorghum bicolor
  Clone ID: SORBI-28MAY03-CLUS14376_1
gcacgaggccagaatgcaatcttctatctcaattcattcgcggacaagggtggtgcgcagctcttcgtgcctgctggaaggtggctgacagggagttttaatcttatcagccatctcactttatcactggacaaggatgcggtaataattggatctccggattcatctcattggccagttattgatcctcttccatcctatggacgaggtagagagcttcctggaaaaaggcatcagagtctgatttttggattaaatctgacggatgtaattataactggtgctaatggttccattgatggtcaaggagctatttggtggggctggttccgcaaccacacattgaattatactagaccacatcttgttgagttgatgtattctaccaatgttgtcatatctaatctaaccttcaagaactcgccgttttggaatatccaccctgtatactgcagccaagtgcttgtccagcatgtcacaatccttgcgcctttgaattcaccaaacacagatggtgttagtccagactcctccacgaatgtgtgcatcaatcattgctatgtaagaaatggtgacgatgttattgtcattaaaagtggctgggatgagtacggcatttcatttgctcaaccaagctccaatatcagcataagcgacatcacaggggagacaaggggtggtgcagggattgcctttggaagtgagatgtcaggtggcatatcagaagtccgggctgtgggcctccgcattgtcaactcccttcatgggatcagaatcaagacagccccagggcgtggagggtacgtgaagaatgtgtacatagccgatgtgagcatggacaatgtttcaatggccatcaggatcactggaaactatggtgaacatcctgatgacaaatatgacaggactgctctccctgtgataagcaatattacaatcaaggatgtggttggcgttaacattggcgttgctggtatattggaaggcattcagggggacaatttcagcaacatttgtctgtccaatgtttccctcagtgtacaatctgcacatccatggaattgttcacttattgaaggatattctaactcagtgatcccagaatcatgcgaacagctcaaaagcaattgtagacagacacccatttgctacgatggaagcggttcttcagcaatgcatgtgcagcaaccaagacatacatcgagcaccagccggttgctaaatcctttactggagttggcttcattttagtgtaggtagagctgtgcttgttattattgctgcaaaggggcttgcttcacggaatgacccctattagtcatgtatatctgattcttgcaattatttgtgcttagagtgccgcttgcttcatgtatatagctgttgagatgactattgatgtatcttgcctgttttgttcccatttttgatatgtgaatgcaatctgcataacttatggttttg

SEQ ID NO: 5494 - DNA, 810 bp, Sorghum bicolor
  Clone ID: SORBI-28MAY03-CLUS14394_1
gaaggaagaagtgaaatctattagcatgttagtttttcctggtacaggtcttctccaaaagccattgctgaaggccttacctaaaggtggtcaatgttctcaaggagataaaactgagaaatcacctgatgtagccaatgaaaattctctttgctctgatgcaagtgttgatcccttagatttgggggtcaaagagcctggggacaacagcaaaaatactgatggtacttgcaacggtgatgtttcacaacaatctccccattcttgattctaagatttggttgcagctttttgggccccaagctttacatggacgaagcctccattagtttttgtacctcgagttttgactcagcagttagcatgacatccatccgttggcagaaagaggcttgcggttttttgcagattagttgctggggcacccctgtagtttttttactcccaaattgatggctcaattgactcgtcggcctgggaagaatcagcctgtgcagtactgaaaagcgttaactccaaccagctaacttgatgtgcagctgaaacgtcagcatgtagaatgtgagaggatagtttcttcttttgtttttgagtcgttaacttaaactccgagggcgaatgcagccaccaaatagtcgtaaatgttacaccagttgttatattgttaataggtttatgttttcgctagcgcattcctgaatcatctcatttcttcttctgtaagataattctcatctctgtaagataaactggtgtatgcgcaagctagaaatagtcccctgatcatctgttgtgcggaattggttatct

SEQ ID NO: 5495 - DNA, 698 bp, Sorghum bicolor
  unsure (1)..(698): unsure at all n locations
  Clone ID: SORBI-28MAY03-CLUS144_1
cgcgtcccgaagggtttggcttatcttcaccatgnnaatgtcttgagtgggtaatacactgtgatgtgaagccagagaacatactgttggatcggaatctagaacccaagattgctgactttgggttggcgaagctgctgaacagaggttcctctaaccagaatgtgtcaagagttcgaggaaccataggttacatagctccagagtggatcagcagcctccagatcacggccaaggttgacgtttatagctatggggttgtgcttcttgagctagtcttgggaagacgcgttctcgacatggctctagctgctaatgaggaggtgcataaggtgcttaggaaatatgtagccatgctagctcttatgttggataaagaggaaccctcttcaattgccgaggttgtggattgcagactgagtggccaattcaactacatgcaggtaagaacactgatcaaattggctgtctcatgcgtggatgaagacagaagcaaaaggccaacaatggaatctatagtgcaaatgctccttttagctgatgaatcgtgtagcatgtgctaggatgacgttctacataatggaagtgcccaacaggtggaaacattaagcataatgagagctattggagtataattttttagccttcattgtgtggctgtttatgtgtatgcttaagtacttttctcaaataataat

SEQ ID NO: 5496 - DNA, 1079 bp, Sorghum bicolor
  Clone ID: SORBI-28MAY03-CLUS14419_1
gcaagatggtttatcatgtaaattcaaggcgcatgatggttgcaaaaataagggaaaaagtctacatgatggcagcccaaaccttgttcaaaagcatcttaactcttaaagactattgcagggaggcccatcaaatggcaaccatcagcattctccttgcggtatacaaatacgatgatgggcttattagagtcacacacactgttagaagacttgtgtagggaagtgtaccattctgttcatttattgaagcttgctcaccaggcgggtagatagtgcattgttgttacttttcttaaaaaaaggaaagaaagaaggtaggtagtatattcttttgaagatgtaccattgtccaggcatcatcatccccatctccaccattgtgtaaatatatatgtcccaagtgttcccacctttcccttttccttccacgagagttgaggtgggcatgaaagcaccatttttccctcagtctctttgtatgggatcttctgaaatcatgtacatgtatctttcgtggcaacaggagagattgctgtgtaatttccattgtaccaaccaaacccctctgttaccaatagaagtcccttggacagtgttggccacgttgcagattgctttaacacttgctttaaaatatctgatctgattctgtgcaaaatctgcgtgtgatctctttctgtgctcagtgaatcagctctgcagctgtagggaacacttgcatggcttgttggaaaatgctggtctgctggccggccactatctgaagagaccacctttacgataacaggggcaagcaaatccggatacgcaaaagctctcataatcatgtgcttgtgtggtcagtggtcaggagcacaggctgactggctgaggcatggtccatgtaggtggcttttccagccctcttcggtcatgtgatataagcgcgtcgggacgcttgattgcctccgcctggtttggacctctgcctaattcaccaggcgtttgtgccgctgaacggcggccgcacgctgattccagttcaaagcaaagggacaacatgcgacgtaggcaacaatccacctctgtcatgctca

SEQ ID NO: 5497 - DNA, 652 bp, Sorghum bicolor
  Clone ID: SORBI-28MAY03-CLUS14928_1
atatctgcacgcctggcccccccccccgccccccccccccccccccccgcccccccccgtcccccccccccaatccccccccggggtcccccgggggccccccgggcccggcccccgccggtccccccccccccccccggccccccctccttcccccccgccccccccccccgccccgggccccccgccccgggggtcctcccccccccggatttggcctggggccccgggccggggccgccgggccgccccccgcccgccgggcccggtgccgccgccgccggggggtggttccgttaccgggtttccgggttggtttggccgggtttttttttccccgggggagccccggcccctggttgcgtgccctttgtggtgtgcttggccgggcgctggagtttgtcgtccgtgctggtgcttcttccgttggttcagcactcggctccggacgtcgggggccgcgcgttcacggctgcacgggtccgactcgagcccctcttggttgcacttccaccatggtttccagggcggggcgttttgcattgtcttcggtcctgacccttggctggcccgtcggtctcgctccgccggaggacgtgttccgtgccaggcctggcccgccggtccgcagttcatacagagcaatgtagct

SEQ ID NO: 5498 - DNA, 219 bp, Sorghum bicolor
  Clone ID: LIB3480-029-P1-K1-B7
tagtacttgtaagaagccagtcaaagccagccaatatgcagttcatacagagcatatgtagctcagggaaggtaagcacagatgattcatgggtgtgattatgctcgtcctacaaagcccctgaagagggcagaaaaaaaagttgataagtaatggaaatcacaaagtgcacataagagtgaaagcaaaatgttaacctgaaagcaagaacgttgccaa

SEQ ID NO: 5499 - DNA, 570 bp, Sorghum bicolor
  Clone ID: SORBI-28MAY03-CLUS14932_1
ggaagatatactctgagaggttgatgacattggccggggtctatggtttctggaagtatgtgtccaagcttgagaggcgggagacaaggcgctaccttgagatgttctacatattgaagttccgcgagctggcgaagaccgtgccgcttgcaattgaccagccacagtagctggtcctcgccttggtgctcgtagcttgctcaactgttactgtgtaccacttggtacaaaactgaaccttatcgcagggaaggaccttcagtaatttaggtgcggcagacggcagctaataaaatgtgcatatgcgctcgtttgtcttgtgctcaactgaaccttgtgcctccctggctatactggctcaacatctaggtttatgtacataaggcaggctatgtgatccacctgtagcgtcaggctacagttttctgtactttgtggtgggtactattttctgtaatacactaatactgtcaagctgtcggctgcaatttgtcttcaggcaggccgcaggcactggtaaagtgctgataatacagcatattctgttgacagttaagaagcatgttcatg

SEQ ID NO: 5500 - DNA, 865 bp, Sorghum bicolor
  Clone ID: SORBI-28MAY03-CLUS15061_1
cgacgccgccggctcggacgccgggccctccgtcgcgcgcgcgctcgacgagtccggatccgtcatcgtgctcggcaagaccgtcttcctcaggcccgatatggaaaagattcaaagaaagggttggcgctgttctaaaacgataataagagatgttgccacccaaagtttgggcaattttactccgctccaagatgggagtttttcttctctcaaaaaccagaaaaaataactggatttaacccctccccaaaccttagagggtacacctcatcatgattgaaaaagaaaatttgtatctctctacctatgcatgaacatgaggagaattcacctggcccgctcctgggcaccattaactttgaaaaaaaagaagtttgtatttaatttggtttggcaaagtgtagtatttcaatagacaatttacagatgtagccccatcacatgccagtggtggagggttgaattgatgagcctttcaacttgtataaaaattagttacggatatagccaagaaatgatgtaagttagctaatacatacataatgaccaataacttatttcccagtgcatttgctctttctggcaatcgtgacaccagctaacctatcatgtggtgttcttgtcgctagtttattgtagggtaaaattgttaatttataagcttatgctacttttgatttgatttagcgtaggggaatcttctgattttgggggagtataaaccaaaaaaagttcattgtttgatgattttcattatatgacacaaaaatatatttcctttgataaaagatctaggggagctctatttttttttacatcagatagaatagctatttttcttttccactttttttctgtttca

SEQ ID NO: 5501 - DNA, 643 bp, Sorghum bicolor
  Clone ID: SORBI-28MAY03-CLUS1508_1
gcacggcgcgtgcgtcccaggtcgcgacacgccgctgcaggctgtacccgcctgcctgcgcacttgccccacccccgcacaccgtctccggcgacggcgagcgctcccgacgctcctcgaccgatccgtccctctcgcggcccttctctcggcctccgccaccacccgaggggagggggaggatgtggtcttcgagccaggcgagcacgaggggcgtggtggagatggggagagtggaggccgggccgtcgcatttccccaagaggcccgcgccccggaattccgccagggtcaatctatcaaggacagttaaaccttgctcagctggcgaccgcccaggaatttctgttaactgcaacttggggtggtcttctcaaacatcgcctgacttgagtcagcactttagaggatattcatcagcatcagaggcagttcttactgcccaatcagatttgagaaaacttttggttggcaatgagaaaatcggtgttctcttgctgaatcttgggggcccagagactcttgatgatgtgcagcctttcttggttaatctttttgcagatccggacattatccgtctttctaggctctttctctttctgcagaagccacttgcaaaattcatatctgtagtgagagctcc

SEQ ID NO: 5502 - DNA, 625 bp, Sorghum bicolor
  Clone ID: SORBI-28MAY03-CLUS14955_1
gcacgaggatcgtttccaagccttgcgtttcgtgggatttattgaggcgagggcttcgattcgacccaggaatcgcccacgtccgctccgccccggctccgcggcatcccctgccccgccttgccttgcgtgggagtgtctgtggcgtgccccccgcgtcgcccctggtttcgcccggtgccgcgccccccccgctccggtgcttccccgggtccgttggttcgcggggcacgagatcctctagaggtttgcgctgtttggcgtgaaattttgggcgcgatttgctttgctcgcatgggggatcatgtcgcggtggatgttggggagctcgtagcgtcccgagtcggtgaggcagccgggttggtgtcccgcggtaaggaggaaacggaggcgctgattgggatggtggagtgccgcatttgccaggaggaggacctcgcgaagaacctcgagagcccctgcgcttgcagcggcagcctcaagtatgctcacagggaatgtgtgcagcgttggtgcaatgagaaaggagatataacctgtgaaatctgccatgagtcgtacaagcctggttacactgccccaccccaagtgcatcatgatgaaacaaccatagagataagtggtg

SEQ ID NO: 5503 - DNA, 397 bp, Sorghum bicolor
  Clone ID: LIB3480-030-P1-K1-A9
cccacgcgtccgcgcccaaatccgctcgtcttcgacttcggttcatcccctggaccgaaatttctaggggcacgagatcctctagaggtttgcgctgtttggcgtgaaattttgggcgcgatttgctttgctcgcatgggggatcatgtcgcggtggatgttggggagctcgtagcgtcccgagtcggtgaggcagccgggttggtgtcccgcggtaaggaggaaacggaggcgctgattgggatggtggagtgccgcatttgccaggaggaggaccttgcgaagaacctcgagagcccctgcgcttgcagcggcagcctcaagtatgcttcacagggaatgtgtgcagcgttggtgcaatgagaaaggagatattacctggtgaatcttgcatgag

SEQ ID NO: 5504 - DNA, 636 bp, Sorghum bicolor
  Clone ID: SORBI-28MAY03-CLUS15090_1
tagttcccgaaaagttcctcgaatgtgtaatacaggcgcccgagaatgagtggaacaaggtgttgcttgacgggcttacagtaggaaaaggagacgtttcaccagatgatctttatgccgttattaacaagagaattgagagagtcttgattcgtacggaaggtggttcgtaccagcaacgcatactggttgagtatctaaaagagatacaggctagagcagaggaagtcgtcaaagtgctccagggaccaacaatataaaatctgctgatcctgtttacactatacatgttttcctgtttgccgtagtctgatggagcaatggcttaattttattgaagttgtttggcagagaactaggagtagatatgcctgatgctggacctgatcacacaaagagcacagggaatggagagaagagataagccaggagaagcgcacattacagcaaatcgcccttgcttattcgcgtcatcgcgtgattgtccattttacgtttctgaagctagctttcatcccgaaggcctggctggtttagctgttgggataataagattttctgcttttgtccgactgaaggctgtagtctgctacggctatacatacagaactacatatggagaagtaaaaatcctga

SEQ ID NO: 5505 - DNA, 747 bp, Sorghum bicolor
  unsure (1)..(747): unsure at all n locations
  Clone ID: SORBI-28MAY03-CLUS20828_1
ctagtaccacagcagacctagctagcgtgcggcgccgcagcggcgccggcccgattcagtttcccatcgcgtggagagggggcggcgttgccgttaccgaccatgtcgcagccgccggcgccggcgccgccgtatcggccgtataggcaggtgcgggaggcgacgccccacagccgggcggtctcctgcgtgcggttctccccctgcgggcgcctcctcgcgacagcgtccctcgacggaacggtcgcgctgctctccccgtcctcgctctccgtaatcgccgtcctgcgcggccactccgacggcgtctccgacctgtcctggtccacggagtcgtactacctctgctccgcctccgacgaccgcaccatccgcatctgggatatccggcccgtcctcgccggcggcgcccaggccgccgccgccgaccccggcgccgaccgctgcatccgcgtgctcaaggggcacaccaacttcgtcttcagcgccaacttcaacccgcagaccagctcgcagatcgcctccgggggatttgactgtaccgtgcgcatttgggacgtcaagaacggccgatgcacccgcgccatcgaagcgcactccgagcccgtcacctccgtgcatttcattagggacggatccatcgttgtatcangaagccatgacgggagctgcaagatttgggacgccaagaccggggcttgcccctcagacgtcatcgatgaaaagaagcccgcggtctccttctcc

SEQ ID NO: 5506 - DNA, 786 bp, Sorghum bicolor
  unsure (1)..(786): unsure at all n locations
  Clone ID: SORBI-28MAY03-CLUS20750_1
gccggccgggttccgagcattctaggtttccgtctcgcctccaccgccgccaacttgtccctcgctctccctcctgctcgccgcagccgcccaccgttcgtcgcaaccgccgccatgggtcgcatgtacgggcccgggaagggcatgtcctcgtcggtgctgccctacgctcgcgccgcccctggctgggtgaggtcgaccgccgcggacgtggaggagatgatcgtgcgcgccgccaagaagggccacctgccgtcgcagatcggtgcgcttctccgcgacacgcacggcgtcccgctggtccacggcgtcacgggcggcaagatcctgcgcatgctcaaggcccgcggcctcgcgccggaggtgcccgaggacctctacttcctcatcaagaaggccgtcgcgatcaggaagcacctggacaggaaccgcacggacgtggacgccaagttccgcctcatcctcgtcgagagcagggtccaccgcctgatccgctactaccgccgcaccaagaagatcgcccccaacttgaagtacgaatccaccaccgcgagcgctcttgtggcgtgatggatttgaattgattctctatagctttggagtttgccttaatcctaaggaagttaagtgatagttgtagtactttatgctatgtgaggtctttaaatttatctacccgatgcacctaagaagaggtgtgtatcttgagactcagttatgagactggatncagttcttgacttttgaagctgcattattcgcaaaaaaaaaaaaaaaagggcccta

SEQ ID NO: 5507 - DNA, 556 bp, Sorghum bicolor
  Clone ID: SORBI-28MAY03-CLUS20890_1
gcacgagggttttctgggccggccaggagagcagcgtaggtgcgtggcgatggcgctcacgaacttcatcctgacggtggtgggggtgggcgcggcggtgatgctgctgcggaaagacgtcaagcagtcggccaccatgttccgccgcaacgtgcgccacatccgcaactggctcgaggaggagtccgccgccgccgccaaatctgaacaatcttcagtgaaggagttggagtcccaagctgccaagaaagatgctgtgcccaaggaggacaagcattagacgatcttacacactgttacgtataatgcattggcagtgtgatatccaggattttgaattagtccttgtaaaaaatgtttagtagtttgtaggacctttaatcccgatggaaattttactgaataatggaacatatctttggtgcgaggttctgaaatagttttgcaaaatgggatatttgatctcagtgagatttgtactcaatgatggtggatatttggacattctgtatacagtactatctttgtcgaaaaaaaaaaaaaaaaaaggccccta

SEQ ID NO: 5508 - DNA, 572 bp, Sorghum bicolor
  Clone ID: SORBI-28MAY03-CLUS20898_1
gccggccgggttccgggggttcagattcctccgttggtttcgatctcctcgcctccgtctccggcggggccatggcgtcctcctcctcctcctcctcgcggttcgacgatccggcggcggtgaggcggcccccgcagcgcgagcggaagccgccgtatatgttgctgctcccgctcatctacgcccccgtgctccctctcatcaggatcgggctgcggcacaaccccgtggtgagggaccgcctcttctacggcgtcctcgccggcgcattcgcccacggcgcctacctcatatcggaattgtatgacgtggagagcaaatgatggggcatccttcggaggatgaagagataagttcaggcagcaaaaaattttgattccatcgggattccagattggatgagaactgacttggctattcacattactagtgtgctatgtacctaaattttgtttggttcgtgctattatattgccaaaaggatggaatgtttgagcacagaaaataattccagactgcgagaaatatttccagcgatggtattccgaaaaaaaaaaaaaaaaaggccccta

SEQ ID NO: 5509 - DNA, 927 bp, Sorghum bicolor
  Clone ID: SORBI-28MAY03-CLUS15255_1
gttttaatctatcatcatcatcttctgcagggtgaaccagatcgatttcgaggaggtcacggtggatctgttcaagtctcagcacctcacccccgaattcagaaaagtaaaccccatgggacaggtacctgcaattgttgatggaagattcaaactatttgaaagtcatgctattttgaggtatcttgcatcggtgttccctggagtatcagatcactggtatcctgctgacttgttcactagagccaaaattgagtcaatcttggattggcatcacacgaatttgcgtcgtggtgcagcaacccttgtacagcacactgcattggctccctttcttggtcttacgacaagccctgaggctgtaaaacaagcagagaaacttctaatgcagtcactgggggtgattgaatcggtgtggctgaaaggtgatgcaaagttcttgctaggtaacccccagccatcgattgcagatctgagccttgtttgtgagataatgcaattggagatccttggcgatgaggtccgtgaccgatttatgggagctcatgagaagatcctcatctggatggataacgtgaagaaagccacgagccctcattttgaggaagtccacgagctccttttccatgtgaaggcacgcatgctgcaaagcaaggctgccgcatcaaaccaggcttttgagccaagcacaaagctcaaaatagcatcgaagctctgaccaaaggggcaagggttgtgcttgttcagttgttctagggttgaacccttaaaagaaggggaaacatactgttgtaataagtatacagagtactccaggcctccctccagggaaagcagaataagcgacagaacattgtggtgcattttgtggacaccctaccgaatgggttatggaaagagaacaaaactggacttgtatagttgtat

SEQ ID NO: 5510 - DNA, 765 bp, Sorghum bicolor
  Clone ID: SORBI-28MAY03-CLUS15335_1
atttgcatctgcagttcagagcgcagccccgttcagtcccagtcccgcagacacggcaggaggcgacgccgcccgacgacggcgagagcgaaccaccgccgctgccgccgcgccctcgtgttagtgcaggttacaaggtgtgaaaatgttagaaagggctttgaaagatctcaatatttctcaatcagcagacctagagaaaggaaaagacaattctgtgaaatcctgcatcaccaagcctgtgttgaatggcaacaaatgtgccaacaaggaagaaaaggctctgtcagcttgccaagatgctgttgctaatggaaatgaggctgtaattgcagatgtggagtacattgattctgaaaatctagtagatctcccagatgtcaatgcagctctaagtaccttagttaaaaggttggattcaaaggactgggttatgacatgtgaagctctcaacaatgttcggcagttggcaatgtatcacaaggaaagattgcaggagctgctggagcctctagttccgcttatcgtgaaatctgtgaagaatccaagaagcgctgtatgcaaaacagcactaatgacttgtgctgacatctttaaggcctatggagacctaatggttgactccatcgatccactgctaatgcagctgtttctaaaggcttcacaagttaagcgatttgtctgtgaagctgctgaggcagcttaatatcaatgacaagttggatctcccctttactactgataacaagaatgtagccctacctc

SEQ ID NO: 5511 - DNA, 576 bp, Sorghum bicolor
  Clone ID: SORBI-28MAY03-CLUS15264_1
gccggccgggccgggacgcaccccccctgatcttcgtatctcatctcccccttcgccggcgtgccatgacgacgacgacgcgcccttgcgccgccgtgaccgcgttcctgctcctactcctcctctcgtccgccgcggtgtccctggcggccaagaccgccggcaaagagagcaagcaggcggccgcgacgagcgtgtacgtggtgatggtgaaggcccccgcccagggcgtcaactacaaggcataccagatgcgcatcctcgccaccgcgctcggcagcgaggagaaagccaagcaggcgctgatctacagctacaaggccgtcgccagcgggttcgccgccaagctcacgccggagcaggtcgccgcgttgaagaagcatcctgccgttctgcaggcgctgcctgaagtgaagtacagccttcaggacaaccgcctcacctgaaccgagcgagtactttcagaccgtcaccagcaagatacatacctacatacttcagcacctgccatcttcaccgtgtattactatctcgtaattatgtgcatatgttagcaagtgtgtgcacacaccatag

SEQ ID NO: 5512 - DNA, 493 bp, Sorghum bicolor
  Clone ID: LIB5047-011-R1-XP1-D5
gccgggccgggacgcaccccccctgatcttcgtatctcatctcccccttcgccggcgtgccatgacgacgacgacgcgcccttgcgccgccgtgaccgcgttcctgctcctactcctcctctcgtccgccgcggtgtccctggcggccaagaccgccggcaaagagagcaagcaggcgctgatctacagctacaaggccgtcgccagcgggttcgccgccaagctcacgccggagcaggtcgccgcgttgaagaagcatcctgccgttctgcaggcgctgcctgaagtgaagtacagccttcaggacaaccgcctcacctgaaccgagcgagtactttcagaccgtcaccagcaagatacatacctacatacttcagcacctgccatcttcaccgtgtattactatctcgtaattatgtgcatatgttagcaagtgtgtgcacacaccataggtgtctgacagtataacaagttacctgatccagaattcatc

SEQ ID NO: 5513 - DNA, 637 bp, Sorghum bicolor
  Clone ID: SORBI-28MAY03-CLUS15424_1
tacagagctcgcaggaaaaccatttctctttgttacagcgggagactgagaaacttcgtggagacattgataagatgaggagtgaactaaagtatgagattgacaaggtcactgcagggcagcggctggatctgaaccttgaaagagggcgcatacgtgatgaacttgccaagcagaatgaggaaactactgagcttaccacaaagcttgacaaggaaattcactcactgaaggcccagttggaggcagcaaagtacgatgtcatcaagtactgcataggtaccattgtttcgatctcagccgtcggcctcgccgtcctccgcatcgtgatgtgaaggcagcacagcaagcaaatacgttctttcgtttacccatattcatcgtccatggaaacccgctagaagaggataggttctgattctgttcctagtttttagaggggacaagacgtgctcagtgggggatgttgtaacacctggtagttggaagatgttgctcaaacttgtaaaatagatggcccgtggaagaaatgcatccagaaatgattctttacctaaaaaacaaaaaaaaaaagtacaaaaacatgcgacatcaaaagccctaaaaaaaaatcctatactgggcggccgttttaaag

SEQ ID NO: 5514 - DNA, 852 bp, Sorghum bicolor
  Clone ID: SORBI-28MAY03-CLUS15397_1
tatcttttggcgctccatggtttctggaccccataattcttggtgattacccctctccgatgcgcaagatgttgggtccaaacctacctgaattcacatcaaaacaaaagaagatactacaagcatccaagttggatttcattggtttaaatcattattcaacatcctatttgaaggactgtatctactcatcaccatgtgaattggatccatttgatggggatgcccaaattagtacttcaatagacagagatggaatacttattggtgaaaggacagggtcgccatacttgaatgtcgttccatatgggatggagaaagtggtcatgtatttcaaaaggagatataataacacaccaatgtatatcactgaaaatggttatgcccaagcaagcaatagcaacatgtctgccaaggattttactaatgacacaggaagagtagattatcttcaaggctaccttacctttctggcctcagcgataaggaaaggggctgatgtgcgtggctacttcgtgtggtctcttctcgacaacttcgagtggaactctgggtacacacaaagatttgggctctaccatgtcgacttcaagacacaaaaacgaaccccaaaactatccgcgaaatggtatagtgagttcctcaaggggtcacccctgagaacaaggccccaaaatggaaattcctaccagtacactgcctaatccatggaccatttatcctcagaagatagtaatttgtatatgtttaatcacactttacacataaagttgatcacatgttctcatataaattgtctcaatgattttgtatatatgtgccatgtgtatgtatgcatatcaagacatcaat

SEQ ID NO: 5515 - DNA, 529 bp, Sorghum bicolor
  Clone ID: SORBI-28MAY03-CLUS1479_1
taggggccttttttttttttttttttggacaacagaacaatatcttcttgtctcttgtaacaatgatactgtattgtctgatcatagtggttcgacatgctcaactagcaggaagtattagagtagcattgagaaatgagaatacaccaacttcatccactcaaagccaaacaattcattacatagtattataataagagtacaatctatcttttaggttcccatccatgcctccatttttgtcatgctttggagctcctcaagcttcagcggtacttgatgaagccgatgtccttggcgttgctgcggaagcactgcctgcagcacatgagcccgtacttccggatcaggccgtgggggttagcgcacacacggcagactctggatccagggccgtagttcttggggtgcgagttccacacgttggagtgtcccatggaggcggcggcggcggcggcagggggagcaggaggcctcacgagtaaaccctaaccttgtctgactcttgcgattccgaaacccggccggc

SEQ ID NO: 5516 - DNA, 468 bp, Sorghum bicolor
  Clone ID: SORBI-28MAY03-CLUS14898_1
gcacgaggatcagctagagcgcaaattaaagatgaagcagcatcagttgttattagtcgtcgtcgtcgttgccggcagctgcttgtggttgcaatcgacgacggcggccggcgagcccagtccgctggtggccaacctgcctagctcccccgtgatgcgggacttcatccactcccgctgcgagacggtgcagcgccccgagtcggcggcgggatgctactcgctcctgctcccgtacgcggcgtccatcaacggcagcgccatcagggcggcccgcgccgccatcaccgccatggtttccgagctcggggcctacgcggcggatctgcgcaaggtcggcggcaccgtcagtccccagtacgacctgagtagctgcatgcaggtagccccggagggcactgacgggtgcaaggagccgctggccaagctcgctcgccttgaggaggaggagaagaaggtggtgaccca

SEQ ID NO: 5517 - DNA, 1008 bp, Sorghum bicolor
  Clone ID: SORBI-28MAY03-CLUS14805_1
gagagagccggagccgtggtaaggcacgcggggcgcagccgcagacgggtcacctggatgggcttaattgggaggtgattgttgtcaaagatgacatcgtcaatgcattttgcctgcccggtggcaagattgtaatcttcactggattgcttgacaaattcagggccgatgctgaggttgccactgtgcttgggcatgaggttgggcatgctattgcaaggcacgccgctgagcagatcactaagaacctctgggtggcaatcctgcagattgtcatcctgcagtttatttacatgccagacttgataaatacagtgtcaacactcctcctcaggctacccttctcacgaagaatggagatagaggctgaccacattgggctcctgctgctcgctgctgctggttacgatccgcgtgttgccccatcgatctatgagaaactaggaaagatcggaggagattcagcattgaataactacctctcgactcatccgtccagcaagaagagagcgcagcttctgtcgcgagccagtgtcatgaacgaggcactggaactgtacagggaggttagtgccggccaaggcactgaaggtttcctctagattctcgtaattgctcctctgcttgtttcaaacgcctcacaaagctgcactagtgacgacctgtgcattgggcgttctcagtggttcagattcctggaagattagactgtactcttgctcctcgtaatttccagtcgttgtgaggccgaacgggccctcgtcgttccccaagcagaagcgtagctgcttttcatttgtgattaggagaaataaataaagcagtccatattgttaataatgggtagttgacagccgcttctgtttccagtgtggttttggtccgttcatgctgatggggcgatggctgaaccgggaaatgattggttttcagcaaaggatcatcacacatcgttctcttggtttctggaaaaaaaaaaaaaatgctttaagctcaacatttggctat

SEQ ID NO: 5518 - DNA, 705 bp, Sorghum bicolor
  Clone ID: SORBI-28MAY03-CLUS14908_1
tggcggtgcagcagagcatgtggccgctgcacgtcatggcgtccgccgagtggaccgtggccgacctggtggccgccgccgtggcgctctacgtcaaggaaggccgccggccgctgctgccgtccaccgacccggccgccttcggcctccactactcccagttctgcttggagagtctggacccaaaggagaagattatggaactgggctccaggagcttcttcctgtgcccaagatcttcagctgctggtcaggatgcttcatcgtcctcccctggcacagcaaacggggtcatcagggcggcttcagggaaaacaccggcctggctgagcaacatgccgttctggccgacgatgtaatcggctagcaccccgcccgagactcttccacccacagtcaccaagcatcggttcaggaaacaggtccaaaagaatctccaagtattgcatttgtgagacaaatggctacaaggacactgtaaatttgtagtatgtttagagggagatgagacagcagtgtgtgtaagcatcttgaatggtgcacgaatcatctgtggctcatgttacgcccaaatttagataaaaatatcaaatgtgtatgtaattaaaagtttaaaaaaaaaaaaaaaaaaaaaaaaaaaaaaaaaaaaaaaaaaaaaaaaaaaaaaaaaaaaaaaagttaaaaaaaaaaaaaaaaaggccccta

SEQ ID NO: 5519 - DNA, 722 bp, Sorghum bicolor
  unsure (1)..(722): unsure at all n locations
  Clone ID: SORBI-28MAY03-CLUS1492_1
gcacgaggaatgagtacaatctaaatcccttaaccaggatccattggagggcaagtctggcgccaccaccaaggtggtgcttctcgacgaggaggattggttgaagccaccgccgcccaaggccgcattcagggcctcggcagaggaggatagtacgtttcgagaactgaggttgaagagacaagagtgggcaaaatttgctgaatcagctcaggatatattgcaaaagatggatgaaatgaccaacaatgaagttggtcccaaggaaccacctgaacaaataattctagatgaggagtctgaacctccagtcgagaaagcaagggaaaagattgtcatttcaattcaggacaaggatgggcatcaacagatgcgtgtatacaaggttatattattttttttggcatggactagcattgctaacaagaatactcatatatacaacctccctccccaaaaaagaatgtcatcgtaggtttggattaagtcacttttttagatttgatcacgtttatagaaaatagtaccaatatttgtacacaagcagaggtctattattttattgatactttatttttaatcaaagtatattagttttttgtctttataaccgttccaaaggcagatttgtctatatgtcaacattctttgaggtcatcttgatatataccgttttatactaattacgcccgcacattctcttcttttgcttccanaagatt

SEQ ID NO: 5520 - DNA, 492 bp, Sorghum bicolor
  Clone ID: SORBI-28MAY03-CLUS15484_1
atatgcaaaataatgaaggtcgtacaccttttgaagacttgacaaacaccatcaattgtggtaattgttttattctgatccccttctatgctttgaacttatttgtggtggttaagttattttcaactaattttgaaacaggtggccagtcaacatcaaattcacgagaacaaattgatgaacgtgtgcaacgtaaaagggaaagagaaaaagcacgaagtgcatcaatgactcaagaacaaagagatgataaaaataaaaaacttaggaaaaagtatcatcaagaaaagtctgaaaaaaatgcaatacgtcatgaacgatatcatcagaaaaaaaacatgtaaaccttggtttatgaattcaatattgtcatttttaagtttatttaatatatactgaagtatatgttgaccagttggagttgaatcaaccatgaaaaactatgatggcgatgaagatagtgattggctacatcaaaaaaaaaaaaaaaaa

SEQ ID NO: 5521 - DNA, 430 bp, Sorghum bicolor
  unsure (1)..(430): unsure at all n locations
  Clone ID: LIB3480-041-P1-K1-A10
cccacgcgtccggttgtacatgtattatgtctactaactttgctcacttttaaagaataatttgatcataatgaaagatatgcaaaataatgaaggtcgtacaccttttgaagacttgacaaacaccatcaattgtggtggccagtcaacatcaaattcacgagaacaaattgataaacgtgtgcaacgtaaaagggaaagagaaaaagcacgaagtgcatcaatgactcaagaacanagagatgataaaaataaaaacttaaggaaaagtatcatcaaaaaaggctaaaaaaatgcatacttgggacgatttatcagaaaaaaccatgtaaacctgggttaatgaattcaatatggtcatttttaagttaatttaatttatacttgaagtatatgttaaaaaaaaaaaaaaaagggcggccgttttaaa

SEQ ID NO: 5522 - DNA, 746 bp, Sorghum bicolor
  Clone ID: SORBI-28MAY03-CLUS15578_1
tagacttaaagaactgattaagtacaaaggttttcagattgcacccgctgagcttgaagggctacttctgtctcatccagaaattctggatgctgttgttatcccgttccccgatgctgaagctggggaagttcctattgcctacgtcgtaaggtcccctgtgagttctttgactgaagttgatgtccagaaatttattgaaaagcaggtcgcatactacaaaaaattgaggagggttacctttgtggacagcgtaccaaaatctgcttcaggaaagattttgagaagagaactgatcgctaaagtcagatcgtccaagctatagcaaaccagcttctgtttcgtaagactgcttgcctcctatctactccctccattccaaattggaatttattctggcttcttagatacatagttttttctatgcatctagatatccaatatgtctaaatacatagtaaaacgaagtatctagagaagctagaacgacttacaatttggaaaagagggagtactagattggaaatttgtcaattgagcgtaaaggtttacctgttgctgaacagagcttatcaagcaaaccattcagtttgccccatcagccattgcgcgtgtatatcatcatatatgtgagacatatatgctccagttgcccccaatcccagtagccatacatggcagtgttgtgtcacttgtatggaatattgggtctgatttacatacaccacatatttcatctatataag

SEQ ID NO: 5523 - DNA, 1052 bp, Sorghum bicolor
  unsure (1)..(1052): unsure at all n locations
  Clone ID: SORBI-28MAY03-CLUS15621_1
cttttctgtatgaaataattctatataaaatatgcttattctattgtgtgtgatgtccgttttcaggatacatgcaggtttgctgtttggacctcacgcttcatcaataattttgttttgtgcaagtctgtatagcaaggatgtttattgtcttgatgtgaaagtgaaattgactttttgaagaaataaacataaggcccatagttgcttacgagtttgagaaattactgatttgcagattctgtaatgtcaagacatctcgaacacccctccaccgaatcttgatgagccttccaatattgctcaaattattgcctcatggggccttgaatatatagttatcacgagtgttgacatggacgatttgcctgattagggcagtggtcactttgctgaaacagtacagaagttaaaggcttttttacaagaagaagttaaaggctttgaagccagaaatgcttattgaagcactcggtaagagacatgttgctcaccgtatgcttggttacttgcatattagcgcggagttgatcatcggccctgtcaaattagcgcattaaccattctattttctgtatccttactactaatttttcagtacctgatttctgtggagatacaagctgtgtagagaaggttgcaacttctggattgcatgtttttgtgcacaatattgaaacagtggaagagcttcaaagaaatgtccgagactaccatgcaaattttaaaaaatctatagatgttctgaaaatggcaaaagagtatgctcttcctggtacccttataaatacataaataatactgggttgtggggagactccagatcaggttattagcaccttggaaaaggtgtgggctgctggtgttgacgttataacatttggtcggtacatgaggccatcaaaacgtcacatgcctgtttctgagtatgttacacctcagctgtcgagaagtatcgggcccttggtgttgaaatggtatgcctatgtataggcttcgaccctgagttgatgaatttcagantacaccattttgtctgtgaggctggtaat

SEQ ID NO: 5524 - DNA, 1013 bp, Sorghum bicolor
  unsure (1)..(1013): unsure at all n locations
  Clone ID: SORBI-28MAY03-CLUS15638_1
tggcctaccccctccccttcctccgcctcccattccattcccaaaattttcaccgcacgcctctccccggctccccgcgacgacgacccccgaagcttcgcgaagcttccagggccttcccccgcggccgcccctccctagatcgccgcctccggcagcggcgaggctgcatcgcgagggcggtggaggagccgggcgacggggtcgaccaaggcggggcgaaggcgaggctagggtttggggtcggcgtcgggctgcatcggccggcgccctgtgagggaggaggaggatgcatatgatgcggcggctcaagagcatcgcctccggccgctcggcaggctccgatccgggtggtgactctggctccaaaaggccaaaatttgagcaggatggagcaggagatattgttatcgagccacacttgactgaggaaaaacctgtgcggatagaccaagaatcatcgtcatcatctaatagggatgctgaggcaagcacatctactagcatgaagcctgctaaaactgaagaaccaggagcggatattcttcccaaagaaatgaatgatatgacaattagtgacgataaagctgatggccacaatgataaggaaggtgaaggtgttactcttgatgggaatggaactgagacagggcagataattgtgacaacaataggaggtcataatgggaagccaaagcagaaggtctcatacatggcagaacgggttgttggtactggttcgtttggtgttgttttccaggcaaaatgcttggaaactggtgagacagtggcgataaaaaaggtgttacaagataagcgctacaagaatagagagctccagactatgcagttacttgaccacccgaatgtagttcagctgaagcatcacttcttttcaacaactcanaggggagaagtttacctcaaccttgtacttgaanttgtatctgagacagtttatcgtgttgccaaatactacaaaccgatgaaccagcgtgtacccataatatatg

SEQ ID NO: 5525 - DNA, 511 bp, Sorghum bicolor
  Clone ID: SORBI-28MAY03-CLUS15696_1
cccacgcgtccgctggtttaatggataacagcacaaagacaacccttttaggagtgtggatgcttcttttcacggttttcgcagctagaaagttccagcagcccatcaaggacgacattggggacaaatctgttttcatgttcaatgcgctccgctttgatccagaaactggagaggcaaaaggcacagcagcagtttgagtagacattgtagcttgtcttggtgtaagccaatagtttgtccatgaaagtttatagctgatgtatatgatagtcggaaaatttgaaaatacagcaggacatatgaaggtgagaatgttgtaatcgagatgtaattagctatctgaagatcataggaaagatttgatccagaaactggagaggcaaaaggcccagcagcagtttgagtagacattgtagcttgtcttggtgtaagccaatattttgttgagctttcgtgccagaatcgagtaaatgcaaaattcatccctgaatggatgagatgaaggttg

SEQ ID NO: 5526 - DNA, 962 bp, Sorghum bicolor
  unsure (1)..(962): unsure at all n locations
  Clone ID: SORBI-28MAY03-CLUS15195_1
gtcgcgctcgtcggctactgcatggacggcgcgcgccgcctgctcgtctacgagttcgtgcccaaccacacgctcgagcaccacctccatgggaaagccggagccggagccggagccggccgcctgccggtgatggagtggacgacgcggctccgcatcgccgtcggcgccgccaagggcctcgcgtacctgcacgaggagtgcgaccctcggatcatccaccgcgacatcaagtccgccaacatcctgctcgacgacgacttcgaggccatggtcgccgacttcgggctcgccaagctcaccagcgtcaaccacacgcacgtgtcgacacgcgtcatgggcaccttcggctacctggcgccggagtacgcgtccagcggcaagctcaccgagaagtccgacgtcttctcctacggcgtcatgctgctcgagctgctcaccggccgtcgccccggcgatcgctcctcctatggccaagacggcctcgtcgactgggcgaggcaggcgctgccgcgggcgctggcagacggcaactacgacgagatcgtggacccgaggctgcggggcgactacgacccgacggaggcggcgcgcctggtcgccagcgccgccgccgccgtgcgccacgcggcgcggcgccgccccaagatgagccagatcgtgctggcgctgcagggggccatgccgctggaggagctcaacgacggggtgcgcccgggccacggcgccgcgttcggctccggctcggggtcgtcggggtccgctggctcgggctccgactacggcggctccgacggctcgtcgtacacggcgcagatggagcggatcaggcgggccgcgatgcctagcccggagtacagcgccgactaccctggctctgtcccggagtagggacacccgtcgccggcgagctccgacgagcgggaagaccggcggcattcgggaggtcgccgntgagtgac

SEQ ID NO: 5527 - DNA, 735 bp, Sorghum bicolor
  Clone ID: SORBI-28MAY03-CLUS15161_1
gacgacgacatcatctttgaacatagtggatctcaatctgacaggaaaacatcaggttccatggcttcgtcagatgttctaactgtcaatcaactaatggaatctgttcatgagactgcaaggcaagttgctaatgttccagtttccaccaaccctgtaccatacgaccaaatgaagagtcagtgtgaagccctggtcatggaaaagcaacagaagatgtctgttctcttgagcttcaagcattcgaggactgactcgcatggttcagccggtgtggatgggctcgaaacgaatgagtcttctttgcgatctgagccagagttgaggaaggggcgcatgcgccgttgcgattcagcatccagcgaatctgactgttcgttcaggctgccacctgctagcccatacgacaagttcctgaaagcggctggacggtagcttggtgcaattgcgtcagcttggcgaattctgtacacagtacacatgagagttcattgcaagtcattcctcggcaccctctggttctcggaatctaattctttcaagtgtatatttacattcgtcgacaaggtgtataaagttttgttactgttggatgctttagaataaaccgaaatgtataggtaatcgcgcctgctcatattcacacaagtatttgttcatttgttggtcgtgaaaggaaatattttttactcaaatcttgccgtttctctgttaaagaatgaattggtaatgaca

SEQ ID NO: 5528 - DNA, 407 bp, Sorghum bicolor
  Clone ID: SORBI-28MAY03-CLUS15208_1
gtcgatcagctgacctggacacggcggatcagagtcagagcgaagctgcttgtagttgggtgcagctagcagccacttgctagccagccagccagccagcagtcgatcgaggccaggcgcgcgcgcgcgacgatggtgagaagaatggtgctggtggcggcgctggtggtggccaccgtcgccgtcctcgccggcggcgcgcgggcgcagctcaaggaagggttctacggctccacctgcccgcaggcggagaagatcgtcaaggagttcgtcaaggcgcacatcccgcacgcgcctgacgtcgccgccaccctgatccgcacccacttccacgactgcttcgtcaggggctgcgacgcgtcggtgctgctcaacgcgacgggcggcatggaggcggagatagacgc

SEQ ID NO: 5529 - DNA, 678 bp, Sorghum bicolor
  unsure (1)..(678): unsure at all n locations
  Clone ID: SORBI-28MAY03-CLUS15156_1
ctctcgctcgtggcgacgactgggcgactgactgcccccgccgcatttcgctaggtgccccacggcccttcgccggcgacgagcacccaccagagcacgggggttcctacgactagttctttttatgtataacctccaatgaaggattctcaggatattcagagcacgacagagttgcagtcatcagcacaaggtactaatgaagtgcaaagtcagcaaccaaaccctatggccactgatgctcctgcaggaaattcgggttccttatctgtagctagtaatggcaataagaaggtgtctcgcgaagatattgaacttgttcagaatttgatagagcgttgtctacagctatacatgaacaaaggagaagttgttagaactctttctactcgtgctagaatagaacctggcttcactactttagtatggcagaaacttgaagaagagaactctgagttctttagggcttactatatacggctgaaattgaaaaggcagatcatcttgttcaatcatttattgcaacaccagtacaatttgatgaaatatccagcacctcccaatatacccttggctccnatacaaaatggaattcatcatatgccagttagcaatttaccaatggggtatccagtacttcagcagcctatcatgcctgctcctggccagcctcacatg

SEQ ID NO: 5530 - DNA, 452 bp, Sorghum bicolor
  Clone ID: LIB3480-033-P1-K1-H9
aacttgttcagaatttgatagagcgttgtctacagctatacatgaacaaaggagaagttgttagaactctttctactcgtgctagaatagaacctggcttcactactttagtatggcagaaacttgaagaagagaactctgagttctttagggcttactatatacggctgaaattgaaaaggcagatcatcttgttcaatcatttattgcaacaccagtacaatttgatgaaatatccagtacttcagcagcctatcatgcctgctcctggccagcctcacatggatcccaatggcctgtggtctgtccagtggtcatgtggttaatggaatacctgcaggtggttatcatccaatgcgcatgaactccggaaatgacatggttgtggacaatggagcacctgaagcaccacatgcttgtgctaccggtagtgctatgtcatctgagatggc

SEQ ID NO: 5531 - DNA, 689 bp, Sorghum bicolor
  Clone ID: SORBI-28MAY03-CLUS15224_1
attgatacatggatgcttcatggctcgttgctgctgtggcccctgttggctgtacctacgcgtccgcaaattgcaaatagctgtacatattttagcatatgctactattttatgaaaaaacaaatagctgagattgagatgctagcaattgtttaagaacacaagccagtattgccaacatgcctaaaagtattagcaaatttcattgcattgtcatctgagattgcaaatagctcagacatagacctacagttcctaattagtgtactactatacttttgatcaatttaggttgggagattccctgcagttcttctagttattaatgatcaaattgatgttaatttatttttcaggtagcattgggcaccactaactgcttacaaatgaatgggatgccaaattttgcgcaactactgcatttggatccaagtatttcttttgttttatgagcttttggaacaacttgtggactttactcgttaggagggcaagaacctgttgttgggtccatacatctctttttggttgctatgtctatcaaagtgattgtctactgcaaacaatctagtatagctcccatttatgttttatgacttggtgtaaattggatatgctgccatgtatgtacttgtgcttaatttatgacttggtgcaaatgtccaagacaactatattcatgccatagg

SEQ ID NO: 5532 - DNA, 985 bp, Sorghum bicolor
  unsure (1)..(985): unsure at all n locations
  Clone ID: SORBI-28MAY03-CLUS15891_1
tcagcctcgcccttctagaagcttccggaagccaacccaagccatggctgccgacagcaccgccgccgcccgagtagcaagtcacctcacgagtcacgactcggattcgctcgttcacctcccgcgcgggcaggtggatctgatcgacttcatcgactggaccggcgtcgagtgcctcaaccaggactcgtcccatagcatcgtcaacgcgctcaagcagagtttgcgggacgacgaggggttgtacctcgccagcgattcggacgagcagctgctgatctacatccccttcatgcaggtgatcaaactgcattccgcgctattcaaaggccccgaggaagagggccccaaaacaataaaactcttctccaataaagagcatatgggtttcagcaatgtcaatgactatccaccaagtgacaccctcgagctatcctccgatcatttgatagagaataaacctttgccgctaaagtatgtcaagttccaaaatgttcgcagtctgactatatttattgaggacaaccaaagtggaagtgatgtctcaaaaattcacaagattgctctttatggaacaactgtggacacaacaaatatgaaagatttgaagaagatagaagagcactgagaccatttaaaggttgagcttattccagtgggtgtatggcatactagaaacagttagatggatgttaaattgagcaatttctagttgaccctggcaacttcttttcccctatttttatacaacgaggagttcaaagagtgcaagtctggtgatgccgaagctattgcctcatggcatcttgtaatcctgcaatttatggctttgggtgtgacaatcagatgatccgaatccatttcatgaatgaaccaaaattactacatgcatccatggtcttgcaaactttgccagcagaacttagttcgttcctgggaagtttggtttgtgttgaacattntgaggatgatgaatgcattggcc

SEQ ID NO: 5533 - DNA, 816 bp, Sorghum bicolor
  Clone ID: SORBI-28MAY03-CLUS15831_1
cgcaggtcacacaaaccgaaaacaatcagcctcaaatccctttctcctccgttgcagacttccagaagtgcagatggcggtgtcatcagggacgatcttctccgtccgcccgccggcgccggcttcggcggtccggccctgcgcctgcgccgcctcggcggccgccggcggggcgagggcgcgcgccgacggcggaggctctggcgccgccaagtggtgggcgccgctgctggggtggtccggccagccggactacatcgacgcgcgcccggccgcgtccgaggaggagccggagcagacgcggcagagggcgtcggcgtcggccaggcggttcggcgtgctgacggaggacaaggcgcgccggctgcggatgcagatgatggagacggagagcttccacgacgccatgtaccactccgccatcgcgtcccgcctcgcctccgccgcgcccgacaataagcactagctaccttgccaccggccaagcgccgtgcccgtgtgtacatacatagtatatgcttggatgttgtccagcttccgtccgtccgtccttcttggatttggtttttagaataaaaaaaaatgaatagcgtggcgacggtgttgcaagcatgggggaggggactagtattaggatggtgcccctccctgtccctcgatctgctgcgacgacgacgagcctcccagtctgtcccggtgcagacgagctgatcctaatcttagggtagctgctgtgtaccattagttgatcttgcaccgaaatgttatggagacaaacacaagcctatgatgttttcggtttgattttgttaatag

SEQ ID NO: 5534 - DNA, 148 bp, Sorghum bicolor
  Clone ID: LIB3480-048-P1-K1-H4
aaaaaaaaaaaaagggcgccgctcgcgatctagaactaggcgacgacgacgagcctcccagtctgtcccggtgcagacgagctgatcctaatcttagggtagctgctgtgtaccattagttgatcttgcaccgaaatgttatggagac

SEQ ID NO: 5535 - DNA, 760 bp, Sorghum bicolor
  Clone ID: SORBI-28MAY03-CLUS15970_1
acccaccggagattgacccgcgagcggaggacaaggagctcaaataccagctcctgaagaagtacagtggctacttgagcagcctcaggcaagagttttccaagaaaaagaagaaagggaagctcccaaaggaggccaggcagaaactgctccactggtgggagctgcactacaagtggccttacccttcagagacggagaagattgcgcttgcagagtcaacaggcctagaccagaagcagatcaacaactggttcatcaaccagaggaaacggcattggaagccgtcagaggacatgcctttcgtgatgatggaaggcttccacccgcagaacgccgctgcgctgtacatggacggcccattcatggccgacggcatgtaccgcctcggttcatgaactgcctgtgaactggactatccaactcggactgcgtcaaaatgtttctgtgtaccaggaagcatgcgttgcaatgcaaggacattgttatggaatttttgttaccgtttaccgctgattgccaaggggggttagtcagtgggtcgcggtcgctcgctctagtgtctatggcttgtagttgtcctgtaatgttgttaatttccgcttgacggcttgtattctaggtgtattccgaacttgattgtccgtgcaagtaccctggtgattaatttggcatgcagtcgcctgctgtttgtatgattgtatggttcagatggtggaacatgcatgttaagggcgtggccgtttgaataaaaaaaaaa

SEQ ID NO: 5536 - DNA, 601 bp, Sorghum bicolor
  Clone ID: SORBI-28MAY03-CLUS16051_1
ccagagacgaggcccatcggcgccacatggaggcacagcacaccactcttgcgcaggtcatcaaggctgagttctgggagtggttcgtgtgcgaggaggggaaagaggtcgaggcggcgaaagtctaagacaaggtctgcagagagcgactgaaggacatgtactccgaggcgcacatccagcgcgtcatctcctaccaccatgaggtgcttggccagaaggtgacgaagaaacaggccacagagatgatcatgttgcccgacactaacatcaccagggagcaatacatgcagtttcctgctgattggtgcaaatcgcacatggactgctgggctcagtttgtggactcgtggccgccaccggaggcgtacggggagcgcaaaaaaggtgggagctctccacaccctagggggcactcaccctggttggcgtggccagatgggggctcgggacacgacggtggccacgacgacgacgggtcagagtcacaacactaggggtgaggcgctagcgacttcgagtagtgatattgatgtggacttgtggtttatgttatgaacttgtggcatatgttatgaacttgtggtttatgttggacata

SEQ ID NO: 5537 - DNA, 424 bp, Sorghum bicolor
  Clone ID: SORBI-28MAY03-CLUS1607_1
gcaccgaacccgcaccccacaactccgtcgtctcctctcctgtcctccacaccacacgagggcacgcacagagagctcgtgcctgcacttccatggccggcgcctcctcgtgtgctcctcgcagcatcacgaccgcacctttgcgttagccagctctgtcttgttgtcgcacgtgagaggagcgagagacgttgattgattcttcctttttctcggcgcgcgcgggagggggtagcactagcacaccgccggcaaaggatcgtgaccgaagattgtggggaagagggagcgggacttcaagaacccgatgcgtaggacgacgagcatgacggagttcgcgccgtccgaggatcactgtgttttactaccctacttactgattaatcctattctttgtatattcttatcaattgctttgaatttt

SEQ ID NO: 5538 - DNA, 338 bp, Sorghum bicolor
  unsure (1)..(338): unsure at all n locations
  Clone ID: SORBI-28MAY03-CLUS1543_1
gcacgaggtccannttttgagcccaccttacaggcatacaantttggactcctcaggcttcctttctctttctataccaactgtgcagcctctaactaaatatgaaatgccatcactagttgatggttctgctgttactttggctgtacaaggtctggaaagtgattctgtccgtgacaagggcctagaaattgacgctgttcatgagaagggtgttgaggttagctcaactccttgatcctgttggggttgaattagaatctgcaccagccaaaagaggggcagtattatcttcaaagaacgagttgcattctacacttggcctcttttgtatcaga

SEQ ID NO: 5539 - DNA, 693 bp, Sorghum bicolor
  Clone ID: SORBI-28MAY03-CLUS15432_1
tgtaccgcggcgtgcctagtgggctacatttcatgaacttccccgcgccgatggcgctgctccccggtgcgcagcagcagctcgggctcggcggccccgtgggcggcaacgaaaatggcagcgccagcggcggcggaggcggagccgagggccacatggggatcctcgccgcgctcaacgcgtaccgggcacatgctgtctcggacgctacgccggcggcgcagaacggtgcaggaggaggcggctctagtcagcatcagcagcatggccatggcggcggcgagcgacaggagagcatgagccccagcgacgactcgtaggtcttcggaggcgtgtgcatgcactggtctgctaaggcgtccctcctgtttttaatctgtgcttcttgacttcccgtttgcagtatttttttggtttgcattgttatggctggccttctctggctccttcacattcttgcaaggatcatacagagtttcatttcatggcatctgggactgggatatataatcacgctccgcattcgtgttggcttcaccaatcacatcacaagagaagacgatagagggaattcatggaggagaggacttgcattgttagggcttgacgggcatggcggagatggagctgttacagaccacttggcagccttgtttatatgacaatcccttattgtccaatgttcaaccatga

SEQ ID NO: 5540 - DNA, 1109 bp, Sorghum bicolor
  Clone ID: SORBI-28MAY03-CLUS15478_1
gcacgaggcaactgcagctttaaagattccgtctcccagtgtttctcgtgggagatcatttgatgaacttactctctcaaactcaactgaaccacataaaaggcgaggtgaccttgaggaagaagaggaactgatgagggtcctcaatctatccaaagctgaaagtggggatgcagttgatggagaagtttcttttgacacttcacatagtcattcatcgtccaacatggaggcaccacaaagtgagagttttcagtcagaagcacctgaggtggtgggggctgcaaaaagagaggaacatggcgatcctcctgggagtgatgatgcctccatcacaaatggtgctcttaatggcagtgaagttgtgcctgaagaatcccaagaaactttgacatctaaagaaccacaggacagtggaataaagaatgtgttaccaggggaccttgatatacccgttcaatcttcagaatctactccttgtccatcccatgaatcctttgctaccagtgaccaccaacctgctgttcctactcttgttgaaggtgataaagaaacctgcagagaacagtttgatgtacaaattcatggccagtctagagatactgaggctgcttgtgactcgtcagttgcaatttgtggagctgttccaggtcatgctacaacagaactggatgtggaaagtgattcattagataattctgagcctctaccttcaagcattcaggaatgtgaaccaatataccaaggtgaagagcacatacttggcgccacaaatatggtgtatgaaaatcaagagccagtgtatgagggggagagtggttcttgctgagcaggctgacattactggggaaagcagtccttctgtggatgacaaggccacagaacatcaatgggaactgattgataattttctgcagaccactgctaaccagctgactgtctatggtctcttctgtttacaagagggacttaacgaaagtgagctttgtgtcttcttccgtaataaccacttcaacaccatgttcaagtacaacggaagtctatatctcctagcaactgatcaaggttttataagccaaactgatttggtattgcaaaagttggatgag

SEQ ID NO: 5541 - DNA, 802 bp, Sorghum bicolor
  Clone ID: SORBI-28MAY03-CLUS15551_1
cttgtgaacgtcattgctactggaggctttagtgaggatatgatccctactgtaggattcaatatgagaaaggttaccaaaggaaatgtgacgataaaattgtgggatcttggaggccaaccaagattccggagcatgtgggagagatactgccgtgcggtttctgcaattgtgtatgttgttgacgcggcagatcgagaaaacatggccattgcaaaaggggagctccatgacctcttgagcaagccatctttgactgggatcccattattagtcattggcaataaaattgacaagcctgaagctttccctaagcaaaccttcacagaactaatgggcctaaagacaatcactgaccgagaagtggcatgcttcatgatatcatgcaagaactcgaccaacattgattctgtcattgactggctggtgaagcactcgaaaaagaagaattgaacttaaaatctgtactagctcttaaagcgcactccagtctccctctttttgcatgtcgcatggcattggagctgtaaattacgcgagaggtattgatcagggatgttgtgttcataattttgttaatctggtttggcagtatgttggtggactgcgtctggtattgtgcacccccgtgatctgttacgacttacaggaggctgccttctgtgttccatacttggtcaatttgagctgtgcgatttgtttcacattgtttaaaaaaaaaacacatactaaaaaaacccaaaaaaataaaaaagaaatatatacaaatttcttaacaatcgccaaaaaggaaaaacaaagg

SEQ ID NO: 5542 - DNA, 629 bp, Sorghum bicolor
  Clone ID: SORBI-28MAY03-CLUS15560_1
gtggcggcgtgggagatgaagagcggcgggggaggaggaggaggaggaggcgggggcgggcagcagtggccgtgcgactactgcggggaggcggcggcggcgctgcactgccgcgcggacgccgcgcggctctgcgtggcgtgcgaccgccacgtgcacgccgccaacgcgctgtcgaggaagcacgtgcgcgtgccgctctgcgcggggtgcgccgcgcgcccggccgccgcgcgggtctccccagtcccgggcgccgacccggcgttcctctgcgccggctgctgcgacgacgccgcctcggcggcggtgcgcgtgccggtcgagggcttctcgggctgcccctcggcggccgagctcgccgcgtcatgggggctcgacctccgccgcgcggaggagggcaaggacggcgccggcggcgacatcgacgacggcgaccccttcctctcggtgctcgactactccgtgctcggggtggcggtcgacccggacctgcgcgacctctacgtgccgtgcgacccgccgcgggttcccgcccccgacgccgccggggcgcgcccgctcatggggcatgcgctgtgcgaccagctcgccgagatggcgcgacgcgagacggacacagtccacgc

SEQ ID NO: 5543 - DNA, 741 bp, Sorghum bicolor
  Clone ID: SORBI-28MAY03-CLUS1620_1
gtctgctcagtctaaaaagtatgctttcaagtgtcaccggaaatctgaagctggcagggacaccgtttatcctgtcaatgcaattgctttccatcccatatatggaacatttgccactggagggtgtgatggatttgtgaatgtgtgggatggcattaacaagaaaaggctatatcagtactcgaagtacgcatcaagcattgctgctctatcattcagtaaggatggccatctgcttgctgtggcatccagctacacctatgaagagggagaaaaaacgcatgaacctgacgctatatttatccggacagtgaatgaagtcgaggtgaagccgaagcccaaggcattggctgccccccagtagtgttgtgacttggtggcggtatcagtcacatggttagatgacccgtacttctctaagagtctaaagttgatgtcaattgcattagttgacgcagagcttgtttgtgtggaaagaagtgaaacgtctgtttctgaatctggtccttcatctttcgttttagttgtccgtggaaacatatcatgttccagctgattgtatattctgagacagattatgttttagtttattcgattcttcgttgaccttatttatcaaatatttaagtaatcgtaagcttggaacctggagggaagaactatgctggaggggagtatttgtaattcctggctttgttgtaacgatgcctatttattaggagttgaagtttggaagtggag

SEQ ID NO: 5544 - DNA, 696 bp, Sorghum bicolor
  Clone ID: SORBI-28MAY03-CLUS16255_1
ccgagccgagagtctctgccatagagtagcagaccgcgtcgcggtccgcgtagtccccggccatcgaccatctcgacgcctacgactccaaccccctgcagctcggcttggccgtggtggaccgtctcaacgctctccagcaggagaccgggcggctgctggcctacctccacgtgacgcagccacggtacacggcgtacgggcagacggagtccggccagcacgggagtgccgaggaggagagccggctgatgcgtgccctgcggggtgcctaccgtggcacgttcatgtgcagcggcgggtacacgcgggagctcggcgtggaggccgtcgagtccggggacgccgacctggtgtcgtacgggcggctgttcatcgcgaacccggacctggtggagcggtttcggcgcgacgccccgctgaacaaatacgtgcgcaagacgttctacaccccggaccccgtcgtcggttacacggactacccattcctcggccagcctaaggcgcgcatgtgattagtaggttgctaatcataagaggcggactattgtttgtgtattgtcaattgtgacttgagaaaataagcaaacatacggtactcctactgtagatgtgttaccaatatccgggtcgcagattgtatcctgatagtgcaaagagaaaatagtgtacttaatgggggaaatgggtttctta

SEQ ID NO: 5545 - DNA, 1072 bp, Sorghum bicolor
  Clone ID: SORBI-28MAY03-CLUS16267_1
ccccccgcacgccacccgctgccaagtccatccgcaacggacagggagcccgtcggacgacgcccccgccgtgggccgccgtcacccgggcctgtccaatcgcgtcttcgctcttcttggcccgcggcctgctggggctgcttttttcgtcggggctccctccgccggttccgggcgcggtcccctgcctcgttggtgctctttcgtggtctgcctctggcgcggttctggtgcgtgcagtgaggagtttcggccttcttcccgcggctctgggggttcttgtctggtgccctggtcgtccgcgtgcgtgtggtcgcgcgtcttgggtcgatgtcaactctagcggtgaagctcgtggggctaccaacggtcgggtgcgggcgggttccgtcgcttcggtcgaaggcgctcgggctctgcgtccgggccgcagcggccgggtgcgtgttcgagactcggcccgcggtcgggggcatcggggccgcttccgtggtgtcctgggccgccgcgtggatttggtttcgtgacttttgatgataagaagtctatggaagaagcaattgaggcaatgaacggaatggatctggatggaaggaacataactgttgaaagagctcaggctcagagttcaggcagcagggaccgtgatggagatcgagactatagtcgtggtggtggtgatcgtgaccgctaccgtggtgactatagccgcggtcgggaccatggtcgtgatttcggtggaagccgtggcggtggaagtggtgattgcttcaaatgtggcaagcctggacattttgcaagggaatgcccttctgatgatggtggcaggggggataggtatggtagcagggacgacaagtatggtggcagcaatggtagtagccgctatgggcctgatcgtggtggtgatcgctattctgggagccgtgatggaggaagccgcaatggtggaggcagtgaccgatacaaccgtgacaagtctggtccttatgaacgccccagccgaggtggatacaaatattgatgtttgcaaggctgtgatcttaggtatgaaaagctaattatgatttta

SEQ ID NO: 5546 - DNA, 927 bp, Sorghum bicolor
  unsure (1)..(927): unsure at all n locations
  Clone ID: SORBI-28MAY03-CLUS16310_1
gngcgccttgctcgaccgggtcatcacggagcaccgccagagacgccgtggcaaccggcggcaggagggggacgatcaccgggacttcgtcgacgtgctgctggagtcaagtttgacaacgtggccatcaagtccaatatcctggtcttgtttgccgccgccacggacacgacctacacgacgttggtatgggccatggcggagctggtgaaccacccacacgagatgcgcagggtccaagacgagatccgagcggccgtcgccggcagcggacacgacgacgacgtcgtcaccgaggaccacctcgacaagctgcgctacctcaggcgcgtgatcaaggagacgctccgactgcacgcgccactgccactgctgctgccccacgagacgatggaggacacggagctgctcggctaccacgttccggcgcgcacccgcgtcatcgtcaacgcctgggcgatcgcacgggacctcgcgacgtgggagcgcgccgacgagttcgtgccggagcggttcgcggacgacgacgaggacgacgacaagaccgactaactgcttggacaggacttcaggttcgtgccgttcggcgccgggaggagaggatgtcctggggtcgggttcgccgcgccagccatggagctggctctggcgagcttactgtaccactttgactgggcgctgccggccggcggggcgtcgaaggtggagatggaggagctgaacgggctatccgtaaggctcaaggcaatcctacatttggttgctaacccatggtatcctcaataagatcatcatgtcttttagtttgtagtaggatcaaaacatattgtgtgtgcgacgttgcatttgcatatgttcgtgattttggttgtgtgtaatcatatagtgtaatgtgcgacgttgcatttgcataaacgtgaataatnc

SEQ ID NO: 5547 - DNA, 643 bp, Sorghum bicolor
  Clone ID: SORBI-28MAY03-CLUS16291_1
catgggagaaaagatagcagcaccgccggatactgttgttgaaatcagcaacttgaatcttggaaagctgtatgcagcatccatcatgtatggttacttcctgaagagggtggatgagcgattccaacttgagaaaactatgaagactctcccaccaaaccccaagcagcagatagtatttgaaaacctacaacctaatccattctgggatatggagtccttggtacagattacacctgatggggaggagataagtttggacgacgaaggatcaaatcctaacaagttgaagtcttatgtctcgaaactggatgctgatacattgcaaagatatgctactatcagatcgaaggaagccgtctcactgattgagaagcaaactcaggcattgtttggacggccagacatcaaggtattggacgatggttcggtcaatgcaaaggatggtagaatggtaacaatcacatttacagagctgaatcatctggtcttggaggcagttactttcggttcctttctgtgggaagctgagagttatgtagaatcgaaataccattttgtcaacagttgaatgtctttcttatttgaattttggaaatggtttgtgtgcatgagataaggtaggatccatctctgatctgtt

SEQ ID NO: 5548 - DNA, 752 bp, Sorghum bicolor
  Clone ID: SORBI-28MAY03-CLUS15702_1
gatggcccagtttttagaggaacatccaaagattgctcgtgtctactatcctggcttgcctagtcaccctgaacatcacattgccaagagtcaaatgactggctttggtggtgttgttagttttgaggttgctggagactttgatggtacaaggagattcattgattctgttaagatcccttaccatgccccttcttttggaggctgtgagagcataattgatcagccagccatcatgtcctactgggattcaaaggagcagagggacatctatgggatcaaggacaccctgatcaggttcagcattggagtgggaggattttgaggatcttaagaatgatcttgttcaggccctcgagaagatctaagcactccaatccgtttgcgttaataaagtcatgaggtgatggttgtcttggatcttgtagagatccgtggtgatatatgagctgatgactgcgaatatgttgtctttttgcttattttattcttcaaattcaataagttgtggttgctgcatccagcatgatcgtagtgttgcacttaattgtacttgccaaattataccatggtctggtccgatgtacttgttttgctttagaattttgtcctcggttgtgggatgagctcacgcccgtagttttttttttttgtggcatttgccgtttcgtgtgagattaaaggcacgaaaccataataaaagagggaaaattgtcacagggaattatcaaatatatgtcgaagtgaatctt

SEQ ID NO: 5549 - DNA, 706 bp, Sorghum bicolor
  Clone ID: SORBI-28MAY03-CLUS15745_1
gggaacaaggggaagaagatgtgttgtatgtaagtcacttctgctttaacattttgctttcttcgcaatgagttggaaagagcaagggattctgcacatggttgtatcgccacagcttactccacacttgtgatactacccccagttacagcagcgttatctatcacttgacccacgcgtccgcaataagatcgcatagaaagggaaatgggggtctgctggcacaatacacaaggcttccatcaaaggttgaagaatgaaaaggacacataacccaggtggagtagcaagggaatctctcccatggagtccacaaccataaattgtgattataagcagtgtgatgtaggacatgtagaatgaaggccaggatgtcacaaggctatctaactgtatatttgcatgcagctgagtggctgactgaggccacaagtttgatctaactttgtacttatacacaaggatgaaaaacaggaaaaaagtatagttggtttttgtaagtattgtaggttggtagtgactaggcccagattgggggggctcaagttttttcaatcttgtttcgttgccttatcgactgagaggttgcaattttttgaggatatggctgattaattgtattgatgtaacatatctttagtgaaagcccatgtttttaaaaattgatgctgttgtcgagatgttgatatggaaaggattaagtggg

SEQ ID NO: 5550 - DNA, 830 bp, Sorghum bicolor
  Clone ID: SORBI-28MAY03-CLUS15764_1
gcacgaggctccccgcgtcgcctgcttctccccacaaccaaacacacaacaaatccgccatggcgctcgcctccggcacgtcccgcctcctgctgggtcgccccgccggcaccgcgcggctccacctcgccgtctcctcatcctcccccgcctcttcgatccgcttccgcccggacgcgtgggccggcggcggcagggcggccgtcgtctccctccgcgcccccgcgcctccagcagcggcggcagcagcagcaacatctggtagcattgctccagcaatttcattgactgaaaaggccttgaaacatctgaacaaaatgagggctgaacggaatgaagatttgtgcttgagaattggagtgaaacagggtggatgctcaggcatgtcttacaccatggagtttgaaagtcgagcgaatgccagccctgatgattctgttgtagagtatgatggttttgcaatagtctgtgaccccaaaagccttcttttcatgtttggaatggagctggactacagtgatgcgctcattggtggtggcttctctttccagaatccaaacgccacaaaaacctgtgggtgcggcaaatcttttgcgactgggaaagaaaccgaggccgcagcaactgcttgcaacaactagagtagcgaaatattgatagcaaaatgtgatgtaacatgttatatagcttgctcctattgaagtcccgtggctacaccacaatacagaaggcatagaattcaaagaaagtacaccattatcaatggcccccatatttcagttttcttgtatggcgatcatttaatctgaagtccttaaacttgtgttatg

SEQ ID NO: 5551 - DNA, 993 bp, Sorghum bicolor
  unsure (1)..(993): unsure at all n locations
  Clone ID: SORBI-28MAY03-CLUS15786_1
atggggcagaaggacgggtctgcttagatgcacctgccctacgatcaagtgcttgccaagatccccggttttgttgctcacatcaagtacaccatcgagacgctgtactcgcacggggcccgcaagttctggatccacggcacgggcgcgctgggctgcctgccgcagaagctggccatcccgcgggacgacgacacggacctggacgcccacggctgcctcaacacctacaacgccgccgccaagcgcttcaacgcgctgctcagcgacgcctgcgcccagctccggcgacggatggtcgacgccgcgctcgtcttcgtcgacatgtacaccatcaagtacgacctggtggcaaaccacaccatgcacgggattgagaaacctctgatggcgtgctgcggctacggcgggccgccgtacaactacaaccacttcaaggcgtgcatgtcggcggagatgcagctgtgcgacgtgggcacgcggttcatcagctgggacggcgtgcacctcaccgaggccgccaacgccgtcgtcgccgccaaggtgctcaccggcgactactccacgcccagggtcaccatcgccagactcgtcaactccacgctgcccaacgacgactagctgcctgccagcctgctgccgcgagaggattgtgatcgcgatccatattcatagaaatctagattcgtaatgcatggcggccaagatgacgctaagatcgaactcgagaagagctggttcaccgctcccatcaggatcgagttcgaacgagcaatttnccatgcatgacaccgagtgacacaattgatttccattattgcactatagtcgtaccagtaaaaagaagggctggatcatataagtgttttcgcggggatgcgcctcgaggctttttcatacaatctatcatgcacctgacatgcaatgcacatatgtgtgtaacatttacagttacttgattttttaaaagacattttcgatatgttggtggag

SEQ ID NO: 5552 - DNA, 729 bp, Sorghum bicolor
  Clone ID: SORBI-28MAY03-CLUS15961_1
gcggccgctgccggggggggccgacctcgccgaggcaaacaaaacaaactttaatttaactatatattcccgtgcagatcgatcagagctatagctgaaagacaacagcaagctatagcatccgtggagaagaaggtgatgatgaacaacacgcggctggccgtggtgctgttatttggcctgctgctggccgggcaggaggccgccgccgccgccgccgaggccagctacggcaaggctgctagcaaggccgagtgcgagatccccggcacttgcgacaggaagctcggcgacatctctgatcgcccgggggcgcaggccaacaaatacaatcgtggctgcaacaagatcactgggtgccgcggctgatccatgcatgcacgcgtatgtgtgtgtgtgtgcaggtggtcgatcgatccagcctcactgtgcgtcgcatgcatgcggtccgggcgtgcgcgccgcagggctagctcatcgtcgattttgcgtgtgtgtgtgtgtgtctccatttcgtatgctgaggtatatatatatactatactattaaaatgtgcgaaatataaatatgtttatgatttgtttatatcacactgtccacttccatcggtgttccgtcaaggaagcactcatccatgtaaattggcagccgtacgttgtaggctcatattctctgcaaggtgttgttaaaatcataaagggtgaaaaaaaaaaaaaaaaagcccccta

SEQ ID NO: 5553 - DNA, 819 bp, Sorghum bicolor
  Clone ID: SORBI-28MAY03-CLUS16513_1
atccatggcttgtgtcagcctcgagtgatggcaggattgcacttattgatttgaggaagcttctgactcccaaaagatcatcaaaaggtctgcgtgttaagagctttgatgcaagtgccatagagcctccacagaggatgcttcatggcgttggatgtgatctcttctccatcgccattggtgcagataggattgtatgtgcaggtgaggatggttctgttagagtctggaacttctcagaagcactggagattgagaggagggcacaggctctaaggagtttgaggcaggagaaccgcatgaggcggaggaaggcacaagtagagatgaatgcaaatggtagaaggcctgaccagtgctcaatagccatgaaaaagaaccaactgaaggctgataagagtgccacttggcacaacaagcgtgccattaatgagaaggccaagtcttagattaggattagtagcccttcactgagttgcagtttattgtggccatacattgccatcattgggtacttccttgttgggagtacttgctaagagtttattttcattgaagatgggtcaactaatacttagttcaacattggcacattcaggtgttctactttatgtggttataatttcccaatttaatatatgcaattcttctatgcctagtgtatattgaccaaatcaatcacaagtccttcaaatctttgaattataaaggcttttggtcttttagctttccttttgcagttttgggcttttggccaattgagagacttggtaacattacattatcgacttgtgacttctgttacttgtaaaagaatac

SEQ ID NO: 5554 - DNA, 677 bp, Sorghum bicolor
  Clone ID: SORBI-28MAY03-CLUS16534_1
gcacgaggggagcttggaggcggagggcgaggccccggcgaccgcgtccggcggcagctacagtcggtggggcggctggcagcttacctcggcggcggattcctcctcctctccgccgcctcctccgtcgccgtccgctccctccgcgccctctccgacgccaaccaggaagttcgccatgccgtgcggcgcctgcgaggggaagggcacctacgcgtgcaggctctgcaggggcagcgccaccatccagtggtctccgatgcacgacccggtgttcgtcaacccgtgcctctgccctacctgcgatgggacccgggtgcagcgctgcttgaactgcctgggaaatggttacgcttgaagaagcaataattgtgcttatcttgatcgatgaactttcctcgcacgggtgctgttcctattctaaatgagagatcaacgggtgaaatggaagtgacatgcttgtacaccattatgtgccagaagtacaaatttcagttgtttggtgaaatatgtatctgtggttgcaattgtgtgccatgcgtacaagccaagatcatggtggcaagctgctttgctgaatttcgcctatatgttagtatgaaataatttattgcatttttgtagtttgcagcttcttggctttggttatcctgaccactagcagtggtctgttttgc

SEQ ID NO: 5555 - DNA, 465 bp, Sorghum bicolor
  Clone ID: SORBI-28MAY03-CLUS16582_1
aagacttctccgaatccgtctccgcctctcccctcgctcgttctccccgtctacgacccgccgccgccgccgctcgccatgggcctcctcgacgcgctctaccgcgtggtgatgcgccgcaacgccgtctacgtcaccttcgttgtcgccggcgccttcgcgggcgagcgggcggtggactacggcgttcacaagatctgggacatgaacaacctcgggaaaaggtacgaagacataccagttttggggcagaggccagccgaagaatgataaattttggtcgccatttagctctggtttaacagtttcattttggcgcaataataagcgatgtaaacttcttactcagctcctgagagctgcttctcattcatttactctgaagatgctgtgtgtggatttcgtggtgcatggcagaaacctgttatatagagcatgcaaataaaaaaggaagattcctttgta

SEQ ID NO: 5556 - DNA, 932 bp, Sorghum bicolor
  Clone ID: SORBI-28MAY03-CLUS16580_1
gcacgagggccggctcaccggagacagcatccaaatccatggcctcccgccaggcgctccacatcttcacgccctcccggcgggcgatgcacatcctcacgccctcccgcggcatcgcctcgaccccgcacctctcgtccttcggctggttcgacaagatcaagtccaccatcactggcaagaagcccgaggagggctccgaggcatcctccttcaccctcatccagttcgcggacacgatggagaaggcgaggaagctggggacgttcaagaacttcgtcgccgggcgggccagcgaggccaccgtcgtcaacgccttcgagaagcactccgctgtgctgcgctacctcggcgccatcgaccccaccggcgagaaactccgaaacactgacaagattaacgcgaccaagcactgtaactgcacgattgctgaggtggagcacattctggccaagtacacatgggctaaagaggctcagaagaagattgaaaagctcaaggaagaaggaaagccattaccgaagtcatttaatgaggtccaaagtctaatgggttctacaccagtggatgttggcagaactaatctggcaaaaagtggtcagataagtaggaacgccctctgcccatgtggttctaagaaacgatataaaaggtgctgtggagcttcatgaggtgaacaagtctcgttcacaagcacatgcaggacaggtgcagcattttaaagctctttttggcaaactctaccaagctctttcgtggagaacacctgaatttgaagcttgcaatttgtaaagcactagagcgagccctgtgtttcagaagaaggcttttacttaaattctgtgatttcttgattggtgttgttgtttgatgttgattcggtttgaccatgtacacgaatctaggtaatatatccctagctcgttttctgc

SEQ ID NO: 5557 - DNA, 678 bp, Sorghum bicolor
  Clone ID: SORBI-28MAY03-CLUS166_1
acctccgggcgttgggtggagtccagcccctagatgataggaaaagaaaggagactttatcaaggtttatgctaacgaccagagaaaaatttcatgtgatcctgaaacgaaggagcttattaagagaacccttgaaattgggcatgtgacctacgaagtccaagtccaactgcctcaggtcagatttttagacatatgggaaccagctgttttggcaataaagagggagggttacagcattaaatgtaatggacagcgtggtgttgttatcacagagaagtttcagcaaggcactgctattcatattccatatgggcatccaacagagttcttgattacatctgctgcatctgctgatggtgtcagttataatctgaagccagtagaaaatacactgttgcgggataccattgttctagtattaaggttgttcaaaaatatggctcttgagaggagaagaggaagaaagaagggtcttttcttcaagtagtttcagctatattatacttgtttatatgcttcttctaatgtatgtagcattttggttgattggcagtggtgcataagtggtgttttattcagtgtaaaaattctaaacgattttgctgtaaaacaaaccaaaataccaactacacatgttaatatttcatgccccctcagaagagctagagttctgcc

SEQ ID NO: 5558 - DNA, 807 bp, Sorghum bicolor
  Clone ID: SORBI-28MAY03-CLUS1610_1
gaccagcacgaggccgatccgggctcgacggctcaccctccgccccatgcccatcggcgagcgggcctcgacgacaacgcgccagaagaacaccgaccgctactgcagccgtcgactggtcgctcctgccggaggagcttcttctcgtcatcatggggcacctcgaggtcattgacctcgtccgctccggcgccgcttgctcctcctggcaccccgcgttcacggccttccgccgcctccgcatcccttccccgaagcaggccccctgtgcactctacaccgcccgcgacgaggaccccgacatcgcagtgctctgcgccccttgcagaccgacctccatcggtgcttccagatccagattgccctccatccgtactgccctcccgggccttccgctcagccgccggactttcgtcggctcggcgtatgggtggctcgtcaccgcagacgaggattccaacctccacgtcgtcaatctcctcatcggtgcccaggtcgcgctcccgcccctcgccagcctctacaacgtcgagagcctaacggacgagggtggcgacctaacataccgggtcttcgtgaaccgggaagctgatgaggagcccaccgacaacctcaccgccctcgccgcgcgtgagatcatgtactttcgtgccgtcctgttgtgctcaccttcagccggggccgaatgcatcgtgctcctcattcactggcccgaaggtgagctctcgtttgccaggcttggcgatgagtcctggatgccggtctctgccatgggccacggcccccttgagcgtagcggttaccatg

SEQ ID NO: 5559 - DNA, 554 bp, Sorghum bicolor
  Clone ID: SORBI-28MAY03-CLUS16117_1
ctcctctcctccccttccacctctcgatcgagaagctagcagctagcgagaagatggcggccaccctcaggctcaggatcctcgccgcggctgccaccgccgccgccgtggcctcgtcgctcgtcggcgtcgccaccgcgtccgaggcggcgccggctcccggccccgccagccccagcaccgccgccgccgccgccgtgaccgccccggcgctcgctgctttcgccgtggccgccgttgggtacctcttcagctgagctgggttgccgctgcgcgcgtcgtcgtctccggctgctggccgcagccgcagccgcgcgcgcgttgccgccccccccggagtcctggacccggatcggagtgatacatacatatatatcagttcagttcatcgcttcttttacttgattgttgttgccagtattttcgtgttgggtgtgttttgatcggctgacgtacgcgagtcgcccggttgggagtgtgtgcatcttggattcttggttcatgtactctccattgatcgacctgtttacacagctatatatataatgccagtg

SEQ ID NO: 5560 - DNA, 1185 bp, Sorghum bicolor
  Clone ID: SORBI-28MAY03-CLUS16146_1
gcacgaggccatctccggcgacgatcgccggcgcccccctcctccgaacgccgcggctgccgtgcgcgcgataggtgacggacggcagctgctatgtgttcttcatacaccgcacactcagtggaggaggatatatatactgtagtatatagctagagtaatattagttggtaagcatggatcgattggacatgatggacaacatcaactgccgtcgggtgatgacgaacaagccacgcatcgaagctcaatcctcttcgtcggtcgacagagacagggagaaggaggaggacgaagcacaacaggacgaagtggccgaggcgatgaaggcacccctgctgggttggaatcacaatcaccacgaagcggctggcggcattggcaacaacaggaggcggcttctgtcaaagcagctgtcaatgaaggagactaccagggaggccaaatgggagaagcgccggcggcagatactgcggcgtagcagcatggtatcgctaaatgacggaggaagcggtagcagcaagagcatcatcgacgaacggcattattgtcatcatgttatgaggtcttcgtcggagtgcgtaatgaggcgcctgactgacgaggaccttgacgagctgcggggctccttcgagcttggatttggattcgacgaggacaccggcggaacacacctgcgtgacacgctgcccgccctcgaattctacttcgctgtgaaccggcagctgtcggaccgcaagctgcggacgctggcagcggcgagccccacgtcgactttatcggccgtgtcttcgtcgtccacgctccctgacatcccgagcccacgcagccccaacgccggtgcaaccgccaatggcggcgccgactcatggaagatttttaccccaggtgacaaccctcagcttgtgaagacgaggctgaggcactgggcgcaggtggtggcttgctccatcaagcacggctgataagacagacaattagcaattcgtctgatcgtaaatcctcatctcgcgtcaaggatgtcctgtcgtcgaccaatatgtataggtgcgtggccatgttaaaatgaactcttgcagcaaccaaatatgatgtaaacgcgtgatcgccatgctgttgtctgtcattcctcatgtacacagaagaagcttagtgcgtaacatgaactaatggtgcactgactct

SEQ ID NO: 5561 - DNA, 663 bp, Sorghum bicolor
  Clone ID: SORBI-28MAY03-CLUS16160_1
ttttttttgcccccctccctcctccccacctctcgttctcttctccctcctccgcctgccccccctctcacgagcgcgcgcgcccgcccagatctagggttccatccgcggcaagatgagcagtccccatggcggcctcgacgaccagatcgagcggctcatgcagtgcaagccgctcgctgagcccgaggtcagagctctgtgtgagaaggcaaaggagattctgatggaggaaagcaatgttcagcctgtaaagagtcctgttactatatgcggtgatattcatggacaatttcacgatcttgctgaactcttccgaattggtggaaagtgtccagatacgaactacctgtttatgggagattatgttgaccgtggttactactctgtcgaaactgtcacacttttggtggctttaaaagttcgatatcctcagaggatcaccattctcagaggaaaccatgaaagccgacagattactcaagtttatggattctatgatgaatgcttaaggaagtatggaaacgcaaatgtctggaaaacctttacagatctatttgattacttccccttgactgcattggtcgagtcagaaatattttgcttgcatggtggattatcgccatccattgagaccctcgacaacatccgcaacttcgatcg

SEQ ID NO: 5562 - DNA, 767 bp, Sorghum bicolor
  unsure (1)..(767): unsure at all n locations
  Clone ID: SORBI-28MAY03-CLUS16137_1
gccggccgggccgggaacaagaaaccagaaatcccccaccgcttgttccattcaccgccggtgccccctccctcccccgacggccttcatctgctaccgtgccgacggatgccgcggatccattggggaggcagcggtcagtggcacgtggtggcttccccgtcctccctccaacgtcatcctcatcctcccctccgtcgtcgcggatccatcgaggaggcagcggatggtgatgcgtggtgagaaagacatctgaccccctttaggcaatgtctgcttgacttcattatatttgaggacggccaataggtgttctgcatcaactgcaattggattaaccgaccaaattaggggagggcaaggggattacctcggggatttgtcatcagcccagatccaggcgccccactgcgtcaggagagagttagggttcgtgggggcggagaggagaggagagagagctcgtggtggggaggaattttggagatggacaaccaggaagagaggggccgcatgacttaactggccaaaccacggcgcatagttgactaacgccgatgtctgggcatcaacatgaactattcccatgcctagaccagcaggacctagtgccacggttaattcaacggtcgcaatcaacggtgatgtggcctaacctcgacgtcaactgacacaatgtcgtgtcccatatcttggcgtcatctgttgtgaaaggatgtctcctctgaagagacacctcttcattatctaaatcgngatctcatctg

SEQ ID NO: 5563 - DNA, 375 bp, Sorghum bicolor
  Clone ID: LIB5048-010-R1-XP1-B3
ccgggaacaagaaaccagaaatcccccaccgcttgttccattcaccgccggtgccccctccctcccccgacggccttcatctgctaccgtgccgacggatgccgcggatccattggggaggcagcggtcagtggcacgtggtggcttccccgtcctccctccaacgtcatcctcatcctcccctccgtcgtcgcggatccatcgaggaggcagcggatggtgatgcgtgatttattggtcgcttgagcatccatcataaatagaactaaagaggtatctgtcaggtgtctgagatggactagtgcttgatagtcttcatgcaatggcatgtaattgttgccttttcctctttttttatatagagcaacttactag

SEQ ID NO: 5564 - DNA, 891 bp, Sorghum bicolor
  Clone ID: SORBI-28MAY03-CLUS16170_1
gcacgagggtccttcagagtcaagctcgtccatgcctaggggtacaagaaaccaaaatgttgtccagagatctcgttttggtctcactggagagagccccaggctacacatagacatatctgaacctgatgaagcttccaatcatcaagatgccagtcatagacctgctgccattgctggagaacaggaagaaaacaactacaatgaaggcccaaatttgacattggaagctcatgaggttgagatgaatggcccttcagagtcaagtgacgtgtcaagcttaaaccaattgttgtgtccactgtgcagagggggcgttagtggctggaagataatcaaagaagctagacagtatttggatgagaaatccagagcttgctcacgagaagcctgcacgttttctggtaactacagggagatccgtagacatgccagaagggtgcaccccacaacaaggcctgctgatgttgatccatcaagacgccgtgcgtggcaccacctggagcatcagcgtgaatatgctgacatagtaagcgcaatcaggtctgctatgcctggggcagttgtgcttggtgattatgctattgaaggtggtgaaatgttttcacatgaccgggaagcacgtggcccaagtgaaccaagtgggtctcttctgacaacattctttctatttcatatgctcagcagtagtccgattagatcaggtgatgagccaagaggcgcatcaaggggcctgagaaggcagagaagacgctatctgtggggagagaatttgttaggtctccaatatgatgatgataatgataatgatgatgatgatgatgatgagggggaggacgaaggggatgctgtggatgaagaagttcagagaccaaggagtcgccggaggtt

SEQ ID NO: 5565 - DNA, 1098 bp, Sorghum bicolor
  Clone ID: SORBI-28MAY03-CLUS16972_1
gccggccgggccggggcgggtcacattcacaatctttgtgagttgcgacggcggccggcggcgacccctccaactcccaccttggtatcgccgctgctgcgccgttatcaccgtcgcagccatgagacctctccttacccgcctcttcacctccactcacattgccatggcctcctcttccttctcttcctctccgtctcggcggttggcccatctcacacgccatctcgcctcctcttcttccggcgagctctcctcagtgggcgcccctgccgcggccgccgcagatgccgtccccgcaaaaaccccacgctcggccccctccaaggtccacgccgcggtgctggtctgcctcttcgaggaccctagcagcgggccacgggtcctgcttacaaagcgcgcttcctccctctcctcccactccggggaggtgtcgttacccggagggaaggtggaggatggggacgcagatccgaaggccacagctctacgggaggcgaaggaggagattggactggacccggcccttgttaatgttgtcacagttcttgagcctttcttatcaaagaacggcctcaacgttgttcctgtaattggcatgatctcagataaagccctattcaagcctgtcttaaataaagctgaagtggaggacatctttgatgcacctctggagatgtttctaaaggacgaccaccggagaacaaaacaaatgagttggatgggcatagatatccctgtccagtttttcgactacgaggcagatggcaaaaggtttgtgatttggggcttaactgcacacatcgtgacgcgtgcggcggcagtcatttttgggaggaaaccatcatttgacgaacttcccagacccaaatatgcaagtgcacctgttgctggcactaacgagtcaaaaccctgatgcagcataatctggatgtaaggggctgttttggttcggatcttggtgcgtgaaccttgtttggttgtagaattatgtttcccactaagtgatagctggggaaggtacctagatttgcttggtatatttatctacagaatatagatagatgtaaaatgtattttgagtatagcacagcaaat

SEQ ID NO: 5566 - DNA, 769 bp, Sorghum bicolor
  Clone ID: SORBI-28MAY03-CLUS17054_1
gccggccgggccgggacccagactcaatcaaatctgcattgtccctgctccaaagcttcagcttcaagcattagcaacctccatcaccaccacctccttctccttctcctcacctggagtagtagcaagcagcaacacatcacagcagagctgagcggagcggagtagagtagagtagggagctgggcaggggagccccaaccgccagacccgccgcggccatgcgtttcacggcggcgctgctcctcggcgtggccgcgctgctctgcctcggcggtggcggccgtgcggcggcgtccacggacttcaacttcccggcggtgttcaacttcggggactccaactccgacaccggcggccgcgtggccgccggcttcgaggccatcttcccgccctacggctccaccttcttcggcggtcccgccggccgcttctgcgacggccgcctcatcatcgacttcctcatggaggcaatagatatgccactcctcaatgcgtatttggattctcttggtacaccaagctttcggaccggtgttaattttgctcaagctggatgttcaatcacaccagcaaagccaacatcagtcagcccattttcatttggtctccagattaagcaattctttgccttcaaggataaagttactaagctcctggtctaaggagatatgtaccggaaatatatttcctcaggaagattacctttccaaagggactctacatgtttgatattgggcaaaaatgatctttgctggtcaattctatt

SEQ ID NO: 5567 - DNA, 702 bp, Sorghum bicolor
  Clone ID: SORBI-28MAY03-CLUS17086_1
tgcgccgctcgagcatttcatggccattctcccctctgccggctgcggctatatacctctctctccctctccgtccccttctgttcttccacgtttctccagagcctgaaccaaatctaggggcttccttcatctgctgtccgagggttgtttgattttaattttaggggtagtgcggtctaatgaattccgccgaaatttgccgcggcagttcttgcctaggtgtgtagttgtcttctgatccttgggggttttcttggttcttgagttgtgatcttcttcagcctggttaagatatcgaaaggggaattttttttatgttcctcgagggaggaaccacggagacgtaattgttgcatctgttaaagttcgagtgaaatacaagcaaatccttggtatttgcatccctttgccggttcttttctgattcgaaagaaccccaatgggggatgtgtcgttgaatcgacccattaaagccgagccaactgccaagggcaatcgagttctggacacgatgtccgccgggtggacagacgagaggcacatgatgtatataagctctatggaggcttcttttgtcgatcaactatacaatcacggaaaccatccgcacaatgcaaatggcactggcttcaaggttctccgcaggggtgtgtgggagtacatcaagtatgagaagactaataatgctcctgtgcgaag

SEQ ID NO: 5568 - DNA, 899 bp, Sorghum bicolor
  Clone ID: SORBI-28MAY03-CLUS17161_1
gcacgagggacagcgccaccaggaagcgcaatatccatggagtcctgaacgccgtgagctggggcgtgctgctgcccagcggggcgggccgggccaggtacctcaagacgttccaggcggcagacccggcgtggttctacctccacgtcacgtgccagctgatgggctacgccgtcggcgtctccggctgggccaccggcatccaactcggcaaggagtccaagggcgtcacctacaccgatcaccgcaacatcggcatcgcagtctttgctctcggcacccttcaagttctggcgctgttcctgcggccgaagaaggagcacaagtaccgggtgtactggaacatgtaccaccactcggtggggtacaccgtcatcgtgctgggcatcgtcaacatcttcaaggacatgaacatcctgggcgtggagcagcggtggcggacagcctacatcgccgccgtctgcgtgctgctcatcgccgccgccgcgctggaggccgtcacgtggggcgtcgtcctcaggcgccgcaaggccgagagcaagaccttcaacagcgcatccagcggccacctgccacattccgtgtgactgtgtgagcgtgcaatgtgcatgagaagaaaaaaaaaagttttgttttctggggtccctctagctctggctctggctcgcatgtatgtatgtatttatcggcatactatcgctagtggcgtatgtgactacgggcagacgatagtaggtttagagttttttggggttttgcattggcctgccggctgttgtatgtccgttttggacggttttctgtaactctgcatacgtcgcgctggagtctgagctgtagcgatcatgtagtactgtatgttggcattttgtttatgtatgtattcctttttagtgctg

SEQ ID NO: 5569 - DNA, 760 bp, Sorghum bicolor
  Clone ID: SORBI-28MAY03-CLUS1719_1
gtttgtggttttggccaatccttcccctccctctcatcccgggccccgggtgaaaattttgccccacaaactctagcgcgtcggatcacaagcaagggcaaaattttctgtgactccggctgaaggaccctgcgacacccaaaactatgtcggtggcgaaggacgacactggccgcactatacccaagttcggcgaatgggacgtcaacaacccggcctctgtcgacgggttcacggttatcttcagcaaagccagggatgagaagaaagccccgacgaccaaaccacaaccaggccacatcacccaaaggtcggcgtcggctgacagcaaggactccaggaccgacaagatgacctcctacaactccaggaccaacgcatcgaagaaatggttctgctgtgtctcgcccagtcctacacaatcttgaggaagcaaaagaggaacgcaatgctgcagtctggtgctattctgtgatggttatgtgtagctctgtcgctggcagactggccatgagtgacctcttcgaactcgatcctactacttgccagtgacaggggcactatgtatagccgttgcaaaatgagaaaattactctgatgggtgtctgcttatagctccttagctctgtataccatcagttcaagttgatgtctgcttgtaaggttctttttctcgccccttctctatgtggtgtaacccttcctcaacgttatcagtgaatccgagttactccccaaaaaaaaaaaaaaaaaaggggcg

SEQ ID NO: 5570 - DNA, 789 bp, Sorghum bicolor
  unsure (1)..(789): unsure at all n locations
  Clone ID: SORBI-28MAY03-CLUS17208_1
gccggccgggccgggaagcacacacaagtccatcctacacaagcaacaagcacagcgcgtgcgcagcaccaaaccaagagaccaagcgcgatggccggtggctccaggagcagcaggacgccagctgctccccactccctcgtcctcctagcgctggtgacgctcaccaccgccggcaagggcagcgcggccacgttccaggtcaccaacctctgccccttcacggtgtggccggcagccatccctgtgggcggcggcactcagctggagcccggccagacatggctcctcaaggtgccggcggagacgacgggtggcagggtctgggggcgcactggctgccgcttcgcccccagtggccacgggtggtgcgccaccggcgactgcgcgggcgccctccgctgccagctctccggcaagcccccggcgacgctggccgagttcaccatcggcgccggcgcggcagactactacgacctctctgtggtcgacggcttcaacctgcccatggacttgaggtgcgacggcgaggcccacacgatccggtgcaggaacgccggctgccccgacgccaaccaccgccccggcgagggcaaggttcgcagctgcaaggccgacagcgactaccacgtcatcttctgcccaaagtagcttggcgtcaagcctcacctcacttctgtcttagagagtgacatgcgttgtcagtatctatctaccgcttcatttgattctgcggataaaataaaaatgaatccgatcttccaaaaaaaaaaaaaaaaagggccctan

SEQ ID NO: 5571 - DNA, 720 bp, Sorghum bicolor
  Clone ID: SORBI-28MAY03-CLUS16312_1
cgcagacgcacggcgccgtctcggcgggcaactccccgcgcgccaacccgcccaccgtgttcgggttcgggatgcagcgcgtccggagctcgcccaacctcagcaccctggacgcggcggcgcagcgcctgcaccagcacggcgtcgacggcagcataccgggctacgtgagcggacgcgtgaggcacgcaggcgcggggccggggccggggcccatgctgttgcagaacaacttccaccactaccagcagtacccgccggcgcccgtgcccgtgcccgttcccgtgcagcaccacggcggcgggcggtacgacgcgcgcgggtacgtcagggttgggaactacatggcgccgatggtgcccgctaccaggccgctctcgaggggtggaccgccgccgccgcacagcgagatggtgacgcccaagaagtctgcgattgtatgggactgacccggccgccggggccggccgtacgccggagggagcctgttgtaatgaattttgctatcagtatacgaggggcagtgagttgagtgctatgagttcttgagattgagatgtgtaacgtgtaaatagacggtcggatgtatggatgcacgcggccttgttttagctgttgcgagtgtgtccacgctaatatgtttgtgcgtttttcactcgtcacaccagcatgttcgccggccgaaacagtaaagcatagactgtttaacacttgtgtctc

SEQ ID NO: 5572 - DNA, 1066 bp, Sorghum bicolor
  unsure (1)..(1066): unsure at all n locations
  Clone ID: SORBI-28MAY03-CLUS16329_1
cgctctctctccccccccctccgctgttcttccccccccccgccgtcgcggctccgccccgctgtccgccgcgcctcctcccccccccgccgcttctactagctgcgccgcgtggtggtggcttcgtgccgcccggccgccgtcctgcgccgcgtgcagctgctgttgttcttccctccgcgcagcgattcgtcggtggcaggcactcgccccgtccgctcccccggctcggccgccaggccgctgctcccctccctcgcgcgtggcttgcccggcgcagcccgttgtcccgctgccgtgggaccgtgggggagacggccgccgcaccggcgggccgtcgccccgcggcacctcgcccggcctcgcatcccaacgcgggccccgccctcccgtgccggcccatggcgcccaggtgctgccccccgccgcgcgtccgccccctcgtgctgccggccccttccttggccctgctgagcctcctcgccgcctgcctccggccctcccccccctgcgcgcctccccgcgacgcgacggccgtcccctcggtcgtccggtcgccacacgtcttccacctcgtcgctcgtcggcgaggcggggagcggcgccacctcttccttgaatcgtacgtgtgccgcctcgccttcgtctcgtcgtctggcaactattcatcagaaggtactcggccgatccgatccaccggatcggccgccaaaccgcatatctccacggtggtgcaagggaaagccggggcagcacctaggaatacgtcgcaacacaacgcagtttgctacaatgccaggccgcggcaaaccaagagggcccaatgcgccgaggagcagcgggccgccgaaggtcctccccgtcgacgtgccggccatttccatgggcgagctgaacaacatcacggggagcttcgggccgaatgccctgatcggggaaggctcctacggcaaaatctaccgcgccgtgctgacctncggggagcccgtcgccatcaagaagctcgatcccagcgtgtccagcgactctctggctgacttctctgctcagctgtcgatggtctcga

SEQ ID NO: 5573 - DNA, 1103 bp, Sorghum bicolor
  Clone ID: SORBI-28MAY03-CLUS16370_1
gcacgaggcaaccaggcttgcgcagagtatgctaagaagaagatgtctaccccagaattcaaactagataaaaatgcccctaatgtcagctgggcagatactaagaatggcggtgaatctgcctctacttcacaggttaaatcactatatatcccacgcgtccgcaagactgttactcaagagcaactgaaaaggctatttgagcaccttggagaagttacaaaagttgttattcctcctgcaaaagctggtcatgaaaatcgatatggttttgttcacttcaaagaacgatccatggctatgaaggctctaaaggacactgagagatacgaacttgatggtcatctgctggattgttcacttgcaaaacctcttgctgaaaagaaggatgatacgacatcagtacctaaaggaggtccattgctcccaagttataccccacttggatatggactgatgggagcttataatccacttggaaatggcctggcgggcgcttacaatccacatggaaatggagtggcaggtgcttatggtgtgcttggtgctcaagccgcacagccaatgttgtatgttccaggtgctcctctaggttcaactatgattccaatggttctaccagatggtcgtcttgtatacttaccacagcctgcagggcagcagactgtgcctatgacttcgcctccgccacagaaaggtggtcgtcataatggtggtagcactggtggtggatccagctctggtggaaggcgacagaggggagatgacagtggtagtagtaacagcagccgtaggggtcggtaccgtccctattgatgtttgcagtgtctctgttagcgcttagaagttagaacctagtaggcatttagagtatctcagctgcagtacaaccatgcaaagctaccaactaatgctggaaaccgtactttctagtagttattttcgctgcgcgtctcgtgtctgtaacacaagctgctgttgtgagaataatgacagtgcaaagtggcagatgtaatctgggatgcagtggtaatgtacctgctgttgtaagaataatgtatctgccaactgaaacattgctgcgcaagaggatctcgggactc

SEQ ID NO: 5574 - DNA, 1550 bp, Sorghum bicolor
  Clone ID: SORBI-28MAY03-CLUS16502_1
gcacgaggcatcagttggaattgagaagttatcaatgcaggcaaacaaacttatgcccttggaagatgttaatggtaaaatgatgcagcagattgcttgggaagctgctccagctctggagtctggcgaaagatatgatgcattggactatcatagcatcgatgctttggtaggagggggtggaaatgctccctctggtaagaagaagaagggcaggtgtgctgaactttcatccttgggtggggagaatgcttcagaatatgtttcacttgaggaccttgcaccattagctatggaaaagattgaagctctttccattgagggtttgaggatacaatctggcatgtcagaagaagatgcaccctccaatatcagtgcaaagcctattggggaattttcatctctgcaaggaaaatgtgcagagagtaccttgtctcttggtttagagggaactgctggtttgcagcttctggatgttaagcaaagtggagaagaagttgatggattaatgggcttgtcaatcactctggatgagtggatgaggcttgattctggggtagtggacgaagaagaacagtacagtgaccggacatcgaagatacttgctgctcaccatgcaaaatccatggagttagttgccgaaaaccggaatggagacagaaagagtaggagatctggtagaagatggggcttgttagggaataactttacagtagctctcatggttcaactgcgtgacccactacgcaactacgagccagtgggcacaccaatgcttgcattaatccaagttgaaagggtttttgtacccccaaagcccaaaatctacagtactgtcttagacaaacccaacagcgagcaggatgatgaggaacccaaaaccgaagaggttccagataaggcattggtcacggaagagaaggctgaggagttagaggatcccattccccaattcaaggttacagaagtgcatgtcgctggtttcaagagcgaacctgagaagacgaaaccatggggcaatcaaacgcagcagcagtctggctctagatggttgcttgcagctggcatgggcaagggaaacaagcatcctctgatgaaatccaaagctatcgtgaagccaaccaaagaggcagctggtcaggcaggagacaccctctggagcatttcttcacgtgttcatggagcagggaccaggtggggcgagctaacaggaaacaagaatcattcacgtaacccaaatatcgtgcttcaaaaggacaagagatttcggtgatggcttggcgattcagtagctagtgccagggaggtttgtctatctcattagaagggagcttacttatctgcaattggacctcgctgggaatgttcctagtggattgtgaaatcatgtacattgagttctcttgcataggatcagtttgtgtttggtgttccttccgaactgtcatgagaaccgtacagagaaactggcgtttctcttgtcacaattagagcggcttctgcctctgaaggtgcaacgctttttcctttgcaggctgccatagccatca

SEQ ID NO: 5575 - DNA, 668 bp, Sorghum bicolor
  Clone ID: SORBI-28MAY03-CLUS16503_1
gcacgaggcttggctgcttctacatccacatcaagcgcatcaagcccaagcccaagtcgcttgcattgcctgatgcggaggacccggatgccgggtactaccccatggtacttgtccagataccaatgtgcaacgagaaggaggtgtatcaacaatcaattgcggccgtgtgcaaccttgactggccgaaatccaacttcttggttcaggtgttggatgactccgcccacgcgtccgcacagactctgattagagaagaggtggccaaatggcaacagcaaggtgcccggattgtgtacaggcaccgtgtgttaagggatggttacaaggctggaaacctcaagtcagccatgagctgcagctatgtgaaggattacgaatttgttgccatctttgacgcagacttccaacctcatcctgactttctgaagcgcactgtgccacatttcaaggacaatgatgaacttgggctagtgcaagcaagatggtcctttgtgaataaggatgagaacctgctgactcggttgcagtatattaatctgtgcttccactttgaggtggaacagcaggtgaatggagtgttcttaaacttctttgggttcaatggcactgctggggtgtggaggatcaaggcattggaagactcaagtggatggatggaacggaca

SEQ ID NO: 5576 - DNA, 770 bp, Sorghum bicolor
  Clone ID: SORBI-28MAY03-CLUS17451_1
gccggccgggccgggtttggcaacgccatccagagcgctgtaacgctggcgacggtgtcggagctggctcgcagcgatcttaggtgggcggcgggcaagctgaatgagagcctcgcggcgtacggcgacggcactatccggcgcgcggcggcggcgtggcaggccgcgccccggtgcttcccgctgggcaaccccgacggcgcggtgatcacgatggggagctcgaaccggttcccgatgtacgagggcaacgacttcgggtggggacggcccctcgccgtacggagcgggcgcgccaacaagttcgacggcaagatgtcggcgttcccgggacgcgccggggacggcagcgtggacatcgaggtgtgcctgccaccggagaccatggcggcgctgctccgcgacgccgagttcatgcagtacgtgtcgtgcccgtcgcatctgttgtgatgtactgtaccggtcccgtgcgtgcgggcgcgagtggggcccatcggccgtcgtgacatgccgtcgggcggcgtcagcgctgctgtttggattgctcggtcgtccttgcctttcgcgagtactactagcttagctggtaccaagacattgtatctgtctcgctttttcggagtgctgcgtgtaatcgtgttagttagcaactacttgtagtacttggaatttggaaatgactcttatgctgcagcctgcaagcgatgcaacagcggggacaatatgaaccgtgtagcaagagttagaaacaagtttctcaaaatgttggc

SEQ ID NO: 5577 - DNA, 826 bp, Sorghum bicolor
  Clone ID: SORBI-28MAY03-CLUS17439_1
gcggccgctcgaggccggccgggccgggattccgattcctccctccccgcctcccctctcgccgtaggggggccggcccgggtggggctagggttcgtcgcgtcacccgccggcctcctccgacgcggcaccgaccgaccccccgtgccgcgtaccgggcccggccggatgctatgctgctgacctgcaggtccctctccacctgggtgcgccgcctcgtcgcttgcatgggaggttgctttggatgctgtgctaagccaactccaataacagcagtagacgagccttccaaacggttgaggatccaggggcgctcggtgaggaaggctagcctgtcggaggacttttggagcacaagtgctcgtgagatggagaacagcgggatccaatcgcagaggagcatatcttcgatcagcacggtggctcagtccagcgatcagcatgcagcaggaagtagcagcaacccgaatgagtttgtgaatcaaggtcttatgctctggaaccagaccagacaacagtgggttggaagcaaaaaacgccactctagatctcaacagcctcgagaaccaaaattaagttggaacacaacgtatgagactttgataggaagcaataagccattcgcccagtcgatacctcttggtgaaatggtagatttgcttgtggacgcttgggatcaagaaggcctttatgattaggcctgtggagtccattgtttgactcagattagcgttacatttcctgagcccaatggtgtaccctgaatatcatatcatgaaacatgggatcgtccttatgttaagcaattgtaatatattgttgcccg

SEQ ID NO: 5578 - DNA, 789 bp, Sorghum bicolor
  Clone ID: SORBI-28MAY03-CLUS17465_1
gccggccgggccgggtacgcatctctttccttccttccttctccgtccgtcagagacgagcggcatccgcatcggcgtctgtccgtccctcggaagttgtcgcgggtaatcccgccatggaggaggccaaggttgtggagtccaaggatggaacgatctccgttgcttcagcatttgctggtcatcaggaagctgtacaagacagggatcataaatttttatcaaaagcagttgaggaagcataccgaggagttgactgcggtgacgggggaccatttggtgcagttgttgtccacaatgatgaagtaatagccagttgccataacatggttttgaagaacaccgatccaactgcgcacgctgaagtaactgcgataagagaggcttgcaaaaagcttgggaaaattgagctgtcggattgtgaaatttatgcatcctgtgagccatgcccaatgtgttttggtgctgttcatctatcccggattaagaggctggtgtatggagccaaggcagaagctgcaattgccattggatttgacgatttcattgctgatgctctcagaggaactgggttctaccagaaggccaacatggagataaagcaggcagatggaaatggagccatgatttgctgaacagtatttgagaagactaaagagaagttccaaatgtattgatccatggaaatacttggtgggatgatttaacattgtgatagccctctgattctcaaaaagaataacacaacctctggtgttatgttatttgtaaagggccacaaaattgtag

SEQ ID NO: 5579 - DNA, 1166 bp, Sorghum bicolor
  Clone ID: SORBI-28MAY03-CLUS17472_1
gcacgagggctcaacggaccacgacgcgtcccgtcccccaacccagcaccaggcgccggccgggccggggcggagggtgcaaaactgcaaatccctgcgatccccacgccaatcggagcagcgagccgtcgccgatcaattcaccaccggacccaatcctaaaccagtaaaccggcgccggcaaatcaaatccttctccgcaaggcgagagcgagagcgcgacgatgtccggagcgacggactaccaggagatggcggcgtcggtgccgccctcgctgaaggccatcacgctgacgcacgtccgctaccgccggggcgacccgctgggtctcttcctcgcgtgggtctccctcgtcccggttttcatcagcctcggcggtttcgtctcccacttcctcttccgtcgggagctccagggcctctgcttcgccgcggggctcctcgtctctcaggtcctcaatgagatcatcaagcactccgtcgcgcagtcccgcccggcgtactgcgagctgctcgaggcctgcgactcccatggttggccttccagccactcgcagtacgtgttcttctttgccacctacctgtcgctcctctccctccgccgctcgcgcgcgcgccaggtgatggccgccttgccatggccgcttgccttcctcaccatgctgtccagggtctacctaggctaccataccgtcgcgcaggttttcgcgggagcagtagtgggcctcgtgtttggtgctatctggtactggattgtcaataccatgcttgttaattacttcccaatgattgaagagagtgcaattggaaggtggctgtacatcaaggatacatctcatattccagatgtgctaaaatttgagtatgataacgcaagggcagcaaggaagaaagtttctactgattgagcttgttatgcttctggattgcattttgctgttgttaagacgattataagaatgtgtggcatgatatttccttcatctatgctacaaacgggaacatgtagcagtaacattcagaagaagaaatgctcactagagcttgttggatttagctcttcctgggcatatgccatatgccacactattttttccccttattggtcactagtcacacatattattttattaaaggttgttcgattataacttgataattgctga

SEQ ID NO: 5580 - DNA, 844 bp, Sorghum bicolor
  Clone ID: SORBI-28MAY03-CLUS17558_1
gccggccgggcccggcttttcccctcccgcaagccgcaaaggcctccagaagcagccaggcgggcggcgcggcgcgatggaggagcaggtggtgacggagcggatccggcggaagctggaggaggtcaacgccaccgtgcagcagcacctcgccggcgtccaggaccacgtcaacttcaccatgcagcaagcatacttcaagtgcgcgcatgattgctttgatcggcgtcgtactcaggaagggatcaacagctgtgtggagaattgtagtgtgcctgtccttaccgccaacaatgttgttgagaatgagatggccaagtttcaggaacggttgaatcggtcattgatggtctgtcaagacaagtatgaagcagccaagctccagaagttgaaaacagatgcaactcaggaactggaatcctgtgtcaacagatctatcgatgacagcatcagggtgctcccacatgtggtggagcagatcaagtccgccctcagtatcaattagaggcactattgcttttagcatatggaatcagatatagttgagaatgtctcatactcacatttgcggcctaagtccacatttttcagtggaaaaatcctaagctagaactatgcagagctcttaccgatatcgatataacgtgatcaaatcagtgtaccgtattactctcctggcttgtcagcatcatcgacattctgaattgtgctgagcttacagcttaggcattgaaatagtacaaggctagatgaacttgttctgctgcatgaaaaaagaactcttacgcctcacgatttttcatgttgcttctgttgcaatataaaaaaaaaaaaaaaaggccct

SEQ ID NO: 5581 - DNA, 750 bp, Sorghum bicolor
  Clone ID: SORBI-28MAY03-CLUS17738_1
gccggccgggccgggaaacagcaaacaggccccggtcccggcctcaagaggccctctcccagcatcagccgccgcgcgctgccctcgtcccgatctccgacccaaatacccgatccgccatggccggaataaggcttacgcccgaggagcccgagatgcccgttggcacgccaccccgcccccagctcccaccctccgtcgccggggcaggcggtggcagcggagggctggaaatggcgtcggacgacgagcggtccattgcggcggactcatggtcagtgcggagcgagtacgggagcacgctcgacgacgaccagcgctacgccgacgccgccgaggtgctcgccgcttccgcggcctccgccaacttcccctccgccgcctccgattactgctctgataaggatgatgaagatcctggtgatgttgaaggatcaatgctgggtctccaaagttattgggatgcttcttatttggaagatcttgcaaattttcaggaacatgggcatactggagaaatatggtttggtgcagatgtaatggacacagttgctgtttggacgaaaagtttgtgtagtattattgaaggcaggattccatctggtcaagacagcatcgaaagtgaagtagatgaaaatttattctccaactaccctgttcttgatgttggaactggaaatggccttcttttgcaagcacttgctaagcaggggtttacagacttaaccggaacagattacagtaaaggag

SEQ ID NO: 5582 - DNA, 692 bp, Sorghum bicolor
  Clone ID: SORBI-28MAY03-CLUS1669_1
aatttctgcgtccgcccgcgctctgggtgaccgtgagactcggtaactaaaccactcggcactcaccggccgcgaccagcagctcaactatctatccccttcgtctcccaggagtcgagcgagaatggccgccgccgccgcccttcgtcctgctctctcccaagggccagagcagagagcttccctgctgtgcacaccgaagcacagagtttctgccagtgccagcaggagaagcttgagattcgccgctagggccagctcgaatccgggcgcccaggtgagcatcccgaagcaatggtacaacctcatcgccgacctgccggtgaagccgccaccgccgctgcacccgcagacacaccagcctctgaatcccagcgacctctcccctctcttccccgacgagctgatcaggcaggaggtcaccgacgagcgcttcgttgacattcccgaggaggtcatcgacgtctacaagctctggcgcccgacgcccctgatcagggccaggaggctggagaagctgctgggcacgccggcgaagatctactacaagtacgaggggacgagcccggcggggtcgcacaagcccaacaccgccgtgccgcaggcgtggtacaacgccgcggcaggggtgaagaacgtggtcaccgagaccggcgccggccagtggggcagcgcgctgtccttcgccagca

SEQ ID NO: 5583 - DNA, 917 bp, Sorghum bicolor
  Clone ID: SORBI-28MAY03-CLUS16702_1
accctgctgcgctcggcactctctctctagactgcgcggccgccgccgccgccgtctgacgcgcacggccctgcgcccgccgcgcccccgtcgccgggccggccgcgggcgccctgcccctgcgcccccggcgcgcccccagggtttgtgcatcaagaatactttctgtcaaggagttcacttgaggaatgcaagaattaggataggccaattagaattgtgtttttttggttggcgtatcctgagtttcctctgataaggatcctgtctcaacacctgggtcaattttaccaaacattttttgccgccagctgccttaactacatactacaaaggtcaaggagatttgtcttcggtggactgcttctaccttgagttcacactttttgcagccagctgcccatggcaaccacaaaagcaaatgctaatgctgattattggaatgcaagttcttctaggcagggaggccaaacttcaagaggtagtggtcctcaaaatgtctgcgtaactaatatgcaagcagcgctatcatcatcctcatcaggccatggaaccaaatcatacagccactctgtggaccactcttcgtcacataagtctgaatcagaacgctcgatgggagcaactgataacctggattctcttgtagcagattcaataggcaggcttgccttcgaggctggtgttgagcctgattttgttcacttgccgtcttttaatggcgtgattgatttgctcacccgtggggttcggattgcaatgccttcttatgaatatattctgcaagtgcaactgaatgaagttcaaaagcgtgaaaaggctatgaggcaacactgggagagaagaggctgcagtttgatattggatagctggaaaagccggtgtgggagaagcttcattagtgcttttgtgcattg

SEQ ID NO: 5584 - DNA, 699 bp, Sorghum bicolor
  Clone ID: SORBI-28MAY03-CLUS16732_1
ggtgcttcggcgactgccaagatcagtgtggatgcctctcttgcccgtggcattgggggtaagggtggggtcaacagtgggcagataagtggggttacaggcgtcaagctctccatccgcgaccacgagtctaaccccagccagaagaacattgagcttgaaggcaattttgaccagatcaagcaagccagtgacatggtgagggacctcattgcgaccatcagcgcaagcatgccggcgaaaaacctatctgcttccgctgctccagcaggaggccgaggcggtggtcttgggggcaggagcaactacaagacgaagctgtgcgagaacttcgtgaagggtgcctgcactttcggcgaccggtgccactttgcccatggcgagaccgagcagcggagaggtgctgcgtgagagttgaggtgctctaggcatgagagatgccctgtgctctctccatttgctactgtgaatttttctccttgcagcgttaggcggttcgactgttgtattgcgatttcagtcgattaaactctagatttcagcttttcttttatgatataagtttgcgaaaacgttattctgtcactcatgcccctgaatgttatgacttatggcaacttgcattttgttggtcaaaaaaaaaaaaaaaaaaaaaaggcggccgccctttttttttttttttttgagacggaatccctt

SEQ ID NO: 5585 - DNA, 857 bp, Sorghum bicolor
  Clone ID: SORBI-28MAY03-CLUS1674_1
cctactgggacttcagcttcagctgctgctgcgagcctgcgacctccgaggaggcggagcaatggagttatccactcccatcgggagctcccttgctagaactgcggccatggccctcgtcagccccaacctcaaggttggtctgcagataaccaatcaaatgtgtgtgagggggatgcaacttcagtgccaattttctcatagactaccatctgtatcttgttcaatgttgttaaacacacaaccttcacaacgaaccaaccataaagattgtggtttgcttcaggtgcaatgtacacaaaaacctgatgcagtcgtcagtatctttcagtgacttctctgtttcagtgtgtactaaagaggatggtctgataaagctacaggtaaatgtatctggcacaatgacagattctatcttcgagaaagttttcacgaagaatgttgccgccgcacaaccccttcctggctttcgacgaatgaaaggcgggaaaactccagatattccaaaagaagtcgctctacacttaattggaccatcaaaagtgaagaaagaaaccatcaagaaaattataaatagcacggttgctgagtatgttcaaaaggagggcctgactgcatcgaagaatctgaaagttcagcagagctatgaagaacttgaagcagcatttgaaccagggaaagaattttgctttgacgcaacagttcatttacaataaggccttgtttagttcccaaaatttttcaagattccccgtcacatcgaatctcgtcacatcgaatcttgcggcacatgcatgaagcattaaatatggacgaaaacaaaaactaattacgcagtttacctgtaaatcacggga

SEQ ID NO: 5586 - DNA, 794 bp, Sorghum bicolor
  Clone ID: SORBI-28MAY03-CLUS16741_1
tcctggccgtcgtccaatccacgccgcagctgctgcgctggccatgcctggagccgttgcgcccgcgcccacgctcgcgccgacgaggagctccgcctacacgtccgccgccgcggcctccacgctgtctccgaacccgacaagccgaggcgacccgcttactctcagttcgtgccgcaacgctcctgctagtgctactccacttgtcccacttgcggccacccgtcgtcacgtgcgcggcttccgcggcgcgcctctagtcgccagtcccagtccccaccacgctcgaaaccctcgcctccgattcgcgtctgcggcggcggcagcggaggggatggctgcggaggcgagcacggcggatgcggcggcggcagccgaggcgaagcccttcgccgtcctcttcgtgtgcctcgggaacatttgccggagtcctgcagctgaagctgtgttccggacccttgtaagcaagcgtgggcttgactccaagtttctcatagactctgctggtaccatcgggtatcatgagggtaataaggcagactcaaggatgagagcagcttcaaagaagcgggggattgaggtcacctcaatatccaggcctatcagaccctcagactttcgtgattttgatcttatccttgcaatggacaggcagaactatgaagacatgttgaactcgtttgagagatggagacgtaaggagcccctccctgagaatgcacccgataaggttaagctgatgtgctcctactgcaaacgacatactgagtctgaagtcccagatccttattatg

SEQ ID NO: 5587 - DNA, 664 bp, Sorghum bicolor
  unsure (1)..(664): unsure at all n locations
  Clone ID: SORBI-28MAY03-CLUS17868_1
gccggccgggcttgcgtcgctgctgctgctgctgttgcctcccttcgcatctgcccccgcggcccacgcccgcagcgcctcgcctcggctcggctgctccacttctaccccgcgcctcccccgagatcggaatcgccgccctccctccgccatggcgccgtctctgctcggggggttcaccaagtcgctggccatgaccgtgctctccgagatcggggacaagaccttcttcgccgccgcgattctggctatgcgccatcccaggaaacttgtcctggcaggctgtttgtctgcactaatagtgatgacagctctatcagcttctctaggttgggctgcaccaaatctgatttcacgtaaatggactcaccatgtaactactctgttgttctttgtatttggcatttggtcattgtgggaaggcttcaaggaagatggagattcggaagaattggctgaagttgaagcagagctggatgctgcctttaagagtaatacaggtgaatctaaaaataaatctaaggcaaatgatgatacgaagaaacagcanagaccatttctcatgcagttcttctcaccatttttataaggcattttctattacattctttgntgagtggggtgacaagagccagaatgctactattggccttggctgctgatg

SEQ ID NO: 5588 - DNA, 1145 bp, Sorghum bicolor
  Clone ID: SORBI-28MAY03-CLUS17880_1
gccggccgggttcggtttctttccgacgcgggatttccttcgccgccgccgccgccgccgccagtgaccactgatcacctttgccggagcgtgtgaaccgtacggaatcgtcggcgtgagatggcggccacctccgcgttcgagtcatccccggagatggagcggttcctctgcgagcggctgttggacgcggagcagcccatcgcagagcgcttccgggcgctcttctccctccgcaacctccgcggggatgcgccgcgccgcgccctcctccaagctgcaagggatccttctaacttgcttgcccatgaggctgcatttgcacttggacaaatgcaggatgctgaggctattcctgcactggtggcagtgctcaaagatctttctctacatctaattgtccgccatgaggcagcagaagctcttggagctattggcctggaaaagagcatccccctgttggaggaaagtttaacaactgatcctgctgtggaggtacaagaaacttgcgagctggcgccaagacgaatagaagagcagaagaaagctaatggtgctgagagtacagtcgcttcaccctttctctcagttgatccagcgctgcctgcaaagcatggactttcagtagatcaattaagggatctactcctcaatgaacaagagagcatgtacgaacgttatgcagctctttttgcacttaggaatgatggtggagatgctgctgtttctgctattgttgcagctctgagcgtcaaaagtgctcttctacgtcacgaggttgcttatgtgttaggtcagctgcaaaacaaagccgcttcagatgcactttctacagtcctgaaggatgtctgtgagcatccaatggtcaggcatgaagctgctgaagcccttggctcaattgcagcccaagaaagcattgcgcttttggaggagtttgcaaaggatcctgagcccattgtctcgcagagctgtgaagtagctctcagtatgcttgagtatgagagatcggggaagtcctttgagtttctcttccttcagactcctcatgtgcagtcctaggttcctctgcatcgatgattactcactgctgaactgactgaaagcttcttggctaaaatgtgactgccccacccatatatccactg

SEQ ID NO: 5589 - DNA, 1085 bp, Sorghum bicolor
  Clone ID: SORBI-28MAY03-CLUS17883_1
ctgcgataaaaacaaaaagaggagagggccgggctgccggagcggaggggtgccgatcccgtcgccgccgctaccccctcctcaatcgcgagcaactccttccggattcgcaccgagctttcgacgattttgatgagattagaagcctaaaccatccgggcatcggtatgctgcggaaggccgtcgtcgccttcatcgcttgcgccgccctgtacctcgccttctccgcctactcccggcgccagagcattgcagaggttcaattaccagcagttactcacagggtctacctagatgtagaaattgatggccaacacataggtagaattattattggtctctatggggaggttgttccaaaaacagttgaaaactttagggccctttgtacaggtgaaaaaggtgtcgggtccaatggcaaacctcttcactataaaggaacaccattccatcgtattatccctggcttcatgattcagggtggtgacatagttagaggtgacgggaaaggaagtgagtctatatatggaggcatcttcccagatgagaatttcactgtgaaacatacacatccaggtgttgttgctatggcgaattctggacttgattccaacggatcccagttttacataactactatcaagacaagctggttggatggggagcatgttgtctttggcagggtgatccagggaatggataccgtgtacgccattgaagggggtgctgggacttacaatggcaagccgaggaagaaggcggtgatcactgactctggtgagatacccaaggagaaatggggtgatcaggaagcttaggctgttctgcattccttgtcaccatgccatcttcaactcaggcggccatatacttcttttttccttgacctccatggtgtgccacagttcaacaggacttctggaatgttgtatatcgtagctagtttatggccagtcgaactgactccgatcccttgagttgtgaagtggagatctgaaaagtctttagctagctttgttaccttgatacctggattgacaatcttgtgtctgaagttattctgccatatatataaggaagctcgt

SEQ ID NO: 5590 - DNA, 595 bp, Sorghum bicolor
  Clone ID: SORBI-28MAY03-CLUS18069_1
gccggccgggccgggaagaaactcgaagcgcagcgccgccacggttgcaaaaggcgcctcttttttttcttgtttcacctctacccggcgacccgaatggagaagggcagtggaggcagcgctccgccgccgccgccgctccacatggaggacttccagctggaggggaagaagcccgtcaagaacccctttgtgcccatcggtgcactggttactgctggagttctgactgctggtctggtcagtttccgatatgggaactctcggctgggtcagaaactgatgagggcacgtgtagttgctcaaggcgctacagttgctctgatgataggcagtgcttactactacggcgatgaaatcaagctgttcaagaaagggtcaagcccatgatcttccatgaatattgatgtttttggtgtgtggaggaatgtcttgtatacactgaaatttcacctgggccctgctgttgaccccttttaacatcattttggcctatgtgatgatagctaacaagaaatcgctgttggtccgatcggcaggcttgaaaataaataatttgtttgttgatgaaaaaaaaaaaaaaaaaaggccccta

SEQ ID NO: 5591 - DNA, 709 bp, Sorghum bicolor
  Clone ID: SORBI-28MAY03-CLUS17952_1
gccggccggggctggagcggactgccttttgttctccagttccccggcgtgcggcggcgggctctcgctcccggcatacggtactattctcccgtgcccgtcgcctgcgctgtctgtctttgtgggggccggcgacgtttggcgaccgccctacgccaggtgcccagatctccatcctcggcaccctcgccggcgacgagcatcaccaggttcccattgaccatggcgcagcgcgcgatgtgcctgcttcggcgctccatggggtttatggcgcccccggcacaaagagccctgagtaccactgccacaacggcggcggagggtgcggcggtggccgaggccacggcgaaggaggtgaagaggaggaagaagaagaatctgtttgacgtggtgcagttcctgccagagtggggcatcggatacaaggtcgctaagaccacctggcgcgatgtctcttaccagatcaccaagatcaacctgtacaaggatggtcggcatggagaggcgtggggggttcggtacaaggcaggtgtgcaagctgcagacgccccaactaggatcagcggggttaacaagcgtgggtggaagtacataaaagaatcacagaagaaactacaagacgcccccaaagtaacgtagctgttgctgcctagttgcatgttgtaagaatgattcttggttccttcatgccatagatgttttgatggct

SEQ ID NO: 5592 - DNA, 829 bp, Sorghum bicolor
  Clone ID: SORBI-28MAY03-CLUS18070_1
gcacgaggggcagaagcaattcaccgccgcctccggaggcagcatcctccggcagaagaatactcatggaatcctgaatgctgtgagctggggtcttctgttgccgatgggagccattttcgcaagatacctcaagacattcaaatcagctgatccggcatggttctacctccacgttgcttgccagctgatcgggtacggcgtcggagtgtctggctgggcaactggtattcatcttggaaacctgtccaagggaatcacctactcactccacaggaacatcgggatcacagtatttgctcttggtactctgcagatatttgcgctcttcttgagggcaaagaaggatcacaagtaccggctgtactggaacatctaccaccactcggtcggctacaccatcatcatactgggcatcatcaacatcttcaagggcatgtccatcctggacgtggagcagaagtggaagacggggtacatcatcgcgatcgccatcctaggcgccatcgccgtgatcctggaggtcgtcacatggggcatcgttctgaagcggcggaaggaggacagcaagacctacaatggcacctcgaacggcggccgcttgccgctatctatgtaacttcatcaccatagtcaggccctctgacctaaaactatcttcggtgttgtgttggtgtgcagatttaggaagggttaggccttacaatcgttttagtaatctcgttttttgtatgatagatgtgtatgtatactgccgattattatactggagatgagtgagtgataccggtggtcaaaaaaaaaaaaaaaaaaaggcccctagggccgc

SEQ ID NO: 5593 - DNA, 417 bp, Sorghum bicolor
  Clone ID: SORBI-28MAY03-CLUS2487_1
tgtactctagcaaattgtatctactcttacacaaacaaggggagagatgggatcggggacggatggtggaggttgcgtgtgggagttggtttgcgcagcgcgacaaggaggaagagaaggatttgggttcctgtaggagctagtagtcacagcagcaatcgtccggtcctccttggtgtgcaaggaagccaagggaacggaacggaacggaacggaatgaagtcagacgtggtggccaccggtggaagctggacggacacgtttgctcttggccctgtccggcccgcggcagccggccggccggcagggcttccccttgttctggcagtagaaaagccttttcttttttctttttcctgtggtggtggtgggtgcgtgcctgagcaatgtggcatgggcgagtccagggccaaattt

SEQ ID NO: 5594 - DNA, 717 bp, Sorghum bicolor
  Clone ID: SORBI-28MAY03-CLUS24890_1
gactactggtcactgcgtcaaaaccctcatcgacgacgagagcccaccggtgtcctttgccaagttctcccccaacggcaagttcatcctcgcggcaacgcttgacagcaccttgaggctttggaacttctcagctggaaagtttctgaagacatatacaggccatgttaacacaaagtactgcatcccagcggcattttctatcacaaatggcaagtatattgtcagtggctctgaggacaaatgcgtctacctgtgggacctgcagtcaagaagaatagtgcagaaactggaagggcatactgatactgtcattgcagtttcatgccaccccacggaaaacatgatcgcatcaggggcgcttgataatgacaagacagtgaaagtttgggtccaaaaggaagaagattgatgagttgcctggttactctcttatctacattggctgtcatgtggactgactaatggtaagtaagctatgtagcttcccaagcaactaaagattgctgcagtggagaatgtgatgctcctggaatgtgtaactgagtgttgtattgtctgctcagcagctcggcgatgattttagtgaactcaatcaaaacgttctgtagagctattcatgggaggttgggatcatgtaagagacttgaacacaacaatgcttagacttcatttgtgtgtttctgattctctaatctatgcggagctgtttgtttc

SEQ ID NO: 5595 - DNA, 683 bp, Sorghum bicolor
  Clone ID: SORBI-28MAY03-CLUS24960_1
aggctaaaatagtgtcatctattgatcagcttttagaaacagctgagatacaaaaagtattgttccttgaaactcctgagggaatttcgtctgcattgagaccatactgggcaaaggcgatagagggaagggcccatgttgttcaggcacaacctgatatgcttgaacttgtaccgcctgcaacttcgaaaggcaatggtgtgaagattctgttgaaccatctttccattagtccggatgaggtaatggcaattggtgatggagaaaatgacattgaaatgttgcaactagcttcgtttggtgttgctcttgcaaatggatctgataagactaaagcagtggcaaatgtaattggtgccactaatgatgaagatggagttgcacaggctatttatgaatatgctttctaacaacactgaatcattttggactggattcatatctgttcttttgattccccattttccctgtattcaacacagaagtcaagtggttccaagtacaccgttcgaagaattacagtggagtgcgacctcaatgtagggttagaatttttgaattgttggcctgtaataattttttgttggcaggcactgaaatccagctccacatactcttataattggaatatgtaatcggattactattttctcaaatttgtatgtaggcgttccttttttttt

SEQ ID NO: 5596 - DNA, 603 bp, Sorghum bicolor
  Clone ID: SORBI-28MAY03-CLUS24982_1
gcacgagggtcagcacgagcaagcagaccaagattcagaagcaagaacaagtctctagccggtgcgcgatcgatcgagaggactgaccgagatcgtcatcaagctcggagcaagcagtgaattaagatgagcgcatcgtcgtcggtggccgtgagcaagaaggcgtcgtcgctggtggtggcggcgagcatgagcgcggtggaggcgctcaaggaccaggcggggctgtgccggtgggactacgctctccgctcgctctacaaccgcgcggccgccgccaataaggtcgtcgtcaccggccgtgccgtgccggtgtcgctctcgtcgtcccaggccgcgggcggcagcgctgcggcctccactcccgcggccgccgccggcagggccgccaggcccaggcgatcggaggaggagaagctgcacaaggcgtaccacctcgtctgctggggccctaattagttcttctttgtatacacgtcttatgcgaattgcgattcctcctcttcttgttcatacatagagatacagagatgtactatgtgtctgcaaattttgacatgtaatccgtcctctgaagccatgggaattgcttattgctgggtg

SEQ ID NO: 5597 - DNA, 577 bp, Sorghum bicolor
  Clone ID: SORBI-28MAY03-CLUS18219_1
gccggccggactctcatcttcttcacttcccagtctcccaccaccaacaccaacgacagagagagagcaggcagcggcaatggctggcgccggggacgagtactactacggcgggccaggcccgcgcggcgcgcctcacggcctgctgctggcggtggtggtgggcctggtggtggcgggcccgctgttcctgggcgacggcggcgaggcgctgacggaggccgtggcggagctgctgagccccgtggggctgctcctcctccccgtctgtctcctgttcctcatccgcgtcctctcctccgaccgcggcgccgcggcgctcgccgacgtcttcgccttcggcgggtcccccgacgccgtccaccgcgtgggaggctcccccgtcggcgtcgccttcatgctcctcctcatcctcgccctgctctactaccgctcctcgctcttcggcggcgacggcggcgacgacgagtagagcaggagccggccgcggcgggtcgctttgcaggggccagggagggggagcggcggggcggggcggtagtcggcgcgagcctgcgatctccggcccggctgtgtt

SEQ ID NO: 5598 - DNA, 698 bp, Sorghum bicolor
  Clone ID: SORBI-28MAY03-CLUS1824_1
gccggccgggtcgggattattgtgcttggtcgtaatcttcattcctccgagaagatcgagagagaaggcaacgggggcagtcgggcaccgagaaccaacagggaagaaggcaagatcgagccgagcctaatccgtcgtcgtcggatcacgatcggatggcgcgtgctgcgtccagctatatatccaggaggggcctctctgcagcgataacggtggcggagtcgtcggcgaagaaggtggaggagaaggcggtgaagctgggcacggtggccaaggacatcgccagcgccatggcgaccacgacggaggagaagacggcgttctgggagccggaccccgagaccggcttctaccgcccggtgaccggcaccaaggaggtggacgccgccgacctgcgcgccgagatgctcaagcagaggatgctgcagcaggactgacgcacgcactactgtccctgactccctggtcgtcaagatcatcacacgaccaagctactgtacctagaatgtgcatgtgtacatctgaagatggcagccgattattactggctatcttcggggccaatttgagaggaaatccggtaatttctgtgccactgatctggttcctcatccggaattcttgtgggatatcatacccaaaagcacaggggaaagccccgaattaaccccgaaaaaaaaaaaaaataaatggccccc

SEQ ID NO: 5599 - DNA, 983 bp, Sorghum bicolor
  Clone ID: SORBI-28MAY03-CLUS18287_1
gccggccgggctgggaagttggtcccatcccatcctctctatccccttatcctgaattccttatcaatgcaatcctttcgctgcttgccatgccagtcagtagctagctagctagctccaagaacgaaggaaaggaagcagcaggaggagtatatagcgagtgtgtcgcacgtgtgtgtctctgactctgtatatataggcgtcgtcgcttgcccttgcgtgcagtgaggggaagatcgaagcagcatcagtacgtaagaactgaatcgaatcgaatcgaatcgaagatgatggatgaggagcacgagcagcagcagccggtgccggtgccggtggcggcggaagcagcggtggagaaagacaataagaagacggcgaagaggaataataaggtgtgcgtgttctgcgggagcagccccggggtggagcggggcatggacctagtgtacggcggcggctgtgcagctctgatgggtctggtgtcccgcgccgtccacgacggcggagggcacgtgctcggcgtggtgcccaaggcggtgctgccgctggagctcatcggggagacgccaggggagctcaagccggtggccgggatgcaccagcgcaaggccgacgcgctcccaggtggttacgcatccacaccaagcccgtgggcctcctcaacgtcgacggctactacgacccgctgctcgccttcgtcgacaaggccgtccaagaaggattcgtcacccccctcgaacgcacaatcatcgtccacgccaacaccaactcctcgacaagctccagctccagctccacgaccaacatcaacgccgacgccgacgccgacgcctagctatattcatccatccatcaccaacccaacaactccaacatcctcatacatactcacgtgtatacacccaaaaaactatgtgtaccagcagcatacacacgtttagttattgcttgcttaatattggctacttcatcgctccagcagc

SEQ ID NO: 5600 - DNA, 732 bp, Sorghum bicolor
  Clone ID: SORBI-28MAY03-CLUS18309_1
gccggccgggtcgggataggctcatagcctcgcgagcgggtccccctccttgcaaggccggaactgagctgccgccggcgctatggcgagcggcggcctggcggctgcgtcagagttcgccgtcgtcttcctcgtccgccctgtcctcgccatcgccttcgtcttcaccctcatcctcctcagttggtacgtggcgtggagaacggtgctggtgcacgtgccgctggtgcaggagatcgccggtctgcgcccgaagaagccctctaaacccaagccagccaaccgcggccgcttcgccaagttctaccagaaccaggccgaggccgcacaaaggaacagcaaatcagaagggacatcttaagagaaatccgtcagcactttgtaacaagtacctgctgcagactatagtatgcaaattccccagttctaattagaattagaatgcaagtactaccaatggtggcagttttttaggagagaatgtataccaatgatggtggttttttaggagagaatgtatatcagcatgtgatgggagcatcttgcttgacgatacatcaggcttatgatactagcgtatcaactgtatattgcatgaccttgtaaagtcaaggaccttataattgtagattatacatgtatacctgtatacaagaataaagaaccacttatcctttggaataatgttaatgtaccttctcttgtgcaaaaaaaaaaaaaaaaaggccccta

SEQ ID NO: 5601 - DNA, 712 bp, Sorghum bicolor
  Clone ID: SORBI-28MAY03-CLUS18376_1
aaaaatggtcaatgcacagccatcaggacaagatcacttgaatgtgccatggcttggaagcacaggtggtgtgaaaggtaatgctcagaatggaatgccaccagttagtgccccagtagccggccgaccagatgagattccgatagaggtgccggcagtgacaccgccagcgaagccgatgcgagtgaaggtgggtgcgaagaagcgtggtcgccccaagggtagcaagaacaagaagaaattatgaatctaatgatgaacattatggttatcatcatcatagatcagatggattaactgagatatgcattcaatcatactgccattgtagtcaactgaagcactcgtctgcaggttgaattctcacttgctgttggcaggatctctaatgtggagcaagcaattttattgttgaaagacttctttaagtcaatggaagaattctttcttttccagattatgatgttaatctatggtttgtccccactgctttacttgccattatgctttagctgtagctattgtatttgcatatttgtctaatctcactgctgccctgaagactgttgtattgatctaaaatgataaggtgtctagatactgtttattgtacatttgagtttggtgctattgtaagatctactctgtgtaggaatgctgcagtaaatggaatggtttaaagctctaaaaaaaaaaaaaaaaaaggccccta

SEQ ID NO: 5602 - DNA, 735 bp, Sorghum bicolor
  Clone ID: SORBI-28MAY03-CLUS17786_1
gccggccgggccgggaactcgtcttgttgtcgattgattgatgatctccgtccgcgtctgcatccggagtccgatctctcctctgctctgcctctgcttttttttttttctccagccccgcccgcccgccggcctgctcgcttggtgttgctggctgcggggtgcgggagccacagcactccactgcatcccccggttcgtctcttcgcctccccctcctccggttcgtctcgtcctcaccccgcagcagccatgccgggggaccacggctccaaggtcgacatctccttcgccggccgcttcaccgccagtgccatcgcagcatgcttcgcggagatatgcaccatcccgctcgacaccgccaaggtcaggctccagctgcagaagaacgtcgtcgccgccgctgccgccggggacgccgcgccagcgctccccaagtatcgcggcctgctcggaaccgccgccaccatcgctagggaggaaggggccgcagcgctatggaagggcatcgtcccgggcctccatcgacagtgcatctacggagggctccgcattggcctctacgagcctgtcaaatccttctacgtcggcaaagaccatgttggggatgtgcctctgtccaagaaggtagctgccggcttcacaactggtgccatcgctatcagcatcgccaaccccactgaccttgtcaaggtcaggctccaggctgagggcaaacttgcccctggtgtgcca

SEQ ID NO: 5603 - DNA, 767 bp, Sorghum bicolor
  Clone ID: SORBI-28MAY03-CLUS17833_1
gccggccgggccgggaaaagcccttctatatattcatccatccatctctcaggctccaaagcaacaagcacctgcaactgcaactagccagctgcaagcaatcaccagtttgtcgaacagcagaggcgatcgtcgattggcgggcgcgccggcagctcgcaaagacgatggcggcggaggcagggaagacggcggcgacgaagagcggcggcgggcagatcatgacggtggtgcggggcctggacgtggcgcggtacatggggcggtggtacgagatcgcgtcgttcccgtccttcttccagccccgggacgggcgggacacgcgcgccacctaccggctgctggaggacggcgccacggtgcacgtcctcaacgagacgtggagcaaggggaagcgcgactacatcgagggcaccgcctacaaggccgacccgaacagcgacgaggccaagctcaaggtcaagttctacctcccgcccttcctccccgtcatccccgtcgtcggcgactactgggtgctctacgtcgacgacgactaccagtacgcgctcgtcggcgagccgcgccgcaagaacctctggattctgtgcaggaagacgagcatcgacgaggaggtgtacaaccagctggtggagcgggcaaaggaggaaggctacgacgtgagcaagctgcacaggacgccgcaggacgacccgccgccggagagcgacgccgcgcccactgacacaagggagtatggtgggttcagtcgctctttgggaatgatg

SEQ ID NO: 5604 - DNA, 983 bp, Sorghum bicolor
  Clone ID: SORBI-28MAY03-CLUS17835_1
gcaggaggggctcccggaagagaaccgaaacacttctaactcgctccctacctgagacctcagtccctctccctctcataaacgacgacgaggaggccgcacgtactccgcaatatagcttctcagttcacgctctctagtctctcctccaggcctccaccaccggccgggcagaagcggatcggaggagcagaagcagagcgagatggggctgggcgtgaaggcgacgccgttcacatacgcggcgcacgcgctggccgcggcggcggcggtgctggtgctggtgtggtgcgtccacttccgcggcggcctcgcgctcgaggcgcagaacaagaacctcatcttcaacgttcaccctgttcttatgctgattggctacattatcctcggcagtgaaaagcttatgatctacacaaggtttttccaactgaaaaccgacacagcccagctgacgcacctcatcctccacgccatcgcgcgactgctcggggcgctcggcatctactgcgcgcgttcatgtaccacagacagagcggtatcgccaacctatacagcctgctctcctggctcgggatcggaaccctctctctgtacgccattcagtgggtgttcggtcgcgagctcttcttcttccggcgcggcgcgccgagtgtgaggcgcagcgctgtgccctggcacgcgctgttcgggctcttcgtctacgttctggcgctggcgaccgcggagctcgggttcctggagaagctcaccttcctggagagcggggggctcgacaagtacggcgccgaggcgttcctggtcaacttcacggcgctcgtcgtcgtgctcttcggcgcctccgtcgtcgtcgccgcagtcacgccggcgcacgtcgaggaaccgcgggagatacgctccaattccgatcaactagagggtataaggagttgctgaaaattcagaagagtgcagcttttgttctgtttgaattaaaccatgacaac

SEQ ID NO: 5605 - DNA, 1115 bp, Sorghum bicolor
  Clone ID: SORBI-28MAY03-CLUS17752_1
acaacgccacgccgcgagattccccacgcagtccgcccccgcgtcgtctcgctctcgcctcgcgatggccgccgccgactacgaccgcgcgtaccgcccctacgcggcccccgccctcgcccccgccggtgagtacgaccgcccctaccgcaacgaggtcgtgccgtacggcgaccggcgcctcgacatcgtcgtcaagccgcccgccaggtcgccgccgccggtatccaccaggagcggcggcagcggaggggcggggtcggcgtggtgcttcagcgacccggagatgaagaggcggcggcgggtggcgagctacaaggcctactcggtggagggcaaagtcaaggcatcgttccgcagggggttccgctggatcaaggccaagtgctccgagctcatccatggctggtacggatcaggccttcttcttcttcttcccccctccccctcttatcgggtcctcccttcttcttctcaatattctcggacatctatcggcgacagccggctgctttggttcccgagcatgggtcatgtccccttccctgcccactgcccagcaagttcaggagcttttaatcttcatgttactgtttgtatggactattggtacgattgattggcattgtccttgtgcctctcatcatacatcgttccttcctgaaatggttagggaagtcacaagtacatggggcagatctctagcaaattacaagctcctcagcacaagttgtcatccttttggctcaccttttaagcagcaagatagcactagcttgttcatgtgattggagtaatcatctatgatgtcatattcgcctctaatttccattttcccccctattttttttccagaaaacccggtgtctcggtgaaattctatcctattgggatggtggaaggtggagctacgacgcgcgacgaatggttctcggatgtatttcgctaattcgctcccaaaatgtggaagagaaattgttctgagattgtgtagagaacttgtggcccccctctggttataggaaaagaactagtggctcttctgagcttgcttgtcgctgcctgctaattacccctaattttgtccaaacatgttgaagaagaattaatctcgg

SEQ ID NO: 5606 - DNA, 573 bp, Sorghum bicolor
  Clone ID: LIB5049-007-R1-XP1-D12
gccggccgggtcgggaagtctgcccccgcgtcgtctcgctctcgcctcgcgatggccgccgccgactacgaccgcgcgtaccgcccctacgcgggccccgccctcgcccccgccggtgagtacgaccgcccctaccgcaacgaggtcgtgccgtacggcgaccggcgcctcgacatcgtcgtcaagccgcccgccaggtcgccgccgccgccgctgccggtatccaccaggagcggcggcagcggaggggcggggtcggcgtggtgcttcagcgacccggagatgaagaggcggcggcgggtggcgagctacaaggcctactcggtggagggcaaagtcaaggcatcgttccgcagggggttccgctggatcaaggccaagtgctccgagctcatccatggctgaacccggtatctcggtgaaattctatcctattgggatggcggaaggtggagctaccacgcgcgacgaatggctctcggatgtactcgctaattcgctcccaaaatgtggaagacaaattgttctgcgaatgtgctaaagaacttgaggccccccctctggctacaggaa

SEQ ID NO: 5607 - DNA, 635 bp, Sorghum bicolor
  Clone ID: SORBI-28MAY03-CLUS17861_1
gccggccgggccgggacgcaccacgcagtgctcgtgcgatctgaagtcacagttgagggacgaagcaaaaatgtcctctagcgatcagaatccagccgccacacccgcgtcgggcggccccgccgaaccctcgccgccgggcaggccaacggcggtgtcctcgcaggtcctcgacgcgggcgcgcggctggtgcagtcgctgaagccggtgcggcagatgaagcagcacgcgtgcagcttcgcgctgtacgcccacgacctgcaccgccagatggaggtccaccacttcgtctcccggctcaaccaggacgtcctccagtgcgccgtctacgactccgacaagccctcggcccgcctcatcggcgtggagtacatcgtctcggacagcatcttcgagggcctgccgcccgacgagcagaggctgtggcactcgcacgcgtacgaggtgaaggccgggctgtggaccgacgtcggcgtgccggagtccctgcagagctcggagatggcgagcctcgccaagacgtacggcaagctctggtgcacctggcaggtggaccgcggcgacgcgctgccgctcggcgcgccggcgctcatggtgtcgccgcaggccgtcgagcctgggcgcgcgccgcgcg

SEQ ID NO: 5608 - DNA, 839 bp, Sorghum bicolor
  Clone ID: SORBI-28MAY03-CLUS18835_1
gccggccaggccgggatctcccaagtcccaacggccccgcctcgcctcggggatcccgccgccgctccatccgcttctactcccccacccgcagcgagcggcagcaagggcgagggatggccaaggccaggtcgtcggcgaagcagtcgcgtgcgcaggcccaggcgcagcagtcaaacggcggcggccacgcgctgtcctccaagctcgctaggtacctcgacccggaggcctccttggacaaggaccaactcctggacgcggtgcactggatccgccaggcggtggggctcatctgcggcctgctctggggagccgtccccctcgtcggcgccgtctggatcgcattatttctgaccatctcgactggcattatctattggtactacacatacctgttgaagattgacgaggaggaatatggaggccatggggctctacttcaggaggggcttttcgcttctttcacccttttcctgctttcgtggactctagtatacagtttggctcatttttgagaagctcctttggtgcacataccatgcgacctttgttcaccattcagccagaagagactcaccaggacagtttagattaaggagcatcttagaacgagcattgtatcaaaaacggttctgagttgtaatgttatttcccaaccccagtgtaattttggtactatgggattagttcagtgcgaagtagaacactgcctatgaaatcctcaaccagagggcaaagatgttgatcactgagtttgcagtcaaacaatattcacttggcatcaggctgtgaattaatgtacaacttttaacacatgaatgttttgggtttctgtt

SEQ ID NO: 5609 - DNA, 772 bp, Sorghum bicolor
  Clone ID: SORBI-28MAY03-CLUS18888_1
gccggccgggccggggtaggttccttgtagggagacgtcagcatcggttccattctccccgtcttcgcaacacctcgccgccgccggacatccgacgaccagcgacgaggtacggcgaacctttggagcaatcattcgccatgtctacggcactcaaggctttcatcaacagccctgtcggccccaagaccacccatttttggggccccgttgcaaactggggtttcgtcattgcgggtttggttgacatgaacaaacctcctgaaatgatatctggcaatatgacagcagccatgtgcgtgtattcaggcctctttatgaggttcgcatggatggtacagccacggaactacttgcttctggcatgccatgcctccaatgaatcagtccagctctaccagttatctcggtgggccagggcccaggggtacctggagaagaaagaaccagaggcacagcaatgaaaagggtggcgtgtataggcctgcatccaccttctcagtaacaataagagttatctgtcgctgcagttttgaatcctcactctggcagacaaatcccaggaaaacaacctttctatagttatactaatgccatatgcagtgctacagcgctattgcagaatctcactgcactagtgatcagagtaggtgtctcgtttttctttttctgatttgatggctgtaaaaacacacatcacatggttttgaaaatggtgatctcagtttctgcaaaaaaaaaaaaaaaaagcccctagggccgcggccgctct

SEQ ID NO: 5610 - DNA, 656 bp, Sorghum bicolor
  Clone ID: SORBI-28MAY03-CLUS1890_1
gagacactgccaagctctcgaggaaactccagaaattgtcttgtcaaaagctctttggcagctaacttccgcaaacaattctcaaacttgatgatagcgatcagcgaggaaaggatcttgtaccctcttacatggatcatgacatcctttgctgttgtgcctattctttctggaaccatgttctgctttcaaacacagtatttgaatcttgatccatcagttattggtctatcgaaagttgtgggacaagtcatggtcttatcactaactgtactctacaatcgatatcttaaaaggatcccactgaggtgccttaccactggacttcagatactatatgctttggcagttttgtcagatttggtccttgtgaaacaaataaatcttgtgctagggataccgaatgagattcatgtcctttgcttctcagctctagctgaagctctagctcagttcaaggtcttgccattctcggttttgttgtcaagtctctgcccaccaggctgcgaaagttctttgttcgccttcttcacatctggactggtgttttcagcaatactaagtggagtatttggagttggattgtgcaccctgatcgggtgtcttctgtggactactcaagcttgcctgtcggtattttgctgcaaagtttggct

SEQ ID NO: 5611 - DNA, 775 bp, Sorghum bicolor
  Clone ID: SORBI-28MAY03-CLUS19004_1
tgtgcggcgctcgagccggccgggtcgggacattgattggtgttggatttgactgcaatcctatgatctttgctgctgatgatactgggctttggagtttcataagattcttggatgagaggaaagttgccccatcagcttcaaaagcctcacagctctctgaagcccttggaaagctatatggccaatcaaagcaagggactagtagcgacaccgtggaaccatcaaaacctcgtggtggggcccatgagaattgcataacgtgtattgtacccttgataaaaggaagcgacggtactatcaaacaattcagcacgtcaggattggacggtaaaatcgtggtatgggatttggaaaatcacatcatcattgcaaaatagctcgagggaaggcttcgttaccaatcaaatcaagggaacttctgtcattacccatcgtactcaggggaccattcttggcagcggggtcctgcaggttttcaagatccagggccagccaggtagattgcttttttattttgttgtacctgtacacagaaaaattgccttagcgtaggggacagcttgcatctatcaagtagattcatttttggcgagtaattttgtcctttgaattgagtccatatatattgtgtaacctgtataattttagctaggtaggcaattgacgtgatccagcgttttttctttccggcaccctgtgtaaaataaccacacgtggaattcatccgcgaatgctttactgggacttgtgggcacctcgtttcttctgctgc

SEQ ID NO: 5612 - DNA, 782 bp, Sorghum bicolor
  unsure (1)..(782): unsure at all n locations
  Clone ID: SORBI-28MAY03-CLUS19005_1
tgcttctgctcctccagccacagcgcagccgccttcctcatcctgattccgtggccggcggccgcctagcctcaccacacctccccaccgccgccgccgccgccggaacctcttgaagtagcggatccgggctctcgcgcccatccgcgtccggagttcgatgtccgtttgcgcctgatggatccgcaccggctgaccggccccgccgcatccgacgccgacgacgccgatgactgggataatgatgactttgtgatcccaagttttagtgttgaagaatctgatctcggtgactgggaatcctcacgggctactgatcctcaaccacctccaaaggccaccaaagatacagagaacatctatctcggaccacacggtgcgccaccatctcgagcgaagaaggcagaggatactttggctacagctgggtaccgtgacaagaacagcaaagcgagggaagctgatcagaaggcttttggaactgggcggaacaccaaaggaggcaacaacgcgggagacttccaccgccacaatggtgccaaccatggcaaggacccctacaagcgatctgtctgaccttgtgcctgtcgaggttcgtccacagtgatactctgatacctgtatcctctctacacaccttaactaagcgaaactctggtgattttatcagtgtactggaaagatatatattttttntacctgtgatcagccctattatcttgagctgcaggtattcctggtcagctggtatgtactactatcagtatattgctgcagacaca

SEQ ID NO: 5613 - DNA, 689 bp, Sorghum bicolor
  Clone ID: SORBI-28MAY03-CLUS18083_1
gccggccgggttcccgggacttgggatctcgcattctcgctcgctcgctcgctcggccatcatcggacttctgtacaagcacgagaggggagaaacagcggattcatcaccgtcagagagtgttagaacaagatggtggccaatggtgatgcacctgctagagggagtgccgcggcagctgcaagcctgcgcaggcgtaggaccacaagcggtgctgctggtggtggaggcggtgccagctcaatgctccagttctacactgatgaggctgcgggccgcaaaatgtcaccaaacactgttctgatcatgagcattgggttcatcgctgtcgtcgctatgctccatgttttcgggaagctctaccgcacctccaactaggttggcattaccaatatccaacaaagcagaggccaccaagagaggaaccttatagagcgatttaaatggatagcaagtgacaatcagagaggaaccttgtagagcgatttaaatggatagcaagtgactattagattctgaactgttatagaagtttatttatacaacttgcaatgctgagggctatgataatccctgcgagtctggtttagtcattgtttgatatttttgaaatgtgcttgcatatgctactttgtgtttctgtttacctgatcttgccattcaatccttgttgcttacctttggcctct

SEQ ID NO: 5614 - DNA, 696 bp, Sorghum bicolor
  unsure (1)..(696): unsure at all n locations
  Clone ID: SORBI-28MAY03-CLUS1814_1
ccgctcaggcggcgggcgagatcatttgtgacagtcacaccaccaccaccaccacctttacaccgggagagaaacgcgagcaaccagcgatcgccatggctcgctctgtctccgtcgtcgtcgtcctcctcctctccgtcctcgtctccgccgcgtccgccgcacggaccgtgggcgacaccgtgcaggacgcgtgcagcaagacgcagttccccaagatctgcgtcgacagcctcgcggcgaagccggagagccagaaggcgaccccgcggaagctggcggagctgttcgtgaacatcgccgccgagaaagggtccgggatggccacgttcgtgcacggcaagtacaacaacgacgccaaggacagcgccctgttcaagtgctacgacagctgctccgacgacgtggaggaggcggtggcgcacctcaacgggctcgtccgggagcccaccgacgccaagttcctggagctcaagtcgtggctctcctccacgctcggcggcacctccacctgcgaggacgcctgcaaggacgcgcccaagagcggcgacaaggacgccgtcgtcaacttcagcctcgacttcgagaagctgcagcgcgtcacgctggacctcatcaccgaggcgtccggctccatgtccgccggcatcgccactgccgnccgtccgacgnncgggnngccagctcctacgacgc

SEQ ID NO: 5615 - DNA, 755 bp, Sorghum bicolor
  Clone ID: SORBI-28MAY03-CLUS18161_1
gccggccgggccggggatttctaagtctccggtcatcccgccaatccacgatggctcccaagatcctagtgatccttctcctcctggccgcagcctcgccggcagctttggctgcattcgacgtgatcgagatgctggccgacaagcccaggtacgccacgttctcgaagctcctgcagcaaacaaaggtcgcgggagaggcgaaccagctccgggcagcgacgctgctggtggtccccgacaaattggtcaagtccctggcgtcgctgcccaatgataagcttcagccggcggtcgcgaaccacgtccttctcagttacttcgaccccatcaagctggacgagatgaagacacgcacagccatcctccccacgctgctttccaacaccgacaagaaactcggcgtccttaactacaccagggccgacgacgggcagatgtactttggcgcgcccggcgcctcctgcgtggccaagctcgtcaaggtcgtcgcagcgcgcccttactccgtgtctattatggaggtcagcgagcccattttgccggctgggttcgtgacctctacagccgtggcgcccgggcgccgcggaaagggtggtaggggcaagatcaagccatcagcggcggggcttgaggattccaagatggtcgcccgcatgcccggagaaggagtgtcgggtaaagggtcccctaaggataccgtgaccaagtcctctgctccaatccccgcaccttaattattagtcgcgtgtcgt

SEQ ID NO: 5616 - DNA, 961 bp, Sorghum bicolor
  Clone ID: SORBI-28MAY03-CLUS18188_1
aacctgatggacgagagcgttttggtggacagcccgagccctagggacacggtcctcaacaacatccgggagatgcggcccaatgtgttcatccataccgtagtaaatggaacctatggtgcaccattctttttgacacggttccgggaggcactcttctttttctcggcacaattcgacatgatcgatgcgaccatccccagggacaatgctgaacgtctgctgatcgagcggaatatctttgggtcatttgccatgaatgtgattgcttgtgagggtgcagacagggtggaacggcctgaaacttataagcaatggcaggtgcgaaaccacagagctgggctcaggcagctaccactgaatccagaggttgtcaaggctgccagggacaaggtcaagatctattatcacagagacttcctcgtcgatgaggataaccggtggttgctgcttggatggaagggacgcgtgctctatgccatgtcgacatgggttgctgaggatggcaaacccatcttttagtgcctgaatccaactataggtagaaacagttagagctacataggttgtagatatagttcttgatatactgcagagttgtaataatctactatgtacaatgtacactagaattaaaaccttgtagttgacaagtggttacatgtttgacctctgaaggcttaataaaccctgaaaagtatctaatgatgcctgatatgaaggtacatggtctatgtttaaactatgatccagcaacctgtggctcagtggacttatgtttccactttccagagggtttagtgcagaaacttgccaggtagaaataagtagatgcttatagctacataggttgtggatgtagttcttgatatactgcagagttgtactattatatactatgtacaccagaatttgtaatggtatactatttacgcaaaaaaaaaaaaaaaaaaggccccta

SEQ ID NO: 5617 - DNA, 686 bp, Sorghum bicolor
  unsure (1)..(686): unsure at all n locations
  Clone ID: SORBI-28MAY03-CLUS19196_1
atggtcatacgggcgccagaacagccgtcaagaagccgtccgagcagggtcacagactttacgtcaagggcaagcacatctcgttccagcgcgcgaagcactcgatcaggcccaacacctcgctcatcaagatcgagggcgtcgacgacaccaaggccgccaccttctacaacggcaagcgcattgcctacgtctaccgtggcaagaaggagatccgcggcaccaagatccgtgtcatctggggcaaggtcacccgccctcacggcaactccggcgttgtccgcgcacagttcaagcacaacctcccccccaagtccctcggtgccatggtccgcatcatgctttacccctcctcgatataagtgcgggtactgcacggctcgactctcgcgaattctgacgatggacgtccgggtttgaccacgaacgacggaggagcaaaggaaagggaaacatcgagctggcaaatccttcgcgagagcatctcggttgtgtgacatttcgggttacccccagtgtcttcattttgctttcgccggcgtaggagcatcatgggattatcacttgggcgatttcgaatgcgcattatcgactcttttattagaaaatcagatcccttgcacctccccatcccgttcccccggggggatgaacncaaaaaaaaaaaaaaaaacggcccctaaggc

SEQ ID NO: 5618 - DNA, 663 bp, Sorghum bicolor
  unsure (1)..(663): unsure at all n locations
  Clone ID: LIB5048-004-R1-XP1-G5
ccggggtactaacgacagcatcaaccccgacccagacgtccccttcatccccccgaggccgcccaaaaaattcgccatgtctgccgacaacaagtcccaccgcctttacgtcaagggcaagcacatcagctaccagcgcggcaagaggaacaccaaccccggaacttctctgctcaagcttgagggtgtcgacgatgtcaaggcagctcagtggtacgccggcaagagggtagcctacgtctaccgcgcacaacgggcgatccaaggctccaagatccgcgtcatctggggcaaggtcacccgccctcacggcaactccggtgtcgtccgcgccaagttcaagaacaacctccctcccaagtccttcggtgcctccgtccgcgtcatgctttacccttcttcgatataagctgttccgatacgatctttggcgacgggaacgaacggtcgaaaagcaatggagtgatggatgattaggcgcaaataccgggcacggagcgagagaacaaacagtagtgtgggagacaccatgcacagtctctcatacacgtaaatgttcaggctggtgcaacggtgtcttttggttccgaaagtccataaacatggggcaatcannntcagatccttccnagatcaatanaaaaaaaaaaaaaaaaagcccct

SEQ ID NO: 5619 - DNA, 638 bp, Sorghum bicolor
  Clone ID: SORBI-28MAY03-CLUS19301_1
gccggccgggctcgcgagcgccgaaactctcaacatctcgactcccgacagtatcacgatcacaaccgtcgcaatgtctacctccgagctcgccacctcttacgccgctctcatcctcgctgatgacggtgtcgacatcactgccgacaagcttcaatccctcatcaaggccgcaaagatcgaggaggtcgagcccatctggacgaccctgttcgccaaggctcttgagggcaaggatgtcaaggacctgctactgaacgtcggctcaggcggcggtgctgcccccgctgccggaggcgctgctcctgccgctggcggtgctgctgatgccgcaccagctgctgaggagaagaaggaggaggagaaggaggagtcggacgaggacatgggcttcggtctcttcgactaagcgtctcgtttcccttcctttcttcgacatttgcctttctcggggttgcaaaacggattcatcagcgggcatattcccattgctggggtgggacagtcacgactattcggtgacacgacttgcatacgggccctcccggaagaacaaagacggcgtcatgagatatgttaggtcggcaggtcaatgaatacttcgaaaagtgcaaaaaaaaaaaaaaaaaaggccccta

SEQ ID NO: 5620 - DNA, 641 bp, Sorghum bicolor
  unsure (1)..(641): unsure at all n locations
  Clone ID: SORBI-28MAY03-CLUS19368_1
tgtgcggcgctcgagncggccgggtccagacagtgcctggctcctgcggcggtcacattccggcgacggcgaggaagaccgcccccttgctctctcggcgcccacagcatcctcctcctcctcgtacactctcgatgagtctccggatggtcccgtggaggctttctccgaaccgctcgtggaggtggaggtggtggacgaggatgaagggagccgcgctcgagaaggttcatggagtgcgccgccgccgcgtacaggttaattaggagcatccaggagggatacacgaggggagatcccatcatctattattagtcttcctgcaatacgtatcctggatctttctttcaaccagctctctggccctctacaaggctttgacatggcatcttcacagttggagcttgtgtacttgagcaacaatgcattctcagtttttttcctgaagccttctttcaactaagaagtttggtatatatagatgttagctcgaacaatttgatgggttccgtggaccttagccagttttgaaaaaaaaaaaaaaaaaaggcccctatacaatgggttgcatgtcatgcatgcatatggtaacaatcctttggctacctatttgaatggacttcatggattagggcttgcaa

SEQ ID NO: 5621 - DNA, 682 bp, Sorghum bicolor
  Clone ID: SORBI-28MAY03-CLUS1937_1
tgcgccgctcgagccggccgggccggaaggaacggcccatgtcgcagaggcccgtgcgggtgcgcttgctccacgcctccacctcggccgccattctccctcctcgcgtgctctctctcacgtcggctaccgccgccgccctccgccagcttcccagcatcccaggtcttcgtcaggcccttctccggcgagagcactcagatcgtgaacctctacagcctaaagatggcgggattcagaagccttgcacccaagaccaggaacctggtggtggctgggggactgtctgccttcgtgctcggggtctactactacaccatgagagcagtgggaggcacggacgagctgcaggtggcgattgacaagtttgaggagatgaagaagaaggacgctgccagaaactccaacccaggaggatcataaacacgcccttcccttctctgtactaaacttggatctgcaggctgacatgaatgatgcgatagtcaagtcgctcaatagaccaaaaccatgcatgcttctgctactgtgtaataagtaatgggtggtgctcgttatcagaagatagagcttgacagcttgtgctttgaggagagatgtacactcgaatgttttgatcctaatataaagtggccgcaatgtctgaattttcctgcaaaaaaaaaaaaaaaaaggcccctag

SEQ ID NO: 5622 - DNA, 669 bp, Sorghum bicolor
  Clone ID: SORBI-28MAY03-CLUS19158_1
gccggccgggtcgggagtgactttctagatgaagctgagaatactaccagctcacctcctcaactaacccaacagccaaaaatctgtcaaaatgggtcgcgtcaggactaagactgtcaagaagtcggccaaggtcgtcattgagcgctactacccgcgtctcactctcgacttcgagaccaacaagcgcatttgcgatgagatcgctgtcatctcctccaagcgcctgcgcaacaagattgccggctacaccactcacctcatgaagcgcattcagcgtggccccgtccgcggtatctccttcaagcttcaggaggaggagcgtgagcgcaaggaccagtacgtccccgaggtctctgctctcgacttcacccagaacagcgagagcggcatgctcgacgtcgaccaggagaccaaggacctcctcaagtccatgggcttcgacagcatccccgtcaacgttgttgccgtccagcagcagcagaccgtcgagcgcccccgccgcttcggcgatggtctcccccgtggcggccgcaactaagcgccattttcagctttgtgcaccgcgttacggcgagcttgaacttgccatggagggtcggctatggttgagtagaaatacgaatacattgccttctccccgaaaaaaaaaaaaaaaaaaggccccta

SEQ ID NO: 5623 - DNA, 729 bp, Sorghum bicolor
  Clone ID: LIB5051-003-A1-XP1-F12
gccggccggattcaaagcgggatccactaacccggctttcccgccccttcccacgacaacctcttctcccagctcacacaacaagtcgccaaaatgggtcgcgtccgaactaagaccgtcaagaagtccgccaaggtcatcattgagcgttactaccccaagttgtcgctggacttcgagaccaacaagaggatctgtgatgagatcgccatcattgcctccaagaggctccgaaacaagattgccggatacaccactcacttgatgaagcgtatccagcgcggtcccgttcgtggtatttccttcaagctccaagaagaggagcgtgagcgaaaggaccagtacgtccccgagatctccgctctcgacttcacccagaacagcgagtctggctcgctcgacgtcgaccaggagaccaaggacctcctcaagtccatgggcttcgacagcatccccaccaacgtcattgccgtttcccaacaacaagttgtcgagcgcggtccccgccgcttcaacgaccgccccgcccgctcgtagatacgaatgcgcaagtgcgacccgccggtctcccttcttcctcctttctcggcttactgaaaatatggtgtctgggaaagggtttctgccacgactatggcatggttttacggctatatacggcggcatgatgatcaggagccaatgaaacaaaaggttctcccccttaaaaaacaaaaaaaaaaggcccta

SEQ ID NO: 5624 - DNA, 629 bp, Sorghum bicolor
  Clone ID: SORBI-28MAY03-CLUS18393_1
gcacgaggtaacatcgtgcctttattttccgtggacccaaaccgtacccatcgtggtcgtcctgctcctttcccccaaccgtaccttgctcccacagaaatccccaccctcgaccagcgtcgcccttcgctgcccctaaaccctagcggacggcggcatcgctcctctcaaccgacggcggcgctgccctgctcccctcgacctcgaccgacgatggcctagctcctctcgactatggtggcatcaggccctctccggccgccgctgcctgttcacggtcgcggtcaggccagggatggtcagaagctgcagcgcgtatggcggatctagcgcggtcagcctggatccggctcctggatggcgagaggtggtgagtggccactgctgagtggacactagatgaagggtggcgagatgagcattaatctttccttcccttttgttgcctccccttccttgcctatggaatgcactgatgattgtatctatccttatccaacaaaattggtaccagtacgtattttgagtgctccactactaatcattggtcaggtggggatgcaggtcccaaatcagaataatggcaatggtggtttgtaaattttgcagaggggaacagcagctgcacg

SEQ ID NO: 5625 - DNA, 1018 bp, Sorghum bicolor
  Clone ID: SORBI-28MAY03-CLUS18696_1
gccggccgggccgggacctccttatcgcaacgcaagcagcagcagcagctcacgcccgggcttgcggaggacgccgcgaggaaggaatggccgctctccgccacctcgccggcgcaggccccacctaccaccaccaccaccaccaccacggcgtcgccgcagccaccgcctccctccagctccaccgccttccccttctccttccccttccctcctgccgccccctccgctcccgctctttcaccagggtttatgcgatctccagcaatgacatcagggtcggcaccaacgtcgaggtcgacggcgcgccatggaaagttctagagttcctccatgtcaagcctggaaaaggtgctgcttttgtcaggacaaaaatgcgtaactatgtaaccggcaacacggttgagaaaaccttccgggctggaagtacgctccaggaaccatccctttcaaaggagaccaagcaatttacatacaaggatggtgcccagttcgtgttcatggatctgacaacatttgaagaaagtcggttaaatgaagcagatgtcggtgacaagcaaaaatggctgaaagaggggatggactgcaatttgttgtactggaatgggaagatcattgattttgagctcccaatcactgtgaggctgactgtaactgatactgacccaggggcaagtgatagtgcacaaggaggaacaaagcctgcaaccctggaaactggagctgttgtcactgtgccctcttttgtgaacgtaggtgatgatattctggttgattcaagaactgggcagtatatgaatcgagcatagcgaattgaagaggatttcagatttgaggagtactggttttttgtttgaccattttagtcccattcacttgtacgaatgctctgcgtctttggccccaggaaatttacatttcctctgcatgtgaatcctcactctgatctcaaactctgattatagccatgtacatctttggcttccagataaaaggaaaattgtgttcagaattttgt

SEQ ID NO: 5626 - DNA, 829 bp, Sorghum bicolor
  Clone ID: SORBI-28MAY03-CLUS18711_1
gtacggccaactctgctcggtgccggccgccgaccgccgctgtacggccatcctctgtgtctagattccagccggccgcatccggcagcctactgctgaaagcaggagccgaagagcgtaatcggctaatcgcggccgctcgcccaccagttcctgattactgtttccttcttctgaatctgaagatagatccgtcttcatcttgccttcgattgcacggtttcggggggaacaggcgacggtgatccgggagtatggccgaggcagcgaacgggaaggaggacgccaagaggacaggactggaaggcactggcctaccgctgcaaggcggctcccacggcaaccttcgcagcgctggcagcgaccagcagctgaggcagatgctcgattcgctcaaatcctcaaagtcccctgctgtgatcaactatggtgcctcatggtgccgtgtttgcagccagattcttccatccttctgcaagttcagtgataagttcaagaatcttactttcgtctatgcggacattgacgagtgccctgaaacaacgcaaaacatacgctacaccccaaccttccatttctacagagacggggaaagggttgatgagatgcttggcacaggagaagagagactacatgatcggctatggttgcattcttgattgataggcttccacttccgttgtttcatgaaccatttatgctgaatgtttgtcccgaaatttctacgtatgtaccagcacagttctaatgtcctttcggagaactttgtctacatttattagtcatggataatttattactgccaaaaaaaaaaaaaaaaaaggcccct

SEQ ID NO: 5627 - DNA, 769 bp, Sorghum bicolor
  Clone ID: SORBI-28MAY03-CLUS18744_1
gccggccgggccgggaggcacaagagaaacagaagcacaagcggaggcccaaatatatctcgccgcggccattagccctagccgccgtccgccgccttcctcgtcgccgtcgtctccagctctccgcgcgctgcctgcgagaagcgaggacagccttcgtacatcacctacgtgaaaggttaaagtccgacagcaatggcgaagcatcatcctgatctcatcatgtgccggaagcagcctggcatcgcgattggtcgcctgtgtgagaaatgcgatggcaaatgtgtcatctgtgactcatacgtgcgcccatgtacgcttgtccgggtctgcgatgagtgcaattatggttcattccagggaaggtgtgtgatctgcggaggagtcggcatctcagatgcttactactgcaaggagtgtacccagcaggagaaggaccgggatggttgtcccaagatcgtcaatctcggaagcgccaagacagatctcttctacgagcgcaagaagtatggttttaagaagagatgatctgagaagatggagctgtgtgtggttctctttagctgtgtgttctgttctatggcactgagtactgatactaagagtaggtagctgaggcagcagctttgtattcctgttatgatttgataattgatactgatgcgagaatacagctctgataagttgatatgcgttgtaataactagttcaactgtatggtgtaagagactgtttatgtaagtcgtgcttgatggtattggccatgaat

SEQ ID NO: 5628 - DNA, 920 bp, Sorghum bicolor
  Clone ID: SORBI-28MAY03-CLUS18747_1
ttgtactccaaaccggcaggcggggccgggagtcgtcgtctcatctgccgacgccatactcctctccacctgagtacctgaccggcatccttcccctcctgcccgatccctcgaggcggagatccctaggacggcggccgagatggcggtggcgctggccctcgcggtggcgcttgccgtcgcgtcgctccacgcggaggcggtgtggctggacgtgccacagtcggggaccaagtgcgtgtctgaggagatccagtccaacgtggtggtgctcgccgactattccatcatgttcgagtcccacccccactcgcatcccaccatcgccgtcaaggttacttcaccatatgggaacaccttgcatcacagtgagaatgctacagttggtcaatttgcattcacaactgcagaagctggaaactaccttgcatgcttctggatagacagtgcagagaaaggatcaggagtatctgtgaatcttgactggaagattgggattgcaacaaaagattgggatgctattgctaagaaggaaaaaattgagggtgtagaactagaacttcggaaacttgaagtggcagtacaggccattcatcagaacttgatatacctcaaagaaagggaagcagagatgcgaactgtgagtgaggcaacaaatgcaagggttgtctggttcagtactctggcactatgggtctgcattgcggtatcagttttgcaagtgtggcatcttcaagggttcttcagaaagaagaagctcatttagattgtctctgtttgatgttgcactgtggttcaaatgctgttcaccttggaaagggacaattttgccttgcttggaacatttcacaccagtgatgacctataggcaacttgtactgtatgtagtttaactacgattgaatcgaatatcaatattc

SEQ ID NO: 5629 - DNA, 741 bp, Sorghum bicolor
  Clone ID: SORBI-28MAY03-CLUS1880_1
gaaggtgatgtctctccagaggttcaaggtgtcagtcgccaatgctgtcatcaacgctgagaactccagcttgaagaccatgaacactgaccagctgcttgatctgttcacatctacccctgcttcaagaaaagcatcggtccttccacgtggttcaagcgacgagcagagtaaagattccaagaggaaatctggtggcaaaggcttgaagtcaattctgaatgggctggatgagctttgggatcagtcgcagtatgctgttgagtacgatctgaaccagttcctggcgaagctgaacggctgagcataggggatcaccggctcgtgtacagtgtaaagtaatttgggacgtgtgatctaggtggttcccagattttgttcccacccccaggagatttttttgttgtttaatagggaaggaaaagagaagctcccaaagattagatgcgacatggctaacatataggggttggggttacgatcccaatttttgttcccatttctgttaggaggaggtttagggctggtcaccaggggctgtaagtttcgaggagttggatatactctgcttccctataatccaagctgcagctctgatccttacagaattcccttgcttgctcgtgtttcctacaattctccttggccatgtcgttggcgagctgtgcgtttgcactggcatctcgcatgtaatgaagttgccgtgcccccgtgtactttcgagccctgcctcacttaatc

SEQ ID NO: 5630 - DNA, 529 bp, Sorghum bicolor
  unsure (1)..(529): unsure at all n locations
  Clone ID: SORBI-28MAY03-CLUS1957_1
gttgactgtctttctcagcataattgctgctcagggactaggattggtaattggagctaccctactggatatcaagaaggcaacaactctagcttcagttccggtcatgacattcatgctagcaggaggcttctttgtaaagagggtaccgccgttcatctcctggctgcgctacctgtccttcaactaccacacgtacaggctcctgctgaaggtgcagtacgatcccgtgccggacatcctgaccaccacgaaacacatggacaacggtgccaccgagggggcagctctcgtcgcgatgatcatcgggtaccgggtgttggcctacctgtccctgagaagggtgaagggcggaagcagctagcgcatcgcttcacttgcctgtgcgcgcactgactgaagcctgagctcctggaggctgcaaggttgggtgtgtatggaaagttgtgttatattgcgctgtgaaaagatggaattcttntttacttttccggctttttcaactaaattcaaagcaaaaaccaacact

SEQ ID NO: 5631 - DNA, 366 bp, Sorghum bicolor
  unsure (1)..(366): unsure at all n locations
  Clone ID: SORBI-28MAY03-CLUS1965_1
gcgtggtagcacgagaaaggtccagccaatagggccaccatagctctcagagcagcggcagaggcctcacctgaagctccgtccgccatggcattcacgcccgctacggcctgctgcaagccttccctggcgctggcgccgcgggcggcgtcgtcccgcgcgcaggcggcggcgctcctctgcacgccctccacctccgcgttccgcggcctccgggccgcgccggccccgccgcgctggcgccgctcggcggcgtccacgggccttcgctgcggcaaggngagcaagggcagcgngccaccaaactncactctcaaggaccagaacggcaagcccgngncgcngaacaagnncaagggcaagccc

SEQ ID NO: 5632 - DNA, 790 bp, Sorghum bicolor
  Clone ID: SORBI-28MAY03-CLUS19708_1
gggggagggggaactgctaggttgctaggggaagctgggtggacgcctgatcagtggggtcactctaaatcacgatcagcgttctccccggactataatacttacagacaacaacttgctaaccttatgcggacattgttgaagaatctgagtgaacatcctgatgcttggccatttaaagagcctgtggattcacgagatgttccagactattatgatatcataaaagatcctattgatttaaagacgatgttaagaagagttgactctgagcaatattatgtgaccctagagatgtttgtagccgacatgaagagaatgttcagcaatgcaagaacttacaattctccagatactatctattacaaatgcgcaacacggcttgaaaatttcttctcaaccaaaattgcttcactggtttcccaagcctcaaccaagagctagactggcgtgggctcgctggacactgttgtcacatgcatgttgtaagattattaagttgtatctgatatagttgtcgccttgctgaatgttcggcacggcgatgaacttttaggttagtatgctctttattttaaccaggtgggacactgatttttacgtattggggttcaacctggcgggcctactaatatagattgaggagattctgtagtttccagcacctatgggtaaagatgtttttcagcatctttggagaactaaattgtaacctactcagaatttggtactccctcgattctaaatggtaagtcgcttttaccaaaaaaaaaaaaaaaaaaggccccta

SEQ ID NO: 5633 - DNA, 670 bp, Sorghum bicolor
  Clone ID: SORBI-28MAY03-CLUS19913_1
accaagagcaaaatgatggtactgatgcagtggatattcagaagtcaagttattctgtctcatgccggcggcttcaatatgctggaaagagtgaagatgacctattgaaagaagtaaatgatacaaaacagtttgtggtcacatccttggccacactttctgcccaatttcctgggaggtttggtcctgtcattgagcagcatgtggacccagcgaacaaaagtgtgcttcttcaactttgtgcagcctacaatgccaacattgtctaggagccaattgcatttgaaggcatatgcttgtcttctaatgggtcttgtcgaagatgaatctattggagttgtctgtctgtcaagattttctggtgccatccttgtttgtttggtggcagggtgttggttgtgtcatgggaagggtgcatgcgaaaacatgcaaggaaaaacattagctttgtggaggatttgtctatttggtttggctgaggatttagtttcgaggctgaggttcctttttttggggaaagtctaatggtgtactggtcagatgtacctgaaagtcctggatcaatggttgttggaacgcgctgtaattttgccgaaaaaaaaaaaaaaaaaaggcccctatattctgcaggtgcgtggccaaaattgaccaagggaccgtatagtcaact

SEQ ID NO: 5634 - DNA, 823 bp, Sorghum bicolor
  Clone ID: SORBI-28MAY03-CLUS1992_1
gccgtatccgtcctctgctttttcttgtgcttctctttcactgcgccaagccgtcacaaatggcgacccgcgttctgctgatgcttcgcgaaacctctccgtgggcgctggccggcgcggcggcgtccgtggcgctgctgtggctggtggcctggacgctggagtgggcctggtggacgcctcggcggctcgaccgggccctgcgggcccagggcctcaagggcaccaggtaccgcctcttcaccggcgacctgagggagaccgcccgggttaaccgggaggcccgcaagaacccgctgccgctcggctgccacgacatcgccccccgcgtgcagcccatgcttcacagcgccatgaaggaatacgggaaattatctttcacttggttcggcccaacgtcaagggtgatgtttccagacccggagttagtcaaagaggtgttgtctaataagtttggccactttggcaaaccacggagcagccgcattgggaagttgctagccaatggggtagtaaatcatgatggtgaaaaatgggcaaagcacaggagaattcttaatcctgcctttcaccatgagaaaataaagcggatgctgccagtattttcgacctgttgtattgaaacgattattagatgggagaattcaatgccttctgagggatcttctgagatagatgtctggcctgagttccagaatcttactggagatgttatctcaagaaccgcttttggcagcaactatcaagaagggaggagaattttccagctgcaaggagaactagctgaacgccttattcagtctattcagaccatatttatccc

SEQ ID NO: 5635 - DNA, 482 bp, Sorghum bicolor
  Clone ID: SORBI-28MAY03-CLUS1904_1
cttcgccgtcaagctcgagagcaagaaatggccgtcggagctgaccagccggctgtttttccggttcgtcgtgctggctctgggaggggtgactggattccaggccctgatgctgcaaggcatgaagatgacgtccccggccattgcttccgccatgcccaacctggcgcccggcttcatcttcgtcatctccggttgtctcgggttcgagagggttgacctgaaatgccggtacacgagagccaagatcctgggcaccgtggtctgcctggggggcgccgtggccatgagtttcctgcagagcccggacgcccggtcggggcacgtgctgccgcgatcgccggaccacgccgcgagctgggtggtgggctgcgtgtgcctcctcggcgcggtgctcgtgctctcgggcacgatcgtcatgcatgcggcgaccatgctgctcttcaggcgcccttcacgctctgctccgtgacgtcgctgat

SEQ ID NO: 5636 - DNA, 418 bp, Sorghum bicolor
  Clone ID: SORBI-28MAY03-CLUS1909_1
cgtccgattcaatttgccaggtcaatacttccaagatgtgaatagtgggggagacattggtgaggctcacatagccaagcttactggttttcggctcttctgccttctgaatgccactgctctcttcatttctctcgcggtggtcgttgtgcagatcaccttggttgcctgggaaactggtgcccagaagcaaattatcaagatcgtaaataagctcatgtggacggcatgccttagcacaggtgcggcttttatctcgctggcctatgttgtagttggcccgcagcatgcgtggatggccttcacagtatcagccataggaggaccgatcatgattggaacccttctgttcctagactatctgctggtgcgcccacgggtcaaggttggcgaagacagacagcgccgcattaagagg

SEQ ID NO: 5637 - DNA, 799 bp, Sorghum bicolor
  Clone ID: SORBI-28MAY03-CLUS19153_1
gccggcctcctcgacatcccttgactactactatacaccttccatgtttctctctaacaagctgtcaatcgccgacgtcgacctcaagggcaagcgcgtcctcatccgagtcgacttcaacgtccctctcgactccgacaagaacatcaccaacaaccagcgcatcgtcggcgccctccccacaatcaagcacgctgtcgacaatggcgccaaggccgtcatcctcatgtcgcatctcggccgcccagacggaaagccaaacgcaaagtacagtctcaagccggttgttcccgaactcgagaagctcctcggcaagagcgtgaccttcacagacgactgcgtcggcaagtcggtcgaggacaccgttaacggcgctagcggcggccaggtcatcctactggagaacctgcgcttccacgccgaggaggagggcagctacattgaggacgagggcaagaagcagaataaggacaagagcaagattgaggagttcaaggctcacttggcggctcttcgtaacgtttacatcaacgatggttttgtcactgtccaccgcgcacacagctccactcacggcgttcactcccccatggtcgcatctggcttcctcgtcaagaaggagctcgactactttgcgcaagcgctcgagtacttcaagcgccccttcctcgagaccctccgtcctttcctcgcctccgtcggtggtgcgctgatcgacgaccagatcgagctcattgacagcctcatcatctaggtcaacaccctattcatcttcggtggtatggctttcaccttcaag

SEQ ID NO: 5638 - DNA, 651 bp, Sorghum bicolor
  Clone ID: SORBI-28MAY03-CLUS1919_1
ctgtccgattgaagcgtcgtccgatgctttcttgcatttgtttacactgcaattgtggcaatattgaaatcttatccgtcggctggagattcagctctgtatcttggtcttctgggtttatttgtcaatgaattagcagaaatgcagttcacattcttcttgtttttcggatatattggagtctccctacttagccctgtcatgcataatctgtggatctggaggggcactggtaatgcaaatttctacttcgccactggtttggcttatacttgccttcagactgtgttgctggtagagagtgtaagttcaatgataaagcacgacagaaagctaaggttacttgttacaagctaacttggtacatcagacaattcagaagctcaagtggccaacagctccgatgcttgcaattttctttctggcgctcttgattcttgaacacaaacagctcctgaccctggagtttgtagatgtagctcatattcggtgtagcatgttgtattgtagaccccccacacttgtacaatacgaggaccacaactcctttaacaaagacagaacccgacagggctcgcccttggtgactaaactcgtgctcgctaccgagcattgtgatgattctgtgatctttagtgatgcagcttggtg

SEQ ID NO: 5639 - DNA, 1015 bp, Sorghum bicolor
  Clone ID: SORBI-28MAY03-CLUS19277_1
gtgtgcggcgctcgacacggtgtgagctcataccgcacgatccacgactccgcctccgtcgtcgctcgttccccaggccgcgcgcgcaggtggtggcggccgttgttcctctaacgccgttgcaggcaccagatcggcgcagagttagggttcaccggagcggcgcggcgctcccgacctctcgtcatcagatcggcgcgtcactggaccggctgccgtcctcgcccggggcacagcacacgcgaagcccgggtaagccgcaacagtcggcgatgtcgccgccgccgtcgcccctcgtggtgctcccgctcctcctcctcctcgccgctgtatcccactttgcggccaatgtggcaggtgccggcgcccctcccccggtgccgacgccgtggccggagcagttccatgccgtagttttcacaaacctcaccgagagcggcggccggctgcagctgatcgacctctactacgactggcccaggggccgcaacctcaacctcatccgggaccagctctccggcgacccgctctacgacgttgagtggaccaacggcacctcctacttcttcgactccgggtcctgccgcaccgtgcgtgtccccgtggggctcctgccgcccgactggctcgccgccggcgccgtctacctcggccgcgagcacgtcgacggcttcgactgccacctctggaccaaggtcgacttcatatggtactacgaggaagtcgccaccggccgccccgtccgatggaatttcttcaatgggatgcagcagcatgtgatgagttttgaggtgggaggagtgctggaagactccaagtggcaggcacccgcttactgcttcatggcggcaatgccgacaccgccaatgtggctgcggatggagttgatagtgatgctggtagatccagtagagttgatgttgatgtgatgaacagcctgatcaggttcgccggggctccagctgtagctgcatcatttgaccagtgagatttttttttttgatgattgagctga

SEQ ID NO: 5640 - DNA, 691 bp, Sorghum bicolor
  Clone ID: SORBI-28MAY03-CLUS20061_1
gccggccgggccgggatccaacaacaatcttcacatctaacaacaactactcaactaccaacactctattcttcaacctcaaccctcaaatcaacttcatcaaaatgcagttcaccaccatcgcctctctcttcgccgccgctggccttgccgccgctgctcctcttgagtctcgccaggataccgcatcctgccctgtcactaccgagggtgactacgtctggaagatctccgagttctacggacgcaagccggagggaacttactacaacagcctcggcttcaacatcaaggctaccaacggaggaacactcgacttcacatgctctcactcagccgacaagcttgaggaccacacttggtactcttgcggcgagaacagcttcatggacttctctttcgacagcgaccgcagcggtctgctcctgaggcagaaagttagcgacgacatcacctacgtcgctaccgccactcttcccaactactgccgcgcaggcggtaacggccctaaggactttgtctgccagggtgttgccgacgcctacatcaccctcgtcactctccccaagagctcttaagcgatatttggtcgagcatataagaagcatcaacttctcttactgtaattttttttagcgcattcaagatagacattccttattctagacttaatttaaccatttatctggtc

SEQ ID NO: 5641 - DNA, 661 bp, Sorghum bicolor
  Clone ID: SORBI-28MAY03-CLUS20136_1
ctcgagggccgggcggcggccgggagccaacctctgatccccaaccaggccacaacaagtcaacgagacgagcttcccctccggaacctcaggagcagagccgagggagagagggagatcccagcaaatccgccaccatgtgctaccaggtgaagtgcggcacctgcggcaagccgacatgggcggggtgcggccggcacgtcgcgtcggtgcacgcgcagatcccggagggccagcactgcgcctgccgcggctggcccggcgtcgcccccgtagagaagaaggccgccgccgacgatgctgggaaggcctccggcggcaccgtcgcttccgctcccgctcccgcggaaggcggcgctgcgcagtgagattggcgtcggcggttggtgttctgtgtcccctgacgatctggggtcgattgaaacccctccgtgtccatggaacgaaacgtgtggtcgtcgtgctaccagcgattgtattgtatccacttctccgtgttgcgtggtctaatttggtactgtaatgaacactgtccgcactttgatgcggattgaccaaataaatgtctcattcttcacaattgtgtagttagtgcacttccaataaaagtttaatgataatttttatctctattgaaaaaaaaaaaaaaaaaaggccccta

SEQ ID NO: 5642 - DNA, 791 bp, Sorghum bicolor
  unsure (1)..(791): unsure at all n locations
  Clone ID: SORBI-28MAY03-CLUS20159_1
gcacgaggcgggctcaaaagccgccatgccggcgccaccgagggcggaagctgtccagatcgcgtgatttcgcatcccgttggcgagggcgacacacgctgaccttaccaggcggcctgcacctccgtcttgaggcgaagcgcaggagcgtaggagtctgccatggccggcgagaataaggtctttgggttcgaggaagtcgccaagcacaacgtcaccaaggactgctggattatcatcgccggcaaggtgtatgatgtcactccatttatggatgagcatcctggcggagatgaggttttgctagctgtaactgggaaagatgctactgctgattttgaagatattggccatagtgattccgcaagggacatgatggagaagtaccacatcgggcagatagatgcttcgacaatcccagcaaagcgtacttacgtccacccccagcaagcgcccagccatgcagacaaggataatgacctcctcatcaagatcctgcagttccttgtgcccattatgatcctgggccttgcatttggtatacggcagtacaccaaatcagagtagtatactattcttagaggcttgcctttggagtctgttctatggtcatggttgggatgaaaacagttcaataattgcttatagtgtatttgtcaggtggatgttatctcattggtcatatgctactctgtattatgaacatccatgtgttgccgaaatgtgctncttttcccatgaccccatgaactgangcatataagatggtttctgactcttcatgatagtat

SEQ ID NO: 5643 - DNA, 755 bp, Sorghum bicolor
  unsure (1)..(755): unsure at all n locations
  Clone ID: SORBI-28MAY03-CLUS20077_1
gccggccgggtttggtgaacgctgcggcccctgaagacgccgcccttactgcaactgtttgatcgatgtatgccgcaaccatggcttccctcctcagagagcaagagaagtcttccatcttgcccagacctacggtttgtacaccaagctacaaagcagaaaggatgaggagtggtcgctggacctgcgatcgctctcggttggtgcagccaagacagcattcgatgattggatgcagactgtctcggagcgctgggtgcagcaaaaggctttgccagagtccttcagcgtttacactgggtccagcacccacaagtttgcgcaggggctggcaagtgctttcgctgctcatctggagcaaatggcggtgccattccatgcgagtgaatctcaagctggcagcttcatcagctcaagggatgatctggtctcatggttgcagatgagcagttcgtcagcagtcgttgccggatgactgaatataggcgcagggctgtagctgcacaatactctaaattccaaaggagggctgaataagcaactgggtgctcatgcatttgttgacatgtagtttgtagggaaacgcataagcaacttcaacgctcttccatagttacaaaattagcagtagcaacaagccgctcttgaaacattggccgattgtccggcttacactgctggttttgtttctgaaatttaaatgccactttaaataccataaaaaaaaaaaaaaaatgnataatctttggatggtt

SEQ ID NO: 5644 - DNA, 590 bp, Sorghum bicolor
  Clone ID: SORBI-28MAY03-CLUS20178_1
gcagcaacaccacgtccagttcggcggcgccagcatcgacggcgaggcggcgcacgggcaggagcattaccggggccttcagggcgccgggtttcacctcctgcgtgaccgccggcggtgatccgatagatccaccaccgtcggccgcgagctctagctgcgagtgagttgtgaccgatggggacgtcgtgccggcgcctagctagctacgggtaccgctgctgccggatgcatggcatgcacttgcgcgcgcgcgcgcccatcggccagcaaacgctgtgtacgcacctgatttgtttggcttgttgcttgcctggctcagcatgcacgccgctctcggtctcgaacgccaccgccgctcgtcgtcgccgccggcgtgcagtttggccggcgctagctacctgccggagttatatactatatgtattatgtagcgtgtgtacagatcgatcggattttggatcgcgagcagtttggacgcgcgcaggtgcacctagagtagtagcccgccggaactgcgtagttgaaacacgcatgcatgcagcttaattgcattgtttgtcaaaaaaaaaaaaaaaaaaggcccctaa

SEQ ID NO: 5645 - DNA, 530 bp, Sorghum bicolor
  Clone ID: SORBI-28MAY03-CLUS1943_1
cgtccgacttgtgtggtttgaagctaattaagaagataagtttgcaaagcaacagattgacttcaatggatgggtttcaggaatgtactgcgttagaggagctgtacctcagccataatggaattcaaaagatggaaggcctctctaccttgcagaacctccgcattttggatgtttcatctaacaagctaaccactatagaaaatattgaaaccttaaccaggctggaggacctgtggttgaatgacaaccaaataccatctctagatgggatagagactgctttggctggttcgcgggagaagttgacgacaatatatcttgaacgaaatccctgtgcaaaaactccagagtactcatcgacattgaagaaaatatttccaaaactcgagcaaatcgattcagatatcatagcatgaaagctagctaatcattgcacagatactaaggcgaagtaaggcttggggtcttgcggggggtcatcagcagcaatcaagttgtgctccagtaatatccactatttgatcatc

SEQ ID NO: 5646 - DNA, 671 bp, Sorghum bicolor
  Clone ID: SORBI-28MAY03-CLUS19495_1
gccggccggcggcgcgagatcacggaacactcgcaacaccgccaaagatgcagatcttcgtgaagaccctgacgggcaagaccatcacgctcgaagtcgagagcagtgacaccatcgacaacgtcaagtccaagatccaggacaaggagggcattcccccggaccaacagcgcctgatcttcgccggaaagcaactcgaggatggccgcactctgtccgactacaacatccagaaggagtcaaccctccacttggtcctccgtctccgtggtggtatcattgagccttcgctgaaggcgcttgcctccaagtacaactgcgacaagatgatctgccgcaagtgctacgcacgtctgccaccgagggctgtcaactgccgcaagaagaagtgcggtcacaccaaccagctccgccccaagaagaagttgaagtaaactactcgcttctatcggcgtctggcgaagagagcaacggggtcggtggatacgaattgcaacgattgcatgcgatggatatgagggctaggtcactactacttcttccacggcacatggcatcaatggagtgcttgtcttgtctcgcatttgagactttatgaagggaaccaggcatgtagagtgaatcgattcaaattcaaaaaccaccaaaaaaaaaaaaaaaaaaggccccta

SEQ ID NO: 5647 - DNA, 594 bp, Sorghum bicolor
  Clone ID: SORBI-28MAY03-CLUS1949_1
ggaggactgcgagttcgccgatccggcgggctccttcagaggcctgcggcgattcaaacggaactgcaacaactttgggtctctgctcgagaaatccaacatgaagctcaccaaatgggaggacatggaggacaagtcaatcgggcactggcgtttcagctgcgtcatgtcgttcccgtggaggcctatcctgtcagcaaccgggtacacggaatactacttcgatgctgagtcagggaaggtgtgcaggcacgtcgaaaattggaacgttcccaagatggcgctccttcggcagattttcaggccgagccgatgggtctgggagaagcgctaaagcctgcacgggccaggttttttttttcggtgcatgatcatcagcatccttatgctccaaaccaaatgcatgtgcgtgtacgtagattcgtaaaacacagtaggaaggacacagtatataaaaatatggattgtacatggacttggcccacgtaacagagaaagggcccatgttacacggcctagattctgtaaccttcggccgcatagcttcatgggcttggcccatgttacacagactgggcctcctagggtttcttc

SEQ ID NO: 5648 - DNA, 461 bp, Sorghum bicolor
  unsure (1)..(461): unsure at all n locations
  Clone ID: LIB3481-001-Q6-K1-E12
cgtccgatgggaggacatggagcgatgttagtcattggtgatgaaaaacaaacaaacaaaaatccactgatcggtgccgctgctctcgttgcatccgggtcgcaggacaagtcaatcgggcactggcgtttcagctgcgtcatgtcgttcccgtggaggcctatcctgtcagcaaccgggtgcgcggaatactacttcgatgctgagtcagggaaggtgtgcaggcacgtcgaaaattggaacgttcccaagatggcgctccttcggcagattttcaggccgagccgatgggtctgggagaagcgctaaagcctgcacgggccaggttttttttttcggtgcatgatcatcagcatccttatgctccaaaccaaatgcatgtgcgtgtacgtanattcgtaaaacacantaggaaggacacagtatattaaaatatggggttggccatggacttggcccac

SEQ ID NO: 5649 - DNA, 812 bp, Sorghum bicolor
  Clone ID: SORBI-28MAY03-CLUS19535_1
cgcggctgccgtccccggtcctcctcctccttctcctcttactcgcaaagaaatcatccccttcccctcgccaaaccacaggaagaagcgaggaggccacccagatcccaccttctcgagcgacggcgatggcgatggcgtcggtgccggccgcgccctcgtcctacgggtgcgcggcgtgcggcgcggacctgaacctgtcggcggcgcacctgtacccggcggacttctacttcgaggcagggaacaagggcacgctgtccttctcgtgggtggacgagtcgcgcctgcggttcgcgcccgaggaccgcatccgccccttcttcgagaccctcgactactggggcatccagcggaagcgcacgcgcatcagctgcgacgcctgcggctgcctcctcggctacgtctacgacgacgggccgccggtcatgcagggcaccggccagttcgggatggggcccagccaggtcatcccgcgccgccccaggtaccgattcaagatcaaggccgtcgccgccacctcctcgccgcctgccgccgccgccgcgtatggaaagtgatcctccgtagatttctgcgtctcgtttcgagtctggttgcgtgtcatgtcggctgtcctgctatggttccttttcctgtaattttttttaacgtaattcttacctgtgtatattaacttttcttcctgtaattcgtgtcatgcggtgtttttcaacttgttccttggtgtcaataatctttttttttatcggtttgcggtgaatttgaattttggagaatggatacaaaaaaaaaaaaaaaaaaggccccta

SEQ ID NO: 5650 - DNA, 620 bp, Sorghum bicolor
  Clone ID: SORBI-28MAY03-CLUS19532_1
cagcaaagcaaaccctatttaaaaccggcgggccggccgggtccaaaaaggtttcccacccagatccggccacgccgcccgctccccttctccgccgcagcgatggtgtacgtggattcctgggacgagttcgtggagcggtccgtgcagctcttccgcgcggaccccaacgccacccgctacgtgatgaagtaccggcactgcgaggggaagctcgtgctcaaggtcaccgacgaccgcgagtgcttgaagttcaagacagatcaagctcaggacgcaaagaagatggagaagctcaacaacatcttttttgctctcatgactcgtggtcctgatgctgacatcagtgaagtttcagggaaggaacaggccgagcaacagcaatcgaagaaaggtcggggaaggaggcaatgatgccagtctgatccttatttctttcagaaaattcacaactggaatggtggattgacatttcattgactcttgttgccccctctgctatggtactctgaaggaagtttttccagtacagaactgagaacaaactgaatgcacactatcatgaattcatgattgaaaaaaaactcaaaaatcaaaaaaaaaaaaaaaaaaggccccta

SEQ ID NO: 5651 - DNA, 1037 bp, Sorghum bicolor
  unsure (1)..(1037): unsure at all n locations
  Clone ID: SORBI-28MAY03-CLUS1920_1
cgcgtccgcccacgcgtccgattgatttcantagtnttgtgtttctgttttttcctttgctgtgttatttaggtttttgtgtcttataaagcatgtaaattatttttaaggtctaatttgaaagataagtattccgtgtttaaatgctttatttgctccatatgaaatcgcaggatttgtgcatacagcattcaatttcttctatgaggcaggcattggaaaaggcaacatccagggaatgatcccacaaggtgccttggtgagaatcgtgcagaaaggtcttcagtacattgaacttgaagcaaattctgagattggcaacgatgacgagcaccacttttttgaatctctggacctaatggccaatgatttagatgacctgatgaagaaaattaccagcagtgggaagcacagttctgtcaagaacgaaaaagagcagaagatcgattcagttgagactgacaaagcacagatgattggtttttctgagactaccacaacttataggaagcaacctgtgcagaaaacaaaggctgcacagaacagcaaacctgatgagactgctacaatgcgtagagctgagccagtgaagcatgtgaaggcacaaaacatcaattctgctgagactgtgcaaaataccagttctgttgaggctaccgcaggactggggtgccatctttcgtggatagggaggaaacctagactcagaaaacgaaagcactgaaagctatacaattgaagaaactgaagttagacattcaaatccattgctgattcagagtgtggagatttgacaaaatttgtgacagataccattcagtttctgatttccttggcagtatatgaaagtacataagtagggctgcattttcatacaggcagttttacaactcgtatatcttataaattgttagttttagatcgatgactgttatcatgtggtagttctagtgcactggttctgtaaagcggataggttttcctttcccctcttttgtagtagttagacatatgaggttgcctttgacaaaattagg

SEQ ID NO: 5652 - DNA, 356 bp, Sorghum bicolor
  Clone ID: SORBI-28MAY03-CLUS20440_1
gccggccgggtgctcaccacgcccaccacagctagtccattgacgcccgcctcagggttagcgagagctccccggccgggtgctgctgccgctcgatctgccatggccggatcctgctgtttccaagcaggagggggagtaggctgtagtagcagcagcagcagccggacgacgacgacgacgcggcggcgaccatcattaacacagcagccgccgtggcggaggctggtgctggtgtttctggtcctcctgctgctggtgccgagctgctgccaggcgacgcgaggcatgcagccgttcagggggaagccactggaggcaggcagcgccaaccatttcctggggtgcttgccgcg

SEQ ID NO: 5653 - DNA, 1066 bp, Sorghum bicolor
  unsure (1)..(1066): unsure at all n locations
  Clone ID: SORBI-28MAY03-CLUS20702_1
gccnggccgggttttccggacaccacttctacactcaccctctgtgaacattcagacacccaacaactaccgaatacacacagcacacccacaaccatgcagatcttcgtcaagaccctcaccggaaagaccatcaccctcgaggttgagtcttctgacactatcgacaatgtcaagagcaagatccaggacaaggagggcattcccccagaccagcagcgcttgatcttcgccggcaagcagcttgaggatggtcgcaccctgtccgactacaacatccagaaggaatcgaccctgcatctcgtcctccgccttcgtggaggtatgcagatcttcgttaagactttgaccggcaagaccatcactcttgaggttgagtcatccgacaccatcgacaacgtcaagtcaaagatccaagacaaggagggcatccctccggatcagcaacgccttatcttcgccggaaagcaactcgaggacggccgcaccctgtccgactacaacattcagaaggagtccacactgcaccttgtcctccgcctgcgcggtggtatgcagatcttcgtcaagaccctgactggcaagaccatcacgctcgaggtggaatcaagcgacactattgacaacgtcaagtcgaagatccaggacaaggagggtattcctccggaccagcagcgtctcatcttcgccggaaagcaattggaagacggccgtactctctccgactacaacatccaaaaggagtccacacttcacttggtgcttcgtctccgtggtggtatgcagatcttcgtcaagactcttaccggaaagactattacattggaagtcgagtctagcgacacgatcgacaatgtaaagtccaagatccaggacaaggagggtatccctcctgaccagcagcgtctcatcttcgctggtaagcagctggaagacggccgaacgctctcagactacaacatccagaaggagtctactctccacttggtgctccgtcttcgtggcggacaataggtgcgctgatggttatgatggttgacgatagttctgcacggcgttcacagga

SEQ ID NO: 5654 - DNA, 713 bp, Sorghum bicolor
  Clone ID: SORBI-28MAY03-CLUS2069_1
gcccgcggccccccaccccctccccgccccccctcgccccccccccttccgccccccccgccccccccgcccccccctccccccccccccgccccctcgccccccgcgcccccccccccccccgccgccgccgccgggccgcggcggcggggcgccggcgcgggccgccgccgcgggcggccgcggggcgacggcgcggcgctgcgccggggcgcgcggctgggtcgcgcgggtcgtcgtggacggcgccgcgccggtcgtcgggttcctgcgctacgacgcgctccgcccccccctccgccgctgcgccccgcccccgtgtccgatttccctttgttcagagctgcaatcgaccttccattgatacccttatgacctgcagacttgcgcatggatgttagagatatgagtatgtttcctgacgagtcgtttgattgtgcaattgataaaggtactctggactcattgatggtaagtaggtaacataagtcaccgtgtccctttgcttatttctggacttcttcaacaatgccgtcttgctgctttcatagtgtggtgtggatgctcctctcagtgcagctcagatgattctggaagtggacaggttttgtagaccagggctgcccttctgaagtatcactcttcagtgtcatctgcaccaagatatctcgtaaatttcaacagccctgcagccttattagttatttactttt

SEQ ID NO: 5655 - DNA, 1009 bp, Sorghum bicolor
  Clone ID: SORBI-28MAY03-CLUS20719_1
gaaaaaaagccataaaagagagcgagctcgcagcgcagatcgaacgggagaagagaacaagagataccgccggccgccagctcacccttctccagttctccttccactcccacactcccagccgagctcgcgcgcacagcatagcacagcacacacgcgcaggcaggagctcctgctagatcccaaactgtcctctgcccgcccgcgcgcgttgcgggggcgcaagcaaaggatcatcggatggcgacgatgttcgcgcggccgctgctggccgccctgctgctgccggcgttcctgctctccgccgcctcggccgccgacagcaaggacaaccctgccgatcagctcgttgcattgatcaacagcaaccgtactgccagcaaggcttctgctgtttctgataatcaaggtttaggatgcattgctctgcagtacatcagagcatatgaaggtcattgtgaccaggtggatgacaagaagccgatggagtcaagtttcaccgacacatttgccccaacctgtggcgtccaagccacaactctttccaagattactggtaggcttgtgggctgccagtccaagtatgcgactccagctgaggcctttaacatcctggtgaatgatgcgaagggccttcaaatattgcacagcaagaaccacacagaggttggggcagctgtgagtggcaccgatggtggtggaccttacttctggtgtgtcctgttcagtgacgggaagcctactaccagcttcaaggtggatggcgaagtgcccaaggcggccatccatccagggtgcttcagtggcaacaatgacgactgcatgggcgcgacgaatggcgccatttcgaccaatgctggtgcatcgaggctggtggcggcccttccttttgctgtagcttgtgcctttgctttgtgagcttgtaagtaggtgtgatgttttcggccattattttgatttgtgaaaaggagctgaacaccgtatcctgtttgcagtggcacgccattat

SEQ ID NO: 5656 - DNA, 561 bp, Sorghum bicolor
  Clone ID: SORBI-28MAY03-CLUS20746_1
atgccggccgaccccatacggctttgagctggcgcctgcctgcaatatagaagtagacatgacgatgggtcccaaggactttgtactcagcgcttgctgcctgttcctgctagcacttgcactcgccagccagcgccaggtggtggtgtttgctcgtgacgtgccgacgcatacttccactgaccgtggccgcggtgtggatgccctcggcggccttcccggagccacagaccagagtgatgtatttcgcatccccaaaattccaccgggatgtcgtataccccccttttgccgccgagctcccgccactacaattgcaacgaatccgtgaggaagaacgacgaccagaggccaccagttgccacctactgcaaaagaaaatatatatgtgttactactgaattattatgtgttaaaatatatatgtgttactactgaattattatgtgttactactagctcccaccgtccacctttgtaagtgtatttatttgccatggaaaaacttttgcaatgggctgctttatttctctataaaaaaaaaaaaaaaaaaggccccta

SEQ ID NO: 5657 - DNA, 796 bp, Sorghum bicolor
  Clone ID: SORBI-28MAY03-CLUS19819_1
gccggccgggttccgttctagaaccttctccaatggcgctactccgagttctccggcgagcccttccggcgctctcctcgccggcggcggttctcccccgtcgcgccccgtatccgcttcctcgtccccccgctcctcttcgcttcctggatccgatcgggctccgccccttctccgccgccgccgccgtcaccgcctcgcaggcgccgtccatgggatccaccctcttcggcgggctcatggacacccggttcccgaagcgccggccgggcttcgccaaccgccggaagagggccagcttgcgtcccaaaggtccatactactgggtgaagtgcaagcctgacgagcccattccagccagccagccgaaccaagggagcgtgcgagggaggaaggagaagaagcggatcaagcagcgcaaggactttatcatggctgagaagaagaagcgcagagcacagtattccgctgctgttaagagaaaggaggcagaacggacagaaaggaagatggctgctgtggcaagagatcgtgcatgggcagaaaggttgatagagctaaaacagctcgaggaagaaaagaaagctgcaatggcataaggggctgctatggaaaatggcaaggcgtctaacttgtttctgttgctcagttttctcccccttttttctacatagtctagaatgtcacaattcttgtgatggaagactagttgtaccacttctttcaacagtaatatgaatatcaagtgctgggaacgggttttaatgaaaaaaaaaaaaaaaaaaagcccctaggg

SEQ ID NO: 5658 - DNA, 730 bp, Sorghum bicolor
  unsure (1)..(730): unsure at all n locations
  Clone ID: LIB5051-001-Q1-XP2-A2
gccggccgggttccgattctccccgcgcatccctgctagtaaaaccctagcccatcggggcagccaccttctagaaccttctccaatggcgctactccgagctctccggcgagcccttccaccgctctcctcgccggcggcggttctcccccgtcgcgccccgcatccacttcctcgtccccccgctcctcttcgcttcctggatccgatcgggctccgccccttctccgcagccgccgccgtcaccgcctcgcaggcgccgtccatgggatccaaccttttcggcgggctcatggacacccggtttccgaagcgccggccgggcttcgccaaccgccggaagagggccagcttgcgtcccaaaggtccatactactgggtgaagtgcaagcctgacgagcccattccagccagccagccgaaccaagggagcgtgcgagggaggaaggagaagaagcggatcaagcagcgcaaggactttatcatggctgagaagaagaagcgcagagcacagtattctgctgctgttaagagaaaggaggcagaacggacagaaaggaagatggctgctgtggcaagagatcgtgcatgggcagaaaggttgatagaactaaaacagctcgaggaagaaaagaaagctgcaatggcataaggggctgctatggaaaatggcaaggcgtctaacctgtttctgttgctcagntttctcccccttttttctacatagtct

SEQ ID NO: 5659 - DNA, 913 bp, Sorghum bicolor
  Clone ID: SORBI-28MAY03-CLUS200_1
atgaaggtcggttcggaccgacatgcccagctcgagcaagaggttgttgagagagtggatgtcgccattagatctgcggaagaactatgggcagtaaaattcatcaacttcatcgtgggaacaaaccagctaatgttcgagggcatgacacgggaaattccagtgattgggtttgtcgaaggttcatggatgataggaattatagatgaaatcaaaatgcccacggttggcgtttcattgcaacccatgctggtggatacaaagacacgttccacgcgaacaattccatcagaagcccgaaaaagttccggaaggcttcaactgatgtgttacaagtatctatgggacaatttgaccacacagaaattcccagcagagaatttcttcagctattttgacctggaccccaactacttgttatcagatgatgtcaaggggtatattaactcattgggattcaatgcaaagacctttgaagattattgaaatatttcaaggttacctgccatacactaccacggtctcaagaacagctgctcttgagatatgaactacaggaagaccattccctgcttgaagcatacgggttcacttatgatgctaggtggttcaaggatcaaatccaggaagtcctcagcttctggataggatcacatgaacctaaatttgtagccgaagaggagaggtggaagtgccgtttctgcaaatttgtgtcagattgcccaatgactgcttccatgccaagattttgatactaacaaaaattgctctgaattggtggcttggtgaaatatttgatgctgagttctgtagcctggagatagtctagctttaatcgcctctttgtttccacaggcgcgtatgtaattttaacattttggggtgttgtggtttgtgttgtatttggggtctc

SEQ ID NO: 5660 - DNA, 463 bp, Sorghum bicolor
  Clone ID: SORBI-28MAY03-CLUS19996_1
gccggagggccgccatggccgccgacgccccgactgcagccgcggctctagagcttcataccctcgaagagagatccgtcgcggcccccaataagccactcgctcactccagactactcgcagaagatggccggcctcaggatgaagttcgtcgccgtcgccgccatggccgccgccctcgtggcgtcagccgtgcacgtcgagccccccgcccccgctggatgcgtgcgtgcttttctgtgtgcttgatagcggtgattcttggggcgtgagttgagttacgtgtccggcgccggcggcggaggtgtgcccgtggtggtggtacatgcgtcgatgcgccattgtttgtggcggcgatcatgtacctgctgcggttggaacttgcgcttatgcatcattgctagcgccagggatcatgcacctgctgcgttctcctgatattgatgcgaagtactatcgctct

SEQ ID NO: 5661 - DNA, 750 bp, Sorghum bicolor
  Clone ID: SORBI-28MAY03-CLUS20044_1
gccggccgggctgggcccctacccttcgtcgtcccggccgagagggaggcgcggccccaattcctaccgcctccggccgccatcgccgcggccgggaagacctcgtctatcgcctccgccgagcacaaacgccgcgcggtcactccctccatgttctcccgcggccgaattctccacgcgacgcgctccgcactcggctgcttcgtgccggcgccccgcagcgccgtcctctcctctccccggagtctagtgtgggcagagatccgtcctggtttggtctcggtccgattccttcccgtgcaggatttttgttaatgatgggggagaataaatggatgggaaaaagatgggaggacatggacactgatgtccttgtgaaaatattcaaggaattaaatttggttgagctgtcaccggtatctcaagtttgtcgtttgtggcgttcggcctgttcagatccacttatttggggcactcttgactttggattgttaaaatccaattttattcagacaagagcatcaccatatatttgggttgatgataggtctgacaagagacttgcaagaatactacgtgtggctatggcaattagctgtgggaatgtcaattgcatgatattccattacaatttgttcatgaaagatgagcaccttcatttcatctcagaaaggtctcctcacctaaaacgattggttatgccagcatgggaccgcatcaccaagtggcaatatgtcaagctatccaaag

SEQ ID NO: 5662 - DNA, 1071 bp, Sorghum bicolor
  Clone ID: SORBI-28MAY03-CLUS20083_1
gccggccgggctcgggaccacaacaaacaccagcgcacaaggaaaacgaccaagaagccgttcccgtgagagctccgagtgccggccgcgtgtccgcacccgagcagtgagaggagatcgatcgagggcggtgaggtgacagaggaacagaggaggagaagcagaagatgtacttccggccgccgcccaagggcccggagtggtacgccggcgatgcggagacggggcaggcggcgcggccgctgtacccaatgatgctggaggacccgcgcctgcggtggtccttcatccgcaaggtctacagcatcctgtccatccagatgctgctcaccgtcgccgtcgccgccgtcgtcgtgtacgtccgccccatcgcgctcttcttcgtctccacgcccggcggattcggcctctacatcttcctcatcatcctcccgttcatagtgctgtgccctctgtactactactaccagcaccacccggtgaacctgctgctgctgggcctcttcaccgtcgccatcagcttcgccgtcggcctcacctgcgccttcaccaaaggggaggtaatcctggagtcggcgatcctgacggcggtggtggtgctgagcctcacggcgtacaccttctgggcggcgaagcgcggccacgacttcaacttcctgggcccgttcctgttcgccgccgtcatgatcctcatgctcttcgcgctcatccagctcttcttcccgctgggacgcatctcgctgatgatctacggcgggctggcggcgctcgtcttctgcggctacatcatctacgacaccgacaacctcatcaagcgctactcctacgacgagtacgtttgggccgccgtcgcgctttacctcgacgtcatcaaccttttcctctccctcctcacgcttttccgggcggcggattcgtgagcacggctttactcctacctgcctgcctgcgcagccagagaataatgatgttggatttggaatgtgccttgccttgccccgcctctgttaattggtatctgctggaattcagttcctctgtaaagtgaaataattgttttggctacgtgct

SEQ ID NO: 5663 - DNA, 726 bp, Sorghum bicolor
  Clone ID: SORBI-28MAY03-CLUS21052_1
aagaagatgaggggtaatgctccggagagactagtttctggttctgatgattttacaatgtttctttgggaaccaacaattagtaaacaccctaaagctcgcatgactggtcatcagaagcttgtaaaccatgtttacttttcccctgatgggcaatggttggcaagtgcatcctttgataaatctgtcaagttgtggaacggtattacaggtaaatttgttgcagctttcagagggcacgttgcagatgtctaccagatcagctggtctgctgacagtaggcttctacttagcggaagcaaggattccactctaaagatttgggatattcgaacgcacaagttgaaaatgggcctgccgggccacgcagatgaggtgtacacagttgattggagccctgacggtgaaaaggtggcgtctggtggcaaggatcgggtgctcaagctatggatgaactgacgaccggggtatagctgctagggattgaagtattatgcgtagtacatatgcaagaaagctcctgtagggtgatggcattatgtaccgtggatgatatatgctttagcgaattattgtagtgatggtattttgaagggatttatagaaattttgtccatgtactggtgctggcatcaaaatcatctatctatgcatgcacaagacaaaaaaaaaaaaaaaaaaaaaaaaaaaaaaacaaaaaaaaaaaaaaaaaaggcccctagggca

SEQ ID NO: 5664 - DNA, 636 bp, Sorghum bicolor
  Clone ID: SORBI-28MAY03-CLUS2087_1
ccacgccgccctcgctcccgcgctcgctccctctcgctctcccccgccccctctcgcgctctctctctctctcgctcccgcgcgctctctcgccccctcgctctctctcaggcggcttggcgggagcccgccctcccgaccgcgccccccggccgccactgcctcctgccctgcctccgccctgcagtgcccggtcctggccccccccccggccccccggtctgtggctgctgcggggccgcctgtcgccccgaagccgccggccctggtccaggccacgccgctcgggtcggagcctgccgcggagctgccgcagcggcccaagccgctgccccgcatcggggacctgccgctcgaggccaggcggccgccgtccatggtgcagaggccccggatggtgcgtgccgcgtcactgtggccccgccccctgccgcggctccgcgtgtggtggctgcccagggtgcccaggtggccgccctccatctgggacacgctcacctacgtatgtgcaagcctctttgtcgaccggctcgctgcctcggcccgtcgtgccgtggttgcccagtgtaccaatttttctgttcagaatctgagacacgatacctacaaaatgtaattctgtttttcacggtaatt

SEQ ID NO: 5665 - DNA, 495 bp, Sorghum bicolor
  Clone ID: LIB3481-003-Q6-K1-D5
tgcgtccgcagcacccaaggagggccaagaaggccacacccaccaatggcgctcctcctctccccgaccgtctccttcctcgtctcccccgctgctccacgctcccgagctctctccactgccgccaatgtctcctacccagcctcaaggctgcaatgcaagaacctgtcctccctacagagccctctgaatgtgactgctacttgtgcttctttcgccgagaagaggccggttcttgtccatgccacggcagacggttctgaggctggtgcggagcagccagaagagccgaaaccggtgaccaagatcgaggacatgccgctcgagtcgaagcagaagatgatcatggagcagagggcgcggatgaagcttgccaagaaactgaggcagcggcgcaagcggcttctccgcaagaggaagcttaggaagaagggcaggtggcctccgtccaagatgaagaagctcaagaatgtatgaaccagatcaatgttgacc

SEQ ID NO: 5666 - DNA, 718 bp, Sorghum bicolor
  unsure (1)..(718): unsure at all n locations
  Clone ID: SORBI-28MAY03-CLUS20927_1
gccggccgggtttcggatcttcacacgcccactctacacgctcaccaaatacacccctacatatctattcttgatacgaactactagaacctcaaattcaccatggtttccttcaccgctctcgctcttctggcaacttctgccatggccggccctgtcgctcgccagattgcaatccccgaaaactgggattggcaagttgagaactgggaggctggttgcggtcgatccggctgctactacaacttcaacgtcaccgtaccgaccatcaagggagagatcctaggtgtaaaggcgtactgccacggctacgagcagggatacgacaacagcttcaccgtcccttcaacatatgagacgtgccagctgctcgagggtgtcaacaacggtgttgcggctaggttttctttgagggaaaacgatggccaaggatttggacccaaagagattgaggtcagcttcttattcgctggatacgaggaccgccctgcctacaacttctccggcagccacgaggccaggtacaaccagtttgttgcaccgcaactcaacttcactatcacccctaccaaggtgtttggtatcgcataaacgaggtcgtgcggactagagcgatagacggctcttccgacagtcttctatcgagtagatactacgaacaataatgataatgattgcgaagcgaaccccagtaaaaaaaaaaaaaaaaagcccctan

SEQ ID NO: 5667 - DNA, 748 bp, Sorghum bicolor
  unsure (1)..(748): unsure at all n locations
  Clone ID: SORBI-28MAY03-CLUS2107_1
cgtccgctgaggattggagtttgcatctgctgagtctcggctataaatggactgacttcttaccaaggttgtgcacgtgtgtggcttcaaagattgtggcaactaaattcagagttgccaacggtgcgaggtgcagcttaatccgagttgcagagttgggagaggtaggagtagctgggataacagatttagtgtggtttgataggattacagattagcgtggtagcaaaagtagcataaataggaaacagaattgaggcgtgggatagtcccacaaggaaaggttttgtacatcattggttcgaggtatacttgtacaggcaatcaatccagtttttacctagcagcatcaggcttttgctcttgcggcagtggacttgaaaggcaagcgtccggaagcggtctacatctgttgaatcaaagatcagcatttggctcaagctctctctctcttttattcccaatataatattgataaatgtgttggccttccaggcatgcggtgccaggcttcgatcaggtagtatggttttctacgcatcctaggacttctcggcgttcgtctgcagacgtgagggaggagctgtgcaagaggatacaataattgtcatgagcttgcgatatactttctttctcgaacgagaacttgtgatataccctgatatatccctccgtgctgaattgtaagatgatttaactttttttagatatatacaaatttgttatggccaaaaaaaaaaaaanaaaa

SEQ ID NO: 5668 - DNA, 362 bp, Sorghum bicolor
  Clone ID: SORBI-28MAY03-CLUS21128_1
gtgcggcgctcaggcggcgggttgcacgagggtggtctgcaaggagcaggtggaagcagtaatcgacaaaataattgaaaaggcaagaaccggagaaattggcgacgggaagatattcttgatcccggtctcggatgtggtaagaatccgcaccggcgaacgtgggaaggaggctgagaggatgactggtggactgtccgataggctgttgtcctctgtggtatcgatttcatgagctcaactggctgcctgtgtcaagtgcattttctcctgcaatgtcattgtaaccttgcgcaaaataaattgaaatgtgatccatgcaaaaaaaaaaaaaaaaaaggcccctattgtgcactgggctg

SEQ ID NO: 5669 - DNA, 828 bp, Sorghum bicolor
  Clone ID: SORBI-28MAY03-CLUS20276_1
gcttctcgcgacagacgggaaccccaacccatcgccatggcgtcgcggatcctggcccgatccaaggccctcaacctcgccgccgccctcaaccgcgccgccgccgacgcagcgccgccgatcgccggagcccgcgcgctctcgtccctgccccgctacccgtccgccccgtcgccccatgcgctcggcaagtttctgggatatgaaccaacatctcacctcagtggagcacaagttttacctcgttggttttcctctctagcatccaatggatcccagatgcagaagtcacagatctctgagacatacaagtcaagtgaggaagccacaccaaaggttatggccttcagcccgctagaagcagctatcgctaaacctagaagtagtcccctgacaagtgagagttctaaagtaaggcgatcagagatggcaagcaaaatcaccttttacatgatcccagctatgcttcttgtctccaagaacagcataagtacctctcttatggtcggcgcggtgttccatcaagtatacatgttccacaaggagattcttctggactacgtgcaccatgatatcaccagaaagtgggctttgatatacttgaagctgcttttgctggtgatggcgaaggacaccatcatgtactttaatctgttttaagctcatcgtgttagtttctcaaatatccagcaatgcatccgtctgtacactcagagaataatgaagatggacgaattctggagctctggttcttgtattcccctcatgaactttgctttttgcatctttttctgctgcaattaaaaaaaaaaaaaaaaggccctgggg

SEQ ID NO: 5670 - DNA, 518 bp, Sorghum bicolor
  Clone ID: SORBI-28MAY03-CLUS2025_1
cgtccgctccattcctttgtccaaagctttgagatggctcagcaaaaggtggtgctcagggttccaaccatgacagatgacaagatcaagcagaaggccatcgaagctgttgccgacatttacggtattgactccattgcagcagatctgaaggagaacaagatgaccatcataggcgagatggacgcagtggcgattgccaagaagttaaagaagattgggaagattgacattgtgtctgttggacctgcaaaagaagaaaagaaggaagaaaagaaagaggagaaaaaggaggaaaagaaagaagagaagaaagaggagaagaaagaagagaagaaagaagagaagaagtgataaacctataaaacctataatatcatcacatggcctcacctatcttcagttgcaatagctttgactttggactgatgttgctatgtggacttattatgtaaaatttatactacagagtacatattagttaaaaataaaagtacaatctgtgcattgctttaagc

SEQ ID NO: 5671 - DNA, 607 bp, Sorghum bicolor
  Clone ID: SORBI-28MAY03-CLUS2023_1
caccatttaaaggggtccattaaagctactgttgagattacacgtggagaagaataatacaaggtcagcttaacagacaagcccaagcaaacttcacaggatgatcaaaagaagagacataagatgcgatcccttgcacaaaatccagaacctgacgggcagcaaactaagaccatgactaatcccactcatgctaaagagttgtctgaccttaaaaatacattagtaaaccactaccatggtcccttttaaccttaactgacaaggctgcgcagtggagaatcttgtgtccatcagacatttgaggtgcttgttcttgatcactcggcagaggcggccgctcccaatgctggagtgtagaagctcatgtaggggaaagtgaaacaggccaaagaactatcttggcacacctttgtgacccggacggacttcggatcaatagtgaaaatcccctcaagtgtgcacacaagaataacatcaaggccatgtgcgaagccagtcaaagaaagtgagtctattggatcacctggaggtaattctgtaagcttaatgactttgctttgtgcccatcctacaacctcgttaggaccaacctccattgaccata

SEQ ID NO: 5672 - DNA, 283 bp, Sorghum bicolor
  unsure (1)..(283): unsure at all n locations
  Clone ID: LIB3481-002-Q6-K1-E11
ttttattgaaccattcagagcatttcattaaagctactgttaaggaatactccgtacacgtggagtagaataatacatacacaaggtcagcttggcagacaagcccaagcaaacttcacagagacataagatgtgatcccttgcacaaaatgtagaacgggggggccagcaaccatgactagtcntnnaactcatgctaaacagttgtntngccttaaaaaatacattactaatcattacaaggggccctttaaaacctaatggagagggggggcctaagggg

SEQ ID NO: 5673 - DNA, 748 bp, Sorghum bicolor
  Clone ID: SORBI-28MAY03-CLUS20362_1
gcatcctctgaaggcgcccagaagtaccctactttgatgggcttagcaacactctgcttggactttgggaagaacccagaaccagaaccagggaggtgtcggcgaacagatggtaaaaaatggcgatgttggagaagcactatcccaaatgagaaatactgtgaacgtcatatgcaccgtggtcgcaagcgtcctgtacaggttgtcgttgaggacgacgagccagattctgcttcagggtcaaaatccactcctggcaaggctaccgatggtgccaagaaggctgacgacaagagcccaagtagcaagaagcttgcagtggcagcaccagctgctgtgcagtctacataattgatgcagcattagtagtcgcggccggagcataacagcgctggcaactagcgccttcttcttattgcatgtaatccccaaaagactgtagtgtggtcttagctataacctcattaagcattcccagtgtctgtgggaggaagccgcaagaacttccccttagctgtcaactgaaaatttcactcctaggtgtatagtttgatttagctttgtcgtgcctccggccttcaggtaggcgatgcggcatgatcttataaatcctccctgaactgacaatatcgcattgtaacccaagaagccggtggaagaacttgtgaaactgcattgatgtgctttttgatgtccacctttattggcctgtgcgcaattgcaaaaaaaaaaaaaaaaaaggccccta

SEQ ID NO: 5674 - DNA, 646 bp, Sorghum bicolor
  Clone ID: SORBI-28MAY03-CLUS20314_1
gggagcaggtcttccatcgctcgcgactcgccgagacgccgactcgcgaccgccgccgcccctcgccccctccggctctcctctctgtgctccagctctgcggcgtcgcccccctccggcctccgctctaggctccgcgatggcgcggttcttcctaagatgggcgctggccgcccgctcgctgccggctccttcctttcagccgagcagccgagcagagcatatgagcaagcttccctcgttagtgtgcaagataaagggggcaaggactttggtttcgtatttccctccagttcctgggcaacagggagccgaacaacaagctactccatcctcagcacaaggacggcaaaacgcccaagctcctacaccgcgatctcaaggattctcatttgctccacccgcgactgcagggctaaggtccctcctaactgttaccggagcaagcaatactgcaacagatccccaggaccaacaggattccgaaacaactcccccaccagcttctgtcccgacaccagagtccggcttcaaagtcagggacacctccaacctgaagatctcacccaggcatgacctcgccatgatctttacgtgcaaggtgtgcgagaccagatctatgaaaatggccagcaaggactcgtac

SEQ ID NO: 5675 - DNA, 614 bp, Sorghum bicolor
  unsure (1)..(614): unsure at all n locations
  Clone ID: LIB5052-004-A1-XP1-E11
gccggccggttcgngaggtcttccatcgctcgcgactcttcgagacgccgactcgcgaccgccgccgcccctcgccccctccggctctcctctctgctccagctctgcggcgtcgcccccctccggcctccgctctaggctccgcgatggcgcgggtcttcctaagatgggcgctggccgcccgttcctttcagccgagcagccgagcagagcatatgagcaagcttccctcgttagtgtgcaagataaagggggcaaggactttagtttcgtatttccctccagttcctgggcaacagggagccgaacaacaagctactccatcctcagcacaaggacagcaaaacgcccaagctcctacaccgcaatctcaaggattctcatttgctccacccgcgactgcagggctaaggtccctcctaactgttaccggagcaagcaatactgcaacagatccccaggaccaacaggattccgaaacaactcccccaccagcttctggcccgacgccagaggccggcttcaaaggcagggacacctccaacctgaacacctcgcccaggcagcgacctcgccatgatctttacgtgcaaggtgtgcgagacccgatctat

SEQ ID NO: 5676 - DNA, 635 bp, Sorghum bicolor
  Clone ID: SORBI-28MAY03-CLUS20591_1
accacagatggtagaaattcctcgcagcaccttcaactttgattttgagtatgagagaaggattcttgctgaggcagagaaggagaaccccaactggactaaattcgtggtagaaagacaggcaccacctcctgtggcacagcaggctagaccagcatcttcaggggatccagttgtcgggaggtatgtctcaatggggcttgggcgtgaagctgtctcatttgcagtgttgaattatggagacaatccaacgaaggtgaaggagttcgtgaaatcctacaacatcctccacgagatgggcttcacatcgccaaacgtccccgagctgctagccatccacgacaacgaccccgacaaagtaatccagcgcctgctctcctcgccatcctgatccccgaacaaaacgcctcgcatttgtataccgcatccatgtacagccctgccctacgctggcaaccatcacagatgatgtcctcttttttcaaaaagaaaaaaaaatgatgtggtcttctatttcgatatacgtgttagctgccgctagctctgtgaaccgagtaacacgctttgtatgttgtacttgtatacagtcacccgtttggtgttttccccaaaaaaaaaaaaaaaaaaggccccta

SEQ ID NO: 5677 - DNA, 1334 bp, Sorghum bicolor
  Clone ID: SORBI-28MAY03-CLUS24992_1
gcacgagggtagattcttcctaaagcagcattggaccgatggagaagatgatgtaaaagattctattaagcacaagcccttgtgggaatcttacatgcccaaaaataagaaagaaaggagaggaactggaaagaagaaacatggaagtctgtacagaacttatgggaccagagtgatcccagtttttgtattatcactggccgatgttgatgctgaacttctcatggaagaggaaagtcttgtttgggcaagtaaagatgttgttattgtgcttgagcataacaatgaaaagattcctctaagctatgtgtcagaaacgactaggcagtttgctcttccgtctctcgcacagcgccacatcttggctggtctggcgtcagcagttggcggtctgagtgcgccatatgaaagggcatcacgtattcatgaaagacatgtagtgaactggctgtgggctgcaggctgtcatccgtttggaccattctcaaactcctcccagatcagccaaattctccaggatgtagcactgagaactacaatttatgctcaagtcgatgctgctcttcgcaaaataagagacacatcagaggtcctccatgcttttccgcctgcgcttcttaagacgccattaggagaacttgtgaaaggtaataaaaacaagtcaaccactgagttatgggtagagaaattctataagaaggtgaccactctgccggagcctttcccccatgatcttgttgagaagttagaagagtacctggataaacttgaagggcaactcgtggacttgtcttccttactgtatgaccaccgtctggcggatgcatatcaaaacagtaccgacatcctgcaaagcactatatttacacaacagtatgtggaacgtgttctagctaacgagagagacaggatgaaatgctgtagcattgaatatagtcatccaaagcagtcatcccaggcttttgtctatggagggatccttctggctggatttcttgtgtattcactggttattttcttctcttcaccggttcgctaattttatgtccagatgcagaaagtcctggatgctttatgataggctaggtttgtctgggctgtcaatcttcatgagggaatgatctaactgtgttggatacagaagggcttcggcgcagtttgagtgctatttttcgatacacaagcagtcagacggctgatatatgtaactgactcatttgtccgcgataaagactgtagtcgatttcacataagagctagtgcaggctatgaaaatatgaaatagctttcacttttttgcaacgtgttatgacagaaaccgtttgttaaaaaac

SEQ ID NO: 5678 - DNA, 683 bp, Sorghum bicolor
  Clone ID: SORBI-28MAY03-CLUS2132_1
gcacgaggccacctctcgccaccgtgtggtccgcccgcgacaccccccccagaccatcctcctctaaccgaaccaccaggaagaagcaccaagcaaaagccgcagagctcgatctctcgcgctgggatcgtcgtctaccaccaccaccaacaacaaccgtatcggtccttccttcctctacgtccgaacgagaacgcgaacgcgccgccctgtgattactacgaccccagcatgtgctcaggacctcgcaagccgtccactcctcctctgccaacggcgacggccaaggactcctcggcgatgacggcggcggcggcggtccttctggagctggcggcggcggacgacgtggttgccttcaggcgcgccgcggaggacgacaaagccccggccttggacgccgtggcccactggtacggcccgtccgcgggcgccggccgcctccgcctcgaggcgcgcacgccggccatggtcgccgcgctctacggcagcgcttcggtgctggcgtacgtgctgtcgtccgcgccggcggaggccgcgcgcgcgtcgcccacggacggagccacgccgctccacctcgcggcggccggtggcgccgcgggcgccgtcgcggccacgcacctcctcctcgccgcgggcgcgtccgcggacgcgctcgccttctcgggactccgcgctgggga

SEQ ID NO: 5679 - DNA, 688 bp, Sorghum bicolor
  Clone ID: SORBI-28MAY03-CLUS21381_1
taggctagctggactttataagatagacagaggtgctcatgttttctggttgaggaaaggaacgttagacacaagaccagatcatatcatcaatcagattcattatgaggatgccgcttcccttgcagtagcaatcatgaaaaagagactgcggagtcggatatttttgggctgtgacaacaagcccctttccaggcaagagataatggatgctgttaacaaaagtgggaaatttgacacgaagtttgaaggctttactggtactgacggtccattggggaagagaatggagaattcgaaaactcgggctgagatcggttgggaaccgaagtatccaagcttcaccgaattccttggtatcagcagttaacatccttgcatacttgtcagttactctgactcagctgtgccggaaccacgattagattgtaccatcgtttgaatttgataatggtctcaactggtgagggtgcatatcttagtctactccgggcctgtcctcagtattttttgattctcacactttttgtgttgtgaaccagactgatgcaaccccacccctccaggcaacatatatatactgtcacgtgagtcgatttgtcgatcatgaacatatactctgccgactaccgtggtcgtataactgcaaactagttttaaggtctggtcctccggccagcaagttgtc

SEQ ID NO: 5680 - DNA, 805 bp, Sorghum bicolor
  Clone ID: SORBI-28MAY03-CLUS21469_1
gcacgaggcgaaccccacctgcgcatcctccccgtccccgtcgcaatcgcaactccccccgccggcgcacgctacctaggtcacgccacgccacctctccccccggctccgacgatgtcggcgccctccgatgccgcagcggcagtagccgcgcccgcgcccacgacgaccgccgccgcctcctccagcggcggcttcaccttcaagctccacccgctcgtcatcgtgaacgtctccgaccaccacacccgcgtcaaggcccaggccgcctgctccggggacagctcctcctcctcgtctgcggcggggtccgggcagccgccgagggtgttcgggtgcgtgatcggggtgcagcgcgggcggaccgtggagatcttcaacagcttcgagctcgtgctcgaccccgtctccggcaccctcgaccgcgccttcctcgagaagaagcaggagctctataagaaggtgttccccgacttttacgtgcttggttggtactccactggaagtgatgtgcacgagaccgacatgcaaatccacaaagccttgatggatgttaacgaaagccctgtttatcttctattaaatcctacaatcaacctctcccagaaggatctccctgtgactatctatgagagtgagttgcatgtcatcgatgggagtcctcagctcatttttgtaagatccaattatacaattgagactgtagaggctgagaggatatctgtcgaccatgttgcccatctcaaaccttctgatggtggctcagcagcaactcagttggctgctcatcttacaggaatacaca

SEQ ID NO: 5681 - DNA, 753 bp, Sorghum bicolor
  Clone ID: SORBI-28MAY03-CLUS21448_1
agcgagatctcgttcgcctactcctccagtctcgtctccgatccggccaaccatggcggaggatgctacgagcagccacccgtcacgctacgtcaagctcaccaaggaccaggacgcccccaccgaggacatccgccccggcgagctcaaccagccagtccacgtcccgcagctcgaaggccggaggtgcagcgagtgcggccaggtcctgcccgagagctacgagccgcccgccgacgagccctggaccaccgggatcttcggatgcaccgatgaccctgagacctgccgaactgggttgttttgcccttgcgtgctgtttgggcgcaacgtcgaggctcttagggaggacatcccttggacaactccttgcgtgcgccatgctgtgtttgttgaaggagggatcacactggcgattctgacagcaatatttcatggtgttgatccaaggagttcattcctgattggagaaggtctgatgttcagttggtggttatgtgctacctatactggcatcttccgccaggaacttcagaggaaatatcatctcaagaactcaccgtgtgacccatgcatggtccactgctgcttgcactggtgtgccaactgccaggagcatcgcgagaggaggggacggctggcagttggacttggctgccccatgacttttgtgaaccccacctcccattcagagatgagcatgtcagagaaccgtggtcctgctgccctggagacagagcagcaacgctgagc

SEQ ID NO: 5682 - DNA, 577 bp, Sorghum bicolor
  Clone ID: SORBI-28MAY03-CLUS21512_1
ctcaatcacgggcaatcggttgatctgaaggcggcggcggcggcggcggcactccgagctctcacgacatggcgatgcggttggcggcggccgccgcgttcgtgcggcgcctggtgccggctcgcccaccagtacccgtcctggcggcggcatctacggcggaggcggaggcggtgacgtgcgggcgcggggacaagaaaaccaagcgcgggaagcggttcaagggctcctacggcaacgcacggcccaagcgggagaagaagattgagcgcatcaaggaccgcgtcgaggtgccccgctccacaccctggcccctccccttcaagcttatctgagtggggactcccctccgccccgcccccctcccctcggttcgcgaggggacctagggtttactgcaacagttgctgctacttcaccgattccaattagcttgcacgcctgcacgggcgtgtgtttgctttgtttttagttgtttctcaattgtgtggtgtcagatatgtactgtcgaactgctgtggttcaactttgaccaatgcaatgtcttttggatggaagtgaaatatgtttctgttcc

SEQ ID NO: 5683 - DNA, 669 bp, Sorghum bicolor
  Clone ID: SORBI-28MAY03-CLUS27135_1
atcttcttcaccttcctttgagcttgctgaaaaagtgatagatgcatgccgtgaaaaacttaagccagtctttctgcaatcactaaaaggcacttccttgagcgaatacagccaaattgttgcatcagtttgtgaagaggtttcagatgacagggaagataacaatgctgatccttctgggaaggatatggtggatgatggcaagctctctgaaaggactatttctgatgaattacctcaggaatcttcaaaggctgagcaagatgttagccgtcctgaacaagatggtacttctatgaatggtaatacaggtactgctattagcagtggtgctgctccaccagatactggtgagtctgatgatcaaggaccaccttctacaaaagagaagattgaaaaactttgcaatgatgaaaacatagcagatgctgatcagttgaaaactgaccacaatgaaggtgctgatttcaatgcagcaaagcccaaaaagaaagctgcccttgattcagacaaaagtactaagaatgaagatcttagtacacctactaattgtgaagcaattgtggattctgatgctgacactaagaagggagatcttgtagcatctgcagaaggtaccaatggagcagctgatgatgcatcaaggcctgctgatagtacacctactaa

SEQ ID NO: 5684 - DNA, 820 bp, Sorghum bicolor
  Clone ID: SORBI-28MAY03-CLUS27160_1
ttcagctgttgctgctaaagaaagtaccttactcaatgagtacagagaactcttggcaacagcagcatcactacaggtccaagagtccagcctaaggacacagctcatacaacaaacagagtgaacaggttaaggtcctgtatttttaactaggaagatagaggtaaacaccattcattagtttcagtgactgcggtgcatatgtgtatctttgatgtcgttttgtttttctctctcttccttttttcacttattagctagcccatatttcttttcatttctactccccccatgttcttttctgttcgaacaacttacatggaagagaagggaagcaacacgaaatcatggatttactccatgacagagctgccaatgtggtcgtttattgcatcctacaccaatgtgccaaaaactgaaagctttgttgtaacttgtaaatcttagcagttatgtgtccttcagtgtaatgcctttagatgtgcatctttcttagatcgccatcaccttagaattagactccagttaacagattacttactattagtgctggtcccaaatccaagcaaggggcaaccagaaacttctaaccgacactacagagtagttgacaggtttccaatactgacttcgttgctaacacttgtaagtattttatgtcctgtcaggagaaataccatgttttgttcttctccacttactctgatggaaacatatttccttttcatgccgtgttgttggcatacagcaagttgttttcgccattgcattcatttgcatgtgctgtgctgctgcacatgcaagaatgtagcttgtggtc

SEQ ID NO: 5685 - DNA, 811 bp, Sorghum bicolor
  Clone ID: SORBI-28MAY03-CLUS27136_1
cttttttcatcctctcgtgtgtgtgcggcccggcgcctgcttcccccatctcgcgatcccagttcgatccgctcgcctgctctcccgatccgacccgccctccgcggccgggcaattcggccgccgctgctcggattcgcgcggagccgcatcagattcgcgcttcccggcgccaccaaaccctagatccgccgccgctcgtcgcaccgccgccgccatgttctggcgcatgaccggcctctccgcggcctcgcccgtggatacaattctggacaaagaaaattttacattggaagaacttcttgacgaggatgaaattattcaggagtgcaaagcactgaactcgcgactcataaacttcttacgtgacaaggcccaggtggaacagttgcttcgttatgttgtggaagaagttccagaggatgctgaaaggaagcgctctttcaagttcccttttattgcttgcgaaatatttacttgcgaaatcgatgtcattttgaggaccctagtagaggatgaagagctaatggacttgcttttctcatttgtgaaacctgatcatccgcatagtacattattgtctggttacttcagtaaggtggtaatatgtttgatgctgcggaagactgctccacttatgagttatgttcaggggcatccagagatagttgtccagcttgttgacctgattggcatcacatcgatcatggaggtgctgatacgactgattggtgctgatgaggccatatattcaaactatggtgatacgttacagtggttagaaaatacagatgtccttgaaatgattgca

SEQ ID NO: 5686 - DNA, 703 bp, Sorghum bicolor
  Clone ID: SORBI-28MAY03-CLUS2713_1
agcccatactcgctttttgaaagcacaggaagaattgaaaaggtcacaagctcgttttgagagacttggtgatttgcttgcttcagatattctgaagcgcggtgctaatgaagaagtttccagtatcaatgttgatgaagatccaaatggtccttatgaaaggagcccaaatgctgctacagctaagaagagatcaatactatactcaacaagtgaagaagcgaaagctgtgaagaaaagaagagaacgagactctgacacaactaggccagataaatataggtcagaagctactattgcagaatttgaaaaaccaatcaagggaactgagccaacaaaatctttatatttgaagaagaaactgtgggaagatgaaaaggataagataggcaattttgtttcctcagccaacactgacaagtatgaggctgatgatgaggaagtcgacgtggactaagtagaatgtcgagatggtactggaatgatctatagctctggcatgtgtaaagccctatgtatttgatgctggaatttaccttgcataaaaaagcattcattagtgatccttggtggatgcggtttaagcagtcaacttttttcttgctttcctgaaggcaacatgccctgttacctgtactgtacctaatataccccgtggtggctagtcttttgtcagtgcccggttcaaaaaaaaaaaaaaaaa

SEQ ID NO: 5687 - DNA, 509 bp, Sorghum bicolor
  Clone ID: LIB3481-013-P1-K1-D10
cgtccgcactgacaaggtcaaagaatctccagtcaaacatgttttgccctccactggtatggctgctcatgcagtggatgatctgtttgaagctgttgaactggaggatagacatgatccaataaacgcatcaatagaaaatgatgctgatgacgaaactaggtcgcctgttatgcccccacaaccaccaccagtggttaattcttacgagcagtatgaggctgatgatgaggaagtcgacgtggactaagtagaatgtcgagatggtactggaatgatctatagctctggcatgtgtaaagccctatgtatttgatgctggaatttaccttgcataaaaaagcattcattagtgatccttggtggatgcggtttaagcagtcaacttttttcttgctttcctgaaggcaacatgccctgttacctgtactgtacctaatataacctcgggtggctagtcttttggtagtgccctggttcttttgagtggtgctgtgcttgtcgtgaca

SEQ ID NO: 5688 - DNA, 850 bp, Sorghum bicolor
  Clone ID: SORBI-28MAY03-CLUS27230_1
cgccaggggcacgctgggctcgcaggtcctccgcgactggggcttcgggaaggaggaggtcgaggacatgggcgagcacctggcgaagatgctgcgcccattttaccctgagatggatctgacgtcggattctgatgattaggtttcagtgtctttgtgagtgtgtcgtatcacaggaagataaagttcaagttttggtctgtggaaactagtagaaactgtgatgtgatgcagctggtgtgagatgccatgctgctatgaattcgtctgtcctgtgttaaagggatgcagagcactgggagaagactgggggccctgttgggtgacctggtgcgtatgtatcttttgagcaacctggaaattagatctgagagcccgggcgtgtgacacgtgcgtgatgcagaggttcggatctgtgctgcacctgcaaaccgcagcagaggaaactgaagagtcaggcgtttctactctgaaatgtttcccctgttcacttgcaaaggtcgctcgggacccccgacccgatgggtatttactctattatggtaccaatatggagtgaaaccagtacctatgggtacacaaacggagcaaacctttcacccattgggtacgcgggtatggggacgttctagtagtccccatacccattttacccatgggtgaaaaatacccggcccaaaactaaagaagcccaccagccaccagtccaccggcagcccatacactgaaaccttatgtagtgctagcaaagtactactctctactacgtgatttgtatggacaatgaactattatggtgttgtactagggttgcagcaaaaattattatgttggtatttgctaggtatat

SEQ ID NO: 5689 - DNA, 570 bp, Sorghum bicolor
  Clone ID: SORBI-28MAY03-CLUS21831_1
ccgggcttctcccgaatccccgttcccccctgcctgcgcgctctatctgtctctctcccgtggcgacgactgggcgaccgccgccgccgccctctgccaggtgcccaggtcatctcggatcgttttcctcgggcccttcgccggcgatgagcacccaaagtaaaaggctcaaggatgtggagatcagtttccctatcgtctatggaaccatttctttctggctcggtaaaaaggctagcgagtacaactcccacaagtggactgtgtatgtccgctccgcaaacaatgaggatctgagtgtcatagttaagcgtgtggtgtttcagcttcacccaagtttccaaaacccaacaagggtcgtggagcaaccgcctttcgagctgtctgaatcgggatggggagagtttgagatagccataaccctttatttccacagtgatgtctgtgacaagcgcttggatctgtttcatcagcttaagctgtatccagaagaagaagctgggcctcaatcaaccaagagacctgttgttgtggaaacatatgatgagattgtctttcctgagcctacag

SEQ ID NO: 5690 - DNA, 822 bp, Sorghum bicolor
  Clone ID: SORBI-28MAY03-CLUS21832_1
ccgggagcccaccgtcgatcacgagccatctgtctcgcccgccgcccgccgcctgccgagcacgaatccagaagctcttgggactcgaacgagcatggcggtctcctccatcagctgctcccttcggcctccagctcccgtcagagaagcttccgctcgtctgacgccgccgcagccgtcgccaccaaagacgacggccacgccgtgggcggacgggctgcggcgggcatgcgtggcggcggcggcaaccgcggcgtgcgtcgtgatcgggacggcgggaggtggcgacgtggtggcggcgtcgatgccacgcgacacccccgttctggctgtggacgcgcggccggcggcggcggcgccgcggtggagcgaccgcagggagtgcccgccgtggcgcgctaactcgctggagaacatcgtgccggagaacctgccccgcccgtcggcgcgccggaggttcaacacagtcaagcgagcgccgcggaaggcccccgcgctcgggcgtcaagcggtggcgccgccgttcctggcgctgcgctccggcgtggacgactgcttcaccctctaggcaaggcaagttaggcaggtagtactagctgaccattctccagctgaatttgttgtacttatttgttttggaatattgtacccaagaagttcgaagtgaacggaaacagtaggatattttttttttgtattccggattttacaggagatgatttgtttgtgttattgtttagttccaaaaaattttgcaaaatataaatagtatcactttcgtttgtatttgacaaatattacccaatcatgtactaaatagat

SEQ ID NO: 5691 - DNA, 756 bp, Sorghum bicolor
  Clone ID: SORBI-28MAY03-CLUS22039_1
ccgggacctaatcccctatcgtcacccaaccgggacccgtaacacccaacagtccctcatcaccgcccacagggaggacctcgagacgcagaatacaggagcgagcgagcgagcgagcgcgacgaagcagaaaagtatggcagccgccgctgccacggcgacgacgacggtggtgccgagatgcagcaagcgcgagggcgacattgcgggcgccggcacgtcgccgaacaaggggaagatagggaggtcgtcgccgccggcggaggaggtggaggcgttcctcgccgcagcggagagcggcatggcgcggcgcttcgcagccaagtacaactatgacgtcgtgaaggacgctcccatggacggtcggtacgagtgggtccgggtggggccatgacacgatcacgcaacggccagtcaacttgtcagatccaagaggtcgcctctcgtgtcctctgttctgtctttatttctcttgtaaaagttgcttactactgtgtaacgtaacgcttcccttagctgtaattatgctcacgagatggctaatcaatcatgtgaaggctcaaccttgtacgtacgtcagtggacgttgtttcgcttgtaactagtgtgtgtgtgtgtgtgggtaacatgtccttctgtgtagtccaaaaagttgtaacttgtcgctgtgtgtcaatttgtcgggtctccatttctatatcaatgaaaaagaatacaggcattcacaggctcaaaaaaaaaaaaaaaaaggcccta

SEQ ID NO: 5692 - DNA, 398 bp, Sorghum bicolor
  Clone ID: SORBI-28MAY03-CLUS21987_1
ccggggcgccgccgccgctatcgcatcagaagcctctcttcccgaaccccgtccgagagggcgagagcgagagcagtcgctccggcgagagaggaaggcagccgtccctccgcgatgagggccaagtggaagaagaagcggatgaggcggctcaagaggaagcgccgaaagatgaggcagagatccaagtaggcagatccatggagtgtccgcctggagtccttgtgttcggttgctgtttaccgaataattttagttttctttagtaacagagtctgtaatgtatctgaaggtctttacaatcatcatctgtccgtgatctgtaatgaagcctaccgtcatctgaatattgttccgaaacatttttttctccatatagaaccattattacatcatct

SEQ ID NO: 5693 - DNA, 758 bp, Sorghum bicolor
  Clone ID: SORBI-28MAY03-CLUS22092_1
ccgcgaaaatccgatgacaaggattatggtttagaagccttggaggagataatgtctgtaatggacagtggcaagatagtgtcatatttgctgggtactgtgatccaatgaagcgagtcatcacctcgaatgatggtttctgtaggcgggtcacaaaattcttctatttcgacgatttcagcacgacagaactagcagagatcctacatatgaagatgatgagcccaagtgagagtagcttgctttatgggtttaagctgcacccaagctgcagcattgaagtcattggagagctgattgccagagagaccactgaagagaggtggaaacagatgaatggaggccttgtagacacactgctcatcaatgcccgtgagaacctggattcacggcttgatttcaactgcgacgacactgatactatgatcacgatcatgttggaagacctggaagcagggcttcggcagatttccagacaacggcaattgcagtgacatgtaaattcaggagaatttttcttgatcatctcttgcttgtcaacaaagacagttatggccgtacaatgacagggtctcatccataaatgcttttggctattctttctgttgtatctagtcattgctagattgatgccgtccaacgatagcagtgtagtggtaaaatgcatgtagttccctgaattcctatgttattccagatgaggtttatacatataaataaatataacctgtgtatatacaattatacattcatgccct

SEQ ID NO: 5694 - DNA, 616 bp, Sorghum bicolor
  Clone ID: SORBI-28MAY03-CLUS21158_1
caataagctcaaatatagagttcgtcatccttcccagtgatggattgtggaaggtaatgaagaaccaagaagcagtcgatctcgtaaagtcgatcaaggatccccaggcagcagcgaagcgattgacaactgaagcattggcaaggaagagcaaggacgatatctcttgcattgtcatccgttcccgctgctgagttacccactttccacggcactgatctccgatcttcgcctcatgatagcgattgagacaatttgtgtctgtaatcatctgcctttgccgaattttttttcgctgatagaatctgctgtacctatcgtagttgtggacaagtctggaactaattaggacagtgaagacttgagagctggttggtgagtgtgtgcagtgtgcccattcgcctgtgcatatatacaccagcgtagactgtgcatccgttgactgggactttgcgggagtctgtcaggaccttgtgtgcttgtgatggtaatggacctaatggtggctaaggaacttgttgatatgtaatttggtgaaaaaaaaaaaaaaaaaaggcccctacgtagggtagatgcatctgatttcaatgaaacatattagtagttcaggccatct

SEQ ID NO: 5695 - DNA, 698 bp, Sorghum bicolor
  Clone ID: SORBI-28MAY03-CLUS21099_1
ctgtgcggcgctcgaggcggccgggcttccacaaaacaaccacttcgtttctcgttctccagcgaaaaacaaagtcacccagtccaacaatggaggccatggaggggctcatcccgttcatctacaaggccgtcaaggagcggcggacccggagctactactcgcggtgcaactccaccggctcgtcgcgcggcaggttcctcggggcccgcgtggaggacagctcgtgggaccagcagaagcagtgggatcggtccgccggcggcaaggcgacgacggcggcggagagggagatggtggcgcaccgccggcaccggtccttggaggagctggccggggaggtgggtgcctcgcccgagtggcgccgccggctgggcgcgctgccgaggggccgcagcgtcaggatcttctcctgcatccgcggcatgtgaggacgatgcatgcacccgccgcccgcgcgccgcagggctccgggactggcggtggccggtggcggtccgggttagtttggacgcgtcgcgcatgcgcgcaggggtggtgaagggggtttgctcgtgcttttgcttagttcgatcggaggtgaggtggtagaaaggagtaattgtgcagtggatgtaatgtaaccctgttgatgttatccaaccaaagtgtacatatgcatgtggatttgcgaaaaaaaaaaaaaaaaaaggccccta

SEQ ID NO: 5696 - DNA, 1108 bp, Sorghum bicolor
  Clone ID: SORBI-28MAY03-CLUS21218_1
ccggcgcttttgcgcatcccctgcctctccctccgtctctctctctgcgctcctggtgctcagccatggcggactaccacttcgtgtacaaggacgtggaggggaggagcacagagtgggacgacatccagcgccgcctcgggaacctgcctccgaagccggagcccttcaagccgccgcccttcgcccccaaggtcgacgccgacgagcagcccaagtcaaaggaatggctcgacgagcgcgagcccgaagagctcgaggaactcgaggacgacctggacgacgaccgcttcctcgagcagtacaggaagatgaggcttgcagagctgagggaggccgcaaaagccgcgcgatttggtagtatagttcccatcactggctcagacttcgtgcgggaggtgtctcaggcaccatcagatgtttgggttgtggtcttcctctacaaggatgggatacctgaatgtggattgcttcagaattgtttggaggaattggctacaagatacccagcgacaaagtttgttaaaattatctccacagactgcatccccaactacccagataggaatgttcctacaatactggtgtataacaacagtgctgtcaaagggacttatgttggtttgcagaagtttggtggaaagagatgcacacctgaatctgttgcattagccctttgccagtcagacccggtactgaatgatggacatggtggcagcgattcatctcgggacaatgtcatcgaaggtgttcgcaggaagttcatagagaaggttgtggcacagcatgaagagcgggaagaagaggatagtgactaagcttatactttttgtgttagtttccctcagctggcagatccaatttggttccaatgtttactgatcttatatgtgattttgatattatatgtgattttgtgggtgaaatttgccagagttttctggttaccttgttgtgtgggtgaagcttttaacagttcagggatcttattgcctggttttgcagttagagatgtgtgaatcataactatatgggccagcaaagtctttgtgttagtaacctttaagcttgtaacatagctccattttttgtttaagagatcagagat

SEQ ID NO: 5697 - DNA, 700 bp, Sorghum bicolor
  Clone ID: SORBI-28MAY03-CLUS21275_1
ccggggcgcaggcaacgcgccgccgtcgctcagcggccctaccggcgaggcgtcgagttcttcttgcttctccactgacgggacagcgcgtggatccggagacctctgggcttcggaaggatggcgctgaggggagtctggcagctgcagaagctcgtggtaaactactgcgactggggagggagcagtaggggcatcagggccttcatggaggcacatcttccagcctttaaggaaaagaatccacacttagaagtggtgacagagcttgtccgtggtcaacatcctaacttgaagggaatttacaaaaaccataacgagcgagtggtctgtgtgagaaacttaccgccagaggaaatactcctgcaagccaccaggctaaggaactccctgggcaggaaagtggtgaagctgcgaaccagacacgtaacgaaacggcccagtgttcaggggacatggacgacggaactgaagatgtgagccaaggtgccaccagccaaggggtttcggtgttcttggtggtgtgattgcagaaaatgtcagctgtgtcaataacttttatagagctgccgttatgctagcctatttcaatagccaaactgtttacaccctttgttcccagtacattctggcaataacatatagatacactggatttctgttagtgccaggccctcacatttgacatttcaggatgggg

SEQ ID NO: 5698 - DNA, 805 bp, Sorghum bicolor
  Clone ID: SORBI-28MAY03-CLUS2129_1
agcagctagctaggtcacttcacttgagctaaagaagctagtgcatagcagccgcacttgaccatccactacttgggaaaaaaaatttgctgcaaacatgtcggtgtcacgtttcgtcctcaccgttctcgtcgtggccagcgtgtgcaccgccgccgctccccgtgcgctcgcggttcgcgagctggcccgcgtccgggagtccgctgcggtcgccgccgcgatggtgtcgcggcacgagaagtggatggcggagcacgggcgaacgtacacgggcgcggcggagaaggcgcggcggctggagatattccgggccaacgcggagttcattgactcgtttaacgatgcagggaagcacagccaccggctggccaccaacaggttcgccgacctcaccgacgaggagttccgggcggccaggaccgggttccggccgcgcccggcgccggcggcggctgccgggagcggcgggcggttcaggtacgagaacttcagcctggcggacgcggcgcagagcgtggactggcgggccatgggcgccgtcaccggcgtcaatgaccagggagagtgcggttgctgctgggcgttctcggcggtggcggcggtggaagggctgaacaagatccggacggggcgtctggtgtcgctgtcggagcaggagctagtggactgcgacgtcaacggcgaggaccagggctgcgagggcgggctcatggacgacgcgttccagttcatcgagcgccgcggcgggctgggcctcgagtcggggtacccgtaccagggcgacgacgggtcgtgccgctcg

SEQ ID NO: 5699 - DNA, 949 bp, Sorghum bicolor
  Clone ID: SORBI-28MAY03-CLUS22378_1
tggaaggagcccagctaattggtagacatgatgaagcaacaatcttcacgttgcgtcagcttgctgaggctaccaaaaatttcagtgaggactatcttttggggcgaggaggatttggttgtgtctataaagcaactcttagtaatggacaggttgttgcagtcaaacaacttgatctaaatgggttccaagggaacagagaattccttgtggaggttctcatgctcaacctcctgcatcaccctaatctagtcaatttgcatggctactgtgttgatggtgatcagcgcttgcttgtttatgagtatatgccattgggatcactagaagaccatctacatgatcttgcacctgatcaagaacctcttgattggagaacacggatgaagatagctgctggtgcagcggctggtttggaatacctacatgataaggcaaatcctccagttatttaccgagacattaaaccatcaaacattcttcttggtgaagggtatcatgcaaaattgtccgactttggacttgctaagcttggtcctgtaggtgataagactcatgtgacctctgcattagttttgacatgtcattgcaaagatgcttattttgcatacattttgaaagataactgtggatacagaaggattgttagaagataatgaggaataatgtgcagcggaaatgtagagcttcaccagagtgagcgccgggaagatttcaccggtggaatctacagtactcagacttgtttcactgcgtacatgtagtttgctttatagacacagacactcctcactccatagatacatgtaatagctccataataggcacacgacctttctgtagtggaagttcagcggttttggatacataacataggatccgctgttggcatacatgaaatggtatgtgttaccacttacaacatatacatttttatgtcattcacaga

SEQ ID NO: 5700 - DNA, 477 bp, Sorghum bicolor
  unsure (1)..(477): unsure at all n locations
  Clone ID: SORBI-28MAY03-CLUS22593_1
ccggggcattgcgcctcggctcagatacacccagcagctagctagcacagatagcgacgacgacgccgccgacgacgacgacatggcggggttggtgaagatcgggacgtggggcgccggcgaccacggcagcgcctacgacatcacggtggcgccgcagcggctggagagcatctccctccgttacggcaagatcatcgacagcatctccttctcctacagggaccgggacgggaagctgcacgccgccgggccttggggcggcgccggaggcgtcagcgacgaggtgatcaccctgggcgctcacgagtacgtgacggaggtctcagtatatacctgcgatccgccgcacgcccccacacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 5701 - DNA, 667 bp, Sorghum bicolor
  Clone ID: SORBI-28MAY03-CLUS22511_1
ctactggatcccgaaccccccaccaccaccagtccaccaccgccaccgccgcccgcacatgcacgcactgactcacctccatcgaccccgcgttctcacctccacgcccccaacacatacaagagcgaaccatcccccgccatgccgaccggctccacccaggcactggcggcgatgcaccgaggcggcgagacaacgacagagccccaccgcctgctgctgcagcgcatggagccgctgtttcgcccggcgccgacgacgacgacgacgggcaggaacagggacgacaggcggctgacgaagctgctggtgaacgtgacggtggaccgcagcctgtggcccgtccacctcgtgctggacgccgacgccaccgtcgccgacctcgtgcgcgccgccgtcgccgcctacgtccgcgagggccgccgcccgccgctccagaccgggacgcccgccgacgccaccgacggcttcgagctccatctcaacaagtactcgctcgagagtatgagcatggaggtcctactgctctacgtcggctgctcgctgctttttgctctgcttgcgcgcacaggcaacgagggcgtgtccacgcgcacatgccgcctttcttgctttgcttgcatctttaataataatctgaagaatgaaagtttcattgcatccatca

SEQ ID NO: 5702 - DNA, 604 bp, Sorghum bicolor
  Clone ID: SORBI-28MAY03-CLUS22644_1
ttcccaattcctagcttccttcactaatcagcgagaagatcagcgcaaccaatcctctttctcctgcacgagggcagcttcccccaatcgcacccgaacattcagatgggaactcgcaaaaactcttcgatcggatgaggctgagggcttgcaaaaacctcgtggatctcccaaaacttagaggaaacggagggagacggacttaacccggaagcggaagggaacgttgccagatttcgcagatctgtagattaccatggcctccgagcaatctctgcacatgaaaacgggagagggagaagcgagctatgctcgaaactctaccactcagaatgcagggcaaaacaggatgaagcatttgatacaggaggctgtcagaagcttgtggaaaaataccaacacccgtaaaagcgtagtgatcactgatttgggatgctcagctggaccgaacgcgttgacccttgttaaaactgcagttgatgcaatatttcaccattgttcagatcataaggaaatggtaccggagatatcagtgctgctgaatgatctcccggataatgacttcaacgacgtggcaaagaggttgcatgcattccagcaaagc

SEQ ID NO: 5703 - DNA, 741 bp, Sorghum bicolor
  Clone ID: SORBI-28MAY03-CLUS22647_1
ctacgatcagcctcgattggaattcttcctccctttccctcgaatcctcgatccccagtgtgattgtgcagtgttgtctttcttgcctgagatacaaaaaagagatcagctcctgagccgatcccccatggctgcttcttccctctcccttccggttccagcaacgcaggccgcgctccggcacgggccggcgctaccgaggaggtcgccggcggcggcaacgcgatgcgccgcgttacgccgggacgcgagcggcggccggggccagtacggaggcgcgctggtggacgaaggcatgtccgtgctgcgtcggcggatccgggaggcgcggatggcggagaccaactacgaggcgcccgccgagtgggcgccgggggagaagcggtactacccggcgtacgtctccgacgtgtccagcctcgtcggcgcgctgcagctgctgctcatgggcaccaggcccggcgtcgccatcgcccaccatctggcgctgctggccgacgtcgtcctgcaggccgggaatccgatttcttgatcccagtcagaccatttttttgggggtctattcgtctcgccttgaggcagtagtcagccagcccattttttttgggggctttttgttggtagtggtagttcgtcactgccacgtgtatatgattggtgacttgtagaagaaaaaatagttcgccacttcgtctgctgtggaattggtctgaaaatcaaataattatgacagtgtatttt

SEQ ID NO: 5704 - DNA, 616 bp, Sorghum bicolor
  unsure (1)..(616): unsure at all n locations
  Clone ID: SORBI-28MAY03-CLUS2156_1
cgcgtccgaaaatgagcacgaacctgggaggagccccttgttgctgcttccgcttgtcccagttgcagcccgccgccgttaggctccggttgccgcctgctcgcgccacagacacttcggcttcccagtcgccggcgcgcctgagggcggtgctggagcaggtggaccaggcgctaagcaaggggaacgacgaggccgcgctcgctcttgtgcgcagttcgcagggggtttccggcggactccgggcctttggcgccgccaggcaggtacctcaacgactttatacattggatgagcttaaactgaatgggattgatacttctgctttcctatcgcccgtggatctgacactaggatcaattgagagaaatatccaaattgctgcaattcttggagggctttctgtatctgctgcattagagctttctcaactccaaatcctgtttctcatactaggtctactatctttgtggtccgtggagantgtatattttggtggtggggtgagaaacttggttcttgatacaattggtcactatctcagccagaagtatcacaacagagttgttcagcatgaagctggtcacttcttgatagcatacttgcttggagtgct

SEQ ID NO: 5705 - DNA, 791 bp, Sorghum bicolor
  Clone ID: SORBI-28MAY03-CLUS21596_1
ccggaaccttgtttacctgcagaagaaattaggaatagccctgctgctgccacggaaaaagctgtcgatctctgtgcattcgaattcttcgcctcgccaacagtccatcgtagtccagaacaatcttgcacaagctagatctacaccactgaaagctggcaaaaacattatcggatcaaagaaggtgagagcagctgtggccttcccgttcgagcttatcaagccttgcagcttcagtggagacatcaccttgaacgacataaacaagaagctccatgctccgccgccgtacaagatcaggcacaagagcaatgaggagcccaactcactccaagcctcggctatgacggggaaacctgtggtccacaagaccaagatccacaccgaggggggaagggggagcataacgataaccagaaccagaggttaagctaaccatttgtgatgcgagcacagtggctatgctaacattcgcctttgcatttctggcgctctgggttcgtccccaattggttttgtggccggagagatgcatgaccttagtagagtgcttgtagcatttctgtgcttgctgtttatgggatagatgttaggtagttgggtgttcgttcacgcttgtaggggtgtcgcggctgtgcttgtttttccgttgttggaaaggtgaagtagttgatttagtttgattaatacggacatattgatttggtgaggttatgtaaatctgcgagatgtgggcttgacgaccagaaacttggtttgctatctggttggtttttgcctgaactgttctg

SEQ ID NO: 5706 - DNA, 697 bp, Sorghum bicolor
  Clone ID: SORBI-28MAY03-CLUS21619_1
gcacgagggccaattccccatcgagacatcggcccgtccgcacgaatcactgctctgcgctcacccccccgccgaacctcacccccgatctgattgaatcaaagaagcggcggcggcgatgggcggagaccacggcggtgggcacgccggcggcgacttccgccagaaggtatggagcatgacgggcgggccctactgccgcccagtccactggcgccgtaacaccgccatcgccatgttcggcgtcttcctcatctgcatccccatcgccatgaagtccgccgagctcgagcaacgcccacatcacccagtccggccaatcccatctcaactgtggtgcaaaaactttggcaagaaggaatactgaaggaccttccaactagcatgaagcgcgggcaccttgcttctgccttctttttgcgaaaactcgtgcttagtgatacttcttggtttcggaactagggcatactcttccattctgtatagcacataatttgaatctctttcttttcgctagctcattaaatatgagcatttgctcttgaacttacttaaactgtccaaacttatgcatctgatgaatccaccgcttgtgattgaggtggaaatgcccctcatatctttgatctagtagtgcaatgaaatgcagtttgggagtcataataagcatcatagttatatgtgtgggtgactgacc

SEQ ID NO: 5707 - DNA, 738 bp, Sorghum bicolor
  Clone ID: SORBI-28MAY03-CLUS21765_1
gcccgggaaggagacagatagagaaggatactgagaaggcaatgaggatgactacaaggcaaacattaactgagatatggaggtctggaggcatgaaagggctgttcactggcgttggcccacgtgttgcacgcgctggtccatcagttggtattgtcatttccttctacgaggttgtcaagtgcgctcttcatcaaaggaacacctcatgacccagttttgttgataagatgggagtccattcactttgtaaaaacaacactgtccgtggtttcccaaagtaggcctggttactctgaccttcggacgggcatggctaggtgtaacttggaagatcagagtgctcagcagtcaagactaaacaggatttttcatggacaatgtccatttcggtcgaggatgacatcagttttgccatggagcaggctccagtttcgtctggcaggttttggaccatcgtctaagcttatgctttgagtgacctgaagctgctttggttaacttattaggtaggtcctgtaattgaaggtgttagtgcagatcaataataccctagaaactacagaagaaattttgcagatcctagtctcatgtcgatgctttctctagaccatgttcggttgatgaaagagcatcttgttgctggcttaggtttaagttcgcaacaagtttatgttgtcggtaagatctatatgtgcgtgcacgatcgctgttcaacaaagttatattggttaaagg

SEQ ID NO: 5708 - DNA, 819 bp, Sorghum bicolor
  Clone ID: SORBI-28MAY03-CLUS21625_1
ccggggccacagcaaggaaacttccagacaaaccgctcacagcaagatggaagaggctatgccccacagcggaattatgcacaaggtgggcaggatggtagaggttttggaaggaatgattacgcagaccgttcaggctacaatgggccacctggtggttttcaaggtcaagctcagtaccaagggcatgtaaatccggctggacaagatcaaggttataacaacccacaagagcgcaggaacttcccgcaagggcagggaggaggttataggcctggtggtccttcagcacctgggtcttttggtcaacaatcagcacctgggtcttttggtcaacaatcagcacctgggtcatatggccgaccatcagcacctgggtcttatggccaaccatcaacacctggatcttatggccaaccttcgacacctggatcttatggtcagtcatcaacacctggtaactatgggcaggcacctccatcagcgaatccaggtggtagagttcctggtgcgaatcctagttatggtggggatggcagacaggggacaggaccggcatatggtggagataactggcaaagagattctggtcagtatcctagcccaggtgaaggacaagggaactggcagggaaggcagtaagagcttgagtgttccattgaagacaagcatggtacttgagatgtagaaatccccacctgtaaaataaacaactctggttattattcttctctcttttttgcttgtattcgaactctaaacttatggacacgtgttattaccaggacgccgatgcaattactattttagttttttttg

SEQ ID NO: 5709 - DNA, 841 bp, Sorghum bicolor
  unsure (1)..(841): unsure at all n locations
  Clone ID: SORBI-28MAY03-CLUS21685_1
cgatttggtcagggcacaaatgttgacaaggcggaagaagaaaaaagaaaggcccgagcagcaagatttggagatacatctagtggatcagctcaggaaaatggcaaagacagctcgaagctggacgcagctgctgttacaggcacagcttgatttcagcagtccggctttgatgaggtctcagatattatccgacttttggtgaagccatagcttgtacaccactaactgcatgaacgggcatcacgtgtttcccagtcatgctgagtgatgtttaccgtgtatgactttcttagttgctgggcactggcagtgtggctagatttgctgcctggtttgtggatggccatgccgtgatgtaccttcggttgccgataccatttggtggatgatttcatttccatgtaccccagtttggactagttaactgttagaagacaacaaggtggccctcttttgttgtgcccaaaaaaaaaaaaaaaaaaaagctgggagctggagccccgtccccngttcagcttgtccaagaagcanngtgagtttgttgatgggttgtatttatccntgataggctgtttgtgtagctcagaaacaagaaagaagaatagaatattggctgaaaaggtggccgcctgttttaattttgtttacgccgtatcatatgtaaccttttaacattccctgtttttaattggaactcactgcgattggcatctggcggttggtttggaagtcgcgtcttgtcgctagttgctgcagtgtgtttgatctgcttgaatgatgcactgatgtaatccgactgttgtaatgcgtgcctcctaattgcaaattttgattcgcc

SEQ ID NO: 5710 - DNA, 875 bp, Sorghum bicolor
  Clone ID: SORBI-28MAY03-CLUS2323_1
cgtccgcggacgcgtgggttatgtcttggcaccaagctggagcatgtcattagctcagttagcccatgatgtagctgagaagcacccagcgatcgagggtgatgtgatcgtaaaaccatcagatgaaccttctggttcggcaagcctaggattatcctttacctgatccacttcatcctctttcagaatgcatttgagattgcatttttcttctggatactgagcacttatggattcgactcatgcatcatgggacaagttcgttttattgtgccgaggcttgtcatcggggttgttattcagcttctgtgtagctacagcaccctgcctctgtatgcaattgtaacccagatgggcagctgctacaagaaggagatcttcaacgagcatgtgcagcagggcgtcctgggctgggctcagaaggtcaagatgaggaagggactgaagggagctgcagctgctagcaagaacgaatcgacgatcaatgccgattcggcaggaccttctgttaagattgaaatggccaaggctgagggggaggatgttgaggtcgttggaaacacagggtgatcagtgatgggacagtagggttcccgtgttgtaatgatgtaacatgttcatatgccatcatttttttttttgtagatagttgttgcagcagccgcgaagtgtttgtcgtagactcgtagtatcttgaagccatttttgtggtctgtgcatgtcatgacctggaccctggcctcctaataggagtgggtgagtttaggcccgttagccttgtctgttattagtccagtaggaaccagagtcctatacttatactaggaaaaagtccacattacattcatcaatatttgcgaaagtcttttttctct

SEQ ID NO: 5711 - DNA, 609 bp, Sorghum bicolor
  unsure (1)..(609): unsure at all n locations
  Clone ID: SORBI-28MAY03-CLUS23326_1
acgcatcgacgggcacgagtcccgacgggctccccgcatccactaccactcgtcccgatccggatcccgatcccgatccgatcagctctgagatcgcgatggcggacggccgatgctgcacgttcctcgagatcctcctcgccatcatcctcccgccgctcggcgtcttcctccgattcggctgctgcaggattgagttctgcatctgcctgctgctcacaatccttggctatatccctggaatgatctacgcaatctatgtccttgttgctctcgactctgaccggcatgagagggaatactatacccttgcttagtgcatctggttgtgccaggcctcaatctttagctctttacggcgcacagttgagttgaatcagtattttcatgtggattgtctgacatggtataaccggcgatgggtaaccaagtgttctggtccagtgctatctctttcttacccaacttgtgacctatttactctctatttggtccagttattcaatctgtaattgtgatactagaagagaataagatgtacctgtatttctgagagcaattgtgatttgtaattgntgctaccttgnttatatattgcaatattccctc

SEQ ID NO: 5712 - DNA, 817 bp, Sorghum bicolor
  Clone ID: SORBI-28MAY03-CLUS23412_1
gcacgagggacgcccactacaaaacgccccgacagtatgcagatcagctaagcctacattcgacagtaaagcaaaaacctgcagagctgcagggatcggaatcgaagctatagctagccacacgtagatcagcagatgaagctgttcgccttcgtgaggcgcgcgcgccggtcgcctgatgcggcgcccgaggacaccgccacggccaccgccgtctctgcagccgcggggaagcggcgccggaggccgtcttcgtcttcctcttcgtcgtcggggtcggcggcggcgtggaagccgacgctgggcgccatctccgaggacgccgccatgacggccgcgtccatggcgaaggcgcaggcgaagccagcctcagcgccgaaagccagggccaggtcgcctcgccgtgccacccgggcggcgagctacgacgacgacttgctgcactacggccagccgacggtgctgccggcgtgagcgccggcgagtttcaagcaacgagcaccggcggccggtgtacatcgtgtgtgtgtgtgcggtggcgcggctcgacgaacgacgacggtggcttcctgctttgtgtgccctaaacaagattgatgcatgctcacaaagctaatccctagtttagtgcttctgatctatgtgcatacacaactctgctgtttcggattctccttctcccccaccacctctcggcagtgctcgccttttgtgattcctcttgcagccatagtgctacaaaatgctccgtttggtttcaccacgacgtggccacttcccactgttccgacgccattgttttcaaacaaatgggaaa

SEQ ID NO: 5713 - DNA, 1254 bp, Sorghum bicolor
  Clone ID: SORBI-28MAY03-CLUS23438_1
gcacgaggaagaaaccgcctatcagcggacgttgctcgttctcatcgcccacctctgctcctctctcgtctctccccattcggacctcagccaccatggcttcttcaaagaggagaggcggtggtggtgttgccggcggggacaagaaggatctattccatgttgtccacaaggtgcccgccggcgacagcccgtacgtcgtagccaagcacctccagcttgtggagaagcaaccggatatggcaattgtgtggttctggaaggcaatcaactcaggggacagggtcgacagtgccctgaaggacatggccgtggtgatgaagcagcaggatcgttctgaggaggcaatcgaggccatcagatccttcaggcacccttgctccaagcaggctcaagaatccctcgacaacctcctcattgatctctacaagaaatgcgggaaagttgaggaacagattgagcttctgaaacagaagctgaagatgatatacctcggtgaggccttcaacgggaaggcgacaaagaaagcacgatcccatggcaagaagttttaggtctcaatccaacaagagacgtctcgcattctgggcaatcttggctgggcttacatgcagcagaacaactttgaagccgccgaattggtgtaccgtaaggctcaaactattgaacctgatgccaacagggcgtgcaacctttgggttgtgcctaattaagcagggtaggcacgaggaggcacgacaagcactcgaggatgttcgactacgtagaatctatggatcagaagatgaaaaggtggttgcccgtgctgagcagcttctccgcgaactaaacccattgaagtgtgtttcatcgccgtttgaagttggcctcagtgtccatgaagagatcatgggtaaactagatcttatgatgaatgagtggacgccgttcaggtcaaggaggctgcctgtgtttgaggagatagcaactttccgggaccaaatggcttgttgatgcattattctgcatggttttatctcgtcagtgtcacccttttagaagtttttgttcatatactgggtgcgcgggggtgagggcgacagtgagaaatagagatcagtagatatcatatagctggggttatgcaaagcgttccctttaggatagtgttgttttggttcatgttgtatcattgtatggttcagattttctcaaacagtgaacaaatgttggtgcatgtcctgaacttctacaggatttacagttggctgttgg

SEQ ID NO: 5714 - DNA, 537 bp, Sorghum bicolor
  Clone ID: SORBI-28MAY03-CLUS23331_1
gagttctctacctactacagagtcagagaccaacaggcctctccgcctccggctcccccttctcgagcgctttcggcaccgcggcacggtaggatggcggcggcggcggcggcggccccgacgaggacagaggtgctggcgctcttccggtccttactccgcacggcgaagcagttctccgactacaacatccgcgagtacacgcgccgacgcgccgcggacgccttccgcgagaaccgcgccctcgccgacgcgccggccgccgcggcggcgttctcggaggggaagaagcagctagaggttgcgaagcggcaggcgttggtttactcgctctacgcccccaaggccaagagcgtgatggagttgaaggtgcagtgatggacgaggtgctgcgcccttttcttcctcatcgtttccctttccggattcgttccttttgtgtggtgatgaaactataaactgatgtgttattacctttgctggatgattgacatgatattgcttctttctgtgcaataaatcactaaattctactgc

SEQ ID NO: 5715 - DNA, 543 bp, Sorghum bicolor
  unsure (1)..(543): unsure at all n locations
  Clone ID: LIB5121-002-A1-PF1-A9
ngatcattcgaacttgcgcctccccagccacagctgctgtggcgacccaaccccaggccgactccacctcccgcggcagggtaggatggcggcggcggcggcggaggacccgacgaggacagaggtgctggcgctcttccggtccttactccgcacggtgaagcagttctccgactacaacatccgcgagtacacgcgacgacgcgccgcggacgccttccgcgagaaccgcggcctcgccgacgcgccggacgccgcggcggcgttctcggaggggaagaagcagctagaggttgcgaagcggcaggcgttggtttactcgctctacgcccccaagggcaagagcgtgatggagttgaaggtgcagtgatggacgaggtgctgcgcccttttcttcctcatcgtttccctttccggattcgttccttttgtgtggtgatgaaactataaactgatgagttattacctttgctggatgattgacatgagattgcttctttctgtgcaataaatcactaaattctactgcaagaaaaaagaaca

SEQ ID NO: 5716 - DNA, 635 bp, Sorghum bicolor
  Clone ID: SORBI-28MAY03-CLUS23415_1
gcacgaggcagagcaccagcagcgccactgatcgattcgaagccaagattttagtcgtacacagaagcatggaaggtgcaggagaggaagctcggccggtgctgctgccgccggtgcaagagctcgccggccagctgggcgccgcggccgacgtgccagctcggtacgtcgcgcgcgcaggcgcaggcaacgacgacgaccgcaaggccacggaaaccgcgccggtccccgccatcgacctcgcccgcttgtgccagccgggcggcgatggcggcgccgccgacgaggcctcgaagctccggctggcgctccagtcctggggtctcttcctggtacgcacacgcaaacgcacagaataatctatatgtatatcttgctacgagaagtataccattattcgatgctgtggagcacgtatcgatgtatgtccaggtgaccaaccatggcatggaggcatctctgatggacgccatgatggacgcgtcgagggagtttttcaggcagccgctgcaggagaggcagaagcacagcaacatgatcgacggcaagcacttccagatcgaagggtacgggaacgactgggcgccgtcggagtcggaggagcaggttctggactggaccgaccgcctttacct

SEQ ID NO: 5717 - DNA, 454 bp, Sorghum bicolor
  unsure (1)..(454): unsure at all n locations
  Clone ID: LIB5121-001-A1-PF1-C2
ngagttcagtagccagagcaccagcagcgccactgatcgattcgaagccaagattttagtcgtacacagaagcatggaaggtgcaggagaggaagctcggccggtgctgctgccgccggtgcaagagctcgccggccagctgggcgccgcggccgacgtgccagctcggtacgtcgcgcgcgcaggcgcaggcaacgacgacgaccgcaaggccacggaaaccgcgccggtccccgccatcgacctcgcccgcttgtgccagccgggcggcgatggcggcgccgccgacgaggcctcgaagctccggctggcgctccagtcctggggtctcttcctggtgaccaaccatggcatggaggcatctctgatggacgccatgatggacgcgtcgagggagtttttcaggcagtcgctgcaggagaggcataagaatatcttacttgatcccacggta

SEQ ID NO: 5718 - DNA, 776 bp, Sorghum bicolor
  Clone ID: SORBI-28MAY03-CLUS2345_1
cgtccgggatgcttggaagagatgctttgttgatccctgttcaattgcacacatggcacgctactgcattgttgatagccatacatgggatatgatgccactgtctctctacttcaattcaacaatggatcaatctgatcccagagatgagaatagaattcttctccaaaattcttgtggtggcagcttgtccaagtatctcatggtggcctccgggagaatgtcagtttttatcctcctagcacgagccgaaaaacaaatcaaggcttgggaccatgcagttggggtaatttgtgttcaggaagctggagggcagacatgtgactggagaggggaacctttggattttgctgctgaccagacagggcgcagaatcatctacccttggggtggtgttctggctacaaactgtgctcttcatgacgagcttgtagaaatgatcacagcaacttataattagcagtgtcgcattgctttggacccaaacacagttatgattttttactaaaattttagctaggtgataccgctagaccatcagattgtattccttctccccgttgaaagaaaaaaccacaaacatgtctgattattacttccagtgtcattacgaaaaagatatatacatgatggaaactgatgctgtctctgaatggtgcctcaacagcttcagagacactgctttgaatgaagtctactttctgcgcttttgtaatctgtacttttttatttctgtaataaaacttcagtaggggctcccttgcccctcctgctcc

SEQ ID NO: 5719 - DNA, 742 bp, Sorghum bicolor
  Clone ID: SORBI-28MAY03-CLUS222_1
cccgggtacgacccacgccgtccggccatgatcgccgtcctctgggaaaggtgttccgtggaactgacaccgttgccgtgctgatcgagtgggtgctggcgaggctcgtgctgcaccctgacgtgcaggcccgtgtccacgacgagctggaccgcgtggtcgggcgtgaccgggccgtgaccgagtccgactcggggtcactggtctacctgcacgccgtgatcaaggaggtgctcaggatgcacccgccgggcccactgctgtcgtgggcgcgcctggccacgtcggacgtgcaggtggacgggcacctcatccccgccggcaccaccgccatggtgaacatgtgggccataacgcacgacccggtacgtgtgggcggagccggcggagttccagccggagaggttcatgggatccaccaccggcggcgagttcccgataatggggtcggacctgaggctcgcgccgttcggggcgggccggcgcagctgccccgggaagagcctcgccatggccaccgtggctctctggctcgcgacgctgctgcacgagttcgagctgctcccgtcgcccctcccggcgcgcggcgtctacctgtcggaggtgctcaagctgtcgtgcgagatggccgtcccgctggccgtgacggcgaggccccggcaagcggtgtgatgacgcgtctcggcggctgggacgacggagcaggcaggcaggcagtcagttggggtatcagtctctctgt

SEQ ID NO: 5720 - DNA, 523 bp, Sorghum bicolor
  Clone ID: SORBI-28MAY03-CLUS22204_1
gcacgaggcaagcgagggttttgctgctgccccggtcaagaggaagcggcgcggcgcgatggcggtgggcgacctggcgttcaaggcgctgacggctgggctcggcgtcgccacgctctacctcgccgccaccttctccgtcaacgtctaccgcggcctttcgtggcactccgagcaatccaagctagaaaaggcgaaaaatgaagattgacaaggatcagcaggcagatttagatagcagatgaaaagagcggagggggcctttttgttgatgtcttatcatgtcaattgtgtttgcttgtgccgcagacctctcgagatatccggactgtatcttctagtatgtgatatacgggatggttattcatctttcagcatcataaatggcttttgaaacatttttactttccacctttgcgtgtgtatcctttgcagccaacttggcgtctatagcacctcaaatagtactgaaatatggctaaatgataaaatcagaagttttctttaaaaaaaaaaaaaaaaa

SEQ ID NO: 5721 - DNA, 600 bp, Sorghum bicolor
  Clone ID: SORBI-28MAY03-CLUS22263_1
tcctcatgtgccgggccatcgatgccccccagctgacgacggccggcgcgctccggacggcgctcgtctccgtgttcgaggagcccgtggtcgacgacatggccgaggcgcagagcaaggccggcgtggaggactgcgtctgctgcgccaccgtgcacggcatcggcccgtcgatcggcgtgttcgactcgatcaaggacggtaagctggactggacctgcatgtacccttctcctctgcactccaggaagcaggtccaggagatctttgacaaggtgaagcagattttgcaccatgcggcggcggctgaagaaaattttgaagactgcgcgtaacgcatttcgggagcttatggggcattacatttcggtaaaatttattgctccatttgtgaggcattcttttctgatgcaggttgtaatgtatgtaatgtacagtgaaatattagtgaacaggcatcacttatgccttgtgctagcgttttattctttcaattctcgacgcaatgaaaatgttttggggtcttaccgttgagtcttacttaagaatgcattgtgtctgaaacaaatgccaaatataaactcctgatgcgttgcctgc

SEQ ID NO: 5722 - DNA, 618 bp, Sorghum bicolor
  unsure (1)..(618): unsure at all n locations
  Clone ID: SORBI-28MAY03-CLUS21996_1
aggccgggcttctcattccatctccccttccagccggctctcattcctcacacggcacaacaaccaggttatggggcaggtcgtggcggcggtcctgcttggacgacggagcccccagctgctggtggcggcctctcccatctcctggtgattgcagcccccgccctcatgcgcacggcaagcatcgctctagccatgactactcccgcaccaccaggatggtgccccaaccacgacgtctctcgtaccggcagcggtggcagcatctacaccaccagcaacgacaacctccacatcactgtagattcgtcgtcaccttccccggatctggcggcccctgtaccccgacggcatgtgcggaccctggatgatgcagtaggaacaggcagagccgcagaggtgccaagtccatctatgcgtgagtggagagtaattaaagagcacaaaaaggggatggcgatgatggtaatctagatgggctgttagaaatgtacatgtgngaccttgcacatatggttatatatggctattgatatatgcatgtgttgatttatgtaaatacgtatgggtgctgtgagcatattttcatccatcgaaatattcaaatgtatatgggcg

SEQ ID NO: 5723 - DNA, 620 bp, Sorghum bicolor
  Clone ID: LIB5050-011-R1-XP1-A9
tttccatccatctccccttccagccggctctcattcctcacacggcacaacaaccaggttatggggcaggtcgtggcggcggtcctgcttggacgacggagcccccagctgctggtggcggcctctcccatctcctggtgattgcagcccccgccctcatgcgcacggcaagcatcgctctagccatgactactcccgcaccaccaggatggtgccccaaccacgacgtctctcgtaccggcagcggtggcagcatctacaccaccagcaacgacaacctccacatcactgtagattcgtcgtcaccttccccggatctggcggcccctgtaccccgacggcatgtgcggatcctggatgatgcagtagtggacttctacttcatgattgattctgatgtctactacaggaacaggcagagccgcagaggtgccaagtccgtctatgcgtgagtggagagtaattaaagagcacaaaaaggggatggcgatgatggtaatctaaatgggctgttagaaatgcacatgtgggaccttgcacatatggttatatatggctattgatatatgcatgtgttgatttatgtaaaaaacgtatggatgctgggagcatattttcat

SEQ ID NO: 5724 - DNA, 812 bp, Sorghum bicolor
  Clone ID: SORBI-28MAY03-CLUS2229_1
ggcacgaggccaaacccggatcagactgtaattccccaattcgattccttcctccctgggttggcgttggcacgacgacgacgacggcgacagcggccggggcctcggcggtgtccccgacctcgccggaggcgggggcgagggggcgcagtgcgcgacgcgacgggtggtgcagtcccgctgcgtccgggaggaagtcgagcccggccgattcgtccgcaagtgcgagaagacggagcagctcctccgcgactgcgtcggcaggccctctgaactggtggaatccaaaaccgaaaacactgaggaagatgtcacagaagaaatgaaaagcggttcactttctcttggctttccaagaaacgagccctttgcattccctggactccgcagtgacatggaagcccttgagaaagatttctttgggagcctagggaacgtcctggacgaagctgagcggatgactaatagtttcatcaaatcttttggttttccacctgttcatgacagagaatcaagtccatttcgacgacagcctgcagagaagcatattgaagaagatacggcaaggaagactaaggagagtgactactctgaattcaggagcaagatttcagatgtgtaagcagctgtagagctgcagtttgctggcatgtgtctacagagctgaaacctgggaagtgagagctttgcaatctcagggtccttgtatgttctctctttggaacaaaacgcgtacttgcgactttcagctgctttttagcctcgcttagtatggtaatcgtaatggtaggtgaagaagaaatatggtaatc

SEQ ID NO: 5725 - DNA, 491 bp, Sorghum bicolor
  unsure (1)..(491): unsure at all n locations
  Clone ID: SORBI-28MAY03-CLUS23666_1
cggaacgccacgcggcaccgcgagncggccacggcggtcatccaggcgctcatggctgcagacgaggccggcgcgggccaccagcccacctgctcgctccccgccggcgatgagctgcctgtggccgtcggctcctcgcagattaacgccgccacgcccgcatcgatgtcttccgccgttggcagcctgcttctggtcttgcttggtgctgccgtcgtcttcttgtcctgctgtttctgatgaaatatggttgcagatcgatatgtgtcgcatggcatggtctcttcgttactactagtacttttttagttcttttttttcgcagtagttcggacaagatttagagttaagatgtggggtggacctcgttatgctgtaattatatgttttatccttcacctaattatggtggcatgaatgaatctcacgtagattctatcttaaacgggatacataaaattcgatcgtgtgctacacatcctattattttg

SEQ ID NO: 5726 - DNA, 788 bp, Sorghum bicolor
  Clone ID: SORBI-28MAY03-CLUS23667_1
atccgcacgaggcacacgttgagcgaggacccaaatcccatcaccacaacgcccacaagcttgacgcaggggtagcaatggcgacgagaagctaaaccacgccaatcagagcggcagaggtagcatagcagctagctgcacaaacttgagcacctaccctctgtactgtgcctgtttttcagttggtacaggatgctacacccattgctcgcggcagtaacagctgccgtctcttcgtccttcgtctcaccgccgcggcgagtcccggcttctccgggtccgggacgacgacgacgacgtcctggtggcttcgcggtccggtgcgcgccgaacggaggtggcgtgacggcaggcgccgacacgaaatcgaagctcaaggtgggctccccgatcgtcatcgtcgaggcgcccgtgatgctcaagaccgccgcgtcggtgccgtcgctccggcacaacagcggtcaggtcaaggccggcgacgtcggaaggatcatggcgcggaagcccaaggacgtctgggtcgtgcggctcgccgtcggctcatacctgctggacggcaagtttttcaggcccttggattctgacgacggagacggtgatgagccccaggcccaggatgaatgagtgatcaatgccttgacgattgaatcgcaagtttactcacaataatgccgtgcaaacatgtccatgcctatgcatgattgcaatttgcaatgtactgtactgtagatgtgtaacttctgccgacagtagtaagtgattactatttgtattagaatcatcaactc

SEQ ID NO: 5727 - DNA, 892 bp, Sorghum bicolor
  unsure (1)..(892): unsure at all n locations
  Clone ID: SORBI-28MAY03-CLUS23701_1
aattccgagaaacagacgacgggggcacgactcgtacggtcatacccgggctgagcctccgatagtccgattcgatctcctcctccgcttccacctctgccggtgcgggggcgcggcgggagtcatggagggaaggtgtcgaggaaagccagcgagataacccacctcaattccactcctgagctcgcgccctcctccggcgccgtcgtcttccctgtctcagtccctcacctcgatggactcacttgccgccgcctgcctctgctcccgccgtcgccgcgctcgccgactcctcctggccgctgcggcggccaccgccgggtacggcctctaccgcctctaccgccaccaccgccgccgcatcgtcgccgccctctcccttgccgacgccgtgtctcaggtcggttccgacctcgccgaattcctccgctccgactccgaccaggtcccacgaagcctcctccagctttccaagctcgccgcttccgaacccgtctcctctgctgcgtcttccctctccgagtccctcgcctccggcgtcctccgcgccatctctcaccagcgccaattacatcaacagcagcagcaaaacccccaaaccccgctccaagatcggatcttggatcgcctcctctcccccgagggcgccggattcgcctccgctgtcgtcggaagcttcgcgaggaacctcgttttgtcctcctgcgacgcccgcacggcggacgccggcgaccgcgaggagccccggtggctggctgcgctctgcagcgccnacggggaaggaggctgccgcggacctcgtccgagtcttcgtcagcaccgccgtagcggcctacctcgaccgcaccgccgcagtgcgcaccaacagccagctgctcgctggcctctctga

SEQ ID NO: 5728 - DNA, 577 bp, Sorghum bicolor
  Clone ID: SORBI-28MAY03-CLUS23678_1
ggcgggactttcgtagactgtctagaggaactgccaccttctagtaggttccaccccaattcccacaagggatcgagatgaacaactccacctcgccggcggtggactggggtgacgactccgcgggggagatggactctgaggacgcagcgccttcctcctccgtgggcatgggcgtcggcatcgccatcagcagcatgatggaggtcgacgccgacgaccgccgccccccgtccgcccccgacgccgacttcttcaacgccttccccgacgacttcgacgaccaagacctcgactgactgccgctgccggcgccgccgttgctttgctcgcccggcccccttccaccagggggttgtatatgaacctacttactactactactactactactactactactactaccaaggaagcaccagtcatccatcacattgtccttgtgttgcagctctagtggtgttgtattgtcagctgtgatcatgtaagaacctgacctggtacgttatgtatataagaagaataagaacctgttaacttctgtggtatataagttcataccaaaaacaaaaaaata

SEQ ID NO: 5729 - DNA, 857 bp, Sorghum bicolor
  unsure (1)..(857): unsure at all n locations
  Clone ID: SORBI-28MAY03-CLUS23777_1
ngagctccaacacaacacaacacaacacaacacaacacaacacaacacaacacttataaaaccagccggacagagcgaacgaatgaacctaataagctcggtatatatatatatatgcaggaaggagggcaagaaagaatagaagagatcgaggccgccgggggaacggaactgaattgaagcagtgatacatgacgaaggtggaggagctggcggggctggggcacctgctggtgttcgccttcctcttctgcttctccgccttcatggtggcccccgtgatgaccgacgtcaccatggcggcgctctgccccggccgcgacgagtgctccctcgccatctacctcactggcctccagcaagcggttactggcctgggcgcgctggtgctgacgccggtggtgggcaacctgtcggacaggtacggccggaaggcgctgctggcgctgccggccacggcgtccatcgttcctctcggaatcctggcgtacgggcggaccaaaggttacttctacgcgtactacgtaaccaagacgctgacggcgatggtcgccgaaggcaccatgatgtgcctctcgcttgcttacgtggctgacagggtgccggagacgcggcgcgcggcggccttcggcgtcttctccggcgtctgcagcgccggcttcgtcgccagcacagtggcagcccgcttcctcccgcctcatccacgtttcaggtctccgcagtggcagccgtggtgacggccgtctacatgaaggccttccctcagnagacggacggcggagccctcatatcctcctcctgcagcagcagcagcagcaataggcgacgaagaggggctcccgggcgctctgccttcc

SEQ ID NO: 5730 - DNA, 1069 bp, Sorghum bicolor
  Clone ID: SORBI-28MAY03-CLUS23924_1
acgatcttccacaccgtcgtcatgggtagggtcattcgcaaccaacgtaagggtcgcggctctatcttcacggccaacacccgcctgaacaagaaccccgcccagttccgcacgctcgacttcgctgagcgcaatggatacatccggggtgtcgtaaaggagattgtccacgactctggtcgtggcgctcctctcgccagggtcaccttccgcaacccctacaagttcaagcacaacaccgagaccttcatcgccaacgagggcatgtacactggccagttcatctacgccggaaagaacgctgcgctcaccatcggcaacgtcctccccctcgcttccgtccctgaaggtaccgttctcaccaacgtcgaggacaagaacggtgaccgtggtgcgctcggccgtacctccggtaactacgttaccgtcatcggccacaaccccgatgagggcaagacccgtgtcaagctcccatccggtgccaagaaggtcctccccagctcgtgccgtggtatggtcggtatcgtcgctggtggtgtcgtcacagacaagcctctcatgatgatgtcgcgtgccaagcacaagttcgctactgagcgcaacagcctaaaggcttctcgtgccaagcacaagttcgccgcgtagcgcaacagctggcccaagattcccaccagcatatcggtccccgctcgaccatctcccggtacgccaccccatcaaaaaaggccggtctcattgaccagctcacgatacgcctgctccggtctaacggccggtcttattcccgccagaaggacgggtatcttccgtggtacccagaagacaaaggagtaaagtggtggctgggttcatggtctcattgggatggtgtttactggcttgcttgcatctattgaaggtactgccgagagcagatggctggtaagctccgagggcaagtactatggcatttggcgcaaaaaaaatctgaaggccgtttctctgtgaaaagatgtgagcgaagaagtgagatgccccgaatcccgaaaaaaggcttccatgagagaagaagcatgcttggttaaaataa

SEQ ID NO: 5731 - DNA, 475 bp, Sorghum bicolor
  Clone ID: SORBI-28MAY03-CLUS2274_1
gcacgaggctatctcctccacctcgtcctctctctctctctctctctctcctccaccaaccataagcgcctccctctctaaaatatcactccatccgagagcacagagcagggtatcttctttttaagattcttggctgcgtgttaacgaacgcagcccagccggcgggcccccgcccgggcgccccaaggacggggactccaagatagaatcatcggcggcgggctcgcgatcgggagcggagcggggcgcatgcgcgagtaccggtacggcgaggacgagcagcatgagccccagccggggtgcggggaaggggcggggcaggcggcggcgaactgcgcggcggtgtgctgctgctgcccgctggcgctgctcgacgtcctgctgctcgtcaccgtccgcctccccgcgggcgtcatgcggcgggtgaggaggaggcgccaccgccaccgcggccggggaggtgccggagccg

SEQ ID NO: 5732 - DNA, 767 bp, Sorghum bicolor
  Clone ID: SORBI-28MAY03-CLUS22777_1
ccggggatccgacccaaagccctcgtttctcatcacgccaccgcttaccccgccgccgccgcgtcggcagcggcgatggcgtcgtcgtcgtcgcggccgatgctccgccgcctcgcagaactggccagaggccgcgtccgcgccaaccaccgcatgctctcatccgccttcccgtccaccgccgccatcgagagggcttcgcagtcgccggcggaggcccaggccgtgcgcatgacggagggttgcgtgcggagattaaaagaattacatgctaaagaaccatccgctgaaggtaagatgctgcgcttaagcgttgaagcaggtggatgttctgggttccaatattctttcgctcttgatgacaagaaaaactcagacgacagggtttttgagactgatggtgttaaattggtcgtggatgacatctcatatgacttcgtaaaaggtgccactgtggattatgaggaggaacttatacgttcagcgtttgtggtttcaacaaatcctagtgctgttgggggctgcagctgcaagagttctttcatggtgaaatagcttcaatgttaccttgaagagatcaataaccagaaatagcattctgtagcggaacatatgctttgaatctgggtgtacaattggtattttttggtagttctgaagatgttccttcttgagttttgttactggtagcaatatcatcacaaactgtgtggttcaatctgtatgcctctaaactgtgatagttgtcttatgatgaccaggttgtc

SEQ ID NO: 5733 - DNA, 799 bp, Sorghum bicolor
  Clone ID: SORBI-28MAY03-CLUS22821_1
ccgggactatcgccgacatctgcgaccagtacattgactaccaagacaagctgtatgataacgagaatggccggctggagttccgcggcgacaactggggtgctctgtggccaggaacttgcaagcccggtctctggatgaatgcagcatcaaggctgggagttctgtacaacctcatcattagagaggaagagctttacactcaggagaggaacaagatgggagagactatccggctcgaccgagacgaagaaatcatgctggtgatcccgccggtcttcaactactgcaccaaggtgctggatcccaaggagcaaatagctgcgagggacctttactgggaggccatatgcagtgatgacaggaaggaaagagactgggagaaagtggagaaggtcctgttggagagtattcagaagaacccgtttgtaggagagcctcgcctggttgctgcacaggtgtatctcaacatggagaggtacgcagaggcgaaggaagaggccgaggaagggctcaagttgctgctggaatggggcatcagctgggacaaaaggatgacatgggaatcctgggtgtcttggggcagggtgatgctggacaaggccaaggagaatgagtggcctcatactgcagcaggcatcatcaacctggggcttgtgaaatgagcagtcagaacatcagtagtattgtggtaaggtaataatgcagtagtaacgaataattgtgggcagcatgtcatgcccttgtctgaagggggggaaaaaaggaataatgttaggcaccattagcccatcttaat

SEQ ID NO: 5734 - DNA, 1077 bp, Sorghum bicolor
  Clone ID: SORBI-28MAY03-CLUS230_1
tcgggaccccattcattccgcatcccaatccgggtctctccggcgaccatctcacgcccacgccgcctcctccccgccccgccgccgtctctatcggagttccctaccgagtaccccgaaccatggcggctgcatcagccacccgccgcggcctctctgcgctcctcctctactcctcccgcgcgctcccccgccgcctggttccgctcgccgcctcggctgcctcagcacacgtcgccccgtgggcccttctcgcgtctcgcggggccaggaccgcgtcgtccggcgggtccgggtactcgccgctgaacgacccgtccccgaactggagcaaccggccgcccaaggagacgatccttctcgacggctgtgactacgagcactggctcatcgtcatggagttccccaccgaccccaagccctccgaggaggagatggtcggggcctacgtcaagaccctcgcagccgtcctcggaagtgaggaggaagcaaagaagaaaatctactcagtgtgcacttcaacatacacagggtttggtgcattgatttcagaggagttatcatacaaagttaaaggattgccgggagttctttgggtgttgcctgattcatatctggatgttcctaacaaggactacggaggtgatcttttcgtagatggcaaggtcatacacagacctcagttcagattcaatgagagacagcaggtaaggagtaagcctcgtcctcgctacgacagacgacgtgaggttgtccaagtggagcggagggagacaatgcaaagaggcccttcgacacagcagcataggccgccaccatttccacagcaggctacacagaaccaagagcagcactgaaaccatgccaccaggagtaggaatgtagcatcagtgtcagagacttcacgcttgaaaccgtcgttgtttataaactaaattcgcgccagaactatttgagctaaatctcgtgattataccattgccccttgtgatttctgactggaacctgtatggctgtatgtgagttccatgtaagctgtgcttcagaatttatgactgaaccattgctgtcctgaaa

SEQ ID NO: 5735 - DNA, 679 bp, Sorghum bicolor
  unsure (1)..(679): unsure at all n locations
  Clone ID: SORBI-28MAY03-CLUS2302_1
gcaatggcagatgttgtttttggtgcaatggttgcggaagcagttcgatcagcagggccggagtttgctggtgatctacagtcattatcttggtcatcgatggctgtaggtgggattttcgggagcttgctgggaggatatgcattatccaatctcccattacatgctatatatgttgttttctcagccctcccattcttgcaactagtttcctgtatgtttgttgaggattctccaaaaggattccacagtgccaatgatgaacacaagtatgcagacaatcagagttctgttactgccttttctgaaaaaggctctagtgaagcacttagatatgagggcactagaaggcggaagggaactcgtaaaaataataaaaggagatcactgtcaaagcgaactgagtctgatgagaaacacaatgggtcaattaattctctgccaagtttgtctctgagatcagccttcttcagtctgtgcacagcttttaagcagccaaacattctgcggcctatggcatggttcttgtctgcctccgttcctcgtccgcatgtctctcctgtctcgttctcctgtcagtctcgcggccttcgtttggacgcatcctttctagggactgcacgtgtgattgggatggttcagtctaatgcttggcacctacacctacnaccgctatttt

SEQ ID NO: 5736 - DNA, 836 bp, Sorghum bicolor
  Clone ID: SORBI-28MAY03-CLUS2309_1
cgcgtccgcccacgcgtccgcccacgcgtccgcccacgcgtccgcagggatcacaaaccatcttgcaacagggagaagatgcgtattgaggcattgggtggatatgtcgatgatgactacctgaacgggcagctcaatgttgcgcgagcaattggggattggcatatggaaggcatgaaggcatgtgatggtcttggccctctcagtgccgagcctgaggtaatgacaacagatctgactgaagaggacgaattcctgatcatgggttgtgatgggatctgggatgtattccgcagccaaaatgcggtagattttgcccgccgtaagctccaagagcacaatgacccggccgcttgctgtaaagaactagttgatgaggccatcaagaggaagagtggtgataacctttctgtggttgtcgtctgcttcaactctaggccgcctcctgttctaacaactcctaggcctcgtgtacagagaagcatatctgcagaaggcctgagggagctgcagagcttccttgatagcttggccgattgacatggggttccagcagccccactataagttttgaccttttccatagcttagcttgggaaataggtttagcatgtgctgtctcataatttcgctgagatggctgttgttgagtaatccagagttgtaaaatatgctgcggcaaattgtatcagcagttgagagtatttatcagttcctgggacataagtcatgaatgactagtcgacatttcgtaggcctccataaaattggtggttgatcgtggtaaaaggctcttaatgcccttgaatattttcctgtgttcgctttggatagtt

SEQ ID NO: 5737 - DNA, 460 bp, Sorghum bicolor
  Clone ID: SORBI-28MAY03-CLUS24357_1
gggcctagtacaatgaccgtaacgaggcccaaagaaaggcaagtgtgcccactcttaagaactttactgaagagagaccggggaagcaactgactgaccaatttgttgtttaacaattccaaatctggttgctgcagaaagccacgtactaggattcagaggatcatgaccagcttgatgggtcagaagtcttctacttctcaacaatagagccaaagagatgtgatggatatgcatgatctcctgaagccaaaggtcctggcggctgcacatattcattccactgataccggaccagatgagagtatattgtaaagtgattgttgtgtatgcatatgtggttttcatttgttgactattgattggagagatggatggtgtaaagagagtggaaagggactgggttacaattgataataatatatgacaaggattgtgaaaaaaaaaaaaaaaaaaaaaa

SEQ ID NO: 5738 - DNA, 653 bp, Sorghum bicolor
  Clone ID: SORBI-28MAY03-CLUS24402_1
cacatggtgcgcgccatggggaggcacgcgcagcacatggcggtgaactactacccgccgtgcccgcagccggagctcacctacgggctgccgggccacaaggaccccaatgccatcacgctgctgctccaggacggcgtctccggcctgcaggtgcagcgcggcggccgatgggtggccgtgaaccccgtgcccgacgcgctggtcatcaacatcggagaccagatgcaggcactgagcaacgaccgatacaagagcgtgctccaccgcgtgatcgtcaacagcgagagcgagcggatctcggtgccgacgttttactgcccgtcgccggacggggtgatcgcgccggccgacgcgctggtggacgacgcccaccctctggcctaccgccctttcacttaccaggagtactacgacgagttctggaacatgggcctccagtcggcaagctgcctcgaccggtttaggcccggaggatccatagagtgaacatgcatgaacaacgccggccacgagcaggaaaaaaagaagaaaaaactatgcaaaacattgttttctgcggcatctcaccatctgactatgtgagcatatgccaataactggatctttggatgcccccttgaacgccactattagattcccctcagggtccc

SEQ ID NO: 5739 - DNA, 494 bp, Sorghum bicolor
  Clone ID: SORBI-28MAY03-CLUS24392_1
ccctcaagcatcacacaggcttcaggcacgaggaggcagagctaattgaatgcacgaagatgctggtgagcgcacactcgactgccgctgagagcaagctgagggttgtatacaagaagtattcaagcgagcagttcggaggtgtcgcgcttcgcccacccgcagtggagatctgcaagtaaacgaagattaactttgtgcaatccgtgtttgctattgatttaagagagtgtaatggaaggcgagtctgacattcgcgctaatgtttgcttgtttcgggagtcaagaaagtttgaatacttgagacagccgtttgtttgctaggctgttctcagagtcaggtgttgtctgacttgtggtggcaattaggatttggatgtttgagttttatgtgatggatacaccttagtgtacatcagaattctatctagtacgacatttattcataaataaatgtgaatgtgttttgctgattaaaaaaaaaaaaaaaaaaa

SEQ ID NO: 5740 - DNA, 655 bp, Sorghum bicolor
  Clone ID: SORBI-28MAY03-CLUS24483_1
atcaccagcaccaaattcgccattgcacaagttaaacaaccacacagcaactagtagcaagctagtaaaatttaccagctgcaccaagagagcttaattagctcacggtaaacatatcatcatggccccagccatttccaagcctctcctcagcgatctcgtggcacagatcgggaaagtcccatcgagccacatcaggcctgtgggagaccgcccggacctcgccaatgtcgacaacgagtccggcgccgggatcccgctcatcgacctcaagatgctcaacgggccggagcgccgtaaggtggtggaggccatcggcagggcctgcgaatccgacggcttcttcatggtgacgaaccacggcatcccggcggcggtggtggaggggatgctgcgcgtggcgagggagttcttccacctgccggagtcggagcggctcaagtgctactccgacgaccccaagaaggcgatccggctgtccaccagcttcaacgtgcgcacggagaaggtgaacaactggcgcgacttcctgcgcctgcattgctacccgctcgagagcttcgtcgaccagtggccgtcaaacccgccatccttcaggcaagtggtgggcacctacgcgacggaagcgagggcgctagcgctgaggctgctggag

SEQ ID NO: 5741 - DNA, 546 bp, Sorghum bicolor
  Clone ID: SORBI-28MAY03-CLUS24514_1
agctgttgtgtgggatcgggcaagtagagagatcaagctgaagaacatgttgtaccacacagctaggataaactccctggcttggtcacctgacagtcgattggttgccactggctcactggacacctgtgcaattgtctacgagatagacaagccagcaaccagtcgcatcactatcaagggagcccatcttggtggagttcatggtttaaccttcctggagaatgatactctggtgactgcaggcgaggatgcttgcattcgtgtttggaaggtggtgcagcaataggttactcattattctggtgtgcattgagaatgtctttgctattcattggaataaacttcttttttcttctgtgcttgttggtacggtggcacccacaggccatagcatcaccgttgccttctctgcgatttgtgctctaaatttcctttacaattctttttgagttgtgttattttcgcttgtttttttttcagtaagaaagactcctttgtaagtgtatccctccatggctgcatttgattttgttaggacgctgt

SEQ ID NO: 5742 - DNA, 525 bp, Sorghum bicolor
  Clone ID: SORBI-28MAY03-CLUS23457_1
gcacgaggcccgtccacacgtccgcagtccgcacacaccccagagcaagcgcctgacccatggccgccaccgccgtcgcggcgtctctgtccgtggcccaggggctcgggaagcccctctgcgccggcagcaacgcgtcgtcgctccgggtcctcgcgccgcgtcgttcggcggccaggaggatggccgtcgtcgtccgggcgtccgcgcaacagaagcagcacccggccaaggagtgggcggccgcggctgccgtggcggcggcgctggtgcttcccgaggtcgcggaggccgcgccggggatctcgccgtcgctcaagaacttcctcctcagcatcgtctccggaggggtcgtcctcgtcgccatcgtcggcgccgtcgtcgccgtctctaacttcgatcccgtcaagcggggctgatcgagctcaaactacatgcatcgttgtgtgttggtgtaccctatgtactgagatctcttctcccgtgtaaacagtgttttaatattgcgtgaatcttttgccgcgt

SEQ ID NO: 5743 - DNA, 968 bp, Sorghum bicolor
  Clone ID: SORBI-28MAY03-CLUS2347_1
cgtccggtgcgctgggaactgaaagacctgaacaagtacaacatccttgcaccctgttaccatcatcctgaaatccaagagctagagttcagcaagagcagcttaccacagagttttagaaggctaggagagacagataggccatttccagtgaggaagcgaatggcagggcgttcttggcccctccgccttgctctcaaggatggtcacgttccgatgtggccaggccttggtggtagatcacttccctgcacgagtgatgaagttgctactacatggctggatgatgaagatgttagagctgcgattcatgccaaaccaaaaagcttaattggatcatgggaactgtatactgcaagaatagacttcactcatgatactgggacaatgttgacctatcacaagaagcttacaggtttgggatatcgtgtgctaatttacagcggtgaccacgacctgtgtattccttaccctggtactgaagcatgggtgaaatcaataggctaccaagttgttgatagatggcgcccatggtactttggagaccaagttgcaggatatacagaaggatacggtcacaatctcaccttcctcaccataaagggagctggacatgctgtgcccgagtacaagcccaaggaggctctcgcattctacagtcgttggctagcaggagaaaagttctaagaaaaacaggaccattgcagattttacaagccaccagttattggtcttttggaatatcggtgtcccatgcatatcttgttcctcactcatcgaaaattattgttgtgtattgtgtgcatagactcaatgtaaatcaaggcatcagatccaataagaaagcaggtttctctgaaatgctgtgtaaccctttctgtacagatgaagagattgttacgtgggatctgcacctcaaatctagtgtggtggtggaggcactattcaattaatcatggtttagatcc

SEQ ID NO: 5744 - DNA, 604 bp, Sorghum bicolor
  Clone ID: SORBI-28MAY03-CLUS23561_1
accaatcactatatatcctagtagttttaatttatatactatacatacacacacacagagagacactcttgtttgtgctcgtgggtataacaatagcaagtctgcaccagcagccatggccaagcagtttcttgtcctcgccgtcctatccgtggcctgcaaaatagctgcggccacaacagtgtacgatgttttggagcagaacaatttaccacggggccttttaccgcttggcgtcaagtcatatgtgctccacccagacggtgctttggaggtgacactccctaaggaatgcaacttctttatcacagtgggtggaacgaaattacagtttcggtacggcaccagcgtcaacggcatcatcaagtccggctccatcagccgtgtgtccggggtgaggtttcaggtgaagttcgcgtggctcggcatcaatcaggtcagtcacacagggaatcagatcaatcttcaggtcgagaggtccacaaagtctttccctgccagcgctttctcacagagccccagctgcaactgatgagtctcccatttgcgaagcagctaccatgtgtgctgcttggtgctaagcacatgcatagtcttgttcatc

SEQ ID NO: 5745 - DNA, 513 bp, Sorghum bicolor
  Clone ID: SORBI-28MAY03-CLUS24688_1
gcacgagggcgccctctccgcgctcctctccacctaccacgacaatcgcctctacgaccgcgccgtccgggccttcaacactctccccgccgagctcggtatcaaaccgggactcgtctcccacaacggcctcctcaaggccctcgtcgccagcggggacatcgccgccgcacgctcggcgttcgacaaaatgcctgacacggctggcgtccagccggacatcgtctcttgcaacgagatcctcaagggctacctcagcactggcgacgatgcggccttcgatcagctagttaaggagatcgctggacccaataggaggctcaagcccaatgtcgggacatacaatctccggatggccatgctgtgctccaaagagaggagctttgaagctgaagagctgctggatgccatgggggcaaatggcgtcccgcccaaccgtgcaagcgtcaacacggtcatcaaggggctctgcaacgagggggaggtgggtgctgccatggctctcttcaagag

SEQ ID NO: 5746 - DNA, 606 bp, Sorghum bicolor
  Clone ID: SORBI-28MAY03-CLUS24769_1
gcacgaggccaccgccccccggcaacaaccgagcagagcagcccatccatccccctctccgcacggctgctctccttcttctcctctgtgtccggccgccggtctcctctgctccagcgagctcccagttgtagacgaccgtacccacatggcgatggcgtcgcacaacggcggcaccaccaagcacctaccgccgatggaggtctccatggaggccgggaacggcgacgcggccgagtatctcgacgacgacgggcggccacgccgcaccggcacgttctggacggcgagcgcgcacatcatcaccgccgtgatcggctccggcgtgctctccctggcctgggccatcgcgcagctcggctgggtggccggccccgccgccatgctgctcttcgccttcgtcacctactacaccgccacgctgctcgcggagtgctaccgcaccggcgacccggacacgggcaagcgcaactacacctacatggacgccgtccggtccaacctcggcggcgccagggtcgccttctgtggctgcatccagtacgccaacctcgtcggcgtcgccatcggctacaccatcgcgtcgtccatcagcatgcaggcgat

SEQ ID NO: 5747 - DNA, 456 bp, Sorghum bicolor
  Clone ID: SORBI-28MAY03-CLUS2480_1
ccgggactttccccaaccccgctccaggtcgagcaccgatctagggttccacctcgtcttccgctcgccggcgaagaaccagccgttcgggacccagacgcagccaaggggagatgaagctcgcggggctcaagtctgtggacggcgcccacgaggagtccatctgggcggcggcctgggcgcccgccgccgaccaccgccccacggcggtgctcctcaccggggcgctcgacgagaccgtccgcgcttggctccccgacgacctcgccgccttgggatcccccgcgcgcggccacgcgctcggagtcgtctccctcgccgcccaccccgccggcgcgctcgccgccgccgtgtcgctcgacagcttcatccgcgtcttcgatgtcgacacgggggcgtccgtcgccacgctggaggcgccgccgtctgaggtctggggcgtcctgtttcacccca

SEQ ID NO: 5748 - DNA, 709 bp, Sorghum bicolor
  Clone ID: SORBI-28MAY03-CLUS24837_1
gcacgaggcgtcatcgagacctgcgacgaccccttctccaccgtggacacgtacgtggccaagctcaaggagctccggtccggcggcgccatcctggaagggatcggcctggagggccacttctccaagcccaacatcccgctgatgcgagccatactggacaagctcgccaccctggggctgcccatctggttcaccgagatcgacatcagcaacaagttcgacgcgcagacgcaggcagcgtacctggagcaggtgctgcgggaggcctactcgcacccggccgtcagcggcgtcatgctgtggacggcgctgcaccccagcgggtgctaccagatgtgcctcacggactggaacctcgccaacctgcccacgggggacgtggtcgaccgcctgctgaacgagtggcggacgctgcaggcgggcgggcagaccgacgcgcacggcgcctacagcttcagcggatacctcggggagtacgtcctcacggtgagctacaacaacaggaccacgcagtccaccttctcgctgtcgccgggagacgagaccaggcacatcaacgttcagatgtgaccgagagtccgtgacgatcgatatgtggggtataaactaggtgctcttgtgttgttttgcattgcattgggctcctctcctgactcccttgtcatgtacgggtcgtaatgcttgatactgcttacccattatacta

SEQ ID NO: 5749 - DNA, 523 bp, Sorghum bicolor
  Clone ID: SORBI-28MAY03-CLUS24807_1
tccgcattatgaaaagccggaaagttttgggccatcaccagcttgtaatggaatgtgtggaacagcttggtcgcatgttcaagccggacttcaaggcaataaagaagcggattgaggtccttatcacaagggattatttggaaagggataaagataacccgaatgtgtacagatacttggcttgatcaatccgctgcctgtggaccatcctgagcctgatttgtttgtcctacggtgctgccacagtttatcgcaatgtttataactcttgtggtcatcatgggcatttctctgctgcacatccaggttgcctggtggttggcctgtcaatgaagagaacagggatgaagattcacggatgggaatgcatccaaggcatgccagccatgatgcaagttgtagcatcatctatcagatccctgtaccatttgttgtattttacgccattgcatatagccttgtttcatttcattcagttgtttagataaatgaagatatgtagtcatgaattggtagcacacca

SEQ ID NO: 5750 - DNA, 700 bp, Sorghum bicolor
  Clone ID: SORBI-28MAY03-CLUS23965_1
cgggacttcccaccatccgtccccgaccctttcgctgttgtgcccgaataggaataatggcggcggaggctcaggccgagggtcccgcgctgcccccagcgccccctccgcccctggcgcacgggagctcttccgcttccccggagaagcgcgggctcctgatcccggggaacgacggcggcggcgcggaggaggagcggcagctgcccgagccgaagcggcgccgcgcgtgcgtcgccgcgctcgacagcgtccccagctcggtgaccgaggaggaggcggcggactcgcctggctcgggctgcggcggggacggcgcgtcgttctcgttccagcacgcgcggggcggcttcgtggcgctggagaccacgcccaagttcgggtccttcaacccgccgggggaagccgagctggcgggcctagatctgaagcctccggggcacgaagcggaagcggagggctcgacggaggcggacgacaaggtcgaggtcccggaggcgtcggctcctggggcggaggtcaaagacgagaactcgcaattactgggcggcgaggttgatggccaggtccaggcatgaactgtgccttggttttgaccagcaacggaagttgcctgttggttgctagtagtagtagtagcccttttttttgtgacttctagtagtagtagcctagtagcatgcagataagcacttatcac

SEQ ID NO: 5751 - DNA, 706 bp, Sorghum bicolor
  Clone ID: SORBI-28MAY03-CLUS240_1
cgtcggcgccctttttttttttttttaatctgaattctggagtgctctggttcgtatctggaactgcaaagtgcaaagtatacatcttattcagcaatcgaatggagaaaccattctcttaagggtgttggataagtacattctatttcgcttctgggatctggttgctgttgaacttcatccgaggcttgcccatgctgaaattgaggactctggacctcatgttgtacttgagcaccccgtcgtacagcattttgcggatgtagtgctcaaggtctgacccgatcaaccgaagtgtgtactccgacagctcagctccctcgtagtgatcgacgaggtcctggaactcgttgaagaccatctggcatgcctcgtcggtccaggcgaactcgtcctgcgggtcgagcatgagcgtcagcttgtccatctgcgtctggtcgaacacgttggtcaccgggtcgatgtacgccgcgtagatgcggacgtgccgcgtcgtgcagctcagccactgtccgccgtactcgcggctcatgttcttgttctccgccagcggctgccgcggcagcgactgcgcgtcccccttcctcgcctgcgcctgctcctcggcgccgccctgcgccggcggcagggtcgccacctcggccgcctcctcctccacctgctgctcttgttgctgggcgcgcgccggagggaccctccctcgtgc

SEQ ID NO: 5752 - DNA, 509 bp, Sorghum bicolor
  unsure (1)..(509): unsure at all n locations
  Clone ID: SORBI-28MAY03-CLUS24239_1
gagctgggtcgccacgggatccgggtcaactgcgtctcgcccgccgcggctgccacgccgctcgccacggcgtacgtgggactggagggggaggcgttcgagcaggccatggaggccgtcgctaacctcaagggcgttcgcctgcgggtggcggacatcgccgccgccgtgctctacctcgccagcgacgacgcgcggtacatcagcgggcacaacctgctcctcgacgggggcttctccatcgtcaacccgtcctttgggatcttcaaagattgagcttgagtgcttgacagagtcacagatatattactccacagagatctgctccggctcgatctcagttccatgctttttgaagagaggtaggtattgatctgtatcagtgagctccatgtgtcgcatggtgcagaagccctgctgtacttgtatgaaccggggagctgttgcaccaattcctaatactagtggacgagcgtcttatgtnaaaaaaaaaaaaaaaaaaaaaanaa

SEQ ID NO: 5753 - DNA, 1090 bp, Sorghum bicolor
  unsure (1)..(1090): unsure at all n locations
  Clone ID: SORBI-28MAY03-CLUS24096_1
atccctccgcgcccccctctttcttccctcctcctgtctctctctcgctaccctctcgctcccagacgcctgttgggccgccgccgccgccctaggccaggcgctgaggctgtccttggtctcttcgccggcgacgagcacccaccagcactcttttaatttcagttattggaccccacattgtggaatgcttgccaaagggaggaagatagctggaaggggtgaagaaatgtccgcacattatgcatttggaccacaggatgatgatgcaattattaaacacaggcttctgactaggacgacgaccaccaggggtgaaccaccactaaagaagcttcagaagaagttcatgtcctttgccactgagatcgagaaggacacagataacgcaagtgactgcgaaagactgtacaaggcctttctacaggaaattaatacctttgagctacctctcctaaaaagtaaggctgttgttgatgcaaatattagggagaaggaaagctttaatgatctgcaggttgagattgagcgacagatcttgcaagctaagactgatattgaggaccttaagaagcaacttgagcagagcaagatcgagaggcagcacaaagaagagtgtgaagccatccggaagctgatttgtttgcagcctccacggtcagaaactgaaaaactcattgcagatcttgagaaggagatagctgatttggaggctgagaatgtagcatgcataaggactttggaactgaggaagaagcagtttgcccttcttttacatgtggttgatgaattgcagatctcgattgaagatgagcaaaagagtatagcagatgagctgagagctatcactggagagcagaagatgaacatagaagaagggagtgtcgttgcttcagattccatggttgttgactgatcgagatacattctcatacttggcagacctgcttgcaaaaatccatcacatgatttttggacaatatggaatcctaacgagttggtaggatatgtattttgcggtgtctttgtacctcacatgtaaattgagttgtatgctactatgaacntaaattaaagtacacattgttgg

SEQ ID NO: 5754 - DNA, 543 bp, Sorghum bicolor
  Clone ID: SORBI-28MAY03-CLUS24299_1
gcacgaggcatcctagttccttcctcttccgactccccgcgcccctcctccggcgacgcacgcagccgccgccgtgcgcccgcctatctcaaatcttccaccgcgccgccgcagaggtcctgtcctcgccttccccgtaggaagccgaagtgcagcaagcagcgtcggcaccagcagcaccgatcatggccgactacgagcaggagcaggatatggaggtggaggcgctgcaggccatcctcatggacgacatcaaggagatcgacccaagtgagagtgggatcgccaccaccgcccggtgcttccagatcctactctctcctcaggatgatgattttgatgagtcagcttatgtcccagttcaactggccctgatttttgcgcacactgagaagtaccctgatgaacctccgctactgaatgtaaaaagtgtacgagggattaaaccacatgatcttacatccctgaaggaaaagcttgagcaagaggcaacagagaatcttggcatggctatggtctacactcttgtttcatcagccaaac

SEQ ID NO: 5755 - DNA, 683 bp, Sorghum bicolor
  Clone ID: SORBI-28MAY03-CLUS25019_1
aaagctgttgctgttttgggaaaagttgttcttttcataagacatgagaatgttgctccgctgtattatttaatatgtgacttcaaacggtcttattttatactgtcagtctatgggctacataatgatgcaattaaagagggtgatcgagtggtattatttgaaccatactacagaatccttgatgcatcatgtaaagacaagcactatcagttcaaatcaatacgggtggactttccagaacaaattctaattaacgagagagctcccgcacctcatcatgttgcacgggcatcaatccatgcacacaacagatcgtgagcggtgaaaattggattttgatacctatcatattggacatgttgtggacacgtggccactagcttgcattgctctatgccccaaaaggttaacactggcatgaaatgtgctgagcacaccgttttatgcaatctgctagtgctttagtttgaagttggtagccagtattttgtgtttgctgtttattagactattagaggaaaaccattcagcaagtttttatcagggaactgtgcgacgtcaatatggtgggcagctgggcatatcatgtgtactattctgtaaatgtagagtgcaatgttaaaatgtctaaggaatacttgggaacacggtaaccaggcctagtggcttgtttctttctc

SEQ ID NO: 5756 - DNA, 896 bp, Sorghum bicolor
  Clone ID: SORBI-28MAY03-CLUS25051_1
gtccgcggcgagagtcaatcattcattccgcccgtgcggcgagaatgtccatctcgatgcgcctcgcgatcccggctcccgccgccgcgccgccgcggctgagggtgcgagcggcggcggcggcggcggcaggggacgggggctgtctccccgtcgcgcgcgccgccgtgcggacggagacggccgcgctcaggggatgtgcgtcgctgccactgaagccgctgggcgccggccagccgtgccggcacaggggggccgccgccgtgtgtcactcgtcggcgtacctcagcgcgcagaccatgcagtggatctccgccggagccagcgcagtgctattacttgctaaaggcactgccatccacaaatctttccttgtgccattttttgctcttcaagcaccttgcagcataatctcatggatcaagggtgactatggccagtggactgcttttcttgctctgttggtgcgtctattcttcttcattccaggggaactggagcttccactgtcaacaatgctgcttgtgagcgttgctccataccaattgatgaatctgaggggaactcaaggtggtgcagtattgtcattggccatagctgtgtatctcgccttccagcacttcactagggtgggaggtctaggcaaagcctttgagcagggatcgattattgcgaccttggccatcatctgcatcacgattgttcccttgatgctgctattctgatttggattaagctggcaagagtttgcttctcatcatgtgcgtaggacataaattaaccttgtaatgcaacatcctataaatcttcctacttttctttctccaaaacgtatgcagtgatctagtctgatgccctgtatttggtttggtaatgttcgttataaagattttggt

SEQ ID NO: 5757 - DNA, 585 bp, Sorghum bicolor
  unsure (1)..(585): unsure at all n locations
  Clone ID: SORBI-28MAY03-CLUS25043_1
ttcaagaggatgcccgaggtgcncaggcagaaaggcaaaggggtctcccccaactttgagacctacatcatgctgctcgaggcccttgtcaacaagaatttgtttgatcctgccctggaggtctgcaaggagtgcctgcacaacaagtgggcaccgccgttccaagctgtcaaaggtttggttgagagtttgctcaagagcaggaaggccaagcacgcgagggaggttctcatggccatgagaaaggctgtcaagggtgacgccaaacaggagtggacaaaggtcgaggctcagttcccgatgttgcttgctgacaagaaagcctaacgaccaggatgtgggatctatgtatgcaatagctggacctggcccaacagatcaccattttacagccgacttctgttattgctcaaaatggtttattttagatgagatttgcattttcaattaatgggatgggtggctgtcgatggttagtcattcagtcatgtcatgtacgctgagttatgacacaaaatgcttctcatccaggcatgcagattcgtgtttttttttttccaattcattttatattatagagttcac

SEQ ID NO: 5758 - DNA, 960 bp, Sorghum bicolor
  Clone ID: SORBI-28MAY03-CLUS25155_1
ggcacgaggacgcaagcctgtaagaagaggagaggggtttatataagcagtgaatcgggagactctgatacagattctgatgttgagggaatcaaactctgtcgaaagtctggggtgccatcaatttctacatgccagcaccagtcatcttataaggtcaaggctgcaagtatgaaaagtagcaggatgataaggctgtgtggaaatatcgtaaggaagctcatcgatcacaaaggtggctggcttttcaaagaacctgttgatccagtgctatatgggattcccgattactttgatgttatccacaacccaatggatttgggtactgtaaagaatatactcacaaaaaaacaatatgtaagcattgaggagttcgcagcagatgtgaggctaacattttcaaatgctatgaagtataatcctccagaaaatgatgtacataaggtcgctaaagaattgaatgggatattcgattcagaatgggaatcagtagaaaggaaatttagggtccaaaaccctgtgcaagagcagcagacaatgaaggccataaaagttcgaggtatcatggattcaaagtctacggttcctagagagctggtagcatgctcaaattcaaaacctttggttgctagagggccagtagcttgctcaaatttgattgcaaacaagacactgacagacgtgttatcctccaaagtaaaaatcaaattttccgtgcgcagctctgagcgtacctcttccaaagatatacctgttcaagcagctggtagcaaagagaggtccttaaatcactctgttcctactggcaacaaaaaggcatctttaaattgtactcttccttgcacgaaggagaatgctaaaatttcaaggatacgagaatctgaccgcagctctggttcaattggaaatggatcgttgttatgcaatgacacttctacttcgcctcttgcttcctctgcg

SEQ ID NO: 5759 - DNA, 677 bp, Sorghum bicolor
  Clone ID: SORBI-28MAY03-CLUS2456_1
tcactgggatgtaagaggagatgataaagatgatcctacaacataccttgtcacatttgataaggaggagggtgcaaaatatttgcctcttcctactaagctagttttgcagaagaagaaagcaaaagaggggaggtctggggatgaaattgagcattttccagtgccttcccgtattactgtgagtaaaacagctcatggtggtaccatggagcgcggagaatcttccggcttgcatgtgaattcaaagccacgaagatctcatgttgatgatgatcttgatgagcatccaaagcgttctcgagtagaggatattgaccaatatagtggcgaagaatattctgagtgatgaactgataaatcaattatctcgcacccacaaatttgatcagtacatgtgaagccttaaaaggtttcatgcaataggcacaagtggttttgtggtgcatggtcatgcagtgaaagaaaatggctgacagcgtgaggagctcggggcttggccagtttcttcagggcagagtatatgaagcaaagctgagtgtaactggacttcaagactttgatctctgtagtgatgatagaaatatcacattgttgtaaagaagttttgtctttaaagtcttggagcagttctcaactgtttgttttgataatatatagacccctgatttgcacct

SEQ ID NO: 5760 - DNA, 740 bp, Sorghum bicolor
  Clone ID: SORBI-28MAY03-CLUS24588_1
ggcatgaaatgcaggacagcatatcacccgtgactgtcactagcacgaagaatgacttacagggagcggaagggcatgaaatggaggacagcgtatcaccatccacagtcattgagacaaagaaaggttccgaagaagagagagaacatgatatagtagacagcatatcaccatccacagttattgacacaaagaaagattctgaagagactgaacatgagatggtggacagcgtatcacctttgatggatgttgacacggaggaaggggagatcagctgctgacggtagccgcacctcttgtcatcatccacataatttattgacatccttgctgggttgttagattaggcgacctcataagcagagtgatgaagaaaactttagattgctgtggttgcgtcgtagaaccactgtggagaacatgtgtcagacgaactgagtagtggttttggctttgctgcggattttaattttcgtggtcttgtcagccagggtaagagtaagataactccgctgtatgttggatttgttattagcgtagtgtgagctcgtcggctggatgacctgtataaaaagatgagggaaaaaaagagggtaatatagtgctggtatatattgtaggagcttatggtggagccggttgcaggacacaagctatagtacagcattgttcccagattgtggtcggtgcaccgtagtaccttgttactgtattcattctaaaacttaaataaaatg

SEQ ID NO: 5761 - DNA, 608 bp, Sorghum bicolor
  Clone ID: SORBI-28MAY03-CLUS24611_1
gcacgagggatatgaaggtaaaaggaaaagcggccattgatgttgtttgcaacccactgggcaaatccggtggtgcacttatccaacaattcatgatcctgacgtttggatccctggcaaattcaactccataccttggcggcatactgctggtcattgttctcgcgtggctaggcgcagcaaactcattggacaagcagttctcggccttggctaaggaagacctgaagaaggagaaggctgcccaagagaaagtagaaccctcgctacttaaggcgcctgcagaaggcactggtgatgtaccggtggagcagacaaatggatctgtgacgagccaagcaactggaacagagagctcaccgtcgaactcatcccccattcaatagcttcatcatcagaagttgtagttaggagagtgattacagtgagcagaaataatcggtaaaaataattcatggctttcaagtttgtaacagtgtgcagcgtcaagctgctagtaacttttctttgtaacatgagcaaattttgacagccgacagtgaatgccgttctggaaatggccccgaccctttgtgccgacgtcaaatgcataaattgttttttttttc

SEQ ID NO: 5762 - DNA, 801 bp, Sorghum bicolor
  Clone ID: SORBI-28MAY03-CLUS24639_1
gcacgagggatcagctcattaattcagtgcatgactcatgagatgatgtgaagatgctggtggtatcaatcataagcagcctccatatccacattactcttgtgcatgtacagtggagtaaaaacaagtgaaatcttgtttccattagttgcagcctcgtaggaaaagaacaggaaaagaacaaggtctttagagtcaatgcatgtaactaatgctccagcaagtccaatgcaatagagggcacaacagctgtgagttgagcattacgcatgggaagtgctgtttttgctaatcttgttcctgatagccttggttcactacagttgtagcattgtggtgcttgggcatggttagttcatgacttgtacttaggttggaggtccctttattcacccggatggatcttccgaaatcagtgctgaaggaactgaaaattggcgcacatgacattgcctgagttattgccttctgaactgtgttcgacctgccaccagatgtctcacagttttggcgtcgatgggcttgctgcaatggacaatatgaattctaacctggaatgtagggccagaaaatcactactggagcaggcagggatgaagatggagtaacaataggctgggaaaattctaaagctcgacatactaaacaacggagtatgtttgttgattccaaatgttgagcgttgaggtttgagagttgtagtgttggggaaaatgtaagcgtgtaacactttgataaggaacaaaatgtattaaacttaagaacagagtacacttaggagaatgatgttctcccaacttt

SEQ ID NO: 5763 - DNA, 458 bp, Sorghum bicolor
  unsure (1)..(458): unsure at all n locations
  Clone ID: SORBI-28MAY03-CLUS2468_1
aggtcaaattatcnaattattcagtagtattttttttcaaaaaaaaatatttcagtcatcgtttttccacatccatttctctatacaacaggtttacagaggcagatcacgatgcgtcgtcgacctgaaaacctgatgggcgtagccttttgcatgtgtaactactgctctgctgctcttcctacgacgatgcttccatgtgcacgcacgacagcgcgatcgagcgtccggccgacgatgatccaacgaagcagcgagctcgatcagctcacgccccagtcgcagatctccgcgcgcagaggaagaagttgcgagagccgaggtccagcaccttctcctccagcctaaaactcgaaagcgagtactagttgagaaccagctcaaagccgtccataacgtcggggggcgaaggaaactggagcggcgggcggcggccctcncggacgtaggcggcgacg

SEQ ID NO: 5764 - DNA, 486 bp, Sorghum bicolor
  Clone ID: SORBI-28MAY03-CLUS24665_1
gcgattccgcctccagaaccttccttcccccacctcgctaaaccctagcccccgcgccttccggcgccgccgccgccggagcatggacgagtggctgccgctgccgaacgtcttcgggcgcctcctcgacaccaatgatcaggaccagtggcctccggaggcgacactcctcatcgcggccaacgacggcaacgtccgccgcctcaaggagatcgcgaggggcctggacgtcaacgggagggggatcaattcggtgctacgtcgcacaaccttcaagggcatggacgcactccacgccgcggctggtgggaagggcaagctaccaatctgccgatacctcgtcgaggaggccaagatggacgtcaacaagcgtgacacctttaaaggtaagagcatgacaccactgcagcatgctgtgttcagtgggaacctccctatcgtgaggtttcttcttgatcatggtgctgatctccatcaagaaggcag

SEQ ID NO: 5765 - DNA, 645 bp, Sorghum bicolor
  Clone ID: SORBI-28MAY03-CLUS25274_1
cagcatgcatataagaatgggagacaaagcttgtgaaatggtggtggtgggctttgaggaatacatggaattggcaggcaacctgcgcaaacggtttccaagtctcaagaacatctggctttccactgaaatgcaggaagttattgacaaaacaaaactttacccacattggagttttcacttcacaagtgtggcacgccaaggtagcaatatgaccatggcaatgtatgaggccagtttgggccgtgagactagcacaaactacccccttgtcaatttcatgatggcaaccgaagcagatttcttcattggagccctaggatcaacctggtgctatctcatcgacggaatgagaaacactggagggaaggtaatgtctggttacctatcggtgaacaaggaccggttctggtaagcaattcaaaggccgcttgcgtcaccgatcatcttgtagctccactaaatagagttgtgacctagttttcttgtgtatgtacaacagtagcatgatgctaccttctcagaatctgagaagacacctttaccatgaaacttcatgactaagtaggagagtcggtaccttgttatatcaaatcaggtccatatcttttgatctggtgtccactaagagctagctcgatagtt

SEQ ID NO: 5766 - DNA, 616 bp, Sorghum bicolor
  Clone ID: SORBI-28MAY03-CLUS25295_1
gttcacctcggcttccaccaggcgggttggctgcactaaatccgaagttcacagttgtccgaaagcataacagcaatgacgctgacgatgacctgcctagcgtgatgacttgtgcgaactatcttaagttacctccgtattcttcaaaggagaagatgagggagaaactcctctatgcaattacagagggccaggggtccttccacctatcttaaccgataagcgataatgatatgccacttgcaataggagtttcactttgtaagtatctcgtaggaaaggaaagcacggtgtaaatgtgggtggttcactgcttctttagctgacagcacgatctggtggagctgattttaggaggaggaaaaaaaaaccgctacccttctttgtacatactaggttttaggtgtggtcaagcagaccactagtgtgcctagttcgctacgcttttatcgaaacttcttgtacatatgcgtgcctgcctgatagaaagtgccaatgctatctttctatgaaaacaacgttgttcgttggtgtttaccttctgaagcgtcgttgtgtgacatgtggcaaaatatatgtgaattattggtggattttgtatgaacagtacctgacc

SEQ ID NO: 5767 - DNA, 1099 bp, Sorghum bicolor
  Clone ID: SORBI-28MAY03-CLUS25310_1
gcacgaggccatattcaactgaagcagaattacttgaacagtttagttctatgaaagatcgagggacacgaattattatttacaatctttgggaggatgaccaaggggacttggagttggattttgatgctgaagtacatgatattcaactcagaggtggtaatcgcgatgagaaaaatatccagatggcaaagcagttcccaaactccaagcattacctcacatataggcattcattgagaagttatgcatcaattttgtatttgcgacttccgacttatttccaaatgattttgcgtggaaaagatattgaacaccataatattgtgactgacatgatgctgaagaaagaggtcacatacaggcctgtggcacctaatggacatccaaaggattcaaatatggtagctgatgtaacaattgggtttgtaaaagatgcaaaacatcacattgacgttcaaggatttaatgtataccacaagaaccgtttgataaagcctttctggagagtgtggactgctgctggaagtggtggtcgtggtgtcataggtgtacttgaggcaaatatcattgaaccagctcatgataagcaagacttcgagcggacaacacttctagcaagacttgaagcacgattagggcaaatgcagaaggattactggtctgggaatgctcatcgaataggatacgttgcaccacgatctggtaggaactctgatgccggagatggagaagactctcgtgaaaacacagcaggtgcacaactcatcaccttatcattctgggaaagggtacacacaggcaaaagacatgaataataatattaaaaagggtggtaaggcaagcacatcatttggtattcagcagagagctgagaagtccgcaaggactaaacgatctatgaagtcaatactacacgggctgtctgatagtgataatagtgattctgagtttatgggcactctgctgaggtcaagatctcacactgtgaacagaaaccaaaaattgtttcaaaatggcagtactgatttgacaacacctcaatccagtggactaatagaaagagacagaggctgtcttttgctgttatagcaattca

SEQ ID NO: 5768 - DNA, 609 bp, Sorghum bicolor
  Clone ID: SORBI-28MAY03-CLUS25297_1
acatctcgtagcggagaaacgaaacagacagcgcacgagctggacgagtttttgaacaaggttaggagaggtgaacgtgtctctaatgacgaaatcttgagcttcgcaaagctattcaatgatgaacttactctagataacatgagcagaccacgtttggttaatatgtgcaaatatatgggtatccggccttttggtacagaccactacctgaggttcatgcttcgcaaaaaactgcaagacattaagaatgatgataagctgattcaagctgagggagttgaatctctctctgaagaagagctccggcaagcctgccgggagcgtggtcatctaggcctgctgtcaactgaagagatgcgacaacagctccgagactggttggacctctcacttaaccacgctgtgccatcttcacttctcatactttcaagagcctttactgtgtctgggagaatgaagcctgaggaggctgttgtagccacactatcttctctaccagatgaagttgtggatacagtcgggacagtattgccatctgaagattcggtttctgagaggaggagaaaattagaattccctgagatgcaagaagaacttatcaaggag

SEQ ID NO: 5769 - DNA, 693 bp, Sorghum bicolor
  unsure (1)..(693): unsure at all n locations
  Clone ID: SORBI-28MAY03-CLUS2953_1
tttgctcatagnatgcgaagcaggaccgggtgacgatgttgaggacaatgacgacaacgatgacgaccccgaggaatctcatagacccgcgacatcgcttgctgcagcatacagattgctgacaccatctgtgaaggttcagctactgatctactttatgctcaagttcgccatggaaatcctactctcggagtcaagtgttgtgaccacgttctatttcaagtggacaactagtaccgtggcaatctttctagcagttcttggcctgacggttcttcccgttaatgtcatcgtcgggagctatgtcaccaacttgttccaggacaggcaaattctggtggcctccgagatcatggtgttgatcggcattgtcatgagcttccgcttcacccctcactactccgttccccaatatgtcacgtcagctctcatcaccttcgtattcgccgaggtgctcgaaggagtgaacctgtccctcctctctcgcgtgatgtcgtcgaggctctcccgcgggacctacaacggcgggctgctctcgacggaggccggaacgctggcccgcgtcgccgccgacatgactatcacggcggcgggcaacctggggcagagccgcctcctgaacgccaccctcctgccgtccctggtgatctgtttagcctctatcgtcgcgacgttatgcacttacaactcact

SEQ ID NO: 5770 - DNA, 472 bp, Sorghum bicolor
  Clone ID: LIB3481-016-P1-K1-C6
cgtccgctagtactcgtggcaatctttctagcagttcttggcctgacggttcttcccgttaatgtcatcgtcgggagctatgtcaccaactgggtccaggacaggtatgtgatgttcgttactcactaactctgaaagccggagagaccattagaccaaccgcattttgctcattctggacttgtttttttccttgctcaaccaactaccaaaggcaaattctggtggcctccgagatcatggtgttgatcggcattgtcatgagcttccgcttcacccctcactactccgttccccaatatgtcacgtcagctctcatcaccttcgtattcgccgaggtgctcgaaagagtgaacctgtccctcctctctcgcgtgatgtcgtcgaggctcttccgcgggacctacaacggcgggctgctctcgacggaggccggaacgctggcccgcgtcgccgccgacatgactatcac

SEQ ID NO: 5771 - DNA, 1060 bp, Sorghum bicolor
  Clone ID: SORBI-28MAY03-CLUS29635_1
gcacgagggctagattgaggccacacaactggaatagctcagatgacctcactgtacagcttattcaatctgtcactagcagcaccagtactgcagccagaaaagacatgcaatctttggtaaatggtcttctaagcaaaagttcagtctatcaaaaggactcgtcagggctaaacaaggagagcctgtaccagatctgttattcatgtctggagtcactggttgatctctttgaagaggccagagaaccaacagattatacaggtcaggctgtggcagttagggggagtaaaccactgattgagcgagtctctaggcaagcagagaacctcaattggctcttggagattctagtaaacaatgacattgcagaagaatttgtagaactgtgggcgaagcaagacatgctcattaggatgcacgagcaagcatcagcgatggtcaggtatgagctaagccgaatatcagctggtgtgttcattgcacttggtaaaggaaaagtgcagtgtcgtggtgacgtgcgaagcctcctctttcgtgggtggttcagcacaatgctgttggattttggctggcttcagcgctgccccaaaggtctagacctaagatccctggaggagaatttagggcggggccttttaaccctccctctcaggcagcagcaatgtttgttcgaggaatggttccagttctacgcgaccaaaggagctgaatgtccaaaccttattagagcattccaggtatggtggagaaggtctttcattagatcattggtagaacctcagagctaaggtttttcttgatgtactagtatgtgttgtgtgtatgatttgtaaaattggaactgttgtgatgacccgtagagttaaatggtttttcttttgtagtttagctcttcccattgtatgtgaatagctgggtgaatttgtttgaggatagctgtgatgtgtggtttatcggagatgccatggttcttaaattaatatatgtaactccatccggtcttatgtcgaacatttgtattaactttttgtagcatgacagtcagttgtgtctgggg

SEQ ID NO: 5772 - DNA, 866 bp, Sorghum bicolor
  Clone ID: SORBI-28MAY03-CLUS2965_1
cgtgcgctcagaacattttatggagatacgatttagcatgtcatatgtggagcacgttatataatcagatgagtactatcagatggatttgagggccttgcaactaaaaatcacatcctgaagttcttgtggttctagtagatataaggagcttcaatgggagccagaacagttcatttagagctgatatgaatgatcacggagatgagtatacaattgtactcttcagtaccactttttgataaattcaatttggtggtttcttttaaggagacagggagagtttgatttcatataaggcttacatcctcaagttcatgtgcttttaaataagttggctttctttgggagtgaaaacagttcatttagagctaatatagacatagtcatggagatggttctacaattctcttcaatatcaaaatgatcaattcaaatttggcggttccttttaagattacatggatggattcagagtttgatttgcttctctaaggtttaatttaatgctaggttgtgaacaggattatagaagtgtgcctgttcgaagcttcatttgagtaagatatatggaggaatacttaagttgtggctgctttgctaatttactgttggtattagtttctctggtggtatcatgaggccttctgtataattcctacttccatgggtcttctatttctcaggcacaattagtagtggacatgacttttaggcttctgttactggattatgtgctcattcagagtgttgtagagatcttcaattttgttggttcagtagaactgtaatatatgtacatgtatgatggtgaaatatatttttgcctagagctgtaattattatatgatatggatatatggata

SEQ ID NO: 5773 - DNA, 676 bp, Sorghum bicolor
  unsure (1)..(676): unsure at all n locations
  Clone ID: SORBI-28MAY03-CLUS2964_1
gcacgagggtcggttgtattgatttgcatagccgtggtgttgcttattcttgcgttccttggatacggcttagagcaatatggaccaagatatacagtctacatatttgtcacctcgtgctcgaaatccattaacaattttacaattctagcaacagtgctgcgaaggatacctgcgaagcaatggaccaatgggcccagcatcctcaagcagagacagctctgagtaacatccttccatgtgtggatgaaagcacaacgaatcgaacattgtatcagagcaaagaggttgtggtgaggcttgttgggatagttaacagagctatatctgctctttcaaatcgaagaccacatcataagcatccaggacagttcatgccttacttatgttctccctacgattcaaacctcaatgatcggccgtgcaatcatagggaggtcacatttgaaaacgcaacaacagcatgttttggtattcttcatgcatggctcaagacaccgacttgtgttcagtctttggaaatgtttnttttcccacttaagtttttcacatagcanacagtccttttttactctgtttgatttgcatatgtgcgtcacccaactggcatgattttagatagcttggttgatggcgttttcacttttcaggcttggttgaattatacatgcatggt

SEQ ID NO: 5774 - DNA, 520 bp, Sorghum bicolor
  Clone ID: LIB3480-018-P1-K1-E8
gctgcgaaggatacctgcgaagcaatggaccaatgggcccagcatcctcaagcagagacagctctgagtaacatccttccatgtgtggatgaaagcacaacgaatcgaacattgtatcagagcaaagaggttgtggtgaggcttgttgggatagttaacagagctatatctgctctttcaaatcgaagaccacatcataagcatccaggacagttcatgccttacttatgttctccctacgattcaaacctcaatgatcggccgtgcaatcatagggaggtcacatttgaaaacgcaacaacagcatggctgaattatacatgcatggctcaagacaccgacttgtgttcaggcaacacgaccttaacctacgacatctacggccaactcgtcctggctgccaatgtaagctacgcgctgtaccattacgcccacttgctgctcaacctccaggacttgaagtttgtccgagccaccttcagcgccatagcctttcagtactgcccgcctctggagcatg

SEQ ID NO: 5775 - DNA, 1018 bp, Sorghum bicolor
  Clone ID: SORBI-28MAY03-CLUS297_1
gctttcggctgcggcggtaccggcgcaggagttgccggtgcagcatcctcctgcagcagctgcagggaagaccaagaagagattcgtgtcgttcagatgcgtcagcagcggcggtggccaggaccaccggcgtgaggccaccgtcgtcgtcggccggcggcgcggccttgcgtcgtgcgcgctcgccgggctcgccgcctcgttctccccgctcgccgccgaccgcgccgcacgggccctcgtcctcgaggaagacgacgacatcgagctgctggagcgcgtgaaggaggacaggaagaagcggctgcagaagcaaggcgtcatcagctcctctggcaccgagaccggatatttgcaggacctcatctacaagctgagcaaagttgggcaggccattgacaaagatgatctcccagccgcaagcagcgtcctgggaccaagttcagatgcgaagtgggtgcagaacatcaatatggctttctccaagttcagctcaagcccagaggagaggaacgtggttgatagcttcaacagctcactggccacattgtttacatcagtgaacaagctcgacgctgaatcctccaagtcggcgttcgtgtcgtctgcgacggcgttggagaaatggattgcattaagccggactgggtggtcagctcaaaggctactgatgtgacggaagcgttgtatgtatcatgtatggatccggcatttgtgaatctcctaaagagggtaccgtaaccgaggactgaattcagataagcgtgctagaataacacagcagcatcctcatcgatcaagaaactgggatcattttttgcgactgtgttattacagtaaatcagtaataggaaatgaagctgtattgttttttgttgtccggtgttacttttgaaattccaaacagctgatgggaagtttttatccaaaacttgctgcatgccgtgtgaatgtaacagggtcaagccgtgtcaactcttcaaaataaaaaaaaaatgggcgtccgcccttttttttt

SEQ ID NO: 5776 - DNA, 622 bp, Sorghum bicolor
  Clone ID: SORBI-28MAY03-CLUS25364_1
gcttccctgtttgctgagtacctggcccactagatggaataaaacttggtttggttggtgaccttgctaatgggaggacagttcgttctctggcttacttgattgctaagtaccagaacataaagatatactttgtatctccagatgttgttaaaatgaagtatgacatcaaggactacttaaattccaaaggtgttgaatgggaagaaagttcagatttgttgtaggtggcttccaagtgtgatgttatttatcaaacacgtattcaaaaagaaagatttggtgagaggattgatctttatgaagctgctcgtggtaagtacattgtggataagaaggtcttggatgtgctgccaaagcattctgtgatcatgcatccccttccaaggcttgatgagatcagggtagaagtcgatagtgatccaagagctgcatattttaggcaggctaagaatggcctctacataaggatggcattgctcaaacttctgcttgttggtcactgacatttctgctactgcatgagcttgtgctgtgtcaagtgatgagaaaattgtactaataatcagcagctcctgtcaaaattcaacgttcatgtacgtgcaggtaataaaagtcggat

SEQ ID NO: 5777 - DNA, 558 bp, Sorghum bicolor
  Clone ID: SORBI-28MAY03-CLUS25441_1
gcacgaggacacgacctccgttcatcagcacggtagccaaggcacgctctactcatcttagctctcgacgcgccactgcggtcttcgccgtccggccagctcgagcgctcgccgcacaacacgtacaatggcgtcacagcagcaagccaggaagcagcagcaggccggcaagggccacgaggaggcggctggccaaggccaaggccaggcgatgaacctggaggagatcggcaagtaccgcgccgaggcgcagcagcggtcggcggacgccatccgcgccgccgaggaccggttcaacaaggccaacaacaacaaccagcaggcgcgcggcgacggggcgcaccacgtgaccgccaccgcgaagcagggggagagccatggccacggtagccacggctctgagtccgaggcgcagcagtggctggcggacgccgcggccgatgccagggagaggtgcaacaaggccatggggacgacccccgccgccgccgcgcacggaggcaatacggcgtcggccggcggcgcggctccacaccaccagcaaaccaagaacgagca

SEQ ID NO: 5778 - DNA, 487 bp, Sorghum bicolor
  Clone ID: SORBI-28MAY03-CLUS25447_1
gcacgaggggcacgagggagagagaggggcgatcgcggtgtcgccgagctcggtggggagcgatggcggggaacgactggatcaacagctacctggaggccatcctggacgcgggcggggccgcgggagaaatctcagcagccgcaggcagcgggggcggtggcgacgggacggccggggagaagcgggataagtcgtcgctgatgctccgggagcgcggccggttcagccccgcgcgatacttcgtcgaggaggtcatctccggcttcgacgagaccgacctctacaagacctgggtccgcacgtcggctatgaggagtccccaggagcggaacacgcggctggagaacatgtcgtggaggatctggaacctcgtcaggaagaagaagcagatagaaggagaggaagcctctcgcttgtctaaacgacgcatggaacttgagaaagctcgtcaatatgctgctactgatttgtctgaagacctatc

SEQ ID NO: 5779 - DNA, 608 bp, Sorghum bicolor
  Clone ID: SORBI-28MAY03-CLUS25468_1
gattcctcgccagtcgcgcctcacctccctccctccccgtccgctccactccacttccatccgctacctccactccacttcaatccgccgctcctgctcctgctcctgctcctgctccagtaggaacgctccccaccctcaccacgctgagctactccggagcactgggacaacaagcaggttgcgccgtccgtccgtggggtcggtgctgtgctggaggtggtggagcgaggggcggtgggggaagcttggccgctggggggagccgagaatagcgacgaacaggcgtcaccagtaagccacggtcaggggcatttcagtcctacttagcagcagtgatggcaaaaatctaacatagtgattgaaacagctaggaggccacccatgttgtctgaatagggatgctctgttggatgtgcagcaagaaaaccttggaatgaatgcacatactacttagggtgctgtattagagttttagtaggatgggttcgttatgctgcgtggcagcacggccacatggggctagcacagcaagccaggattggtcctctattagccgcagcgacccaccctggcggactggtgctggcttttctccacctctgtct

SEQ ID NO: 5780 - DNA, 541 bp, Sorghum bicolor
  Clone ID: SORBI-28MAY03-CLUS25455_1
gcacgaggattattttggaagacacgaaaggagtgccactgcattgatgctgatctactactgaatgagcttaagaaagatgctggaaacaaggatggtgaaattggttcaagtaaggggtggagaggtccagtaaatatagcagattctcttggtgatgatgaagttgacttggttataccgcaggcaccttatgatgctgataaggatggagatctatcagctgatgaacatggggatgattttaggaagagtagtactacatataaaaggagcagattcatgtcactttcagatagtgatgctgaggaaaatgagaggaaccatgtatcgagagattcggtgcccaaagttccaaaacgacgaggtcgttctctttttacggaagagcaagagaggcttataagagacctttatgaaaaatataaggatgatcgcaaatgcagtcatctaatagctgatgctttagactccagcgggaagataacttctgctcaagtttctcgtaagcttacacagttaggtctcaggaatgtcacaa

SEQ ID NO: 5781 - DNA, 678 bp, Sorghum bicolor
  Clone ID: SORBI-28MAY03-CLUS25627_1
cagcagattatattgggatcaatcaatacacagctagctacattaagggccagaaattgctccagcagaagcctactagctactcagctgattggcaggttcaatatgctttagaacggaatggcaaaccaattggaccacaggcgaattcaaactggctttacatcgtcccatcggggatgtatggttgtgtgaactatctgaagcagaagtatggaaatccaacagttttcataactgagaacggaatggatcaacctggaaacttgacccgtgagcagtacttgcacgacaccacaagggtgcaattctacaaaggctacctcgctgagctgaagaaagccatcgatgacggcgctaacgtggctggctacttcgcttggtctctccttgacaacttcgagtggcagtcaggttacacgtccaagttcggaattgtctacgtcgacttcagcacgcccaagctcgaacgacaccccaaggattcagcctactggttcagagacatgcttcagaaacactgagtgtctaacaaccaagcctgaaccctggagtagttaccattgaatttcttcagcgttgcctaagttagtgtttggctggccatattattctagcaaaagctgtaagctagctcagtacaagggtatcaaaattggagtaaaagatgataaacgg

SEQ ID NO: 5782 - DNA, 561 bp, Sorghum bicolor
  Clone ID: SORBI-28MAY03-CLUS2518_1
gcacgaggggattctgatggtgtcaaattcaattacttgacaagctgtgagataaaggtcaagtatgttcttgatggttcaacaatattttgggccacggggcataagtctggtgttgttgcaaagcatactgagcattgcggacaagaagttggaatggttgttccgtttgaggatatcaatggcgagttaactgtaagccttgtgctaaaagaatggcagttctctgatgggtcggttacattgagtaattctctgggcaatggacttcaaagctcatttgatggatcgataaagcttcagtccacaacaggaaggagacttagggccagagttgttgagggtagggcccttacagctaacagtaaatctggaaaatgtgacccttatgtgaaactccagtacggaaaggctctataccgaacaaaaacactgtcacatacagttcgaccagtttggaatgataagtttgagtttgatgagatctctggtggtgaatatctgaagatcaaatgctataatgcagatatgtttggtgatgagagcattggtagtgcaaga

SEQ ID NO: 5783 - DNA, 1045 bp, Sorghum bicolor
  Clone ID: SORBI-28MAY03-CLUS25174_1
ggcacgaggctggctcagatccatgtccacccagaatctgctaaccggcgcgtgcacgagctccgctccgaccccgcccgaggcggatggaggggacaggacgcctctagcggacgcggcggacgcggcggaagagctgtaccgcctccgtgacaccttcttcccccgcgaccctggcgagaaggccgccgcactccgcgcccgcaccgacgccgccctcgccctcctcgacgccctcccgtccgaacaaaagaagtctccacaactgcgtggtgtttatgaatttttgaggggaaaaatactggatgtctttcctgactatcataaggaggctgaagatcatttatccaaagcagtaaagctgaatccatctcttgtagatgcatggttatgtttgggtaattgcatttggaagaagggggatctatctgcagcaaagaattgcttttcattagcactaggaaagggtccagataagaaaatactgtgccagatctccatgcttgaaagaagtatggctcaaggtagtgcagaccaggcgcttttagtagaagagagcattaagcgcgcaaaagaagctattatgctggacattagagatggcaattcttggtataatctgggcaatgcttatctcactagtttctttgtgggaggagcctgggatcacactaagcttcatcattcagtgaaagcatatcaaaatgctgagaaggatcaaactatgaatttaaatccagacctctactataattgtgccacagctgacaaatatttagagaattatgaaagggcccttcgtggatttgaagttgcagctttaaaagatcctgggcttggtgctgatatagaagttcagaagataatcagtctccttgataagcttgagaatgcgatgaagggacaattacgaaccaaaaaattagcatcatttgtgtcatccttgagtggtgtcaaactgaaatcatcacacaagaaagccaccatagctactctatcagagggtttgaacaaagctgttgctgttttgggaaaagttgttctt

SEQ ID NO: 5784 - DNA, 609 bp, Sorghum bicolor
  Clone ID: SORBI-28MAY03-CLUS25240_1
aacggaggaggatggaagggccacgcccaaggcaattaggcgctcggcgtccatggattctccattgtttctcgtggctgttcctgaagctcaggatgatgtcgtgcggtatagttgcaagttgccaaatgcccgagagatgaaggtcttcagggtcaaggagaaggaggcaggcacttcttcgtcctcttgtcagtcaggccggttcaagattggaaggtccatgtcaagcagtggccaggggttcttcttctcacggaatggccgctccagtggtgctgtgctgccactgtgagtcggtatgtttgtactgtcaatgggttgcagcctcagcaaagccgggagctggtagtgtgtcagtgtctgttgatagaaagtgcagagagctgaagttgctctcagagaaaatctcctttgaggtgtgagttattgatgagagcaattgttgccgataaggattgcttgagtgatacggttatgttagctttgaagtcccaagtttcctgtatgataacttcaagcttggcttgagtgaatttggggaaggctgatgtttggcttctccatacttgttatgtactagtagtcatgcaagaaggaatgggcttt

SEQ ID NO: 5785 - DNA, 735 bp, Sorghum bicolor
  Clone ID: SORBI-28MAY03-CLUS2520_1
gcacgagggcgggcccgaccctgactacgaccccgcccttgacattgaacgcatcgagtcatcgactgtaaggctcttggatgaacagaaaagaatggttggtgtagtatctgtaagcgaggcagttaaaattgcagacgataacgatcttatactggcaatattatcattagatggagatcccccagtacttcgactctttgaggagagagattacaaaaaacataggtatgaacaacagaagaagaaaaagattcagcagaagagatctgtcgcgaaacgcatgggcttgaaggagttgaaaatgggatacaacattgacatccatgattacagcgtgaggcttaaagctgcaaaaaagtttcttaaagctggagacaaggttaagataattgtgaacttgaaaggacgggaaaacttgtataaaaaagaagctatcgaacttcttagaagattccaaaatgatgttggtgagcaggcgacagaagaaagtaaaaatttcgcggagaggaatatatatttggttctagttcccaataagatagctatacagaaagaacaggatgaattgaacaaaaagggtaccgtgaaagaagagagagaccaatcagacagtgatgaaccagaagaggacagtgatgaacctctgacacaactgctggaggaaagtatggagcctgaggcagaagtctcagcaaatgtttgatttgaactctaaggccaagtgccttgctc

SEQ ID NO: 5786 - DNA, 690 bp, Sorghum bicolor
  Clone ID: SORBI-28MAY03-CLUS25244_1
aagttgttaagacggtcccctcgcattccctggcgtgtgctgggccctgggccactcgagcggctctggaatgcttattccacgctggaaggtcgtgttttccggcgcctcgcctcccggcccaccccgtagtcttgcgtccaggcctgcctcagtgctaatacatgaggcaacatttgaggacagtatgaaggatgaagcgatcgcgaggaaccatagtacaaccaaggaggccatagaagtaggcacatcggctggagcttaccggataattctgacccacttcagccagcgataccccaaaatcccagttatcgacgaggtcgatatggagaagacctgcattgcctttgacctgatgagtgtaaaccttgcggatctgccagttgtgcccaaggttctaccacacctgaaggtcctgttcaaggacgagctggtagttgacgaggccgatgagctccaagaggctgctgtgtactgatatagataaaatgatgtacattaatttgatcgccttgtagcttagcaacattgtttttgacctgaagctccaatccaattttaaggccgcacggggtgtatcgtctgtcttttttatgtttgcgtcgatcttgaagttgtttttgttgggtgattgttgtgagttgagttgtgataacaaagataataaaagctgtgcctattttattc

SEQ ID NO: 5787 - DNA, 519 bp, Sorghum bicolor
  Clone ID: SORBI-28MAY03-CLUS25249_1
ttgaaggagctattttttggcaagtgatgaaccgtcggcaaccttgtttctcttgcacttgaagcagctaactgttcctgggtaggaagctctcctgcaataattcatggtgactgttaagaacggtggttcagttgctctcattttggtctgaagaacggtgcttcagtcttggcattttgaggtgaaaacgtgaaactttactggtcaactgaaggctataaacattgccatggccctggactggaagctccaacttcccaggctgtagaaagcgccatgtgcctctctacagaagccaccgcgtgatggccagcttcatcaggcagggtgggtacagtagcaagttagccctagtctgatgtaagaacaaatttatatatattgtccatcccatattgtcttgaataagatttaaggtattttttttttgaaaccgataaaatttcagctcttgctgtcgtgcaagtgcaaatttgtacccattgtccatggatgattttccaatagctgctgctg

SEQ ID NO: 5788 - DNA, 655 bp, Sorghum bicolor
  unsure (1)..(655): unsure at all n locations
  Clone ID: SORBI-28MAY03-CLUS25263_1
ctcctcagcagcagggtgcagaaaatgaccaagcagcggacagcggtaagaagaanattggtaataactgaagaacacttccagagagttactcaagctttggttatgagactaaggcagcatgaagagtcagtcaagaaagatggcgatggtttggctggcatgaagcaaggggatcttatcatttggtatgttgagcagcagaatgccaaaggggcatatagttctacagcagaggtgaaggaagaagtgaagtgtatcaaggccattatagagagacttatacagcgggaaggccatcttatagtcattgatgaaggcacagcagccccagccgaagatggcagtggcgtaagaagaacatcagagagcagaatattggcagttaacccgaactatgttgttgattagcaacagctttgtaacatgctgctaactcaagtcagctgatgtggttaacgaacataagctgtagttcgggtgatgtgcctgttgtgccctggcattgttgtaccatctccgtcactgatgtgctcattgcaaaggagcacatgatcctcaaaatttataatttgtttcctcttgcttctaggcttagtgatgcatgataattagcgtatgtagtctgactatataattttgaccgtgttaccct

SEQ ID NO: 5789 - DNA, 783 bp, Sorghum bicolor
  Clone ID: SORBI-28MAY03-CLUS25564_1
gcacgaggggagctcgggtgcagcgggcggtgcgccaccagcctgtgcggcggcggtggcacggcgtccgccaggcggccttccgcgttccgcgtggcggagttcctgtcgtgctgcgacatgtgccggcgggcgctggacgggaaggacatcttcatgtaccgcggcgagcgcgccttctgcagcatggagtgccggtaccacgccatcgtgagcgacgagttccaggaggagaaggagcggaagcgccgcgccgccgccgccgccgccatgtcttccgccgccgacgtgcccaagaagtctgccgcggcggagatggccgggtcgccgtgcagcggcagcgggcagatcttcttcaccaccggcatcgtcgccgcctgatgagccgacggacggatccaccattccttctagtctagtgatcaccaaaaaaaaaaatccagctagaggaaccggcggccgctgtaacataaacatgacaacaacaagaagaaaaaaccataaaaaaaagcaagaagagaaataagggtgggcgtttgtgtagagaaatgggtggggaaaatttgaggtggcaggggtgttcattggatctggatttttttttttgtatgattagtatttagtagtactactatcatggcgatgatgatcatgatgacgatgatgggcgagatgagatgtttttgtagcagcagcagcaggagagaagggggaggggatgatgacaaagttttccaaggattgtgctttcccttgtgtttctcctctgctctgccaaaagga

SEQ ID NO: 5790 - DNA, 584 bp, Sorghum bicolor
  Clone ID: SORBI-28MAY03-CLUS25573_1
tgtgtgttgtgccagcaggcagtggtaaccccccaaacataatcgttgatcacttagtttctatcgtagatggtggaggccttccaggatttataaatctggtgaggtcagctgatatagagagtgccagacttgggcttcagttcctggaactggtgatgagaggataccccaacaatcaaggtccaaagcttgtggagagggaggatggcatcgaggctatggagaggttccagttccatgagaacgaggtgatgaggaatatggccaatggtttggttgacaaatactttggtgaagactacggtctcgagtgagttccttgtgccccgctgatacatctgggtaaacatcgacatcgtagagctgttcgttggtttgaattgtaacagtgctagaacagaaggatgcccgttcatcatggttaccatggaatttagtccttgatatgtagctggaaatgtgaatgtgttgagtgtgaaactgaccgtgagctggaaatgtgaagtatggataggggaaaacgtcgacagactttgacatcttgtacaatacgaaattaatagcctggctgttttctttct

SEQ ID NO: 5791 - DNA, 1239 bp, Sorghum bicolor
  Clone ID: SORBI-28MAY03-CLUS2562_1
gcacgagggaaccatttgtgacgatcaatcactatgacatacccgaggaactccaacaaagatacggttcctggttgagcccagagattcaggaggacttcacctactttgctgagatatgcttcaagatgtttggtgaccgagtaaagcattgggctacattcaatgagccaaaccttatggcaaagctcgcgtacttcaacggcaaatttccaccaagccactgttccaagccatttgggaaatgcaattctgggaattcatcaactgagccctacattgcagcgcataacatgatactagctcatgcaaagacggtcaatatctacaaaaagaattacaagaccaagcaaggtggctctgttggaattacagtatatatgagatggtatgaaccactgagcgtccgcacagacgaccacttggcagtaagccgagctcagtctttcgaagctccatggttcctggatcccttgttctttggtgactatcctcaccaaatgcgccaaatcttaggtccaaacttgccggaattcacagaaggagagaagcaactaatgaaaaaccaaattgacttcatcggagtaaatcactacaaaacattatacgtcaaggattgcgtatattctctatgtgacttggacacctatgctggtgatgctttagtttctgaatcagcagaacgaaatgggatacccattggaaagccgacaccggttgcaaacaactatgtggttccaagctctatggagaagctggtcatgtatttaacgcagagatataaaagcatacctttgtacatcacagagaatggttatgcccaaataggcaatagcagtcccccaacagaagaattaattaatgatactgaaagatcaagttacattcgtgactacctcacttacttgagctttgcaataaggaaaggagcagatgtgagaggttatttcgtgtggtctttgatggataacttcgaatggctctctggttacaccataaagtacggtttttatcatgtggatttcaagtcactaaagcgaacaccaaaattgtttgttaaatggtacagcaattttatcaagggctatgaacagatagagatggcctttgaagaatcccctaagcatatggtttcctagcacagatatacagaattttcaaggtccgtatatgtacaatactcaatgatttgataaagatgtttacacaggaaattatttggtaaatttccctcgtgtc

SEQ ID NO: 5792 - DNA, 667 bp, Sorghum bicolor
  Clone ID: SORBI-28MAY03-CLUS25662_1
cggcgtcgcagacggcggacaaggctcgcgacatgaccggacagcagcaacaggacagtgccacgggcaccgccggcgacatggcgcgtaaggccgcggacacggccgtgcaggccaaggagaaggtgaagggggcagccgtgtccgtgttgcataaggcgggtgacaccgccggacatgccaaggagacggcgaaggacaccacatggcgcgcggaggagaaggcaggagaagtgaaagaaagtgcgtcagggactggcggtggcggtgcgacgacgacggcgacgacgacgaaggcgaagggtggcgacgacgaaggcacgacggtagtgggcgacgtcctggaggcggtgggcgcgacggtggttgggctcgcgcagcacgccaaggggatcgtggctggcgaggaggagctcgtccccgtcggcggcgagaaaggggaggtcaccggaggagccaaggaggagaagcgcaagctcgcttgatggaatgatgacgtggagccgttgctctgctttcttttgggatccctgtactgtactgccttttgcgacacgttcagctgtgtatagtagtagaataataacgttgctactgtacgggtgctccctgcggggtgtgaagtacgatatactacgaagtatagtgtttttaatgtatgacatgc

SEQ ID NO: 5793 - DNA, 638 bp, Sorghum bicolor
  Clone ID: SORBI-28MAY03-CLUS25311_1
tagatgttgcaaacaaggctctcctttcttcaattgacagctcgctgaagcttgaccatgacgcatgcgcaaacattggtgcgattcttacgccgtgccatggggaaatgagggagctgaagggggagcatcaccacaaggttgtggagatcagtgaaaacgctgggaaatgccttgaggaagagtatctggtggatgaaccctcgtgttcgacgccaaggagaaggcagatcgacctgccaagtgtggagtcaatagaggagttgcgaaccccagactatgacgagcttctcaagtcgttccgggagtcgagggggagctggaagcaggcaaatggagacacaagacatttgtcagagacagctcaggaaccaacagtcatggattcaagaattcctctcataggaagaaattagatttaccaaaagcttgtaaaaagaaaaagaggaagaagaaaggcatgtgtttagattacctttttccatattggtgttgatagtggtatcggttaactgctatttgtttggttgatgtttgtttgttcttagggtggtctacttgtatagtgactagtgagtcaatatatacctgctatcgcatgcatcattgaatctgttgtaaaaaaaaaaaaaaaaaaa

SEQ ID NO: 5794 - DNA, 596 bp, Sorghum bicolor
  unsure (1)..(596): unsure at all n locations
  Clone ID: SORBI-28MAY03-CLUS25349_1
cccgccgccgccagcggaggaggacgcgaccaagatcacgatcggcgaggcgctggaggcgacggcgagggccggaggcgggcgccccatcgaccgtgccgacgcggaggccatccgcgccgcggagatgagcgcgcatggggcggacgttgccatgcccggtggcctcggcgaccaggcgcgggccgcggcgcgcgccaacgcccaggccacgcgcgacggcgacaaggtcaagctcggcgacgtcctctcggacgtgacagcgaagctggcgggcgacaaggcggcgaggaccgaggacgcgacgagggtggtgcaaaccgagactttcaacgacgcggaagcgcgcgccaaggctggcggggtgggagcggcgctcaccacggcggcgaggctcaacgaagacaacgacctaagcggcgacacttgaattgaatgcggttccacgccacgtcacgactctctgtgtatagtagtacggagtacttgtagtatattgttagcacgtagcagtactaatgtataattagcaagatccaaggatcggagtatgcaagcatgtgtaatagcaagtctggcactatagctatnaaagg

SEQ ID NO: 5795 - DNA, 1281 bp, Sorghum bicolor
  Clone ID: SORBI-28MAY03-CLUS2533_1
ctgatttccctcgccacgctgatttccctcgcccctcagacgccgaaccctgattctgattctcgcctgcggtgagtacagggaaggaagtagccatggcggacgacgagcaggcggagaggaaggaggaggtccccgagcttgctccttttgatccaaccaagaaaaagaagaagaagaaggtggtgatacaagagccatcagatgaggtggataacttggcagagaagactgagagtttgactgtagctgagtctagtgagccaagctttgcgggcatgaaaaagaagaagaagaaacatgtggaacttgatccttctcttactgagactggagatggtgatgaagctggagacgatcaagttagagaggatgaagaaggagaagggattgtcctcagtggtgctgctgccaccagatacccttgggaaggaactgacagagattataagtatgaagagctgcttggcagagtattcaatattctgcgtgagaacaacccagatcttgctggtgatagaagaagaactgttatgaggccccctcaagtcctcagggaaggaacaaagaagacagtttttgtgaactttatggacttgtgcaaaacaatgcataggcaaccagaacatgtgatgatgttcttgcttgctgagatgggaacaagtggatccctggatgggcaacagaggttggttatcaaaggaagatttgcgccaaaaaatttcgaagcaatacttaggagcgtccgcaatgaatatgtcatatgcaatggttgcaagagtccggataccattctttctaaagagaacaggctgttcttcctccgatgcgagcagtgtggttcgtcgaggtctgttgctcccatcaaggctggattcgttgcccaagttggccgtcgtaaggctggatcttaagttacctaatagtactgcctggactcgcttcccgatcatgagaatccaaactagtttgcctgtccaccaaaatttctgttccactttcctttgtgcctacaccgtttactggatttctgctgttcactatacttggattggagctatgaatttatttcatgtgatgaaaaaaaaaaaaaaaaaacctacatcaatagttgaatacagtgagcacacgcccaacctctccctcatcggtggtcctactccattctactgagctagatactgcagtttggactactgctccagttctcagtatcacttgttataaactaagcaagctgagatatactgaatatctgaaactgttttgcatataaatatg

SEQ ID NO: 5796 - DNA, 688 bp, Sorghum bicolor
  Clone ID: SORBI-28MAY03-CLUS25363_1
aggggtgcatgtgaatgggatggtgtactatctgacaaagtttcgctacattgcttcatcgcgtatcaactgcttgaatcttgagagtgaaaaatttgatgtgatgatgcttcccccgcgcaaatcttatggaggccattgctctttgacagagctcgagggaaagttatgcttgttgattgtggatggtgcactggaaggcccgcctcgtacaatggacatcctgatgctcaatagccatgataagcaggactggactcccagataccacttctccttgccttggttgatgccttcatgttattttactccgaaacacacgctcttccacgaaggaaagatttgggtgcagttgttggctaggagtctatactgttttgacccaagttcaagttcagacgaactaacgacagcctggccagagctcgacttttcatttagcacacatactttcattgagagcatagttccactgcgtaaagactactacttcaagcagatacaatgactgactgacagtggtgttctgccccttgctttcaaggtggtttgcagtttacatcattacattgtcttattatttcttttttcttatataaggaccaagctgttacatgttagtcagcttaagatggtgtgctgttctggattctaattagtgataataattgcaattccgaaacatctt

SEQ ID NO: 5797 - DNA, 875 bp, Sorghum bicolor
  Clone ID: SORBI-28MAY03-CLUS25351_1
gcacgaggcacaaacacacaccgaaaactgagacagagaggtgcagatcgatgcggcggtggtggtgcgccgccggcggcctcggccgccgcgtcctctcgtcctccacccccgccgtcgcctcccatgcccgtccgctgccgctacccctgatacccaaatctccctcctttaccgtccctttctccttgtcctgtcgcaggcaccactctctccaggggttctttcacccggccatcgcttcttctcccttccgccctccgtcggcgcatcatcagcaagtgcggcactacgccaagaaggagagatcgcgcgcgccgctcacgcccaccaaatccaaagtcaagaaatacaagatcaaggccccctcgtccatgaagtttagattcagaaccatgaaagacggacaggtccgcaggtggagggccggcaagcgccacaatgcacacctcaagtctaaggaggccaaacgaagacttcggaaacctgctttggtgcatttggcctatgcaaaagttataaagaagctcaacttctgtgggtaggaaatggagaaagacatagcagagtttggcatgggaaactagttaactgatactgactgccaaccgctgcatctcgattgtaaacgctggagtctccatggacaaaatagttgcttttgtcatatgatatgatgcattgtattcagatgttgtgctctcattatctcgagaagccgtttgttttctgcaaatgtagctgatataaatctgcactgcattctgttatgcacacaatcggagagaaattcatcatcaagagtagtttggaaatagctgctagcaaataaaaagttctgcaacatgcagggctataattttttgttgtagttt

SEQ ID NO: 5798 - DNA, 932 bp, Sorghum bicolor
  Clone ID: SORBI-28MAY03-CLUS25431_1
gcacgaggcgcaacagcttcttctgcctccacggtgcccaagccgcgacctgacctatctctttctccaagccgatggcgggcggcgggaagaaggagaagggcgaggggctcgggcgcgcgctgatccggcagcggaacaaggcggcggcggccgccaaggaacggggcgaggcgctcgccttcggccgccgccgcgcgatgccgctcgagtccgtcatcgacgtcagcgacatcgacgccgtgctccagcgggccgcggaggcagaccagctcgccgaggccgcgtccgtctcctccgactccgacctcatcatcgacctggatgcgacgggggagacggaagacgagaggcggcggcttcgtaaggagcaggaggccttgcacgccagcagcctcagggttcccaggcgaccaccatggcatagtcagatgacggtggaggagcttgatgtgaatgagcggcgtgccttcctggtgtggcgcaggaatcttgcgagattggaagagaatgataagcttgtcctgactccctttgagaagaatattgatatttggagacaactctggagagtgcttgaacgcagtgatttgttggttatggtggttgatgctcgggatcctttattctaccgctgccctgatcttgaggcatatgcaaaggaaattgatgagcacaagagaacaatgctccttgttaacaaggctgatctgttgccgttaaatatcaggaagagatgggctgattattttaaggcacatgatattctctatgtgttctggtcggctaaggctgccactgccacattagaaggcaagaagttaagtggatactctgaagaagaatctgcttctcttgacttggataccaagatatatggcagagatgaactgttgatgaagctgcaagctgaggcagagtctattgtagct

SEQ ID NO: 5799 - DNA, 584 bp, Sorghum bicolor
  Clone ID: SORBI-28MAY03-CLUS25902_1
gtcaccagagcaggggcaacgcagaatcaggcgccggttttctgttgctgaagtagaagcacttgtgctcgcagttgaaaagcttggaacgggaaggtggcgagatgttaaacttcgcgcttttgacaatgcaaagcaccgtacttacgttgatcttaaggacaaatggaagacgctggtgcacacagcgagcatctcgccacagcagcggcgtggcgagccggtgcctcaggagctgctcgaccgggtcctggcggcccaggcctactggtcccagcagcaagccaagctccagcctaagacgcccccgctggctgaggctcgcttgctcacctaataattcgatgatcccggctgatggcctcctccgaggccattgcagcctttgtataaagtcagtaagtcagtcagtcccttcacaggaggtttaaggaagatatattagaaaaaaagaatacatatataaggtacaagaagcattgaccgatttgttgtaatatctactcaccaccggttattctttaagccaggattctctctccttgtgaatttaaccaaaggaaagggtatttcttggcaaatgt

SEQ ID NO: 5800 - DNA, 542 bp, Sorghum bicolor
  unsure (1)..(542): unsure at all n locations
  Clone ID: SORBI-28MAY03-CLUS25984_1
gcacgaggatttttcaacaccattaactcttcaagctagccaccttttcaatacgccaatcaagatgagggctacccaagttttcctattgcttgccttcatggtgctgctatcaaatgaggtaggaacaactgcatcaacagaaagtagcggcaatggagattgtgaaccagcagttattaagttgggcgatgattgtatcccgaaggagtgcagccacaactgcattgccctcggagctcgtagtggaaactgcatcggagggccggcatgcaattgtgttttctgtggacctaggcatgcgccacctccgcaacaataggattctgttacatgggtgctgcagccgcaatgctgctgctgatgtttaggaacttctgctcaaggatagattcatagatgtatacctacagtaacagtgctggagcaagttaaatggctggaataattgatgattagtgatttattaaagtggaatatgtctgtgctttctatccaaagaaaaaatntatggaaaactaaaaaaaaaaaaaaaaaaaaaa

SEQ ID NO: 5801 - DNA, 526 bp, Sorghum bicolor
  Clone ID: SORBI-28MAY03-CLUS25978_1
atggactgtatcaaaggacacaacagaaaaggtcgaaggtctgcattcagctatcaagaaggttcaagttatagctgatgaatgggtcaagatgaactctactattaacagaatatggtcattcaccaaggagacagagaaaagggtggaaggtctatattcagatttaaagaagggcttcaagcagacgaagagaaaagtgccattctggagagattgatgatgctgtggacgggcctgatgtttgatcacttgtcattgatgctccgcttggaattgtcacacaagctgttagcaacttaatccgcttgtgtccgtgtttatatatcttagttcacgtccttattacttgtcagacgtcagtgcaaggttgtggttgttgataccttgtgcgacccaacttgccaacttctttggtcccgtcatggtcgcataatgggtaatgtgcttttaacactggcggacgtccgtcgaaatatgaattgttatttttagctatatatatgaaatacacagtagatctccg

SEQ ID NO: 5802 - DNA, 559 bp, Sorghum bicolor
  Clone ID: SORBI-28MAY03-CLUS2600_1
ttttgttacagtaccgaaaacttttaactaaacaaggccatagttgaactttgtacaaggcacaaagccatatcccgaatctagttaccagaactgccaaattacacatgaacattatatcaggtttgcaatatcgaatgcaacagaatatattcacctctctgctggtggaagtcagatatatcatcttggtgtgaaatacatgagacaaaaacggaacattgcatcggtatacataatggtactgtatacttagtgtagtagattcagtactgtatacttagtgcagtagattcacttccggagcgatattgtccagataaggtaagaatccgaggcgacggtaaccttgtcctcttccacgatgtttgacgtgctgatcaatcctccatagctcatactggtattatctaaattccatcggagccccgtggttgtggtgctagtggagggcatgccgatggggatcaacccgcagtggggtccctcgatcaaccgttcaatgtgaatctcgtgggtgtgtgttcttgggagcagaaagatcagacaatcatctgat

SEQ ID NO: 5803 - DNA, 808 bp, Sorghum bicolor
  Clone ID: SORBI-28MAY03-CLUS25481_1
gggaacataccagagttggcagcaaaatgcgcctcctcctcaaccccctgaacatgtggtcaagatgcacccttcgcctccgccagcatatgccaatcgtcctccacagccgccgccaccgccaccaccagcgatgctaaatagtagtggtggatctggttctaactactctggtggcgagatcctacctccaccatcccctggcgcggcgctcggcttctcctcgaagagcacattcacctacgaagagttgttgagggcaactgatgggttctctgatgctaatctccttggacaaggtggttttgggtatgttcacagaggattgcttcctaatggcaaagagatcgctgtaaaacaattgaaacttggaagtggccagggagagcgtgagttccaggctgaggttgagattatcagccgagtacatcacaaacatcttgtgtctttggttggctattgcatttctggaggcaagaggttgcttgtctacgagtttgtccccaacaacacattggagttccacttgcatgcgaaagatcgaccaacaatggagtggcccactagattaaagatcgctctgggtgctgccaagggtttagcttatcttcatgaagactgccatccgaagatcatccaccgtgacataaaggcatctaacattcttcttgacttcaaatttgaagctaaggttgctgattttggacttgcaaagttcactactgataacaacactcatgtttccacaagagtaatgggcacctttgggtatttggcgcctgagtatgcatcttctggcaagctaaca

SEQ ID NO: 5804 - DNA, 497 bp, Sorghum bicolor
  Clone ID: SORBI-28MAY03-CLUS25497_1
ccgctcggcgctgctctttcggagaagagggaaccactgcacgaactagctagaaaccgagcacagaccggaataacaatggcgcaggcgcagccaaggagacaagacgatccgctgcaggcgcagcagggcaataaggctcagcaagacgagggcctgcagccggaggaggcggccatcaggtatggccacgtgttcgccgtctcaggagacctcgcggggcaacccatcgggccgcgcgacgcggccgccatgcggtccgcggaggacagcgtggcaggcgtccaggtcccgcagggcgccgggggcggcttcagcgccgcgaccgccatggagacggccgcggcctacaaccaggccgtcggcgccgtgcacccggggcaggccagcgacaccgcggccatgcacggcatcgccgtgacccagaccgccgtgccgggcggccgcatcgtgacggagtttgtggcgggccaggtcgtcgggcagtactccgtggc

SEQ ID NO: 5805 - DNA, 700 bp, Sorghum bicolor
  unsure (1)..(700): unsure at all n locations
  Clone ID: SORBI-28MAY03-CLUS25508_1
aaaacaaaccgaaagccggcggctaacgcgaccgaggaggcggaaacgggtggaggaaaagggcaaagtcgccgccccgccgcctccgggcggtcggtgagcccgatgcgctgtcccgctcgacctcgtcgtgtccctccgcgttgatctccgcctcgcgcgacgcccgactcgagaggaatccgccttcggtttcgccggccggtagatgcgagggttcaggaggcgcggcgtctcggcggctgcaatgcaggactactaggggccggggcatcctgccctgcgaggtggccgtggctgtatgatagaaactgaaatcttgcgcggttgctttgtggatgcaaaaaccagtgggtgctgggggttgcgccgtctcagctagccgcggacttgtcttggcctagcggggaattgatggagcacaagaaagctagagcagtggaggatcctgcccggttgatttgcgacgatgccctcactgaggtcttccgcaggctgcctgcccgtgcgctcgcggcatgcagattggtgtgcaagtcgtggatgtccgtgctcacagatccacatttcatccatgagcacctgagccgcggccagcagaagctgctgctctttgcgaacgaccgggcaaatgacaggtcgctcgccatggtgcttgcagacgacnagtccatgtaccagctgtcgaggcccgcggcgt

SEQ ID NO: 5806 - DNA, 501 bp, Sorghum bicolor
  Clone ID: SORBI-28MAY03-CLUS25512_1
gcacgaggcaagaacagaagagagacgagagtagcagagcagctagaaaggaaggagtggtcaggtcagcaatggcgcagcttagagcacccgccgacgaggagaggctgcagcaggaggcgccgcacggcgtggccggcggcggggacgtgagcagcaacaagaaggcgcgcgcggggctctgcggcgtgctccgcgagcgcaaggtggtggagctggcgcgcgccaagcggcggctggtggaggtcccctacaccgcgacgctggcgcacacggcgaacgcgctccttgccgcgcgcgtctccggcgtggccgtggccgcgccgccgggccactggatcggcgccggcgggtccatgatcctcgagtccgacccggccaccggcgccgtccgcaagcactacatcggcatggtcaacatgctcgacatcctcgcccacatcgccgaggccagcgacgacgccgaggccgacggcgagtccgtcgacctcgaccgccgga

SEQ ID NO: 5807 - DNA, 760 bp, Sorghum bicolor
  Clone ID: SORBI-28MAY03-CLUS25561_1
tcggtccccccggtcattcttcgcgggccacggagtgtgggcacccgccatgcagtgaaggcggccaagcttcggaacgtggccaagccctttgctgcgaatccatcccgtccgctccccggggccctatcccgtgcgccggtgccaaatcgcgtgctgtctgggctggtgctgcacttcagcaggccaagtgctgttccatcacgcagtgacctaatcaagatctttagccaatacggtcctgtcaatgaagccaaggcagatgttgcaaacagtgccagctctgctcaggtgatcttcaagaggcgcatggatgctgaggcagcttttgcaggtgctgggaaaatcagtgcccttggacctgcccttgtgagctttcgtctcaccgacttcccagctagtgcttcaggaaataaagcttcccatgttgcatcaaagagcgatagagtgttgcatgaccagtgagggaaaccggatgagggagttagagaaaaaggtatactctactgtatgtgctatattgtagctaggttgtttcaggattaagagcattcataggaacagcaaatggcatctttgtcttccagtgttgtcgaggtttcatatactcctattgtcatttatgctgcagatcagtcgagatgagttgccaataaccaataggtgttgtaaaagcatgcttgttttaagctgagtttttgtacttaaaaagtttactctgtttcttaataatccaagtactggattttgatgcgggtgc

SEQ ID NO: 5808 - DNA, 575 bp, Sorghum bicolor
  Clone ID: SORBI-28MAY03-CLUS26211_1
gcacgaggctcgtctcgtcctcgtaccgcgaaatcgcacgcccccaaaaccctagctacccggcgcaactcctcccccttcccgcctcactgcggcgctgcgcgacacccggcctccgccggaacaccggaggcgggtgtagcctagcgggcgggccatggcgtcaacggtgctggaggcgacgcgggcggcccatgaggacctggagaggctggagcggctcgcggtgcgcgagctgcaaagggatcccgctaacccgcgcgaccgcctctttcagtctcaccgcgtccgccatatgctcgacctcgtcgtctccacctccggcaagctcgtggaaatctacgaggacaaggacaatgctaggaaggatgagatcaatactcatcttactgcgcccacgcaaagtggactgtttagcaagtactatgaaaggctcaaagagatccgtgaatatcatcggcggaacccatctgcccgttttgtcagtacaactgatgactatgaagagcttctaaaggaggaaccaattattgaattcactggcgaggattgtttgattcctcttgtgggatctt

SEQ ID NO: 5809 - DNA, 714 bp, Sorghum bicolor
  Clone ID: SORBI-28MAY03-CLUS26245_1
ggcgtatcctgccgccgctcccggattcaccggcaggcggcagccacccctctcctgtcctcgtcgtgtgtctgtcacgggtcacgatcgactcctccccctcctcaagcgccccgctgaagtcgtccctcccgcttagctcgtcgccggcatcaccggcctcctctcagcccgtcgctggggtacactaggagctagtgtaaacaggtcgttcaaaaggacagaaaagtgtgagctattttaaatggcttcaaagctccaggccctttggaaccatcctgctggccccaaaaccattcatttctgggctcctacatttaaatggggtatcagcatcgccaatgttgcagactttgcaaaaccacctgaaaagatatcctatcctcagcaagttgctgtggcttgcactgggatcatttggtcacgctacagcttggttatcacaccaaaaaactggaacctgttcagtgttaatgttgcaatggccagtacaggcttgtatcagctttcacgcaaaataaggcaagactacttttctgatgagaaggaaaccgccgcgtcgcacgaaggatgatgacgcactgcattgcacgaaggatgatgacgacaaacaagaatgatcgattgaggggaggaccatacagattggagtcagtcccaattcattatggattttagatgtcattttatcaaatataggaacccgttcattaa

SEQ ID NO: 5810 - DNA, 968 bp, Sorghum bicolor
  Clone ID: SORBI-28MAY03-CLUS26246_1
gcacgagggagaaatgtcattgacatgtattcgtttgacaagtgtgcagatctgcctaaaagcatgctgaaaagactgaaagcagaaggacaaacaaagaaaaaattcatgagagcactggttctagacaaggaattatctaatgggcagacttcaaatcactctgaaggtgctattgggctaactcagtctgacccggaaggagataagtttggatctgtggaagcgacatgggaaaagggaatcagttcagagactatgaaacgacgaagagggaggccaaagaaaatcttgaagcaaacaaatgatagcatttcagatcgtgacaagggggagcacattgaggccaaagaggatgtagatatcagtggcgggaaagacttgaggaatgtgaagacttcggagcataccgagacgcagaatagcatgatgataatcaaggaagtaaacaacaacaacacagcagagaataaactgtcaaagacagtgggagacaaatcggatttggtaaccggcatggctttgcacaaacaagagaatgtcagattaactgaagttagtgagaaggcaacattctccacagttcacaaattttacaagaggagaaattgcaaccagacactcggttcaagaaaaagataaattcgatcaagttacctggtgagtttatggctcgtccccaaaaggatggatcatacttctttagggaacaaaaatggaccaaagttgatttgtgtccagctttttttttttgtttcattattcccttttgcatgcttttattcgatgtaaggggtgtctagtggaagtaatccatttgattcttgtatcattgaattaatactgcttgtagaaagcaggattttaacacttgatagcaggagcatcaaaagaaatcaaatggaagaagttcccattgacctgagaggctggacataaatgccgtcaatgagcatattgtaaggatt

SEQ ID NO: 5811 - DNA, 633 bp, Sorghum bicolor
  Clone ID: SORBI-28MAY03-CLUS26280_1
ctactgggaacgcgtgctacaatctccctcgagcctcaaacccccaaaccccagcggccagcaaaagcagcggcggcggcggccaggggctgacgaacccgccgcgagaaaccccggttggcaccccaaccaacggcatgggtggtattggcgtcagcccgtgcgatctggacagggagttcgcgccccaaatcgcccagctcctcgccacgcctcctctccaatccgctcaggaatattatgatgaactcatacggtccaagaagcctgatggcattagagtgagctacagtggcaagcatgggaaaggtgtttgtgcaaatagggactttgctgaagacgaccttgttctgaaggaccaaatgttggttggtgctcaggacagccttaacaagattgactgtgttgtgtgtagttactgcttccgcttcattggttctatagagttccaaattgggcgtagattgtatttgcaaagccttggtggtagtgttgatggctctactgagagacattgccatgggagtgatgctgggccaagtactggctgctctggtgcatcaagtgggaatagcaatgctgtgccacaagaggtcctgatgtcacttatggatggtaatatgtcattgcctt

SEQ ID NO: 5812 - DNA, 779 bp, Sorghum bicolor
  unsure (1)..(779): unsure at all n locations
  Clone ID: SORBI-28MAY03-CLUS2629_1
gcacgagggggactggatcggtagctcgggggaatgctccaaaattttatatgaagaaattgattacattaatgaaggaaagaacgcagacaggtttcgacgggatttcagaaatataaagtgggttcgcgtgccacttatcatgtgggactacacaactgaaaaggtgttaaccctggagtatgtccctggtattaaaataaacaatttggatgttcttgacaaccggggctatagtcgctcactaattgcatcacgtgcaatagaatcttacctaattcagatattgaagactggcttcttccatgctgatcctcatcctggaaaccttgctgtagacaaggatggttctctaatatattacgattttggaatgatgggtgatataaagtcgttcactcgggagagattactttccctattttattctgtgtatgagaaggatgcaaacaaggttatgaaagctctgattgatttggaagctctccagccgacaggagatctctcaccggttaggaggtccatacaatttttcttggataatctgttgaaccagacaccagatcagcaacagactctggccgcaattggagaggacttatttgccatagcacaagatcaaccttttcggtttccatccacatttacatttgttataagggcattctctactcttgaaggcattggatacatattaaatccagaattttcctttggcaaagnngcannaccntatgcgcaggaactgtanactngaaaccnanacaacaacgggggcc

SEQ ID NO: 5813 - DNA, 665 bp, Sorghum bicolor
  Clone ID: SORBI-28MAY03-CLUS26700_1
agcaccaggtggcatgcagatacgacagatgcataggtgggttttgaggtgccatgcttgctataaggtgacccaagaggttggcaaaatattttgtccgaagtgtggcaatggtgggaccttacggaaggtttcagtaactgttggtgaaaatgggatcactatggcttcacggcgcccacgtgttacacttcgaggcacaaaattttccctcccaatgccccaaggtggaagagatgccataactaagaaccccattcttcgtgaggaccaacttcctcagaaggttcttcatcctaaatcgaagaagtccagcaaggaggatgatttcttgggcgtcgacgacatattttcgcacagtggtgataagaaggcaccattgaaacctccagtgaggaaggcactcgcaatgtttagtgggaaaagaaatccaaacgacaaccacttttctcgcaagaagcactaagctctcatctgtcttctttttatgcacgtggcgcacctatggtactttagtttgtaatctcagcatgtaatggttgaagcagagtaacttattcgttgttagtggcggagagtcatcattttcatatacgaagatataagcatgtaagctatgcagttttgcagcatctatgtatggtttcccgtgctactgtttatgc

SEQ ID NO: 5814 - DNA, 802 bp, Sorghum bicolor
  Clone ID: SORBI-28MAY03-CLUS25664_1
atggcccaaagggattttttcgtggcactggggccacactctgtcgcgaggttccgttctatgttgctggaatgtgcctctatgcagaagctaagaaggcagcacagcatgttttgaagagagacttggaagcatgggaaacagtggcagttggagcattgtctggaggagttgcagcaatagtgaccactccatttgacgtgatgaagacgcggatgatgactgcccctccaggcacaccagtgtctatgcagatgatagtcttctccatccttcgaaatgagggtccacttgggctttttaagggcgcgatcccccgcttcttctggattgcccctcttggcgcaatgaactttgcaggctacgagcttgccaagaaggcgatgatcgaagatgagagcaagtccagagaatcaatagaggagaagaaaaccatggtgggttccagaggataacctacctttcaccttgttaacatgtatggtgcaaaggcactgaaaccacacaacaggaaattttctgtccatattgcagagaagcaacagaacatgtgccaccttccttgtgaatccagtttttaggttgtcatattttgcccctccgagggaaatttgctgaatttccctccctgtaggccttgagatggctgtatagtacagtagacgagaaaatgactagaggatagaggcactgctggagctggtgttcttttgctggacagctcgcttcttgtttgttgttcaacgatgatacatagcctttcttgttaaaccctgatgtaaatttgctgctgtacttaccc

SEQ ID NO: 5815 - DNA, 618 bp, Sorghum bicolor
  Clone ID: SORBI-28MAY03-CLUS25701_1
ctgcggtgcggagtccacactccacaggaaagggcacgaggggctggctcaggtgaggtcgccgctgccaccaccaccaccaccggatcgagaccgacgccgcgcccgcgcggataggatgaggccgccggtgagcagggccgccttcgcgtccgtgctcatggggccgcgcgcgctcggggcgtctcttgtcgccgcccgctgtgccgcctcctcccctgccgccgcagccaccgctgccgtcactgcctacgatcatgcatcgtttgtcaatgaaatcgccgtaaccagtcctccggagcatctcaactctctcctgaatgtgcttcaagcacgaggtgaaaagattgtttctcctggagcaaaaagagggttgattccatgtgttgttcccttgtcagaaagtccagcaggtaatttgacatcactccttagatggccaaccgctccaactgggatggaaatgcctgttgtggaagttcgtaaacatgggttgtggcttttggctaagaatgtgaaacagtatatccatagaatacttgttgaggctgacatcaatgctgatactggtgatgatttatggactgccgtgggcgaagctggtaacctttatgctaa

SEQ ID NO: 5816 - DNA, 742 bp, Sorghum bicolor
  unsure (1)..(742): unsure at all n locations
  Clone ID: SORBI-28MAY03-CLUS25744_1
attactccaaggccagaggcccctcccttctccgttcaccccccttctcagccccaccaagtctactccaaatcgcactctccatcgccgccgccgccgccgttgtcgacgacgacgatggcaagcctactccggcgatccgcggcacccgcgcgccagctcctcctcctcccgcgccacctcgccgccgcgggcggctccgcccccgcctcgtcccgctccttctcccgcttccacccgcgcgacgacagctccatgttcgacccgccggagccgccggtgaactggggcgtgagcatagtcccggagaagaaggctttcgtcatcgagaggttcgggaagtatctcaagacgctcggctccgggttccacctcctgatccccgccgtcgaccgtatcgcctacgtgcactcgctcaaggaggagaccatccccatcccccaccagaacgccatcaccaaggacaacgtcaccatacagatcgacagcgtcatctatgtcaagatcatggacccctaccttgcttcctatggtgtggagaatccaatctatgctgtcctacaacttgcacaaacaaccatgagaagtgaacttgggaagataaccttagacaagacttttgaggagagagatgcattaaatgagaaaattgtgagtgccatcaatgaagcagccacagattggggcctgaagtgtatccgctatgagatcagggacattactcctccnatagggattaagc

SEQ ID NO: 5817 - DNA, 549 bp, Sorghum bicolor
  Clone ID: SORBI-28MAY03-CLUS25776_1
gcacgaggcagaggtttcatccgccagccgtcgacgccgtcgacgccggcgacgaggctgaaatcccttggatactcatcgagaatctagcctacgtcgccgaccgccgcaacagcaccaccgccttctcagattggaggtacgacgggcaggtccaggtcaccctcatcgttgtccctccgccgcgcgtctcctacctctgcgtcttctgccgccgccagcggcggcggagaggacccccatactgatgaggaggaggagcagggacagatgatccccatcgagcctgacatcatcgccacggacgaggacctcgtcctcctccgcatcgccttcagcaatgggcagcactggaccgacgccttcgacttcttcgtctaccagctcgccggcgacggcgggccgttgctcacgcgtctggggcgccccaactcctcctactgcagttatggcttcaattgtagttatggcttcaattgttaccaggttggccttgtgagctgcaccgccgaccgccgcgacgaccacgacgggagcagcagcagcggt

SEQ ID NO: 5818 - DNA, 674 bp, Sorghum bicolor
  unsure (1)..(674): unsure at all n locations
  Clone ID: SORBI-28MAY03-CLUS25764_1
gcacgaggaagagcccgttttgagattttacatgcagaacatagtgctatcaaattgaataatgcaaattcaagtattcacattgatgctgtcattgatccacttagtcccattgggcaaaaacttgccccacttctacgcatactctggaaacagattcagccgagcatgaggattgtacttaatcctattagttcccttgcagatcttcctttaaaaaacttctacagatttgttcttccatcgatggatgattttagcagtacagatcattctgtacacggacctaaagctttctttgcaaacatgccactgtcaaaaacacttacaatgaacatagatgttccagaaccatggcttgttgaaccagttattgccatccatgatttagacaacattcttttagagaatctcggcgatgtcagaactttgcaggcagtatttgaacttgaagctctcctcttgacaggtcattgcattgaaaaggaccgggaccctccccgtggtctgcagtttatccttggtactaaacaaagaccacacttggtagacacacttgtcatggccaacttgggttactggcagatgaaggtctcacctggtgtgtggtacctacnactggctcctggtcgtagtgccgatctgtatgagttacctccaaaactcattgccat

SEQ ID NO: 5819 - DNA, 825 bp, Sorghum bicolor
  Clone ID: SORBI-28MAY03-CLUS25802_1
gcacgaggatcagccactctcgtctctcttctccgtcctcaccaagtctgtgctccgacggcgccggccgccagagcgagggccggcgcaaggttggcgctgcggcggccagggcacgcaatccgtcatcagatccctgcgaaccgcggcatagcgttggaggcgagaatgggcccgacggcgtccgtgctccagttggcgcgcggcggcaaggtgcgctcgcggacatggccgtctgaggtggaggaggcgagggagagggcgaggtgcgcctgcggcagtgcgcgatagatccggcgaagggggtggaggaggtgacattcaggcgaggaggcgtttgtgctcctgtttgcggcgtcggcggccgtcccagctgctaggagggtgcggccgggcgggtcgtctccggcagggcgtacaaggagtaccacctcggggtacttcatctggctgcagagtagggtcgaggactcgcagatctgggccaagatccacagctcgctccaggacgacgaggtctgccagaagctcgcggccaggaagaagacggtcgcccagttcgtcaacagcaacctctctctgatccaggtacatacaacgattcgtgtagttcattgagtgtggctgtagttactgctacaggtcgaaaaagcaatttctgacttcattgcatggttgattcaacaatcggtattgtattggcatgaatgtgttaacctctatttggttgattgaactcattagaattatttgacatcataatgcaagcactatcagtatggaagttggagaaagcatttgtgattggatacactatcatttacc

SEQ ID NO: 5820 - DNA, 176 bp, Sorghum bicolor
  unsure (1)..(176): unsure at all n locations
  Clone ID: SORBI-28MAY03-CLUS26506_1
ccaatttctccgcacatatttacataccnttttnaccgaatgccatcccccctcctgggcttccagctgctgcagcagatccaagatgaacaataaacaccgtaacaggcgaacagggagcaggtctatgacgtcagaggacgatgaaatatcatggtgtcttagccatcttatta

SEQ ID NO: 5821 - DNA, 722 bp, Sorghum bicolor
  Clone ID: SORBI-28MAY03-CLUS26525_1
catgatgagctacaaaaagcatgtgaggaatttggtatagaagatgcacacctagaagatatcatccgtgacattgatcaagacaatgatggccggatcgactacaatgagtttgtaacaatgatgcagaagggaaataatccactagggaaaaaagggcactaccagatgagctttggtcttagagaagcattgaagcttggctaatggtatgatcaatcctgtgtaaagtgccattcagctttatatgccaaactatacttgagaaaactaacttcgagaatttgggactcgggtgccaaaggtggagcaaatgtgcgataggattagcttcgaggtaccaactgagcaatgagcacgttgcatgcaggaactcaatggtgatctttttttatatatatatttcaaatgttcatcttcaaatacggagcctccttaacccaccaccatgtataggcttttttgaggtgggaaaggaatggcggttgtgttttccttgaccttctgaagctcagttgcaggatgctcctatatagagagaaatgttagtcacatcacatcgcctgtgcatactgtatagcgaagcttaacatgtaatatcggactatatgtgtgtgtgtgttgtgttttttttccttattagatagatgtgcaggcagagccttgtcatatatgtattgcaagaataggctggctattaagaaaagattttgtgtgtgtgg

SEQ ID NO: 5822 - DNA, 502 bp, Sorghum bicolor
  Clone ID: SORBI-28MAY03-CLUS26552_1
atcaccttccatacatgtagcgcagaatatgggcaatgttgcttctgagagcagcaatcaaatccagttgccacattctaatggcgacagtgctgcacagatggttcttgcagctcctcagcagtcatcgtctgtcgaacagctgtcaacttctagcaccacagctgttatagtgggcgagcctgggtcaagtaggcggtcaaggcctttggagtccccacccataagaagaacaaggaggaggctgcagtaggtaccagagtgttgtcactcccttcaataaaacctacagaccttgccccagtgtttgttattaccatgattagctccaataacatctcaaggttaataatgtaggaatgtatatgccatcactcgttcccacctttctcttacataccatgtatcatgtatgtagcttcatcatggagtcaaaatgtcagttccagtatctataataatcttgatcttctgtactcagaatatattttctgatttagtc

SEQ ID NO: 5823 - DNA, 1082 bp, Sorghum bicolor
  Clone ID: SORBI-28MAY03-CLUS26677_1
cttgaggggcatgatcgaattaaaagtgctctggcccatattggcactcatgcgctcttgaaaatgctactggttgataatttcgtccatgcagatatgcacccaggaaatattttagtccgtgttgtacaaccaaagaactcaaataacacccttataaagtcaaggccacatgtagtcttcctggatgtaggaatgactgctgaactttcaagtaatggccgtgtgaatttactcgagttcttcaaggctgttgctcgccgagatggtcgtacagctgcagaaagtactctaaagttgtcaaaacaacagaattgcccaaatccaagtgcttttattgaggaagtggaacgatcatttctctttttggggcactgctgaaggtgatgttgtccacccagctgagtgtatgcaccagctgcttgagcaagttcgacgtcacaaagtgaatatcgatggcaatgtttgtactgtcatggtgactacattagttcttgagggctggcaacgcaagttggacccagattataatgttatgaagacactacaaaccttacttttcaaggaagactgggcaaagtctcttcaatacacgatccaagggctcatggcgccttagggtctgtgctgcaatcctctcaaaagttttgatctggtttgtgttcggctggaggatcctctgctctcaccatcacgtttcttttcttctctactttatttgctcttagattatacagttctttgtactcgtcctggcccttgtgctgctaaagcagccctgatgataaagtaataataacagcaaattttcagaagctaccagagtactatgctgtagagtgcattgcttctcatatgttctcgatgggccaaaggattaggtcctttttccccctcccaacacttttgacaatagctcttagatgatgtagcaaaaggtgttttgttctgatgatctttttttgtaactggagagattgtataagtgaacaagagagttgcttatgtacacacagatacttgaagaaacctacttctcaactgacaattcccaggattaacgtccataaagaggctcacca

SEQ ID NO: 5824 - DNA, 566 bp, Sorghum bicolor
  Clone ID: SORBI-28MAY03-CLUS25986_1
gaactgtcaacagggtgacaatcttgactgacaagtttgggcagccaaaaggtttttgcttatgttgaatttctggaacaagaagctgtccaggaagctattaacttgaatgaatctgaattgcatggtcgccagattaaggttgcgccgaagaggactaatgttcctgggatgaagcagcgtccaccacgtgggtataatccctaccatggctacccttatagatcatacggagcaccgtacttccccccatatggttatgggagggctcccagattccgccgccctatgcgctacagaccctacttctgaagtacggggtagtgaagttcaatgcaaaaccagccatggtcactgctcagtcccgggaataattaaacctgctgctgtatcgtttgcactgttcgataattgacatgttgcgggcttgcggctcaatgctcctgtatcagttgccttttctgacctctgtattaactattaagtgccttcataagcgcacacatggtattggcttgtaatacaggatcgtaagaacgcaataataaccccgtatttcccaaggt

SEQ ID NO: 5825 - DNA, 613 bp, Sorghum bicolor
  Clone ID: SORBI-28MAY03-CLUS26085_1
catccgcgcccctcgccagtgtgcgcgggcttggttccggctggctcggcgggcacgctgcgtggcccctgcctctagctgctccttgcccgtcgtccctgttgccccagcccgccgcttgggcgtcgactacctcccgctgcccgccaccaggacggatcatcacccgtgcaattgtcaatgcattggagttcctccgtattgccccagcaggcagcgcgggaatctacagcttcctgacgagtgcctctgatggccttctaaagggtgtgccgagaaggaatcttcacagcgaccttcttcgtcctggcccgcaagcctcttagtaaggagactgaaatagtgaacgacggcaatctttgagttgcaggaagggatccttcagccccgcctttttcgtcctgggccgcaagcctctcaaggagactgaaatagtgaagtggcaatctttgagttgcaacatgccaacataagtatggggttgtgtttaagagctcatgaatagtggccaacttgttctgtactgaggtgtggttaatcttatggctcttgcactgtgtgctgggtcgttggtcatcttcccgcactagctttgtgtcctgtactaattcct

SEQ ID NO: 5826 - DNA, 667 bp, Sorghum bicolor
  Clone ID: SORBI-28MAY03-CLUS26026_1
gagcttctgactgaagaggatcagaagatattcaagtacttggactcagttgatgtggatgattctgatgttaaggcaggatactccattcatcttaacttctctgagaacccatactttgaagacacaaagcttacaaagatctattccttcgctgatgatggaacaaccacaataaaagcttctcagattaagtggaaggaaggaatgggacctgcaaatggaaatggtcttaacaagaaggggagcaagcggccattagtagaggaaagttttttcacctggtttggtgatacagagctcaagagtcttgctgatggtgtgcaagatgaggtggcggagatcatcaaggaagacttgtggcctaatcctttgaagtacttcaacaatgaggttgaagatgaattcgaaggagatgaagatgatgatgatttggatgaagatgatgacgacgatgacggtggcgaggagaactgagaccagtggtgcttggatcagaatgttctctgaatctcattagctgtttggtggaaggtgtggctgggcggaaggaattgtgggaccctttttgggagatttttttttttgggttgtttgacttagctggaactcaccgtagggaactgtttaatgccttctgaagtcaaccaacctgaaaggagactgc

SEQ ID NO: 5827 - DNA, 1023 bp, Sorghum bicolor
  Clone ID: SORBI-28MAY03-CLUS26183_1
acagcgcagaggcaggcaggattagggaagcgtcgcgaaacgcgaccggcctcgtccttaccaccggtcgatactaggggatctcatcagcctcgtgccccaccgccctgccctgtctgtgtctgcccatcaccggatcacccctcctccccctgcgcatcacgggcacgacgagctcgagccctcctcgtaccctccctcgcttgctcgctcgctcgccgcgctccgatcgaactccaggccccgcggggaggagagcagggcccccccgagggccctcccgcgcggcgacctcgtggcgttcctgcgcggctgcttctcgttcgggtcggcggggcggagccggcccaaggcctcgcccttgccctccccgccgcgcctgaccgccgctgcggccgcggttgcggcggcaggggacgacggggccaagatgaagggcctcttcaagtccaagccgcggacgcctgtcgacatcgtgcggcagacgcgcgagggcctcgtccagctcgacctccactcgggctcccggagcggcgacgccaagcgcgaggagaagatgacagagctaagcaaaaatatcagggacatgaagtctatcctttacggcaatggtgaatcagagcctgtaactgaagcatgtgttcaactgacccaagaattcttcagggagaacactttacggctattaatcatacatcttccaaaactaaatttggagactagaaaagatgctactcaagttgttgcaaacttgcaaagacagcaagtatcctcaaagatagttgcatctgagtacctagagtcaaataaagatctcttggacattttaattttagggtatgagaatatggacattgctttacattatggtgctatgttgagggaatgtattcgccaccaaagcattgcaaggtatgttttagagtctgaacacatgaaaaagttcttcgactatatacagcttccaaattttgacatagcttctgatgcttctgctacttttaaggaactactgacaaggca

SEQ ID NO: 5828 - DNA, 574 bp, Sorghum bicolor
  Clone ID: SORBI-28MAY03-CLUS26102_1
gcacgaggccacggacgacaatgactatcgacgcggcgctcctcgccatcgtcgtcgccttcctcctcccgctacgcctcgtctccctcggcctccgcctggcgtgcgggcgccacagcaccagcgccagacacctccgccgttcctgtgctgctttggccgtcgcggccgcgctcctcgcagtaatcttcgccctcccgcgtgaccaagccagggagtgcgccgccccggtcgcctccgtctccagtggcggggatgacttcggcggtttccgcgaggagttgcggtcggaggtcgagcagcttaagctgcagctggcgcggcttgaatctctttgggatagtaaatctaaagtggtggatgagaaacttgatcctttagaggaggagaatgatcgtgtagtgagagcaatggaacttgatatccagtctctgatcaatgagcaggaaaatatcaagattcaggaatcattatgcagctcatattttggtgatagtatcaaggcaatagaaaatgaggttcaaattctaaaagatggatcaagaaagatgaactcggatatatggactgtatc

SEQ ID NO: 5829 - DNA, 538 bp, Sorghum bicolor
  unsure (1)..(538): unsure at all n locations
  Clone ID: SORBI-28MAY03-CLUS27011_1
ctactgggcagtgggctggccaaccttcacctaacgcactnnggttcgtctcccacnnctcgcgccgccgcggcgctcgccggattccgccgcccagcccgcgttctcctcgacccaaccgagtcctgagaggcggaccatttcttcagtgatcatccaccagtgcgccatggcgtctctgatttccccctacctctccgtccccaccgcccccgggcacgcgcgccttgctgctccggcggcgccgcggcggcggaggatggcggtggtgagggcgaagattcgggagatattcatgccggctctgagctcgacgatgacggagggcaagatcgtctcctggacggcagccgagggggaccgcgtggccaagggcgaccccgtggtggtcgtcgagtccgacaaggccgacatggacgtggagacgttccacgacggcatagtcgcagtcgtcctcgtcccggccggtgggaccgcccccgtaggcgcccctatcgccctcctcgccgagtcagaggaggaggtcgcgctggcgcgg

SEQ ID NO: 5830 - DNA, 799 bp, Sorghum bicolor
  Clone ID: SORBI-28MAY03-CLUS27022_1
gcacgaggggatgatgtttgtatctctgtcaactcatccccgagtaaagtgatcaactgcaatgcaactttcaataatggattgcctgtagtcagtagcagtgtactctgtgcaaaggcatcgatgctgctgcaggatgtttctccgccagcactcctgcgctttatgcgggaacagcggtcgcagtgggctgacagcaatttagatgcattctttgcttctgcaatgaaaccaaatttctgcaatttgcctatgtctcgccttggaggatttagtggtcaggtcatacttcctttagcccacacgtttgaccctgaagaattccttgaggttataaaattagggaatgccagtaattatcaagacgcactcctgcaccgtgatctgtttctgttacagatgtacaatggggtagacgagaatatggtaggaacttgttcagagctcatctttgcccctatagacgcatcattcagcgatgactctccactgctcccatctggtttccgcatcattccgatcgacgctcctctcgacacatctagccccaagtgcacattggacctcgcctccacccttgaagttggaactcccagatgcaggataaatggcagcggtcctggaaatgctgcttctgctggctcaaaggctgtgatgacgatcgtgtttcagtttgccttcgagagccatctgcaggacagtgttgcagccatggcaaggcagtgcatgcgaagcatcattgcatcagttcagaggatcgcgctggcgctctcctcctcacgcctcgttcctcatggta

SEQ ID NO: 5831 - DNA, 1048 bp, Sorghum bicolor
  Clone ID: SORBI-28MAY03-CLUS27061_1
cactgcactgctctgctagctactaactcactgcgctccatgtgacctcacttatttctcctgtcagcgcagcgcagcagcagccacctataccgatcgagcttcgctcgtccggtccgtcctcccgatcggatcagcgtcgtgccgctcgatcggcaaacgaaagcaagcaagcgatggaggccggggcgtgggcggtggtggcggcggccgtggcgctgtacatggcgtggttctggcggatgtcgcgcgggctcagcgggccgcgggtgtggccgctggccggcagcctcccgggcctcgtgcagcacgccgaggacatgcacgagtggatcgccgccaaccttcgccgcgcggggggcacgtaccagacctgcatcttcgccgtgcccggggtggcgcgccggggcgggctggtcaccgtgacgtgcgacccgcggaacctggagcacgtcctcaaggcgcgcttcgacaactaccccaagggccccttctggcacggcgtcttccgggacctgctcggcgacggcatcttcaactccgacggcgagacgtgggtggcgcagcgcaagacggccgcgctcgagttcaccacgcgcacgctgcgcaccgccatgtcgcgctgggtgtcgcgatccatccacgcccgcctcctccccatcctgggcgacgccgacgccgacgtcgtcgtcgtcgacctgcaggacctcctgctccgcctcaccttcgacaacatctgcggcctcgcgttcggcaaggaccccgagacgctcgccaggggcctccccgagaacgccttcgcctccgcgttcgaccgcgccacggaggccacgctcaaccgcttcatcttcccggagtgcgtgtggcgcttcaagaagtggctgggcctcggcatggagaccacgctggcgcgcagcgtccagcacgtcgaccggtacctctcggccgtcatcggcgcgcgcaagctcgagctcaccggcggcaagcagaacgacgcgtcggccacgccgcacgacgacctcctctcgcgcttcatgcgcaaggggac

SEQ ID NO: 5832 - DNA, 537 bp, Sorghum bicolor
  Clone ID: SORBI-28MAY03-CLUS27094_1
gcacgaggatttccaatttcttcagcagctccggctccagctccagctccggctccagccaaccaaccaaaccaactcgagccctcgacgactcaccactcgcccgagagaacacacacgcgcgcgcaggcaaaaccctagccccactccggcgcgccaccggctgatggtttcgatgagcaccacgccgaagccgctcgacaccgccgccgccgtcgccggcggaggcggaggcggggacgagggaggcggcggaggagggaagaagcaggtgcgcggggcggctgcggcagcggcggtgatggcgccgccgccgatggcggtcccggtcccgcccgcggcgggggaggaggttcggaaggtcaggaagccgtacaccatcaccaagtcgcgggagagctggacggagccggagcacgataagttcctcgaggccctgcagctttttgatcgtgattggaagaaaattgaagcatatgttggctcaaagactgtcatacagattaggagccatgcacagaagtacttcttgaaggt

SEQ ID NO: 5833 - DNA, 935 bp, Sorghum bicolor
  Clone ID: SORBI-28MAY03-CLUS2712_1
cgtccgacaaaattacatactctagaactgtccaacagcttatgaaggagcaaccagatggaactaagtttcctcctgctttagatgcaataaaagatctaaaaatgaaagacatggatcttgttgaaagctaccatgcataccacagactactgcaaaaaatgtctgaaaacaagtgccatggttgtataaaactaaaggagcatatatcgttgatgaaggaggaaaagatgtacaaggatgagttgagtaaattgaaattccaaatgtcagatgaggcacttaaacagatgccggagtttcaaggcagaattgagttgctaaagataatcgagtacattgattctgatctagttgtgcaacttaagggtcgagtagcatgtgaaatgaactctggtgaggagttaatatcaacagaatgtctgtttgaaaatcaattggatgacctagaacctgaagaagctgtggctattatgtctgcattcgtcttccaacagcggaatgcttcagagccatctcttactccaaaactggctgaagccaaaaagaggctttatgatacagcaatcgaattaggaaagctccaagcagacttacaggtgcccgtggaccctgaggagtatgcacgtgataatctcaagtttggccttgttgaggttgtctacgagtgggcaaaggggacacctttctcagacatatgtgagctgactgatgtatccgaagggatcattgtaagaacaatcgtccgtctagatgaaacatgcagggaattcaggaatgcagcttccatcatggggaactctgcgctgttcaagaagatggagatcgcgtctaatgctattaagcgcgacattgtgtttgcggcaagcttgtatgtcacaggaatctgatacctcgtagttttttttgcttttgttagagaaaaatccttgtgg

SEQ ID NO: 5834 - DNA, 587 bp, Sorghum bicolor
  Clone ID: SORBI-28MAY03-CLUS2636_1
cgtccggaacgcccagctctgggcggcgccgccggcgatagccgcctgaagggaagacgaggagggaagtgaggcccgaaaaccaaagcctaggatccgttctggttggccatggctgcgcagctggagctggagaggtgcacgtacgcaccacggcacccgtgacgcgtgtggggcactggcggccacggccggccagagcacgctgggccagcgcgagactgtgagcctgcgctgggtgtgtctcctcgaccagaatgcgtccaccgtgtgtccgtgtcatggcacttgaatgcggctttggttttttcctgtggtcggcttgtgaccctctcctctacttgtttgctgtggttggcgccatgcgaggtgaatgcgatctggcttggtgcttccgtgcttccgtctgtttctgttatgaatggatgactctgcttttttgctcagtgctgtaagcctgtaattaatataagaattggaagagtggtgtgcctgcaaactgatttgacgagtggaccttcaagcaacacatccagaaatttcaactcacacatcatgttgggcgagtggaaacggataatttctct

SEQ ID NO: 5835 - DNA, 520 bp, Sorghum bicolor
  Clone ID: SORBI-28MAY03-CLUS26338_1
tcagacgcaggatgtaggtattacgccaactcggcagccgaacctggataaaaagcttgtccgtgtcttgcgtcaccatcgagttcgtagtttgcgcaccgtctaccgataaactactaccgtgggtataccccaaggtagactgccgaccagctttcgtcgacactggcgcgccaggtagggggtgtgcgtgcaacttctccggcggacaagatggtcacgatcccagcttccgcggccgtgcccgaaggcctcacgttcaccgtcggccagatcacgtggacgacgcgcggcggcggcctcgcgaccacggttccggaggagacccagatccaatctgggatcacgccggctccgaccacccgcgtgacggctccgagctcccgaccaccgctcccgctctacaagggaaaggagatcgactgctcgggcctcctccaggcgctcgatcgcgccgactccaagctactcgaagcctcccgactagtagatggggtcctgcgcccgcccgcccaagctg

SEQ ID NO: 5836 - DNA, 661 bp, Sorghum bicolor
  Clone ID: SORBI-28MAY03-CLUS26460_1
gccatcaccatatattcgatatataaaaggttactacaatttgctttctgtacttaacagaacgacattagcgcatatcagatctacaaaacggtaaaggattccaacacttgtgcaagctcaactacagatatttcttgaagtttcaacctactaccaaaggattaatggaactatgcctcacggtatgtacatcgctgcagatagaaaccgaaaaactgggtttcaacgtcaggactcatttccttgtctttccacttcctggatttgctcacttgaaaaagaacttccatatctccctgtcacaaacctcagtcaagaggtgaccaccaaggacaccttcctcttccatcagagctcgaagctgcctggcgccaccattggaaccaaccaagttcttcttggaagccacgtacaggactccataaggaggacgtaggcactttgaaataagtgcatagagcttcttcagagagttaactgcgtaggggacatcagaaatcaaaattacatcatagccaccgtctgcttggtcagtctcattagccctctcccatgcacggctaccagaaagcttcctagatcttctggggcagtagtcatgaccaactatactgcttccatcatgactactgcagacatccataaaatcatcctcaga

SEQ ID NO: 5837 - DNA, 541 bp, Sorghum bicolor
  Clone ID: SORBI-28MAY03-CLUS26421_1
atcgaaaccacgtaataatattataacaagctgtaaacggttgcgtgccaagagtagaagagttgtgaaccaatgggaaaccataaaaaacggctagaatagaaaacccgtggccaggtccctcccggcattctccgcctgcagaacccaaacatccccgatcaggacaaccataaagattggagcatgcataccaatcatgtatactcgttgactcccagcagggtcacccagtaagcaacgtgctgccccccaactacgtgtgaccactactgggaacgagactcccttaagcaaaggattgccatgtttgccgacatctaacagccgcttgacgaacagctcttttcttatcatcgagagccttgattgctgcttgtacaaccttacgccgcataggataaatttttgagtgaggtaacgtagaaaaggccactaaacattgtaatgctgtctcccgcacaaccatcatgtgagggtaggaaacaagttcggtaagaacactgattgtgatttggatattgtccagcctcgtgccgaa

SEQ ID NO: 5838 - DNA, 639 bp, Sorghum bicolor
  Clone ID: SORBI-28MAY03-CLUS26473_1
ccacgcggatatccgtcgccaccttatccggcgagttagagctgcggttcgacgtcaagccaaaggcatccgccgcggacattcccgccggcggagaagaagacaagaagatcacggtcgtggtgtcgccgacgccggaggaccccggggcggctggcaagctgaggctgagcccgcagccgccgcaggccaagatgaaggtggtcaccgggctggcgtccctgctgctgctcgccagctgagctgatcaagccaagaagaagaacagagacactctgcctctccggctccattttttttttccagttcatcagaactcagaagattttcccttgcgttttgtcgatccgtccgagggccggctccaggtgttttagcggttttccggctcttggaacagtgagagaacacaaaaacgcctccttttttttccctccttttccgtcggttttttgttcctgcgaaaaaacaaacaaaaaattcagttgtccgcggccgggggaacggaaggaatcccgggcggttttgggttccttcttgtgtcctcctgttcatgggaggaactgtcgaactgaagcgtcgctggtgtgatgtggagctgcttcgcagtactgtatcgtgttcatcagctcatgtcag

SEQ ID NO: 5839 - DNA, 495 bp, Sorghum bicolor
  Clone ID: SORBI-28MAY03-CLUS26477_1
ttttttttttttttttttggcagcgcaacattcctcatattataaagtgcaatctgttgtgtcgtttgtgagacacatcaccatcgactcatctagatgttgcacaatacaacatttttgtgtcgctccagcatcctcaggcaccaatgaagaagatacatgctcatcaaaatgcatcgggcaccatacaatgaattcgataccgaattgcctgtagttcgccagtttccattaaacccatccaaaatcatgtaaacattcaagcttgagccttttgtagtctttttcatcctgctcaggtgtcttcataaaatttgagaatgatcctggcccttttggtgcttcaacgtgtgatcaagctgctgtgccttgtgctcaggaacatcagtttgcctatgaaatgctggaggatgatgttctttactgtctggaaagcccatgtcttcagcagttgttggtacaccctgcttggcatggtgaccgttctcctcgtgc

SEQ ID NO: 5840 - DNA, 609 bp, Sorghum bicolor
  Clone ID: SORBI-28MAY03-CLUS27275_1
gcacgaggctccctccaagcaacagcactcggcccctcccggctgccgccggcactcaaggcacagcaaggcgatgtgaaagagatggatctgttcggcctgataaggacatgtgtggatgatgcataggatgatgagtgcaatggaggtggcctaaaggagagaggaagacgtgaggggcaggtcacaggtgcgattctcgatcttgccgacttctggaggagcgctgatcttggagttgttctgcagaagtatcaatattcattgtgcagcagctcataaagagtgtcatgttgtagctgaagcctactcgatctactgcctcggtttgaaagcctggaatttatgtgcgagcaacgcatatccaatgaatcaaaaagtacagaaaatagaaggtatgacaactaatagtgtacatttccatcaatttaggttctgaattaagtttggatccaaagggacattatcaatttcccagtcgaaattcagatacttcagctaattgcttctgcaagccctacactgtatggtgttgcctggtaggacaaaaccaagttcattcgtatgagtatcttgcagttccctgtggcttccttttttttacagtct

SEQ ID NO: 5841 - DNA, 628 bp, Sorghum bicolor
  Clone ID: SORBI-28MAY03-CLUS27294_1
gcacgagggcccgccgccgccgccacccccgcaccgcccctcctcctcgctgaaccagcaccagccgccggcgccctccgccgctgctcgcgcgggtgccggcgggcgccaggtgccgctgctcaaggagttctcgctcgcggagctgcgcgccgccacgggcggcttcgcggcggagaacatcgtgtccgagagcggcgaaaaggcgccgaatttcgtgtacaagggccgcctcgaggccagccgccgcgcgatcgccgtcaagaagttcaccaagatggcgtggcccgatcccaagcagttcgcggaggaggccaagggggtcgggaagctgcgccactgccgcctggccaacctgatcggctactgctgcgacggcgacgagcgcctgctcgtcgccgagttcatgcccaacgacaccctcgccaagcacctcttccactgggaaacccagactattgaatgggctatgcgtctgagagttgcatactacatcgcgcaagcactggagtactgtagcaccgagggaaggcctttgtatcatgacctcaatgcatatagggtcctctttgatgagaatggtgatcctcgtctttcatgctttggcctgatgaaaaacagcagggac

SEQ ID NO: 5842 - DNA, 813 bp, Sorghum bicolor
  Clone ID: SORBI-28MAY03-CLUS2731_1
aacatcgataaaattggcttggtaaattgtccggtgcttgtcattcatggtacatcagatgatgtcgttgactgctcccacggaaaacagctatgggagcattgcaaagtaaaatattctccactgtggttgagtggtggtggccactgcaatctcgagctatatccagattacattaagcacttgaagaagtttgtgtcaagcgttagcaaaaaaacatcaaaacctgcaccaaaagagataacggcaaaggatggcactaccagtaaagaaacaaaggaagcatactcggagaaacctcaagaggctactaagtgctcacagatctcacggaagagcctagatagccgagttgggaaatccaaaacagtggatgttcctgataaaccacggatgagctcagatgacattgacaagttccggaggagaagatgcttggtttggtgatgcctatgttctgcacaaattgtggaacagtacctgagtgaggatactatagcatggaaatcaagcatctgtattactacatcatgtcaccaggaatggcatcagcggttcctgcagtgcagaggaaacaactgttaaataagaaaaagaaccaggaagctaccatcatcatcatccatcaaagacacggctacttgactgaaaactggtagttcctcaattaatttaacacttacaccgtcaacatgttttgcagcatcggttagggtttccatcatgtaaaagtgtaccattattgtctgtaatcacgagggaccaatacaaacatttgctgcccctcggtgcaaagtctgaaagtcttaacgg

SEQ ID NO: 5843 - DNA, 690 bp, Sorghum bicolor
  Clone ID: SORBI-28MAY03-CLUS27340_1
gacgagggctgagtgcgtgcgaccgcactagcaagctgagcggaggcagcatccaagccggatcgagcaaggtacgtagcgcgatggcctcgcccaagcattctcatcagcatcgtgcttccgcggctcctccggcgtcgtccaactcccactccaagcacatgagcaagcagcactacgcacgggcggcggcgtcgtcgacgaagcagcggccgctgtcgctgcggcgtgcgatgctgcattcgtgcgtgtgcttcctggtgggtctcctcaccgggttcgccccttccgactggacggacgccgcctcccgcgcggccgtccacgccaacgccgccgccacggcgcaggtgttccgggcgctgcacgccatgaacaacacggcggcggctggggcactcggccacctgctcacgctgcagcactaccagtcgtcgtaccagcagccgcagcagcctcctcctctggatctggttgtggtggtgacgacgaccacgacgtcgacggggctttcggagcgcgagcggcggtcggcggggctgacgcgcacggcgcacgcgctgcggctggtgtcccctcccgtggtgtggctggtggtggagtcggcccgggaggcgggtcccacggcgcggctgctccggcgcaccggggtggtgtaccggcacctgacctacggggagaacttcacgt

SEQ ID NO: 5844 - DNA, 671 bp, Sorghum bicolor
  Clone ID: SORBI-28MAY03-CLUS27349_1
gcgcctcgcccgcccccccgcccctccgcggccgggcgcgggcggcgccaacccggccgcccggccccctgccccttccgcctccgcccgggcgccgccgctgcctcgctcccgctcccccccttctctgccgccgcccgcccgcgccagggcggctgcgcccgcgccgggcccggccggctgccgggcgcgcggcggcgccgcggccccgcccggcttcgccgctgggtcgcggggcacgcggttcatatcatccaaaggcattggatggaaatcatggaacaagcgttggttcatcctcacacgaacctcacttgttttcttcaagagtgatcctagtaccttcccgcagagaggtggtgaagtgaatcttacgctcggcgggattgatcttaacaattctgggagcgtcgtagtcagagaagacaagaggctgctgactgtccttttcccagatggccgtgatggtcgtgccttcactcttgaaggcagaaacctctgaagatttgtttgagtggaaaacagcactggaagaagctcttgcacaagctccaaatgcagctcttgtgatggggcataatgggatctttcgtgctctcgcagctgcccctgctcaagctcctattccagctcgggtgatggggcataatggaatctttcgcaatgacaca

SEQ ID NO: 5845 - DNA, 707 bp, Sorghum bicolor
  Clone ID: SORBI-28MAY03-CLUS34475_1
gcacgagggtttagtttggttgaggttgtgcctttgtttgttgatgagatggaagtcacagaaacctttgcaatcgtgaggtttaccaatgattggagtggattcaatgacgcgcttacgcttgagaaccattgcacgaggaataagctagggaagaaggagtttgagacgagagacagtggtctaggttccgtggagggagatggcggcaaaggtgaagtcaaggtttatgggtgggttgcccgagccgaggactatgatgcaacgagtgtggtaggaagattcttgagaaagcacaccgtcctgaaaacaatagatgaggtttccaagactgaattagagaaatcaggggagatggtggcaatactggcatcccagatcgaggaaaagaaccgatacttgcaggatttggagacaaagaagaatgcgacagaactctccatctcaaggcttgaggacgacaacaggaaactgcatgaggcatataatgaagaaatgcgcaatcttcatcgcagggctcgtgaaaatgctatgcggattttccaagagaatgaaaacttgaggattgacttagaaaataagaggagagaactgaacttacgagctaaggagcttgaaaaaatgtcagctgagaatgctaatgacaggaagacactcgatgatgagaagcagaaggcaaaatatgataatagtgaacttgagttagc

SEQ ID NO: 5846 - DNA, 769 bp, Sorghum bicolor
  Clone ID: SORBI-28MAY03-CLUS26752_1
gcacgaggggaaggcattcaaggcctgccttttgtgcatccagcaagcccccaagctgttttaatcgaccctttccgaaagggtcttctggagcagatagaatattatttcagtgatgccaatctgtgtaaggacctatacctgcggcaacgcatggatgaccaaggttgggtgccattatccctgattgctggctttccccaagtccagaagattgctaataatattcagtttatcttggaaacagtcatgctatctaacgttgtggaagtgcagggtgacaaactgcgaaggcgtggagcatgggagaattggctgcttccaaaacaaaattattctgctgggagttcttctggttcgttgtcccctgtgacatccaacattgattctctggcatctcagtttcgttctgttggatttgagggggcaacataccatgccaacatgccaggaatgcatggtgaagctctcctgacaagatcagcaacttcagttagtctaggttatcatgcatcaaccttcggtggcctacagagcaatgggagtggacctctttttgggccgaagtctgcaagaaatttactgaggagcgataccttttgaggactatatattcaagaaatatgaagtataatggcaggccgagttttcacagtaacggcctgcacaccttatctcttgtgaggtgaaagatcagttggtaaaaaaaacaaaaaaagggcaaaagcataataccaaaaaaaaagagataggcatacacaaagaactg

SEQ ID NO: 5847 - DNA, 902 bp, Sorghum bicolor
  Clone ID: SORBI-28MAY03-CLUS26822_1
gcacgagggttagctttctttaaggctgcctatgcattgtatgattctgatttctatgttaaagcggatgatgacatttacttgagaccagatagactttccttgcttctggctaaagaacggtcacatccacaaacatacattggatgcatgaagaaggggcctgtttttactgatcctaagttgaaatggtatgagccccaatccttcttactcggatcggaatacttccttcatgcgtatgggccaatttatgctctatcagctgacgtggtggctagcttggttgctttgagaaacaacagtttccgtatgtttagcaacgaggatgttacaattggatcttggatgcttgccatgaacgtcaaccatgagaacacacatgcactttgtgaagctgactgcacggagtcttcagttgctgtttgggacattccaaaatgctcagggctatgccacccagaggtaaaaatgctagagcttcatcaaagaaaagagtgcacaggtggtccaactgttgcagctgaggtgtccgagtctgaggattgatgttttcttggttggagcacaaactacggatctcatagttgacctctgcccctcacccagtagatgtgtttggagtattcatttgattcatcaggtacaatcattgtgggagcaccgctgaaggaacctataccggctggcgtcataacctagtactgtagcaaaggcattctcattcaaacattcttgtcacagcagccttcattgctccttttgcgttggaacgttcatcctgtatcgtagcaaaaaggaattttgttgtatagaaagtacggagtagaaggaaacaatgcattgtcaatcgatagatcatatacatacatcttctgatgctgtgactgactgaattagcg

SEQ ID NO: 5848 - DNA, 714 bp, Sorghum bicolor
  Clone ID: SORBI-28MAY03-CLUS26781_1
ctcacctgaattcagacgtttacgaggaccccttggcgttcaatccatggagatggaaggatactcctgagcccgttggtggctctaaggattttatggcctttgggattggtttgcggttatgtgttggtgctgactttgccaaactgcaaatggctatgttcctccactgcttggtcaccaattatagatggaaagccatcagcaaaggaaagatgatgttttatcccgggctgcgatttccggacggctttcgcatccagcttttaacaaaagcatgaaatgttgctgcaaaagactagctagtacatggtattaaaagtatgctcatttataatagctgtgatcaaatgattaaagacaattggatacaagtaaattttggtcagtatataagatatataaataaacgaatgtacaaataaacctaagaaaaagagaactagaggaagacttcaagatcatcaacctaagctgctcaaagcatgatctgtaagttacaatgttgaagcattagtgccaaatctgaagggaggaagtaggaataaaagcctaaaaattagaaaatggtgtagtatgattcctcattttccaagatgtatacctttaaactggatgttgtaatgcaatgcgtgtaattgtttccgtttatactatataataagtaaaagttcagctatatacaatatggcgacttttccaaaataatttgaa

SEQ ID NO: 5849 - DNA, 650 bp, Sorghum bicolor
  Clone ID: SORBI-28MAY03-CLUS26970_1
gcacgaggcctcaactcagtgcggtgccttcccccatctccctcctcaacaggagctcgagcacgcaataggggatctatggaggcggcatcctctactcatctcgagcccgatgtgcgtcctccaccatagcgtgtcatcccccacctcgacgccggccatggtggctttcccatggtggatccaaggagtactggacttccatggtggatacatggagcacgacgcagatctagtagtgtggtggtggtctcctccacccagtaggcgatggcggcccatcccccatcccatccatggaggcggctcaatctgcaccctcgatggcgcccccaacccatgtgcctcccctctttcccttatctcgtggttcccttatattgcggctacagtggattttgtggtgttgcaatcgtttatcggagatgtttcagtagtccactcgagatgttttagtagtagttctgttgttgttgcaataatatgtttcttcctatttttaacttcttcatcccaatgttgttgtagtattgcttctttgagatgttgcagtatgttttagttgcttcaatctcatgttgtagtaggtgtttcatgttgttgcagcagtttgttcggtgttgctgcaataacatattcatggtattcaa

SEQ ID NO: 5850 - DNA, 470 bp, Sorghum bicolor
  unsure (1)..(470): unsure at all n locations
  Clone ID: SORBI-28MAY03-CLUS26976_1
tttcatcctccaaggctcggccatggagttgcatgctacactcctattaacctcccttgttctcataggcctgctaccacacacccatcaagccatcacccaaggaaattgtgaaagatctggcctctgcacgtatattgtacgtgtgagccctcctccaagtatttccatggatatgagccccacgaaccttgaaagctggtatagatcattcctccccccgcatatggaaagatcgcctcgatcagcatcaccattcattcacacctataaagaagccattttcggtttcgctatagacctcacaaatgatgaggcagagtatgtcaagagcaaagatggggtccttatgatgtacaaagacacccttcttccgctcttgacaacccacacacctgattccctaagccttcgaccaaatggaggggcttgggatagcttaagcatgggcgagggaagcatcattgngt

SEQ ID NO: 5851 - DNA, 635 bp, Sorghum bicolor
  Clone ID: SORBI-28MAY03-CLUS2753_1
gcacagggtcatgtccgcacaagactttacttcacatcggaatctcatatacactccttgatgaatgttcttcgttactgcaatttggacgaaagtctacaaggagaggaaagccttgtctgccagagtgctttggaccgtctacatagaactagggagcttgattacatgagtaatattgtgcttagaatgtttgaaaacacagaggttcctttggaagatgagaagaggttcaggattgaaatgacattcagtcgtggtgccgatctcagtcccctagaggacacgtccggtgaaagttccttgcttcaggagcacactttgcccataatgggacctgagagactacaggaagttgggtcctgcctgacgatggacaagtttgagaaaatggtgcgaccatttgccatgcccccagaggacttcccccctgctgcccctccacaagccttaggctacttctccaaaggggcaggaggagtgcttgaaaggttggttagcctctggcctttccacaagagcgcaaatgcggctaatggaaaatagctgaaagctacaaattcctgaaatcagttaatgtaattatttcttgttttgtaacacttcttgcacaccggccaattttgacaatctga

SEQ ID NO: 5852 - DNA, 640 bp, Sorghum bicolor
  Clone ID: SORBI-28MAY03-CLUS27614_1
ggcaacagcactctgtcagtgaagagagtgagtgagcagaagcaatggcggccgcggcgtcactctccggcaagctgctgtttccctcgtcgctgtgcctctgccttctcctcctgtgctgctccggcgccggcggcgcagcagccagcagctcatggggggcgtcccggggaggagccgccagggagtgcggcttcgacggcaagctggaggccctggagccgcgccacaaggcgcagtccgaggccggctccgtcgagtacttcagccggttcaccgaagccgaccgggagctcacctgcgctggcctcttcgccgtccgtgtcgtcgtcgacgccttgggcctcgtgcttcctcgctactccaacctccattcgcttgtctacatcgcccaagggagagggattattgggttctcgtttccgggatgccaagaagagacccaccatcagcagcagtatggatacggatatggatatgaacatcatcatcagcgccctgacgagcatcacaagatccaccgattccaacagggagatgtggtcgccatgcccgccggtgcccagcactggctgtacaacgacggcgatacgccgcttgtggcgatctacgtcttcgacacaaacaacaacatcaacca

SEQ ID NO: 5853 - DNA, 684 bp, Sorghum bicolor
  Clone ID: SORBI-28MAY03-CLUS2757_1
cgtccggtgagtatgaaccttcaggtcgtccacttgatgggacagactatgctcgggcacagaatgcacggcgcttcatgatctacgttcattccaagatgatgatagtggacgatgaatacatcatcgttggatctgccaacatcaatcagcgctcaatggatgggggcagggactctgagatcgccatgggcgcctaccagccgtgccacctgaacaccaaaggccaggtcgcccgaggtcaggtccacggcttccggatgtcgctgtggtatgagcacctcggtgtgctacacgacgatttcctcaaccccggcagcctggagtgtgttcagagggtgaaccagatggctgacaagtattgggacctctacgctagcgatagcctcgacgccgacctccctgggcacctgctcaggtacccggtcaccgtcacgaaggagggcacggtgacagagctcccgggggcgaaattcttccccgacacgcaggcgcttgtgcttggggcgctagggaaatttcctcctttcctcactacatagagaaatcttctgaacttgttaccatgtgacgtttataggctgaactggttgatcagctagtctgaggtatgaaaatttacccggtccttgcagggtgcatagcgcatactatagtactactagactgctgaatttctgacag

SEQ ID NO: 5854 - DNA, 874 bp, Sorghum bicolor
  Clone ID: SORBI-28MAY03-CLUS27538_1
aaacgtgcgccattttggaagccacacgccttccgctttcccctttcgtcctccttcctcctcggcactccccactccccgccgcccgccgaagcaatcaacccgcgcgcggcggccccctcccccgaaggagaagagcgggtcggaggtccgaggtcggagctgagcgcgccccccatcttccgttccatcggcgagagctttgtctgtttcagcttcatgagttctgggaaagcactggcatccaacgtcccttattcaacagtgaacaacagcatcatctttctctgccttttcgcgggatacttgggaattcctggtggaaggttcagtggagggagcctaatttagacactgtggtagaagcttggcctaagagcttgtaggctttcaagcttttgaaatggtttcttctcagccatcctctctgactgcaatcctcacacagggccccaacctctgtccagtaaagatacttctcccaatgggccctccagatgttgtctcctcagataacatcgagtacgatttctctgatgtttttggttccaccccggtccaaacaccaacaaaccttggtggtcttggtccagatagtccttcacctactgttgagtccaatgaagaattttatagtgatcctattatcatcatcaaccgatcccattctcttgttggtccaacatcacttgttagccgctccttgcgacttagcaagcttagtctaggaaaaaccgagggatcatcggaacttgtaaagtgcctctcagaagaaaaggaaggggaccaagggcagctcagtgatgaagagcttggtaatgctatgacggaggatgagggcgttgggcttgatgattttgaaatcttgaagctt

SEQ ID NO: 5855 - DNA, 827 bp, Sorghum bicolor
  Clone ID: SORBI-28MAY03-CLUS27653_1
gcacgaggccgacttcctggtgccgcgccctccccacctgccccagtgcgcctaggccgccgtccccggggtcgacctgatgcgtccgctccctaccattcagcctggccccgcgcggcgccgggcctccctctcccggcgtgctctgctgggccggccgactgctttcctctgtgccaccaggtccggcggtgccggagccggcagccccccgccgcgcgcggccgccagacaccagcaggaggtccttgcgcagatcgccatgcttcaggcgcaaaaggtgcgcatcacagacttcttggatgagcgctctgcttacctgaccaagttcgccaaggacgccgactccgagttcgacctgattggacagaacgctatgaaagaacttgatgcggttggtgaccagatattggagaggctcgacagcaagatgcaagcattcgagcaggcgcctgagctcctatggccagtgaccgggggctgcggggaggtctcgggggtccttgtgccctggcctgctttgcagcagcaccgaggaatgttcttccaaagccttggcaaggtcaagcctcggaacaaaaaggaaataaaggtgaaagccaaggtggaagcacagaaggtcaaagagattgcaaaagagagtgcaggatcaaaaactcgtatgaacatttacctggggctgatgggaatactcgggattacaattgccaatgccatctttgcaacagcagaggtggagtggaggaaggttgctgctctgggtctaattttcattggcctggttgctcagatcatctacgagcaggatatctcaccacccaaaaact

SEQ ID NO: 5856 - DNA, 590 bp, Sorghum bicolor
  Clone ID: SORBI-28MAY03-CLUS31952_1
gacgcccgcggccgcagcaagcgagagagaaggagagcgggagatgaagggcgccggggccggcgcggcctcgccgggggactacgtcgcccgcgggtccgtcgtcccgctccacaagatctccattgggtcaaaactgtggagttactatgactttggacccaaggttgtgccgcctcttgtatgcatcccaggaattgcaggaacggctgatgtatactataaacagatcatgtccctttgtatgaagggttatcgagtaatatctattgacgttcctcaagtttggaatcaccatgaatggattcattcatttgagaagtttttggactccatgaatatccatcatgttcacatttatggtacatctcttggtggattcctggcacaaatatttgctcaacaccgtccaaggagagtaaagtccttggtcctgtcaaatacttttcttgagacgcacaagtttgctgctgccatgccttggtctccagttgttaattggaccccttcttttttgctgaagcggtacctcttgacaggaatccgagatggtccccatgaaccattcatcgcagactcagtagattttg

SEQ ID NO: 5857 - DNA, 969 bp, Sorghum bicolor
  Clone ID: SORBI-28MAY03-CLUS320_1
cttcctctcctgccgtccaaccagccgccgctcctgccgctcccacccaccgccaccaagtacgctactttcccctgcctaccaccagcagctccatctccaccaccgccggcgccacgcgccgccggcaaggcagcagcagcagcccccgcgccgctgccacgccagagggacaggaggaggaggccgtcaaggccgccgccgccggcgacggagaggtctgcagcgcagaagaagccgctggagcgggcgacgcctctgccgcccgcgccagtggtgacggaggcactggacgacctcgagcaggaggtggccaggaacttcgttgaggacctgctgcacatgctggcgccgccgccaagcagcctgccgctgcccagcttctccctcgtcgtgaaagcctgccctgccaaggacaccagattggtggcgccggccgcgccgtcctgcaacgtggaggccgccaccgccgacggcatccgcggcctcctccgtctgtcggacaccaggagaaccccaacctcgcccccttggtattccataattaatatttccccgccaatattatttcttgggttgggaaaattaaatgcgtactaaaggtggaaaaataatggaagaaaagatgtgacgctcgagccatggtcggtcgagttgtccgtagtgtgactgtgatgttggcgttggatggatgctacctctggcgggcggtgcaaaagcgagaggaagacgacgacgatgtcagctaaggttagtttgtgtgagacgttgtatggtagatatctagggttttacgttagtgtctaccaccgtactccactatatatactgcttttcttgattgggtgatgtgtttttgaattaccttgtatcaagagttgactacatatatacgatgtatgcaagtgtgtgacgttattatatatatatatacagaaactgtgtggctgtgtgcttcataagtaaaaa

SEQ ID NO: 5858 - DNA, 752 bp, Sorghum bicolor
  Clone ID: SORBI-28MAY03-CLUS32003_1
agccaaagatgaggaggtctatgatgctgcccgacgtgctgctattcacgatacaattatgaacttcccagacaagtacgacacagtagtaggagaacgaggcttgaagctaagtggcggggagaaacaacgtgtgtcaatagcccgtgtattcttgaaggagccctccattctattatgtgatgaagcaactagtgctcttgacagcactactgaagcatcaattttgaattctctgaaatccttatctgttgatcgaacatcaatctttattgctcatcgactcacaactgcaatgcagtgtgatcagataattgttttggagaatgggaaggtagtagaagaaggaccacatgattttcttctgtcaaaggggggccgatacgcagaattgtggtatcagcagaacagcagtgacgccagtgattctgctgcagttagcctagaggtttgattgacgcaacgtaaaaagaagggaaaccacaatcataactgagagacagagagggatggagccatcttgtctgccttgtaaatggaggtaggatttttggtatgtggggggggcagaaacttacagttccattttcaagatacccgggaggattttcttttttccttttcttttgagattatatagacgatcccagcatattatggtaataatgtaacatttctgtagcataagggataagcccagtaaatattcaattgcctcaggtgtattaccatttcaatataaatgctcacat

SEQ ID NO: 5859 - DNA, 935 bp, Sorghum bicolor
  Clone ID: SORBI-28MAY03-CLUS32028_1
cttccatctaatattcaggttaaatcatttatttgcatgtggttcttatagttttgatttttcttgcattttgatgtccttctgaaaactgaaaatgggtgccgattgatttcagagtgctcaccatcataataccaagtagaagaatcacttaattcaattgctttacacaccgttagtggttttagcagtcattgctccatgcttacttcagctatagttgaaaattgacaaaccatagcaacacgacttcagtttataagctgaaacacagcagtattaagtttactaatagcattgttaccttttgttagcaataaagtctagtgctattgtagctatactagtattgactacccatcgctttttgttgtgctgtttagttccaactcactacaattcattgtactgtattccacaactgaaatgcggcatttgtttggttcgtactgtaaactacaatacattgtacattggcaactgctttgtgagggtggggatgctgtctggcgctcctcctgtcgtcgccagtgacactggttgtccccgctccattcacggccccgctgctgcctccccgggttgctcatgcttcagttggttcagaaactgatgcttccttgcagggttgctactcatgcttcagttggttcggaaactgataggtgtcgttgaagattggatgaaccagtgccgattgtatcattgtcatttgagtttgtgcccccgttgtgttgtccctgttgtaatacttgctgtgtggtagcaagacgtggcagagcatgactttgagaacttgaggttcagtagtttgagctgtttttgtaacatgcgatttgcttctctatagaatcatgcaaacctgcttgattgccagtagtttcctgccccaaaaaaaaaagaaagaaaaaaaagaaacaaagaaagaggaagac

SEQ ID NO: 5860 - DNA, 828 bp, Sorghum bicolor
  Clone ID: SORBI-28MAY03-CLUS32007_1
gcacgaggctggcctgttgatgattgcttcatgctttattgtagctgaaaacggccgggattgatttccgtgctcctccagcgcggcgggcttccccgcgggggccgagcacgactacctggtccacgtgctgctcatccgggtcagcggcgtgcgcgcgtcgcgcctgctctccccctgcgcccgggacgtgctctgccgcgtgaccaggtccaccatcggcgccggcttcgcccccgcgtccctcccggtcggcgtccggcccctcctggcgccgtgcgccctcgccgccgggcccgccaggtaccgcgccatcacgagcgcatactaccgcggcgcggtgggcgcgctggtggtgtacgacgtgacccgccgcatcaccttcgacaacgccgagcgctggctgcgggagctgcgggaccacacggacgccaacatcgtggtcatgctggtgggcaacaaggccgacctgcgccacctccgcgccgtgacgcccgaggacgccgcggccttcgcggagcggcacggcaccttctccatggagacgtcggcgctggacgccaccaacgtcgaccgcgccttcgccgaggtgctccgccagatctaccacgtcgtcagccggaacgcgctcgacatcggggaggaccccgccgcgccgcccaggggaaagaccatcgacgtcggcgccgccaaggacgaggtctcccccgtgaatacgggcggccgctgctcggcttagcttttttttatttcgtttcgtctcgtttcttttttttttccacccgttgggatagccctggtcaaacatacatacagtacgcttgctga

SEQ ID NO: 5861 - DNA, 964 bp, Sorghum bicolor
  Clone ID: SORBI-28MAY03-CLUS27760_1
tccatacatgtgttaaacattcgattggatagtctttaaaaaaagcagcctgaaccaaaatgtataggcatttgcttttttattgcaaatgatgataaattcaaggcttgtttctctacattcgcagttgccgcctaagagctttcgccttgccaggctggagagctaatgctgctaaatccttccttggatgtctgatgcaaagcaataagaataatgagttgtttgttctttggtagttgtcttttttgctgggagtttgaatcgtttgtgtgttctacattttctgtgttcgatttttcttaatcttcatttctttcttgagctctgattctgcccaatgatgatagagcacgaggcttgtttctctacattcgcagttgccgcctaagagctttcgccctgccaggcttgagagctactgctgcaaaatccttccttggatgtctgaggaccaatgcactcaaacctgtttcattgaatagttgattaaatctttttcttgctggttctattgttactaaatgctgtcttttgctatgtttgtcaaacatcattcagaatttgccaactgtttctactgcatcaccaatatgcaatgggtctgttgtcatattctgttttgaattacagttatggtgtgaacctgattttgaagtctgagctcatgcttatttttgattaatattcaatagataagtctcaagaacaattctgttttgttttcgtttcaacaatttgaagaagtgtgattcttgattccacggtccacatcatgccctgccgttttcttacaagcctaatcatgagcgtgggatggtgaaagctgcaaagactggtggtgtattgcttgatggcctctcttggagtctcagtataacacttcagctgtgctgggggtttcttagtttctcaatggtagattatcttggtcagattatgtaaaagaacgtaacttttcgta

SEQ ID NO: 5862 - DNA, 1048 bp, Sorghum bicolor
  Clone ID: SORBI-28MAY03-CLUS27861_1
ctgaaaaacactgcaaggaaggattgattgtctttggccattgctctaagcttactatccaggatatgtctgccactacaaggtttctaggttctgtcttctggttgttgctgcattctaaagaaatctgctatgtatacattagcaataggaactcagtttgctaagggaaatggagttaaagtttacttcgcacatcagagattattttgttttcaataaatatatatatgaacttttgccatgagctacttactaaggtcttcccatgagctacctcgacgctagggactcagctctcgctattctggcaacctgtcagtttcgtcgtggatgccaagcctataaggttcctatatataacaatgatgccaaaaccgtaagagtcctagcttagaaatgcgtgagtacatttaaccaggtttatgtgtatcactttgttcttatgagtaacttttgcatgagattactatttcttattttaaaacaacacgagttgtgtttcccataactttttcctgcatttagcttacttttggttggtttgtgactgatattgttcatatttttccttatatttgagctacaacattcttctgttttacagtgcctcactgcccctcatccgtagtcatcttcaaaacaccctggctacgcttagaaatatttttactactgtatctgaatggctctttggttgaaaacaccctttgtaagctcatttttgtgcactacctattgcttattagtgagatgacaaatgattgtgcagtaggcacctgagattacatcttactaggcatggtacaatcagcttggtgattccatcttatggtagaatcagctcagcatgtacaagtattgatgttgaataaaataagctacgacacttggtggaagatatcctagcttttaaagatcttgatctaaggatgatgttacaagaaggatcccaaacctaagtgtaataaatggttatgtaatttatgctgaataaaaaaatatgacaattgcagtgactatttaaatcttactatatgggatgctt

SEQ ID NO: 5863 - DNA, 841 bp, Sorghum bicolor
  Clone ID: SORBI-28MAY03-CLUS2790_1
gcacgaggccctcgtcgcccgtcccgcgtccaggcggccagctcctctctctcctgtccccttctgcccttctccgtggcctgggcgtgcggcactgcggctgcggctggcgccggccggctcccggccctgccctcgtcgctccacgaccacgcccccacccggccagtcactgcggccagacagggacagcggccggtcttcccaccggccaggcggccaccgccctgggcttccggttccagctggaccagcacgtcacagcagtgtcgcacggggtcatggcttcaggaggctgtttgatggccaacttctacaagaccttgtgactcagcgtgattgggctaatctggaaaaacaactaaagatactagtttctgctgtggatgtacatggcgatcctgagaagctgcatccgtcccttttcatcattgtcgtccgggagtggatagttgaccatatcaagaagaaagagcacggagctgcacttaagatgttcatcgataaagtttctattctatatgaggtggagggtgcatttattaatagaagtgatctgaaacttcaaatcaataggttgcacaaaattgccaatgccaaggctaaagccaaggctactccagttaaggccatccaagacagattgagtgactatatatacctgtactttgctgatttttatgggcctgagaaacaagctggctgtcatagtcacttatggcggtttgctaaaatgatagggaagccacctggtcaggaagatcccagctttaggtgtctcgcttgtagaaccactttcaagaactgcccaatttctaagatgagagatcacttagacacc

SEQ ID NO: 5864 - DNA, 654 bp, Sorghum bicolor
  Clone ID: SORBI-28MAY03-CLUS27900_1
gctgtgtcagtgcttatctcaatcgcttggattggctatgagctatatttcaatgcaactgacccgttgagtgaactttggcaacgggcatggatcttcccctccgtctggcctgttcctgccgctccgctcctcgccttcctctgctgccctcggtctccttctcccacgcccactgggtttgcatattcagaggatgcaggtgagggagctgatgaggaagggctctctctagtaggcagtgcagtgaaaggaactggagatatggtaaacatgcatatctttcctgaggataaacgtgcatgataaggtttgacctgaattgcagctgtactcctggcagaatgctatgtgaagtacctttttcctctggattcacgactagctgacatcttctaagcttgcttaagattccagatgtacaggtggtgacttgtgttgaacgatttgaccaagagatttttacttgtccagttgtggctactcaatacgaaaggtcggcacaataaactatcactttgagagcataagagggttagtctttgtaatccttgtgatggtgatgtaactcgtaggaggttgaaatgtatcattgccaaagctgaaatgtataaaaaatgtatcgtggatctaatgatatatttgcgattggtt

SEQ ID NO: 5865 - DNA, 679 bp, Sorghum bicolor
  unsure (1)..(679): unsure at all n locations
  Clone ID: SORBI-28MAY03-CLUS27906_1
catcagtggggaatattgcacaatgggcgcaagcctgatgcatccatgccgcgtgtatgaagaatgccttcgggttgtaaagtacttccccgctgcgacccacgcgccctcgaagccaccggagtagagcgcgacggtggtaacttccagtgaacggcgcaactccctttctccctgctctttctccctcgctcttatgacctccatgcatctggagatggagacaacggcgcggctccgacgagtaatgtttttcaagtgatgttgcagtaggatagggtttcggcgagctctcggcttcagatttgtcattgttgcaatggttctctctagacattgcagtaggtttcagtcgttgttgcagtattgtgtttttgagatgttgtttcagttgcttcattctgcatgttgtagtagtttgtttcatgttgttacaacagttgtttggtgttgttgtagtactatgtccatggtgtttcagttgctccatccaatgcttcaatttgcactgttgtattagttgttgcatgttgttgcaacagttgttcgatgttgttgtaatactatgtccatggtgtttcggttanctccatccaatgcttcaacctatgctgttgtattagttgttacatgttgttgcaacagccgttcgttgttgttgtaatactatgttcatgtg

SEQ ID NO: 5866 - DNA, 605 bp, Sorghum bicolor
  Clone ID: SORBI-28MAY03-CLUS27363_1
gcacgaggaagggggcaaacagaaaagtgagagccccaaaccctagaccccccatggaagcgtggccgcctctcgcccccgcggcggccgccgccgccaccccgaccgcggctgcctccggcgaagcggcggccgctcccgccgttgctggggcgtggggagcagtggcaacggcgcagcgtaaggctgtggtgaaggagtcggcggcgcaggcggtgagccgcatcgtggcgagctgcgccaactccagcggagtggcggtcgccgtggtggatgccaacgccgtcatctccggcggctccgctctctccacctccgcggagcggcttgtcaccgtgccggaggtgctcgaggaggtcagggacgcggctgcgcggcggcggctcgggctcctccccgtccccgtcgagaccgttgagcctgcgccggagttcgttaagaaagttaccaggtttgccagggagacaggagacatccaaacactttcagatgttgatatcaagattattgctttggcttacatgttagaagctgagatccatgggactagccatttgcgggagcaccctcctcctctgcgtgaggtgaatgtcagaaagctatcc

SEQ ID NO: 5867 - DNA, 643 bp, Sorghum bicolor
  Clone ID: SORBI-28MAY03-CLUS2740_1
gcacgaggtggatctgtgccacctccaagatgtgggcattccgcaaccatgattgagaagagactgcttatatttggaggcagaggtggagcagggccaataatgggtgatttatgggctttaaagggtattgctcgaggagacaatgagacgccaggtgggacacagttgaaacttccagggcaatcaccctcaccacgatgcggtcattcagtaacatctggtggaccttatctcttgctgtttggaggacatggaactggcggttggctaagtagatatgacgtgtactacaatgaatgcattattttagacagggtgtctgttcaatggaagcgcctaccaacaagcaatgaacctcctccacctcgggcatatcattccatgacttccatagggtctcgatttcttttatttggtggctttgatggaaagaatacatttggtgatttgtggtggcttgttcctgaagatgatcctattgcgaaacggtaccaaattctttacctcgttcctatctgcttggtatcttgagggttgtgtggagtgtactgggatataaaactctgcacataaattcttcaattcatattcctgcagtcataccctttaaacttccatgcatggcattcagtagtgacaa

SEQ ID NO: 5868 - DNA, 912 bp, Sorghum bicolor
  Clone ID: SORBI-28MAY03-CLUS27413_1
gcacgaggatgatgatattactgaggaacgtctttatcagaacatttttgcttctcactttgggcagttagcaataatctttctatggacgtccggaaatctgtttcatgtagcttggcaaggaaattttgaatcatggatacaggatcctttacacgtaagacctattgctcatgccatttgggatcctcattttgggcaacccgccgtggaagcctttactcgaggaggtgctgccggtccagtgaatatcgcttattctggggtttatcagtggtggtatacaattggattgcgcaccaatgaagatctttataccgcggcgctttttctattatttctttctacgctatccttaatagggggttggttacatctacaacccaaatggaagccaagcctttcgtggttcaaaaacgccgaatctcgtctgaatcatcatttgtcaggacttttcggagtaagttctttggcttggacaggacatttagttcatgttgctattcccggatccaggggggagtacgttcgatggaataatttcttagatgtattaccctatccccaggggttgggtccccttctgacgggtcagtggaatctttatgcccaaaatcctgattcgagtaatcatttatttggtaccactcaaggagcgggaactgccattctgacccttcttgggggattccatccacaaacacaaagtttgtggctgaccgatattgctcatcatcatttagctattgcatttatttttctcattgccggtcatatgtatcgaactaacttcggaattgggcacagtatcaaagatcttttagaagcacatactcctccggggggtcgattacgacgtgggcataaaggcctttatgatacaatcaataattcgattcattttcaattagg

SEQ ID NO: 5869 - DNA, 658 bp, Sorghum bicolor
  Clone ID: SORBI-28MAY03-CLUS2744_1
cgtacgcccacgcgtccggctttgtattgactgactcccgcctgcctgacatgccaattatttatgctagtgatgcttttacatcattaacaggttactcaagagaagaaatattgggctgtaactgcaaagtcttaaacggtccaggcactagcttggaggttttagaggagataaatcagcatatttgttctgagcaggcatgcacagtggatctactaagttacaggaaagagggaagttcgttctgtgatcttctacatgtatctcctatccgagatgcttcaggcaaggttgcctttcatatctgggttcaccttgacatgggtgcaaagcacgagtttaatgggttggtccctgaagtatggctgcttggtgctgttggagcggtgagggttgctgtgagaggcttgtcggcgtcaggtagcctgttgagaccatcccaataggagttagttttcttgccatttcatgacacgtcggccggccttccaatgtacattgatgcttgctattgtatgtaaagtaactggttagcataacaaagaaaacaagttcatttgaaggaaaaattcatggtaaatacacgatgttgttgtgattatgtaaccatgtggaatgaagtaaagaagaggaaatagaagctgcagaatttttc

SEQ ID NO: 5870 - DNA, 1087 bp, Sorghum bicolor
  Clone ID: SORBI-28MAY03-CLUS27418_1
gcacgagggattgaagcaagaaactgataaattggctaaagaggttgaacaacttcagagtgacaggtttgcagatgttgaagaattggtatatctgaaatggataaatgcctgcctacggtatgagttgagaaacaaggatgctccatcagggaagactgttgcgcgagatcttagcaagaccctgagccccaaatctgaactgaaggccaagcagctgataatggaatatgccaatgggggtgcagaggacagtcacttgggccatgtcgaatttggttcagagtgtgcttcctcacgggcttcgtcaggtgaactggatgatgtatcaattgatattgcttcgatgacaaagcataataataatgataataaaaacccaaaaaagaaaaagttcttctctaagcttcggaaactggtgctgggaaaagggaaggagaaccgtgaagtttctactctggagaggagagtgtctatttcaagttgttcattcgatgacttcactggaagggattcacatgatagctattcttcattcatggcagaaccaaacatatctgatagtcgacgacatggtgatcatggctttggtacacattcttctttcgacagtgcaaaatctagtcctcgtggaacagaaattgtaggtgaaagaagtgacgattctgggatcaagactgtatgttctagagaggaaaaggtaaatgcatttggtcacagtgctcgccttgatagtagcaaggctatacctgaggatgttgagatccataaatttgctgatgcgctgatcacatcaaggtcaggttccatgtcatcaagaaagtcgtcatccttccgacactgatatacgaatagattaggagtcatctgctactgacccatctgcctggatgtatatttctgtcggttcttgatggggaagttataggagatgttactggaataaagttctgaatactttattctttgtacaatcacatataggatgtagtttatacttacctttaataccaacccctaccacttgggctggtaatgtgtatcatagccacagttcaatggcaaacatacaacacttcttttattc

SEQ ID NO: 5871 - DNA, 255 bp, Sorghum bicolor
  Clone ID: SORBI-28MAY03-CLUS27507_1
gcttccaatttccaacctctctcttgcacgggaggagcacgtacacgcgggcggagcgaaagcgatcggcgccgcggcggcaagatgtcggcggcggccacgatgacgtggcacgaggacctggccactctcgtgggtgacacgggcgttcgcctccccggcggcggggggcacgcgccggcggcggcgaatgttgcggcggcgggggccgggtggtacggggaggaggaagaggggagggcggaggaggggtgg

SEQ ID NO: 5872 - DNA, 670 bp, Sorghum bicolor
  Clone ID: SORBI-28MAY03-CLUS28080_1
cttcttgggtttggttcagatggggttaatgaggaacgcctgaatgatattgccacacagataggaaatgccgtcggcaaactacatgatggaggccttgttcatggtgatttgaccacatcaaacatgataattaagaacagtaactatcaattggttcttattgattttggtctgagtttcacatcaacaattcctgaggacaaagcagtggacctatatgtgctagagagagctttgatttccatgcattcgtcctgtggtgatgtgatggagaaaatcctggcggcgtacagaaaggcttcgaagcagtggtgctccacccagaacaagctggctcaagtgaggcaacggggcaggaagcgcaccatggtcggatgaagtaaaatctgtggcatggaatggctggatgtcattattagaatttagaaagacgaagtgaacggagtattgcaccaccattgggttgcttgctgtatttttgtagtgggtgagtggctttggctgctgtaacgtttgtggatggaaatttggaattacgttgcccaccacccaccagcatttggtcaagagaagtggtagaagttctttatttatttcttgtgcaaaataataactgggagacgtgctggttggttggggtatggttagcctgttactgtttgggcct

SEQ ID NO: 5873 - DNA, 334 bp, Sorghum bicolor
  Clone ID: SORBI-28MAY03-CLUS2817_1
cgtccgggaaaccagtttgggcagcttggcactggttctgatcaagctgagactgttccaaaattggtagatgctacaagcctggagaataagaatgccagatctgtttcttgtggagctcgccatagtgctatcataacagatgaaggcgaagtattctgctggggatggaacaagtatggacagcttggtcttggcgactcaatggacaggaacgtgccttgcagtgttcctgtggacgcttaccacccactaaacgtatcctgtggttggtggcacaccttggtgctcgcggagtcgcctacttgaaacctgacaaagaaattaccttaga

SEQ ID NO: 5874 - DNA, 780 bp, Sorghum bicolor
  Clone ID: SORBI-28MAY03-CLUS28189_1
gctgggattactccccttgccctggtatggaaagatgagacttgtagccaatatgttattgatacagacaagaaaggagaaataccaagtgaacaacatcttgtgttggagctgctagaagatggaagcgtagttacttctgacgatcctcctgttgcatttggtagcttggacagtgcgttcatacagaagtcaaacctgcgaccagggaatcttctccgctttgcagttagagatgaaagtgtgaaacttgtggacggaaagatgcagatcggtcagctgcagtttgtgggaaagccaaaccgtgctcgtgcttttgctgacagccattcaaaagttttgttccagtatgcagcgaggcatgttcctctgagaattgaggatctggttgcctccattcaatcaaacaacatggagcttgaatccactgacgttgaaatgcaagattaaggttgaagatgctttcatgtcaggatttcagcaaatgacgtgattgtctgaaacacatgttttacctcaaggcctgtaaaaggtttaaacaacgcatgagtttttggaaagatgaacattctgaacattgccatccacgtggatgtgacggatatagtgcaactcaaagtgtgaaggaaaaaagtgttgtatctacataattggatttctccgtatttgatgatcctcgctgccagtgtggacacatacgaatctaattgtctaacatagtgtcctttttttttaaaaaaaatattactgagcaaatcaatgtagtagctgcgagctgct

SEQ ID NO: 5875 - DNA, 648 bp, Sorghum bicolor
  Clone ID: SORBI-28MAY03-CLUS28211_1
ctggattggtttctaccgtcgttctggattggttacttacgtcctaagatcgtttcagtcgtctcattttagtctggccagtatccatgaatgcaaagagattattctttggttccattctatgtgcctttagcattggaggaccactgtttcacacttcatcgggtgtcttgatgaactggttatggttgcttcaccatgctggggtgttccttgagctgccctctgttcctgttcctgttccttgtgaaaccagagattatgcttattcagcctgagtggatgtgatgctatctggttgctgttccattgacactgcaccgctggcctatttcagcttatacgctggttccagagtagttactggtcccttttgagaggagttatgatgatattatgattcatcagcagcaactagttgtcctttggcatctacatgtgtcttgtctttgatttagagtagccttttcttaattcacctattctcaggatgcaaacgttagggggcatttgatgttcgaactagccaattgagtttttgtactcaagtacgttacattagctgctcaagattcttttccccggttttaaacatgttgatttgtactgaaaagtgattctctttctctatgatccaattctttctct

SEQ ID NO: 5876 - DNA, 507 bp, Sorghum bicolor
  Clone ID: SORBI-28MAY03-CLUS28213_1
ccacaccagggtcatcgattcgagcagcaactgcaccagtgcgcctgtcgacatctactcctccaaccccccccagtcagcagagcccttgcacgtttataagtgctgaactctgggtagaggaatgttgggttgtcttgcaagttaggctctctcttgctggtgaacggtggagtcccagagcaggggaccgactcgctgcagtgttattcccatcggaagaactcggagatgtacatagatagcgtggggtgcgtagcattttggtgccggagaatatcatttggtcccgaactacgtagataattggttgatcacagcattttcttgtttatttttgtctgattatgcttaaccagcagacaccagtaagcccgtccattggatcggaattaatttaagagatctgtaatacaggggtgtcttgaaatagttgatgacgaactggaggttagtggagaccaaagaatatagctctgcttacgatcggaagttaggttggaccta

SEQ ID NO: 5877 - DNA, 1041 bp, Sorghum bicolor
  Clone ID: SORBI-28MAY03-CLUS27662_1
gcacgaggatctcgtccatccatcttcattcccatcttactctcagctccggcccggccatccgctagcaagcaagcaagcccgagaacgagaacgaagcagggcatccaccatggccgtgctggtggcgaggcaggggcgcgagctgcagcggtacagccagagcaccggcggtcgcatcgtggtgggttgcatcccgtaccgcgtgcggccgtgcgacggcgagctggaggtgctggtgatcacgtcccagaaggggcacggcatgatgttccccaagggcgggtgggaggtggacgagtccatggacgaggccgcccggcgcgaggccctcgaggaggccggcgtcctcggcgacaccgagcctgtcctcggcttctggcactacaagagccgccgctacgtggaccagacctacgagggcttcatgttcccgctccgcgtcgccgacgagctccaccagtggcccgagatggcctcccgcaagcgcacctgggcaacggtgcagcaggtgatggacgggtgcccgcactggtggatgcgcgaggcgctggagcggctggtcgcgcggcacgccgtgctgcagtccgctctctgatcgtccgtcaccgatcggggcaacaaagaggcggcggcggcggcgggtgaggagctcgctctcgcggcggctccggcgagaaaggaccggcagcgcgaggcagccaccacacgtcgcggctctatgtctctctcggtgcagtggcaggccggccggccccggcgtcgttccggggctcggatttggtcgccctcaccggggagtcgacggcgcgccgcgcggcttagcgttgtgccggtgcttttttctatgacacccctctgcgtgcctgaggccggagtcgtcgttggcaaataaatcaaattattttatttagcgggcaaatgattggacgaagtgtaaacaaaaccagaacttgattagttcgtaaaggggtggaactggaagagaacagcagcgcaaaacacagctcacgattctttcgagtaactgcaaaaaattgt

SEQ ID NO: 5878 - DNA, 968 bp, Sorghum bicolor
  Clone ID: SORBI-28MAY03-CLUS27675_1
gcacgaggcacaccgcccccccggtaggctcaccgccggcgacgcgcagcacgcgtcccaccacacccaaaccgaccgaccgccaccgctgctcgctcgctcgcttccgcccgggacggaccggcggcctccagatctcatcacccgcgccgcgcggactgactgaccctcatggcgtcgtcctccgacgagcagcccaagccgccggagccgcccgccgcggccgccgtggttgccgccgccgccgccgccgtgccgccgcagacgcacgccgagtgggccgcctcgctccaggcctactacgccgccgcggggcaccacccctacgcctggccggcgcagcacctcatggcggcggccgcggcgggggcgcccttcggcacgccggtgccgttccccgtctaccacccaggcgccgccgcggcgtactacgcgcacgcgtccatggccgcgggcgtcccttacccgacgagcgaagctgtccccgcggttgtgccggcggctcctctaccggaagggaaaggcaaggggaagggcgggggcgcgtcgcctgagaagggcagctctggggcgccctccggcgaggacgcctccaggagcggtgacagcggcagcgacgagtcgtcagatactagagatgatgacactgaccataaggattcatctgcgcccaagaagaggaaatctggtaacacatcggctgaaggtgagccatctcaaactgctgttgtgcgctatgctgcggttgagtcgccatatcccacaaagggaaggtcggcctcgaagcttccagtgtctgcacctgggcgggcagcacttcctagtgccaccccaaatctaaacattgggatggacatttggaatgcttctccggcgttggctgttcctgcagtgcagggagaagcgaatcctgggttggcacttgcccgacgtgatggcgttactcaactggatgaacgtgaattgaa

SEQ ID NO: 5879 - DNA, 579 bp, Sorghum bicolor
  Clone ID: SORBI-28MAY03-CLUS27706_1
gcacgaggccccccacagcaggcctcggtggccgcgcgggcgccggcggtggccccggtgcccgcgttggacccgcgcggcagcgggttccgaagctcgcgtgcgccgatgctggccaaacaggccccgcgcgtggggcagcagctccacagccccggcatggtagcgcaaacgcccccaaatgtgcggttcggccaacccatcggaaatggggctcaatcacatattgctcagggcacgtttccgaacccatgtaacttggcccaagccggccggacgcgccccgccagggaacgtgccacgtggtgcggcaacaaccgccggggttccctcttggcgagcgctccgcaccgagccgttctgtcgcatgcagccgagccgggcgcgcgggtcgcaccacccggggatggagcaaaccgagctccccactggagtctccccactttggtaccccagaggcatggctgctcctctctaattggctcgggctgtgccgagcccgctaactgttggcctctgtcgctttccctgtctgaatgtttagcttcattttgtttggttacgtagatttggtatgat

SEQ ID NO: 5880 - DNA, 845 bp, Sorghum bicolor
  Clone ID: SORBI-28MAY03-CLUS27739_1
gcaccccggctccccggccctcctcgcccatggctcccctggcctcccatcctctcccgtcccgcgctcccaccaccgcccctcgcttcctcgccgcccccgccatccgggtgctcagcctgtcgcggtctgcgtcgccgctcctctccgcctccgcaggccgcttccctcaggcccctcgcgctccctgcagtgccgcccgtgagcaccgccgcgacaccgtgcgggaatgcactcgagctgatgctgctggaccagctccattatcaaagacactattagacctcaaggattcctgctggagatttctaaggccacatacaatccgaggaactgctttaggatccatagcattggttgcgagagccttgatagagaattcccatctgataaactggtggttactattcaaagcattctatgggcttttagcattgatctgtggcaatggttacatagttgggattaatcagatctatgatgttgctattgacaaggtaaacaagccatatttacccattgctgccggtgatctctcagttgagtcagcatggttgttggtgatattatttgcagctgcaggtttttcaactgttatagcgaaatttggacctttcattacctctctatactgtcttggcctatttcttggcactatatattctgttcctccattcagactgaagagatatccggttgctgcttttcttatcattgcaacggttcgcggtttccttctcaactttggcgtgtactatgctactagggctgcactaggtcttacattccaatggagctcccctgttgctttcattacatgcttcgtgacactatttgctttggtc

SEQ ID NO: 5881 - DNA, 569 bp, Sorghum bicolor
  Clone ID: SORBI-28MAY03-CLUS277_1
ggtggggtagcacttggagagcttgaattgaatccagagtttaatttgatgcagttgtcagtggaggattttgagaataaaattcaagatgcaatacgtccaacatatgaaaggtcgatcaaagctgctcaagattacgggatcatgaaagagagccctgagtctttggtccatggcgcgaacatttgtgctttccttaatattgcgcaagccatggctgaccagggatgtgtttagttaggcctttgattctgtcaagaagcttcaactggagcttcctgcaactgcgaggaggaaaaaaaaatcttctgatgactagaagtgtttcgatgcttaaaccttgagtagtgctgcacaaatcatgaagcgccacaaaacagggagtaactgggattcattcacccttgtttatgctagaaatgtgtacaactaaggtgccggaaagaaagccagttttgtggttcaattaagaagagctgaggatgtagatcaccggagtatcatccattgttatgtacgtaaatgtcaatggaaggttgataggaagcaactcatttgcatgcaaagac

SEQ ID NO: 5882 - DNA, 677 bp, Sorghum bicolor
  Clone ID: SORBI-28MAY03-CLUS2859_1
ggagttccgttgagctcagctcaggttcagttctcactactgagcatgggtgacgatcagatggaactgaaaactgtgtgtgattcattgggcattcgtctcatcgcatatagtccgcttggactaggaatgctcactgggaaatatgatgcttctaaactcccacgacccacgcgtccggtgctgttccgacaaattcttcctgggctggagtctttgctgtcttgcctgagaaggattgctgaaaagaaggggaaaaccatgtctcaggtggccatcaactggtgcatctgcaaaggcacaattcctatcccaggcgttaaaatggtcaggcacgtcgaggagaacttgggtgcgctcggctggaggctgagttctgctgagatcgcagagcttgaggccgcggcgatggcagctccaaagaagatggtccagaatgtcttccagactgcctgatcatgtgcaggaacctgagtctgaaactctgaataccgaccccaggatgattttgaacctgaatctcggtaccaaatataacagacaatggtgtcagatgagagtagaggggtggtttctttgctgagttcagatttccactcgcagcaaaccctgctcactgttttaaaatagcgttgcagtatgcagatctcaagaagtctgtgtatgcatgtttctgc

SEQ ID NO: 5883 - DNA, 596 bp, Sorghum bicolor
  Clone ID: SORBI-28MAY03-CLUS28562_1
acgcccgcacccccaaagcacagcactgctcggcttggcttggcttgtcctcttcctttgttgccatggctaccaagatggtcctgtgtcgctttgtggccttggcggctctcgcctgcctcctccgccctggcgcgcccgtcgagctccaccgcaggctctccgcctggtccggcgacgccggcgcgacgtggtacggcgcacccaccggcgctgggagcgacggtggtgcgtgcgggtaccagaacgccgtcgaccagccgccgttctcgtccatgatcgccgccggcagcccgtccatcttccagaacggcgagggctgcggctcctgctatcaggtgaaatgcaccggtcacgcgtcgtgctccggcagcccggtgacggtggtcctgaccgacgagtgccccggcggcgcgtgcctggccgagcccgtgcacttcgacctgagcggcacggcgttcggagccctggcgaagcccggccaggccgaccagctccgcagcgccggactcctcaagatccagtacactcggtacgtaagctctcgcagcgcgccgcgtgcacgtgccgcgtaggagtgtagtacgtacttgtgc

SEQ ID NO: 5884 - DNA, 907 bp, Sorghum bicolor
  Clone ID: SORBI-28MAY03-CLUS28594_1
gcacgaggggaatggattggcctttattgatttcactttggatgaccggagccctatgtcagaacccttcggtgacaatcacgatgcatactctcaaccagtaaacaaataccagctgattcgagtaagcgccaagggcatgaacgagggctgcaagtgggtggaaatgtttgaggatgttagcatggtgatcttctctgtagcgctcagtgactatgaccagcttggagccccagcgagcggcagtagcaggacactcacgaataagatgattcaaagcagggacttgtttgaagcaacaatcagacagccgtgcttccgcgacacgccattcgtgctggtgctgaacaagtacgacctgttcgaggagaagatcggccggtcgccactgtcgtcgtgcgagtggttcggtgacttctgcccgctgcggacgaaccacaacaaccagtcgctggcgcagcaggcgttctactacgtggccatgaggttcaaggacctgtacgcggcgagcacggggaggaagctgtttgtgtggcaggcgcgcgcccgtgaccgccccaccgtcgacgaggccttccgctacatccgggaggtgctccggtgggaggacgagcgcgacgcggccggctactgccccgaggagtccttctatagcaccaccgagctcagctcgtcccgcctcatcgtcgccgcagagtgatctgacatgtgtatagctgttgttggtgtggttcatttgctgtcacaattttactagtaactgtacagtcgtgtaatcttgttctttgttcgtcgtagagcattgttgcagtgttgttgttttctgtaattgtatgcctgctagtaagttttccaaacaaaaccaatatagcaaaggaaaatatcttgtgctgatgagcagagcttc

SEQ ID NO: 5885 - DNA, 452 bp, Sorghum bicolor
  Clone ID: SORBI-28MAY03-CLUS28605_1
caacaactcaaaaaaggagcagagcagagcagagcagaggagggggaagagaccagccagccaggcagccatggaaatgggcgacagcttcgagtactactgggagacgcagcagtacctggagtcagaggagctcagcatctaccttggtacgcaggacgacgccctgtcctgctacgactccagctcgccggacggctccatctccaataactcctcctgggccgcgccggcggggacgggggccacggcggcggccggaaaggaggaggagggccccggcggcgcgggcggaggtggtgcggtggccgccgcgaacaagaacatcatcatggagcgcgaccgccggcgcaagctcaacgagaagctctacgcgctgcgcagcgtcgtgcccaacatcaccaagatggacaaggcgtcgatcatcaaggacgcgatcgagtacatcgagg

SEQ ID NO: 5886 - DNA, 558 bp, Sorghum bicolor
  Clone ID: SORBI-28MAY03-CLUS28649_1
gcacgaggagagaataaaagaagaagctgaaaagcaagctgctgttgaaaagggagcacctgatgcctcttgggatgtagattctaaggaaactcaggaccatgtgcaagaagatgaaaacaaggtagctgaacagcatgatggacatgcaacggaccatgataatcatgtaacagaaagcggggcatctgttgagcagcatggttccgtaagtaaagatggcattagtgctgaagctggaactgtagatgaattgccgcagaaggagtctgcagcatctaccttagagaaggatcttagctctgacaatcctgagggtttatcaagggaagagttaggtcgtatggtagcttctcgttggactggagaaagtgtaaatgaggttagtaaagatgataagaaggggcataaagatgagcaagaaataccagaacctgcagaagaagcacttgaagatgaaatagaaatcccagaacctgctgaagaaagttatggtggttatcattcagaagttgaggatgacaggcataaatatgaagatgaagagtttgaccatga

SEQ ID NO: 5887 - DNA, 597 bp, Sorghum bicolor
  Clone ID: SORBI-28MAY03-CLUS27927_1
cgaagatgctggtgtggcacctgaggaggtcaactatattaatgctcatgcaacatcaacccttgctggtgatctggcagaggtgaatgccatcaagcaagtcttcaaggacccatctgggatcaaaataaatgcaaccaagtccatgataggacattgccttggtgcagcaggcggtttggaagccattgctactattaaagcgataactactggatgggggcatccaagcataaaccaatttacccccgaggaagctgttgaatttgaccctgtccctaatgtaaaaaagcagcatgaagtgaacgttggtatctcaaattcctttggatttggaggtcacaattctgttgtagtatttgcgccatttaagccataaggtgttccttgcctcacagatcttggtcagaacagtggagatcttttctagggatttctgcgttcggtcttcgcggcttcgcttcgggggtagttgtgtctgctgtgtgccagcaacgggacaagggtcctgtagctgcgcttctggcccttttagttcactccctgtccactgagtttgcgcgccggggttcgtcgcccctttgaatcatttgtaat

SEQ ID NO: 5888 - DNA, 939 bp, Sorghum bicolor
  Clone ID: SORBI-28MAY03-CLUS27930_1
aggaagatcatgaagcattttggtgttttgtgggtttcatgaggaaagccagacacaactttaggcttgacgaggttggaataagaaggcagctgaaaaccgtctcacagataatcaagcgcaaggattcacacctctataggcacctgcagaaacttcaggccgaagactgtttctttctgtacagaatggtggtggttctcttcaggagggagctcacttttgagcagactatgtgtctgtgggaggttatgtgggctgaccaggccgcaattcgagctgggattggaaggtccacttgggcaaggataaggcttcatgctccgccaacagacgacttgctgctctatgctattgcagcctgtgtcttgcagaggaggaagctgataatcgaaaaatacagcagcatggatgaaatactgcgggagtgtaatagcatggccgggcagctggatgtctggaagctcctagatgatgcacaccacttggttgttgaccttcatgacaaaatctgatgcaacggccttcctcagttatgttcggtagagtatgcagacatgaacccttttccgaggtgtatttagtaatatgttatgtactgttcaccacccggaataaaaaccctttcttgggtatatgtgtagagaaccttgtagcttcaagtgaggacgaagttgtcttcactttggttaagctgataaaccattggatatcacagtggtttttatgcaagccatccatagtcaaacttgatggaaaattttgtttttgcttctaatgtctgtccttggcagaaacaacattttccatgaagtcttttataggaaaagttaagttcccagattttgggtgtaatgtggagtaataatgaaatcaaagtctttactgtcatttcacacaccagtttctttcatcaaaaaaaaaaaaaaaaaggccaca

SEQ ID NO: 5889 - DNA, 693 bp, Sorghum bicolor
  Clone ID: SORBI-28MAY03-CLUS27959_1
gtggagggcctactggggagcttgctcgcgccgcgggtcaagggccttgcgctgatcgggcactcaccagggtcctgtgcattcccgcggctgggccaccccgcctgggctcgtccgtccccgtgcctcgtcgaactcaccagataagggtgcatctaaagcacgctggttatccaatagctaatgatgagctgtacctatcggggaacttttgtccacgatcaacaaaaggaacaagtgccagtaaagaaattgcaccatcagatccagacaatagtgctgttgatcatggcagcaaagatgcagaaacagatgtggagtttgatatcgacccgatgtgcacaaactgtccaaatcttgctccagtaggttatgatggagatgaggaaggactatggttgcattgtgcgcggtacactggtcctgattggacctacgaatgcccttatcctgactgggcgttccttggtagcgtgtcaacaaagaagatgaagtcatgatgtagttcatggtgaactgtaagcccatcaaactgaacaagcaatccgttttggcgtgccctatgattggggatccgaggttttcatttaaaatcaaacacaccatgtccggttttcctccccggcttctcattcagccaatccacggttccactaattaaaattcaatatacattagcgcatcccgcctttg

SEQ ID NO: 5890 - DNA, 906 bp, Sorghum bicolor
  Clone ID: SORBI-28MAY03-CLUS28014_1
gcacgaggggtaagggatgattttccccaatgtttcctctatcttgtttctacaggtcacagatgggtaggtggcggcgcatgggccttctctccctccaccggtggcggcgcatgtgcgacattttttttctttttttcctctccattttgcggcatggtctggcggctcttgcatgaccattgaacctgcaatgcaatgtcggtgagggctggggcgaggactctaggaggcgttaggtggccggagaagaagttcgacatgtagtgctccaggccatggctccccacggggcggtccggtgcacgatgcagtccacggccatggcacaagatcaaggaggccattgcccccgcttcgtcgatgggcatgtgtatgggcacacattctgtggggcgagcaaatccggccctagcgatgtcatctttggtccagcagcacgcttcatgcggcgagcagtttcgtgcatgaggagggggttgcttgcttgtttccaagatggttggaaggattattcttcatttggtgtgagaggtcaatggcatggcttgcgacgtccacgacttagttgacttgtggcggtggcgcagtgtgatcttgatgtagttgatgggttaatgtaaaaaattagttttccatatgttatgtttatatgcttggatgaatgagcaaagctattggttgttatgtaacattagttgggtttagatagttttgttgactaggtttactatgcatgttgtgaattgtgctcatatgcacaatgttttctatgccacaactcatgagttttctatgccatattttattcaccttagtttgcataggttttatgtttagtttgcataggttttattcatgcttagtttgtatagaattctatgcttactttgcataatttgaaga

SEQ ID NO: 5891 - DNA, 508 bp, Sorghum bicolor
  Clone ID: SORBI-28MAY03-CLUS2804_1
cgtccggtgcttgactcccccactcacccgacaccacttctcccacgcagcgactcctcctcctcgatctctccctcgcggtcagcccaccaggcgagggcgccggccaaggacgcggggctgccccaccaagcgagggcgccggccaaggacacgaggccgcccaccgccggccaccagggcgcagggctccgcacgcactctctcgtgatgccaggtgcctaggttttcgtcggcccttggccatgtcttcgctggacccttcgccggcgacgagcaccaatagataaactggcagcagtgatgatatgttccatgggaatatttgctgggaggccacacgacaccatgcggccacgacgagcacccccgcagcacgcggcgcagtcgcacagccatccttgccgcttgccggtcgtcccatgtcaccgtcgatccgtcgtcctccgcacctcatggagctgtgggtggtgctgggatgcctagcccgggtcatggtgttcctgaa

SEQ ID NO: 5892 - DNA, 596 bp, Sorghum bicolor
  Clone ID: SORBI-28MAY03-CLUS28791_1
gcacgaggattccgtgccacctgtttccgcattccgccattccgccttctgttgctggggttttagacaaaaatcactcgtcccatttctcgcgtccccaggccacggtcgcgagcaaggccaccacccgctgtctcgatccaccgattcccctcctcttccgttcctccacggatctgctcgctgtggaagcggaggaggacgctggaggcgtctctcggcagcgcgaggattcccgagctgttgttgtggtgggaaatgaggatctgcgaattgggagacggtgacggggggctggtgcttcagcaggagcagcaggaggaggctgttcaggcgagcggtggcggcgagctcgtacggcttaaggcgaagcgcgcgctcgtcggcgccggcgcgagggtgctgttctacccgacgctgctctacaacgtcttgcgcaaccggtacgaggccgacttccggtggtgggatcgcgtcgaccagtttattttgcttggcgctgttccttttccaagtgatgttccacgattgaagcagcttggagttcaaggggttgtaacgttgaatgaaccttatgaaactcttgtcccaacatc

SEQ ID NO: 5893 - DNA, 636 bp, Sorghum bicolor
  Clone ID: SORBI-28MAY03-CLUS28888_1
tgaagttgtgacgggggttgctaagaagcaatcgaaagcccccaatggcagcagcaaaagcagcaaatctaactctaaaccatcaaaacagaccaactctaacagtaagcctgcgaagccaacccacccaaaagaagaggaggacagcggccatgaggacgcagaggaggaggaccaggcgtacctgtgtgggtcctgtggggagagctatgcgaacggggagttctggatctgctgcgatgtctgcgagaagtggttccatggcaagtgtgtccgcatcaccccagcgaaggcggagcacatcaagcagtacaagtgtcccagctgcagcaccaagcggagccgggaatgaccggcaaccctggcctgggacaggacttgctcccagttaacggaagcatttagaatcattaggagcagtgaagcggtgtgtcattagaaccgcttcacctgtttagcagaccggtgcttgtgccggctgttgtatgtctcgtcgtgttgtaaactggtaagggacatggtagctagtggtgatgtgttgtgttagcaggctgactgctgtcatcgtagtgtcggatgaactgctggagtttgcaaactcatgttcagtaattaagtgctgctctagtgtgtatg

SEQ ID NO: 5894 - DNA, 809 bp, Sorghum bicolor
  Clone ID: SORBI-28MAY03-CLUS29017_1
gccataactgataacaagctagaagaattgtttcaattatccctgcgaatgtttgatacaagattacccccaggtgtaactgttatgtccccttttgccgatgattcttcgcttaataaaatgggagtggagagcttcccggaagagttattttcagtgcttcgaacaattcagcttttgcgagggttgactgtaggcatgggccttacattctcgtgcgctcagcattggagaccaatcgctgaggaagtattgttaaaggctggaagacaaaatgcttcaaaatcaagaaatcaaaagagaagttttctcaggagacttttttggtgaagtagggatagggcccatcaaagaatatggtatacgaacaattctatgatgaaatggaagtagccataaatctcaacccttcgattcttatattcacagtacatctgttcactttttttttgagaggcatctgttcacattcatttacattggatttgcaggccaaaaatctcggcccattatcaaacgtgcaaacctacggaaccatcctccaggagatcaatgcaaggagacggagcttcacaagagcagatttcgtctttgaagtgtgaagatcgaatgttgacgctcatctagtcgctagaagctctataaatttattgataggtagacatgcttggtttttggagcctcctgatggagtttgtaatccttatcctgctgattgaataaagtcagagctcccctaaaaaaaggaaaaaaaaaacatgtacacattcatgctcaaaatactccaaatatcgtgtggggacaaacac

SEQ ID NO: 5895 - DNA, 643 bp, Sorghum bicolor
  Clone ID: SORBI-28MAY03-CLUS29028_1
ttgccttcattcgttcagcaagtcaagtctccaagtaatcttggcttcctttattctctgatgaacagctctttctctttctatttattctcgtaccaagttcatgagaaatcaattttgcttcctcttttacctgctagtcttttagcactggaagaacctcggatgtatggatggtttgtgtactttgcccttttctcaatgtaccctcttatctgccgtgatcaacttcttctacagtatatagctgttcttggcctattctttcttatacactattcacctggtggaagctatggaaagagatcaaacatgtcatgcagggcaaaattagttcttagcttgccatttttatgctcacttctacttcacattacctacctgcaaatagagcctcccaataggtatcccttcctctttgatgcactgataatgttcgtctgtttttcacaatttgtcatcttagctctgtacaccaattataagcaatggatgttggacacacattttagatcaataggtgtgaagaaggatctgtgattgaaaaatttgactgctaattttacggagaaggtcactgcacctttgtaaccttgtgtgtaggcccttttaacatggtttatgaatgaaatgtgcacacggg

SEQ ID NO: 5896 - DNA, 891 bp, Sorghum bicolor
  Clone ID: SORBI-28MAY03-CLUS28314_1
gaaaagttaccacagggataactggcttgtggcagccaagagttcatagcgacgttgctttttgatccttcgatgtcggctcttcctatcattgtgaagcagactactacttcaacagtgaagctgccaacagccattttgtcaacttacgcgaaggcaaaatctagagcaaagaaggacgcagaaagcaaagctaaccaggagaaggccacagaagaggcttcgggttctacctcaagcaaggcggctaaagctcaggagaaggatgctgatgcaatgcaggttgacaatgccaccgagaagaaagctcctgaaccagaagcaacctatcagctcctgacaaacccagctcgcgtaatccctgcccaggagaagttcatcaagttccttgaaaacagccgatatgtccctgtgaaaccagcgccttctggattcatcctcctccgagacctgcagcccactgaggctgaggaccttgcactgaccgatgctcccacaacagttgcaggaagcaccggcaacactgcccctgctgcaggtcaacaggggtccggatcatcagctatggctgtcgacgatgagccacagccgccacaaccctttgagtacacctcataagcgtagatgcctgggacttttgttcctttttttccccctttgagtatgtagtgtgcggaaatttgttgttggttggaagaccttttgtagaacatgagcagggaattttacttgaattggcgctatagggtcaacgttggaaatctgggatatcacctgggtcaacccctgcgctcctgcttgctcttttttttttaccctgtgatgtaatatgctcaagtattttaccctggaacaacaattttgaccacggtttacattatctgttgcaat

SEQ ID NO: 5897 - DNA, 631 bp, Sorghum bicolor
  Clone ID: SORBI-28MAY03-CLUS28320_1
aaaggggagaaggccggcaaggcagagacgttcgtcgaccttccggggtgtccggataacattcgcctcgggtcagacggtcacttctggattgccctcatccagctgaggtcgccatggctggatttcatcacccgctggaccttcacgaagagagtggtggcttcgttcaccgggctcatcgagtggagcaagggaacggcgaagggagccatggtggctcaggtgacggaggacggcaacatcgtccgcattctcgacgactccgaagggaaggtgatcaacttcgtgacatcggtgacggagttcaacggggacatcttcctcggcagcctcgcgaccaacttcgtcgggaaattatctctggcgcaggtgatacagcaggagcagtgagcagcacatctccagcccttggagcacgaggaaagtttacgtgcctgtttctgcaaacaatcggatcttgtagtaaggctttcgaaaagatttcggattttctgtactgtaacatttttatttttatttgtcaaatatcatccaattatgcactaactaggtttaaaagattcatctcgtcatttgacagtgtgtaattagtttttttttcgtctatatctaatctaatacttcatgc

SEQ ID NO: 5898 - DNA, 538 bp, Sorghum bicolor
  Clone ID: SORBI-28MAY03-CLUS28331_1
tcacgaagcggatccacggatacgcgaggctcttcatcgccgaggtcttcgccaagggcctcggcgacaagctgcaggtcttctccaccgacttcatcgacggcgacttcgtcgacgcctgcgccggcgtcaccaaggcgcgcgtcgagggcaccgcgtgatcatcgtcgacgaacccgccgcgcgcgtggtacccgtacgtattccccgatttgattaataattattaggacgtgcccgtgcatggggctcgtagcaatttagaggagtcaccgcgattacaggcagaggttggtgtccgtcttgtcgtcggcgtcgggacgactagtgtgcagtttgctttctcgttaggagttgtatgtagcttgcgttgggtgtagtaatcgagacgtacggggcattgcagtgtatgtactgtgtagtgtacactccagacgtgcagtatattcattcatgtgtaacgtgtgcgtccgtgtatactgtgtatagtgatgaatttgctcgtgggagcaaaggagtaaataaacatatacagtga

SEQ ID NO: 5899 - DNA, 547 bp, Sorghum bicolor
  Clone ID: SORBI-28MAY03-CLUS28359_1
gcacgagcgaaaaagccctcgtctgactacgctgtgttcatctgctctgctacgactaagccagagctcccaccgtcaggtcttcttcttcttcccccccttcgcgtcctctcctctgcctgcgcgcgcaccgtcaagcgagcgagaaatcgtcatggacatggaggcggccgcgatcttcggcaccgccagcgcgtcgttctctccagcgccgtcgtcgtccaggtcgcgcggcggcggcggcggcacgagcatctcccggctgccggcgcgcgtcgccggcgccgtggtccggagcctggtcaccttcgtcttcgcggcagtgggcatggttctcggggccgtcacgggcgcgctgatcgggctcgccacggagagcggcctggtgcgtggcgctggcatcggggccatctccggcgccgtcgtgtccatggaggtcgtcgactcctccgtcgccatctggcgctccgacgagtccgggatctggagcgtcctgtacgtgcttgatgttctctggagtctgctgaccggccgcctggtacgcgag

SEQ ID NO: 5900 - DNA, 1058 bp, Sorghum bicolor
  Clone ID: SORBI-28MAY03-CLUS28369_1
gcacgaggatcttcttgccgctgccgcagccgcgatgccgacggtgagcatcggccgggaccgtctcttcgccgatctaggtcgaacctacaatcttgggagttgagaagactgcttcgcaccaggccttctcgtgcgctctgttcggcctgcccccgcccccccgcgctctcccccggcgggcgggccgccgccgccgcccttcgccagctgctgaggcttttgtccgtccctgcgccggcggcgagcacccccctgcttgatggggctgccatcacggtcggtgtcgcgctggcggggccggccgccgacgtccttcacgagcccctcagccctggctgccaggaggtcagtttgagtgcatttgcattcttgttctctgagttggttcagtacaaccagactcaagttgacaacattactgagctggaacggaggctggaggatgctggttatgcggttggtgcaagggtgcttgaattactctgtcacagggagaagggaaatagacgagagacacgacttctgggtattttatcattcatccacagtactgtttggaaagtgttgtttgggaacgtggctgactcacttgagaagggaacagaacatgaggatgaatacatgatcagtgaaaaggagcttcttgttaaccgtttcatttccgtgccaaaagacatgggagcattcaactgtggagcttttgttgcgggaattgtaaagggtgtattagaaaatgctggctttcctgctgtagttactgcacattttgttccaattgaaggacagcaaaggccaaggacgacaatcctgataaagtttgctgaagaggttttacacagagaagcaagacttggctgaggtttatgtatgtacacaaaacctttgactagcctatttgtaaggtggattgttactggatagtttggtaatttcttgtatttgatttatgtattagaggtgtagcgtttgggggtgtaacttacttttttcatgagaatcaattgcaaaagcgatctcaagtatggcctaagttaagagtgctatgcatcccctgc

SEQ ID NO: 5901 - DNA, 353 bp, Sorghum bicolor
  Clone ID: SORBI-28MAY03-CLUS28486_1
agtacttgttcagttcctcttttctggtgctatgaaattacagcctggggtttggcagtcttgtatggtggcacggccttcttcttgagaccgcgagctgcagttgtccttgacgagggcgaggacaccacccacaatgtgggtctagagatgctggagtccaaaatggaagtgactccagagatgcagcgccgcatcaacgatggtttcaagcagtggatgggttcatcccttctatcttctgatgacgaggacgaagccacggatgactacattgagcacgatgctcctagcccgactgccttgggtcaacagcaccagcaggagcatgatctagagacctgactgctgat

SEQ ID NO: 5902 - DNA, 665 bp, Sorghum bicolor
  Clone ID: SORBI-28MAY03-CLUS29354_1
gcacgaggcgcaaacgatccagtcggacatgttcttggtgcgagaggcatgggtgctgtaccagcaaggcaggctgctggacattgtggacgcgagcatggagaggtacccggagaaggaggtgctccggtacatcaaggtggggctggcgtgcacgcaggcgacgcccagcagccgccccacgatgcgccaggtgctggccttgctgtcgcgtcccgtcgcgctgccggagacggagatgcgcccgccgagcttcgccgagtaccgcggccaccacacggcccccggaggtctgcccgccggtccgctacttcgtgcgtcgccgagggcgaggtggccgccgcaggcgctggcagcagcagcagcagcaacagcgcccaagtgctccgcctcgttcacgtacagcgaggtggctccgcggtagccaggtggtggaaaaccggtcggagcaggcgcgcgaaccggcaaaccgggcacgtctgaactgataggaccgtgtgaggcggcgtgttcgatgtctttcgtgtaatcgtgttgtgtagaattgcgttagatttggatttcctttttctggtcgtgctttcagtttggattggttaagtttggggccaaatgctgttggaatttagctctcaaatgttagatgatgtaaggcactccatttt

SEQ ID NO: 5903 - DNA, 643 bp, Sorghum bicolor
  Clone ID: SORBI-28MAY03-CLUS29386_1
ccacgccccatgtcatttcgttttatgagacactaataaacactattatttttatatattattcgtcaatcccacttcaattacctaaaaaatgagggatattttcttgctaggattcgagacatgcagataatatagaatccaaaaaatgcattgatcattacatagaattctattaagatattatatgaaagtcgaatttcttccattctcatttgagaatgcgaatacaaggaggtattttgtgtttgggaaagtccgaagaaaaaaggatttggaatctaccttttcttttgctttttcccttagaaaaataactcaatcaaaatccaattatctactctacaagaatgaaatgcttgttatgcctaatatacttagtttaacctgtatctgttttaattctgttctttgtccgactagctttttcttcgccaaattacccgaagcttatgccattttcaacccaatcgtggatgttatgcctgtcatacctgtactcttttttctattagcgtttgtttggcaagctgctgtaagttttcgatgaaatctttactattctgcctgccaaattgaatgatgtattcattccaaaaaaaaaaaaaaaaatccgagggggggcccggaaaaaaaaaaaaaa

SEQ ID NO: 5904 - DNA, 643 bp, Sorghum bicolor
  Clone ID: SORBI-28MAY03-CLUS29395_1
gaaaacaggaatactacagaccctgaagagagtgagttgtcaccgtcaagcatccaaaacaagcacggagtaactgaagtgccgtcattccaagaactaaactctgaccatgtgccaaatgttgaggctgacaagcatcctatctcaagtgctgaggcagaaatagttgacaagtctgtaattcaagaagagttggtaatgaaaactgaggccaagagtttacccactgagaagtctaaccctcaccctgcagaggatgatgatgaaaaagaagtagatgattggctacaggatgtggatcatgtgtccagcaaaactggaaacaccactgcagttggtgaggaggaagatgtatccttcagcgatctagaggatgactagggggctgatatcgtgcgaaccagctatgagcacattgctagacggtggcttcatgaagaagtgaagaacacttagtttctctgtgcctctggctttaccacttcactgtctggttctttggttgcagtagcagaatcacgtaacaatgtctctcgcgcgtcccaattccatgttgtatctaagcggtctatcgtttttctctgtacataaagttctagacgcggttctgcatttcccgctatatcgctgtccttaagagctg

SEQ ID NO: 5905 - DNA, 681 bp, Sorghum bicolor
  Clone ID: SORBI-28MAY03-CLUS29373_1
gagagaaaactagggcgctcgagcaagaaatcagcatcgattagcgaagtcgttgaatcactaccatacatccaaagaaagaaagggtatatcaaaaatgttccgtggcaaccctagggcgagcgcaagcaacgagctgccgatcgagagtgtggtgagggtgaagaaggtggagaggatcgaggcgaacaacctcgccaccaagccgtcacaaatggcgacagccaaggtgaccaggagcctgaccgtcagcattgtccgtgtcggggacgtggatgaaatgcctgacagctttgtctcggtgcctattgcgcacacctaatcagtgaccgctactgtcatacatttaatgttcagttctgtcaggaaaagcctgtaatactaacacgtatggctgtgtcgtcaggaaaatagtggctcaacaaggctcaccagccatacatacgtgttactggtgtgcgtgttaagtttctataagcagtccgtggtgagcttctcgttgtataaataaacttgtgcaactcgatctcttttgctagctcacttgtcgagttcgatcactgcaattgttttctctctgaattcagtgagtaataacactagacagataacggattatatattattcaccagggccttgctctgttcttctatagcatgtgcagccacaagtaagctaag

SEQ ID NO: 5906 - DNA, 684 bp, Sorghum bicolor
  Clone ID: SORBI-28MAY03-CLUS29348_1
tcattttagtggtggccaatggaattcaggcggtagctgtgacaaggagagcgaaccaataaccaatgaacagtacctttcaacctacccaccaaagatgagcattctggaagatgtgatccacaagatgaaaactccggttgtttatttgaacataacgagaatgactgactacagaaaggatgcacacccttccatctaccgcaagcagaaccttactgatgaggagaggagatcgcccgaaagatatcaggactgcagccactggtgccttcctggagtaccagattcctggaatgaactggtttatgctcaacttttgatcaggcagcatcaaatgcgccaacaataaaggcatctactgttttttttgctgtgtgcctatatatgatctgttgttttctaggataatagtcaacacggtgatgaaagtaaggttggcatgagatcgaggattttcctaaatccatatatagagtaaagttgtccatgctacctcccaatacccacacaaattcttcaatagaggtttctgggacgtcacattgtaaagttcatatctagcactaatctgaaataaagaatagtatagatgtgatgatatagatgctcctgtgtcttctgtgattcccttcgtgttctcatatagtttctaaccatcaagggtgtcctatatacagactt

SEQ ID NO: 5907 - DNA, 554 bp, Sorghum bicolor
  Clone ID: SORBI-28MAY03-CLUS28704_1
ctacgaccccgacccggccaccaagaagatgatgaccatggtcgcggagctggccttccgctgcctgcagcagaacggcgagatgcgcccgccgatcaaggaggtgctcgaggtgctcaggagcattcagggcgaatgcctgacggagaaggatggagacaagaagaacaaggacgggcccgtgtctcccaccacggttcatgctccgtgggacagcagggccaccacgcccaacaccagcaaggactaggctagttagtgctcgaggactgagaccgtccgagatttgtttgtgtttcgtgtttgtatttaggcttccgcatatagagaactgctttgctgtgctgtgtgactatgaggcatcccagattgcctgtcatttgttttcaggcttcgtagctcctggtgatgtaaatatttgtgtttgttggtgctgtcaggacagagggaatgtacatagtatatgtgtaagagtggtaagtggtatatatacatgtgtaagagcggtgaatggtagtatatagtacataaagtacatgaatatagatgtcgct

SEQ ID NO: 5908 - DNA, 826 bp, Sorghum bicolor
  Clone ID: SORBI-28MAY03-CLUS2869_1
cgtccgcccacgcgtccggaagtttgctagtacaaagaaacttgttgacttactcaagaaacaggcagaatcaaataaaccatatggtgcaatatgtgcctctccagctcatgtgcttcagccacatggtttactgaagggcaagaaggcgacagcatttccacctatgtcacacctgctcacagatcagagtgcatgtgagcatagggttgttgtagatggtaaccttatcaccagtagagccccaggcactgcaacagagttcgccctagccattgttgaaaaactgtttggtcgagataaagctgtcagcatagccaaggaaatgatctttatgtgatattgcactgacctggtggtgtgagaagtataataatgtgaataaacataacagaaacctgttagtcatgcttctggttctatgcctgaactggtaatagctgcctgaggatttcaattgaatacttgaatggtactattacatcacactgtaaactgtgaaccaagatcgtacattttgcataccataagagaaaggttagtgtgactcgttacttgtaaatacttgtcctgtctgttcagtgaaacaccaagtggaggtgctgccttcccaccacccacctgctctgcctctaatcatcatggatttacacgaagttaagaagctgtttggtcaatcaagagagagtgcaggacattggcagcaatctggtcttcatgtcacagtaaactgtactgtaagctattgatttgataagcactgtactctttacgatgtacgaactcttttatccttgttattacagctcttctttttttgtttctg

SEQ ID NO: 5909 - DNA, 580 bp, Sorghum bicolor
  Clone ID: SORBI-28MAY03-CLUS28754_1
gcacgagggcacttcggcagtcagcactcagcagcgcccgcggctgggctcgtcgggcgcgtataccaaacgttagatcaccaccgtcgaccctgcgaccggtgcccaccgtcgccatggcgacgccgcctcgtttccctcccgccctcgccggctgcttcccgcgcagaggctcgcctcggggcccggacaaccctaaccctaggccaagctctcctctccccggctctcccgaggacgccctcctccgcgctgccttcgacggcgacctccgcctcgtcaagaagatgacgagagtgctggacgggggcgaggaacggggcgcggaaaaggtgagggctgtgcggagcagcaacggactgggcgctctgcacctcgccgctgcccgtgggaagctgccggtgtgccgatacctggtcgacgacctgggtctggatgtcaattcaatcaacgaggcaggtttgacccccttgacatgtgctattgatgctgggagcgtggatgtggtgcagtacctcctcaataatggcgctgatacagaaacactcgtcagcactgggcttactcctcttgtttacgc

SEQ ID NO: 5910 - DNA, 473 bp, Sorghum bicolor
  Clone ID: SORBI-28MAY03-CLUS28762_1
gcaccacgagcagaacaacaatctttcaattcgacgcgcgcacgccaaaatacgcacagaagatcgaatgcagcaggcgtctgcttgcttctcctccaccacctcgtcgtcactgctagtgatgccagtagtagccctcgtaatggtggtgccgctgctgctcgggctgctgtccacgacgccgagcctggcatgggcggcgccggtgtcccggaccatcaccgtggactgtcacgggcgaggtgacgtcaggacggtgcagtcggcggtggactccgtgcccgacggcaaccgcgactggatcaagatccatgtcatggccggcagctactggcatttgcagggagaaggtgagcatcccgaagcagaaaggctacatcctgctggagggggacggctcgtcgacgacggacatcagcttcgacgcgcacgcgcacgccggcatcgacgacatcatgggccgccccaacttg

SEQ ID NO: 5911 - DNA, 901 bp, Sorghum bicolor
  Clone ID: SORBI-28MAY03-CLUS28780_1
gcacgaggatttcaactgagatagacattagtatattctaccgtggtctagatcatggaagcaaacacaccctggtgtcagtggtttgttactatggccagcattatcattgttttgccttcaaggatggacgttgggtcatgtatgatgaccagacagtcaaggttataggtagttgggatgatgtgctcgtgatgtgtgaaaagggccatttgcaaccccaagtgcttttctttgaggctgcaaattaattattcttcagagtggtaaagtgctgtgcagtggttaacatgccctcagatatagggtttttccctgtggccgtgaagattagaaatagagtagcaaatttgttgagcgggggtatagagtagcattctacagttgcgttggtttgagctgttgtcgagcccttcgtaataagcagtcacctgagcattctagagcaaaaatggagcttttatcactcgttgtttgctttaaccttcggtatagttgctgaacttctgatccttcatctgccaataagatttcactgccgatcaagtgggtgaggcattcgacatgaactgccatccaacaattctagccgaatctgccaaaagctcttcattatgcacctattatgtatagaattttgtgcttacaatggggaggcgggtataggagtgcctgcttggaggctagagggtttagaatggaaggaaatggaatggatgatgcggtgtaaactgtatttatctgtggagggattgtttgaaaagaggaaggctatctggaatacggtactgactttgagaaatctgtagtacacgagtctactatatatatacaatgccccgatgagattatgtgcgatgattatagcgatgaataccagaatccgtatcactcctgtggt

SEQ ID NO: 5912 - DNA, 547 bp, Sorghum bicolor
  Clone ID: SORBI-28MAY03-CLUS28783_1
cgaagattgggcatgtcattcacatgcttgaagttgatgatttcccatacagagatgagcgtcggggtggcaaagctccaactcaagcaagatcagtggaaacacctgcaagtgaacctggcgatagcagtggaaacaacactccaaaggatgcaccgaagggagaccctttcaagtggagaaatcaggaagactagctagcccgcgggaaaacggtggttgctacgagtctgtgcctgataaagaagctggatatcgcgtagggacagaggaaagctcatctgcagtctcatcggttggttggtcaggcatgcaaactctgcaagcacctgtgtcgatcgtcgtgacagtatatgtacattgttggatcaatatgttagcgatagcgattttttccgttggttttcttggggccgtatttatgcgagggatgattttgtatgataaaggcgcgcgtgtgtgtactcctgaggggaaaaaaaaaacattgagcattgttatagctgaaaaccgttccagtaggattggccgatgacctccaaagtcc

SEQ ID NO: 5913 - DNA, 548 bp, Sorghum bicolor
  Clone ID: SORBI-28MAY03-CLUS29512_1
cctccaaagcatgatgatcaaagatccagcctcaatagtctatctggtaaatcttcgaattctccagatagctcaggctttggtagaactttgtcgaaaaaatcactggatatggcacttcggcatatggacataaggcgcagcattccaaacaatttacggcctcttatgacaagcatccctgcatcatctgttcatagtgcacgttcaggatccacaaggagcagaccgataagtgtttcagactcaccgctcgcaacaagcagcaatgctagctcggagccgagtgtcaacaacaacctgatgtgcctggacagtattgatattgatgatgagttgtgcagcgatagagcaggaccctatggacgttgattcacttatttgcaagaagtataaaaggcataattctgatggaactatttggctacagaatgttcagagcagcagagtagaagatctccgagatgatcccgagtatctgacgagcattattattttgttatatttaggttcttcgaatgttcaatatttatccagctcattctgtc

SEQ ID NO: 5914 - DNA, 674 bp, Sorghum bicolor
  Clone ID: SORBI-28MAY03-CLUS29523_1
ttctcatctaattctttcaattttatacaaacattactgttgcagttactggcaggtcacctagagcctcttactgatcagcagcttgttggtatatccaacctgcaacagtcctcccagcaagctgaagatgctctttctcaagggatggaagcgttacaacagtcgcttgcagaaactctagcatctggatccctgggccctgctggaccttctggcaatgttgcaaattacatgggacaaatggcaatggctatgggaaaacttggcacccttgagaactttctacggcaggctgataatctacggctgcaaacacttcaacaaatgcaacgcatattaaccacccgacaatcagcacgagccctacttgcaataagcgactacttctctcggctgcgtgctttgagctctctttggcttgcccgtccaagggaataaattcaattaattcataaataggataattttttgtactgtctctagtatgtccattagtttcttcacatgttagtgagatatttggatctaagatcttatgaagggatgacatgtatgtgttcaagtgaacgatcagttcatattgtaggccgtcatgggttattggataagtttgtaacaattttggataaaaaaacagagttgtaaatacatccggaataatctaagatctt

SEQ ID NO: 5915 - DNA, 631 bp, Sorghum bicolor
  Clone ID: SORBI-28MAY03-CLUS29580_1
gacctttaagaccagacgaggcagagctttttgaaaagtcagcacaaaatgcttatgcattgtttcgtgataaagcagccatgtcgcgatcaatgagtgttgatcagatggagattgtcgctcaaggtcgagtgtggagtggccatgatgcattttcaagagggttggttgattcagtaggtggactctcacaagctcttgctattgcaaaacagaaagctaatatacccaaggataagaagatccagctagttgaagtttcaaagccctccccatcattaccagaattcttatctggcattggaggttcattgcttggagttgacaggccagtgaagggagtgctccaggacatgaccaccctaagtggagtccaagctaggatggatggaatcttgtttgaaaatttaggagatatgtcaggagaaaatcaattattgttgctcgtaaaagatatcatgaactattttgattgattctagcattcaggtccttatgttacaaacatttgtatttagggatgaggaaaaattcataatgtcattacacatctaccttacacagaaacaggtagtttgggatttgtacagttaatttagcattgtatatgctattttgttcttttgcattg

SEQ ID NO: 5916 - DNA, 632 bp, Sorghum bicolor
  Clone ID: SORBI-28MAY03-CLUS29603_1
tcaacaatttaagccacagcatagcattcataaagctggagtgtcaaatcagtatcaagctgctttaactcagaatgtactgccagcaatcaatcagatttcgcagctagttgctgggagccatcgtccagttggcatccaaaatcaggccattgctgttccgcctcaatatggtagtggtagcttggcaagttattatggagtgacgtccaccacgccatacaggtccagcactctagctcctggacctggtgctttgaatggtccaagtgcgcaggcatcatcaagatcaaagctctattctggagatcccctcgcggctgtctcccgatcatcagataagaagggatcatcttacaaatattctttgtctagtatgtcaacttatgatcataaatgaagatttgttttgtctgcctctggacgaacctgacaaaccttgaaagtttgggtttcagaccgagctctggtcccctttgtaaatgccaagtcattgtagctaacaaaggtccttttacaatataaaggatgtgggtttttatctagaagagattctcctatggagtccgataaatattgtaggaattctaacatatcttccgtccatatgggcacattctcttttattcaat

SEQ ID NO: 5917 - DNA, 600 bp, Sorghum bicolor
  Clone ID: SORBI-28MAY03-CLUS29613_1
tttctccaaagtcagtaatgccgcgcttgtcaagaaccctgagtgggaagggtcgccgaatctggggcagaaatctggcctcatctcaacgctcatcagcacacatttctctacagcggctcagaagcctgcccctcgccctgctgatgtgaacatcaactcggctgtgtaccctggtggtccgccagtgcctgcgcaggcaccaaagcttctgaagtatgtggacacagcagagatggtgcgcggaccgcaggacacaccgggatactgggtggtctctggtgccaagctgcagctggagaggggcaaaatatcgctgcgggtgaagtattcgctgttgacagccatggtacctgacgagtatacacttgatgaatgaacaaggttgaaactcattgcctcaaagggggctagataatgtgcatttgatcatgtggtgcattgcaagtaaagagtttcagcattcttaggaaacctgacttgtatgtacatcgcttgtcctttcaattatgaccatttactcggcggatccggcggctgtccgtagtacaatctttgaaattaaatttgttttgcaaagaggtacacctcattctttgt

SEQ ID NO: 5918 - DNA, 781 bp, Sorghum bicolor
  unsure (1)..(781): unsure at all n locations
  Clone ID: SORBI-28MAY03-CLUS2904_1
gccggccgggttcgggagaagacgcgaggggaggggaggtgcgccaccggaagcggaaacctcaggaaccatcgaccaaaccccgtcgatccggttgcggcgcggcgcggcgtgctagatagctaccgacgatggtggtggaggagatcaccgagggcgtgaagaacctcgccgtcgccggagatgcggcggcggcctcaggcggagaggggcagaggaggggcggcggcggcagcagcaaccgcatccaggtgtctaacaccaagaagcccctcttcttttacgtcaacctcgccaagaggtatatgcaacagcacggcgatgttgagctatccgctcttggaatggccatagcgacagttgtgaccgtggcagaaattctgaagaacaatggatttgctgttgaaaagaagattaggacatctactgttgaaataaacgacgaatcaagagggcgtccattccaaaaggccaagattgagataatcttgggaaagagtgataaatttgatgagttgatggccgctgctgcggaagagaggggagaagtggaagatggtgaagagcaggcttgaaaacagtaccgacgacaagcgacttttgttgtgctctgttaatgttgtttaatttaataccgtgtgcatgactcatgagagatggcatgcgttcttgctcactacatcaccatggcagtgtctgcaaattcatggattgatggacggatgggtggttgnttgntaacattnttggacatctagntcattttgttctttggctanaa

SEQ ID NO: 5919 - DNA, 627 bp, Sorghum bicolor
  Clone ID: SORBI-28MAY03-CLUS29074_1
ctacgcctgggtgtcgagccaccagatgcagcgcgccaccagcatcggctcgccggagaaggcggtcgtcgagttcctgacgccggcgatgcggctcgtcttggaggaggcgcggaagctgccgctgtggcaggctggaacgacggcggcgacgacgaacgtccagcacgtgggcagcggcgtcgacgaattcgagatggtagagtggaggctggaggtgtggtccaaggtaaagcagcagctcatgtcgttccaggagcagacggcggtggacgaggagcagcagcacctggccgccgtcttccaggaggcgtcgctggaggccatcgaccgcgccatgcaccgcgacatttacctggccgcggtttatgcgagcaagctgaggcgatgccactcgtcgggcgccacgaactgaaggactgagaaatcggcacatgaaagtggacatgtttatcaggtcgtcaataactaagttacctagccgcttgtactgggcatgcccacctttgttatttactagcaaatgagctcttacgttaaacatgcattttgttgtgtaatcatgttgtggtgcatatatgtactacacttcagatctatatgtatcactgtcggatctaaacctgc

SEQ ID NO: 5920 - DNA, 772 bp, Sorghum bicolor
  Clone ID: SORBI-28MAY03-CLUS29266_1
ccgccacagcaaccacaagcacaaccccaacttcagctgcatactcaaacacagcaacccatgcaatctcaactgcagttgcattcgctaacacagcattccctccaacctcaactgcagctgcagcctcagtcacagccacaacagctgccacaagtgcagctgcaccctcagccgcagcagcaaacccaagtgcagatgcaccctcatccgccgcagcccccacaagtgcaggtccacccgcagccttcgcaaccccaagtgcagatccaccctcagccgcagcagcccccacaagtgcagttgcattcatcagcccagcaagcttcccaacccgaacctcaggtacatctgcaatcacaggagccctcacaagctcagctgcaatcccaactgccaggtcagctgcagacacaggcgcaaagtggacctggcgtggacagttagagactgttgttgtgtagcctcagtataagcaaaagactgggcactttagctggcatctactaggagcctgtgtgcctgcttgtgacccgttagatcctgatttaggtttccgtgcttcctgtacaatgtaaatccagtgtgattgcagttgccttgttgctaataatgcgaagccgttagttactgatgatgtccttactgtgtcgtcgaatactgaattcctgacaagtgtcatggcgtggtttattatgtgccgtgctgaaagatattctgttgtcattgtaatagcctaacgtgacatttgtccatggtgatagtgactgat

SEQ ID NO: 5921 - DNA, 644 bp, Sorghum bicolor
  Clone ID: SORBI-28MAY03-CLUS29132_1
ggcgacgagtccaccgcggcgctcacgtacgagcacctcaagcgcctgcactacacgcacgcggtgctgtacgagaacatgcggctgttcccgccggtgcagttcgactccaagttcagcgcgggctccgacgtgctccccgacggcacctacgtcgccggcggcacgcgcgtgacgtaccacccctacgccatgggcaggatgccgcgcatctggggcgccgaccacggcgcgttccgccccgaccggtggctcaccggacccggcgggacgttcgtgcccgagagcctgtacaggtaccccgtgttccaggcgggcctccgcgtctgcctcggcaaggagctcgccgtcaccgagatgaaggcggtcgcggtggccgtggtgagagcgttcgacgtcgaggtcgtcggggacggtggcaacgccgcctgcgcgcccaagttcgtgtcggggctcaccgcgtccatcagcggcggccttccagtgaggatcaggagagttgttcgttaaaaaagagagagagagagagtctgagagagagagggactagatagagttgtttagggtaacagtgtactgtgcatagatctaattgcaagagggaatgaaatagcaagttaatcaaaagctccattcacaagtcc

SEQ ID NO: 5922 - DNA, 657 bp, Sorghum bicolor
  Clone ID: SORBI-28MAY03-CLUS29309_1
aattggcaaagtacctcacctctcggagtttctcaattccctctacaattgccagtacaagtcattttttattgcattctctggcttgactgaaccgatcaagttagaccggtacttgcagcctcattttcgctactacatgcgtgaagtgcgcactgttgtctactcgcaatttctggaatcgtacaagagtgtgacaatggaagccatggctgctgcatttggtgtcacagttgactttatagaccaggaattgtcacgcttcattgctgctgggaagctccactgcaagatagacaaagttgctggcgtcttggaaacaaaccgacctgatgccaggaatgccttctaccaggcaaccatcaagcaaggagacttccttctgaaccgtatccagaagctatcacgagttattgacctgtaggcggcagcccttcatgcaagagcatgactagaatgtattatttgccttcgctcctggagtgtacgtgcttgactttcaatcggtgtcaattgaagaagcttttagggatatttgtgttctgagaaaataatgtgtttttttacttttgtagcctaactacatggaccccaaaaaaaaaagtcacgggcattgcttgtagacgtttcttcattgatgaattcatccctgttttg

SEQ ID NO: 5923 - DNA, 753 bp, Sorghum bicolor
  Clone ID: SORBI-28MAY03-CLUS29682_1
tcgtcaatgttgattttgctgatgtaaaagctgtcatgaaaaactctggaactgccatgcttggtgttggtgtttcttccagcaaaaatcgggcccaagaagctgctgaacaggcaacacttgctcctttgataggatcatccattgaggcagctactggtgttgtgtacaatattactggtgggaaggacatcactttgcaagaagtgaacaaggtgtcccagattgtgacaagcctggctgatccttctgcaaacataatttttggtgccgttgttgatgatcgttacactggtgagatacatgtgacaatcattgcgacaggatttccacaatccttccagaaatcccttttggctgatccaaagggagcacgaatagtggaatccaaagagaaagcagcaaccctcgcccataaagcagcagttgctgcggttcaaccggtccctgcttctgcttggtcccgaagactcttctcctgagcagtacgtttggtgaactgtgacccgtaggccattagtcttatcgtgttgagggcagtcctgaaggcgatttccagctatctggagatttatagcttcgactagcgttgatagtggtagattcagatttcagtgtatgtatcttttgctttgtgtttttgaggttccgcactgcactagttttgcagaagatctttgattacttttactgcaacaagccaacaacccttgtgttggattcttgaaccgaatgtggattcctccaagtgtt

SEQ ID NO: 5924 - DNA, 709 bp, Sorghum bicolor
  Clone ID: SORBI-28MAY03-CLUS29703_1
tctccagaggcaagcacagaagctgaagtgatccactcgtctctgcaagttgatgaaccgctcattccagagccaagcacagaagtagaaggcatggactcatctctagaacacacatcagttgtgaatggtcaggctgccctcatagccccaaccattacctctgctctaagcatgtcagcagctaccatgcctgtcagcaatgacagctgcggttgctatttgggaaccaacagaatccaagtctaccctcgccacactgatatggttatcccagaaggtgcgaccatgcttcccatcagcgataatcagtgggtagctgtcagcctaccttattccaacaataactaaggtagcaggactgccaggaagattagagcagacaaaaggagaattgatggatgctttgtgacgattatatggcttgtgattccgagctaatatatttcccgtgttgtactagtaatctagtctaacaagactgccttgcgctggatatcattaatgcccctattgcggagacttgtgacttccattgtactccttatctagctgaagctacttgcttaactatgtgaggaaatctgagttataccagtgccaggttataactgaagtagagaagctgaactctggatgactggatggaccatccgcaacatttatcatgatcagacttctttcatgctccctggttgagctcgttgtt

SEQ ID NO: 5925 - DNA, 850 bp, Sorghum bicolor
  Clone ID: SORBI-28MAY03-CLUS29709_1
cagttttgggtagcatgccatcattaaaagaggcatttgccagagatcataatttggattgtgaaaatgtggattgtttctcttgtgctgatgatgttaatgatgtcacacctgacaaatcagactataagaacaaatgttttcttctgcaaggattgtcggaagctcagaatttgacattgatgtgtgactacaatggggttgttttccacagggatttggagtggtgcccaacttttaacaacttgaggactcttttgctgaatgaatggtggtgcaaggatcctgacttctatgggctaaatctcattctcaagcattcaccggttctggagaggctcaaccttcatctttttactaagggacctcaacataaagtggaaatgataggcaggtacaatcaaatggagagaccagctactatattgaaacacctgaaggaaattgaagtcaaatgtgatgtggttaacgagcaagttcacaaagttttgaagtttctgggtacttttggcatacatttccttttcaagtaataaggaagagaaaaactgggaggctgagagatctgtcatgtcttggctatccggaaatgcaaggcttaagcttctggtgacatagtaccttgttttgtctatgcgtgtttttgtcctgtcaattccagttatccggatggattaggattgacccattcgtcaatataactttatgtgaacccgatgatagtcatgaaactggttaatcatgtcattttatcgctgtttccccttttgctttgccctccctaaatttactcggttctccgatcgattgactgttcttactgttttacttcccttccctaagaggtaac

SEQ ID NO: 5926 - DNA, 666 bp, Sorghum bicolor
  Clone ID: SORBI-28MAY03-CLUS29718_1
cagatccagaggaggcacttgcgttcttgggcaagtattgcaaatgggctgtggtgacacttgcttcaaagggatgcatggcaaagcatggcaaacaggtggttcaagtgccggccatcggggagagcaacgcggtggacacaactggagcaggcgacctgttcgcgagcggcttcctgtacgggctggtgaaggggctgccgctggaggagtgctgcaaggttggggcgtgcagcggtgggtcggtgacacgggcgctcggcggggaggtgcggccggagaactggcagtggatgtacaagcagatgaacgccaggggcctgctgctccccgagctcaagaactgagctaatgctagctgccgtagctgtagctagctgcatgctgcaccagctgttgtatctctctcagcactcctaagactcgtatcatcgcccaggagcaaagaggctattatccggcctcccattgttgattgttgcagttacctttcccctgatagtctgttactgttactagaatattggtgtccatgcctgattgctggcatggcaaaggacggacagccgggcaggcaggcaagcacattagttgatttgttgaagtaaccgcagtgccactcctaagactgaatcaatcaaatggagtatattgattactgcactt

SEQ ID NO: 5927 - DNA, 1004 bp, Sorghum bicolor
  Clone ID: SORBI-28MAY03-CLUS29782_1
ctgcgattcccttctgatccatgggatagggtttctgattcggccaaggaactagtcaccgggatgttaaggcgtgaccctagacaacgactcacggccaagcaggttctagagcatccgtggatgcaagaacacgcggaccaatcacaagattcctgcagccattgccacgagatcggcctccggcgggaggaccctggctcatgctccttctccatgccactagcgtcacggagcagggacatgagcttcaacacaggcggcgcgatcgcctgccagggcacgccagaggacgaggcgtgctgctcgcccacgttcgccaccgcctgcaggtcgtccttctcggcgtttgtcaccgacccagccccgtcgtcctgcctggcctccacctccggtggctctgggttctcattcggtggggcctgtgaaccgccctgtggaggtttcccattgcctgtgccttccatgccgagcttctcgttcttcagcgcgcaagactgcagcgagcctgaaccgtcggtggcggcggcagccgagaaagctccctgcgacgcgacggtggctgcctcgtccctgaggacggcaaaaggggccacgtcgcggggtgtcgtcggcgtcaacggcaggcggaaccacacgatcggcgccggcgggcgggagcacctggacgtggcggtgtcggagtccgtcatacgctgggcgtcgtgcaccaacttctccacgacgcactcgctccgggcctccctcgtgtgctagcaatagcaactatagtggtgttccacgcggcgccagcgggagctgggatcgatattgctttggccgttgtttgcctgtaaagcgcgatgcaatgcaatgcaaaggtgctaagggtgaggtgaatttgagtgtatgagatgagaggtagaagagtgtagcctggacttgtataatacatatttatacacacagtgctgttatagtggtaatagattaattaaagagtgctgatgtgattgcatgctgtc

SEQ ID NO: 5928 - DNA, 743 bp, Sorghum bicolor
  unsure (1)..(743): unsure at all n locations
  Clone ID: SORBI-28MAY03-CLUS29445_1
agcgaggcagtgaagtgagatttgtctcagcacatcccatgcaaacgattgtaacaaaattggaggagattgcgaaggtgaagagctntgcagttcgacggaaggactggcgggtgagcctggaaggcacgagagaaagtgaaaagggtccattgacaattggggctgaagtatttgagctcacaccaagccttgtggtggtggaggtgaggatgaaagcaggggacagggaagaatatgaggatttttgtgagaaggagttgaaacctgggatgcagcacctcgtgcaccatacagcctcggttccagatataccttctgacactgagtagcttaaaaggtagtgttctcttgattggaaggaatatgaaaaaagaaattggattgaaaggatgcacttttctgtttcagtgtaagcaatctgtgcaggaaaatgttattcatagatttccttagttatttctttttgttaatattctttccgcaatcaaagatgttttgcgatagtagttgtgtgccaatatcaatcatcaatctttttagttgtaagtataaaagttgtggccatttcactacagaattatcaaagctataactctaatgttattagccatgtaactgtgctacaattatgtacattcattcttgtacaaatgtcatctgtaaatttttggaagaaggaatattggcctcggtgtgtacaaaagaagagtgtaacttttgtaaaaaaaaaaaaaaaaaaa

SEQ ID NO: 5929 - DNA, 678 bp, Sorghum bicolor
  Clone ID: SORBI-28MAY03-CLUS29446_1
aagtagggatgtcaaactcttcatgcctcaggtcattgatatcttcaaagatgcatttgtggaatctactgatgagcacagtgacatcttctcagatatggttaattgcaaaaatggagaccaagagaaggattttcgaggaatgtattgtgcactgttaaccgcaagcacgcatgttgtgtctgctgcgattctgaaagtgcgcatggaacaaattgcagaactggtccttatcgccactcgtagagagtgcagaaaaaagggttacttcatacttctcctaaagtcaattgaggcaaatttgagagcctggaatgtaagccttcttactgcgcctgttgatcctgaaatggcgcaaatctggtcagagaagcttgggttcaccattttatcagctgaagagaaggagtcagtgctggagtcgcaccccttggtgatgttcaagaacctagtcttagtgcagaaatcacttgcttgagcaaatctaatctgtgtttgcttaacctggtttgtgatgtatggaagagaatttatctttgtacatagtgcagtttagtctaggagatgattcagggcacagacctttctagagactagacagtatggacatgagtttgtctatgtacctttttcttaagttagatactcctatgagaaaagaagtctagatgtattgtt

SEQ ID NO: 5930 - DNA, 696 bp, Sorghum bicolor
  Clone ID: SORBI-28MAY03-CLUS29448_1
agcagaccaaaagtggctaaatgaagatgtggaggtcgaggagggagaattgattgaagaggaccatcatgacatcatttctaaaagcaagcttaagccaagaaatgttgtactgaaatcagttattgaaacaggttcagcagagcagttgcaggtgaataatacaatgtcgaaagatgctgcttgcaacaacagagctacaagagaatgtgatgacaaacacattcttgaggtaatggaaaagatgcaaaaaaggagggaaaggttcaaagaggctattgcaccacaaaaagaggatggtgacaagaaagacctgtcgtctttagcatgcagtacagattatatccagaatcagcggcctgctaggaaacggcggtggggtggcaatagttggatgctggaaatgccttgagagtatgtccatgatgatttcttcaacaaggtgttccgcttatggtactcaaaatcttgtactgttttgtgtttatttctgatggctgggttagggaaacaaaatatagaaaacattagtcacttgaggtacttttatagcatagtatcttgcatagtttaagagtaaaagggttcaacttcaaatgtaacgtgtttgtgtcgggggtgctttcaaaccaccggggaatgatttactatcccctaagatataagatttaaatgatttcctttctgcaggctggc

SEQ ID NO: 5931 - DNA, 680 bp, Sorghum bicolor
  Clone ID: SORBI-28MAY03-CLUS29450_1
ggctcttgtcaagattcttcaaaggttgagcaacgtaaaacagcttaccgctgcaggaaatgcaggagagttattgctgtagaggacaatgttgtaagtcatgttcctggtgagggtgaatcttgctttgattggaaccgaaggaagagtggtcatccatacaacagcaaagaacaagattgctcatctttgttcgttgaacctctgaaatggatgactccagtagaagacggtgctttggaaggaaagctatcatgcatccactgcggagctcggttgggatacttcaactgggcaggaatacagtgcaactgtggcagctgggttactcctgccttccaaattgttaagagcaaagttgatatcagcaccatctagacctcgggtataggaccctcccctaccatcaacaactttgagagacgaggagcatggcactactggcgcctgtcggcttaatattttgtgtacaatatgaactatacagaatacaatgaagcagcgtcttgtatgtttttccattgctgatcagaagctgtgtgcagcgaacaccgtgtattagggatttgctgatgtaacaagttgccgtgatgtcggtgatctatatggctggaaatggatcgaatataatttggccagagaaaggcacacgaactagtgcattcaaatgcgtgcccaat

SEQ ID NO: 5932 - DNA, 807 bp, Sorghum bicolor
  Clone ID: SORBI-28MAY03-CLUS29495_1
tgctaattacatagaggagcaatattggccacctagtgattttgatcacttactatctgcaaaactgaaggacttgtccaccagtggcaaattgataaaggtgaatcggaagtacaggatatcacctagttcacccaattcagagggccgaagccccaaaatgctgctgttggaagatgtgcaaagagcgcctgtcaagatatggagcgatgatagtaaaacccttaccagatctcaagttgatgctgaattggcacgtatgtcaacaatgactgctgaggaagcttcagtggctgcagctcatgcagttgctgaagcagaggccatcatggcagaagctgaagctgcagcgaaagaagcagaggctgcagaagcagaagcccaagctgcgcaagcatttgctgaagcagcatttttgacattgaagaacagaaatgctgcaaaactgatggcctaaggttgatgctactcggactctcgggtgttcggggtgccagctagatttgtataactgtacacgtctactgttgttacagttgctcggcttaaagcagctagtagatttgtataactgtacaaagtgggagccatgtgaagctccggcctccagcctccagcgcaccagtagcagcattagctgtttgctacaacgccattcagagaacttagtggcataccctgggccctccactgtcgtgaacatgctaaactctgtcaatgtctaatgtttcgcggacggtttgcaggattgcattgtgcatcaacagcctttgcattgctgcgctgcctgccaacagtcgtaccgtt

SEQ ID NO: 5933 - DNA, 552 bp, Sorghum bicolor
  Clone ID: SORBI-28MAY03-CLUS29503_1
taacaggctgtaagcaggctgaatgctgatgtggatgagagagaggggggggggaggagagagagagatagcttacagccatcagccggccgtattattagccctgctctcagagaatgaatcagcctaagatcatgtctctccctagcatgtattgaaactgaagggatctgatgctcctctgggattagggtgtatgtcaactcaactcaactcaatgggtctttgggattagggtgtatgtcaactcaactcaactcaattggactatggacggcgggcctgaaagagtcatttactctggtttcatgcctccatctctgtagtctgtagtatactagcctgcgtgtgtttcattttctgcgtgttttctattgtgaagatattctgacaccagaatatgatggcgtgaaataatcattcatttgtttgcaactgttggtggcacaaaatgcaataggtgttaccatcatcgttgtataattgcccctcaggcatgctactgcaatgaaccaatgatcattgaatatttcatgttatgcaatttaggtc

SEQ ID NO: 5934 - DNA, 634 bp, Sorghum bicolor
  unsure (1)..(634): unsure at all n locations
  Clone ID: SORBI-28MAY03-CLUS30062_1
cgtgctccttgctcccccgtccatgctttcgcactagtcaagggctagtccagtgccctggctgaaccccgcatccggagctcacagagccgccccgccaccggagctcggcggagacgatgccggagacacacccgccgccgccgaggccggtgatgctcgccgacctcaacttcgaaccggcggagagcgatggcgaggaccgcccaccgacccccacacccaaccccgccgccaccgccgccgtggccgttgccgcggctccggcggtcaccactgactccttcacgaggagtggcaatgaggagggtggtttgatgaaaaatgtgattgctacaaaggacaccgatactgttgaatgtgaagatgctgatcaacattgtcaaggggcttctgctccacgtgaggaaaaagttagcaacctgaaagctgctttggttcatgtggcccgaaaaatgcctaagaatgctcatgcacattttatgttgggtttaatgtatcanaggcttggtcaggcacagaaggcaatagcatcatatgagaagtcaactgaaatactgctacaagatgaagaagaagtgcggaggcctgatttactctcatcagtgaggatacaccacgcacagtgcatttt

SEQ ID NO: 5935 - DNA, 666 bp, Sorghum bicolor
  Clone ID: SORBI-28MAY03-CLUS30080_1
gtcattctatgatctcgcacttgatgccaaaggatgttctgatgtctatgcatcatttgataagtatgttgcacaggagaggttagaaggcgataataagtatcaatctgaggaacatggtctacaggatgccaagaaaggaatgctttttattgacttccctccagttttgcaacttcagttgaaacggtttgaatatgattttgtgcgggatacaatgctcaagataaatgaccgttatgagttcccacttcaattggatcttgatagagatgatggaaaatatctttctccagatgcggatagaagtgtgcgtaacctatatactcttcacagcgtgctggttcatagcggcggagttcatggaggacattactatgccttcattcgcccgaagctgtctgatcaatggtacaagtttgaggatgaacgagtgacgaaagaagacatgaagcgggcattggaggaacaatatggtggtgaagaagagcttcctcataccaatgggcttaaaaatgctcctatcagatttacgaagcattcaaatgcttacatgcttgtttacatccgagaaagtgacaaagagaaaatcatctgcgatttagatgatgaagatataccagaccaccttaaggttaggttaagaaaggaacaggaagagaagga

SEQ ID NO: 5936 - DNA, 827 bp, Sorghum bicolor
  Clone ID: SORBI-28MAY03-CLUS30146_1
gcacgaggctctctcctcccgcggcggctgcggggctgggagagacgacgacgacgcacgcagaaaaacaaccgctcccgccttgcccctccctcctgccacggccagcagcccgagcgctcgcttttttgaccgcgtctacccctcctccccctcgcacacttgcctctgatccagtgccactacaatactctactgctgcgcgctagcggtagcgctcacaccactcgcgcaagtatacgccaccgctgctgccgtgctggttcctcctcgcgctcgcattgcgacctagctagcgcgaggggaaggcggggggtggtgcgcgtgctccgtgatctgggaagcgccgcagcgagatggccgggggtggaggcggcggcggcggcggcggcgggccgaagcatgatgacctcacgccgcaccccgtcaaggaccagctcccgggggtctcctactgcatcaccagtcctccgccgtggcctgaagccgttcttcttgggttccaacattatctggtcatgctgggtaccagtgtgatcataccaactgcactagttccacaaatgggaggaaacaatgaggacaaggcagtggttatccagacattgttgttcgttgcaggcatcaacaccctcctgcagagtttcttcggtaccaggttgcctgcagtggttggggggtcatacacctttgttctgcctaccatctcaatcatccttgctggacgttatgctaatgaacccaatccacacattaaatttctccgcatcatgcgagggacacaaggtgcattaattgtggcttcagccttacagattatagttggg

SEQ ID NO: 5937 - DNA, 534 bp, Sorghum bicolor
  Clone ID: SORBI-28MAY03-CLUS30190_1
gcacgagggttaaatcaagacatgaaacaagaaaaggacagaggagacacaatttagatgacagaaggaatgctatattcgttgaaaaagaaaaaccaacagacagctatcctagtaggtatgatcggaagtatgagaagagaagatctagctcatcttccctgaggactaactatcacaattcagttcgcaatcaatcttatgaacaacgttattcgcctcttgaaagaatagctctgaaaaatgacgagcattactttagcaatgagtctaattaccaccgtagacaatctttgtcatgtgacatcagtgaaggagaagatgttgatgagtgcttctcttcagccaatgagtggcagcgagatcgtgatcatatataccattcaatggtaaaaactgatatgcctgatgctgatgatggacaaatgtacagagaaaggtatagtcaggaaaagagaagagccatacatgaccgtagcatggatgttgaattttcccattacactgactacagaatttgcgaatggcagagtc

SEQ ID NO: 5938 - DNA, 676 bp, Sorghum bicolor
  Clone ID: SORBI-28MAY03-CLUS34067_1
aaaaagggaaaaggaaacaaaaaaaaaccgtcagcacgagggtcggctgtagtgcagttgcaggtgttcgccggcacacgcgcgcggccgcgaaccctagatgacgccggcgaacggcgccccagcgccggcagcggagtctgtcccccccgaggtggagtcggaggccgatgcgttccggcgccaggttgacgacctcgtctcgaagaccgacgtgctggagaagcgggtgaaagaggtggtggacttctatgatggcaagaagcacggaagcggcgggcggaagggcggcggtggcggcaggcacggggcatactcgagggggatgcccgaccttatgcgccagttcggcgtgcttttgaaagagatcacctctcataaagatgcatggccatttctgaagccggtggatgttgtaaccctgcacattcctgactatcacaaaattattacccaacctatggacttctctaccatccaaaagaaaatggaaaggaaagatggtacctgttacaccaatgttcgagaaatatgttctgatgttcgattaatttttgccaatgcgatgaagtacaatgatgatcaaaatgtagtccacttgatggctaaatcattgcttgagaaatttgaagagaagtggctccattttcttcctaaagttgagagtgaggaaaaa

SEQ ID NO: 5939 - DNA, 636 bp, Sorghum bicolor
  Clone ID: SORBI-28MAY03-CLUS34258_1
gaagaaggaggagaagaaagaggagaagaaggacggcgacgggaagaaggaggaaggggacggcaagaaggacggcggcgacgggaagaaggaggaaggcggcgagggaaagaaggaggaagcaggtgatggcaagaaggacggcggcgagggaaagaaggaggacggagatggcaagaaggaggaggacggcaagaaggaggaaggcaagaaggaggacgagaagaagcccgccgcggtggcccctccatggatgcaccaccagcaccagctgccgccgcagtacatgcacatgctcaccgccgactacatgaaccagtaccaccgccccccgccaccgccgccggtgtaccacccgtacgtgccgccgcagccgcagtactactacatgcgcaacatgagcatggaggagaaccccaactcctgcgccatctgctgatcgaatcccgacggagacgcaatccccgccgccgccgccgccgtccggccgcttttctcgcgctgcatgaggccctcgcgcgcgaaaacgtagtacgtattacgtgtcctgtcccgtccatccatgtgtacatccgtcgtgtagccgtgttattattatgagatgatgagaagacagacgaatcaaaatactactac

SEQ ID NO: 5940 - DNA, 753 bp, Sorghum bicolor
  Clone ID: SORBI-28MAY03-CLUS34322_1
gcacgaggccccagaatactttctttggaacaaagaggttaatcgggcgacgctttgatgatcctcagacacagaaagagatgaagatggtgccattcaaaatcgtgaaggctccaaatggtgatgcttgggttgaaacaacagatgggaaacagtactcaccaagtcaggtcggtgcatttgtgctgaccaagatgaaggaggcacgaggatcttaccttggcaagtctgtctcaaaggcagtgattactgttccagcttatttcaatgatgctcagcgtcaggccacaaaggatgctggccgaattgctggccttgatgttgaaaggatcatcaatgaacctacagcagccgctctgtcctatggaatgaacaacaaggaaggcttgatagcagtatttgatcttggaggaggaacttttgatatctctattctggagatctcaaacggagtttttgaggtcaaagcaacaaatggtgatactttcttgggtggtgaagattttgacaacacactacttgagttcttggtgagtgatttcaagaaagctgagggcattgatctgtcaaaggatagattggccctgcaaaggcttcgtgaagctgctgagaaggcaaaggttgaactttcatcaacttctcagacagaaatcaatctgccattcataacagctgatgcttcaggggcaaaacatttaaacatcacactgacaaggtcgaaatttgaatctcttgtacacaatctgattgaga

SEQ ID NO: 5941 - DNA, 766 bp, Sorghum bicolor
  Clone ID: SORBI-28MAY03-CLUS3414_1
gcacgaggtttgaaggtttcttctcttctccgggaaaatttcagatcccggaaacaactggaattgaagttccccctgtcccgcctgcccggtcccggcgccctcccctcccgcccgggccttccgcggcgcggctccctggccaccgaaatctctaggcgacgaatcgagcaggtagaggaggaatcaggcatccatggctgagcatcttgcgtccatctttggcacggagaaggaccgcgtgaactgccccttctacttcaagatcggcgcgtgccgccacggcgaccggtgctcccgcctgcacaacaagccgtccatctccccgacgctgctgctgtgcaacatgtaccagcggccggacatgatcaccccgggcgtggacgcgcaggggaaccccatcgacccggagcggatccaggaggacttcgaggacttctacgaggacatcttcgaggagctgagcaagcacggcgagatcgagagcctccacgtgtgcgacaacctcgcggaccacatgatcgggaacgtgtacgtgcagttccgcgaggaggagcaggcggcgcgcgctgcaggctctgcagggccgctactactcgggccgccccatcatcgccgagttctcccccgtgacggacttccgggaggccacctgccgccagttcgaggagcacagctgcaaccgcggcggatactgcaacttcatgcacgtcaagcaggtcggacgggacctgcggcggaagctgttcggccacctgcatcgctc

SEQ ID NO: 5942 - DNA, 452 bp, Sorghum bicolor
  Clone ID: LIB3481-022-P1-K1-H2
cgtccgttctcttctccgggaaaatttcagatcccggaaacaactggaattgaagtagccactgatgctgttgccgtgttcttgagctcatagattgctatttgttaatgctcaaattgtgtgcctgaccacagaaatctctaggcgacgaatcgagcaggtagaggaggaatcaggcatccatggctgagcatcttgcgtccatctttggcacggagaaggaccgcgtgaactgccccttctacttcaagatcggcgcgtgccgccacggcgaccggtgctcccgcctgcacaacaagccgtccatctccccgacgctgctgctgtgcaacatgtaccagcggccggacatgatcaccccgggcgtggacgcgcaggggaaccccatcgacccggagcggatccaggaggacttcgaggacttctacgaggacatcttcgaggagctgagc

SEQ ID NO: 5943 - DNA, 789 bp, Sorghum bicolor
  Clone ID: SORBI-28MAY03-CLUS30349_1
gcacgaggctcttgcgcgcgcgtgacaacctccctccacgggcgcgcggcgcgggagcagcagcggcagcacccaccgactgatcgccggtggggcggggcgggggcgatctgatgccggcgcggcggtgatggcagcgccgtccggcggtgggggcggcggtgcgggggagcgcgccgcctcggccgccgcagctgcgacgatcggggcccacggggtggaccaagtcgcagaggcgatgtggcagatgaatttaggagaaaccatggcccccatggaactggggccatacccagagcgtgttggtgagccagactgtagctattacatgaggactggcatgtgcaggtttgggatgacctgtaaatttaatcacccagcagacagaaagctggctgttgctgctgcaagaatgaagggagaatatcctcaaagaattgggcagcctgaatgtcaatactacctgaagactggcacatgcaagtttggagcaacttgcaagtttcaccatccccgagaaaaggctgcaatggcaactcgagttcagttgaatgaactgggctacccactccgcgcgaatgaaaaggagtgtgcttattatttaagaacagggcagtgcaagttcggaagcacatgtaagtttcaccatccacaaccatccaccatgatggttgctgtacgtggctctgtttattcacctggacagtctgcaacttctcctggccagcatgcttaccaaggggctgtaacaagctggcccttgtcgagatctgcttctttcattgcaag

SEQ ID NO: 5944 - DNA, 678 bp, Sorghum bicolor
  Clone ID: SORBI-28MAY03-CLUS30378_1
gcaccgcggttgccccaccaaaaacctcccctccgcctcgcgccgccgccgccgccccgagcgcgccatggcgccgccacgcccgccgctgccgctgatccacgacgtcatggtcgagattttcctccgcctcccgccggacgagcccgagcacctcttccgcgccgccctcgtctgcaagccgtggctccgcatcctctgcgaccccgggttcctccgccgctaccgcgccttccacggagcccctcccctgctcggcctcctccacaggctcaaggtcatgcaaggagaccccgagccccgcctcacccccaccacggcggcgcccctctccccgtaccccgaccgcggccgctcgcgggccctcgactgccgccacggccgcgtcctcctccacgtgcgcgccgtcggctggccgttcggcctcgggggcccccccgccgccggcgaccgccgccccgtgcccccgcccgtcccggggctgtgcctctccggcgcggcgccgggccccgggcccgcccgtggccgcctccaccgccacggccgcggtggccccttccgcgtggtcttcatggccacccatgattacaagcctaccatatttgcttgtgtgtactcctcggagacgggtgcgtggagtcagcagatatctcttgacagcagttgtgaacactatgc

SEQ ID NO: 5945 - DNA, 704 bp, Sorghum bicolor
  Clone ID: SORBI-28MAY03-CLUS30379_1
gcacgaggctttcctcctcgcctccgcctccgccttccccgcccgcggctcaggcaggagccagacccaaacccacgaaaccctcctaccacgccgccgcttcctcgtcctcccgacggccggtccggaacccggaccaaccttcacgagggcggaaatcggactagaggggcaggatgccgccgaagaaagcggcgccgtcgaaggcggagctggccaagaagcagaaggtcgtggaggacaagaccttcggactcaagaacaagaacaagagcaagaacgtccagaagtacgtccagtccctgcaccaggccgtccagcccaagcccgacgcgtcgaagaccgccgccaagaagaagaaggaggaggagaaggcgcgcgagaaggagcttaatgatcttttcaaggttgccgtcagccagcctaaggtccctgttggtgttgatcccaagtcaatagtgtgtgagttcttcaaggctggccagtgccagaagggttttaagtgcaaattctctcacgacctgaatgtccagaggaagggtgaaaagattgatatctacacagacaagcgtgatgcagaaaccatggaggactgggatcaggaaactctcgagaaggttgttgaatctaaaaagatggagtatcagcaaaacaaacctaccgatattgtatgcaaatactttcttgacgctgtggagaagaaa

SEQ ID NO: 5946 - DNA, 683 bp, Sorghum bicolor
  Clone ID: SORBI-28MAY03-CLUS30391_1
atccagaggacgaaagaccaaaagggcgctgaaagggaggcgtcggcgtggcggcggcggcgacgcgatgcgatcctgatccaccacaccacacatctcgaggagggtcccggaggcccgtccagcgtccacccgctcccgccccgccccccttcgcgccgccgcggcccgtggatacagccaccgccaccgccatgggagcgctcgaggaggcctacctcgcggacgccgcgtgcgcgtgcgaggaggaggaggaggaaagcgacgacctcggcctgctcgccggggacgccgcggcggcgggcgacgccatcgagccggcggtgcgcgcgctgctgctggggctcggcgaggacgaccgccgcgagggcctgcgccggacgcccaagcgcgtcgccaaggccttccgcgacggcactcgaggttacaggcaaaaagtaaaggacattgtgcagggtgctctgtttccagaggttggtgtggacaaaaggactgggtctgctggtggaactggtgggcaagtagttgttcgagatattgaacttttctcatactgtgagtcatgcttgcttccattcagcatacagtgccatgttgggtatgttccctcaggtggaagggttgttgggttaagcaagctttccagagtatctgatgtctttgccaagagattgcaaaaccct

SEQ ID NO: 5947 - DNA, 652 bp, Sorghum bicolor
  Clone ID: SORBI-28MAY03-CLUS30436_1
acggacaggtagcacgagggccaccgcagccatggccgacgccacgccgtccatcccgagcgccatcgcctccctccaggcctactccacggccctctccgccttcaccgccgcatggcgtgccgtcgagacccacgcctccagcctcgactccaccctcgccgcccgcctagccggctacaccgagctcgagctgatctgctcggcgatggacggcgccggcctcctcgcgtacctcaccgagcacagggacgagctcaaggagccagcgcgcgccctcgacgccgccctccaggtggcgcccgacccggggcttctggtcctctctgcggccgcgactttctgccgcacgccgccggagaaggccaagaacgacggtagcgtcaaggcgtcctgccgcctgctcatggccttgctcgaccggctgcgcgcgattgggttcaagccgtcgcctgaggcacgcgacgaggccagagctgtcgcggcggactggaagcgaggcaagcggatcgggacggaggtgatgtttaagcaggagacgttcgccttcttgcatctcgtgggagtgtttgggctcgtggaggatgtgggcggtgccggcgaggtgcttgatctagtcgtgtcgatctctggtcgtgagcgcgctgttgag

SEQ ID NO: 5948 - DNA, 942 bp, Sorghum bicolor
  Clone ID: SORBI-28MAY03-CLUS298_1
gcacgaggccacgtgcggcgcacgcgctcacagctcaggagcgagccggagagcaagccatggccgcgggagccgcgttgtactaccacccagccgccgggaaggcgagcctcgggtcggtcgccgccccctcgccgtcgctggccctgaggccatcgcggagcaaggtgctgtgcgtcagcagcggcagccggtggtggatgaggcgaagatgggaggggaaggcgagcagcgtcagcagcggggcgagagcgagagcaagcgcaaggcctgccttgttctctcctgtcgccatggactggcaggagtgcaccactgagcttgaagttgatgttccatgctcggtggcctatcagtgttactcagaacgggagaccattcctcagtggatgccattcatctcgtctgtcaaggtccttgaagataaacctgatctttcacggtggactctgaagtacgaggtccttgggcgggatgtagaattttcttggcttgcacgtaacatgacaccaactaaaaaccagaagattcattggcgatctcttgaaggtcttcctaatagaggtgctgtccggttcttccccaaaagctcatcctcgtgtagagtacaactgacagtggcatatgaagttcctgaaattttggccccagttgcatcagcactgaaaccgtttctggaaagcttgcttctcaaaggtctagaaagctttgcaacatttgctaaggagcgtaatagcaagattcctcaggcttgacagcgtcactcttctgtgttcaacactccataacaataattctagtttcgttctagtgaagccattgaatccacatcacaatgccacaatagatgtaaagattgcgtaatgtcattctggatgtggccaaataatgtatcaaaaaggaagagaatacatgtgtgaatacaaatatgtcaaaagttgg

SEQ ID NO: 5949 - DNA, 843 bp, Sorghum bicolor
  unsure (1)..(843): unsure at all n locations
  Clone ID: SORBI-28MAY03-CLUS29822_1
anaccatgtatattgggcttggaagattatggtatcgttcaccagctagttactagtgtctcaaatgtttcatcagagtaccatcgtcagctgcttgaaaataccatgttatgtggtggcaccgcatcaatgactggctttgaggacaggttccagagagaagcagatctgtctgcttcagcaatctgtccatcacttgtgaagccccctgaatacatgcctgagaacctagcaaggtactcggcctggttgggtggtgcgatcttggccaaggtcgttttccctcaaaaccagcatgtcaccaagggcgagtatgatgagacggggccgtccattgtgcacaagaagtgcttttagagacaactaccttgaactaggacggttggtgcaccgtttgctgctgttcatgtcacaggtgtgctcatacctgaatattgcaggtgtgatgcttgtgtgtacaccttattccagccacagttgatacctgactgttgcaaagtattgatgcatctagctcggttaggctgttattgcccctagggtttattcagagtgcaatagagtgtaacatcgacatgtatttgttaggagttttaggcaattgcccatttgtacctgtagtatcagagaatttgctgagatttccttttcaatttacattatgatccattatctgttcagctactacttctttggatcatgctcacaaattaagcgcgtcacagttcaggccacataaattgtactcaagctttgttagcgcggcaccccatgtcatagatcctttttttgggctaaacttnntgtaacaggtgtggtgttcaatttattcgccacacttat

SEQ ID NO: 5950 - DNA, 497 bp, Sorghum bicolor
  Clone ID: SORBI-28MAY03-CLUS29870_1
gaggagcataagatgattgtgtttgaaaagggagatttggtatttgtgttcaacttccactgcaacaacagctattttgactaccgtattggttgtcgaaaacctgggatgtataaggtggtcttggactcggacgctggactatttggtggatttggcaggatccatcacgcagcagagcacttcactaccgactgttcacatgataacaggccccattcgttctctgtttatacaccaagcagaacctgcgtcgtctatgctccagcggaatgatagcaaggtactggttgctgggcggcatgtgtggggctgtcgatgtgagggaaaaaaaaaacattctgccaacaccggcagatgcatgcatggcacaataaggttctgaaaattcaatcgttgctggaaagcccagacatcccgctgcgttgtcatctctatatatttaagaccttcaggatgtcaattaaacatggccttttctttttcgttttccctaa

SEQ ID NO: 5951 - DNA, 805 bp, Sorghum bicolor
  Clone ID: SORBI-28MAY03-CLUS29961_1
tactggagccgctgcgttccgtgcctgtactcgcgggttctcctcggccctgccccccaatcgctgcgcccgggcgccgctttcgccgccggatctgggcgccggacggtacccctgacgaatcgatggcgcgagctgcgctccgattgggcgcccgctcccgcgcgctcgcgctcctcgtcctcgtgtcagtggctctgcttccacctgtcagttccgacgatgggtacaaacactgcgagggtgtcgtcagaggctgggcggattcctccactgggcgcgagaaggacggggacaaactgagcctcaaggatttgctcttcttcctccacattcctaggactggaggccgcacctactttcactgcttcctcaaaaagctctatacaaatgcgcaggaatgcccgcgttcttatgacaaactacggttcgacccaagccatcctgattgcaagcttgttgttagtcatgatgactacagcttgacgtccaagctgccaagggagagaacttctgttgtaacaatactaaggaacccagttgatcgtgtatttagcacatatgagttctcagttgaagttgcagctagattccttgtgcacccaaacttaacttctgcaaagttaatgactacccgtgtgttaacaaagtctcgtgctgtcagtactttggacatctggccttggaagtacttggttccatggatgagggaagatctgtttgccaggagagatgccaggggtggtgacaaagttcatagtagtaagaaggttaatgcatatgatgtggaggatatggttatgcc

SEQ ID NO: 5952 - DNA, 566 bp, Sorghum bicolor
  Clone ID: SORBI-28MAY03-CLUS30026_1
cctactgggactctccagcgcgcgccagagtggtggcggcgactcctgtgctgccactgcgagcgccggcgcgaccgcaccggcgaccttcagcagcccgcagggatccccgcgtttgttggcaggaaatgcctacgaggaaaaagggaaaggcggacggtgcggcggcagcggcggcggcggcgccggatgctggcgtcgatcgtatcagcgcgctcccggacgacaccctccatcacgtcctctcgttcctgcccgcggaggacgccgtgcggacatgcgtgctcgcccggcgctggcagcatctctggaagtccgccactggcctgcgcatcgggttcagcagccatggggatgcaccgccgtccgtggacagtctcctacacttcgtccaccatctgcttctcctccgcaagcgcgactcctgtctccacacatgcgagctcaggttacggtcccggtatgtgaacagctggtcgattgacgaggggatcaatctgaatctttggatccgacatgttgtagagcagcgtgaagttcggaggctcaggctcgaaatccatgac

SEQ ID NO: 5953 - DNA, 1038 bp, Sorghum bicolor
  Clone ID: SORBI-28MAY03-CLUS30075_1
aggacaaagcttcgtcgactccctcgtcctccctcacctcctcctccgcttgcttctccgcgatcctcccctttcccgcgacttcctctttttcaaaaatcctcgctagtctcgtgccccgttcgttctacccacctctaccctcgaatcctagcgcctcgcctccgcatcctagggtttgcccgcccccgccgccggccatggacgcggtggtcgtcgacgcgggctccaaactgctcaaggccggcatcgcggcgcccgaccaggcgcccccgctggtgatgccgtcgaagatgaaggtggatgtggaggaccaggagctggccgacggcgccgtggttgaggaggtggtgcagccggtggtgcgcggcttcgtcaaggactgggacgccatggaggacctactcaactacgtcctctacaggaacattgggtgggagattggggatgagggccagattctcttcaccgaaccgctcttcacacccaagactcttcgggagcaattggtgcagcttatgtttgaaaagttcaatgtttcaggcttttatgcctctgaacaggctgtattgtcactctatgctgttggacgcatttcaggatgtacagttgacattgggcacgggaaaatagatattgctccagtttgtgaaggagctgttcaacacatagcttctaagagattagagattgggggggttgacttgacaaacctgtttgcacaagaactgaaaaaatccaatccatcagtaaaccttgatgtttctgatgttgagaggctgaaagagcagtatgcatgttgcgcagaagatcagttggcttttgaagctataggaagctcttgccaaccagaaaagcacactcttcctgatgggcaggttataacaattgaaaaagagggatacattgttggtgaagctttatttcaaccatgtatattgggcttggaagattatggtatcgttcaccagctagttactagtgtctcaaatgtttcatcagagtaccatcgtcagctgcttgaaaataccatgttat

SEQ ID NO: 5954 - DNA, 531 bp, Sorghum bicolor
  Clone ID: SORBI-28MAY03-CLUS30594_1
atttcagcccactgttgctgttggaagggatggatcagacaacagggaagttaccaaaaatagttgcaaaatatttggcatatctttgactgagaaggttccagcaatcaaagaaaaggactgtggtgagaccaactatccatcccccttcctgtctttgaagcaacacgtgccaaaatcgctgggcaacagttgtgccactattcatgagcagaggcctgttgttggtagggtgattgatgtttcaacagtggatatgatgatctgatctgttggaaaagttgtcctgaaggctgtattgtgtagtgtggatagtcaggtggttgatgatccggtatgatgaaggtggatggatcaacgacgctgatcaaacatgtatcctagttgtagctgttagagcactttgtatgacaaccgtgagtgctccatgttatcagcatttgttgctgcttacaacttgcctctatgtttataagccgtatgctatgacaaacccatttatagagtgtttatttgcattggcatagttct

SEQ ID NO: 5955 - DNA, 681 bp, Sorghum bicolor
  Clone ID: SORBI-28MAY03-CLUS30612_1
tagagcagaggttagatatcgccgttgacatcacagatgcattggactacctccataatggctgccatccaatgatcatccactgcgatctcaagcccagcaacattcttcttacccaggacatgagggcttgtgttggagattttggcatcgctagaattctaaatgaagctgcaaaagaaacttgtgtgaattccaatagtaccatcggcgtaagaggctctatcggatacgttgctccagaatatggagaagggcttggagtatcaactcacggtgatgtttacagccttggcatcgttttgatcgagatgtttacacgaaggcgcccaacagacgacatgttcagggacgggttaaacctgcattactttgttgaggcagctgcacttcctggtcaggtgatggagatagcagattccagaatctggttgtatgaccaagcaaaaaatagcaatggcacgagagatatttccagaaccagggaatgcttggctgctattatccagcttggtgtgctgtgctcaaagcaatcacccaaagatcgtctgtcaataagcgatgccgctgtagaggtgcataatatcagagatacatatctctgtaacatggggatgaaacatcataagtacgtgaaggaaataagtgtctaagttgtactgtataatcacaaaaaaagta

SEQ ID NO: 5956 - DNA, 636 bp, Sorghum bicolor
  Clone ID: SORBI-28MAY03-CLUS30618_1
ccccgattcagtctggatgctgcaagccaccgacatcatgtgcattcacctatatgaacgagacgtactggacacaaaaccctggtgtgccgactgtgatgaatgaccctgactgcagcaggtggagcaacgaccagcagatgctgtgcttccagtgcgactcatgcaaggctggcgtcctagcgggcatcaagaagagctggcgcaaggtggccatcctgaacatcgtggtgttgatcatccttgtgatggtctatgtcgcgggctgtgccgcattccgcaatgccaagaggatcgagaatgacgagccgatcggcatggcacggatgaccaagtcccatcttagcaggttccagttctaggcagctgctgctgcgggtttggaagcttttgccttgtacaaatgatcacaatgggtggtgctaaggcttaggctttgttatatcttactgaaatgtggattctactgcatttggtggtgaaaaggggaagttcagtgtggtttgagtttgtgtttgtgtttgctttagtgtttagggtaggcctattatgttgtaggggtacaatatgagatctgcaaagaacaagagaagttaaatcatctaggagctgttctgtattggagatttttaaatt

SEQ ID NO: 5957 - DNA, 497 bp, Sorghum bicolor
  Clone ID: SORBI-28MAY03-CLUS30639_1
gcacgaggggcacgcacgaggcaaggctgcaggcggcccgccggctgctggtgatcctgctcgctctgatctttctcctcgtcgtcgcgcccgctcaagccgctcgtttcacaagtaaccttttggccccgaactatttgtcctctcttcctttcatgtgtgttaatctcgctacgtactagatgttctggagatctgaactgcagctgtggtgattttgttgtggacggcgcagggggcttcagagcgaggatcggtgaggctccggcgttagagggtgcgcaagtttcagcagaggtacaggtacttgactatctagatgcaggagtccgtagtacagataaaaagccttaagaggtagcggcatatatatatatattttttgttcaaagtcggatcttttttcttcttcttttttgaacaaaatatggcctggagaaattatttgtgcctttgtatagtgtggctaagagcagaagttaacgacacatgcatgg

SEQ ID NO: 5958 - DNA, 656 bp, Sorghum bicolor
  Clone ID: SORBI-28MAY03-CLUS30623_1
cgactcgcaccccacccgcagcagcagcttcccatattcttcgagcacggtgtccaacagcatgcagaagatggccggacttgccgtcctcgtcttggttgcgctgctcgccgccgccactgctcaagcccaagggtcctacggctatggcaaatctcctgctcctgcagcaagcccgccggagagcgcccccatgccgccgccgagctcaagcccaccaacccagactcctccacctccggcttctcctcggacaaggctgaggttcgacttctacaagcggtcgtgcccttacgccgaggaaatcgtcagggaggccgtcaggaacgccaccaacgtcaaccccggcctcggcgccggcctcatccgcatggccttccacgactgcttcgtccagggctgcgacggctcagtgctgctcgacccgacgccggcgaacccacggccggagaagctcagcccggcaaacttccccagcctgcgtggcttcgacgtggtggacgcggccaaggcggcgctcgagaaggcctgcccgggcgtcgtctcctgcgccgacgtcgtccagttcgccgcccgcgacgccgccttcttcctcagcggctccaagatccactacagcctccctgggggacgcttggacggccgcgtgtccgtgg

SEQ ID NO: 5959 - DNA, 572 bp, Sorghum bicolor
  Clone ID: SORBI-28MAY03-CLUS30646_1
gcacgaggccaatcaagtgacagaagcacatcaggcggaactacaagtactgacagaaagaccattgatactgcaagcattcaagatgtggatcaagtgaagtcagatgaaaatggcgcaacacctgaagatcttagaggcaacaaagacaattgtagtgttcagtttaaaaggcaagattcattgaaatccatacatgttgatcaccatcccagaccagagagcaaacaaccaaagatcattgagaagataatgaccacccttagagaggagagcaggctgagagaaatcaactctcctgtcagaggtggtgtaaagccgagttctggcctcagcagcaataatcaagtagagcaaccattacaggtttcaaggacaaacagtgacatgccatgcagcttaaagtctggcaacattctatcccatgatgaacatgtaaatgaagtggaagcatcaccacccttgaagcaactgtcacctattgttgaacatagtgcaaagatgaaaaccgctgggccatcaactcctgaacctgccaaacaaatcacagaaaatggggctgcagcttcagg

SEQ ID NO: 5960 - DNA, 635 bp, Sorghum bicolor
  Clone ID: SORBI-28MAY03-CLUS30191_1
cctactggaggtcttcctctcttcctccactcggcagatttcactgactcccaccggcggtctccgcctcctccgccggccgccgccatgccgcacctcgtccgcgagcggctctacttcggcgacatcaaagacgccatcgccgccctcacggagtcgtcccccacgccgcacttcacccacgtcctctccgtggtcagctccgcctccatctccttcatcaccgactgccgcccaggcccctcgattcccaccgaggaggtccgccgcgtcgtcgccggcgagaagggcgcgccgccgaccgcagccgtggcccccgggacgctgatgcgggtggtggagcgcgcgggccaggggctgcgggtcacgcgcatggccgtgccgctgcgggacaccgaggaggaggacctgctcgaccgcctcgagccctgccttgatttcatcgatgagggcaggaaggtcgggaatgtgctcgtacattgctttgctggggtgtcgaggagtgcttccatcattgttgcttaccttatgagatcagaacagaaatctcttgaagatgcattagaagctttgaaggagatttcagagtcggcatgcccgaacgatggctttcttgaccagctgaaattatttga

SEQ ID NO: 5961 - DNA, 646 bp, Sorghum bicolor
  Clone ID: SORBI-28MAY03-CLUS30244_1
gtccccgtcccaatttgttgcggcgggagagcagctctagagaaacagaggcacgaggatttgttgcggcggtgcggcggcgggtggtagcggcgatgaggatcgaggaggtgcagtcgacgtcgaagaagcagcgcatcgccacccatacccacatcaagggcctcggtctcgacaccaatgggatggcgatttcgttggcggcagggttcgtgggccaggcggcggcgcgcgaggcggctgggctggtggtcgacatgattcgccagaagaagatggccggccgcgcgctgctacttgcgggcccgcccgccacgggcaagacggcgctatcgctcggcgtagcccaggagctcggcagcaaggtccctttctgtcctatggtaggatcagaagtgtactcctcagaggtcaagaaaactgaggtgctgatggaaaatttccgtagagctataggtttgcgtataaaggaaaacaaagaggtttacgaaggagaggttactgaactttccccagaagaggctgagagtacaaccggtggatatgcgaaaagcattagccatgtaatcattggcctaaagactgttaaagggactaagcaactgaagttagatccttccatttatgatgctttgatcaaggaaaa

SEQ ID NO: 5962 - DNA, 800 bp, Sorghum bicolor
  Clone ID: SORBI-28MAY03-CLUS30236_1
gcacgaggcaacatatggccttgttatgtctgggagaaattgggaggaggaaggacctcagcaatcatgttcaaattgagaacattgtcattgaatcatttcaatcaccttttgaggagattaagtctgcagcatcctatgcacttggaaacattgctgttggcaacctctccaagtatttaccatttattttggatcagattgacaatcaacagaagaagcaatatctgttgctccattcacttaaagaggtaatcgtgcggcaatctgttgatcatgctggccagagtgagctccaggattcaaacattgagaagatattggcattgctcttcaatcactgtgaaagtgaggaggagggagttcggaatgttgttgcagagtgtttaggaaaaattgctttaattgaaccaaaaaaattagtccctgctttgaaggtacgcacatctagcccagcagcaaatacaagagctacagttgccattgctataaagtattcaattgttgaacgacctgagaaaatagatgaaatcatgtactctgagatatctactttcctgatgttgattaaagacagcgataggcatgtgagaagagcagcggttctggctttgagcacagcagcacacaacaagccaaatttgataaaaggtcttcttccagagttattacctcttctatatgaccaaactgttattaagcaagagttgatcaggacagttgatcttgggcctttcaagcatgttgtagatgatggtcttgaacttaggaaagctgcatttgaatgtgtggacacttta

SEQ ID NO: 5963 - DNA, 1494 bp, Sorghum bicolor
  Clone ID: SORBI-28MAY03-CLUS30256_1
gcacgagggagcgccgagcgcgatccctcccgtccgtgtcgccccctctgcgctccgccttcctcttccaccccgtcgcttccgtgccatccgcggctcgcctccccacctcctattcccgccgccccatgcctccggcccgcccgtaggccgcccgacgacgaccgccatggccgccgattccggcaaagggatggccgacctggagatcgggccggcgtcgccggtctcggagggggcgccgtcgccggcgtcgagcgcgggcgcctccggggagcggcccgaccagtcgccgtcgctgctggccaagcgcccaggcctcgtcatgtccttctccgggaagcggctggaccagtcgccgggcgggtcgccgtcgcagtcgcgcccggtgctcgtcatgtcccacccccgcaaccgcctcgaccagtcgcccgcgcgcccggtgctcgtcatgtcccgctccagcaataggctggaccagtcctccccggcgtcatcgccggcacgcgtgagggggcccgtgctcgtcatgtccggctccagcaatcgtctggagagctcgtcgccgtcgccgtcgccgacggccgcggccgccgccgcgccggtgctggtgctctccaactccggcaagcggatggaccaggcgggccggaagaagtacgtcaagcaggtgacgggccgccacaacgacacggagctccacctcgccgcgcagcgcggggacctcgaggccgtgcgccagatcatcgccgagatcgacgcgcagatgaccggcaccggcgaggagttcgacagcgaggtcgccgagatccgcgccgcgatagtaaacgagaccaacgagatggaggcgaccgcgctgctcatcgccgccgagaaggggtttcttgacatcgtcgtcgagctgctcaaacactccgacaaggacagcctcaccaggaagaacaagtccggatgcgcgccgctgcacgtcgctgcaagagagggccacagagatattgtcaaggtacttctggatcatgatccatcccttgggaaaacgtttggccaatccaaagtgactcctctcataactgcggcgattagaggccacactgcggtggtgaacctgctgctggagcgagtttgtggtttggttgagttatcgaaagcaaatggaaagaatgccttgcactttgctgctcggcaggggcatgtggaagtcgtgaaggctttgctagatgctgatacccagcttgctcggaggactgataagaaaggccagactgctctacacatggcagtaaaaggaactaaccctttagttgttcaagcacttgtgaatgccgatccggcaattgtgatgctacctgacagaaatggcaacttagctttgcatgttgcaaccagaaagaaaagatcagagattgtaaatgtgcttctgcttcttccagatatgaacgtgaatgcattgactagggatcggaagactgcatttgacatagccgagggccttcc

SEQ ID NO: 5964 - DNA, 704 bp, Sorghum bicolor
  Clone ID: SORBI-28MAY03-CLUS30275_1
tgggcttgccgcacacctcctggccgcgcgtccgttacccaaattcgccgccgcgccgccgctcccctcgtcggcggcgccgcaccctgccgcttggtaatctctatcgacagcggaagctagggcgtcccagatcctccgcccatgacccagaccctggcgccgcaagcgcgcaccgagatagggtttggttcttgcgtcccccggcctcggtgaggtgggacggcaagggcaagggcaaggcggcggggcgaggggtggggctgtgggggcacgagggccgtcggatggacgccgatgaggccgcggggagcagcaggaggatggatctgaacctttacctcggtcttttccgcgccgcgcgcccgcgtcgctctgacctcggttcagacctcgccctcagcaccccgatgccttcctctccttcgtcctccgccgcgtccgtcgacgcgccgccgccgccgccggcgccgccggagcccctgcacccgccctacttcccctcccgcgccgacctctcccctccgccgccagaggtgtgctcccgctacaaccccgaagactcgcctgttccggatgcgcatctgtcgtacatgcagactccggaaccgctcatccccggtccgcggaacatgccgcctccggaaccgcttgctctctcgagaatccgagagggtcttcgggaacttcgggacgccctccat

SEQ ID NO: 5965 - DNA, 756 bp, Sorghum bicolor
  Clone ID: SORBI-28MAY03-CLUS303_1
gcacgaggcaaaagacatttatcaaagaggaagggcagtcgatggcgccaaatcaggtggctggagagatcctgtcgttcttcacccgcaacaatttcaccgtctcagaccgtggggaggtcatcacatttgagggcacaatgataccaagcagagggcaggcagcgctgctaaccttctgcacctgcattagccttgggagtgttgggctcgttctatcaatcgctgtcccagaaggtggcaacaactggttctggcttatgaccctaagccccttggcgggagtgtactactggacaaaagcgtcaaggaaagaagagatcaaggtcaagatgatcctatccgacgatgggagcttatctgagatccttgtgcagggtgatgacgtccaagttgagcagatgaggaaggagctcaagttcagcgagaaggggatgatatatgtgaagggcatctttgagacatgaccgggagtttgatatctgtgagtgaacagtcgagatgagtctatttgctgcaacggaaactgcagaactcaggtgaggaaatgcaaattggacgggcaaatctgtaccttggcttaaaggaaaagaagtgatcttcatacgggatttgattattgtaagtgttggcagtatgaggatagtttatgtgtgaacttgactttgtaaaaagttgatgagaaacaccttgttgagcatgaaaatactagcccttttacgggagaaaagaagtaactggaaatttggccgctgc

SEQ ID NO: 5966 - DNA, 857 bp, Sorghum bicolor
  Clone ID: SORBI-28MAY03-CLUS3072_1
tctgggctccgtacaccgtcgtgtcgcgattcacggcagcggtgctcgtgctccacgcgccgcgacgaacaaacctaacagtgggactgggtgcgtcacccgacagcgacgacgcgcgcgcgatgccagggacatcttctctcccccaccccttctgcccacctctccttcagatcgtcgctcgctccactcggaccactccaagtcccagcgacccagcccgcgcggaggccggagcatcgcaccggcaccagcaccgcacgcacgccgcggcgcgcaaccgcccagcctctcgtgcgcgcgcgagcgcacagagcacagcaagcaacccgatggcgctcctggtgctgcgaggctgcgccacgccagccgtccacgcggccccggcggcggggtcccggctgctcccgccgccgctgcggcggcggaggctcgtggccgtcgcttcgacagcctcctccgcgccgtccggcgaggtggcgtcgtcgtcccagcacggccgcgagtacgggatcgtgggcgggcccaacggcaacgccgtcgctcccgctaccgccaccaagtccaccgtcatcgagaccaaatctgacctaattggttgttatggaactgggccttgatgattgtgtaataaggtgaccacttagggcgagcacagatgtttgaagtcttaacctactgttacagtcgttggagcacacccactgcagaacttgatgttgacacactaataagctgaattgttattttgtcatgggagagatgaccatcgggctgtactaatttcccattgtaggcaatttagctgtaatatcttgcatatcatttacttgaaaggtatattctgctgatacttg

SEQ ID NO: 5967 - DNA, 1016 bp, Sorghum bicolor
  Clone ID: SORBI-28MAY03-CLUS30823_1
gcacgaggccttttccaaggagaaagggatgggctgttgcagcagccggagctccgattcgccggccagccgcgtgacgcggtggcgctccacagggatcgtcgcgctccgggacgccagattgaaggaagtgccaaatgaagttctacaagtgggcaattccttgagaactctggacttgacaaataacaagctagttgagattccccaggaaattggcagacttgtgaatatgcaaaggcttgttttggctggtaatttgattgaaaacatcccagctaatattggatacctgcggaatcttaaaatcctcacacttgacagaaataggatctctatcttgcctgaagaattgggtttgctgtcaaaccttcagcaactttctgtttctcaaaattctttactgtacctgcctaagagtgtaggagatttgcgcaatatgtcactacttaatgtatctgataacaaactgaagggacttccagaatcaattggagcttgcagttccctggaagaatttcaggccaatggaaacgctattgaagatgtgccatcgtcaatttgcaacctagtttgccttaaatccttatcacttaatggcaacaaaattcgtcagcttccgcaaaacttactgaaagactgcacggctcttcagaatttatcgctgcacgacaacccaatcacaagggaccagttccaacaaatggatggatttgaagagtttgaggcgcgcagaaggaagaaattcgacaagcagattgattcaagggtcatgatgggctccacggccctggatgaaggggttgatttccactgattttagagctcaagtgactcccattctttctaattggtcaggaccaattgtagatctgtacatatcagtctcacatcccgcaaagaaaaacaacagacacgcatattataacacatataaatgaaccgaattctgtcattttttcttgcactaacgctgtaattggcgctgtacttacatctttatgttcatataggaa

SEQ ID NO: 5968 - DNA, 583 bp, Sorghum bicolor
  Clone ID: SORBI-28MAY03-CLUS30897_1
aacacccttccagctgaccggaaaagatgtatcaatgagttatgtactctgattcaaacagtggaacagcttctatgtgcgtcgtcaactactgcagaaccaatattgacgccttggccattgatgcgggcacttgatgatatggaaaatgccaacgctcaagttgaagtttctgtggaagaagtaaccaaggctcgcacccagaagataaagatctttgaaaatcgtgcccacgaggtggggagggagcgacaaatatttgttgatttcttctgcaaccctgagcgcctcaagaatcaagtcagagagctgacctcccgtgtgaaagctctccaggactagacctgttcttgtacgctggtctcacatgtcgtgctgcttttttttttgtgtaaagtttgacttcgctccaacatcaagttggggctgctgtgcagagacggtatggaacaatagaccaggtagctcggggggttcattcaggctctaggtccttgtgccacccggataggatggcattgttgtgatactatttatagcgatctgtatgtgtaaaatagtccgaaatcacgagccctttctt

SEQ ID NO: 5969 - DNA, 492 bp, Sorghum bicolor
  Clone ID: SORBI-28MAY03-CLUS30912_1
gcacgaggcccagatcctcccctcgagcgccgcagcgagcccgagcccgagaagccgacgagaaggaagggagaggggaagccgaccgccgccgagtcccacttctccagcccgagagatccttcttctcgttcgtctgtctccatggctgcctcgaccaagaccgtcgccgtgctcctcgccgtggtgctcctcgcgctggtcgcgtccgcggcggccagcaggaagctggaggaggacgcgctcctgggaagcctggctctggccccggcccccgcgccggccgtgggcggtgccgcggggctcgctggcgccataccggggacgtgggccgtcgcagccctggtgtctctcatcgccttcctcgccaactgagggggctctgcggcgagggatggagggaagaatcctgcgatctggattgctgggagagggggaatatttatgttcgttctgtttgttctactaggctattggttccagtgctgctga

SEQ ID NO: 5970 - DNA, 513 bp, Sorghum bicolor
  unsure (1)..(513): unsure at all n locations
  Clone ID: SORBI-28MAY03-CLUS30443_1
gcacgaggataatatatatcctaccttcctctcacaaaaaaaaaacctgcagcgcggggattctctaaaaaaaaaaaaagggcagtgggngagaaggaggagaaagcatctctcaggcggcggcgtgttcctcatctcccccaccccaagcaggcgccgtctatcaatccgatctgcaacatggagtttggttcgatcgacggaggcgccggagtaacgtcgggggcatcaggcagcgggccgtccgccacatccgcgacggccggcacgtccgcgacggctgcgaggcggaggacgcccgggcgatggaggaggatcccacgcgccatcgttcctaaacagataactctgctggaggagataactatgctggaggagataaatctgccggaggaggtaaggcgggctctgcctcctcttctgccggaggaggtatggagggctatgccggaggaggcaaggaagtcgagggaggaggtggtgagggcgacacaggccaggctcaaggatatg

SEQ ID NO: 5971 - DNA, 535 bp, Sorghum bicolor
  Clone ID: SORBI-28MAY03-CLUS30506_1
cctactggggccttgttgcccgagcccctcccccaccccctcttcttcctcggtctctccgccgcccaccatctccatcccctcctctctttatacgccaccgcggcgggggcctccccccgcagtccattcctctgctcgttctttcactgcattgtcccgtccgaacagcggagggagagggcagagagagatggcggccgcgtccttcaccgccgccaagttcctggtgccggtggccgcgagatccggcggcgagagggcgcccccgcttccccccgtcggagcctcctcctcctccttcgccaggaccctgcgccgcggcggcggggcgcaccaccacccgcgcctccgcaccgcgctcgccgtctcctccgacctggtcgcgggcaacaaggccgcgcaggccgccgccacgcatccggctgttacacgggaagaggcactggaggcgtatgaggacatggttcttggccgtgtatttgaggacatgtgcgcacaaatgtactaccgtggcaagatgtttggtttcgtc

SEQ ID NO: 5972 - DNA, 535 bp, Sorghum bicolor
  Clone ID: SORBI-28MAY03-CLUS30501_1
gcacgaggatcattgcacgagggttcaattcagtagcaaggtagctagctagccagccaggggaagcgtattgtgatatggctgacgctcaaggccactacgatcagattgaggagctggtgccggcgaattccaagtctcctccacaggtggccctagtggtctctatcctgctcgtctgtcctctgctcgtcctcctcctgcgccgcctctttggaacgacgacgacgacgccatcgacggccagagaacagctgctgagcaagctgccttcgcctccaagcaggctccccatcgtcggccacctgcacctcgtcggccccctaccgcacatctctctccgcgacctctctaccaagcatggccgtgatggcctcatgctcctccacctcggcgccgtccctacgctgatcgtctcctcgccgagcgccgcgcaggccgtgctccgcacgcaggaccacatcttcgcatcccgagctacctcccctgtcaccgacatcctcttctacggctccaccgacgtcgtcttctcgcc

SEQ ID NO: 5973 - DNA, 776 bp, Sorghum bicolor
  Clone ID: SORBI-28MAY03-CLUS3049_1
cgtccgttgttttactaattactactccctccgttccgaattataagacgatttggcttttctagataaatttcttttgctatgaacttagatatatgctatgtctagatacacatagtaaatgcaacgtatcaaaaaaagccaaacatcttataatttgggacagagggagtattgctcttgattagaaggattctgacataattctttggtttatatgtatagtcaccaaacgtaatgagctgaagaaaaggaagcattcaggaggattagggcccttctggtggaagttgggaagcaaaaggcttctgtacgaagcgctttttgagcaccgtcgtcagaggaaaatcaaggggtccggagaaggaaaagcaactggtttcagcagtaccttagatgggtagttcgctgactgttgatcttctaggcatgaacagggtagttcgctgactgggtttcctaaagcagagtagcttgcgtttacctagagcctagttttgactggttacttggtctgccgtttcagatgaagtttgacagcaacccgttgtgttaacatgcggggtgtatcaaccgaagtttcatgttcccatctttttctttggttggttcgtaccatagatgtatgtactggtcatcgatagaaaaccctgcctgttttggaatggcatgcgtttcagttattaaaccctgttattgcatatggatttttgggattttttgcatgattgactgcgacgtttgatgtgcatttgttactcaactgattccccgtc

SEQ ID NO: 5974 - DNA, 658 bp, Sorghum bicolor
  Clone ID: SORBI-28MAY03-CLUS30535_1
aagaagctctgtgatgtgattgatgattttagtttagtccaacttttcaactttggacatccaggacaaggaaagtgttggcaatcttgtgaagctgattgacaagagcaacggatatatattttcttctattgacagtagcgctgttgagttcagcaaaattgcggcggcgcctcttgattgggactactacagaacaggagaagtgcaggagaagtacatgaaagatgatgagtacgtgcaacagacaagcaggatgcaatgaccattgaggctggcggtgtcccccacttttgtagcactatacgggtgaatcacgtcagtgtggtacaaggcacatcgagaacttcggttgctagaacgacgtgaaacctgtctgaactcatgtagatcagttgtagatgttttctgaagctgcttgctagttgcctgatgtggagtggtagggtactgccattatcttctgggtagtatacttttgggcagtataagaaatgcacctatcacctgtaatcaaccaatcatatggccatctgttttgttttatggggcaaactgaatacatgttcgttgtttagtttgtcctgatccaatctcagatttttgagcaagtacaattgaataaccaagggaccgtttggttgtgcgaaacgatcgg

SEQ ID NO: 5975 - DNA, 668 bp, Sorghum bicolor
  Clone ID: SORBI-28MAY03-CLUS31050_1
gcacgaggggattactgggtctcagaatcgctgaggcagtgaagccgccttgaacttacgctaccaccgccgcgccgccgcccgccgcctgcccgaccacccgccgccggctctcctgcctcaccaaacaccgaccccatcgccgtcacggggtcacctgagctccctctcgttccgccttagtcaggacgttggcctgtttcttctgttcttgaggcttactcaactaggttcttctacagcggatcgacattggttgctactacagtacaggagttgttgcttcagccgttcagcgcaatcaagctgccggggcagcttgttttccagaattattggcgggattgagctgagctcccgcgcccccgcgctgatccctctcctgccatggcgtgcgttgcttacagtatcagataccctctcatgctcgctgcaaggcaccgcgctgatgttctggccaaaaatagcttgtgcattggcttgaagtcttcggtgtcttactccgtagctcagcagtggagcagcaattgctcttccgttatgatgcggcatgccacatcccatcgtcacttgattgttagggcttcagcaaggtggcgctctaactcgaaagcttcagcaaccgaagtgggcgctgcttctgatgagaggataactgtattggtcat

SEQ ID NO: 5976 - DNA, 835 bp, Sorghum bicolor
  unsure (1)..(835): unsure at all n locations
  Clone ID: SORBI-28MAY03-CLUS31110_1
nnnnnnaagcaaagcaatcggacaacctcttcattagcacagcagcatgaacttttacatcacttcctcgttacaatggcaatgctcaagcaggaacccaaacaacactcagataggcagcagctagtgccatcatcgtcatctgttgttaggtcagccccacaagaaaaaatgtatcaaacgctaaaaacattgatagttacaatgcgcctaaacaagggctagactagtttttcccaggccaccaaagaatggattttgcaacatttgagcagtaattacaaccattagctaaaattatgacaaaactgttttcttccttttctcgtataatatacacacagttatcgagaaaaaaggcaggaaataactaaaatgttggcctatatatacacctacattggagtcagacaatcctcattgaacctccgcaaatttgtaaggtattagacactgctgagtcctgaagcacctcctgtgagaaccttctccgcaagcccaatacaaggtgtggagactttaggacaagagtgctgacctaagcttacactggccccctggaaagaaaactgagactgccctcgaacgctgaggcctttggatttgatcactcacaagacactgaaaccgagaatgttggatttagcaattaacatttgcaggctaattctttgtaacaatcccctttgccagtttgacagtagtcaaaaccatcatctacaagaaatatttccgggcaacaaaagtagcaatatgacttggtaaagaaacccattttggcagttcggcgctggtcaaaattgatcacccacaagataatacttccatgcaacca

SEQ ID NO: 5977 - DNA, 910 bp, Sorghum bicolor
  Clone ID: SORBI-28MAY03-CLUS31154_1
gtgagagagacagattccacagcaatttgctcctcttccacgcacagcccaaggcaagaactgctccccggaaaaagatcgtattttcagccggtttctgtccggcaaatcgctgccggagatcttagaaccggaaggctcgaagtttctgctccgtttgcgtcgaatctgcctcgggaagcggagaaaggagcggcctttcgagctcgtaggggccgtccctcagaaggctagaggggacgcggcggcggcggtggcggcggcggcagctctagggcgctcgtggaagtcggtgatgccggtttgaggtcaaggcggccccggtggtttggaggaagccgggcggggatggactccagcggggaggaactcctgaagaagatccgggagctggaggttgggcaggcgcagctcaagcaggagatgtccaagctaatacccggcgccggggagcggcgacgctcgcaatccgtctcgccgcggcgcggcgcgccggtgccgccgccaccaccggccaaggggaaggcgggggcgccaggtaggcggctgtccgggggttttgagggcgggcagcgtgcgtgggcccgtgggtcggcgtcgttcccgcactcatcgccgctgcagcgggagggccgctccgcgggcgctggagacgctagcaccagcgctaggctgccggagaggcagtactctaaggtgctgcagtcactggggcactccgtccacattcttgacctcgacgggaggatcatatactggaatcagtctgcggagaatctgtttggctatcctgcgtcagaagcccttggtcaggatgccctaatgcttctggttgattcccatgaccacaatgctgtaaatgacatcttccgacgtatttctatgggtgaaagttggactgggaagtttc

SEQ ID NO: 5978 - DNA, 665 bp, Sorghum bicolor
  Clone ID: SORBI-28MAY03-CLUS3118_1
aagtcacttttggttgagactttgagaactttgaagacgtccgtttggccattccagtctgatcagtctagtagcttatttctgaatgctgttgctgtaaaccactacggccctggtactttaggtgataaccaagcaaggtcacatggaaacataagtgccattgagatggctgctgctaaagctgctcatcatagattgatgcgtggagtatggactaatgtttgttttggtgatatgcgtcgtgctttagcagcctgtgagcggctgatactactgcatcatgatccgcatgaactgagggattatgcagcccttctgtaccactgtggatactatgaagactgcctacactacttgtcattgtaccaaactgccacggctgggcaatccccgatgaatcgattagagatcttggaggaggaagctgtgaatactctcagagcacggctaacacttattttagcagaggatggctggagcagacgtagacctgtggcaagttactggaccaagaactctgaaccgtggtagtttaggtagctgaccttcgttgcaatttgcaactgaagcaaagaactacagattgtatatagcattttcaactgtggatatgttgtacagccacttggtaatccatgcgggatgaatcgatttcctgattt

SEQ ID NO: 5979 - DNA, 631 bp, Sorghum bicolor
  Clone ID: SORBI-28MAY03-CLUS31135_1
gcacgaggcttttgcagacgtcgttgaattttttttgtgagccaggggacactgaaccgcagctcatgagtgatgcaaatgttgacagcaaattttgactcttgcgccacgtgctgtctattctatatcttcagttcttgctgatccgtttatcgaggaattcacacgggagaagaacccgtagggcacgtaagattaactcgtttatagacaggacggcgacggttgcgtatatgtatgtagttgcctgtccttttactttaagaaatttcatatctgcagcgcatacagatcttggttgcaattgcaatccaagatgggcgacgttggtgaaattcagctgcaaatcgcaggtatccgaggccaagaagctggtggagacgatcatggacagagagcagagaacggtggcgcatgtcgtgcaactgaggcgccgcggccgccgctatcgaaacggctggcgtggtgggcggtcgtcctcatcaacatcgtgttcatcctcggcgggcagagcgtggccacgctccttggcaggatttactacgaccagggcggcaacagcctgtggatgcagacggtggtgcagtcctgcggcacgccgctcgccatcccgctgctcctctacttccgg

SEQ ID NO: 5980 - DNA, 671 bp, Sorghum bicolor
  Clone ID: SORBI-28MAY03-CLUS31402_1
ggttaggacacgttgaggtggttaaggatcttgagtttttaaagccctgcaaactgaatgctcatacagcagggtgttattgcattgcaatggatccaattgataggtatttcgctgttggaagtgcagattcacttgtcagtctttggaatgtcaaagagttgttatgcattagaaccttcacaaaacttgagtggccttgcacgagggttagcttcaatcatactggagaattcattgcatatgccagtgaagatcctttcattgacattgccaatgttgagactggacgatcaattcatcagattccatgtaaagcagcaatgaatagcgttgaatggaatcctaagtacaatctcctggcctatgcaggagacgacaagaacaagtactcagctgatgaaggtgttttccggatatttggcttcgaaacacacaactgatgctgacttagactaccatcatatctttacattgtagattcactttcgtatctgtttacactgatacattttctagatgttcattgtaatttcaatgctgatcaatcttctgccagcttgaactgaacgtcattgttgtagtgtatcacaggataccgtgtgactaacgtattttcattttttgtgttgtgacgaaggatacgttatgttatggggacgaagttaacc

SEQ ID NO: 5981 - DNA, 647 bp, Sorghum bicolor
  unsure (1)..(647): unsure at all n locations
  Clone ID: SORBI-28MAY03-CLUS30674_1
aggctttgacactcaggttcatactaacccgcacgaggcgcacatcgaactcgccatgtcccacaggaagttcgaagccccccgccacgggtctctggcctttttgccgcgaaagcgcgcctcccgtcaccgcggcaaggtcaagagcttccctaaggatgaccccaagaagcccgtccacctgacggctgccatgggttacaaggcgggtatgaccacgattgtccgcgacctggaccgcccgggtgccaagctgcacaagaaggaaatcgtcgaggcctgcactgtcatcgagacccctcccatgatcgctgttggtcttgtcggctacattgagactccccgcggtctccgctcgctcaccactgtctgggccgagcacctgagcgacgaggtcaagcgccgcttctaccgcaactggtacaagagcaagaagaaggctttcaccaagtacgccaagaagcactctgagaacaacggccagtccatcacccgcgagctcgagcgcatgaagaagtactgcactgtcatccgtgtcctcgcccacacccagatccccaagacccctctcaagcagaagaaggcccacctcatggagatccaggtcaacggtggttccatcgccgacnaggtctctttcggccagg

SEQ ID NO: 5982 - DNA, 773 bp, Sorghum bicolor
  Clone ID: SORBI-28MAY03-CLUS30682_1
tttacttgtcgtacttggattctgttaagtatttcagacctgagattagaacagtatctggagaggccttgcgtacatttgtgtatcatgaaattctgataggatatcttgaatactgtaagctacggggattcacaagttgttacatatgggcttgcccaccttgcacgggggaagattacatcttatattgccatcctgagattcaaaagactccgaaatctgacaaactgcgtgagtggtacttatctatgcttcggaaggcttctaaggaggaaattgttgttgagctgacaaatctatatgaccatttcttcattactatgggggaatgcaaggctaaggtgactgcttctcgcttgccgtactttgatggagattattggccaggagctgcagaagatatgatcaatcaactccgacaagaagaagatgatcgcaaacttcagaaaaagagtaagacaaagaaaattattacaaaaagagctcttaaagctgctggccacactgatctcagtgggaatgcttccaaggatgctatgttgatgcaaaagcttggggaaactatatatcctatgaaggaagatttcattatggtccatttacagtattcatgtagtcactgttgtgttcttatggtgtctggaagacgttgggtttgtcatcaatgcagaagctttcacatctgtgacaagtgttatgatgcagaacaacaacttgaagacagggagaggcacccgagtaatagtagagacacacatatgcttcatccg

SEQ ID NO: 5983 - DNA, 784 bp, Sorghum bicolor
  Clone ID: SORBI-28MAY03-CLUS30713_1
gcacgaggcgcaacgaccaaccaacatggctggcttggtttccctttactgtctgcaaattaattttggccaaaaaagaaaaaaaaaaccctccgagattatattgatctctgtttatgcctcgtcagattgtcagagaaggggacccagtgaagaggatgctgttcatcgtgcgcggccacctgcagagcagccaggtgctccgcaacggcgccgagagctgctgcatgctggggccgggcaacttcagcggcgacgagctgctgtcgtggtgcctgcgccggccgttcctggagcggctgccggcgtcgtcgtccacgctgacgacgctggagagcacggaggccttcgggctggacgccgcggacgtcaagtacgtcacgcagcacttccggtacaccttcaccaacgacaaggtgcggcgcagcgcgcgctactactcgcccgggtggcgcacgtgggcggccgtggcggtgcagctcgcgtggcgccggtacaagcaccgcaagacgctcgcgtcgctgtccttcatccgaccgcgccggccgctgtcgcggtgctcgtcgctcggcgaggagaagctccgcctctataccgcgctgctcacgtcgccaaagcccaaccaggacgacctgctgtgactgagacgcgacaggaggaagggcttctgttcagcgagttgaagcagaatggttctctagagggtcttcagctagcaagtgagtgaatggcagaaagaactcgagcattctagctccatgtgtacggacttacggttgagtcg

SEQ ID NO: 5984 - DNA, 896 bp, Sorghum bicolor
  Clone ID: SORBI-28MAY03-CLUS30808_1
gaaggtcctcgcatccccagagatggttgataaatcagttgacgccattttgcttaagcttcgtggtttatatgcccgtgcaaaggagctctctgagaatgaaatcagtgcctcaaacgctttgattggattactagatggtttgttgcaatctggagcgtcaactgcacaaaagaaaaagatagaagttggtgagcaggaaaagaagaggatcaagtcggatacagattctgcacgattttctgctgcatctatgaggaatcaacttgaccaagctgcaagcccgaaaggagagcaggttgctgctagggtaaaatcagatgatgaaaaagatgagtggtttgtcgtgaaggtcatacatttcgataaggaaacaaaagagtatgaagtacttgacgaagaaccaggtgatgacgaagagagcacccaaaagaagtacaagttgcctatgtcttacattattccatttccaaagaagggggatccttcgagtgccccagattttgggcagggtcgacaagttttagcggtttatcccggcactacagcattatacagagctaccgtagcttctcatcgtaagaggaagtctgatgattatattctggagttcgatgatgatgaggaggacgggtctctgccgcaaagagctgtgccgttctatagggtggttgccctcccggagggccaccggcagtgaagatctttgacgcggttgcgcatttgtagtgtaaccgataacgcaagatagatgtcttgagtgtgacaatgtcgtggtcatatctctgcagctcggcgcacgttgaagtgcaggctatagcgcctgcgatttgagatgaaataacttttatagccaacttatatcctgtaaatagatatggatctattgttttcgt

SEQ ID NO: 5985 - DNA, 585 bp, Sorghum bicolor
  Clone ID: SORBI-28MAY03-CLUS30734_1
tcacaactgcaggtgtggttctggagacgatcaaggatgtggagaccgcagtctcaggccgcaagggcaggagtggcacagcagcgggcgacgtcgccttccccaaggggaaggagaacctggcctctgtgctgaagcggtacaagcggaggctcgccagcaagggacagtagcagcgtcggacagcgattgcaatgttaggagtctgactattgttctccagggactgccatcggcctccctgagtcctggattttttcgttacatgacgttcgtagggaccggttgcccgatgatcgttttggtcccttccagcaagtttttcttcttttttttttttgtttttttggcagtgtcatgttttgtaagggcaactacgtgtgtgctcaaaagaacccaagatgtacacgcaaaggagatgtagtctgctgatgcagcattgtaaagtccacactctgcaggttaacccttttttggggccgtcaagtgttagcgccctatgtatgttatcataccctgcagagaggttgcaaatactgaaccactctcacaaacttgcacctgtcgagatcattttgtaatcta

SEQ ID NO: 5986 - DNA, 671 bp, Sorghum bicolor
  Clone ID: SORBI-28MAY03-CLUS30892_1
agcgacacgctccacaccgtgctggagatgcagttctggagcaacaccgcggcggcgtgcgtgtccgtggccgggctgttcgcctccggggagtggcgcaccatcgccggggagatggaggcgtacaagaagggggagctggcgtacgcgatgacactggcgtggacggccgtctcgtggcagctgtgcacgatgggcctcatgggcctggtcgcggcggtgtcatcgctgttcaccaacatcatcagcacggtgggcatgccgctgtcgcccgtcatcgccgtgatcttcctcggcgaccggatggacggggtgaagctgatggccatgctcataggagtgtgggggctcctgtcctacgtgtatcagcactacctcgatgaccgtgccgctaagaagatagccgagaaatctgaagaacaacaccaagctgcaaaaatctccgcagaatagtgttttttttcctggcactatcactatcaacatcacaaaactacttgactgctgtatggaagttcctgtcgatgccactggaaaatgctgaaagtttagttcgattctttgtcgacataagtacagtaggagtagttcagtacttccccgtcaaactcggtttggatctttgtcatttctcgagtacacaaaaatttataggtctatttatgtcataa

SEQ ID NO: 5987 - DNA, 687 bp, Sorghum bicolor
  Clone ID: SORBI-28MAY03-CLUS31346_1
ttaagaaggggaagggacaagggaggtggggcggcgggagtcggaggcggaacgagcagcggctgggcgtcggcggcggcggggcgctatccctcgctgcattcgccagcgccaagtcccggagcaccggctacaacccggcccttatcaagaagcaaagggagttctacaagaatgctaaattaattagcaagtacaaaaagacaaagaagcaacaaagtcagtcaaacaaccgtccagaaattccaatccatgaggatggtggtgacactgcccaagatgtgccaaaggcacatcataaagggaagaagcgcattgcgcatagtttgaaggaagagtatgagaagaaatgcgcagaggatgagaaagctaagaaagagcgggatgcagaaattcaggcgaagagggaacatcgggagagcacgagggagagagagagagaactaagggagaagatgttcaagaagacaaggtctggacaacctgtgatgagataccggatcgagcatctcttggagactgcattaagcaaataacacaataccaccatggccttataagatcaaagtgtgctagcaaattttgtagttccgtgcaagtgcaaccatttgtttgttgtaactgacttctgtcacttcatgattgtatatatatctttggatttgatcaaaaaaaaaaaaaaaaaaa

SEQ ID NO: 5988 - DNA, 635 bp, Sorghum bicolor
  Clone ID: SORBI-28MAY03-CLUS31369_1
gtggcgcggagcacgatacaggtgtacccgggcgcgtgggcggcggtgctggtgtccctggacaacgtcggcgtctggaacgtgcggtccgagaacctggactcgtggtacctggggcaagaggtctacgtcagggtcgtcaaccctgaggacaccggcaacaagaccgagatgggcatccccgacaacgccctctactgcggccagctccacaagtaccagaaggagcagacgccgcaccacaagatgggggtgtctgctgtggcgccgagctcgttgtccctggcgcgccggctggtcgcgtcggcgctgctcgtggccggatccttcgtgttggcgccgtagagtggcaccgttacttgtgcgccgaggcaacaccgttgacataggcttgtttaggattattagaggtgtaggccgcgtcattgtcatttttccctgtcgatatgagaaatgttcttgttcatgtgccagtagtgctgggctctgcctgcctgactgcacacgatacagtgttccttcgctttttgtgtatgtgtgtgtgtgcgtgttgcctgttaggaagggtcgattgtttatctctgattagttcgtcccttttgttcgacgtgataactctgatcttagcgtttctc

SEQ ID NO: 5989 - DNA, 733 bp, Sorghum bicolor
  Clone ID: SORBI-28MAY03-CLUS31391_1
ctggacagccaagaagagaagccagagccaagtgaactgaagacaatagcttctgaagggataatcacttgtctgcaagacgccatagaatccctcgagcaaggcaatgatatcaagggagttgcagagcagtggagcttcgtaccccatgttgtcaacgaactgctgaaactagatggaggcggaaaaggcgcagctctgcccaaagaacaactgtgtcaactagcagccaagtgcaagaagatctatcaggctgagtttgctcgcgtggacatggatggcaagaacaaggataagcatcaaaatgattcacatgtggcggagcatcgcaggaagaccaaatcagatgatgaccactacgatagcgatgagacgatagaaatgacagaggaagaaatcgatttcgcgtgcagacagctccctgggctatgcggatgatagtaacttgagatttcaggtgtgtgtgtgtggccacgtctagaggaactagttgacatggcgtatgtgtggcccctctagagcagaagaggaagggtactggatgtagccgccatctctagtagatcattattttactgctgccagccaaattaaccgtacgagtattcggttgtcggttgtttgatgacgacgggtatctttcactatacgaatcccgcgctaaaaaacaggtcagcggatagggccaatcacctgtaacctgtgattctgtgaactaatgacagcgtggtgt

SEQ ID NO: 5990 - DNA, 604 bp, Sorghum bicolor
  Clone ID: SORBI-28MAY03-CLUS31396_1
aaggaacagttgaatgaaaggtaccctggtgcaaggcgtgctgtactgaagactggtggtgatttccccttcctgtcacgtccagacgaggttaatctgtaccttcagctacatttgaggcgagttggtgtagaaccaaggtcagagctggtccaaggcttcacccgagatggcagtgctgggagttcaaaggatcagagagatggaggggacagttttggtaatagtggtgaggacaatggccaccatggttcaggtggcactgatcatgacaggcaccattgtggatcagaatcacacaattctgatgagccaataccaacaagcacaatgcttgccaatactgtactagaactggtaatttaggaaatcatggaagcgtgttttgcagctatattggggccattgttgccggtaggaaaggcaaaagagcacctcaaatgatggaaaggcgcttctatatgtttgtataatatatgcttgtcttctatatttagttatttaccaaatttactgtgtatgtagcctgtaaattgcattccatatgcccgagacatgatgtgattgtgcggctttcttgaaacagaatacctcattgtgtttt

SEQ ID NO: 5991 - DNA, 1064 bp, Sorghum bicolor
  Clone ID: SORBI-28MAY03-CLUS31403_1
ccggaatgggtgggaaccagatgcagtgacatacagcacctacattgttgggctttgccgctctggatacattgaggaagcatttcagcagctggaaactatggtagcaaagggactacagctcacagtagttggtttgaacatactgttggaccacgttgcccagaatcttgatatgtgggtaggcaaggaggtcctggagaggtgccaagaactgggctttgtggtcgatgtggtgacatacaacacagtcatggatcatttgtgcaagaaagggaagtggctgcgtgtcctaaagttgttcacggatctgctcaagaaaccaataacacccaatgtgcagacatacaacattttgatttcatgcctatgccgagctggcaagtttgagtttgccaagtatgtgttcagcagcaaggggttcgtggcagacactgttacttgtaacattctgatccatgagttctatgaggccggaaaggaaggtgagcttggttttttgttcgctgatgtgaatgctgggaagattgccccagataccatcacatacaatacactggttgattgtctctttaggtctgggaggaggtcacaggctgtcaattttgttaggcatatcgatggtggctaccctacggagcccgttgcccatttgacatattggttggttaggagtggatatatacgtgaggcattgaggctgtttgatgatatccaaataaaaggactggttttagattgtaggatttttgctaatgtgatcaaggcattctgcagaaagggtccaacagaatgctcagatatgtcgcaattgtgctttgtattggataggatgcttggaagtgggtaatcattctgtggtatgggtctgtaactttgaaatgtctggagctctgcatgattctttttcgctaaccttgcatggtacaggtctccttttttaacttgcatggttgtaccagcagctaatagctgctgaaggttagatgtgcctttgatttcttcatgtaactctttgtcgtgcatacacttgtaaaatacaatctgtgatctgagaattaatc

SEQ ID NO: 5992 - DNA, 579 bp, Sorghum bicolor
  Clone ID: SORBI-28MAY03-CLUS30913_1
ttctcaaacatttgtatcgtgatatacctgaggatcctccaagcgatgtcattgaaaggatgcctgttaaactattttatgagagaaatccagttgaggaagaaacgcccgtgacattttcagatcatgcagcagttaaggagttctgcagaaagttgagagcttactcaagaaaaacagaggatgccaactgctaaagcctcttgatgggatcattttctgatggaaaccatgttacgaccccacgttcctcgccaagcagaagcaaagatgcagacatgggaaggaagaatgattccataagatcgtgatcctaagagagaaatccacgaaatgatgttttacacttcacaccagaattagggcacgtccggttgccgcaggttgtacatagaacgtccggctgtagttttgtgtgaatcttgaatgtaatgttgcctgctgtacatgctacagaatgtcacgaattaggcctttttagttgcaaaatggacactagcaatttttgtttccatttgataaatattgttcaatcatggattaactagactcaaaagaattatctcacaaattataggc

SEQ ID NO: 5993 - DNA, 622 bp, Sorghum bicolor
  Clone ID: SORBI-28MAY03-CLUS30917_1
caagagcaagctggcagtgatgatggatttgatagaaaatcctcatcgtctgacatggactttgatgattctgatgaagacaatgattttgctgaagaattaggtgacaaggatgtggatgattcttttatggagtcatattcagatgctttaactaaagagctaagcagtaccactcttgagaaaagctttgctcgtgcaccacgcccagaaactaacaatgagggtccatcagatgatgcagctactgatgcagagatgactccagttgatgtagatctgaaccttgttgagagcattcttaactcgtactcttcgcaacaaggtcttcccggtccggcttccaatctgctaggactcatgggcgtaaaggtccctccagatgctaagaagtcgtgatttttgtattccactagtgtacacgtgggatcttgggaagttgggatatataggaaaaacttatcttccatatcttggtggttactttgttgtaatagtacagggggtgtttggttgctagccacactttggaaaaggttcggttagcaattaaacataggcaggaatactttgggctcgcatatgcggagtaaaaataaatgtggtaagattctgttagaca

SEQ ID NO: 5994 - DNA, 595 bp, Sorghum bicolor
  Clone ID: SORBI-28MAY03-CLUS30960_1
ctcgatctcttccatcgggcggccgccgtgaacgcggtcaccgcaggcggcatgcggtttccgttcaagggctaccccgtcgcgcgtccaaccccgcaccagtacttcttgtacgaacaggccgccgcagccgctgccgcggcggccgcccaccggatgcttaaggtggccccaccgccggtcaccgtggccgccgtcgcgcagagtgattcggactcctcgtctgtggttgatcacaccccttcgcctcccgcggtgacggcaaagaaggaggtgggcttcgagctggatctgaactgcccccccccggcagagaactaggcaccccggagtttttagctgacgaattagtagttacttttttttccctttttgccctcatcaggaatgttacttctggttgtttggtcctgtattcttgttctgtagactatgagattgggagccttgtaaatagttttttttttccgcgaagacggaaatgatctgagatctgttcgtctgtctggacggatcaagccggcgttggtacgggcttagaccatggagtattgattatattagtagtataattcctaagtttactgagaatata

SEQ ID NO: 5995 - DNA, 639 bp, Sorghum bicolor
  Clone ID: SORBI-28MAY03-CLUS31017_1
agatgttgctccgacctccgaggcccctccgcgcccccgcccccgcccccgccccccccccccgccgcgcgcccccgcccccgcccgggcccgcccccccccccccccccgctcctcccaagccggtggccggagttcgcgcggccctcggcctcacccggattcggcgtccgagcccttctttacattcaccgcttcgtgcctcgttcgctgccgcgactcctcgacttcaacgccctcgcgagtcgcgaagccgcgacggcgctgcaggcgcccggtgaatctccgacttgactccgacgagaccacgacggcgaccttcccttgtctccccactggctgcggcccctcgccccctcctgcggtgactgttggccgcctggctgcccaaccagagctcagccctgcctactattttagtctgagtctgcccctgatcaagattcaagtatggcttctgccgggttggctgggatgagcggtgcggctcgtcctctcatgaggctcgtcaccatgagcggtgtgccaatcctccagcagctgcacctggaggaggagctcctgcgctgcacttcagacaactggtgcatcatcaacaatggcacgacccctgctaccatcgtcatgggcgtgtctggg

SEQ ID NO: 5996 - DNA, 769 bp, Sorghum bicolor
  unsure (1)..(769): unsure at all n locations
  Clone ID: SORBI-28MAY03-CLUS30971_1
ctactggccgccgcctgaactcgtctcgccagcggccgatctcctccatccgctcgccgggccgcaacccggccggagaggagactgcgctcggtcgagcagcccagcgtcctcgcgatcagctccggcgcggcgtccgccctctgcagccccggtgtccccgcgaccgtcgctgctgtcctacttcgccactcgccaccttggccggcgacgagcaccaccaggacaccaggtgtatgcggngatggctcggagcccctgcgacctccgcctcctcctccttgctgccgctgcagctttcatctacatccaagggcgggtcctcgtggctcagtcccattatgcagatcgtcttgcagaagcagaaagatctgaaaatcaatgcaccagtcaactaaagtccttgatcgatcaagtcagcatgcagcaggagaagattgtagcattggaagagataaaggtacggcaagatgaagaacgggcacatctgaagattttgataaaggatcttgaaaaaaggagtgtgcagaagctactagacaataatgtggttcctgttgctgctgttgtcataatggcttgcaatcgaccggactatttagagagaacagttgaatctatcctgaaatatcagacaacagttgcttcaaagtttccgctttttatatctcacgatggagcaaatggagctgtcaaaaggaaagctttggaatataaacaaataacatatatgcagcatgtggatcttgaacctgtgcaaactgaaagg

SEQ ID NO: 5997 - DNA, 634 bp, Sorghum bicolor
  Clone ID: SORBI-28MAY03-CLUS31589_1
gcaccacgctcaacacttgagctgggagaagctgaggcgttttcgttctccttctcgtgccgctggccggccggcccggctggtggctacctagctagctcgatcgtgttatctcgtacaaagcttggagtcgaattgaaggcacgatgaaactctgcagcgttgcggcggagaggagctctgtgaccggcaagccccatgtgcaggaagtgtccgcttggcatgaagagccgagagagcgtccggtgtggccaccgggagcagcagttcagatggttcatgcgtagtattatcatggcgttatcctgattgagcttttcattcaagccaccgttctcatccttcttcatattctttgtatcccaatgtttgtggtttcgcaaggtgaggtcttcttgaccttgcaagaccttttcttgaccttgtaagacccaactctgcgacatctctttccttcgactcaatcttctctgtcttacaccttcctcttcattcttacttcttttctatgtctatcccttctgagctgtgttgagctatgttaggtcctagttaagtattttagggtataggtgtgttccccgtgaggtgaatagctagtgtgttgcctctcatatgtgtaatgatatgaatc

SEQ ID NO: 5998 - DNA, 666 bp, Sorghum bicolor
  Clone ID: SORBI-28MAY03-CLUS3170_1
taatgaacagatatttgagaaagaaagtaccttgcagagtatcaagcaagaatatgaatccctcaagatcagtgaggcagccgcacagagtagcattaaagaattgaaggatatgattgatgctatgttcagttccgaatcgaccgtccggtcagcaacagcatcacctcgtgatgccaagggaagcaagacgaaagaaaattctgtggcagcagatgatgtgtattctgatttcgaaagatctactcaaccagacgacgtaaaaaaccctggaaagcagaaaaggaagacaattctcagaaaatttggtgagataatgaagaaaagaaactcctaaactgtaatctagtattatgaattgaaagcagtatagcttcgattttgattgttcagatccactgagcacacaggacagctggaatggcaaagatttacagtgacgactgtgtggggtcatgccatggatttatactacaaagaatggaacatacatgtaaaaatacagagaatgaaataagaaagtgtcatagccttttatgttttttataagtttctgcattttagaatctctatataaaatcttggcctgctatatgcaattaagcagcccaggttcccagattacagtatgcccaaattaccttatctttctgggaaatacgttga

SEQ ID NO: 5999 - DNA, 997 bp, Sorghum bicolor
  unsure (1)..(997): unsure at all n locations
  Clone ID: SORBI-28MAY03-CLUS3177_1
cccacgcgtccgcgccggggctgatggggatctacgtcgtgttcctgtgctggtcagcgatcagaagtgagccgcacacggaggtttgcaacaagaaggcagaagttgccacgagcgcagactgtgtgaacatcgcgagctatgtgatcgccgtcatcgtcatcgtggcggcgaccttctcgacgggaatcgactccaagtgcctncagttcaagcaggcggagggcgtctcggaggaggacgacatcccctacggcttcggcttcttccacctggtgttcgccatgggcgccatgtacttcgccatgatcttcgtcggctggaacgcgagccacaccatggaaaggtggacgatcgacgtcggttgggcgagcacgtgggttcgtatcggcaacgagtggctggcagcactcgtatacatatggatgatgatcgcgcccgtaatctggaagacaaggcaggtgggatcgtcggcggagacggagacatgagcagatttcactgattctgacggcgtgatgacagccagcaatttatatatatatacaaacgcaaaacaaatgaaagggaaggggaaacggcaagaggtggtgcgtgctatgaattgcatgtatgcatcgccggcaaattcgcattcctggatgttcgttggtcaatgaggatgatgcactgctgctcgatcgggtagtttttgctaagccaagacaaggcaagaaggaagaggcaactagggagtactatatatgctaccactaatccaccgtgaagctcggttgaggaagctcatcatcgatctcgctgtactaaattaactatctgaaaagcatagagcttgtttgtttgggaacctgacaaagctgtctagtccgagcaataatgcaaatccgggctccttgaggtttgggattgctgctctgctcggctgcagctatttggacaggtcaccatccgatcactcctataatctttttcgaaagggcagaacactcttatactc

SEQ ID NO: 6000 - DNA, 605 bp, Sorghum bicolor
  unsure (1)..(605): unsure at all n locations
  Clone ID: SORBI-28MAY03-CLUS31764_1
gcacgagggcgaaccgagcactgaatctgaaggagagtgagctgtccaaagcctcctccacaatggcgcaccacctcgcgctgctcctgctcctgctggcctcgccggcggcgacgcgtctagcatccgccgcctgcgggagcgagaagttcccagcggggcgcgcgtacgcgtcgtgcgaggacctgccgaagctgggcgcgtcaatccactggacgtacgacgcgtccaagacctccctgtccgtggcgttcgtcgcggcccccgcggcggccggcgggtgggtggcgtggggcctgaacccgacgggggaaggcatggcggggacgcaggcgctggtggcgctggcggggtccgggtccgcggcgcccaccgtgcgcacgtacaacatcacgggctacgtcccgctcggcaaggcgtcgacgccgctcgacttcccggccaccgacctcgccgcggacgccgccgggagtggaggcaagatccgggtgtacggcaagctgcagctgcgcaaggggatgaaggccgtgaaccangtgtggcaggtcggcgcgtcatccaccggcggcgcacccgacaagcacgcgttccaggcggataacctc

SEQ ID NO: 6001 - DNA, 832 bp, Sorghum bicolor
  Clone ID: SORBI-28MAY03-CLUS3185_1
ggagcgagaaatatcgtgacatcgtctgtccgcggccgggtacctctttctccgagtaccacaccagagggacggcgaggagcagacggcaacggggatgggaagcgcaggtgcgctgcttttgcacccgccgccgcagctgcaacccggtggcgtcctcttccgcaagagccggcccctcctgcgccagcgcaacctgcctctattatcgctagctgccgcggcgctcgagcccgagcgccgccggcggcagagcctccgctgcgctgccgtcgacggggacggcgggccatgggaggctgggccactgccacagaaagagtctccgaccagccgcatcggcgccgcactcgaggacccacctcctgtggaaaatggttccttaggcccctcagaggaagaacagagtgctctgtataattttctttatccaagcaaagacttacttccagatgataaggagatgagtatatttgatcatctagaggagcttcgtgagaggattttcatctcagttttggctgttggggctgcgatactaggctgttttgctttttcaaaagatttggtgctttttctagaggccccagtgactgttcagggtgttcggtttttgcagctctcgcctggggaatttttctttacaacattaaaggtttcaggttattgtggccttttacttggaagtcctatcattttgtatgagatcattgcatttgttatcccaggtttaacaagggacgagcggaaatttctcgggcctattggggtggggtcttctgttctattctacctaggcattttcttctcctacacggttctcagccctgct

SEQ ID NO: 6002 - DNA, 581 bp, Sorghum bicolor
  Clone ID: SORBI-28MAY03-CLUS31216_1
gccgctcgacttcccggccaccgacctcgccgcggacgccgccgggagtggaggcaagatccgggtgtacggcaagctgcagctgcgcaaggggatgaaggccgtgaaccaggtgtggcaggtcggcgcgtcatccaccggcggcgcacccgacaagcacgcgttccaggcggataacctcagcgccaagagcaagctcgtcctcgccggcaaggccgccgcggccgaggccccctcgcctgcctcccccgcgcccgaggccggcggcccgtccgcgtccggcgcaggcagcgacagcggcgcggcgtcgtccatgtcgccctccaagtcgcctaacgctgctgtgcccgcggctggcgtgtccgcgcccgcactcctcgtgctcgcgctggtgggcttcttggtgacggtatgatgatgatgatgatgcatggtggctggatggtgggcggtggcaccattcccagcgaaggtggcggcggcggcggcggtgggtaggggaggggaggaaatattgtggctgttttagttcatttttcggtttttttggccgtgaaataaaaaaaacggggggttgatgt

SEQ ID NO: 6003 - DNA, 934 bp, Sorghum bicolor
  Clone ID: SORBI-28MAY03-CLUS3123_1
gccggccgggccgggagccaccgcacccctcccgaccatgggacgcggcagtgccctgctgctgagtcgtcgtcgtcgtcgtcgtccgagcacggagaccgaacgccagcagtagctagcaacatgcgcaggactacggacggcggtgacgacttcaccttcgccgccgcccagccaccacctcgtctactatctgcagtcggcggcggcggcgggtgcatgggcccgccgctgctgtacccaatcttcggccggccgaggtccccgccgcgggcttctccggccccggagctggagacggccaccgcgcgggttccgctaggacggtttctactggtggacagggatccgtcgccctcgccgccgccagcgccagcgcccgcgcccgcggacgacgtcgtcgacgacgaaggcctcgactcggtgccggcggagatgttctgcccctggtctcccgggtggtcggcgtcggccgcggcggcggcgtcctccccggcgcggtgcaagaagagcggctcaacggggtccgtgctccggtggcggccccggctcgtcgtcgggcgcagccagagcgacggcaaggagaagttcgtcttcttcagcgccgcctcctccggcgggtcgttcgggcgccggaaccagaaggggcgaggtgccgtggagggtgccaacggcgctgccagcgccggctccgccggagctggtgctgcccacgcctggagctactacgtcaagaacaataacggcggtggcgcacgccggaggtcgttcctgccgtacaagcaggacctcgtcgggctgttcgccaacgccgccgtgttccgccggagctacctcccgttctgatatacacacccagccgcatatacgtatacactcacccagctcacatatactagctggtacgtatatgtgagcgattggtaactttttg

SEQ ID NO: 6004 - DNA, 599 bp, Sorghum bicolor
  Clone ID: SORBI-28MAY03-CLUS31262_1
gcacgaggaaggcgcccgtgtcagtggttcgaggccacccacggcagccgctcccatcgctgcggctggcggtggctttgactaggaagagaaccttccctgccgcgctcacctagaacaagatcaccgaagacttcgtccccgcgcctccatccacttccaggtgagcatgatggcccgaccccgaccctcgctgccccatctgcatctcctgagcaccggcggcccaccttaacactgatggcagtgaaccagtggagctgtaagagacagacgtgggttttgcccttgccgcttttgctttctcatttacttgtcatgctgtgtcgaagggtaacagggattcagggcctgtgaacttcatactcagtatttgtgaaatatgacgtaaaggttgacagagatgatgcccaccatgtattcactgaaatgctcttaaggtaatatatggtacaagttttaatttctcgttgattttttacgaatttgatatcaacttcactgtttcctttcatttgggtctgaaagcgctctttggacttgctcactgtttgaggaaaaatgcacactctatatatagtcccaactcaaaagcgcgg

SEQ ID NO: 6005 - DNA, 1055 bp, Sorghum bicolor
  Clone ID: SORBI-28MAY03-CLUS31234_1
gagagttccatagtgctgatggtagactcactgagaatgaagattaaggaaataatagaatcaaggcttgaagcttgcaaggcgtgggaagggcctttaacaccaactatggaatacaaagtgcaggatgagatgctgaaggctggcaaaatgactgttctgtgttcttctgagactgtgtttgaagtgaggggcaatgcaatttttgtagttaatattgggaattgggaatgcacatgccggcggtggcagctctctggcctcccctgcatgcatgccattgctgtgttcaacaggcttggtcgcaatttatatgactactgcccaaagttctttagaatagaaagctaccatctgacatactcaggaataatcttcccaatacctgacatggatagtgttgattttagtgctggtgcgaatctactcccactgcctcccaagcagcgctcatcagataaaccaagaaggaagcggtctaactccaacaagataagtactctcgtacgactctgtagcaggtgcaaacaaacagggcacaataaggcaacatgtgaagttcagttctagtcgaaagcaacctcttcttctctagtttgtacagaattagcagtgtcaaaggtctgaagttaaggtatagtgcagagaacatggtttcttttctcagagatatgaaatgtggcaaagcaaagtgtcattgatgctctggttcttgctgctatttttagtttcttgggtggaagggagttgcaatcattggatgttgatgacatacatgggcgatgcagcttaataataatttacttgtcagggagtgagctgcgatgatgccatagcttcctatcatagtttcgctgtaacagcagagtacatgggagatgcagcttagctttacttgtcagtttactatatggtcatatacataatacatagtgttgtaacatggattaagcatcgcagtttttaggctagttgacttcgtgtcttggttagtggcactgacgacagtaggaaaggggtaattagatattcatcactgaattcttttaatccta

SEQ ID NO: 6006 - DNA, 592 bp, Sorghum bicolor
  Clone ID: SORBI-28MAY03-CLUS31274_1
gcgtcggcgacggtgccaaggacaaggacaaggacgcggtcaccaagcccaacaaggccagcgcagccgcggcggcgacgaccgccgtgctgcgggacttcgacctcaacctgccggccgacggcgcgccgccggaggccaagcgggcacggacgacgacgatcctgctcgtggtctgatccatccatcggtcgttccaactacggcggcgccggcggcgggggagttggatggcggtctaggttttgatggtggtagaagttatttggttggttggttgattgctttgttaatttcggttgcgttgcgtgacgtcggctgcgcttgctctcgatcgatgtgataagcacaagcacagctgcgtcggttcgttcgttcggtggtatactacacctttttctctcagttcagactttttcgagagggagctgattttcgtggctccggtgctattcatctgtccatattttgcgacgcagagacgccggattaagaacagaagaacggctgcgatgtagctatctatacatagcacttaattacctgtaaatcctggtggtcaaagtccagatatatatacaattatacatgc

SEQ ID NO: 6007 - DNA, 503 bp, Sorghum bicolor
  Clone ID: SORBI-28MAY03-CLUS32041_1
gcacgagggatctctcagaagcactgaattgttaataccgtcaaaagaggcatcaattaccggcaggttgttttaccagtcacaatggtgattcctggaatcaaaacaactacaaatcatggaaccatcaaacccagaatatcatcacagaagtcagaattgaactgaagattatgaacaaggatgaactgtgttacagcctgtctcattaatgaattgtgtcaaggataataacagtattagtttggatggagcaggaacaagcattgctgcatcggaaacaatctggaatgctttgggttttaatgtgtctgggggtgtgtaagtgaaagctaataatgaaatcgccgtaccatttttaggtaggattaagctcatgtaacacagcaaactattcacttagatgcactatgagttaagtgaatcgtaggaaacaaattctcgtgctgaagcgagggatgactccagaatactcaaggcacgagtaaaaagttatccatgtc

SEQ ID NO: 6008 - DNA, 1093 bp, Sorghum bicolor
  Clone ID: SORBI-28MAY03-CLUS32053_1
gcacgagggatatcccagtcgtcaaataaagtttcaaacatcagagctcgcgtgttgtctgctccgtcaacccttattgtggttgatcagtttggctttccatatgctgaataccgagatcaagacgactccagagataaggaaggttcaacaaaggggcatcgcttttcaaatcctcggccccttcctcttccttcaccggaaggacattcttttaggaactctggtagcttcagggctagcaacgtaagtgggccattggagatgtccggccctctcccattgcctccaaagaaatgtgatggacttagaatcttttcttacgaggaggttttgtctgcttgccaatggttttcaagtgatcagtgtgtttcagaagcacttggttcaacatcatacaaggcaacatttagggatgaatttattgatacaaagaccactgaagcaacggtagctcgattactcccctccactcagagtttgaaggagtttaaaacacaagcaactacattggcattgcttcagcatcccaatttatgtaaactgattggctattatgcaaaagaagattctaatgaaaggatgttggtctatgaacggcttcatcatgggagcttagataagctactctttggaagaccagatggtcgtttcatggactggtctaaacgtttgaaggttgcccttggtgcggccagaggtcttgctttcttgcatgatgaaggaccctttcaggccatgtacagcgagttctcaactttgaacatccaaatagataaagatttcactgctaagctttcaggatatggttgtgttggcttcaatactgaggagatatctaatgcacctgcgtctgcagcaaacctttcggtggagaccttggagaagggtttactcactcccaagagcaatgtctggagctttggagttgtgttactggagctaataactggaaggaagaaccttgatgccaattcttctaaagaagaacgcaatattgtcaggtggagtaggcctttccttactgatgatagtcgcctatctctgatcatggactcccgtataaaagggcgctttcctactaaggctgctc

SEQ ID NO: 6009 - DNA, 643 bp, Sorghum bicolor
  Clone ID: SORBI-28MAY03-CLUS32172_1
aggagatgttccccgagtatgtggtcagttggctgtctccagagcttttggagacaggaatctaaaatcactattgagatcagagcctgatataaaagtcgaagacatagatcacactgctgagctacttgtccttgcgagtgacggtctttggaaggtgatgaacaatcaagaggttgtcgatttggccaaaaggtacaaggatccctatgctgctgccaagcaactaactgctgaagcgcaaaaaagagagagtaaagatgatatatcgtgcattgttgttcgtttcaaggcgtaaatcggtcacaggcagattcacgaaggattttcatggagagcaaaaaaacgagtaaattaggctgcccgatgacggtagtggtaatctgatggatgaataattactgggggttcgctgtaaatgatttgtctgctccattgtaaagttcatatataaatatgctactaggattatttggttttggcgatttcaaaggtacaggtgtgagggcccgagagctactaaatagctatcatatgtaaataatggttatattggacgttgaatttgtaagagtaggctgagcaaaagacatttggatagttcctagaggaattgcatggtcctctatatttcagaaggttc

SEQ ID NO: 6010 - DNA, 1114 bp, Sorghum bicolor
  Clone ID: SORBI-28MAY03-CLUS32200_1
gaaagggttgccaaacatttagttttccccagcagttgcttctcatagctttttccataaatcaacttgtgcatgagtttaagcttgtgccaaacagggcctgttttctttgcattccttcacagaaagtcacccattttttttttcttttaatctgtttttttaatcttgtgacagatgactgcttcaaggatccagattgctggtaggttcaagccctgtgctcacatgggttgttttgatttagaagcttttattgaaataaaccaacgttcccgaaagtggcaatgtccaatttgcctgaagaattactctctagagaacataataattgatccttacttcaatcgcatcacttctttgatcaaaagctgcagagatgatacgtctgaaattgatgtcaagcctgatggttcctggagagttaagggcagagctgaactaaaggaccgggctccggggcttcggcccgagggtactctctctgtggccacagatacagcagccaaacctgaaatttgcattgtaaagcatgaggttaaagaagagccgctgtctgaagaggtgggatgtcttaagttgggacttaggaaaaaaagcaacggccagtgggaaattagcaagttaggggatgctgatctggtgccatcttctggtaatgaccattcaagatacttcgggtgcagtggctgcctcccccgcccatgctctatcgatgccaggctcagtttctggggctgatttgggggtaccagcaaacctggtggaagatggggatgatggcgcattgcaaccttgttcattaagtgaaagagatagtgccatgggtcttgctaacctgggagcagacactcaaacatgtggtgatgtccattctgacaaatggacagctgtcagcattagtgtctctgacgaagatttaactagtgccaagattgcatctaagaaaaggagcaatcctggagacagaataacagctttaaatggttcacttgtcggaagtgcaaaggaagacgagtgcaccggagagaggtcaccactgcagcagcgacgttcagttcgaccgagagtgatactagacgttgcctcagattctgattagcataagtacatt

SEQ ID NO: 6011 - DNA, 620 bp, Sorghum bicolor
  Clone ID: SORBI-28MAY03-CLUS32215_1
ttatggctattgtaatgttggttcgatcagtcaaagatcttgccacaaggagattgccatataaaggtggatcagaagaaagctactctgcattgtacccagactccatccagaaagaggaattccgtcctccttcaccgatccctggattcgctgaagccgacctattcgccgcggtcttgcaaaggctgggagagcttgaagagaaggttcagatgcttcaagaaaagccttctgaaatgccttgcgagaaagaagagttgcttaacgctgccgtgcgtcgtgtggatgcattggaagccgaactaattgtaacaaagaaggctttgcacgaggctcttatcaggcaagaggaactgctcgcctacatcgacagcaaggagattgccaaggctcagagaaagaagaaaacaatgttttgctactaggacaaggagggagatacttgtccttgcccagctgcttcctgagaggagatgccaaagatggcgtctgagatgtaaccagcgatcccttcattttcctgacacatgtgaatcaacaggtttccgttgtaaattgagaaaattctgacataaataaaatgtgtttttttgcatcaaaaaaaaaaaaaaaaaaaa

SEQ ID NO: 6012 - DNA, 543 bp, Sorghum bicolor
  Clone ID: SORBI-28MAY03-CLUS31426_1
gcacaaccggctgccgttgctgggggagccactcgacttgtatcaccacttggcgagccggcgccatttagccactttcttggggtttccttggctatgtgcttggctcctccatcttctcaccccggcaatcctccagcccttctcccactccatccgactcctgccccaggcctaccgctgcttctaaccgttcgttctctagggcctcttcggatctgcgtcaaccgctaaccataccagtcctgttgtgcataatcggacctgaaggcgctctaacgcgcataccatcgtacacgcctggtgccagcaatactctgtcacgaagacatatgggtcatcaagtcagcgggttgttgcggctccaggagcggcacgggtcggcactaaactatacctccgcggcaaccataaggtggcagcatagccggaatgtggggaaagatgtcatgtttgggagagctattgcccaccggagcctgcccaccggttgcctgcaaaaccacgtgaaaaagaaatatgagtcttcaagttagatgatgg

SEQ ID NO: 6013 - DNA, 615 bp, Sorghum bicolor
  Clone ID: SORBI-28MAY03-CLUS31483_1
gcacgaggatgatattatcgatatcacagcaaacacgaactgtacagcgcggcgacatatctcatgtcagtcaggaacaaatccagaagcacccgacggtgaaagttaccttttgaacatccaaattacttcttagcaccggacgacatatacagaaactaacgacgccaatagctaacggcagtttgagcaaccaattaaactatgctaagttcgatcgtgaactaataatctctactgtgcagattcttcaagctgccaatttgccaagaatcgccatgtccactattttcacgtctaagctaccttccaccttcacgatgccatcagacccatcaagtccaatgagttttcctgtggctccgcgcaaggggccattcattatcttgagcttctcgtttttcttcggcctgaccacctctagctcgtttgcagtgacgatcagttcatctccctcacccaatggcccaagggatacacgacatgatccatccgggagcacttccttcaccacagcattgctgacctcatcacctcccctggagacgttcaccaaaacatctggcagcagccagcttccggcagcctcgccacctattacgggagacattagtt

SEQ ID NO: 6014 - DNA, 1338 bp, Sorghum bicolor
  Clone ID: SORBI-28MAY03-CLUS31549_1
cctactggagtatttcaacataagcatcatcataagctaacaactttcaaattttgaacttcgagaaaaaaaaatccctatgtttgaagaaatgcccgtttcagaaagcgagtccaaatctctggctaacttcaacctgcatgacaagtaggggtaatcccctctggaagaatggaacggacgaactgccacactggacacagcgctctcggatctgcctcgccggctcgccccatgctctcccgtctcgctcgcgtgacaccaccctccattggccgacagggacgacacgccgtcgtggctgctcacgtgttctcaccctgcgctctcgccggccgaggcaagcgccgagtgtgccgccttccgctccgagcaaacgccaacgtcaggcgccaacgccatttattaatcaacaccccccaccgcaaccccaaagcccacgcttccgaagcccccggctcctcctcctcgcctcgtcgagatcgctctcacgccttccatagttccgctccagcaactccaccactcagcccgcccgccggagcaatggggagcacggggcgcgacccggaggtgacccgcgccgacttccccgacggcttcgtcttcggcgtcgccacctccgcgtaccagattgagggagcgagaagggagggaggcaaaggagacagcatatgggatgtatttacagatgacaaagaacgtgtcttagacaaaagcaatgcagaaattgcagttgaccactaccatcgatacaaggaagacattgagctcatggcaagtctaggttttagcgcgtacagattttctatatcttgggcacgtatatttcctgatggcttgggggaaaaggtcaatgagcaaggagtcgccttctacaatgacctcatcaactttatgatttcgaaaggtattgagccttacgcaactctgtatcattgggatcttccaaacaatcttcaaaaaactctggggggctggatttctgacaagattgtggagtactttgcattgtatgcagaagcttgctttgcaaattttggagacagagtaaagcgttggataacaatcaatgagcctctccaaactgcaatcaatggttatggtattggaatatttgcacctggtggatgccaaggtgaaactgcaagatgttacttggctgcccatcaccaaatcttggctcatgctgctgctgttgatgtttatagaagaaaattcaaggctgcacaaggtggtgaagtaggcttcgttgtggactgtgaatgggcagagcctttttctgaaaaagcggaagaccaaattgctgcacaacggaggattgactttcaacttgga

SEQ ID NO: 6015 - DNA, 1053 bp, Sorghum bicolor
  unsure (1)..(1053): unsure at all n locations
  Clone ID: SORBI-28MAY03-CLUS315_1
cgttcgcgcacccgggngccgcctcgccacggcggcggcgggcgcgtcgggtcccgggccgtcgtcgccggagccgtacccaccagagtccgacgacgggctggtggagctcccgctgttcccgctcccgctcgtgctcttcccggacgccacgcacgcgctgcacatcttcgagtaccgctaccgcatcatgatgcacacggtgctgcagaccgacctccgcttcgggatcgtcttcgccggcaactccgggtccgccgccgaggtcggctgcgtcggggaggtcgtcaagcacgagcgcctcgccgacgaccgcttcttcctcatctgcaagggccagcagcgcttccgcgtcgcccgcgtcgtgcgcaccaagccctcgtcgccgccgtccagtggctcgaggaccgcccgcccgccgaggccccggcacccggggaggacgccgaggcgctcgcaaccgacgtcgaggccctcatgcgggacgtcatacgcatcgccaaccgcctcaacggcaagcccgagaaggaggtcggggacctgcgcaggggcctcttccccacccccttctccttctacgtcggcaacacctttgagggggcgccccgggagcagcaggcgctcctcgagctcgaggacaccgccgccaggctgcgcagggagcgggacacgctgcgcaacacgctcaactacctcaccgccgcctccgccgtcaaggacgcattcccatcctcgccgtcttcggggtgaggtgaggtgaggtcgtcactcgtcagctaggaatggatggatgacgataaggagtttgtggtggagggtataggactaaactttgttatcactctttgaagcccttttttccccttctcttattatattttctatggctaggttctactgcatgtggttagcattttagcgtgtaaaattgtataatttggtgtgtgtcaactcaagaaaatttggagctgtgatatataggtccttgataaggatgggaattttgctctcagagagactcatgcttctgcggctaaattggagctgaattga

SEQ ID NO: 6016 - DNA, 803 bp, Sorghum bicolor
  Clone ID: SORBI-28MAY03-CLUS31564_1
tggaaccccaccttcttccccctcgtattgtccccggctcaccgcgcgccctaaccctagctcctcgattccactctgccccgagccgaattctcgcccgaattcgctcgcggggggcactcgctacctcgcccgccttccgtcgcgcggattcggtgccgcgcctggagatggacccgatggacatcgtgggcaagtccaaggaggacgtctccctccccaaatcaacaatgtttaagataattaaggagatgcttcctcctgatgtacgagtggcaagagatgcacaggatcttcttgttgaatgctgcgtagagttcatcaatctcctttcatctgaatccaatgaagtgtgcagcagagaagagaagaaaacgattgctcctgagcatgttcttaaggctctaagtgatcttggcttcagagagtacattgaggaggtttatgctgcgtatgaacagcacaaacttgatactctggattctccaaaagccagcaagttcacctgggattgagatgacagaggaagaagctgttgctgagcaacaaaggatgtttgctgaggctcgagcaaggatgaataatggagcccccaagccaaaggagccagaacaagatccgccacagcaaccacaagcacaaccccaacttcagctgcatactcaaacacagcaacccatgcaatctcaactgcagttgcattcgctaacacagcattccctccaacctcaactgcagctgcagcctcagtcacagccacaacagctgccacaagtgcagctgcaccctcagccgcagcagca

SEQ ID NO: 6017 - DNA, 606 bp, Sorghum bicolor
  Clone ID: SORBI-28MAY03-CLUS34380_1
gcgtcacctctgccccccccaccttcgtctcttctccccttcacccctttctggctttctctcctcccccgcgtccccgactcctgccggaattcgagatcccggaggttgcttcccaagggctcctccgctccgcttgctggatcaaaacaatcgtgctctcgccagaaaccccggctggaacccagccggaccaagccctgttcgccgtgagcgcggtgcccaggccgggccagatctgcgagatccgcaccgacaccgccactcctatcacgaggtggatgctctcgtgatctctcggaggccgcggggactgagcggcatctcggcggaggcgtggcctgcgtagctggtggcctgccgagatgcagcggaacggggtggtggaatgcagcgtgtgccgctcccgggtggtggtgccgagcccccggagcgtgtccagggcatacgacaagcaccgcagcaagatgtcgtccaagttccgcgcgctcaacgtcttcctcgtcgtcggcgactgcatccttgttggtctccagcccatcctagtgttcatgtcaaaggttgatgggaagtttcagttcagtcccatcagtgttaactttctga

SEQ ID NO: 6018 - DNA, 449 bp, Sorghum bicolor
  Clone ID: SORBI-28MAY03-CLUS32683_1
ctacgcgagggcgccgccgcgctgctcaactccatgacccgcgccggcttcccctacacgacggagcaggtccgcgacgcgttcgccgcggcggccgcgggcgggtccgacggcgccgccgccgcgcaggcggccgccttcaggaaggccaacgagggcaaggcgtagaggtggtgcgcgcgtaccatacgtgcatgtggcgacgtgccagatgagatgatcgagcgtctgtgtacgtgcatgatatggttagctggagttctcaggtgcatttgctgggttcggctgttggttcgatggttacgtacgttggttgtgtgcgtgtatgtgttgcatcgttgaacacaccgacctactagctcattgtctagtacagtagctcaatgtggtgtttgttttgttgttgttttttttcgtttggatcgatcgaacgaagcaaactgctacgt

SEQ ID NO: 6019 - DNA, 546 bp, Sorghum bicolor
  Clone ID: SORBI-28MAY03-CLUS32645_1
aacgccgcctcctcgctagccgctacactactatctacgccgccacggcacctcccccatgagatgagcgccgcggccgcagccgcagccacatccacagccgccgcgctcctcgccccgggtctaaagctctgcgcgggccgcgcgcgcgtctcctcctgccgcctcccactccgccgcgtcgccgccatggcctccgcccccaactcctccttccgcccagaggaggcacgctcccctcccgccctcgagctcccgaccccgccgctctccaagttcaaagtggcgctgtgccagctctcggtaacggcggacaagagtcgcaacatcgcgcacgcgcgcgcggccatcgagaaggcggcctccgacggcgccaagctcgtgctcctccccgagatatggaatggtccgtactcaaatgacagctttccagagtatgccgaggacattgaagctggcggagatgcagccccttcattttcaatgatgtcggaggttgctcgcagcttacaaatcactcttgttggtgggtccatagctgaacgt

SEQ ID NO: 6020 - DNA, 821 bp, Sorghum bicolor
  Clone ID: SORBI-28MAY03-CLUS32717_1
gcacgaggcctactacctctccaggaacttctccgtcagctcctgggacgacaccaactccatcatgtatctcgtcccccaacaagaagcctaaggtggaccccgccgatgacatggtcaccagcttcagcaacatcgactcgcagttcggcttgtccaactcgtccttggagatgtccggcatggacgactacctgcagatgcagcaggactccgtcgcctgcagagtccgtgccaagcgtggctgcgcaactcacccgcggagcattgccgagagggaaagaagaacaaggattagcaagaggctgaagaagctgcaagatcttgtgcccaacatggacaagcaaacaaatacgtcagacatgttggatcttgctgtagattacatcaaagagctgaaggaccgagtagagaagctaaaacacgaccaagcaaactgttgttgcctaggagtagccaacaagggctgctgatgctggaggagcaggtcgacggaggagggtattatgtcgtaacaatgtgattgttaaaccagaattgttgcttcagaagatcaggctctgattgtcaaaccagaattgttgcttcacaagaccaggctcatgtcaagtggcttccataactcagcttcctcgttcttggttgtaccacggattagtgacttagtgtcgacggcttgaagactaggagatgacaagtaggctatcgtaatttaattactgtggtgcggtggcttatgtgtaaaaagtcctccctttcaacgcaattgggattgttgctgataaaattattgtaggacatatcatgggtatcccattttc

SEQ ID NO: 6021 - DNA, 509 bp, Sorghum bicolor
  Clone ID: SORBI-28MAY03-CLUS32721_1
gcccccttggtggcaaacacactaaagatgaagaacgcaaattaggaaagtcagagagcacggtttgggaaaagaatgatgagcccagtgataaggtcgacgttcaggaaaatggctggggaacatggaaacaaaatgctagtacgtcagcttggtcttacagagccctcaggagcagcgcccttggcccgacaatggcaatgctacgagggaagaacagccagaggggtaaaccaccctatcgaaagaatggcaagtgatgcctaagtaaaccaccctatcgaaagaatcctagtttggtccgatcttttggagaaggtcaagcaagttgaagcagctgatcttatatatatatatatatatatatgtaaaatttggcgaggaagagtgactgccattgctgtcctggttattttggaacctgacctagcgaattctgatcctttgcaaaggatggttgtaattggctccgccactgtcaaatgcggttttagagactttagctggcg

SEQ ID NO: 6022 - DNA, 716 bp, Sorghum bicolor
  Clone ID: SORBI-28MAY03-CLUS32723_1
ggactcctggatggaagttcaaccattatgagatgaaaggggttcctgtaagaatagagattggtcctcgtgatgtcacaaataagagtgttgtggtttctaggcgtgatgtcccaggaaagcaaggaaaggagtttggagtgtctatggagccatctatattggtgaaccatataaagggtcgtctagatgacatacaagcatcccttttacagaaggccatcacattccgtgatagcaacattgtcgatgtaaactcatacggagagctgaaggacgctatttctgaaggaaagtgggctagaggtccttggtcagctagcgatgctgatgagctgaaagtgaaagaagagaccagcgccaccatcagatgctaccctttcgagcagcccgagggcaccaagaaatgcttcatgactggcaacccggcagaggaagtcgcaattttcgcaaagtcatactaggtccaccgtgtctgtccattgccagagattaaaacagcatttttcttttcctttttaggattgtaccctgtatcacggttcatggattagcagtggaatgctcgtgctgctgatatttgaaatgtaaattcgataatcaataggccaattttgttcccacctaagcattggaagctcgtttacaagttgtttgcctacttactacttagtatcaattgtttctaacaagttcccctgttgctaatgagtaaa

SEQ ID NO: 6023 - DNA, 657 bp, Sorghum bicolor
  Clone ID: SORBI-28MAY03-CLUS36478_1
gcacgaggcggatttatctcagtcacaagatcctcatctccacagagaagtacttggtattgcatgagattgttgatacagcattgaagaaactggaggctgaggtcggtcctatatctggagctccgaatatgagccctcgaggtgttagtcgacttactgttggtgctgaagttcagaaactttgtgctcaagcaatagatgctatggaatcattgttctcggatgtatctcctgctagttcaagaattcagcgaccatctatgataccaccaaactttgtaaagtttgaagctataaccccaacatctgttgtggtatttttggatttggttcactgtcctatgcttgcccaagaggcaacttcgtttaatatctggcaccgagtggctgttactgaatcgtacctgtcaaatccgagtggcataatacttgcgccatcgaaaaaattacctgtcactgggcttgcaccggctacaagctatatctttaaggttattgctttcaagaattcaatcgagttggggtcatgggaaattagaacgaagacaagctgtcaaaaggatgatccaaggggttcaatgccaggtggtactggactaggacaaaatagtgagagcccaaaggcaaacagtgatggccagtctgatccttcct

SEQ ID NO: 6024 - DNA, 924 bp, Sorghum bicolor
  Clone ID: SORBI-28MAY03-CLUS3648_1
tatccaccaagcaaggagatggatgccaagttaagggacgaggaggctagaagactacgagctgctgcaaaggacaaaggagaagcaaaaaggactcgaccacgggatcggtctcgcagggctggaccagcaccagaagctaatgcagagattcaagcgaacttagatcagaggcgacggatgataactcatgcgaatgcaaagagcaaaagtgagaagtttcctcctccgcatcaggatggaggtacgggtaatcgactgggatcctgtcgtcacatggagcctatgttcgagcatcaggatgcttccttcagtacagtagtccccatagagaaggggacctcacaaacatggtcggggccgttgtttgacccagcagctcttgggcagtcaaggcggaagaagcaaactaccctagatgctaaggctgctgcttactcaaagcagctccaaaaggaaacgggagggatacgagcccgataataaagtgtcccagtgctggcgagcaagctccaccagttttccttcaaaaaaaaaaaagaaaaagaaaatgaagtgtctttttttttggtcatcagtatgtggagggaccgtgggaaaggtttttcatggcgtatagatgaattttcttgttttgcccctccggtggttggaaagcaggcaacagcactgtttgtagggtgaagtcttccggattgtgtacatgtcatgtggtagcgtttccagtactgtttagatgcttctgaacaagctgccgtcaccaggacgggacctttagcggtctaaagactcgtgtatttatgctcttgatgacaattcagttgcccatgtgtatatatggattaattctttcttctgtatgtaaagagacgatggtaggcttgacttattaatgaatcaagtgtgatggcgacctttctcagt

SEQ ID NO: 6025 - DNA, 667 bp, Sorghum bicolor
  Clone ID: SORBI-28MAY03-CLUS3650_1
cgtgcgaggccatatgaccaaaaagttgatgtctacagctttggcattgtgctctgggaactcataactggcatgctcccttttgctaacatgacagcagtgcaggctgctttcgctgtggtgaacaagggtgtccgcccagctataccccaggactgtctgcccacccttgctgagatcatgaccaggtgctgggatccaaatcctgatgtccgtccgccattcactgatgttgtgaggatgctggagcatgctgagatggagatcctgagcactgtccgcaaggcccgatttcggtgttgcatctcccaaccgatgactaccgactgaatcaaacaaaagagagtcgaaaagaactccatggaagcataattgagtgtatttatcatgtgtccagactccgctcagctgaagtagaaagcacacctgagtgtatggctgtgtgtgtgtatactcaggtgtaatcctgttgtctttgaaatattcctgcccttagaaatatacctagtttgcgttttcagactcttgagatgttttagggctagcctatgtcctgtggaaacatcatgcaggcttcctattcttgtaatgtccttgtgatcctgctgctttgttgcatgttataaccctcctactggaataatgcacaaacactttgttgcttatg

SEQ ID NO: 6026 - DNA, 694 bp, Sorghum bicolor
  Clone ID: SORBI-28MAY03-CLUS36526_1
gtcaaagcaggcctcttgctcttgctcttgggggtggcttgagagaaggagaggagatggccgccgcggcggtcttggcgctgctcacggtgtcggttctggcgggggcagcggccggcggtgatatcgtccaccacgacgacgaggcacccaagatccctggatgcaacaacgatttcatcctggtaaaagtgcaaagctgggtcaatggcaaagaggatggcgagtttgttggtgtcggtgctcgctttggtccaaaaatcgtctccaaggagaagcacgcaaaccgaactaaactcacgctggctgaccctatggactgctgctcgcctccaaaacacaaggtttctggagatgttcttttagttcaaaggggcaagtgcaaattcacaaagaaagcaaagtttgctgaagctgctggtgcttctgctatagtaatcataaaccatgtccacgaattgtacaagatggtctgtgaaaagaatgaaaccgatcttgacataaatatacctgcagttctcctgccaaaagatgcgggttctgctttacatacacttcttacagatggtaacgcagtttctgtgcagctgtactctccagatcgtcctgtagttgacactgcagaggtgtttctatggcttatggctgttggcacagtgcttggtgcttcctactggtcagcatggagtgctag

SEQ ID NO: 6027 - DNA, 564 bp, Sorghum bicolor
  Clone ID: SORBI-28MAY03-CLUS36530_1
cgacgctggcaggagcgatggcggctcccgggaccggggctcgacggcggcgcccaccttcctcctcctcctccgttcctccctcctcgcctgcttcgcacctccgttcctccctccccttcatctctctctccctccctcccgaggtggcggcgggcgcgaggtgacgggctgacggcggccctcgcgggcagcgctccgacgcggctgtggcccggcggcccctccctctccctcagcctccacgcggtctcctcgatgcctcctcccgctggggagcatcagcatgtgcttctgtgctcgacgaaaccctagcacatgcagctgtgcaggcgcggcggcccctccatgggcacacctcgacgccgcgtcagtctgcgtttcttcctccagctgttatacgtgctattgcctatggatcaatatgcatgcaattgacagtactccctacggatcaaatatacatgcacttcagaaatttaaagggttcatgttgattcaacttggtcattgtgctgctgttggagctcaggacatgcatcatttgcgcagggatattcggtt

SEQ ID NO: 6028 - DNA, 663 bp, Sorghum bicolor
  unsure (1)..(663): unsure at all n locations
  Clone ID: SORBI-28MAY03-CLUS32901_1
tgaagaagctgcacagtttattgcttaaggagaaggagttgattttcgggtccaaacctagtcctaaaaagacaagcagcttcaataggaggacaagcaaccaccatccaaatgcaaatggcactggattcatgactccggttccacgccgagtttcagctggcagtgccaccccagagcttctaaccccacgctcatattctggccggtacaacaactacttcaaggagaacaggcgtctgacaaccgcaccgctaaacttctcagttggttccaaggaggatagcatgtcatccttcgcatccattagtggctcggaacctgattcgccattgtttttgcactaagtgttggttagggaggagacttttgggtgagacggatggatagcctcaagattggaccattgtgtggtagctgttaacattgctgatgggtaacaacaggttgtgacaaatttagatgagattgcttgtagatataatatctaacattcatggttctgctgtacttccaaatttaagtcgtaagttttggttaggaagcatgcaatgcctaagtgtgcaatgtatttgtttcgtgctaagtgtgtattctttcttcctttccccttttcggggttctgtactatgttttgcatgtgaagaanagggtgattttgtc

SEQ ID NO: 6029 - DNA, 476 bp, Sorghum bicolor
  Clone ID: SORBI-28MAY03-CLUS32948_1
gcacgaggcacaatggcgtcgctgctgcgcctcccctcgctgctctccccgtccaaggggcccctgctccggcgccggctgccggcggcgaggctcgcggcctccgccgcgtctaggggccaggcctcggcggccgcggagacccgcggcggggacagggaggggcaggtcacgccgcggtccgcggacttcaacgcctggtacacggacgtgatcgccgccgccgagctcgcggactacgggcccgtccgggggaccatggtcatccgcccctacggatacgccatctgggaggccatccaggactatttgaatgtcaaattcaaggaaacagggcatagcaacatgtacttccctcagttcattccatactcatttatagagaaggaagctagtcacgttgaagggtttagcccggagcttgcattggtcaccattggaggaggaaaagaactagaggaaaagcttggggtaag

SEQ ID NO: 6030 - DNA, 658 bp, Sorghum bicolor
  Clone ID: SORBI-28MAY03-CLUS32929_1
gcacgagggtcttctttctgcggaagctcctccaaaagaatggcttccccacgctgatatatcgttccagccattggtgcagtgtctggatgttgataaactaatactgctctttactgctgtcctgcttgaaagaaggatattgcttcgatcaaataagtatactctattgactctagtttcagaagccatttgccatttaatatacccaattaggtggcagcatgtctatattccaataatattctctagtggggttgattacattgatgccccgacaccctacatgatgggacttcattctggtgttgacacatctgcggtgacaatggatggtgtagtggtggtagatcttgaatacaaccggataacaacgtcagaagaaattcctcctataccagaaactgaacatagcttccttcgtggtgagatattaaaattactacaacccaatgtcatgggaattgatttcatgaaagtcaatcttgccaatatgagtgaccgttctttaagggctggcacaaaatcatggagtcaggaacatgatttccaacttaggctgatatttttgagattctttgcacagatcctgagtggttaccgtaacttcattgatactacttcaacgactggtttcaattctcaagcttttctgaaa

SEQ ID NO: 6031 - DNA, 957 bp, Sorghum bicolor
  Clone ID: SORBI-28MAY03-CLUS33026_1
gcacgaggccccccccgccgctcctcgcctcggctcgccattagagcgcgcgcgccaagctagtggcgaggttttcgagatgaaggtgatcgagaagattcaggaggccgcggggaatggccggacggcgttctcgttcgagtacttccctcccaagacggaggagggggtcgagaacctgttcgagcggatggaccgcatggtggcgcacggcccctccttctgcgacatcacctggggcgccgggggatccaccgccgaccttaccctcgaaatcgccaaccgcatgcagaacatggtgtgtgtggaaactatgatgcacctgacatgtacaaacatgccagtagagaagattgaccatgccttggaaactatcaaatccaatgggattcaaaatgttttggcccttcgaggggatcctccacatggacaagacaaatttgtgcaagttgaaggcggatttgcttgtgctcgcgcgtgggtgcagcatattagagccaagtatggtgattattttggcataactgtagctggttatccagaggcacaccctgatgcgatacaaggcgagggaggtgctacattggaagcatatagcaatgatcttgcgtatttgaagagaaaggttgatgctggtgctgaccttattgttacacaacttttctatgatactgacatcttcctcaagtttgtgaatgactgccgccaaattggtattacttgtcccattgttcctggcataatgccaataaataactacaaaggtttcctgcgcatgactgggttctgcaaaactaagataccttctgagatcactgctgcactggatcctattaaagacaatgaggaggctgttaaacaatatgggattcaccttggaactgagatgtgcaagaaaattcttgctactggcattaagactttgcacctttacacactaaacatggacaagtctgc

SEQ ID NO: 6032 - DNA, 919 bp, Sorghum bicolor
  Clone ID: SORBI-28MAY03-CLUS3226_1
cttctcgtcctcctgccgcggaagattttgcagcggaagctacttgctagcatgggaggtgcgggcggcgcagtcccgagccacggcctcgcctgcgcgcccccggccgccgtcacgtccgatccgcgagcgcggcgcgcttccccgggcagcggcggccactggagcagccctcagcagccactgaggagcgacctgctgccgccgcccaccgtcgcctgccgagctcgctctcggtcttcttcctcgtctaatgtgaactttgggagaggggatgatgcggataagttgctcgaggatttgctcaaacggcacggcgaggtggtgtacagctcatgtggacctccgtctcccaccgttgaggccgacgacgacgccgagtgcttgtcctttgctgtctcgttggctaaagccgcaagtgagataaaggctactgatatccgtgtactttgcgtgaagcggcttgtctactggactaggttcttcatcattctcactgccttctcaaatgctcagatagatgctatcagttccaaaatgagagagattggcgagaagcagtttagcatagttgcatctggtgatacgaaaccgaattcttggacattactggattttggtgatgttgtagtccatatattccttccgcagcagcgagcattctacaacctggaagagttctatggcaacgccacacccatcgaactcccatttgacacccaattgcagtgattgttgattgttatatcattctgagccagcaccaggaagcatcccaatcaagccaacatactgttcgctttactgagaagtgagattttcgtgaagccagatgacattgttaccacaaatttgacatcgtcatcttactggtcatcagatgtggtcagctgtgaaagaaaaaaaaccctgggtgcga

SEQ ID NO: 6033 - DNA, 723 bp, Sorghum bicolor
  Clone ID: SORBI-28MAY03-CLUS32274_1
agtccacagcccctgtcccccggcggccatgccggatctgagcaccggctacctccctcccttccctgaattctccctcgacgcggggaccctcaccgtcgaccacgccgaggatgctgccgccgccgccgccgattcggcgcccccgttcgcgtcgtcgtccgccaccgtgcgcggccgcggccgcgtcggccttgttgatgttgatgttgttgaacataaacacaatcgtatgtatgaaagtacctttcatgatgaatctgctgacatcaatcttaccttgttagtctatctattttattatattgatggtcaaagtgaaaagtttgattattaggaaattctaaaatgacttataactgttaccagtgttagtaattaatcttgtttgttgacttaggaagttaggatccagttttccccccttttcatctgcttagcatctaataccttcttcatttgtgcaaaggttgaatgccgttcgtgctccaagattatttatgctggagaagaaataaaatgttcagttaaaaaatgtctactgatgttccatctcagctgtgttgtgaaagatacttcaaacttcactgctgaaagcttcaggtgccctcaacatgtaagtgttggaattaatttattttcttgagacgagaaaaaataatttgattagtgggtgctatacactagttgatccttgacgtttctagcgaagtccaaagaaag

SEQ ID NO: 6034 - DNA, 748 bp, Sorghum bicolor
  Clone ID: SORBI-28MAY03-CLUS3231_1
cgtccggtttgaaagggttcagaattgaaagcaacatagtgtttcttggctttttttattattattggagtgaataaaatgcagagaccgtaaacattattgccgcagattggaccaagcagtttggattgatgggtgtgcacttctatttctgcccttcttcagttggaggtctgacctgggtgcatagcaatggtgtcttagaattggcaccatgattgcttcctgtgctccttaagtgaaggtatagccccttactcagattcttggctaccggcgtgttatgttgtaccactggatcaacaagggacgacctctctttggcgagcgaggtgtggtgtctcaccattgaacagcaaacggttgtcgattagaatttggaaactaccacagctacacaggatggcaaagacagtccacctgcagcgctatcacagtgcaaacccaagaggttcgattgaactgcagcgtgcgagggtgcaacctttgcagtgctatcaccaagattaatccagcagctcctgccgagtgaaacagcacaacaagatattgccagatgacaaaaccatcatacacgcagattgaagctatccatgtataatacgcatgctcatgtgcacatcaataccactacttgcattgttccctaatgtatgcagccatcaatggccataaattatacagctaaaatgttgctagacctataaaatataaccatgtatgaagtctaccttgatcattctcatgt

SEQ ID NO: 6035 - DNA, 912 bp, Sorghum bicolor
  unsure (1)..(912): unsure at all n locations
  Clone ID: SORBI-28MAY03-CLUS324_1
attaaagatattggaagaggtggtccgatggtggaatatgagaggagaatagcatcaggagacctagtagatggcgatagctttcaggttgatacaattcatcaattacaaaggctctatgaggagttgattgagaatgaagaagactgtcagctggatagatataagtcatctgagaaatcaggacggagtcgatggctatggtcccgcctcattactcagccttctacctatgctccagttaagggcctttacctctatggtggtgttggtacagggaagacgatgcttatggacttgttctatgaacaactgccatctaattggagaaaaaaacgtattcactttcatgatttcatgttgaatgtacatagtcgtcttcagatgcataaaggtgtttcagatccccttgatgtcgtagcagctgagatttcagatgaggccatcatattatgtcttgatgagtttatggtaactgatgttgctgatgctatgattctgaaccggctgttcagacaattgttcagcaaaggcgttattcttgtttcgacttctaaccgtcctccagataagctttatgaaggtggcttacaacgggatcttttcttgccatttattgacaccttgaaagaaagtgcatcgtgcatcccattggatctgcggtggactatcgtcaactgggttctgctgaacaaggcttctattttgtcggaaaacattacagtacgcttctgaaacagaagctccagtctttaattggagatgaggaacccagcccacaaactgttgaagtaatcatgggaaggaaattacaggtttccctgngagcaaatggttgtgcatattttccttttgaagatctttgtgatagacctttaggtgcagcagattactttggactctttaaaaatt

SEQ ID NO: 6036 - DNA, 1011 bp, Sorghum bicolor
  Clone ID: SORBI-28MAY03-CLUS3252_1
cgtccggcatgccttatatggcggacggaggatgaaagcttagaggcagcccagctacggaaagtttgcctcctaatccacaaggctaaagtggagcgagatcaccacgttcttgagattggttgtggctggggcagcttagcaatccaattggtgaagcaaactggttgcaaatacactgggatcacattatcagtggagcaactgaaatatgcacagagaaaagtgaaagaagctggcttagaggaccacataagcttcatgttgtgtgattaccgtcaaataccaacacaccgcaaatacgacaggatcatctcttgcgagatgatcgaaggtgttgggcacgaatacatggacgatttcttcggctgctgcgagacccttttggctcaagatggcatatttgtcctgcagttcatctcaatcccagaagaacggtacgaggaatacaggcgcagctcagacttcatcaaagaatacatcttccccgggggctgcatcccttcgttggcccggatcacgtctgccatgtctgcagcatcaaggctctgcatcgagcaccttgagaacattgggtaccattactacccaacgctgatacagtggagggacaacttcatggtcaataaggatgcaattttggccctgggcttcgatgagaaattcatccgtatatgggaatactacttcatatactgcgccgctggtttcaagtcacggacacttgggaattaccagattgtgttttctcgccctggcaacgacaaactgagcaacaacggcgatccttacgcaagctttccggcagctaatcaagctagctagctagctaacgagtctacgcccgattttttttggaagggatgtgattcatccgcactacagcagccatcgttattcattccgttaattcaattccgggcacatgcttccatgaagtgtgtgaactcaatgcaaccaaatgcaagggatttatacgaagtggatagatatatattttggtggtagctg

SEQ ID NO: 6037 - DNA, 703 bp, Sorghum bicolor
  Clone ID: SORBI-28MAY03-CLUS32476_1
gcacgagcctcagcccacctgccctcccttcccccctctccgttcgcctctctccccctctcccaccttcctctctactcgcggcgtcgagcgccgcggcccttcgccggcgccgagcacggagcacgcaccaggtccgcctctggtgctagcggaggtttcggtcgctgtggggggctttcggatttctccgtccccccttttgtttgggttctaaaaatttcagttcctggattggaactgagtctggcttaccaagacatggaaaagttctgctgcttcggcgccggttgctcagatttcacggggcatgggtcaacagcatctggtaaagggaaagtctgtcacgggcaagtcaaggtctcctatggatataaccttgtaagagggatgacgaatcatccaatggaggactatcattttgtcgatcttgttgaggtcaaaggaaacgagcttggtctttttgctatttatgatggtcatctaggagacaccgttcctgcgtatttacagaagaatctatttacaaatattttgaatgaggaagagttttggacacatacagatagagcgattacaaaagcgtatgagaaaacagaccaggctattctgtcacatactccagatttgggacagggtggctccactgctgtaactgccattcttgtgaatgcaggaagttatgggtagctaatgttggtga

SEQ ID NO: 6038 - DNA, 745 bp, Sorghum bicolor
  Clone ID: SORBI-28MAY03-CLUS33137_1
gcacgaggcagctctccaaaagagaggctgagttgcttcagcaaaaagaagaagtcacaaaattagcaaaatcattaaagcaggcttctgaagacgcaaagagaattgttgaagaagaaaggcacgaggctcatacagaaatagaaactgctaagagtgctgtccagagagttcagcaagcagttcaggagcatgagaagatgtcccaaaatactgggaaacaagacatggaagaactaaagaaagaagttagagaagcccggaggatcaaaatgttgcatcagcccagcaaggcaatggatctggaaaatgaaatacgaattttacgtaacacgtttgctgagaagtccaaggattgtgttaatcttttgaaagagttggaaatgcataaaaggttaaaagaaaatggtaccatcccttcatttgatttggagggtctccaatgcttaggatcaatgctacgtatagttggtctgagtggtacccacatggatttgtcaaatatttcaatccagtggttccggatacatccaaaagaaagcaacaaagagattatttcaggtgccacaagaccagtatatgctctagagccacatgatgttggacgctatttgcaagctgaaatcgatgttggcggtgaaattgcagtagcaaagacagctgggccagtagaccctgatgctggattggttgattatgtggagacactcgtaaggaaacctgaaactgaattcaatgttgttgt

SEQ ID NO: 6039 - DNA, 831 bp, Sorghum bicolor
  unsure (1)..(831): unsure at all n locations
  Clone ID: SORBI-28MAY03-CLUS3320_1
cgtccggtcgaaggtggtgcggccggaggaggtgctggagtcgctgaagaacgacggcagcatcgacgcgctccgcatgaagatcatcgcccagctcaaggccaacgaagatatgaagaaaaacaccatgatgatggtggagcaaagcaaggtattgaatactcctggagctgagaaaaagtcaaagctagagtgtagtgatgcacttcgacaggaactggagactccagtccttgagaaagcctccaaggcagtttgggagctgattctagacaatggtggattagggaaagagataactgaaacagttgagaaagtcttctgtcggctcagtggaattgacatgatgccacctccgccttcagtatctggtgctcgtcaagagaaagatgacatggctgttgatgaagttgtgaagagcaaggaggtggatgcttttgaaccatcctcatcaaggaagagacccttcagcgacatcaaccgaaaaggagcaggtgctttaccaaatggcagtgctacggaccagcatgatgagtccgaggatagtgaccagaagatatgatgctgctctgtgctgtaatttttagttcagcctgtagtagctttcgtcctggtctggcagcttctcggagccccctccctgcgttttctagggttgcatggtagcggcgccagttgcgcttcttctgcatacaggttctgtggggtgccctgaccggcttgtggtgtgttcagcttgcaagcatgcagctgttgtggtggttcctctgtgtttttgcattggtttaattggttgactaattccttttgacagttgttgtatgtttaang

SEQ ID NO: 6040 - DNA, 592 bp, Sorghum bicolor
  Clone ID: SORBI-28MAY03-CLUS33169_1
gcacgaggctcccctctctcgccgaaaccctcctccccaacactcgctgccatgggcaggaaaccctccgccgccgccgcggcgatcgaccacgaatccctcgcggccaccatgcccgccgacctcctggccgcggccgactgcggtggcatccacgggcatgccctcttcttcgacgccctcgtgcagctcatcccgccgcgcttttatctcccgtccggcgacgaggaccgcccgtggtaccagggcctgtccaaggccgccaaggcggccatgaaggccaagtcccgcgccaacgtcaaggccgcccgccgcgcacgcctcgacccctccgcgccgcccgcctccaccctcgacctcctcaagaagtccgtcgccggccaggcggcggaggaagaggaggaggatcaggaggagaagtcaggagaagagagcgaggaatctggggaggaggcaagctccgaggacgatggtgatgcggaagacggagtggaggaggatgagatggagattgctccggcggcagtggtgtccgaggaccgttcggtgacttatgaggagctgaaaggacgccttcaacgccgcattgctg

SEQ ID NO: 6041 - DNA, 559 bp, Sorghum bicolor
  Clone ID: SORBI-28MAY03-CLUS3323_1
gcacgaggaattccttgtcgggtaagttccgacccgcacgaaaggcgtaacgatctgggcactgtctcggagagaggctcggtgaaatagacatgtctgtgaagatgcagaaatcggaagatggacttcatatatgaggatgagcttaataattttgttgatggtggtgtcctttctgagttgattatagccttttcccgtgagggtcctacaaaagagtatgttcagcacaaaatggcacagaaggctgccgagctctggagcatcatttctcagggaggttatatttatgtttgtggtgatgcaaaaggcatggccagagatgtccatcgcacactacataccatcgtccaggagcaggggtctatggacaactcgaagacagaaagctacgtgaagagcctgcagatggaagggagatacttgagagatgtttggtgacgtatcaaccaaatgtgaaccccgtgcttactgcgagcttccccgcaaaggggggggggggaatcagaagcgccggctgggaaatgattagtagaaaattacatgatctgtttgaatg

SEQ ID NO: 6042 - DNA, 697 bp, Sorghum bicolor
  unsure (1)..(697): unsure at all n locations
  Clone ID: SORBI-28MAY03-CLUS32761_1
taaagaaaagcaggatccntgtgtctgacaaagacgagggtctcaggaaagcaaggcgccccttcattgttcaggcttttagccaacaattcagaaaggatttcacaattttcttgaacacacgggctaaagaattggcccctaatggtcaaatggtgctttccatggtaggcagaccttccagtgacactgcctaccaatccgttcaaccatgggattttttatttgtgcctttaaatgacatggcatcaaggggtgtgatcagtagagacatattagattcattttacgtaccactatatgggccttcagataaggagttaatggagatcatacaagatgaagggtctttcaagatcaacaatattgaggtgcatgaacaaatgactggtatagataaaagcatgcagactccaaagatcagggcactcgcagccagggctgcattcgagccaacaatcagccagcattttggacgttcggaaggagttatggatgagttcgttggaaccattgagcgccaactcagccacgttccagcttctcctgcaggcagcttacttttcttatgtgtttccctaacaaaaagggtatagaataatggcgcattactattccgtcgtgaattgctattagaatctgaactgggctcggaggtttgaaaggattctgcgagtacaacgtaagtttgcaccgt

SEQ ID NO: 6043 - DNA, 583 bp, Sorghum bicolor
  Clone ID: SORBI-28MAY03-CLUS32791_1
gagcatttctgcatacatgctggtgggcgagcagtgatcgacgcagtgcagcgtagcctggatctatcggatgagcaggttgagccgtcgaggatgacactgcatcgattcggaaacacatcgagcagctcggtgtggtatgaaatggcatattgtgaggccaagcagttgatgcggaagggggatcgagtttggatgattgggtttgggtctgggtataagtgcaacagcgccgtgtggaagtgcattctaccagcccgtagtgccgactcagcatgggcaaactgtattcatcgttatccaatggaagtcccaaaacaagtgtaattgccatgaccaaacagtaggtactgatggatacatgaaaccaagatgcatgttcagtcacaaatacaagatgcttggagtaggatccggtcttaattaggtatgttcatctatccaaagcacacattggtctccctctttacccttcttgtactctcctcaataacagcatacatgcctccctctctccaagttgtgcaaaggagttaataagttactccaagtttgtattccaaacgaaaatattatgggacct

SEQ ID NO: 6044 - DNA, 683 bp, Sorghum bicolor
  unsure (1)..(683): unsure at all n locations
  Clone ID: SORBI-28MAY03-CLUS32814_1
tcagcctcagcaccaacagcatcagccacaacaaaagcttgaccgcaggtctgccggcttggaagaactgataatgggatgcacgtcgtccacaagcacgaaaggggaaacttcaattgctcacccccaagagacagaatggccttacccgtactggccacctgacaaccaagatcatcatggatagtagcaaggactggtaaaatagtggcgactggcgatgaatgctaaaaggaacactaaccacaaccactttcactggaatggtttttgtctgcttgaacatgcagcgatgcttttcttggagaatgtacacctactatagtggggggaagaacagagaaaaattgatctctgtagatctccctcaataaaaaaaaggaactatgtgagctctccaagacagaaaagacaaaatggccaacgaaaagagaagatgaaagatcgatgggaggaaaggtattgtttgtgctgacactgaagggatcatgtgtgggccgctagatgtattagagaccacttaatcaagtacaactataatcagttcaccgtttatcatagtttttttattcgtactacctattttctaattgtaaagagtagtggtattgtttgcgtgtacattaacccttttaatttcttttgctttccanaattgatgctgattttaatttcccttggtt

SEQ ID NO: 6045 - DNA, 1176 bp, Sorghum bicolor
  unsure (1)..(1176): unsure at all n locations
  Clone ID: SORBI-28MAY03-CLUS3281_1
cgtgcggactagttctatctgatccagctctttcacttggatcagagagtgagaagtctggtgcatctatagatcataatatgttattagagtccaaacacgaggatataaatctgaatgcaagtgaaatacatcatgaagaaactgcaggcaaaagacaaattatactggggcattcttctgcagatccctatggaactaatcttcccacaatatcaacaggagaaggtcatgacatggttcgggattatcccgctgctgcaaaaggtagcacaggaacagtaggtggaaacaaaatggagaaagcagatcagaatgaagctctcttctgtttttcacagcaaccaggtgcaattagatcaatctcacatgagataaaacttaagaaacacagtcttctgccctcacattgtcatagtggatcaaggatatgtgatgatcaaaccaaatcagctccaagttcagatatgggttctttggattctaacctcaccaacaaaaggcagaagacttcttatggcaaacactctacttgcatttttggagatgaaatgccacctattaaatgcttgtccaagatacatcccttaccgactggacaggatgatccatttgatgttttacagcattgtcacaggggtccttcagatcctgtccctcttcaaaaacctgtacctgatcatatcatccatgttctttcatctgatgatgaagattcaccagaacctagtactagcttaaataaggcatcactgaaggcagatgagggctcctccgctttattgtcactttccctatccatggtggcaacgaagcgtaatctttctggttcagatattgtagatgatgaaccactgtctctatctcttgggctccccagtattgttgacgggagtgcggatcaggagatgaagcaatttctgccggagaagccgggcataaacacttaatgcccctttagatttgcgagtgtacagttttgtgctatatttagctgtatggagtttagacagggtagaagtatggtatagctgttaaattatgagtatttttcctttcttttcactcactgttatatgcatctgctgctgttgttagtgatactggtctgatgatgttattgtctgccgtatttatgtgatatatggtgttagttttncgagggggggcccgggt

SEQ ID NO: 6046 - DNA, 891 bp, Sorghum bicolor
  Clone ID: SORBI-28MAY03-CLUS32926_1
aagcgaggacagcagcccaaccccaaccccgacctgccgagcgccggctgccgctgcgcaccaccaccagcacaggcacgagacagcgcttcagctcacatgccgcggcggccggcaccgcatttccaaagcccggggcgggccgggggcctcgccctcgcgcaatagacaacgcctctccaaccgcagcacggccacggtcacctagcctaccaccaaatacccggctgcgcgcgacgagcgagttggtaccagcgactgcgagcgccatatatcatatatccatccaaagcttcggaccctcggggacttgcttgctgcttccttccttgtccattggccatggcttccttgtcccggtttggtgcctgattgctcgacctcacctgatacatcgctccgccgtctatatagctgctgcctacaccggccggacagcggatgagtgcggctgcactggtgccgagccagggatcgagaccggcggcgagaggggcaccagcaggaaggctcagatggcgccggcgggactgaggagagccggcggcaggtttcttcttgcgcgggaaatcaggagcaggcgccctggcgccaatgtgcacttcttcggtgccagaggcggcgttacaatgccgcgcgcgttgctggaggatccagcgcccgcgccggcgatggacgccaccgccacgacgaccgggagggggtcgccgccgtccgcctccgtctccgccgcggcgtcgaggatcacgccggcggtgctgttcgtcacggtggtcctggccgtggtgctgctcgtctccggcctgctccacgtcctgcgccgcgtcttcctcaagagccaccacgccagcgccggcgccggggagcgccagctgcagcacctcttcttcc

SEQ ID NO: 6047 - DNA, 796 bp, Sorghum bicolor
  Clone ID: SORBI-28MAY03-CLUS32841_1
ctgaattcaatgttgttgtgcttcaattgaatggcgttgaccagccaaaagagtcagttcatgtactcaatgtcggaagactgcggatgaggcttactaaagggaagtcggtagttgccaaggaattctattcctcatcaatgcagttatgtggtgttagaggtggtggcgaagcagcctcgcaggcaatgttttggcgacccagaaacgacctcagcttggtgctagccttcgagagcactcgggaacgcaacacagccatcatgcttgctcggcgattcgctatagattgcaatatcatccttgctgggccaggcgacaaaactccctggtgaacgaagatggtacctgtgctctgctgatcccaccactcttaacaatctgcgattcgtgcagtgatgtacatcttgtgtgcacagcgtgtttgcaccagttcctctaatttttcagtctggcgtctgtgctgttctgctcgtcctcgtgttgtaggtttctgaaagaaggcgctgtgcgcaccgttttaaccgcctcggcgccgcctttctatctcactgtgctgtgtttttcagtcgcgagggttgtaatctgttgctaggagatgcgacagtaatgtaagcttgatgcggtacacgtctaattgtgtttgacatatgttagtgttgatgttgaagcaattgataggtaatatgtgtgggagtgagggaagaaaccttctaacccacctcggttgtgatgcgagcccaaatactggctcgcggttcttgttcaaatgatacaattgcacaattagatttta

SEQ ID NO: 6048 - DNA, 726 bp, Sorghum bicolor
  unsure (1)..(726): unsure at all n locations
  Clone ID: SORBI-28MAY03-CLUS33289_1
cgccaccgccgcctcccgttcgttctcaaggttctctccccgcgaccgctccaagtcccaacctccatcgacggggaggcgtcctccagtcgggccggttagattcatcgccttccttgtcgctggccctcggcctttccctctgctgttgtgggtagaagcgactcgcgcacgcgctcggccagccgattaaagcacggggcggggccgtacgcaggggcgagcgcgagggctctctggcgagaaggcgccgaggcacgcgaggctgccgccgtactgagtttgcagtccggggcgtagcagttttttggcccggaggtgtggaagcggagagcgatggctgcgccgaggaaggggacggcgacgccgctgggcgccgtattctccccggaggagaccaagagagccgtggcgagggtgtccgagtccatcgctggccgccgcgccgagctcgggcgcctccagggcttcgtcgccgacaacgcggccctcgtctcgctcgtcaacaggctccccgacgaactctctcacgaaatcatggttccctttggcggcgccgcatttttcccagggcgtttaatacacacaaatgaactcttggtgctgctgggtgaggggtactatgcanagaggtctgctaagcagacgactgatatattgcataggagggggcaggaattggaagctcaagtcgaagcaatgaaggcaactatcgctgaccttgaa

SEQ ID NO: 6049 - DNA, 698 bp, Sorghum bicolor
  Clone ID: SORBI-28MAY03-CLUS33358_1
tactgggtctcgacaccaccccgcgcgccacggcctcggcctcggcctcgctgccctgccctgctccgcctcctcacgctctccccgccctccccaccgcgacgcgctccccgcggcaaccgggcgtccccaggtccccaggagcacgcacgcccgcccttccgcggcgcgcgcccaatgcccagggcgcgcggtttatgggcacgagggcccggtccctcctccgctggctccgtcaccgctcccgctcccgccgcgtctcatcctcttcctcctcctcctccttccacctgacctccaccaccactaacaacaacgacagcaccgccaccagcggagacctccgcgctcgctcgctcccgcaccagttccacgccgaggaggaggaggaggagcgagaggtcggagaagagatcgccgccgagcccgcgtctgagtccgaggggtgcattgtcttgggggatccggagccgggtgctggaccgcgcgcaccggtgccgccactcatggatccgagcaaaaaggaatctgaattcttcaccgagtatggtgaggcaagtcggtatcaggtcagtgaagtcattggcaaagggagctacggtgttgtggctgctgctgtcgacacccagactggtgagcgtgtggctatcaagaagatcgttgatgtctttgatcatgtctccgatgcaactcgcatc

SEQ ID NO: 6050 - DNA, 504 bp, Sorghum bicolor
  Clone ID: SORBI-28MAY03-CLUS33362_1
gcacgaggcccgcccggccccgcgcccgcgcattaccattccaagagaggcagcggaagtcggcagagtgaaccggcggagagcttggagccaaggccttgtgttgtgcgtgccacattacagcacactgtgaaagatcgagatggcacggtgcccagctcatgtcgctctctgctcacttgctctgctcctcctgcttccagctgcgcggtcggcgacgttcacgatgaccaacaactgcgggtacacggtgtggccgggtctgctgtcgggcgccggcacggctccgctgtccacgacggggttcgcgctggcgcacggcgcgtcggcgacggtggacgcccccgcgagctggtcgggccggatgtgggcgcgcacgctctgcgcgacggacgccgccaccggcaagttcacctgcgccacgggcgactgcggctccggcagcgtccagtgcaacggcggcggcgctgctccgcccgccacgctggcggagttcaccctcga

SEQ ID NO: 6051 - DNA, 1000 bp, Sorghum bicolor
  Clone ID: SORBI-28MAY03-CLUS33369_1
gcacgagggggacaacagatctacccgagagcgacagattccacaagcgagagcgacagatcagcatggtggtggcgctgggacctggccggttctacggcagcgggctgccgaggccgcgcggctttcccggcgaccgcgtcgacccgccggcgtccgtcaccgacccgctcctcgagtgggcgcgcgaggcgcactggtccatgggcggcttcggcgtgaagcgcctccgcctgcagggccgcatcgagggctccatcgacaagctccgccgcaccgcgcgccgcgacgccagggcaaaggccaaggccaaggccccctccgccggccacatgcccgcctcgctcgccgcgcttggatccgacgacgacgcctccgatggggactccgaggacgaggaggaggtggcggcgcgggagccggccatgaagcgggagctcgtcgacggcgacgaggactctggcgagtcggaggaagatcgaggagaatgagccactcgcagctatcatcactgccgccaagaagaggcacgcgaggaagctcagcgacgagttcgaccgcatcgccgtggagcagcagctggtggcaaaagcaccggagaaatctcgatgccgcgctctcctccttccgctccaagatctccgacttccgccgcgccttcttccatggctccccctcttccgaatttcggtttggatttacatatgctagctggtttgcaagcgagtccgacagggacacgagcagacggtcgccagacaaccagacgaaaattttagctgaaattttgcctcttatgtggccacctctcgttgtctctacccattgatattttgcaaaaaaaaagaacaaatcaaaggtatattttgaaaactgtagatgcccaaggcatcacttatttgtaactattatctaaaaaaatcacttatttgtaactagaacaagtatatcactacaacagaccttatatgatgtttaattagtttactgtcataaacat

SEQ ID NO: 6052 - DNA, 644 bp, Sorghum bicolor
  Clone ID: SORBI-28MAY03-CLUS33401_1
gcacgaggagaaggcccgcctgatagaggagaatagcggcgaggaggacgaagcggggcgcccaggaaatggcgtcgatgcagagctggcgcaaggcctacggcgccatcaaggacaccaccaccgttagcctcgccaatctcaactcggacttcaaggatctggatgtggcgatcgtgaaggctactaaccacgtggagtgcccgcccaaggagcgacacctgcgcaaggttgttgcggccacgtccatcgccaggcctcgggcggatgtcgcctactgcatccacgcgcttgcccgccgtcttgccaagacccgcaactggattgttgctctgaaaacacttgtagtaatccatagacttcttcgcgagggcgatcctacatttcgagaagagcttcttaactttacacaaaggggacggattctgcaactttcaaactttaaggatgactccagtccaattgcttgggattgttctgcctgggtgcgcacatatggtttgtttttggaggaaaggttggaatgcttcagagttctgaaatatgatgtcgaagctgagcgtttgtccaaacaaggtcaaggtcctgaaaagggtcacagtagaacaagagagttggattcacaggatctgttagagcagctg

SEQ ID NO: 6053 - DNA, 637 bp, Sorghum bicolor
  Clone ID: SORBI-28MAY03-CLUS33028_1
actctcttccgctactccgctgccgcgccgccgcccgacaccgctgagtccaggacgtcgccgcgggactcggagaacacggtgtcgccatcgcgcctagcgagatcgcctgggaggtcggaagccgcatcggcatcatcgccgccaccgcccatggcagccgtcgcccccgtcgtctccgacctcgtcgacttcctcaacgtgtcgcccaccgcctttcacgccgttgacgaggcgaagcggcggctgaaggcggcggggttcgtgcagctctcggagcgggaggagtgggcggggctcgagcctgggcgcaagtacttcttcacacgcaaccattccaccatcgtcgctttcgccatcggcgcaaaatacgttgctggcaatgggtttcacatcatcggtgcacacactgacagcccttgcctcaagctcaaacctgtatccaaggtaaccaaaggaggttaccttgaggttggggttcaaacgtatggtggtggattgtggtacacatggttcgaccgtgatcttactgttgctggtagggtgattacaagggagaagaaggatggcgaggtctcttatgcacacaagcttgtacgggtacaagaaccaattatgaggatacctactttggcta

SEQ ID NO: 6054 - DNA, 546 bp, Sorghum bicolor
  Clone ID: SORBI-28MAY03-CLUS33034_1
gcacgaggcaacgtctttgcctcgggggagcggcggggcttccttgccgtcggtcgacagaagcgactcaccatcttccgcctcgacagtgggcgagaatttgttgaagtgaaggaatttggagtgccagatattttgaaatcaatggcctggtgtggtgataacatatgtcttggaatcaggcgggaatatatgataataaatagcatgactggggcactaacagaagtgttttcttctgggaggattgctcctcctttagttgtgcctcttcctactggggaactgatccttggcaaggataacattggggtattcgttgatcaaaatggcaaacttattcaagacggcagaataatttggtcagacacaccagcttctgtcgttatacatagaccatttgctgtggcacgcctgtcacggcatgttgagatacgctctcttagggctcccaatgcattggttcagacagttgtgctccgtgatgttcaaaagcttgtccaaactgaccactgtatacttgctgcgctatctaactctgatcat

SEQ ID NO: 6055 - DNA, 1011 bp, Sorghum bicolor
  Clone ID: SORBI-28MAY03-CLUS33076_1
ttctgcagctcctgagaggtttgaaatcaagtacgaatggtgtatcccgtcctactggaacttttaggattgagaactccacagaagtttcggtacattggtttaggattctattggggaactgcgcacctggctatgatgggcttattgcagatattcttggagattcatacattcttgcactctcaaggttgcagcagatgcttcctctaagtgtaatctttcctccggcctactcaatttttgccatggttctttggagacgatatatttttaaccgtgaagatccacagctttatcagtctctgtcaaacgcaataagtgatattaccagacatcaaccttttcgggagatctgcttccgtaatacacatcgtctgtataaccttctggcttctgatgttggtgattcagagtttgcagcaatgcttgaaagccatagcccggacaggaattcaaaaatattgccatttatacctctccgtgcccggctttttctggatgctcttattgattgcaacacaccaactattcacggggatggtgcttcagagccttgtgaccccaaagataatgaattaaagctttcagagaggcttatgcaacttcttgatactcttcaacctgcaaagttccattggcaatgggttgagagcacgcggcttttagatgaacaggctcttatggaaaaagttgcagcaggcaagacagcacttgaatcacttcggtcattatccccaaatgctgagggttttgccctttctgatagtgaaaaagggtttactgaagtgattctatcaaggctacttgctagacctgacgccgctcctctctattcagaagttgtccaccttcttggaaagcttcaggagtcgcttgttatggatgtaaaatggattttacaagggcaagacgctattcttggccgcaggtcaacaagacagcagcttgttcatattgcccaacgaaaagggctttcaacaaaggcacaggtttggaaaccatggggtt

SEQ ID NO: 6056 - DNA, 682 bp, Sorghum bicolor
  Clone ID: SORBI-28MAY03-CLUS33072_1
gcacgagggttagatcccacccccgcccgccgctcgccgccgacgagcaccgcatcctgacgcagagccgcgggcgaaccttcgcgtgcggcctcgcccgagatggcgactatggggagcctgatcgggctggtgaaccggatccagcgcgcgtgcaccgtcctcggcgaccacggcggtggcgccggcggcgagggctccctctgggaggcgctcccctctgtcgctgtcgttggcgggcagagttccgggaagtcgtcggtgctcgagagcatagtggggagggacttcctgccccgtggatctggtattgtcacgaggcggcctctagtgctgcagctccacaagacagatggtggtcacgaatatgctgagttcctccatgccccgcggaagcggttcaccgactttgctgctgtgaggaaagagattgctgatgaaacagatcgcataactgggaaaactagagctatttcaaatgttcccatccatttgagtatatattcgccacatgttgttaacttgacacttattgatcttcctgggctgacaaaggtcgctgtagaggggcaagcagaatctattgttcaagatattgaaaacatggttcgatcttatgttgacaagccaaattgcatcatcttggctatctccccagctaaccaagatatagcaacgtcag

SEQ ID NO: 6057 - DNA, 597 bp, Sorghum bicolor
  Clone ID: SORBI-28MAY03-CLUS33103_1
gcgcgcgcctgagttccaagccgatttcacgactgcaattgcaaaaccctagctactgcttcgccgaattccccctcctccgaccgcttcgcccgccgctgcccgtcaccgcggcggcgtctacgcttgtccctcccgctgcaaggagcacgtgcttctcggcgcgctgttcgcccgtcgccaccaccaccaccaccggttcaccgccagttatgtcttctcaggtggacagccgcagccaatccgccgggaagcgcgcgcgcaccgacggcagccggcgtgaggacgactgggtttgccccagctgcaagaacgtcaacttcgccttccgcaccacttgcaacatgcgcagctgtaaccagtccaggccagcagatcacacggccatgcagaagcctatgcagaccccgcctcactatcccgcatcagggggctacatgggcccagggacgccaccgtcgatgtaccttggtggggggtgctcccccatatggctcctcaatgtttaacgggcctgcaatgccacgctatggcatcccacagtaccctgggggttctgcgtatccatatggatatggtggtcgcataccaatgggg

SEQ ID NO: 6058 - DNA, 574 bp, Sorghum bicolor
  Clone ID: SORBI-28MAY03-CLUS33127_1
gcacgagggggtttgcccgcttccttccttgccgcgagatccaaaccccaatggaggagacgctcgcctcgctccgccgcccgaagcgccgcggccgcccgccgcggccgcgggaggagtaccacgcggcggacttcgaggatgtcgccgacgcggaagggctcgcgccgccccagtccaagcgcaagcgcgcggcatccgccgccgccgctgcgtccctggaggaccagccactcatcgatattatcaaacataatggcaggctgatcagccatgctgtcaaaaggttggttgaggactacgaatcgaagaaaaatttggtgacgtttcagattttaacaatgctatttgaggcttgtggagccaagcatgagatttatcctgactaccttcgcgagtctgatgtggatgacattgtggtgtctcttgttgacctagccaggaaaggtctggtggaagataattacaactcaaagcataaggatctcaaaaacttcaaagagaatctggtttgtttttgggatagcttagttcttgaatgtcagaatggcccgttgtttgatgacctcttgtt

SEQ ID NO: 6059 - DNA, 736 bp, Sorghum bicolor
  Clone ID: SORBI-28MAY03-CLUS33548_1
aaaagaaaaggggaacccgcttctcttgccccgagggttcttcgccgcccttcccatgtccccctgcgcgccgcccgccgccgccgccgcgcgcggagtgaacccggctaaaccactccgccgggccccgtcctcctcaacccatgctcgcttcccccacctctttatgtcctcttctcctccccgcacctcgcccctcgcggcggcggcctgcggaagcggggcggcggccccttcctcccttctcgccgccgacccgggccaccgcgaggccgtgctgctcgctgcacgcgccgccatggggaactgcctcggagagacccgcctcgacctcgcggtgccagggctccgcctcgctgccaagggcaaggtgagggacgtgtacgagagcggggagcacctggtgttggtgaccaccgacaggcagagcgctttcgaccgcgtacttgcttccatcccgtttaaagggcaggttcttaatgagacaagcctttggtggttcaatcagacccgtcacattactccaaatgcagtagtgtcttctcctgataagaatgtaacaatcgccaaaaggtgcacagtttttccagttgaatttgttgtgaggggctttgttacaggaagcactgatacatctttatggacagtttataataagggtgtaaggaactattgtggaaatgctcttcctgatggcatggtaaagaatcagaagctatctgcaaatatactgaca

SEQ ID NO: 6060 - DNA, 1117 bp, Sorghum bicolor
  Clone ID: SORBI-28MAY03-CLUS3355_1
cgtccgcggagaggcggagccgagcaaggcgaggaggcgactcgatggagttggcgtcgggggacgatgagctgaaatcgctgctccagaacttccatcgcgtctaccaggggtacaaagatgcacttatggaggtccaggctttaagagtaaattgcaacactgagttcaaaaggcgtgaagctcttgaatcacatattacagatcttaagaaagataatgagcgattaagaagactatacacagaaactttattcaagttcaccaaccaggtgaaattccacgcagaagctcaaagcctgaaagaagagctggaaaaggcaaatagtagattgatatccatggaagaggagcacaagagggaagctgagcaacttaagcacagcagtgaaatgaatagcaatgacctggagaacaaactcagccacgcccttgttcagcaagcaagagatgaagctgcaatgaagcaactgaagtcggagctgagtgcccataaagctcacatcgacatgttaggtagcaggttggagcaggtcactgctgatgtgcattcgcagtataaaaatgagatccaggatttgagggatgtgatttcagttgaacaagaggagaaaaaggacatgcacaggaagcttcagaatgcagaaaacgagttgaggatcacgaggatgaagcaggcggagcagcaaagggattctgtctcggtccagcacgtggagacgctgaagcagaaggtgatgaagctccggaaggagaacgagtccctgaagaggaggctggcgagctctgtagcctgaacatgaaaactgcagctgctttccttcacgccgtagctttatctcctactgtcagatttaggaaaatccaatgctccgagaacacatatcacactgccggttgctttgaaactggctacagccggcagtgattggtacgttttcattgacagttattgtcaccaaccgacagactcataacttttttcgtatgaaatcatacgaagattaactttatatcaaaattgtaaagttcaacaagacctataattttttagttgacaacattttcataactgagatgatttattagatgttcagatattcaatataagatcgca

SEQ ID NO: 6061 - DNA, 886 bp, Sorghum bicolor
  Clone ID: SORBI-28MAY03-CLUS33566_1
gcacgaggccgactccgatccatcgatccgtgtccctcctccctgttcctctctccggttaattagaggcagtaagccggcgagagcacgctcgcaatggtgtcggagaggcagcagcagcaggggaaggtggccgccttcaacctggcggagtccggcttcggcgaccaggccgacctgctcgacgacgacgggcgcgagaggcgcacggggacgctggtgacggcgagcgcgcacatcatcacggcggtgatcggctccggtgtgctgtcgctggcgtgggcgatcgcgcagctggggtgggtgatcggccccgtcgtgctgctggccttctccgccatcacctggttctgctccagcctcctggccgactgctaccgcgcccccgaccccgtccatggcaagcgaaactacacctacggacaggccgtcagggcatacctgggggtgtccaagtaccggctgtgctcgctggcgcagtacatcaacctggtgggcgtgactataggctacaccatcaccaccgccatcagcatgggggcgatcgatcgttccaactgcttccacagcaaggggcacagcgccgactgcgaggcgtccaacaccaccaacatgatcatcttcgcgggcatccagatcctgctgtcgcagctcccaaacttccacaagctctggtggctctccatcgtcgccgccgtcatgtccctcgcctactcctccatcggactcggcctctccattgcaaagatcgcaggtggggtgcacgtcaagacgtcgctgacgggtgccaccgtgggggtcgacgtcaccgcgaccgagaagatttggaagacgttccagtccctgggagacatcgccttcgcctactcctactccaacgtcctca

SEQ ID NO: 6062 - DNA, 615 bp, Sorghum bicolor
  Clone ID: SORBI-28MAY03-CLUS33635_1
agcacgaggctcgttccctgccggccgccgctcgctcctcacccgtcgccgtcgccgtcgccgtcgccatcgccctctcctggtcccggcctcccatctcgtcaccgcagggcgcaggtgcgcaccagcacacgctcacccgcgccgcccagctgcacacgctcgcccgcgccgccaacctgcacacgctcgcccgtgccgcccagccgctcacccgtagccgtcgcgccctcccggacacccagtcccggtcctccaagattcagatcagtgttttgctggcaccatgtccagtccgtggagccctatgagtatggaggaagacgaagagatccaagagcttgacgccgaggagcagcagggtggtgagcagccgcagcagggtgatgggcagcggccggagtcgacagctgaagcaagggcgcaacaaaccggaaagaaacgcgcaagatcagcggccaattcatctactaatccgtcaaattctcgtaaacctgaggcaaaggtaaaggttgaggaaagtgcaccaggagctgcgacaggagtgattctgtctcttcgtgagagtttacaggactgtaaacagagccttgcatcctgccaggtggaactgga

SEQ ID NO: 6063 - DNA, 644 bp, Sorghum bicolor
  Clone ID: SORBI-28MAY03-CLUS33659_1
gcacgagggtcagtttggggttgcagtaaatcccgtggcacctacccagcctgccatgggaagctattcgggacaaaatattgttgctgcagaaaatgcgcgtcgtttaactcctggaatggctcctgcaactgcaaatgcagatttgacctcccagaaccaaatattatcttctttaccgcaaacggatgacagattagctgatggctttcaatccaaatcaggagaagatgtttcacatggaagagtgagctcttcagctgaagctatcggacaactgggtgcacagcttggaccaacgcaactgaacactcagcaacttgaagacacaagaaaccagatgtcatcaactgatctctccaactcaatgatgccatcgcagatgatgtcaacaccatctgctgcatcagtacagccttcattgacaaccgttgctggcagtgataatcaaagcagtgggtgggctgtacctgcacaagtggcgaacacacctggccaatctcagataactggaaatatgacctggggaaatacacctcagggtgatgcaagcttaggttggggaatgatgggacagagcaatatgaatatgccttgggtagcatcagctcaaggtgcttcaggctacatgggtgtagccatgc

SEQ ID NO: 6064 - DNA, 764 bp, Sorghum bicolor
  Clone ID: SORBI-28MAY03-CLUS33231_1
gcacgaggctccctccaccgctccaccgccgcgcccacacgggtcctgccgtcttcatccatcccctccggtcctctgaagactaattcttcaggaaagatgagcttgatatcccagaacgcggtccagaagcgccgcctcaagaaaagtgaagctgatgatggcaatgacgagaacattggctctccgacctccatagatgcagaggttgggaaggaagcaaagttgaagaatcacaataaggaaaggaagaagaaaaggactaaggtgcaggagtcccagcagaacaaagagggcgcggggatgcggcagctggagagctcattgtttggttccctttatgcgccactggagtttggcactgaggctggggctgcagtagtagctcctgaccgggatgcgcctttgtttttcacagataggtccgctggtggtggcgtggatcattttcctatatatgaggaggatatggcccatgaagatgaggaagatgtggtgcgtatcaaggggaggttgcctggttgggggggtggaggaagaagaaaggacagaagtggacatcgtgaaggtttcaaggttgaggaagctaagaaaagaggaagatgagcatttgatttcagggaaagagtatgaggccaggctgcgtggtcagcatgccaaattgaaccccttcactggctgggctgatatggaccggaaaacttctcttcctgccgcgtcagatggtgagtctgatgatgagggttgtgttgatgatatccttc

SEQ ID NO: 6065 - DNA, 757 bp, Sorghum bicolor
  unsure (1)..(757): unsure at all n locations
  Clone ID: SORBI-28MAY03-CLUS33234_1
gcacgaggcgggtgcctcctagccgaaagggcgactccaaggcaatctccggtaccgccgccggatccgctagctttctcaactccggtggccttttcaacgccggtgggttgaggtcttgaggaagctgtggatccgatggagggtgtatatatcccttactattgtagtagtttcagggttagggttagagactttccaagcttcttcggcatcgaccatgttgggtgagtttctgtgttgatccatggacaagaggagcacagcgacaatatcatctacaggaggtttggtattggcgatttttttctttgttttggctattgttcgaaggagattccttttactggtggagtgtttaccgggtttgtgtcccttccttgaggttaagactccacttgctcatgtatatgggcaggtgtccttggatcccctttgtgggattgctgcttgttggccagagcataccggtgttaccattggcgtctgtttccggtgagagtggttttgtccgggacgttcaacgtttgaacaacactgtgtgctattgatgggcttcaaagactctttgtcgaattgagaatcagccaaaagcttcattctggatcttcttcattgcgggagatggaggaggttcagcctgcgacagcgaaggtcggtgacgatgaagggcactggatgctcctataatggtcttatgtgtaatttattttcttcaggggtacccagtcaagggcttggttgtaagagttnctat

SEQ ID NO: 6066 - DNA, 713 bp, Sorghum bicolor
  Clone ID: SORBI-28MAY03-CLUS33258_1
gcacgaggcccttcttcaccctccctcgtatgagccgagcaaggttgggcagcaacatgactagttttatgtagagcaaacttcacagcgagagaaaaaaatatcttccctggctcagagatcccccacaagaccagcagaagaaaaaaaacccaacatttttcagttatatcttttgctaccgagcaaacatcacagcttttcttcttgctatttttcttcacattttgtagacaccctaccttcagtgttctacaaacatagtagattcagccagcagaaaaacaaaattctcgttttgttctggtcactaggtccaatcttcctccagtagattcatccagcaagatcttggttctgttatttctgcccgtgtactcgagaaacaatcccgccttcaatagcagcaggcttcccatctctagaatccattctgctgccgccaactcttcaagcaagtgaagattcagcagcgggagaaaggccaagtctccagcgatggcagcggcgctggagtgctggtcgggtcggccgagcaccgacgaggagatggtagagcaggttctcatgaagccccacgggcgttcggacgactccctcccgacctgcgccgactctgcctacgccggcgagccgacgtcggcgcccgcgccccccaagaagtggcagcggctgggccgcaactttgccggcgccatcgccgcgttcaaaaa

SEQ ID NO: 6067 - DNA, 1166 bp, Sorghum bicolor
  Clone ID: SORBI-28MAY03-CLUS33264_1
gcacgaggggcatatccaacgtccgccgcacgcagaacgtcgccgcgcgcgccgcggccgcgaggctcgcgcaggtcatggcctcgcagaacgctgccgcggccgccggcgacgacgatgacgacgacgactacgccgccgaccacccgccgccgccccctgggaggttcggaagtggcagggtagcgcacggcagcaacggcgtgtccctgcttggacgctccgcgagatctccctcccctgcgctcgggcggaacattgtagagccacctcctaccgtccgctcatcatcggcaggcaggccagctgttgcatcacgaccgaccaccacagtggtgccaccgatcaaaaccaacacaacactgcgaaccccatcccctattccacctgtgtctgtggagcctccagtggatcgcactcggccgaaaagatttgatgcggggcttcataactcgagagaatcaggactaaaaagagaggcatccacgcttcacgatgagcttgatatgctacaagaggagaatgaaagtgttctagaaaagttgcgacttgctgaagaaagatgtgaggaagctgaagctagagccaaggagcttgagaaacaggtagctgctcttggagcacgaggatcattagaagctcgcctcttgagcaggaaggaagcagcacttaaacagcgggaggccgcactaaaagctgcaagagaatcaaaggatggtagagatggggaagtaacaacattaaggcatgaacttgagtctgccaaagaagaggttgcatcagcaatggaccagctaaaggaggcagagtctgaaacgaaggctctcagatctatgactcagagaatggtcttaactcaagaagaaatggaggaggtcgtcctaaaaaggtgctggcttgcacgctattggggcttagcagttcaatatggtgtgtatcctgaaattgcggtatcaaaatatgaacattggtcatcattggctcctcttcctctcgagattgttctttctgctggtcaaaaagctaaggaggaacctcgaaaacaaggtgaaaatggtcaggggagaaataaacttgcacgagaaatgagtgatgtgatgggagaaggcaatatagagagcatgctttcagttgaaatgggccttagagagctttcttcattgaag

SEQ ID NO: 6068 - DNA, 636 bp, Sorghum bicolor
  Clone ID: SORBI-28MAY03-CLUS33278_1
gcacgaggccccccgtcggccgtctccactctccagcagtccctcttcttgttccctctctctctctctctctctctctctctaggtttgcctgtgctgtgctgggtacagagaaggggatttgtgccaagaaactgacatttcgatttggggagtggctaaattcgtcgctgtgaaatcatggttctgaagtcgtacacaaatctgctagatatgtgttgtgaagatgtgttccaacaacctttaagatctcttcctcatgtggtgacctctcctggcatcatatctgaccctgattgtgaaagtagtaatgatggcaacttggttggttctacgcatatttgttttaagagaaaaattattgttgcaaatttccttcctatgatctgtgcaaaaaatgaagctaccggtgaatggtcctttgccatggatgataatcaacttcttgttcaacttaaagatggttttccaattgataatgaagttatttatgtgggtagcttgaatgttcaagttgatcctagtgagcaagatcgagtttctcaaaagctcttccaggaacacagatgcatacctacttttctcccagctgacctccagcagcaattctatcacatattctgcaaacagcaccta

SEQ ID NO: 6069 - DNA, 737 bp, Sorghum bicolor
  Clone ID: SORBI-28MAY03-CLUS33341_1
gcacgaggaatgttagctttagcaactcatgaagtccacttttctatattgagagaggtagtttttacacctggacagcaggacaagtgcttcttatgtggtcaggtgggacatctagccgctaattgtgaaggaaaagcaaaaagaaaagctggcgaatatgatgagaaaggtggcgcgagggttccaaagaaaccataccagtttttgaatatctggacccttcgggagtacttagaatatgagttcagaatgcctaatccgcctttccagattgattttgaacgcattgttgatgatttcatcttcatatgctttttcgttggcaatgattttcttccacatatgccaacactagagatcagggagggagctattaatctgttaatggctgtgtacaagaaagaatttccttcaatgggtggctatctaacagattcttgcacgcctgatctgaatagagttgaacacttcattcaagcagttggctcttatgaagataaaatatttcagaaaagggctcgtttgcatcagcgtcaatcagaaagaataaaacgggaaaaggcccaagcaaagcgtggggatgatctggatccccatgtcagagatgatcttattgtacctgttgcaaatttccgagggtctcgccttgcatctggagcagtaccttcaccatatgaacagaatggatctcgtagagaaaggaacagccaagctctgaaagctccaagagtatc

SEQ ID NO: 6070 - DNA, 772 bp, Sorghum bicolor
  Clone ID: SORBI-28MAY03-CLUS33749_1
tccagataccaatgtgaaggatctacacctgaaccaaagaaaagcactacagcaacagcatgcggaaagaatgaggcaacctgtgaaaaatctgaaggccaggaatctaactcagggctagcgttcctgaagctggctcatgaaaagcttagtaccgcagagtacaaagagtttgttgaatatatgaaggccctaaaatcgaaaactatggataccaaggtctcacttgaagcaataacaaagcttttttcgtccccaggaaaatttccacttcttgaagggttcagggtttttgttccaaagaactatcttccattatatgagcagcttgttcgaagatagtgtttgtagtacatgacaaccacttctgctatgttcgcaggacactatcagattcttgaggtgcatgcatttacttttggaatgtcatatggcgcttctggaatctgaggaaaagaaatggacatgacaaaactccatttaagatgaagttctgaaacttgaacggtgaaatgcagcatgctgcttgttgtttcggatatactctggaagccaaaaacaaaacactctgaatggatgccattaagtagaaccatgggagacatcaaagataaatgtagagttttaaaatttgggacaccatagttgtctatgtgactgattaagctgatagtttggcgtactatcctatggtttaccacaatcagtatcttagttgtgggtagtgtgaataaacgtaataatagaatgaaatatagtactccatccagaa

SEQ ID NO: 6071 - DNA, 773 bp, Sorghum bicolor
  unsure (1)..(773): unsure at all n locations
  Clone ID: SORBI-28MAY03-CLUS3383_1
aacagagaacagctaaccattgatatctttggacttccacctcattngtgctgtgaattcatagtacgccacctgcttaagaaacgtccggtcatccatgaagttacatttacaccagcaattttagtgtactcagtcgatgcctatggatcagaaatgtgtgttcccaatattgcatatataggtgtgaaaaaaacaacacaaaatggtatcagcatgtggccattatggtatgaaaccattacagaagacatgcatggctacccttgtgaaccatactatttacacaacaccggcaacttcgaaggagactctgaccttgacagtgagcatcgtagagaggtccacaaacaatactatgatcttcaagatggaaacaatgagatgacctcccgattaaaagaatatgtagccggattttcagacgattcagattgggaaccatatgcaccatgaccaggtatcttcaacaccaagcaagacagcatattttggcaacaagcttcaagcaatgaagaacaatattctggcagtctggattagacatatatattactactatgtaattgatgcatcctgtacatacatgcatgtatcgtatttatattagtctaatgtacttggctactcagaacaagtatctattcagtacttcggcgaacatataatgcatccgatatgtaaatacatgaagatctaatacgtttccgtatatctaccatataaaaaaaaaaaaaaaaaaaagggcgagcagctcgcgatctagaactagt

SEQ ID NO: 6072 - DNA, 568 bp, Sorghum bicolor
  Clone ID: SORBI-28MAY03-CLUS33832_1
tgcaggtggccaagggagcggatctatcagatcagcaaatttccaaggccatgtatttgctgcatctaaccctgtaccaacaaaccaaagagcagatcaattatttgatgtgtcctcggaaggagcgagtgcccattctagtgttcccatcaactacggtggttacaaccctccaaactatcctcagcaaaatctccgtccccatcatggacagccaattcttcatcagcgatataaccaggcaacttccagtccaatgcggccaatgggaagccatcacagtgggcagcctgcatggtctagtagttttggcatgggtgacggggtgccttggggaggaacaggagggcactcatatacgacaagtgggctaccttcatctcttccaagaaaggattatgggagcatcttttagtgtggagttgtggaccggaggaatgtcattgattcattgcaggcgtaaattatttgtattagcgaaattggagtgcgatgattctgcttgattgttttcgatgttgttaccccatccctccacttggttcctgtgtgaacaagacacggatac

SEQ ID NO: 6073 - DNA, 789 bp, Sorghum bicolor
  Clone ID: SORBI-28MAY03-CLUS33754_1
tttcagctgaacgcgcaacagcaaatgcagctccagcagcagttgcagcagcagcagcagctccaacagaacccccagcaacagcagcagctccatcagaacccgcagcagcagcaactgcagcagctacagcaacagcaacaaatacagcaacaactgcagcagcagcagcagctccaacaacaactgcagcagcaacagcagcagcagcaacaacaacaaatgggatctccgttacagcaggcacaggtgggctcacctgctggctcgcagcagtcgctgatgatgcagcagcagcagcagataagcccacagcaaatgggacagcaggctgccatgagcccccagttgagctcaggaacgctgcagcaaatgagcaataacgtggtcaaccctgtagccactccaggtcctcccccaagcccgcagctgagctcccagacccatgggtcggtaagcagcatagctaactccccgatggagcagctgcaaggcgccagtaagggaggtcccggtagcatgtaaccacaaataattggttcacttctttgcctatatatacagtgtaggaaggtgtaaacactggccaagatcactatgttttctttgttgtggtaaatgaggttaaattaggtgtgttatagtaagttatagaccatagatgatagcttgttaaggaccgaccatctttatgcatggatttttatgctgtagattgtagttagtaggaatggtagtcagttcttgtgaatcattattcaattggtcagttttctacttttctcgctt

SEQ ID NO: 6074 - DNA, 799 bp, Sorghum bicolor
  Clone ID: SORBI-28MAY03-CLUS33835_1
gaagaagctaaaaaagcatatgtagctgctagggaagagccagaccatgatgctgaggtcgctgcagaagaaaaggtctcgtcagcgctgattgagaaggttgatgctatgctccaagaattagaaaaggagattgatgatgtggatgcacaaattggaaaccgttggcaacttcttgataaggaccatgatggcaaagtgacacctgaagaggtggcggccgcagcagcctatctcaaggacaccatagggaaagaaggcgtgcaagagctcatcagcaacctttctaaagacaaagaaggaaagatccttgttgaagatattgtgaagctagcatcccaaacagagaacaatgaagaggaagaggaagcacggcagtagctggtagagtatttggaaacatcgcactcgtttagataggtggcctattattatacacatattatttcagcagccagagctcagaaattcaagagacctcagctacctatcggcagtgtcatatgtattgaaaggcaatgcggccattttttgtgcctcttggctgactttgatagtgacttccagttagtaaggtagacttcctgtagagatgctcatgctgacatgcatttagttaggcgcggtgctgtggtttggcaggtaattgcaacaaatttcgaccggttactatggacgtggaaaatacagaccaatggttgcgctactatgcatcccgaaattttgaatcggtttcgaattcgtaagtgatggttgctggatgtttgggtaatgtattgacccatgaagtttatggaat

SEQ ID NO: 6075 - DNA, 698 bp, Sorghum bicolor
  Clone ID: SORBI-28MAY03-CLUS33403_1
agcggcacgtcgcacacgcgcctgcacgatctcctcctgccagcgagatctcaccaccgcagcggcgccgcgcccatggcgggaaggtactaccaggggcagggcggtggcggtggcgggggcgcgtccatggaggtagtcagcacgccgaaccaggagctggcgctcaccaactgcgcgtacatctcccccgcggacctccgtcgcttccccaacggcctcgccctcgtcgccgacgcctgggtcttcaccctacgtgaccacaatgctgttgcaagtgggcgcattgccttgaatgctattcagcgtcggcaggcgaaggtttcagctggggattctgttactgttagcagttttgtcccccctgatgatttcaagttggctttgctcactttagagctagagtatgccaaggcaagagccaaccgaaatgacgagctggatgctgttgtgcttgcccaacaactccgtaagaggtttctggatcaggtcatgacctcggggcaaagggtgccttttgaattttatgggacaaactatgtgttcactgtcaatcaagctttgttagagggtcaagagagttctacaccattggatagaggatacttgtcaagtgatacatacatcatatttgaggctgctcctaattcaggaattaaggtgatcaaccaaaaggaagctgctagcagcaaactttt

SEQ ID NO: 6076 - DNA, 647 bp, Sorghum bicolor
  Clone ID: SORBI-28MAY03-CLUS33409_1
gcaccccacacgaaccagcaaagcaaacaacgaggcccttttcgccccttgcccctcggtttcgccgccgctccccggtgatctccgcgaccgtgacccgccgccgccgcagatctcgccgaggagacagggatcggttccgccgcccgggtaaccggaccttaaacgaggccctccgctccctgtcgagttcccgagtcactactcttccagggttcggcatccttggttccccacatggccagttccacaactcagcatgtgctttcgtccatcaaattgctgcccacaggctgcttccatcatgataggagaaatagctgcgtgctttctgtctcagtagggcgtcgctgccgcagtgcccgcaatttgggtttagtttgtgcttcaaacacccaatcttcagtgattgagccggttcagctaccggggagccctaaaagtggagcaactccaaagaaatcaggtgaaagcgcactcattctgatacggcatggagaatcgttgtggaatgagaagaacctgtttactggatgtgtcgatgttcccctgacccctaagggtgttgacgaggcgattgaggcggggaaaaggatatgcaacatcccggttgatgtaatatacacttcgtcgctgattcgggctca

SEQ ID NO: 6077 - DNA, 562 bp, Sorghum bicolor
  Clone ID: SORBI-28MAY03-CLUS33428_1
gcacgaggctcttcttctcctcctcgtccgccgttggttgcagtctcctccctcccctagctccagctgcttacgtcctttcaccgcaacaaacaagcagagagagagagagagagagagagagagcggcgagcaagtcaaaaagccatccatcatgggcgccttgttgctcttcgtctgcctcctggcgccgatcgtgctcttgtgcgccgccgtccgcggcagccggaagcggcggtccgcctcgccggcgtcgtcgtgcggcaaggcgctgcctctgccgccggggtcgatgggttggccgtacgtgggcgagacgttccagctctactcgtccaagaaccccaacgtgttcttcgcccggaagcagaaccggtacgggcccatcttcaagacccacatcctgggttgcccctgcgtgatggtgtccagccctgaggcggcgcgcttcgtgctcgtcacgcaggcgcacctcttcaagcccacgttccccgcgagcaaggagcgcatgctggggccacaggccatcttcttccagcaaggcgactaccacacccacctc

SEQ ID NO: 6078 - DNA, 634 bp, Sorghum bicolor
  Clone ID: SORBI-28MAY03-CLUS33459_1
gcacggcgcgtcggcccatcgataagcctggcactggcagcagcagaaaattggaattggaagggcaccagcgtccgcttgtggaacccgttgagagagtgaaaccagaagccatcaaactggtagaaccttgaccacctgcgcgataaaaccctctccaatctccctcctcatttctcgccagcgcccccgagcccccattttcaccgccagattcggtgccgtccggatcgatttcctgtgcatctgctcctacacgggagcgggtgactcagcacaacctgcgggcatctcctctctgttcttgcatcgaattttgttattgccgactgaaccgtgcagacaagtgtttggtgagcgcatgggcggaggtggagatgggggatcatgcgatctcctccaacttcttttcgagggggccttggctggaggagctgctggtgttgttgttgaaacagctttatatcctattgatacaataaagactaggcttcaggctgcacaaggcggaagtaaaattcaatggaaaggcctgtatgctgggttagctggaaatattgtcggtgttcttcctgcttccgcaatttttgttggagtatatgaaccagctaaaagaaaactactggaaatattt

SEQ ID NO: 6079 - DNA, 647 bp, Sorghum bicolor
  Clone ID: SORBI-28MAY03-CLUS33484_1
agaaagggtgagcacgaggcgagcgcgctgctgacggggtcgccgtggctgcgcatgcgcctcctcccggacgcgcccgcgagccccttccgccacctccacctccgccgggccctctccgtccgcgcctccgccgccggcaccggcaccggcaccgacggcagctccggccccgtacgcgtccgcttcgcgccgtcgcccaccggcaacctccacgtcggcggcgcccgcaccgcgctcttcaactacctcttcgcgcgctccaaggggggacgcttcgtgctccgcgtcgaggacaccgacctcgagcgctccaccaggaagtctgaggaggccgtcctcgccgacctcgcctggctcggcctcgaatgggacgaaggtcctgatgtcggtggggagtttgggccttatcgccagtcagagcggaattcactatacaagcaatatgctgagaagcttttggactctggtgcggtttatcgctgcttttgctccaatgaggaacttgaacaaatgaaggaagtcgcaaagcagggacaacttcctcctgtgcgtatggggaagtgggcaagtgcctcagatgtagaagtacagcaggaattagagaaagggacaccttacacttaccgcttccgtgtgccaaagga

SEQ ID NO: 6080 - DNA, 1032 bp, Sorghum bicolor
  Clone ID: SORBI-28MAY03-CLUS34016_1
gcacgaggctaatacagctgctgggcgcttggtaaatagcatgcaacctctttcaaggagaactagatcaattaaaggtgacaatcacattggtggcccagtagatgggtttccaaaagttagttctgttgatggaggctcttcatttgatggccccgcggggaatagcttagacatgagtgaaagtgatggacacactcggaaggattcgaaaagtttttctcgtgaaatcccaatttttctttcctgtgctacaccagatgagtttcttgaatcaatgataaaggcagatgccccccttaatgtgaagtacctgagaacattggtacaatgcttatccatgcttggaaaggttgcagctgcaggagctgtgatatgccaacgagtacgccctacaatccatgatgttatcacttcaaagattaaagcatattctgaagaggcttcaaaatccagtatagacaaagctgcaaaaatgtatgatgtgttgcattcaaatggacccattccccagttccaaatgctcaaacagaaaacaaagagtggcgcatctgtaatggcagcacaactagttgtcagtcccatttcgccagctatggcacccacaggagatgctcagcgtgcagctactcaacttcttaaatcaatatttgaatgtcttgtggagatacttgagaaccatattattgttggagagcttcttgaacaaaaatcgacagaggttgataacgtaaacacacctcatattgcaaatggggatgcaagctggaatccagactccgaatcttcccaagctactgggggtttcagtgttgcattctctctatcagtcgtgcagagtgaatgccagcaacttctgtgtgaaattttgcgggcaactccagaagctgctactgctgatgcagctgtccagacagctaggcttgcaaataaggatccagtgaaggaaaagagggatggatctgaaggcctttctttcgctttccgcattactgatgcagcaaccccagtgccaaatgaaggtcaaggatg

SEQ ID NO: 6081 - DNA, 720 bp, Sorghum bicolor
  Clone ID: SORBI-28MAY03-CLUS34049_1
aaaagcccattcgatatccagggcagggcagggcagggtctcgctcgccctcgtcgtctccgtctctctctgtcgagcgagagcaagaagacgagccgagggacgacagcagcagtagcagctccagcatcttctacctccttcattcatgggattaggtctctactgaggttttcgtctcctctcgattggtttggattggtttggattaggggtgcttcatttcatccgatccccatcgacttgacctgattctgatctcgacgacgatgcggaagcgggatctgggcatcctgctcctcgccgccttcgccgtcttcttctccctccaccatgagggcgacttctccttccgggagtcctggtaccacctcaccgacgaggacttccccatcaagtacgaggccgaccgcctgcccccgccgctcgtcgccgacctcaacggcgacggcaagcccgaggtcctcctccccacccacgacgccaagatccaggtcctccagccgccccacgcccgacacctcagcgatgactccgccttccacgaggcccgcgtcatggccgacatctccctcctccccgacaacgtccgcctcgcctctgggaggcgacccatcgccatggccgtcggcaacgtcgaccgctcctacagggccggcgaagccaggaagcaggtcctcgtcgtcgtcacctccggatggtccgtcatgtgcttcgacc

SEQ ID NO: 6082 - DNA, 648 bp, Sorghum bicolor
  Clone ID: SORBI-28MAY03-CLUS3406_1
gcacgaggcgacgacgtccagtccctcgcctactacaaggaccagcgcttcggctacaccacgctcgacgccttctaccagggcacccaggcgtccaccaagctgtccccggagttccacggcaaccagctcctccagggcgacgtcaccgccgccgagttcaggcaggagcagtccgcgggcaacttcgccgtcaacgtggatctcaacgccaaactcagggtcaaggtctgggcgttcaaggtccgcgggcctaagcgtccgatcagctgccagctctccgtccccgcgcctggtgccgccaacgcatcgccgttccagcccacgaattgcaaagtctggttctgattttgggatttgggatttggatttggatgccacctggtggtgtggatttcctacagatgctaggattactactagtagataatattgccatctgatgctgctgctgctgctgctgctgctttctgtggatttattctttctttcgttgattctctcagtcgatttccatgtcgattgttcctctgtacatccccgcggctgcttgatttatatatagattttcttttctatatcctatcctgagattcaaactgctagatgtgtaccagaggtaccatgtctaactactgatcactacgg

SEQ ID NO: 6083 - DNA, 620 bp, Sorghum bicolor
  Clone ID: SORBI-28MAY03-CLUS34110_1
tactggatgacgacatcccttctcttctccactctcctctcctttccctacgacttcaacttctgttctctctcaatctcctctcctctccctgtccgctggccgtgccttgccttgcgtgcgacgggaagattgggatccacggcgtcggaaaagttgtccggctgaagaaaccgatttccccaaggtttttttgtccggtcctatcccttgtgcaggatcggactctccgtctctggccatggctctcggcggcctcgtcggccagttcttggccagcagcaatgagcttatggtggcgtcgctctcggccgtgagctgcgcggacgaggtgcaggaggagggtgcggagggggcggggtgccgtgacgacgccgcggcgctgcggctcaaggaggtggccatggcggcgatcctggtggccggggtgctcggcgtcggccttccgctcgtgggccggaagcgccgcgcgatgcgcacggacagcgccgcgttcctggcggccaaggcgttcgccgccggggtcatcctggccacggggttcgtccacatgctccacgacgaggccgcgcgcgtcaaggcagccgccgctgccgcgctcgttgcgacgacctcctctg

SEQ ID NO: 6084 - DNA, 663 bp, Sorghum bicolor
  Clone ID: SORBI-28MAY03-CLUS34092_1
cctactggaaaaaccctaacggcccgtgggccgcctctctcgagcgcttcccactctctcccacctgcgccgcctgcggcctgcccctccccccacttccgcaccatcgcgaagtcgacctcaaggtcgcccttcccgtaccttctagaacaccaggatcgccagcgccgccgcatcggggcgctggcccatggacaagctccgcgtccaccgctgcactggcggcgcggtcgagtggtccccctcccccatcgtcgcgctcgtcgcctctccttgcgcctcccaggtcgccgccgcgcgtgaagacggctcactcgagctctggctcgtctccccgggctccgtcggatggcacaaccagctcactatacaggggaatgccgaatcgaggatcacatcactggtgtgggggcggagaggaggtgaagctaccggcaggctgctctcgtccagcgttgatgggtcggtgtccgaatgggatctcttccacctgcagcaaaagactgttctagatactgttggagttccaatctggcaaatggccatcgagccttcagatgatgctaaaagtactgaaaataattgctcagagtctggtgtcaatggccatccaaaccaaaatgactccagtgattctgacttaagtaacattgatgatggtga

SEQ ID NO: 6085 - DNA, 520 bp, Sorghum bicolor
  Clone ID: SORBI-28MAY03-CLUS34469_1
gcacgaggggacgacgaggccgatctgatggacctcgacggcgacgtccgcgagaggacgctcgagggcaaggaggccacggacgcgcgcctcacggcggcggccgtcgccggccgtctggctgccgtttccgtccgcgggagccacccggcgcgtggcgtcaccgacgccggcgtctccgctctcgcccgtggctgcccggagctccgctcccttgccctgtgggatgttccgcaggtgacggacgccgggctcgccgagatcgccgccgagtgccactcgctggagcggcttgacatcactggctgccctatgatcacggacaagggcctcatcgccgtcgctcagggctgcccggaactgaagtctctcaccatcgaggcatgctctggtgtggctaacgagggtctcaaggcaattggccggtgctgcgccaagctacaggcagttagcatcaagaattgcgcacatgtggatgaccacggtgtgtctggcctcgtctgctctgcgaccgcctcgt

SEQ ID NO: 6086 - DNA, 913 bp, Sorghum bicolor
  Clone ID: SORBI-28MAY03-CLUS33705_1
cataaaaattcttttacagcttcttggttctcggatggttacacatcctgtggctatagattctattcgagcccttgcctgccgtgtcctgcttggcctggctagagacgatacaattgcacatatactgacaaagctccaggtgggaaagaaattatcagaactgatccgtgataccagtgcccagacgtctgggggcgataatggaagatggcaggctgagctgacccaagtggcaattgaactaattgcggtattgacaaattctggaaaagaaacaacattagcggcaactgatgctgctgctccagcattgagacgcagcgcgcgggctgggatagccgctgctactcctatctcctatcactcaagggaactgatgcagttgatacatgaacatctccttgggtctggtttcactgccactgctgccatgctccagaaggaggctggccttgcacctttaccattgacagcagcagtgcttcctgcccaccaagttgctgccctggaagcatcatctgttcagcaacagtggccctctggacgtgttcagggatttctctcagataaaataaatatgtcgacagatcaatctgcccagagatcagattctatcctgccttcatctaagaaaaaggcactgaccttctcatccagtttctcacgaagagctctgtctccgcatcctatttctggtagcagagcaagcaacatccttaaaagtcctgtacctattgcggctgatattggagatgcagaaatgttgaataaaacaccactgtcgctgccacttaagaggaagcttgtggatgtgaaggataataattccgcatcagcatcgaagcgcctcgcagcaactgatcaaatgtaccaaccatctgcattccaaactcctgctcccactcgcaaa

SEQ ID NO: 6087 - DNA, 663 bp, Sorghum bicolor
  Clone ID: SORBI-28MAY03-CLUS33717_1
gcacgaggagacggccgtccctatcggattgcttcgagcttgagcattggagtgttgctgctaggcgagatgaagaggttgcttgctcatcgccagttcggttgcccttcccggagcttggtggccagatcccctgccctgccagcactttgcaacaatgttcttcccagctactacaggtattattccgccgagaaacacgatgacaccaccctaggtgaaatcggggataaggcaagatcaacagcggaagagttcgtgagggtagcaaaggagaagactgacgatgtcgcagagagggcaaaagaaacgctgcacgagacgaaggaagcggtggtcggggagtcagatgacgagaaggagaagttcaaaaggagggtggaggaggggaggtacaatcatcagaaataagtggcttgtgttttcttgactgtgtatgcagtcaggctcatggctcgttaaactcacatgatataggccttgtagtctgtaaaagtttagtctctgcatccagtgtcttgtccaattttcaccttcaataatgtggtgtgaccgtcagcactagaaaagctatctcctgtagaataaataagatttgcttttgtgcttcagtctctttcgaactactacaagccatctcacactgaataagttttgcctttg

SEQ ID NO: 6088 - DNA, 671 bp, Sorghum bicolor
  Clone ID: SORBI-28MAY03-CLUS33721_1
gcacgagggtgcaaaatcacgtgacctcgctgcctttcttcccccacttcgctcgccggaactctgaagcctccccagtcgcaaaccccgcccgcccaccaacaccaccatggacgccggcgcgaaggagacgctgatcctggacctgcacgcggtggaggccgtgaagctaggcaccttcgtgctcaagtccgggatcacctccccgatctacctagacctgcgcgtgctcgtctcccacccgcggctgctcgcctccgtggcgtcactcctcggctccctccccgccacgcgcccctacgacctcctctgcggcgtgccctacacggcgctgccgttcgcggccgcgctctccgtctccgcctccgtgcccatgctgctcagccgctacgacaccaagggtgtcgagggtaccttccgcgccggcggcggacagaccgtgctcatcgtcgaggacctcgtcaccagcggagcatccgtgctcgagaccgtgggcccgctccgcgccgaggggcttgttgtcgccgacgccgtcgtcgtcatcgaccgcgagcaaggtgggcgggagaacctcgccgccaacggggtcgcgctgcactcgctcatgacccttacggagatgctcgccgtgttggtgaagcacgggagggtggacgaggataaggtcgcgg

SEQ ID NO: 6089 - DNA, 663 bp, Sorghum bicolor
  Clone ID: SORBI-28MAY03-CLUS33728_1
gcaccgggctcgagagggggtgcagaacctcgaagctcccccagcgcccggcgccggcgcttcgcgctctctgccacggttcctcccaccggccggccggccgctcctctgctggtctgctggatttgagcggggatttaaccacacgcggattggattggtactgctcttttgctgatcaccacacatgacaagggtcatccatgactccggagatgacatgcacaaggaggcacttgatttggtctcatcggatgttaactttcccaagggccgtttcccagactacaggattggaccaaacaaccaaatcattgatccagaggagactcatgaggctgtacctctcaaggagattgttgcaaaggaaacagcacagttgctagagcagcacaagcgcctttctgtgcgtgatctcaaagagaagtttgagaagggtctatctggcgcttccaagctttctgaagaggctaagcgtcgagaagccgcttcattagacaggcaggttcttctgaagaagctcagagatgttttagacacactgaaaggccgtgtggctggtcgaaatagagacgatgctgaggaagctatctcactggtggaggctctagctgtccagctgacacaacgagaaggggagttaatttatgagaaggctgaagt

SEQ ID NO: 6090 - DNA, 383 bp, Sorghum bicolor
  unsure (1)..(383): unsure at all n locations
  Clone ID: SORBI-28MAY03-CLUS33738_1
acccggcccgcggcccgtcctctgttttgcccagggccaacaacgggtcgagtggaaccaacgcccgccattagaagagagaagagagaatagagataggtgtggggaggaggcagacgagaggcgtagggaattcggccgacgggggtgtgtggagggagtgagtgagtgcgagagggagaggggcggggctgtgacgagcgagcgtgggctgctggcgatcgcgggagcgatgacgacggcggccggcatgccggggtcgtcgccggtgggctcggcggctgccgcggctggcggtcccgcggcgcccgaggtggcggcaagggacgcggtgatcgggtggttccgcggcgagttcgccgcggncaacgcgatgatcgacg

SEQ ID NO: 6091 - DNA, 697 bp, Sorghum bicolor
  Clone ID: SORBI-28MAY03-CLUS34348_1
gcacgagggatcgacgctgcaggcatagctgcagctccgtcctcgccctccacagtctagcctccagctatatacgcccacctatctatcgccacccgcttccccgtcctcctccacatcctcgtcgtctctctcgcggtgtcgcctcctgcagcctcgatctcgccagaaagggaaaccgcatctgctcccgtcctcccgtctcggcgccgccgcctcctgatcgaccagaggcacgaggggctaccggcgcgtcgaggccgtccggcgctcagatctgaggcgcgaggagcaagcggacgacatgcaggtcggaggaggagcggccgacagccccggcgcggcggcgggcgcggaggcgccccgcccgagccgctacgagtcgcagaagcggcgggactggcacacgttcgggcagtacctgcgcaaccaccggccgccgctggagctggcgcggtgcagcggcgcgcacgtgctcgagttcctgcgctacctggaccagttcggcaagaccaaggtccacgcgccggggtgccccttcttcggccacccgtcgccgccggccccgtgcccgtgcccgctgcgccaggcctggggcagcctcgacgcgctcgtcggccgcctgcgcgccgccttcgaggagcacgggggacggcctgaggccaaccccttcggcgcgcgcgccgtgcgcctatac

SEQ ID NO: 6092 - DNA, 550 bp, Sorghum bicolor
  Clone ID: SORBI-28MAY03-CLUS34414_1
tttcttttttcactccaaacgccatcacctcggcacgaggcgtgaaaccgcgccatggccacggcggcgcccgcgctgcccaccttcctccggctgtggccggcctcgcccttcctcctctcccccagcctacacgtccccagttcaaggcgccccactccgtcgcgcctgaactctcttcgccctgcgaggcccctcttccccatctcagctgtggagaagaccaacgaggctgctgcggtcggggagggcgagctggaggggatgccacccgagttctacgacgaggagtggcaggcccgtcagcgggagaggactaaggagtggcatgcatatcggcagaaagaggaggccgaggaggaaagaataacaaatgagtaccgagagataggcatgcgcctgaaagcttacccacaagaagaagtttgcaaagctaggattttagtttcaagtttcataagagctggtgaagatgttgagaaggaaattgagaaggctgctgaaagaggagagcttactgaacttgttcttatggtcatctggaatcgac

SEQ ID NO: 6093 - DNA, 1012 bp, Sorghum bicolor
  Clone ID: SORBI-28MAY03-CLUS34416_1
gcacgaggtgatgaggatgtctactttgatgacgagtcggctgaagtagtaatctcttcattgcgtttgggggatgatcaggacacctgttccctcttcacgaattcaaactggtttacgtttgatggagatagaggaatcaatgatcgcctagctgcctctgttccttcatcatcccccaattctgaagagatttccttgaacacggaggaaactgatgaagtgctaactggtgaaaccactggcactgagtcactgctggaaagtgcatcccttgaaaatggtcctgttgaggaggccaaggagctagcagaagttgctaacgacagtgatgctaccacggttagtgagaaaattttgtgtacagaagagcatagcgcctcccatgagcctgaaacctctgagcggcctgtggatgctcaagagggccagactggaggtgtggctgaagcaacgagcacagagggagcaacgaatgaacctttcagctcttctgagcctggcaacttgccagaatctggtgacaccgattgtcacactgccaactcatctgagcctaatgagattgcccatgaatcaggatcacctgcggaggttgatgatgaaaagaaatctgagattgccacaacaaatgaatgaagcgtatgggctggaatggtaccacaaaccaaggcaggatcgccgacctaattcgttttgcatcgcatgctcagggaccacggactaccattcagaagcaggggcgccctacaattttagtggcactgctttgctatgagcagtcgattgttactgcttggatgagcatactcgtgcagctgggcacgctctgttatgatctcagctcatcaccatcccacatgaacttattacaccgtattagttggtggttgatgcacagggcgtttaattcatttggtacttcctgattttggctcagggttttttttttcttttgctagggtactcgaactgtaatttctgcagttgagtttttaccctcaatacttat

SEQ ID NO: 6094 - DNA, 765 bp, Sorghum bicolor
  Clone ID: SORBI-28MAY03-CLUS34422_1
gcacgaggaacacttccagttcaattgttggcatgcaaaatggtgctccaagtactgctgttgttcctgttgcaacaagcacagaagttccattagttgcaacagatgcaggggccagcagaaacaacaatgaaaattcatctctgaccactggggttgacacacaggatggtacatctgttgaagatttggaggaggcaaaaaagaccatgccagttgcagggaagattaatgtcactccactggaggagaaaacaaatgaagaagaacctgtagtctacgcctctaagatggaagcaaagaatgcgttcaagtccctgctggagtcagtaaatgtggagtctgattggacatgggatcagactatgagagtcatcataaatgacaaaagatatggtgctttgaaaactcttggcgagagaaagcaagctttcaacgagtacttgaaccagcgcaaaaagtttgaagccgaagaaaaacgtgtcaaacagaggaaagcacgtgacgatttccttgcaatgctggaagaatgcaaggagctcacatcattgacaagatggagcaaagcaatacttatgtttgaagatgatgaaaggttcaaagcagttgagcgtccaagggagcgggaagatttatttgagaactatcttgtggaactgcataagaaggaaaaagccaaggctgctgaagaacacaaaagatatgtagcagaatacagagcttttctagaatcatgtgacttcatcaaggcaactactcagtgga

SEQ ID NO: 6095 - DNA, 710 bp, Sorghum bicolor
  Clone ID: SORBI-28MAY03-CLUS33841_1
tgagggagtcattcaattccgttagattagatgaagtggataacgaagatgatgattctccgcccaagaatagtcttgctctaaaattcatagctaggactagaaaagtgcctcagaacatgaaagagttgcctaagctaacgaagccagatgagccagatttctcagctgaacctgaagactagagatgtttgcttatgctaagtacagtggtcatagctgactattgtgaattagtcctatttggttcgtgaaggaggttacaggccaactagttacggtgaattgaacttgggttgacggtgccatctgtggatgtgaggcaggtaactcgaaactcaatcaaagctcatctgtggatgtgaggaagttaactcaaatctcaatcaaagcgtgatgaagcttctgactggtatagatcgaatggttgtaactactagctatgttcatgttgtatattcagatatctccgtgcctatagatttcttgaaaaaagaagagaaaaagaagaatgcatcgttacatagactgataacttaaacatctaacaagggtgtggctacattgtttgtgaccgtggaggactctgtaaattatgaggctgtggcttctggcaaaatgttagcacagactgctgtcatgtacaaatgcacctgtgcctgcttttgagcatggtcgaggtgctgtaatgtttttttttggttaactgt

SEQ ID NO: 6096 - DNA, 688 bp, Sorghum bicolor
  Clone ID: SORBI-28MAY03-CLUS33855_1
gtgctagaaaacggggataactggagcgtgggacagcgccaacttattgcactgggtagggcattgctcaagcaggcaaaaattttggtacttgatgaggcgactccggctgttctcgcgcctgcggataatcttatccaaaagatcattcggagtgaattcaaggactgcacagtctgtaccattgctcatcgtatccccacagtaattgacagtgaccttgttctggtccttagtgatggtaaaattgcagagttcgacacgccccagaagcttttagaggacaagtcgtctatgttcatgcagctagtatcggaatactccactcggtcgagctgtatatagagaggcttagcttaaaacccaccccaaacctagcagtagaggctgggaggcaaaatagccggtatctgccagtgtacttacaccatagaggttccgtaccaacaccatagggcgacatagaaaacgaggtgtatatgagtgggaggaacactgagcgttccctgacctgaataaccatggaatcgatgagggaacacagggcacgaggggaggttttgtgacactagtacattacccgaagctgatgcttctgtatgtatgtataacaacaatgcatactgcttctacccttgcagagtggagaacgaagggaataactcgtgcgtaataagagcggagaaga

SEQ ID NO: 6097 - DNA, 1094 bp, Sorghum bicolor
  Clone ID: SORBI-28MAY03-CLUS33858_1
gcacgagggccgcattggtcaaacctccatccagatcacttctgcagatgaactgtggactcctggacttcctccattcctggaaacagcccagctgcagtgaattccacccttgttctctttcagaagggtgcagctgagtcttcagagaattcttcaaaactgcagtgccactgcaagatcttggagctcgaaatgtggacttggtggcctaggagtcatcgcagaagttacctttaatgtgtagaaagacaccagcttgtgtagcatgcattcgtttccaatgcagatgaaatcaagaataaacacaagaagcagctctccgaaaacaaatgtattaagtacttgtggattccatatactgacacagttgtggtccaatggaatcctccctcaaagtggagaaccccaatactgacatcaaaatatggcaaggatgaagctttacagcatgttgggatctttattgtgactcactgaaaaaatatagtcttgtagatttcatgaaaaaactaatgaccctggtgcaacaaagggaaatacaaaggagctacctcctgaatgcacggaaccaacgccactatgatagtgtcatcccacgaccactgaaaaaacaccacatgcatgcaagcagttgcggttcagaggaaaaggtggctgaaacctgatgggatccttaaactgaacacggatggggctttctctaagcgagacaagactagagacagggagttcgttattaggaatgaaggccaagtgctgaaagctggtgccggctgtgaagatctccagaatgcttttcatggtaaactgttgggtttgctatcacgtctaataattgaaactgatgcgttccgcaatgggaggaatcgtcagagtgaagcattatatttgctgtgttctgtcctcgtatttgtaatcgagctgcgattgggtgtaaatctcctagtgagtctgcaatcactcggcaggtagttccacaggatgttagggtttagggtttagggtttgtaaattatagtaaataggtccgtgcattgcaacgagagaaggaacttatctttttaaattcattattatgtaaaccactttag

SEQ ID NO: 6098 - DNA, 653 bp, Sorghum bicolor
  Clone ID: SORBI-28MAY03-CLUS33892_1
tccttgtctgtggaccccccatggtcggttgaggtcgagaagaacttcctcaacggaaagctgaaagccataacagcatactttgaagaacaggattgttgagtcgcgcatcggcactggtgatacaaatcatcttgtgaacttaggactcacgaccaattttggagggaccttgggtataggacttaggacatgtccctctccaatggatacaatgaaggggtcttggatgttttcaccaaaggacatgccccttcgcctttggtgaagacagtatttgctaattgatcaataactgttgtctaattctaacaatttgccctgagcccatgatgaaacagaaatttgttggcagaggcgagtcaagagaatgcctaaccttcattggtatcatacaaaagtagctcagcttatctcaattctcagcaagtgaaactgtgaaacgaaagctacaggcagacagtcgaaagcgtgggagttagtttaattttgccctatgataaacaagcaaagcttcctggtttggatgtgattgtaattgtgaaatatctggtcctgcgggtacgtgagcggtgcaaatgtatgtatgtgtcgtccatgtaaatgtaataattggggagagaaacgagacggcatcatggttccaacttgaa

SEQ ID NO: 6099 - DNA, 560 bp, Sorghum bicolor
  Clone ID: SORBI-28MAY03-CLUS33931_1
tgtcacgagcggtgtcgatgctggcgggacacgtgcaggtgggcgaggtggtgaacaaacccagctacatcaccgagtggcagatcaagggtggtgacgccagcagcttcatgagcagcaatgtcagtgggcagtcgagcgtggcaccgaggtcgtcagccgcgcagacctcgtcgccattcctgagctctgttattgaagaaggccggtgatgattagcatgttctgtcttctatgaagcgacggactgtttcttgtaaaagcacgctacaaaatgctctctgcttccgcacatatgctctctgggttatacgtgcagttttcttttgaaaaaaaaattatatatgcagatggctgcttcgaagtagatcttttccggtgcagttttctctttttttttaggggataacttttgcagttttctgtatgcaaatgatagatattcggatggttacgtccatttggatgtttgagatgtactgtatatatggtttgtaagaagtcacgttagatatagattttttttttggtcgcttatataaatattcagtacatgtaac

SEQ ID NO: 6100 - DNA, 586 bp, Sorghum bicolor
  Clone ID: SORBI-28MAY03-CLUS33999_1
ccacgctgcccagtgtgccatcacgcttgcgcgcgccgggtgaggtcgcctgcaccggagttggccgagctcacactggcccttgcgctcacactgctgtctccgtttcatccccgcgagatctgactcttgcgctcaccctgcccccatccccttcgcgccccgatccacccgctaaagagcggcctccgaaatccgccggcgatggtcgtgtgcaaatgccgaaaggcgacgagggtttactgcttcgtccaccaggtccccgtctgtggcgtgtgcatatgctttccggagcatcagctatgcgtggtgaaaaactatgctgaatgggttgttaattctgagtatgactggccacaacattgttcatcttgcaattcagtactcgaaggtggaactgaagaaacaacacgacttggttgcttgcatgtggtgcacacgaaatgcttgatatcgcatatccaagattttccttcccaaacagcaccagctggatatgtctgcccttcctgttctgcacctatatggccaccttcaagcattaaagatacaggttcgcgccttcacactaaactgaaagaagcga

SEQ ID NO: 6101 - DNA, 732 bp, Sorghum bicolor
  Clone ID: SORBI-28MAY03-CLUS34598_1
tgcaaactcttcaggaaacaaacgccaatttgaagaagataagtttcaggaaatgctcgctaagtcagctaattctgagcttcggctgtctgtatggatggatgatgtctacaattttatgcgctcgcaaaagaggcgtcggattcaaagttcagacatttctcaagattttgatacaatgagaaagcagctagcatcagatgctagaatatttaggtcaaaagttccggagtcactgatagacaatctcatcaaacgtctgagatcatactttgagggcaaatattcaccaaatgcctagtttttcatgcggcagttcttcagaagctactaggtgtcaattggatcttggtggtcaactccccaactcctcgcgcggcttatttttgaggacagttttgttttctttgctgagattgagacgaggagttctaagttgcatgtacaatatcttttttgttgttatccctgatgttataggcaccacgccaccatccccactgcttatctgtctagaatgtaggagatacctctttttctccctttgtaagataatatagctggcagattaaagcacgagtttatgttgtttttgaccctttacaaatgtattttcgccctgaccagtctcagttttggtcaatgttctgttatgggggtcgattcgccagctaacatttttagattttgacagtctccggaagcaaattgacttgagaatataattattta

SEQ ID NO: 6102 - DNA, 649 bp, Sorghum bicolor
  Clone ID: SORBI-28MAY03-CLUS34658_1
ttgtatagaagggtagagacagagattctaaagagtgaagcaactcctgccatgagtttgctcaatgaacttcttaatcttcatgacggaagcgacaatgaaaagtggttaaagaaatgtagaaagcgcatgcttgaagtctttccaagagaggacccattcactgtggtctttcctgctgggttcaagatggagaatcatgaagggcgaattgagctgccgcctcaggacgatgatctccttctgagagtggactttgtcagggaagttgatgagctgctgaaagaggttcaagctgagcaagacaagaataagcaacaagttggatttgacccagaatcagttgcatatatgctgaaacagcaggagaagatgcagacgatacgtcaggtggaatctctcctagacttggcggcgtccttgaaatggtgaggattgagtagtatcgaacaactattctgtctgcttagaagctagaagtcgttgacacattatactcaatagttagaaagggaaatcttggttttcagctagttagaccaataaccgttctgggtagagccttacttcgacgtccatgtacatttgtatgagtagaaatatattccttatatcaatgtagttctgcactgctaatgaaaaaacttgc

SEQ ID NO: 6103 - DNA, 790 bp, Sorghum bicolor
  unsure (1)..(790): unsure at all n locations
  Clone ID: SORBI-28MAY03-CLUS34666_1
ggatcaagtgagaagacaagagaggaaaanccgtgatgggttccgtaaaatgttggaagaacatgtcgctgatggtacactcaatgcaagaactcggtggcgtgattactgtgcacagataaaagattcagagtcatacttggctgtagcctcaaacacatctggctctacaccgaaagagctatttgatgacgtgatcgaggaacttgacaaacagtatcaagaagacaagacccaaatcaaagaagtggtgaaatctggaaagattcctatgacaacttcgtggacattagaggaattccaaactgctattctggaggatgatgctcttaaaggaatatcaaccatcaacgtcaagcttatctatgatgatcagcttgaaaggctcaaggaaaaagagcaaaaagaggctaagaagcgccagcggttgggtgaaaatttttcggatcttctgtattcaatcaaggaaatatctgcttcttcaacctgggatgattctaaacagctttttgaggatagtgaagagttcagggctttggacagtgagacttatgctagagagctttttgaagagtgtgttgtccacctgaaagagaggttaaaagagaaagaacgtttgagggaggaagaaaaggcaaaaagagagaaagagcgtgaggagaaagagaagaagaaagagaaagagagggagggcaaggaccgagaacgcaaagaaaaagaaagagaccaccgggagaaggagagagaaaaggaaaaagggaaagatcgatcaaggagagatgaaatggat

SEQ ID NO: 6104 - DNA, 698 bp, Sorghum bicolor
  Clone ID: SORBI-28MAY03-CLUS34693_1
tgcaggaatatatagtgctcctgttgccttgtctctttatgcgaaggtatttgaagaggctggtgccctagataagctagaaacatttacaagcttcaatggccccgatttttatggcctcccaaggaacacttcaaagattgtcttgagaaagaatgcctggaaagttcctggaacttataaacacagttcaggggagattgtgcctatgtttagtggcagcacccttgagtggcttccatctgatcagcctaaagagtaaacagtatgcattattgtacccagcagttgggggaatcaataggtggagtttttctagttctttttcctttttctgttagaatcagcatagcaaactattcagccataagcagcaattcctgaaggcaattgaaagcaactgcgaaagatttgcttgtcgagttgttattggattgcagtacaattctggaagtagttaaaaggtcacattgtatggttatcaagggtagtctactgctctagacaccatagcatccatggtttcaaaggcgacgaggcgtccacgtgagagctgggtgtgcctggacacctaggtgacaaggtgccactgttccccaaggcgagctgggtatgcctggtgcctaagtgacgcctttgaaacgggtagcatccataataatgtaatgaataaatatctgcattgcagttacatcgtc

SEQ ID NO: 6105 - DNA, 698 bp, Sorghum bicolor
  Clone ID: SORBI-28MAY03-CLUS34702_1
aatttctaccagcttaagttcagaatcatgcttttatgtctaaatatcatccggtgatgatttctttgctctgccgctgtgtcctgtctcatgtctggcagattccttgtattgctgtacatgcttggtatattgctaggtatgactcatgtctttggtaagggccaagttaatacacctgagatcttgtgaaacatgtatgccatgcctgatatacttggttgcattcttttctatcttagtatgttgattgtgttatgttacttaagcagcatgaaacacatatgtatgtgtagagtaacataatattgtctccttgctgtatatcatgctttgtctattgcactgctacgtgttcatacacttgcatcttgcatctcatttaggtacgctagatgaactacgtgaaggactttatggtggacctatcgggatgatggaaggactacacaagtgttgtcaccttagatgtcgtcaagacggtgcaagctaacttaattgacttgtgtcggattccagggtttatcccaccatgttgcaggtgaagtcttcagcttgctaaagatggtggctaaccgccggtgggctcggtgattctatatagtgtcatcatctacatgcttttgccggaggatgtcacttatgctagcaatgtatttggaacttatgttattgtactcatttcaaagcctttgttg

SEQ ID NO: 6106 - DNA, 602 bp, Sorghum bicolor
  Clone ID: SORBI-28MAY03-CLUS38596_1
ctcagacacaggcaggcagcgggggcacgaggccccctcgatccttccgcttccttctagaaccttccgccccctccgtcgcagcacaactttctccttcccccaccacgaagatggcgaccatggagaacgtgatcgagctcgtgaaccgcatccagcgcgcctgcaccgtcctcggcgaccacggcggcggggacgttgccgccctctgggaagcgctcccgtcagtcgccgtcgtcggcggtcagagttcggggaaatcatcggtgctcgagagcatcgtggggcgagacttcctgcctcgaggatcagggatcgtgacgcgtaggccactcgtactgcagctgcacaagacagaggacggggtgcaggagtacgccgagttcctgcacatgcccaagcgccgcttcactgatttcgctcttgtacggaaggaaatccaagatgaaactgacaggttgactggaaagacaaagcaaatatctccagttccaattcatctcagcatatactctccacatgtggtcaacttaacattgattgatctgccgggtctaacaaaagttgcagtagagggacaacctgaaagcattgttcaggat

SEQ ID NO: 6107 - DNA, 684 bp, Sorghum bicolor
  unsure (1)..(684): unsure at all n locations
  Clone ID: SORBI-28MAY03-CLUS38646_1
taagataagagacaggggaggtttcatatgtgttttaccaaacctatagctttttcacagcagaactcacaacanngcctctccacagctacagcaactttttcaagcccatagctgaacccaacagacgataaaaaaaggctaaatgtgacgaagtacatagaattaaaaaagaaaagaaaaggaaagggaagactatactacgaactatgtggtgccaggtacaggcatacagcaagttgctacgcttcctaatcagccttgcattttatgtcctccaatttgttatgtaggtcatgaaccattgtactggaggagaaattgtaagatgctatctcgacaaaaatggaaggagacaacgaagctaacttgatagtgcctccacgacacagaatgttcctaaaacacgtgactgatgtgcctctgtggcggttcacctagcggaatctctccaattgaccatttttccttcaaccagatactatcatcctgattttcatttttattgtcctcaacaggagcttggtttgtggcacttgtaggagccacgattccactaagtaaatcttgtgactgcctatcaatgtctctatgatggctagaggaggaaggagactgctggtagctagcatgaggctttgggaaattgccaacactggacatgtttgagccttgcaaactccc

SEQ ID NO: 6108 - DNA, 872 bp, Sorghum bicolor
  unsure (1)..(872): unsure at all n locations
  Clone ID: SORBI-28MAY03-CLUS38655_1
gcacgaggcttctagaacgcggagtggacttgtcagaagaagccctactgttaagactctaagcaaggatccaccagggattaaggggctggttgatgggtcgctgaaagaagacatgcctcttggaactcgaagtggccttgtcagaggaagccttgctgccaaggttccaatcaaggctgaactagtcagaaaggggccggctgatggatggctgaaaaatgacaaggttgctggaacacagagtggccttggcggtgcaagattatctaccaagactgtaagccaggatgaaagagtcgttgagggttttcctgatggatggcgaaaagaatacaggccaaggaagagcggttcatttcaggatccgtactacattgatccagtcagtggatatgaatttcgctctttgaaggatgtgcaccgctatcttaaaactggagatattagacaatgtgccgtgagaccaaagaagagcaccaccttcgaagttcatgtaaccgaaagtcaaactcatacaagttcatcatcgcaatacacgaggcctggtactgcagataagggtattcagtgtgaaatattaacttcggatggtatcatggtgccatgggaggaactaattactcaatataatggaaatgatactgaacataccgtgttaacagggcctgagagcttgaaagcaagtcaaggatatggcagcaagcttgacactgtggaacacatgagtgttcaaccggtttctgtgcataatggttcaaggcaaaccaaatctgttaaaaggaaagaaccanatgcagaggtgaaatccaagaagcgcaaaaccagttctgctgtgactcctgttcgagcgtcgccccgcttagctgcat

SEQ ID NO: 6109 - DNA, 637 bp, Sorghum bicolor
  Clone ID: SORBI-28MAY03-CLUS38726_1
agggcgttggacccaagccgccagagcgagaaggtgaacttggtaaactgggcaaggccattgttgtctgaccggaggaagcttagccagctgatggacagtgggctggaggggcagtacaatcccaaaggagccctcctggctgctcagctgaccctcaagtgcctgaacggtgacccaaagagccggccatccatgaaggaagtggtggaggcactggagaagatcgagtccgtgaagagcagggtgatgagggagcccaggaacagctcctcgtcctcgcgtcgcagtcaggtgcagtcccctaggagtgacagcgctaggaacaactccagctccaggggcaggtagatgcatggcatggtcatgaggacatttaggatgaactgatcgattctgatgcggaggtacgttgtaaaggtagtagaccacaatttttgttgtcatgacgaagtttacggcgatcatgatgatcaatgtaacagtgtagcggtacacaaagatgatgactttttagttggcatatgcataaaattcaaccattcttccatggaagtcttgtctgagttgaattgcatcagattgcacttacaatagttccagtcatggtcattcagtccattttctgctagtcatg

SEQ ID NO: 6110 - DNA, 600 bp, Sorghum bicolor
  Clone ID: SORBI-28MAY03-CLUS38782_1
ccaccgcgttcgggctcctcccaacaccagccgcacgaggccaaaccctagctgcgcttccctcctcctccagatcccggcgccccggacccatggccgtgctcgttcccagctccagcctctctgcccggcgcccctccgcactctagctccggatcgcccgcgcacgcaaagccatggagcccaccacagccgaggacgccgcagccgcagccgccgcgccggactcgtgggagacggccgacatcgacgggcccatgagccggctcatcctctccgcgcgccgcgtgtcctcgtcgcccgacctcgccgacgaccaggacccgccccagccgccgccgcctactctgcagccgcagagcggcccggcttcctcggctgcgcgcgaggatttggtcgctcaggtcgatcagttcctacgggaggccctcgagaaaccaagggagaggctttctgtgctaagaatggagcaagaaattttgaagttcattcgtgaccctaggcgtacagagtttgaattcaatggtcttccaacttcgtatctgcgtcttgctgcacatcgcctggcacagcattacttcctgcagtctattgccatac

SEQ ID NO: 6111 - DNA, 667 bp, Sorghum bicolor
  Clone ID: SORBI-28MAY03-CLUS34857_1
attcttttgggttgactcatgcaaatgctccgcagcacatgttacaacaaccgatgtttcatccaggtgcgaatcctcaaactaatttccttcctggccaaccaccgctgcctagccagccaccaccacagcagctgtatcagcaggctagttcacactacaatacacaaagtacgactccaatgggagttgataggtcagctccctggggacgggccccagaaggtcccacatctggctctcatttccctggacaattacctgggttgcccggacaaatggcccaaggaattggtggtatccaggcaggccaagcacctctgacacctgagatggaaaagatgctagtccagcaagtcctgggcatgtccgctgagcagattaacatgttgcctccagaacaacggcaacaagttcttcaactacgagacatgctacgccaatgatagatcgtcatttttttttttgacaacaatgatatatcgtcagttgagtgggtagaaatgtttcagtttaatgcagcagagatcctgactgtgggtgcttttcggtttacccatttgtatcacctgattgacaccccgactgcaccctttcttggagatgcgatcgtagaatgctagccattgtcgtcatttatagaaatgcttggccaatgtgttttcct

SEQ ID NO: 6112 - DNA, 760 bp, Sorghum bicolor
  unsure (1)..(760): unsure at all n locations
  Clone ID: SORBI-28MAY03-CLUS34888_1
cttccttttcatcatttctctggtgggcccgagccttcatcacccatccttccagcaaaagaatcgttgcattctgaaccagaaaacatccaacacggtgatccagcttgtcggttggaagaagtgatacagttggacatggaaacagacgagccacaaccaccagaaaatggcaacgaggatggacactgtgagactgaagacactgagatgtcaaagtccccttcagatgacccgtctggtactgagcaacgattccgaacactcaacgaagaaagaaacattcagcagaatcagaagacacctcgagaatttgaattgagtgttccggtggtgccttttgattatgcggaagccagaaagaatctcgtgtctagtcagcctaaagctgagaggagaaaagacgatgcggttgcaagggctataaatacagactctggagataagcggattgcttcaaaaaagccaggtgggggagaggacgagggaaatttccagcatccaaggagacggcaggctttcccgccttctggcaatagaagtgctacatatcactagtaagatgtataactgacggattggattgtttcaaaattatggctaccctaaaagggtagcacgcgttgtatgttctatttgaatttggactgggatttctcgtagacaaaacttgtggccttttcatcatgactcatgagagaagaaaccgccgagactgctactgcactgcggtgtcctgatgtgttgctaacatgnacta

SEQ ID NO: 6113 - DNA, 754 bp, Sorghum bicolor
  Clone ID: SORBI-28MAY03-CLUS34909_1
gattctgctcagggagctggttcccctgccatgttggatgctttatcaagaatcactgggtcttttaactcttcaaattccaagttgctagaaaaggctattcagaggagctttctggtgtctgctgacatggcacatgctttacaccccaattatatggacaagcatgaggagaaccaccaaccaaaattgcatggaggacttgtaatcaagcataacgctaatcaacgatatgctacaaatgctgtgacagcatttattttccgagaaatcgctgagagacaccaactacctgtacaggattttgttgttcgcaatgacatggcttgtggttcaacaattggcccaatacttgctagtggtgttggtattcgcactgttgatattggagcaccccaattatcaatgcacagcatcagagaaatgtgtgccgttgacgatattagccatgcatatgagcatttcaaggcatattatgaagaatttactgaattggatagcaaggtcaaggtggattactaaggcatttagcacaatagattagctttgttacaagctgtacttctatacaaatttgataaacaagtggagaacaaatttgggagaatgtagcagtgtgtgctctgccataccacgttctaaattttatctttttatttatctaacccaagtacccacatgtttggaattcttttggtgaacggtttcctatcatgaaaatgcatgactataaatggctccaacatgcagcctc

SEQ ID NO: 6114 - DNA, 657 bp, Sorghum bicolor
  Clone ID: SORBI-28MAY03-CLUS34917_1
gacaggatgaagaatttgcaggagctcgttccaaactccaacaggactgacaaggcatccatgcttgaggagatcatcgaatacgtcaaatttctccagttgcaagtcaaggttcttagcatgagcaggctgggcgcgacggaagccgtcgtcccgctcctgacggagtctcagaccgagagctccggcggtcttctcctgtccccgaggtcaggctcatcaggcaggcagcgggcaggcggaggcagcctgccgtcgtctgaggcccgggacggcgcggcgttcgagcaggaggtggcgcagctgatggagaacaacatgacgacggcgatgcagtacctgcagagcaagggcctgtgcctcatgcccatcgcgctggcgtcggcgatctcggatcagaaggggtcctcctccgccgcggtccagccggaaaatggcggcgccaaggaaatgctgcgcgccgtgaagcccctgggaagcccgatccaagggagatgaaatggagcccttggggggcggctcatcggtgcagtgcagtccccggcatcaaagccatctcgagtttagattccccaagtcctaagttcctaacagcttgcgccttgtttttgcatgtcctttggcaacttgtagccctgaaatgaaacctggacctag

SEQ ID NO: 6115 - DNA, 742 bp, Sorghum bicolor
  Clone ID: SORBI-28MAY03-CLUS3489_1
gactagttctagatggcgagaaggtggctcaagctagtgaccagtcagagctgaatgatgacttctgggcagagctgttggtcgaagatttcggagacaaggcaggacagtcagagttggagggaagaactgaagacgtggatgaccttgctcaacaactggggtatctgagtaattctagcccaaagtagagtcagttcctaatggttgcccccacaatcactggtgctttccccactactgcagaccatcctgaacaaactgttaactggtggaggtgtccataatgaaggcgtattgtggaggtcactgcctttgacgttgaaggcttagtgctgtactgctgtgggagatacgtggggtgttgggctgttggctaatgtctccgacgtcgactggcaagtggcaaagtgatcttaaggtcgacggtgactggcaaatatgtctataggccaacgtatgcatacagctgttatcagctcttattcgttagctcttactataggaaaaaagtagctgtgtcgccagtcattggctcattgaacgatgtggacgttgctatgccttggtcaggcttctggggttgggttgtaggtttgattggttgagtacgagtcaatctccacctgtgattggtgtaacctgaaaacatcctcagcttgcagttgaactgataagcatcttgttaatattactccagtttcatgatcattgtacatcaagttgcagaatatgagaaatt

SEQ ID NO: 6116 - DNA, 369 bp, Sorghum bicolor
  unsure (1)..(369): unsure at all n locations
  Clone ID: LIB3481-023-P1-K1-G2
cgtccgtattgctggaatatgcaggggtaaagattagaatagtgatgatggatcttggcaacaaggctgatgacccatcattcttaccatatccattatgtgtgtgcagttgcatctttagatttgccctcatttattttttctcccaactcccttctgaaacatttattctaaattgctccttattcagttaactggtggaggtgtccataatgaaggcgtattgtggaggtcactgcctttgacgttgaaggcttagtgctgtactgctgtgggagatacgtggggtgtnggctgttggctaatgtctccgacgtcgactggcaagtggcaaagtgatcttaaggtcgacggtgactggcaaatatg

SEQ ID NO: 6117 - DNA, 884 bp, Sorghum bicolor
  Clone ID: SORBI-28MAY03-CLUS34484_1
gcacgaggcccacccctgccgtccatgtcacgcctcggctccttcctttcgcctccccggctcctgcccctgccccttgtcctcttccccaccccctccggaatctggccgcgcacctactcgggttcccttctcgctttcccgtctccgttttctttatcctgcgggcggggcgggtggagtggggcagtcgttgctctcggatcaaggagaaagggtggacaaaaaaaacagtgctttctctctgtggccggcggttcgcccgtcgctcgctcgctgaagccgtgtagcagctgcatccgcgccctcttgttgtgtggccaaacgggttacggaactcgagcgccgttttggggggttccgaatcacttcgaggctaaaggaggtttgatcatcacataagctcaagatcatgagttggttcaaagaaattttcaagggttcagtaaacagaagagtttcaaggggtcactatgatggaggctggcatgaaggacattcatctgatcacaccagagatacctacgatgacagtgataatgaagatatggatcgtgctattgcactatcgctagctgaagctgaggaagatcagaataagggaaaggcagcggctattgatactgtctataatttggaggaagatgaacaacttgcacgggctctgcaggagagcctgaatgcagagtctcctcctcgacggaatgttcctattgaggatgttccagtgcctcctcaatgggacgttcctgttgagcgtgcacctcctcggcagtatgttccagcaaatgaaccacctccacacgtttattcacagagtggatccaggatttgtgctggatgccacaacccgattggccatgggcgtttccttagctgtatgg

SEQ ID NO: 6118 - DNA, 488 bp, Sorghum bicolor
  Clone ID: SORBI-28MAY03-CLUS34515_1
gcacgagggccaccagagatcagctaaagaatgcaatcccatcaatttgtatctcaaggagaaaatgtgtggtaggtgatgagggtgttaaaatttcagcatgctgcatcgctgtcgtagcactagctgaacctaactccatgtctcagttggacactatcaagaaaagggtgattccaatcatactggatacactgctgaaaggttttttggaatttaaggatgttgagatccagtgtcaacatgatggtgaacttcttgtgaaagtttgtatgtctcaccattgcaaaggtgggaggttctgggctactctacagaatgcttgcattccagtaatggagttgattgactgggagctgagtcgaccaagcaacgtagctgatattttctgttcatatggcatagactcagcgtggaaatactttgttgaatctttgagatcagcaactactgatattgggaggaatattcggtcggagcacttactg

SEQ ID NO: 6119 - DNA, 888 bp, Sorghum bicolor
  Clone ID: SORBI-28MAY03-CLUS34543_1
tgatgtgcagaggcagagatttggtgttcaacaagtaatgacaagcgcagtaagcatgccagtggtgaccagctcaggcacaattcctgtggtggttagctcggccactgttccatcgttgaggtatgatgattgcacaatgtgccaaaaagcattgccgcatgcccattcggataacattatccgggagcagggaaattctcgtgcaacgggcaaccttgagggagctccagtgttttacatccctcatcaagacagtgcatccaacaaatctagtccaagtgcaagctcaggaactcctgcaaactatgcggcggaaccaagagctgggaacacagcagtgatggcacaattcgattcgactcttcctgccagaaaacatgcagtccaggcaactgcatctccggatacaggtttgccggttcaacccaccatgattgctttaccagtgtctagtgcacctgctccaaatggagtatttgtgggtcattctcgtccggctggggttgaagatcatatcaggtaccagcagcaaccgttctcttatagcatgcaaccaccacaagttccagtgaatggcccacaaggcattgatgctagtggatacaaggattcaaatcatccagcagcggaaccgcttagagaatatgcacatgatcttcctcatgactatgccagagctattgatgctcgtatgcaagcagttcatttgggtcctattgcaccaccagaatctagtgtgcatggaaagccttctattcctcatggtgtcactgatcatgccaaagttgggaagccacctgtaaatattgatggtagttctatctataaatctcaagctggagggtatcatatggggattacaaatgcctttactgctccagcttt

SEQ ID NO: 6120 - DNA, 698 bp, Sorghum bicolor
  unsure (1)..(698): unsure at all n locations
  Clone ID: SORBI-28MAY03-CLUS34525_1
tactggactggaactctatccactgtccatcttccccgtggaaatctactctttcctcaccgtcacactgtcgccgccgccgccgcgaccgcgaccccgccggccgacgagatgagagctgccgctgcggcctccttccatctggcagccgctacgaacccggcccatccccgcggctccaccacagactcctgttccctgaaacctgcaccgactgctcagccacctcgcctccgttcgctcgcccgccgcgctcctctcgcctgcgcctctctcgggatatctcatgataaagggtctgatatttccgaccccaatgttgttggccagaatgatttactgattgtgggccctggtgttcttggacgaattgtagctgagaagtggcaaaaggagcatccaggttgcaaagtttatggccagactgcaagcaagaatcatcacagtgagttaacagatcttggcatcatcccctcattgaaaggcaccactattcatcagaaggttccacatgttattttctgcgctcccccgtccggttcagatgattatcctgnggatgttagaaaatgcgtgcagattggcagcatcaaattggagtggtgaaggatctttcctgtttacatcaagtacagctctgtatgactgcagtgacaacagcatgtgcaacgaggattgttcgtcagtgccaattggca

SEQ ID NO: 6121 - DNA, 706 bp, Sorghum bicolor
  Clone ID: SORBI-28MAY03-CLUS34561_1
ggatcagtggtgtggcaataacagcaaaggcagatgtctttagctatggcatgatgctcttcgaactcatatcaggcaagagaaatgctggtcacggagaacagcatggatccacctttttcccaaccttggctgcaagcaagcttcatgaaggagatgtgcggaccttgttggaccccaagctgaatggagatgcaaatgttgatgaactcacaagagcttgtaaggttgcctgttggtgcatccaagatgacgaaactgctagacctacgactggtcagattgttcaaatcctcgagggattccttgacgttaacatgcctcctgttccaaggtcattgaaagttcttggcgaaagccctgatgttataaacttcttttcagatatatcttcaagtcagacttcccagacacagaacagcacgacaacttcccagacgcgcagtgctacttcaggcagttcacacccccaaagtccataaatcaaataacctggaatttgttagggcaatagttgaagagtatgagtaaagctgtacatgattagaacctaatatgctcagcttttgtatcacgctatgcttcagtactgtaaatttagtgcagaatgtcaaccgatacaagaaaggtactactgttgcatttacattacacatgcaagatcccccattttctcttactaaatgtaaaatatcaagttgcgttc

SEQ ID NO: 6122 - DNA, 776 bp, Sorghum bicolor
  Clone ID: SORBI-28MAY03-CLUS351_1
actgtgcgccgctcgagccggccgggtcgggagagcctcgttggagtccaggtcctgggaaggaaattaaagccccctcgaatcctcaaagaggcagcaatggttccacataaaagcgcccaatgggagctccctcttctccccctcttaagcccacgtatgtatgcccagggcggcagggggccggcagccggcaggctggctagttgctccatgacaccatacatcgcgtgtcttggtcttggcaatgggaagctgcgcgcacctcgacgggacggcgcggcgcctagctgtagggcgcgtccggctcatcgtcgccatggagctgcctgctgctgctcaccttgttgatgaggagtgatggatggccatggcttcgatcgccgtcgaggacgacagcggcggcgagttttatttacctctctactaaggtagggcaacttgtatcctttggcaattgttctcatctatctggggggccgggccgggtgtctcttgatgacggtacggtcggtgatggtaggacagggagagggtgagtaaccttgtgttcttgttcttggaaggttatgatggaagtgcgtggtatgtatgatgctataattgacctttggtgtttgtatacatgtttatcgcgtgttctaatagttatagtcgatggtcttggagttggtgctactgctctcctttgttacactgtgttgtcgtgttgagcacagatgtcatgaatgaataatatgaatgaatttgatatatagtatatgtggtgtgcaaaa

SEQ ID NO: 6123 - DNA, 762 bp, Sorghum bicolor
  Clone ID: SORBI-28MAY03-CLUS35087_1
atggctccactatagcatatgaggagtatatagattacattttcccggatgaagttgctctagcaccaaacctgaagatcctagaagctgcttacaaatggaagaagcagaagaccggagatgatgacgagtgatcctggcatctcagtatggaattgtcgtgaatgttttgccacagccaaaatcagatgtcccgcaacactggctagagctatcggaatgggaatcatcaatttcttcatgtcacagaggatgtcgttgctgttgaaaggaatcgtgcgaattacttttaactgataactgtatggatggtagtttggtggccatgagtcgcttccatgtgtcggttcaggctcagaacaatgaggggattacacaagtcgcgatggtgtatgagagtttgtcttgcaacaaaggtgcctctccagtgtctatgctttgtctgcagtagtgcagttagagtaaactgggcatcttcgacttcaatcgatgtgaggccatgctggtcacgctggtgtccaggattcagtaggtcgtcatcttaggtgcatcagctctgtttattagccagtgaggcttttggttcctaatagtctgttgccaagtgtgtttcttgtatgtttctctcgaaaagtcgaccaaagctctgttgagctaatttattagaaaggacgagaaatgtacaagacagccaaaaaaaaacaaaagaaaaggaaaaggggcagctatacgaaagtgaggaaattcttcctttgctctttt

SEQ ID NO: 6124 - DNA, 646 bp, Sorghum bicolor
  Clone ID: SORBI-28MAY03-CLUS35154_1
gcctgcgcccaaacagcccgaataagcgcctggaatcgcgcgtcgtcctcgctccacgcgagctgcgacaatgggcgagccaacgaagctacttccctgtgcacggtagcccgccgccaggacagcttccccagcagggcagtcaggagggcacgggagggacaagaagggccagatcccgtgactgctgcccatccatcgaaactggcacgcgccaaggaagccgtccgagaagaaccgaaaccgaggtgaaccgacagcgagcatggcgactagacctccgctcattccaaatcgcaccccgaagcgctctgctgcggacttcactgcccctccccccccactcgccggtcttgcacaccagcaccgcaactgtcctactcaagccctcactaacgccggcatggcgctggttggtgttagacttgagcaagggatctcccgtcctagtgcaccttcttctgtccttctggtggtttcgactgaagggcaggcaggaaaggtctcgagggtttggcctgcttcgtctcttctgttgtttggcggtgcctgtgccgagagaagtcaagtgacattgatttggtttgctaggagtattgtgatgtaatgcagagacttgttcccctatatcaatccacccttttaa

SEQ ID NO: 6125 - DNA, 603 bp, Sorghum bicolor
  Clone ID: SORBI-28MAY03-CLUS34730_1
caaaggattccgaaatcttagtattgaggttgaagaaggcatctgccaagttctggcccacctgtggttagagtcagaaatcatcgctggttctagtagcaacgtcgcatccagttcagaagcatcgtcatcttcgtcatcctcaggtcctacctcttcaaagaagggtgcaaagaccgaattcgagaagaagcttggggcattcatcaagcaccagatcgaaacagattcttctgaggcatatggaggtggtttcagagcaggctatccggctgttgagcgctatggcttgaaaagaacccttgatcatattaagttgacagggactttcccatattaaagcaactgaagtaaaggagggggcattcttccatttgtgaggatactccacattggaggattttggtttcggttatacatatactggtatacatagttacatacaaaatgaggggaatttggctgtaaatcaagaggcgaaagaacccgctgctgcgaaaacttattgcaagtgtcgttttactttttataggaaaacaatacatgtaagttttcagataagggaaattgaaaagaccatatgtaatggtaaactctttgctc

SEQ ID NO: 6126 - DNA, 663 bp, Sorghum bicolor
  Clone ID: SORBI-28MAY03-CLUS34758_1
tcaaaactgtttgagcagttactgggcgtcattctttctgtatgctttgtggcagcagaatcggttctagcagcagatagcaatctgtcaaaattgttctacgactgtaaggactacataattggcatttgccacgatgcaatgtcaaaagatgagctagatgagatctgcaaggtgtacgagacaatggaagccatagtaatccaccctgaagaagctctccagatcatggagcaacctgatgaaaagtctgttgacaataaaaaccgcttcaagctgaagctcaactttatggccaaagatcgcccaccactctggaagcgcacaacaaaggatgagaagaagatgtctccaaaggatgacaagaatacatcagaggaaaagaacacgaagatattctccaacctttttgacaagaaggtcaacatattttcaaagaagaatgtgaaatcgccggaagtgccagcggcacccacttcatcttcgcctgggccatttgacgagagtgagtggacgattttgtagttgaaattcctgttttgttctttttgtacaacatgtagaggggtgccccgaagatgtcgggaataatcttaagctgtaaatactcaatctaattcattgatcattttgggtaaactgaaaagatgaagatttcattgg

SEQ ID NO: 6127 - DNA, 746 bp, Sorghum bicolor
  Clone ID: SORBI-28MAY03-CLUS34768_1
cctgatgttagcattatgcagattcctacgcgacaagtatagtcttgcagctgtcacaaatgatatattcacaaaagaagatggagaattcttaatcaaacatggagctctccctgaagagcgcatacgtgcagtagaaactggaggttgccctcatgcggctatccgtgaagatatcagcataaatcttggtcctctggaggagctatcgaacttgtacaaagctgatttgctactctgtgaatctgggggagataacttggcagctaacttcagcagagaattagcagactacataatctacattattgatgtctctggtggggacaagataccaagaaaaggtggccctggtataacacaggctgatcttttggtaataaacaagacagacctagcacctgctgtaggagctgatctggctgtaatggaacgagatgcgcttcgcatgcgggaaggagggccttttgtgtttgcgcaggtgaaacatggagtgggcgtcgaggagattgtgaatcagattttgcaggcgtgggaaattgtgactggtaataagcggcgatgaggtcttgcgacttggccatatgttggatgcagatttgtatgtggatctgattgactcggcacttccacatgcatagaccatttcttggtttctcaataaattttatttggtgctaattgtacttgagaagtatagacatggagtcttaaaattgcatccttgggttaaatggcatatccga

SEQ ID NO: 6128 - DNA, 540 bp, Sorghum bicolor
  Clone ID: SORBI-28MAY03-CLUS34817_1
aagatacagcatcagatggacaaccatcggtatcacctgatgatttgcttgtgcttgctcaacagtacagtagtgatttactacaaggggagttggagaggactcgattgaacatagcctgcttcatggagtcaacccttcaatcaacaggcgcgccagcaggctcaaagcccggtgcatattttttttaccaagcacaagtaccacagcacgcccctgttcaaacgtcctcgcctagttttagaaggcagcagactggtacaagttttcctgtagtttccaggcggcgccggtgagcttagtgcatttttcgatcattggtgtagccttttccctggaatttccttcttttcccccctcatgggggtggttgttttttgatttcttgtaattatcatcctgttgtcatgtgttatgaattttgattgatccattcttttggtgttgtaagatagataaaaggggggtacaggtgctgctgcacgggaccatttaattgtataatatccccgagtcaaatattattgccttgctgcctgg

SEQ ID NO: 6129 - DNA, 690 bp, Sorghum bicolor
  Clone ID: SORBI-28MAY03-CLUS34847_1
tggtcattgaagaacccagatgcaataatcaggtctttaaaaggtgctggtcttaattgtatggaggtctacagaagtgacggaaaagttgatggatttagtgaattagcagagaagtatggacttctgaaacttggaggttcagatttccatggaagaggtggaaaagatgaatctgacgttggaacggttaagctcgctattacaactttgtgctgctttttgaagatggctaggtctatctggtcttctgctatgaaagacatcctgcttaagtttgcagaggaaccatctgctgcaaatctaggaaacatgcttaagtttggacgacttaccaatttttctggtttttctccaataaacaatggtattcacgttgttgatttctgcttatcttcatggtcttctgctatggaagatgttgagcttgaagaggtaagattgaagcttgcccattatgtagcagaaagataacctcaactacatggccatcttgagcaatgttttctcccttattcaatcacagcatgtgctgctgtaatgtttcacttcttttgcagcccaatataactaatgtatttgttcattaggtgagggcattgttgaattagatatactgaatctggtagtctttgacattttattcaagaatgtattttctctactatgataattgaaatgtgcaacatg

SEQ ID NO: 6130 - DNA, 663 bp, Sorghum bicolor
  Clone ID: SORBI-28MAY03-CLUS3485_1
aaaaaaaccatttcgtcgtctctcgctccctcggtccctccccccttctcccccgctcctttcccctcacctcgccatctccttcttcctcacctcgccatggcgttcttctctcaccaccatctccagcagccacacccgcagcaggcgccaccgccgcatcagcagcagccggtccttccttccttcaggaacgcgctaccggtgcctgtggatggccagatcccagcgcccctcaccttcttcaacccgccgcctgccttcccggagcagcccgcgcaggcaccgctggtggatgcgatggggctgacggcagctgcggggcttggatggaggcagccgagggagcaggaactgcttggggaaaactcccagatgtcatccatcgattttctgcagacgggctcggcggtgtcgacggggctggcgctgtctctggaggaccggcgccacggcggcggcggggctgggaactcctccggcgattcaccgctgctcctgctgcccatgctggacgatgacatctcacgcgaggtccagcggcttgacgctgatatggaccgcttcattaaagctcagagtgaacggctgaagcaatctatactggagaaagttcaggcaaagcagtttgaggcactggccttaagtgaagacaagatactc

SEQ ID NO: 6131 - DNA, 702 bp, Sorghum bicolor
  Clone ID: SORBI-28MAY03-CLUS35365_1
gcacgaggcagtcatttcattcgttggcagccaggggaagaaaattttcgtggataagagctgcagagctgaaatatcaagaacgtagggtgaagattgaaacaaggcccattttcgattagcaaaagcgccaagccaaagaattcgccacggcccgaggcgttttggtcgtcacctgtggaagtcttcagggcctactgaaccacagctgctgctggaaccatggagatggaggccgtggaatcaaatggctcacacggcgccgccgatcgccggacacccaagagggaccaccgcatcttctgggcctccgtcttcatcctcgcgaataactgcttccagtgcatcgcctacttcggcgtgtcgacgaacctagtgaactacctcaaggaccagctgcacgagggcagcaaggccgccgcgaacggcgtcaccaactggctgggcacgagctccatcacgccgctcgtcgccgccttcctcgccgacgccttcctcggcagatactggaccatcgcgctcttcatggtcatctccgtcgtggcctacgtggtgctgacggtgagcgcagcggtggcgctggagagcgcggccttctacgcggggctgtacctgctggcgctgggcggcgcgctgcagccggtgctgtcgtcgttcggcgcgaaccagttcgacgagtccgacgagggggagcgcgggcgg

SEQ ID NO: 6132 - DNA, 630 bp, Sorghum bicolor
  Clone ID: SORBI-28MAY03-CLUS35369_1
gagacggcctctttcccttctgtcatctgactcgcgtaagcctcggccgccgccgccgccaccacctgctttgcgccatggcggagaagtcgccggcggccgacgtggaggccggtctcctcgcccacctcaactccgcgggcgaggtccccgactcccgctccttcgcctcctcactcggcgtctcccacctcgagctcgagggcgttattaagagcctctcagctttccgcatcgtcgaaagcacagacatcgtcaaggagacatgggtgctcaccgaagaggccaagggctacgccgccaagggttccccagaggcacagctcgtcgccgcaatcccatcggagggcgcctccaaagacgctctcaaggcaaaattgggagatgctttcgatgttggcatgaaggcagctgcgaggaacaagtggatagggttcgagaaggggaacaaggacttggtccttaggaaggttgagagcgtaaaggatgagttacaagagcagcttagaagactagagaatggggaggttgttcctgataaagtgattgatgatttgaagagaaggaaacttattacgaaagagaaatcaatttggtactctctaaagaagggagctgagtttgttctaa

SEQ ID NO: 6133 - DNA, 907 bp, Sorghum bicolor
  Clone ID: SORBI-28MAY03-CLUS35356_1
ctcaacatgactgacgaaatgctgagcgcccgctcgttctcgaggcagctcatggaccagatttatctagccaaaacttatgtcatcgttgccaaggaggcaaacaacctgcagttcgtggcggagcttagtgcccaggtacggcgggcgcagagcatccttgcgcacgctgcagcccatgggggcacggtgatggagcaggaagcagagaaggcgatcagggatatgtcggtgctgctcttccaggcgcagcagcttcggtatgacagtggtatcacaatcatgaagttgaaaggccagattcagtccctagaggagaagtcgaaagctgaggcagacaagagcacaaaatatggccagattgcagctgaggagctcccaaagggactttattgccttggtgtccgattaaccatggaatggttcaaaagtcctgagcttcagagaaagttttcagacaggagcccatcagtgcagagcaatctaagggataacagcctctatcatttctgtgtcttctcagacaacatccttgctgtttcagttgttgtcaattctacggctataaactcgaggcaccctgacaaggttgtttttcacctagtgactgatgacttgaactatgctccgatgaaggcgtggtttgccatgaatgactacagaggagtcactgtggacatacaaaaggtggaggacttcacctggctcaatgcatcatatgttcccgttcttaaacagctacagaacgctgctacccagaagttctacttctctggcagtggtaatcgtggaacaccaattaaattcaggaacccaaagtacttatcaatgcttaaccacttgaggttctacattccggaaatatatcctgaattgcagaaggtggtatttcttgatgatgatatcg

SEQ ID NO: 6134 - DNA, 706 bp, Sorghum bicolor
  Clone ID: SORBI-28MAY03-CLUS35395_1
gcacgagggtcaagtacgcgcggtgggaggagcagcagcgggacttcgcgcgcgcccggtccgtctacgagcgcgcgctcgacgtcgcccacccccgccgcacgctctggctcaagtatgccgagttcgagatgcggaaccggttcgtcaaccacgcccggaatgtctgggaccgtgcggtgtcgctcctcccccgggtggaccagctctggtacaagtacatccacatggaggagctgcttggtgcggtcgccaatgcccgccaggtgttcgagcgctggatgtcttggcggcctgacactgccggctggaattcttacatcaagtttgagctgcggtacggggaggtcgagcgtgccagggctatctacgagcggtttgtggctgagcacccaaggccagataccttcatccgctatgctaagtttgagatgaagcgcggcgaggtcgagcgggcacggcgggtgtatgagcgtgcagcagacctgcttgcggatgatgaggatgctgaggtgttatttgtggcatttgcagagtttgaggagaggtgccgtgaggtcgagcgtgcgcgtgcaatgtacaagtatgctctggacagggtgcccaagggtcgtgctgaggaactgtataggaagtttctggcatttgagaagcagtttggtgaccgcgagggaattgaagatgccattgtgggaaagaggagatt

SEQ ID NO: 6135 - DNA, 969 bp, Sorghum bicolor
  Clone ID: SORBI-28MAY03-CLUS34940_1
gcacgaggcataattgaggagactggagtagatgctattgatactggagacgatggcacggtaaaaattactgcaagagacctatcaagcttagagaagtcaaaaactataatagctaaccttaccatggttccaaaagtcggagaaatatacaggaattgtgagatcaagtcaatagctccatatggtgcttttgttgaaattgctccagggcgtgagggtttatgtcatatcagcgagttaagttcaggctggttggccaaggctgaggatgcttttaaagttggagatcgcatagacgtcaagcttattgagataaatgataaaggtcaactacggttaagttcccgagctttgcttcctgacgcggattcagaatccaacagcggttcaacaaaagaaaaggcaccgcaaaaagatgatgcccatcaagatgacatcgaggagacccaggcgcaagagacagtctgagccatttggagctgaaaatgccacaataaagactcttgagaaaagtgctgcggctccagctggttcaaagggcagtgaagttgggaagtaggaaaacgacggtgacttgtgccttaatcagacgattgcttcacttgactggtcaagttaagggatacacacatcaattgactatatgattgtcatcgggcatgacaaagaattccaacatgaggcataactgtctaaaccggattacaatgaagaagatttgatcgaccttgatgttagacaggtagcgtgcctgctttgcggtacaggacgtatgcgcccatccggcaataatggtgcccaggactagatcgtcaccttgattagcggaacggatcggcgtaacagccatggaaacttgattgtaatctccaggatagtatgtttacctttgtgttgtactcctaagtaataaccttttgtactactacatattcttgccgatcccgccaatgcaaactagtgcgt

SEQ ID NO: 6136 - DNA, 664 bp, Sorghum bicolor
  Clone ID: SORBI-28MAY03-CLUS34967_1
aatcgttttgctcttgtatttggaacgttggatggtggcattggatgcattgcacctgttgatgaattgacatttcgccggctccagagcttgcagaggaagctcgtagatgctgtaccccatgtctgtggcctgaatccaagatcatttaggcattttaagtcaaatggcaaggcgcatcgtccaggaccagataacatcattgactttgagcttctttctcactatgagatgctgtctttagaagagcagctcgagattgcacagcagattggaaccacccgctctcagattctttctaactttagtgactttttactgggcactagtttcttgtaagtggtaacctgtggctaagtaacaccatgatgatgatgatagtggcgcttgccattctgacgccgcttgaagaattagtcccaattccatcgacatggtcacttccacaagttttattgtaaagatggttgctgaactttagatgttaacggtgtaactggaagttgggtgcctggcaactgattgcaaccatgttttccattgacctgctgcattagtattgcaaaatgcactggaaatgaattacctgaagagttggttttttacctgagccattgtaaaccttctacttgattaaagcccaactgcagtaatgataactact

SEQ ID NO: 6137 - DNA, 411 bp, Sorghum bicolor
  Clone ID: SORBI-28MAY03-CLUS35006_1
gaatgcctattcccggatccttgcgaaggagcaccccatcactgtgcatcaactgcgtgcatccgggctatgtccagacggacatgaacttccatgctggggatctcccactcgagcagggtgcacggggagctctcatgatggcgatggcacctaagggaggcgtcactggtgcgtacttggacaaaaccaaggtcgtgtcattcgtgtaatacgctcgaaccgcccccacagggcacgggagtcgcaggctctcaattttcacgacgtttcttgtggagtatattgattgtaatttggttcatgcctagaggtccttcaagtcagaatttgcggtgttcccagtacgtgcaaaaaacaaagttacttctgctccccgtggggctcactgtcttgtctatcctctttgtt

SEQ ID NO: 6138 - DNA, 590 bp, Sorghum bicolor
  Clone ID: SORBI-28MAY03-CLUS35034_1
acattataagtcgtcaaccaaaacacacccgagcctgcagccctggaacctgggaacggatgaaagcggttggtggctcttcccaaccggactcatgctattgaaatgcattcaagcaaggcttgttgattggcacgttgctaatttagaaattcaagaccgtgcggtatatagcaacgacccaaatatcttttggcagtcatgacacctggtgtaactgaggtccttctggaaagctttttacaactcgattttttgtgagttgataaaaggaagagtgcgggcagcaaggcctttctttattgaccaggccaaagaaggaactacagaggttatatagatgcatacttccgcatcccccgctgataatgtgcagttgcaaccggtgttctgttgtatatataaaaggtgttcttgatccattctttgtaggatttagacaccatagagtttataaacaatgtgaaagctaacctaagagagacatcggggggatgtggatttgttgttctattgctaccatgccctggcccttgatgtttgttgagatgggcaaaggggctcaagtcaaagagatgcaaaagcctctt

SEQ ID NO: 6139 - DNA, 708 bp, Sorghum bicolor
  Clone ID: SORBI-28MAY03-CLUS35076_1
gacaaagttcagatcacaggcccctcaggcaaaataatgcttcttcccgaagatgatccaaaagcgactcatatcatgattgccacggggactggtgttgctccttaccgtggctacttacgtcgtatgttcatggaagatgtccctactttcaaatttggtggtctggcttggctcttccttggtgtggctaactctgacagccttctctatgatgaagagttcacaaactaccttcagcagtatccatataatttcaggtatgacaaagcactaagcagggagcagaagaacaagaacggcggcaagatgtacgtgcaggacaagattgaggagtacagcgatgaaatcttcaagctgctagatggcggtgcgcacatctacttctgcggtttgaaggggatgatgcctgggatccaggacacgctcaagagggtggctgagcaaagaggcgagagttgggaccagaagctgtcacagctgaaaaagaacaagcagtggcacgtggaggtttactagtaggttatgaaacgccaaaggattgtgattgtttcggcgagtgaggtgagaaactggacatatgattgaacgattgttgtggtgatgtaacattgtcgactttattcataagcttctgctccaaattgtgaataaaatgaagcagacggtttttataattgttactatctatcggagagcattaccggt

SEQ ID NO: 6140 - DNA, 723 bp, Sorghum bicolor
  Clone ID: SORBI-28MAY03-CLUS35015_1
cttgatgttggcaacaaccacctgacaggcactctcagggattttatcggcaatgggaatggcttcccttccctgagaaatctatacctgaacaacaatgaattgactggtgtgctgccagatcagattgcaaatttgacaaaccttgagattttgcacttgtccaataataagatgatcggatcaatatcgcctaagctagttcacattccaaggctgatctatttgtacttagacaataacaacttcattgggaggatacccgaagggttgtacaggcatccatttctgaaggagctgtacatcgaaggaaatcacttcagaccaggaactagatcaaaaggaacacacaaggtgctggaattgcctgatgctgacattttagtttagcaagctcgtttggggacctgaggtcttggcgtcctgcagtagactactgccgctaccacgattatttttagggcatatatgtagctatgtttgtcactgaactgttcagtggcaaaattacatttgaaaaagtctcttgcaaaaaagagagaggaaaaacagtgaatagtagaggccactgtcacactgccgacattattagatgtgagtgtacaggttgtattgtttaccctgtatctttgctgtatgatggagatgctcgtcagatgtaacgccagcacatcgcatggcaccgacagtcctggtacaaccaggggccaatgatattttgtt

SEQ ID NO: 6141 - DNA, 672 bp, Sorghum bicolor
  Clone ID: SORBI-28MAY03-CLUS35594_1
ctgtgcgctgatatgctgctgcctaccctgcataatctccttaatgggtttccgggaagatctgaacgaaaacagaggtgctacttcagatgcaatcaatgccctgggcacatacaagttcaaaacgaagaagcctcgtaacacagagggaaatgaaggcggcggtggagtctttgctcctggaacagacaaggaacgagctgtttctgctgaagatgctgtttgctgtatctgcttggcgaggtatgtagataacgatgatctccggttgctcccctgcgggcacttcttccataaggactgtgtcgacaaatggctcaagataaatgcactgtgcccactctgcaaagctgagatcgacatcgtcccgacgaccgctcctccagccatcggctttgggcgccgccacagtgacaacagggtaggaaacgacattgaatcacaacggtagctttatcacggcttccatgatgtatagtgagagagcaacttccctccgatgtgtggtttccagaagagcaacatgtaaattatgtagtgatagagattatgtgatgaatcaacgagtccttacatgatccagcgagtaatcgcctgactgaaaaatgtgtctttgttgtcaatgtgtcactatggctttgttccttccgaatttaccttcgtattcttctc

SEQ ID NO: 6142 - DNA, 929 bp, Sorghum bicolor
  Clone ID: SORBI-28MAY03-CLUS3559_1
gcacgaggccctcctccggcagctcatttgctccgtcgtgtgcgtcaatcaaagacgccatttccttcgtgctccttcctgttcattcctttccttgaaacccttttccccgtaaagctctccgctgcgcgtacttcgaatggccgtcggaggaggcgtgtgcgtggcgtcgccctcgtcctcgccgtcgtcgtcggttgaggcgccgtgggggacgaggaggacgaggacgacgacgacgacgagcggggcgcgacgcggcgccgcggcggcggcgaccagcgtcaggtgcagcatcgtgggcgaggccggcgggccgggcgcctccggcagactggcggaggacccttaccggacgctgcggctgcgcccgggcgccacccgcggcgaggtcaagaaggccttccgccgcctcgcgctcatgtaccatccggacgttcgcaaggagaagggaagggaaagcgacggcgtcagcgacgtccaattccagaggattaacgtggcgtatcagatggtgatgagtagcatgagggaggccgacgagcggctggagtactggcggctcaagtacggcctcaccgacgaggatctcgacaggtacaggcaccacctcaaccaagaacacggtgacgacgactggttcgacatgtgaagcagccaatcggtagacaaggattttatgtacataataaccctgtttatccgcattgacccgattaaattcttgttgccattgcggaggcaccaacggtaatttggtcggcgttgtgtatattgaatacctctccccatgttttatagcgggtgaagggatacagttagactaaaagtgtagtgtcatttgtgtttcagaaacatgggagaaaccccacttcttgtttatatactgtacaaagatttagttgatcttaatcatgtctgcaagtgct

SEQ ID NO: 6143 - DNA, 707 bp, Sorghum bicolor
  Clone ID: SORBI-28MAY03-CLUS35668_1
gcacgaggggtatattcctttatgagctcctatttggtaagacccctttcaaggggtcaggaaaccgggctacactcttcaatgttgttggtcagccccttcggttcccagagtccccaattgtgagtttctcagctagggacttgataagaggattgctggtcaaagacccgcagcatcgtcttggctacaaacgagggactactgagatcaagcagcacccgttctttgagggtgtgaattgggcgttgattcggtgtgcaagccctccggatgtaccaaagcctgtcgagctggatcgcccaccaaaaccggccccagctaacgataaggttgctccagctgccaaccagaagggcccagataactttctggagtttgaattcttctagagttgttttcctttcagttttgtaatgtgggttggtgcatgcaagctggtgtatgaaaggaggaagatcagttcggaggcgtatactgtgatgactggtgatgctctattgtaagctgtagttctatttcgagtagctcttgttcgttttttttctctctccattgaactgctaaagaccctatttgtaccgggtcaatgttgcaattttttttagaaaatcttgtggtgcttaaaggacacaggggaatactttcaccctggcattgtaaatcctgtttgatttggcatcaattgcaactgatttccttttttg

SEQ ID NO: 6144 - DNA, 771 bp, Sorghum bicolor
  Clone ID: SORBI-28MAY03-CLUS35699_1
gcacgagggtaaggttcataggggcatgcaagaaatcaatcgtgtggtgtattattacggagtatgcaaaaggtggctcagtccggcaattcctggctagaaggcagaacaaatcggtgcctttgcggttggctgtgaaacaggcgttggatgtagcccggggaatggcatatgttcatgcattgggatttattcacagagatctgaagtcagataaccttctgatttcagcagacaaatccattaagattgccgactttggagttgctcgtatcgaagtgaaaactgaagggatgacaccagagacaggaacctaccgctggatggcaccggaaatgatccagcacaggccctatgatcataaaggtgatgtctatagctttggcatcgtcttgtgggagctaataaccggcatgcttccgttcaccaacatgacggctgttcaggcagctttcgctgtcgtaaataagggtgctcgcccggtaattcctcaagattgcctgccttctctaagccacattatgactcgttgctgggatgcaaacccagaagttcgcccaccatttactgagattgtctgcatgcttgagagtgctaaaatggagcttgtgagcaacgtgcgcaaagcacgcttccgctgctgtatttctgaacccatgaccaccgactgaagtggaagttggtggctagatgaccacaaagtgggtaagagaatggagtgggaaaaggataaagagcctatctcatgtattcgtgtcagtgccagggtct

SEQ ID NO: 6145 - DNA, 649 bp, Sorghum bicolor
  Clone ID: SORBI-28MAY03-CLUS35169_1
tacaccatcagcccatacatctcatccagtatttcctggccaaacttctataacaaattctgatgtccaagttcgcactaaagctgtatcttttgaagacgacaaatatgtagttagttcgtcaaagtctcctcccctgctactggattcatgtccgtctgcgcccgggcgcgggatctcttcaggcccccctccatctcgtgaccgcgtcatagtctcctccccgcctacgggcgtcttctcggtctccgcctgggctcgcgggctctcccgtccccactccctcccgtgaccgaaagataatatcaagtgggcgaaaggcctttacaggatctatcattgagcacgacgacaatatttcaaccattcaaccttctgtgggtaattcattggcaaaacctggtacttctgcttcttcaaggcccatgtcaagattcaagatgcagaaaggagggcggtgattcgctcgacacggggtggatctttggtggctgatagatgcatctgggacaatcatgataagtggtagtgtggatactgtaaccccttcaaatagtttgtgcgagctgagcacctgaaactagacatctttttgtggagcgattgtcctctgcgaactgtgtagtgcacctccagtgaaactgttggg

SEQ ID NO: 6146 - DNA, 630 bp, Sorghum bicolor
  Clone ID: SORBI-28MAY03-CLUS35201_1
cccgggcgcggcgctccagctccccgtcgtcccccccacccgccccgtcgcccgcaccaccccccccgtcacctccccccgccccgccacccccccacccccgccgccgcaccccatcgccagcgccgccgcgtccgcgagctcctcggcctcctccgggcgaaggaaggagaaccagctggtcatcgacatcccgacgcggcccgtggccctgaacacaccgcccatgaactccccgctgccggcgagccgcatgcccgggaccgccgacgacatgcggtcccctgtctccgccaggctgcggtcgctgcgccggttgctcagcagaggcaagcaggccgtggtcggcacctgctcttacagcccgcccgcgctcccaagacgcccaagacgcctccgtcgtcggcgaactgatcgtccagatccccggctcccgagctccgtgacgcatttggctgcactcgccgatcaccggagcgcgcacatgcgttcattctttctttccccctttttctttactcttcttcttgatttgacagcagaaaagagactgatgtggattggttgttgttgggggggataaatgttgaatttgttcatatattaagagttaatcaagagactttcttg

SEQ ID NO: 6147 - DNA, 1199 bp, Sorghum bicolor
  unsure (1)..(1199): unsure at all n locations
  Clone ID: SORBI-28MAY03-CLUS3514_1
gcacgaggctcaggttgctcccagctcccatccgcgcccctcggggagtacgaggtacgagaaagagagcgactctcctccaagaatggcgggtggcggcgccgacgacgacgacgtggtggaggtgagctgcggcggcagaggcggcggcgaccccggcgcgtacgccgcggtgctcaagaggaagctcgacctgtactgcgccgccgtcgccaaatccatggaagctaaatcacaagaatcttcgttgggctaccccaactcacaagcttcagatacttcgcaattgatttctcaagcttcctttgatggtgacatagatggagcaggccttgtcacaaactctaatgtcataatagaagatgatgattttcaaggcaagccaaccaatagtggtacatcaaaggaactgtcagacgatgatggtgaccttgaagagaacactgaccccactaacgccaagaagatgaggagaatgctgtcaaatcgggaatcagctaggcgatcaagaaagaggaagcaagcacacttgaacgatcttgaatcacaggtttccaggttaacatctgagaatgcatctttgctaaagcgtctggctgatatgactcagaaatacaaggatgcttcccttgacaataaaaatctaacagttgatattgagactatgaggagaaaggtgaacatagccgaggaagctgtcaggagactaactggaacaaccctcatgttatcaaccgcatttgacaagcccatgagcagcacacccttgtcatcatgtgcatctgatgcggcttctgcctctgtcgccattgaagatagcgcgaaacatttcctccatgcgccacttcaaagcggtcagatgaagcttgacatcctgaacgcggcgattcctctgaccagtgaggggataggcaccaagccagcttctctgcagcgtgttgctagcttggagaacctgcagaagaggatcattggagattcgatgcactctgagactgcatcaacattctcagagcctgaagctcttgccgataggtaaacatgagctgtaaagatttgctcctgtgatgaacagctctagtgacctaagttttgtggcaatggaagttgtgcacccatgcgtctgggtgggatctatacagtgattttgtacactattttgaagattaataatctgtggccanaggctgtcatctttg

SEQ ID NO: 6148 - DNA, 495 bp, Sorghum bicolor
  Clone ID: LIB3481-024-P1-K1-B1
acgcgttcgaccaaacctatggtggagccttggctgaagggctgatgtatctctcgagaacaagaataccgtgaggagtccaaacagaatactgcgatacaaacagttctttaatgcttgagtgtgaacatagcccaggaagctgtcaggagactaactggaacaaccctcatgttatccaccgcatttgacaagcccatgagcagcacacccttgtcatcatgtgcatatgatgcggcttctgcctctgtcgccattgaagatagcgcgaaacatttcctccatgcgccactgtaaagcggtcagatgaagcttgacatcctgaacgcggcgattcctctgaccagtgaggggataggcaccaagccagcttctctgcagcgtgttgctagcttggagaacctgcagaagaggatcattggagattcgatgcactctgagactgcatcaacattctcagagcctgaagctcttgccgataggtaaacatgagct

SEQ ID NO: 6149 - DNA, 422 bp, Sorghum bicolor
  Clone ID: SORBI-28MAY03-CLUS3519_1
aaaaaaaaggtttacaaatcatacatgtggtggatacaacactaaaacaagcgttccacacagctagcacggcactgatcactctgtcagatcccggtgtagtgaaccggtgaacgatccattcccaacgaacaactgaactgtaccggcggcgacgagcagagcaggcgggggcagaggaaattgctgaagaagaggggaggccggtggccgccgttgtggggggagtgagttcagaagaaggagcgcttggtggatggcgccctccccacggccctcatgaagttggcgagctccagcacccgcgccaccttggtgccccgcttggcctccgccgacgcgcgcttctcctccgccttccgccgcgccttggccacctcgttctgcgccttctccatcgccttggcacgcttctcctccag

SEQ ID NO: 6150 - DNA, 302 bp, Sorghum bicolor
  Clone ID: LIB3481-024-P1-K1-B4
aacaggaaaaaaaaggtttacaaatcatacatgtggtggatacaacactaaaacaggcgttccacgcagctagcacggcactgatcactctgtctgatcccgtggagtgaagcggtgaacgatccattaatccagcgaagaactgaactgcacaggcggcggcgtcgacgaacaactgaactgtaccggcggcgacgagcaaagcaggcgggggcagaggaaattgctgaagaagaggggaggccggtggccgttgtggttgtggggggagtgtgttcagaagaaggagcgcttggtggatt

SEQ ID NO: 6151 - DNA, 720 bp, Sorghum bicolor
  Clone ID: SORBI-28MAY03-CLUS35237_1
tcgaaaagctagacctgtgctgcttccctggagagaagataccagattggtttagtccgagtaagctgttgagactgaagagactctatttcactggaggaatgctaagaacttttggcaacaaaaacatgtcagaggtgtggagcgttgaggttttgcgcctgaaattcttgaatgatttatcagtacaatggacccaggtgcatgacatatttccaaaactgacctttctggaggtattcagatgtaggaagctagaatccttcccttgtgataaggatggggtgtggatgaaccatgatacgaaggatatcagaaagtagaaggcaggaatgaatcaattgagcttccactgttacttttgctgtgtaactagctttgtctcaacacgtggacgacaactggatcccgaatgtacaccatagatgatgtacatcacgactgtcatcagtcgaccttgactccgtgcctcatagtcatatcgaaattggagttattttgagagctgtcacttggtggtgcaatgttcaacatgttttcatcatgggaggttatgcttgcctgtagctttgctgttccacgtcatgtatcttgtctgtggttgtttttcccttgtgttgtgttgctttgttggtgtttctgtctcgcccctgctatgtacctctgggacttgctccaataatgtaaccttccattcctggcttgctggtatatgtggaa

SEQ ID NO: 6152 - DNA, 938 bp, Sorghum bicolor
  Clone ID: SORBI-28MAY03-CLUS35249_1
tccccatcacacaaacctggcagggttcctttttatgtcacatgtaccaacaggttggcctgcagtgaaatccgagagtttgagtttcgaccaagtgttactcaatacatggatgccccaagtccacatggtgctacaaacaaaacatatctccagatgcgtcttgatgacctgttgtctttgggacacaatgagtaccaggcaacagtatctaaccccactaaagagatggttgatttgagcaagaagataagctcactgatgacaagcaacgattcctggtccaagttgctaaaattggctagtgacaatgagcctgccactgatcataatcaggatcagttctttgaaaaacgcttaaaggaaaaattgcatatctggcttgtccacaaagcacgcgatggtgggcacgaggccaatgtgttggatgatgaagggcagggtgttcttcatctggcagctgccctaggatacgattgggtgataaggccaacagtttctgctggtgtgaatataaatttcagagatgctcatggatggactgcactccattgggcggcattttgtggcagagagcgaacagttgtcgcacttattgcacttggtgcagctcctggagctttgacagacccaacgccagatttccctacaggaagcacaccagctgatcttgcatcagctaatggatacaagggaatctctggtttcttggcggagtcttctttaacaagtcatcttcagaccctcgatcttaaggaaggcaaggggagcaatgcaccagaaatatcaggtctgcctggtattggagatgttactgaaagaagagcatcaccattagcaggtgaaggtcttcaagctggatccgtgggagattcactaggtgctgttcgaaatgctgcccaagctgctgctcgtatatatcaagttttcagggtgca

SEQ ID NO: 6153 - DNA, 887 bp, Sorghum bicolor
  Clone ID: SORBI-28MAY03-CLUS3527_1
cgtccgacgaaatggtgtaattgaatttggcgaatttgttcgatctcttagtgtgtttcatccagatgcaccagaagaacaaaaggttgcatttgcatttaagttgtatgacttaagacagacaggctttatagaacggcatgagttaaaggagatggtgttggctctgctggatgaatcagatttggatattgcgagcgatgctgtcgagatgattgttgataggacatttgatcaggctgacacaaaaggtgatgggaagatagatcaagaagaatggactgcatatgctaaagataatccatatgtgctgaggaatatgacccttccctacctcaaggacattactatggtattcccaagctttgtgatgcactcagaaatcagcgaaacagacatggctgtctaacctgaaaagtaactgcaaacttgcaacgtctctgtacatcctgatctatattttaatgatgaaagggcgcacttgaatcttttcatcaagaaaaggtgcgctaccctccgcccgtcattcggatccgtgtctcgtgtatttcgccgattccggagtcgggttctgttaccctaccctctgccgtttgggctttggcgcacctttctgcggccttgctgacctcccgtacaatcacacggcaatgggtccattcttgggtcatctttctgtttcttccgcttttaagttggacaatgctttttcttttctttttgatgagatgggtgttgaacaagggttaggaagctgcagccttgtagatcaagtactgcaattgaattcatgatcatccaaacaaaaagggtgtaccacaaattgatgtttacctgttctctgacgaaaaaaggggttattgctctatgagaataagctaatatat

SEQ ID NO: 6154 - DNA, 594 bp, Sorghum bicolor
  unsure (1)..(594): unsure at all n locations
  Clone ID: SORBI-28MAY03-CLUS36019_1
gcccgcgggccacgcccgcccgcccgctcgccgcctcctcctatcgtcgcctctcgcggtctcgccgctcgctgctcctccccccgcccaccccgcgcgcgccgcttgcccgccctccctctatcgttcgggatcgatcgatggtgggggacctgtccctcctcgccgtcgcctccgcctcccccgtcgtcctcccgccgtccaaggagctccatggcgtgcttcctctccaggtccaggggaagaggccgcaggacgccggcgtgcagctctgcgcgccgctgcagcagcagcagcagcagcatccgccccaccatctagaggcggggatgccttaccaccagggccagcccatgcagatggtcgtgcccggtgtccatcagggacagcctcttcccgccgcctaccaggccttcgtgatgcccgacacggccacgctcatcgacgtgcaagattctcaccctgactcagttcaacttagccttgggatcgctgagcaatgtgcaaggcaagagaaactcctcaagtttctcatgtctgggtctgacgtganagaacttgatgaatccttgctagctgaattcacagggcaac

SEQ ID NO: 6155 - DNA, 839 bp, Sorghum bicolor
  Clone ID: SORBI-28MAY03-CLUS36025_1
gcacgagggcccgcccacggccccccgcacggccgctcccccatctccgaatccgcgtgcgactgcaagctcctgtcgtccgaactcgccgggcaccgccgctcccctggcccgtcaacggccggccgccgcctatcctcccgacgcactgcactgcccctgcggaagtgcgagcggaggtcgtcgtctcctccactcggacccgtcggccagctgcttgataaggcccgtcggccgtcgccacgccggcgccgtgcctcgtgcccctggccgcagggtaattggtaggcgcgtgcaaccacccccgcgcggatgccccgttgcgtggctcgctgacgcagtggtgaggctgccgagggggggcgcgggcggggaaatcttggatccgggttggtcggcgacgtggcggtgtccatagagattggatccatgggctcgtcctcccatcacgatgccatctccgcatcaggaagtttggaatgtgctgatggcagcagaagcgggatcagcaagtggaccaaaattacaagcacaaactcgtggagatggtgcctagggttgatttacatcgttgctgttgccggtatatggattgccgctagctacatcgtgcagtctgttgtggatgctggcgtctctccgttcttgatcacctacatatgcaattctctgtttgttgtctacattcccatagtcgaggctgcccgttactttgaggattctattggggacttttggacaaagttgaaattcaaggacgctgaaagcctgcagagtggggggcagcagtcttctgacctggagagtgtgaatcttctccaaagtggggggcatgagat

SEQ ID NO: 6156 - DNA, 1140 bp, Sorghum bicolor
  Clone ID: SORBI-28MAY03-CLUS3602_1
tttagaattcttttttttcctaagtttaagtcagcacgttttatccactggatcaaatccaatcagattgtacacctatgtgcatacagaatcttacagatccaattgtcccaaaggttgacacagattttagggggcaaaggtaactgatgaatagcaaaaccattaatctattgttctaataactatatttggtggagttgtgtgtacatgactccacccagcagggttcaaatcctgggtgtgcacctatttagatgtttgtggagtaaaacattcgggtgttgaacttgatcataatctatgtactcttttgtcagatatatgaaaagatgatttctggaatgtatcttggagaaattgtgcggaggatcctgctgaaactggctcatgatgcttcattgtttggggatgttgttcctccgaaattggaacagctatttatactgaggacgccagatatgtcagccatgcatcatgacacctcacatgatctcaagcacctgggagctaagctgaaggatattctgggggttcctgatacttctctcgaagcaagatacattactcttcatgtgtgcgacctcgtcgcagagagaggtgcacgcttggctgctgctggtatatatggtattctgaagaagcttggcaaagacaaattgcttagtgacttcagtcaacaaaggactgtagttgctattgatggtggcttatacgagcattacaagaagttcagtgcctgcctagaagcgacgctgacagacctgctcggcgaggaggttgcctcatcggttgttgtcaagttggccaacgacggctcaggaatcggagctgctcttcttgcagcctcacactcccagtatgctgaagctgcatagttctaggagctcggctcctagtgtaacctttttcgttttgctcccttttccccttcaatcgcgagccaccctcgtgcgaatgtgcgattcgcatctctctcttttttgcctcagccgcggggtatagctaggatggtgccattgagcttggagtacattatcactagcattagcaacggcagaaaaaaaagtggaagcggaggtctgaataagccattccactcctgccaattcttttttttccccaatcccttgaagtttg

SEQ ID NO: 6157 - DNA, 1181 bp, Sorghum bicolor
  Clone ID: SORBI-28MAY03-CLUS36119_1
tttacccatttcctctcctcccactcgctggcctgcgcatctcctctaagcgagcaagctaggcgtagcaggcgggagctcgtttgggcggtggtggaggagagagggagggaggagatgaaggcggtggagcgcgcgaaactggtgaggagcctccggcacgagtcgcggcggctgcgtctactcgtcctcgtcatcggtttcttcctcgtcacgctcaccttcgttgtcgtctccaagcccgacgccctcctcttcaacctgaacggcaggctgttggtggaccaggcgccgcgctcgctcttgatccgccagcgggttgacgcccacgacgggagatccgccgacactctcgcctctgcctctggggatctaaaggtggtcgacgacgataccgccggcgaggaagccagcaccaacgccatagggaccagtggagaggaggaacgggtgctcgctagcgagcccgagcagagcaaaagggcagtggaagccactacatcagagattttaggtggggaacacgacgagggaaggaaaagccagcaagagggggcacgagggcaccagcagcacaagttgactctcccaactgtttcaaattataccattcatgatgccactgatggcaccgacaatggcaaccgggatgatgcagaatttaagcccactctggatgttgaccagagaaatggtcgtgacagatctcatcaagcagcattggataatgtggagcgggacaaaccattgtgtgatttctcaaacttcagagcaaatacctgtgagatgagaggtaacatcagaatacacccaaatggcagttcggtcatttacgtggaacctacaagttcaagtccaaagagaaatgaacaatggaaaattaagccttaccctcgcaaaggtgatgaattatgccttaatcatattacagaagtgacagtgaaatccagcaaagtggcacctgagtgttccaagtaccatcatgtgcctgctgtgatctttgctctgactggatacactggaaatctattccatgacttcaccgacgtgcttgtcccccttttcacgactgcaagtgagttcaatggtgaagttcaattcctaatcacagacatggctatttggtggacaaggaagtatgcagtggtgtttgagaagttaactaagtaccccttgattga

SEQ ID NO: 6158 - DNA, 1030 bp, Sorghum bicolor
  Clone ID: SORBI-28MAY03-CLUS35449_1
caaaaaactacgaaccacctcctggtgaattttattttgaagttgatgataattccccggctcgccgggatgatccccttcttttcgattataatgttgaggaacgagtaaatgattttgttgctgcagctgtagcacaggcaaatatcacgaggacaaaccatatcatgtttacgatgggaacagacttcaaataccaatatgcagagagttggttcacaaatatggacaaactaattcactatgtgaacaaggatggccgtgtcaatgctctttattccacaccttcaatttataccgatgcgaaatatgctgcaaatgagctgtggcctctcaagactaatgatttcttcccatatgcagacaacccaaatgcctattggacagggtactttacaagcagacctgccttaaaacgatatgtccgcatgatgagtgggtattacctggcagctagacagctggagttctttaaagggagacatagctcaggtctctcaacagatagtctaggtgatgctctagctcttgcgcagcaccatgatgctgttacaggaacagagaaacaacatgttgcaaatgattatgcaaagagattgtcaattggatatacacaagcccaggagctcgtttcaacttctcttgcttgcttgacagagtcaggctcaaaatcgcattgctcatccccaatgacgaaattttcacaatgtcttctgctaaatgttacatattgccctccttctgagatggacttaacaaaaggaaaaagcttggttgttcttgtatacaactcgcttgggtggaaacgagaagacatccttcgtataccagttttcagtgattccattgttgttcatgattctgaaggaagagaaattgaatcacaacttctgcctatagctactgcctcgttgaacataagagacaagcatgtcaaggcttacctgggcacaacgccaggtgcaaagcccaagttttggcttgcttttcctgtgtctataccacctcttggtttcaatacttattttgt

SEQ ID NO: 6159 - DNA, 1067 bp, Sorghum bicolor
  Clone ID: SORBI-28MAY03-CLUS35450_1
gcagagagttgaattctttacaatgtcacccttggcgagctcatctatccattggctagttgggattgtgtatatgcttcaaataagcatatttgtcagccttcttcgaggggtgctgcgcaatggagttctttattttctgcgggaccctgctgatccaaattacaatccatttagggatttgattgacgatcctgtgcataagcatgcccggcgtgttcttttgtcagttgcagtgtatggaagtttgattgtgatgctggtcttcttacctgtaaaactggccatgagagtagctccttcaatttttcctcttgacatcaccatatttgacccgtttactgagattccagttgatgtccttctgttccaaatatgcataccatttgctattgagcatttcaagcctcgtgcaaccattaaatctcttttacatcattggtttgctgcggttggttgggcccttggcttaaccgatttcttactgccaaaacctgaagaaaacggtgggcaggaaaattggaatggcagggcagaaagaagggacaggggacatggtggacgggaaatggttgccccacaggtcgaacaacgcatgatacagcatgttgccgcagaagataatggcaggggaaatgcaaatgaagcaaatgatgccactgaagaatctgatgtagatgatcaaggagactctgagtatggctttgtgcttcggatcgtgctcttgcttgtactggcatgggtgacactactgatattcaatgccggaatgatagttattcctatctcgctcggccgtttggtttttgaggctgttccccgtctgccaatcacacatggcatcaagtgcaatgatctgttctcctttagcattgggtgctatattctctggagtgcggcagctgggaccagatatgcgattgattacatcagatcacgacagctgggatttctggtacaacaaatctgcaagtggtgctcaattgttttgaagagctcttttctcttgtcaatatggatctttgttattcctgtgctgattggactcctttttgagctgctggtca

SEQ ID NO: 6160 - DNA, 776 bp, Sorghum bicolor
  Clone ID: SORBI-28MAY03-CLUS35462_1
gcacgagggtggttttgaagtgaatctgagctcgtgacgcacccgcaagccgtgactcactcacccacgaaacgcgccgccaccgccgccgccgtcacatcacagcggcctcgccgtcgtctcggccgttccccgccgtagggccagtttccctctagctgccggagaccatgtcgagcggcctggacatgtccctggacgacctcatcaagaagtccaagtcccggcccaaggctaacccggcgtcctcgtcggggcctgcccgccgcgcgccacaccccgcccgcgccgcgccctacccgccggccgctcccaaggcgcacgaggccgctgactcgccctacggggtctactccgagcacatcgccactatagccgcggtcgcgccgccgccggcggcggcggcggccacagcaaggtcgctcgagacggggacgaagctgcacatctccaaccttgaccccggcgtcaccgtcgaggatgtccaggaacttttctcagaagttggggagctcaagcgttattcaatgaactatgacaaggatgggagatccaaggggaccgcggaagttgtctttgcaaggaaagtggatgctttggatgctatcaagagatacaatggtgttctacttgatgggaagccaatgaatttagagctcattggaaacaatgtcgaaccacctcccatgccaccactgatacccaatcgtcctttgcagaactataacgatatccatatcagtgtgcctcaatcccaaagaggtggtcagcgaaga

SEQ ID NO: 6161 - DNA, 641 bp, Sorghum bicolor
  Clone ID: SORBI-28MAY03-CLUS35548_1
gcacgaggctaggttgcgcgacccgagaccgcgagagggaacgacggcggcggcgttggagatggagactcaatcgtgggagggaggccgcgtattgcaatcggcttcggagagtagtaggaagcttgactatgaggcggaagcgcgtttggtggcggaggcgagagctgcgtgggagaggagggcaaagggggaggtggaggatgacgacgaggacgatcctgagatgctgttggactaccatgcttaccgggctagaaagttccgcgacacctggaactgcctctatttcggctactgcggctccttcgaggacaccacaaagatcccatccatgcgttttacagacaagccgcctcagcagcgctgctctgcacacctgtgcgctactctgcagatcttttcagtcaaagtagcagagagaaggagaatggggagtttacagtggccactccatgtgtttgggaagattgccctgcgtgactcagttgatcacaatcgcaatatgatctttgaccgcacaagagacaactgccaaattcttacgcaagaggtccccaatttgaaactgacaggtcctactcgtgctgttctgctgacggatcctgtgacctttgagggtgatttgaaagtgaagggct

SEQ ID NO: 6162 - DNA, 1046 bp, Sorghum bicolor
  Clone ID: SORBI-28MAY03-CLUS35550_1
gagttacagcatctttgcagctagcatgacattgctagttgctgatagacgatgctgagatggtgatattttgctcatagatttgtttgtgtttcagtggaaggatcgattcaccgatcctgaagatgctgccctactttgatccggactacgacaacttcaaccagcgcatcaaccctccaagggtttgcattgacaacaccacatgcaccgactgcaccttggtgaaggttgacagcatgaacaagaatggcattctgctggaggtgctgcaggtcctgagtgatctggacctccacatcttcaaagcctacatcacctctgatggtggatggttcatggatgtgttccatgtcggcgcgaggcaagggcagaagattactgatgacaagaccatcaagtacatcgagaaggctttgggtccagagagcaatttgctgtgcccaaaagccagcaacaagcaggggaggtctgtggggctgcactccatcggcgaccacaccgccatcgagctcaaggggcccgacaggacgggcctcctctcggagatcttcgccgtgctcgccgacctccagtgcaacgtgctggcggccgaggtgtggacgcaccgcatgcgcgtggcctgcgtcgtgtacgtgaacgacgtggccacggggctggccatcgacgacccgggccgcgtgtcccggatcgagaaccggctgcgccacgtgctccgcggctacggcggcggcggcgggggcaacgacgacgacgacggcagcggcgcgcacgccaacttcacggacgcctcctcgacgccgcaccacctggaccggcggctgcaccagctcatgcacgccgacgtggacgtcgcgcccgcggcggctctggcggccggtggacagggcgacaggccggaggtgacggtggagcactgcgaggagaagtcctactccgtggtgaacgtcaagtgcagggaccggtccaagctgctcttcgacatcgtgtgcacgctcacggacatggagtacgtcgtgttccatgccgccgtgtcgtccgaagcc

SEQ ID NO: 6163 - DNA, 671 bp, Sorghum bicolor
  Clone ID: SORBI-28MAY03-CLUS35552_1
tggatacgctctctcctcgcccgtgccgccgctcgagtgcgctctctgtgtctactctggtggcgacgactgggggtcgggggaccgccgccaccgccgtacgccaggtgcccaggtccccatcttcgggcccttcgccagttcgccggcgacgatcatccaccaggttgcaagattttccagcgctgcttgctcacccatttctcaatttagaaaacctcaatttctggatctcagaaccaaatcacgaccataccactttattcagccccgactgattgcaatggctgcagctccggccaatggtgattcacagagtggtcctcagaggaactaccaggttgttgttgctgccactcgtgacatgggcattgggaaggatggggttctgccatggaagcttcttggtgatcttaaattcttcaaagagcttacactaactacatctgatcctgccaagaagaatgcagttataatgggaaggaaaacatgggagagcattcctgttaagtcaaggccattgcctggtcgtttgaatgtcatacttactcgatctggtagctttgattttgcaacagtagagaatgttgttttatgtggaagtatgaattctgccttagaactgctagcatcaactccatactgcttatcaattgagaaagtttttgttg

SEQ ID NO: 6164 - DNA, 695 bp, Sorghum bicolor
  Clone ID: SORBI-28MAY03-CLUS36430_1
gcgacaggagagtgcccacaagaatcaagatgcaagcttcatcaccccaagaagaaaaacaaatccaagagaagcaaagtagataccgtccaaaacaacagttggggtcggtattttgagacaagcattggccatggcagtggagcaaggatagtttctttggaggaagaagagagacaaaaaccagagcaagtctctggtgaggactttgctgacttcattgaacttggttccgatattgaagtccctgaagatgcggatgcttcggatgacatacagccgatggaattggactcagggaatctcgacatgcaggctgacaatcttgaagcgataatcaagccacttcggatcatgaggactgcaagagtttgacgagttcttttgttggatatagctgcagtgttactgggtcaggggggtatgttatgctatgcatgacgaggcataggcgctgactggagtttctaattcttgaagactggttctgacagggcgtcagtttttgcttggttgaaggtttgattttgttcatcttgtacatctcttaggaaatatacagggtccgtccatatggcagtggtagaggccatgagggttactggctgttaacctgtgttttttgaacattacccagagttgaatgtaacaaacagtgctttacaatagcatgggaaatgaaggtttttttgtgt

SEQ ID NO: 6165 - DNA, 531 bp, Sorghum bicolor
  unsure (1)..(531): unsure at all n locations
  Clone ID: SORBI-28MAY03-CLUS36453_1
gtcanagctgcaggagttgaaatcaaatatgggggttttgggcaaagaagctgttgcagcaatgactgctgttgaagcccaacagcaaaggctgacactgcagcgtcttattgcattggttgaatcagagagaaactaccaccaaaaggtcctacaagttcttgatcaacttgagagagagatggtatttgagcgccaaagaattgaaggagcacctcctccggttgttgagagttccatgcctccgccgcctgcatatgaagaagtcaatggtatattcatgaggaatacagttgcagaattggtcgagactgtggagtatttcttggctgaggcaatccagtcatatcgagcagagagtgataccgagctcaacctttcagctggtgactacatagtggtccgaaaggtgtcgaacaatggatgggccgaaggtgaatgcagggggaaagctggctggttcccctacgactacatcgagaaacgagagcgtgtgcttgcaagtaaagtcgcccaagttttataagtttt

SEQ ID NO: 6166 - DNA, 775 bp, Sorghum bicolor
  Clone ID: SORBI-28MAY03-CLUS36439_1
cggcaaattgcgcccagtgatccagcagataacctcgtgggagcggccacttgttactggcactatccttgttgtagctttgctaaccatatacaatgaatggttcaattacgtgttagctgcatccctgataatggctgttggggtgatggtttgggcaagacaaagaaagataggcatgatatgctcggaagtgatcatcgtcgatacttcttcagacaagacaacaatggagagcatagtggatgcgctccttcgcccgttcggggtgctccgctccacccggactgcggaccttgccagcctcaggccccgctcgtctgctcgcgcttggccgccgcagcacacagagacgatgatttggatgctgaccggggctgcggtggtggtggccgtgatcccgttcaagtacattctgatcgggctgatggccggcagcttcgccgcgaacacgagggtcgcgagggccctgttgaacccacagggcggccggcggtggagggagtggtgggagtccatacccgccgtccccgttcgtacagttcacagttgacaagagcgagctgaggcgaaaccagtcaaaactcggttctcccgccaagtgtttcttgtgtgttgtactctgtactagtactagtctacaactctgtgcatgcatgctttgcagaactgcagtgaaatggtgtgcactgaccttcaaaaaaaaaaaaaaatggtgtgcactgcagtctgcagtacagagaagaaacttgttagaagatgctgttcaggaaga

SEQ ID NO: 6167 - DNA, 864 bp, Sorghum bicolor
  unsure (1)..(864): unsure at all n locations
  Clone ID: SORBI-28MAY03-CLUS36460_1
ctaaaatcatcagctcaaactatctatgttactgtttgggcatcttccaatgttcccctccatcttggaaagactgaaaatgctgatgaattgcgagagaaacattttggtatcagacttcagcctccaattggcccagagcgagtcaatgaattgggtcactggacagaaagacatattgaggtttctggggcaagctgggacgtcaacagtatggacattgctgtttctggccttggatggtactccttgggccttaaaggcactgccactgtttccttgtggacatttgagggcattggtgtgacagaacgagatgcgatgattctgcatcgagcccagtttctcgaaaggcctggattttggttacctattgccatcgctaatgctctaggtgaggagacaagaaagaagaacgagaagagaaaggctgagcaaagaagaagagaggaagaagagctccttttggaagaaattgtttagtgatgattctgtagcccacaaagtcaggattcccgtttctcctgtcgacatgggcttttgtctgtcccagttcttgatgtcttttgacataggctgcatcctcttattttttttctttgctcatagatatatatctcaatttttctgtctatttgttttnccatgtgttctttgcaaccagttttgttaatgctgcttgtatcttacagattcagttcttgcaacttgaggaagattgatatccttgattgcctattcagttatgtgcaaaaacgagacttttagacatgcagagcagccaatttattatgtactactttttttaactgaaaacaatttattatgtactatttttttgaactgaaaaccaatttattatgt

SEQ ID NO: 6168 - DNA, 597 bp, Sorghum bicolor
  Clone ID: SORBI-28MAY03-CLUS36474_1
gcacgagggcacggcacaggcacaggcgccccttagccgtgcggcggcctggccctcaggtgtggcggctcggccttccagtcctggccggccagcggcaggccgcacgaaggagcagccagccccttccgtcctgcaggcggcatgaaggtctcctgccttctttaggttttggtgtttagtttttgagaggttaaaaaaatctgaactttgagtatgtgtattcgttgagatttgagatgggaaagaagggccgaatccttctcgtgccctctgggtttcatggcatatatttgtgattttgtcttcactgtgttcttcatttttctttattttcgtgcttagctgtgatccagttttcccggagtttgagccaatctcaagcaatgatttttggggaatagttttgtgcctaggtgaattttatctgaccaaaatttgggagcgatttgtgaagatttgagtcgaatttcgttgtttgttttagccgcacctttttctgttcttggagctcggtctcctgttcatccgtccaaccaatcaggctgcaagtcacttgaaccaatgggagctgggctttttacgtgagtacccagg

SEQ ID NO: 6169 - DNA, 660 bp, Sorghum bicolor
  unsure (1)..(660): unsure at all n locations
  Clone ID: SORBI-28MAY03-CLUS35643_1
gcacgaggccgcctccgcctccaccggcaccgcccccgcccctccgtcggcctcgccgcagcggccgtcctgctccactccacctctcctttcgccgattaacatccgacagccatggcgaagcaccacccagacctgatcatgtgccggaagcagcctggcatcgccatcgggcgtctgtgcgagaagtgcgacggcaagtgcgtcatctgtgactcatatgtgcgaccgtgtacactggtccgtgtctgcgacgagtgcaactacgggtccttccaggggaggtgcgtcatctgcggtggcgtgggcatctcggatgcctactactgcaaggagtgcacgcagcaggagaaggaccgggacgggtgccccaagatcgtcaacctcggtagcgccaagaccgacctcttctatgagcgcaagaagtatgggttcaagaagaggtgatgatgtatcacaggatcagtcaggttcgcttggcctcttgttgagtcatgctcatggatactggcagtaggatgttgcggcaacgtttgcgttatgtttattcatggtgatggatgccggcttagaacatgaactgggatggcctctttcgttctcagacgtgaacaagagattggtatatgaattgcagttgagcatccctgatgtgnctgt

SEQ ID NO: 6170 - DNA, 619 bp, Sorghum bicolor
  unsure (1)..(619): unsure at all n locations
  Clone ID: SORBI-28MAY03-CLUS35735_1
gaagttcgcggtgatcgacgtgccgccgatcgggtgctgcccctacccctggagcctgcacccgctgggcgcctgcatcgacgtcctcaacgagctggcgcgcgggttcaacaggggcgtcaaggacgccatgcacggcctcagcttgagcttccaggggctgaggtactccgtcgggagctcccatgccgtggtgcagagcatcatgaagcaccctcaaaggctcgggttcaaggacgtgacgaccgcgtgctgcgggtcgggccggttcaacggcgagtccggctgcacgcccaacgcgacgctgtgcgacaaccggcaccagtacctgttctgggacctgctgcacccgacgcacgccacctccaagatcgccgccgccgccatctacaacggctcgctccacttcgccgcgcccataaacttcaggcagctggtggaagacgaccggtactaggtagcgacgtgtgccgttgctgctgctttactactgtacgtgccatagagttacggccgtgtgtgtctgtatgtgctggtgttcatgatgtatgtttctcgcggtttagatgatgattatggcggcgtagtttggactctgagataacatgtcactnctcgt

SEQ ID NO: 6171 - DNA, 708 bp, Sorghum bicolor
  Clone ID: SORBI-28MAY03-CLUS35831_1
ccaggcaaaggacaagaatgttcctcaatctcaaggaaatcgtggccatggctgacgagataggctatgacgtggtggttgaagaggccaatgtgaactccaatgtcactcattttgccaaggtagttaactccgtcgatgtgatgatgggtgtccatggtgctgggctcacaaattgtgtgttccttccacacgatgccatactgattcagattgtaccttggggtgctctagatgggatatgcagaattgattttggctacccagcagaacaaatgggcttgagatacaagcactacagcataggtgtgcacgagagcagcctcacggagcaataccccctggatcacgagatcttcagaaacccacttgctttccacaagaatggattcgagtttgtcagacaaaccttcatggatacacaaaatgtgaggcttgattgcaaccgtttcagacctatactcttggaggctcttgatcaattgaaccaataatgaccattgatttaattccagggccactgtactagattttttttcttctgcaattttagtttcaccatttttctctttgtaaaatttcatgatcatcgtctctgctggttacatgagcaacaggaaaatcgattatttctccaaaggtaggaaatgtcgtggcatggatttcgatcatgctgttaggacctttcgaatgacgagacacggagca

SEQ ID NO: 6172 - DNA, 636 bp, Sorghum bicolor
  Clone ID: SORBI-28MAY03-CLUS35843_1
tggcgccacacactactccacgccggttgacatttggtccgtgggctgcatatttgctgagttggtcactaaccagccacttttccctggcgattctgagttgcagcagctcctccacatcttcaagttgctgggcaccccaaatgagcagatgtggccaggagtaggcaagctgcccaactggcacgtgtatcctcagtggaagcccactaagctgtgcactcttgtccctggtcttgactccgatggctatgatttgcttgagaaaatgctggcatatgagccggcgaagcggatctctgcgaagaaagccctggagcacccgtacttcaatggtgtgaacaaggaggtgtactgaagcaatcccagtagtaggagtcgtcgaggggatccttgtcaccttgctcatagcttagtgtgttaacatgactgccctgaatcagtgcttctgcttccaggcaggcagtatctctgtgtttaagctgctactttcctttgtgttgtgccatccactttggttgtaatggatagtagggagaattttcagcataagtgaacttatgttgacattgtttcttgcaatttgtagccagaaaccctgggatcatcttccaattgttttataaagcttcactc

SEQ ID NO: 6173 - DNA, 882 bp, Sorghum bicolor
  unsure (1)..(882): unsure at all n locations
  Clone ID: SORBI-28MAY03-CLUS35960_1
gcacgaggcactcacccacggccggaaagccaaagcaccgagctcactcgcggcccgctcgccgcgaggaacgcgtgacctcgccgcgcggttgcggctgcggctgggcgggcggcgcagcaggatctgctagggttcccgccgccgggggcatggcgagcccacggtcggccggcggcgtcgcgggcgacgaggcgatctggaggaagctccgggaggccgcacgcggcgaggacgccgtcaggcgccgggacaaggcggcgctaatcggctacatctcgcgcctcgagtcagagatttatgattaccagcacaatctcggacttattttattggaggggaaggagatgacttccaaatgcgcgcggcttaaagcttcttctgaagccactgagatcatgctcaagcgcgaacgagcttctcatctgtctgctttagctgaaacaagaaagagggaagaaaacctcaaaagaaatctagccattcagaaggagtgcatatcaaatcttgaaaaggcacttcatgatatgcgtggggaaacagctgaagtaaaagtttcatatgaagcaaaacttgctgaagcccttcaaatgatagagagggcacagaaaaagtttgatgaagcagaagagaaacttctcactgcaaaatctttagaagcagagtgcattcgaactcgcagtgcctctctgagaagtctgcaagacattgaagatcgtgaagatcagctaagaagataccgaacttctttagaacttgagaatgcatcgaaagagaaagagattaacctcctgaggaaatcgttggatgataccanaaaagttttgcatgaaaaggaacaatctttactganagaacaactacttcttaatcagagggatg

SEQ ID NO: 6174 - DNA, 755 bp, Sorghum bicolor
  Clone ID: SORBI-28MAY03-CLUS35958_1
gctctctctctctccaggactaggaggactagggtcgcctcgccgccagccaaccaggcgcgcacacgctccttccggtccggtccggccgtccccgcacttcttcattcccggcccactgctcgcacacaaatactactactactactactactactgtgactccgtgagggagcaacaggaggaggaagcagaggagggggaaggcatttgtgttccttgctagtaggaaggagtacaggactgcgccgctccccggctctcctctcctgctgccggccggcttcccggcctcttcgccccttgccatgtccaccatggatgaaggctacggccctacttgggacagcgacgacgaatacgacaacttcatacgcaagatgaacccgccaaggatcgtcatcgataatgagtcctcagcagaggctacaattgtgagggtagatagtgcaaatgaatatgggatactgctggaagtgatccaggtcatgattgatctcaaccttgtcatcagcaaggcgtatataacctcggatggtggatggttcatggatgtattcaatgtgaccgataaggaagggaagaagatcaaagatgaggcaaccctcacacagattgaagattacatcagaaagtccttgggtgcagattcaagatacattccttcccgccggagatcagtagacgtggccgcagcagctgatcacaatgtcatcgagctgacagggacggacaggccaggcctgctctctgaa

SEQ ID NO: 6175 - DNA, 1136 bp, Sorghum bicolor
  Clone ID: SORBI-28MAY03-CLUS36628_1
gcacgaggggattatatgatggttttgatctaactatggctcggaaactcagagcaagaataaaacgtggtgtgagctgctttggtcgttacatgccccgtatgattgcaatacctcctggcatggagtttagtcatatagcaccacatgatgttgatcaggacagtgaggaaggaaatgaagatggctcaggttcaccggatccacctatttgggctgatataatgcggttcttctcaaacccccgtaagcccatgattcttgctcttgctcgtccggacccgaagaagaatatcactactctagtcaaagcatttggtgaacatcgtgaactgagaaatttagcaaatcttacactgatcatgggcaatcgtgatgtcattgatgaaatgtcaagcacaaatgcagctgttttgacttcagtactcaagttaattgataaatacgatctatatggacaagtggcataccccaagcaccacaagcatgttgaagttcctgatatttatcgtttagctgcaagaacaaaaggagtttttatcaattgtgcattcattgaaccatttggactcaccttgattgaggctgctgcttatggtctacccatggttgccacccggcacggggggcctgtggacatacatcgggttcttgataatggaattcttgttgacccccacaatcaaaatgaaataggtgaggcactttataagcttgtgtcagataagcaattgtggacacgatgtcgccagaatggtctgaaaaacatccatcaattttcgtggcctgaacattgcaagaactatttggcacgtgtagtcactctcaagcctagacatccccgctggcaaaagaatgatgttgcaactgaaatatctgaagcagactcacctgaggactctctgagggatatccatgacatatcacttaacttgaagctttccttggacagtgaaaaatcaggcagcaaagaagggaattcaaatactgtgagaaggcatttggaggatgcagtgcaaaagttgtcaggtgttagtgacatcaaaaaggatgggccaggtgagaatggtaagtggccatcattgcgtaggaggaagcacatcattgtaattgctgtagactctgtgcaagatgca

SEQ ID NO: 6176 - DNA, 495 bp, Sorghum bicolor
  Clone ID: SORBI-28MAY03-CLUS36615_1
tctccgaggggctggggctcagcccccgcgccgacgtcgtcgacgaggaggaggccgcgcgcaaggccggccacaccgtcaagtccgcgcgcgagtccgcccagaacaccgcctccgaggtagggaagaaggcgggggacgccaaggaggcggccgccgatgccgcggccggcgcgtcgagcaaggctggccaggccaaggacaaggccaaggagacggtgaagggcgcggccggcgaggcgtccagtaaggcggagtacgccaagcagaagaccaaggaggccgccgaggcggcgagcgagcgcggcgccgaggcgcacgagcggtcgaagcagggcaaggagaaggtcgaggagaaggcccgagagaaagccgggcaggggtacgagagcgccaaggacgcggccggcaaggcgcaggagacgctgcggcagaccacggacgcggcggcggagaaggccgcgaaggccaaggaggccgcgtgggagacgacgg

SEQ ID NO: 6177 - DNA, 602 bp, Sorghum bicolor
  Clone ID: SORBI-28MAY03-CLUS36666_1
gctcttcttcccccccggctgtttgctccacgcgcggccacgcgacgcgacccgcctgagctcctcctcgcgcggcccacgccaccgtcgcccggcgccgccatcaccgcgcctccgacccggcgcctccgtcgtcccgctccgccggccttgcccgcgacgacgcgcgacggggtaaaccggacaacggacacgcgagggcccacgaggacatcaagaagcggggcaaagctatagcacatctatcccgcttccctctcggcctctccccactccactcgccatggcaaaagcccttgtgggcctccgcgtctctgcccccgccgtcccgcagcctaggagccaccgcagccggcttctccccactgcacgcctcgccgcattccggcgcggccgtcagtgcaccgcccgcgcggccgtcgcaggtccaccggaggtggacgaggacgactccatgaccatcgacaacttgcatcgcttcttcgacctcaacgtcgggaagtgggatggctcgttctaccaattcgacgcgcggaggacaacctcatcagcctcctgcaatcgttgtacattaagcaagcatcctctgcaatatcaattgt

SEQ ID NO: 6178 - DNA, 798 bp, Sorghum bicolor
  Clone ID: SORBI-28MAY03-CLUS36705_1
cttctcttctccactagtagggctctagggggcaaaggcgtcagcttcccactccagtccttccggttttctagggtttaaagagcccgccgtgcgccggcccagccagagcccactactttccgccgtcgccggagccgacccctccgtctccgcgcgcggcaatggcattctccttcgcctcgccgccggcttcgaaccccttccagacgccggccgcgtcgaatctcttccagacgccagctgcgtccaaccccttccaggcgccggcggcgccgaatccgtttcagacaccggctccggccacctcgcaggcgccgtccctatcgccctcgccgttccagttcagcttccagcagcagcagccacagccgcagccgcagcagcaggtggcgccggcggcgcaacctcagcagccgcagccacagcagcagaagctgatgctgtacacgacggatatgaaacccgcggggtacaacaccaagtgggaggagctgcacgccgagtcgcagaaggctttgctccagatcgaggacaagatacgggactacagagacgagagtgagaggttggatcagtgcagtcgcctttatgactcctcaatctcgaatgtcaattttgagattgatgcgaatcgcattgctcaggaacttggagggaccaccactgtaatggagagagagaaggcttccattcaagagttgatgactgttgtcaatgaaatgatgtggaacacagaatttgctattaggtcatatctgatgttgaggccaagattcacccgtccaggtgctggag

SEQ ID NO: 6179 - DNA, 631 bp, Sorghum bicolor
  Clone ID: SORBI-28MAY03-CLUS36650_1
gcacgaggcgccttcctcttccagcccccgccgtccatcgtcctcctctgcgcccgtacgctcgcctcaaaaccccccgggcgccgtgctaaaaccctagccctcgaattcccccttgcccgcgcggagtagacgagcccgagcccgagcccgctctcctcgtccatggcgtcgtcaggggccgccgctaacctctgggtactgcttggcctcggcatcgcgggcgtcttcctggcggcgcggcgactgaggcgccctgcgcgccccgaccacggcgccttcatcgcccgcctcgagctcctcccgccgccccagcctccgccaccgcaggcgccccacccgctcaccggactctgcttcgccatcgctgacgcattgcatgtcagtggttatattacaagtttcggcaggcttgaatgggcaaagacacacgatgcagaagtgcaaacatctccagtggtttcagctcttgtcgatagtggtgctatttgtgttgggaaaactgttatcgatgagatggcatacagtatccatggtgagaataaatattttgatacaccaacaaatcctgccactccggatcgagtaccaggaggatgttcaagcggatcagctgttgcagttgctggtg

SEQ ID NO: 6180 - DNA, 684 bp, Sorghum bicolor
  Clone ID: SORBI-28MAY03-CLUS36152_1
ttgctattttactattctggagtacatttcgaagatttcagcaaaaaggctgccctgtgtttgatgcttgtcccaattgcttttacattgctcttggcattgaactctaactatgagtttctattcgatagtcaaatgccgtacaaaccggcaaagagcctgccaaggaggtccccaaggaaacatttttcacctgcccaatatgttggaataagatggaggagccttccacaacgacttgtggccatgtcttctgcgacacatgcatcaagcaggccatcaagattcagaagaaatgccctacttgcaggaaggggctgaaaatgaatagtgctcatcgcatttaccttccgaaagcttctagttaaggttgattggccttatcaaagaaacttctggtaacataaggctgtgcaatatacagttaggatcagaagttcttagggtgaacagtggatagatgtttcatcctagtctgtatcatttaactgcatcaccaggagctcatcatgaaaacttcccgactagggaagtggatatcagcctcagttttactcccctcttagtgcatccatggttccagaatgttattgtgttgttgtatgtattaggtttttgccctagtggattagtgtaactgggatttgcttcattctaaaatgataatagcgagtggaaatattt

SEQ ID NO: 6181 - DNA, 986 bp, Sorghum bicolor
  Clone ID: SORBI-28MAY03-CLUS36194_1
cgccgccagcgtccgaccccggctcgggcgccggccaccgtgccgcggcgcaggcggtgccgtcccccgcgcccggccgcacgccgccgcaccgcgggccgtctcccgcctccgccccgtggcctctccgctgccgcccgaggttcgctccagggctgtgctcccattccgaacctgatgagggtgccgttgtccacgcctctcaaggtacctgtgcgggtgcgcgggctcctgcgtgggcgcaccggtcggaggccttcgggggtgccgctcctgccgctttcaggctcctctgactatgcaggtgcttcagctcctgggctgtgggttggtcctggtacctttccgaccaggctatctcgcgcgcgccgagccgaggtcccgtccacggagtcctcgaagatttttataccgcaatacctttggccgtttcaagactgagaaggatttactgaatgatgctgagcaaagtatgatggagtacaaaacatctattcagaacttgaagaaagaatcgaaatacactcttgacaaagtagctgttggtgaaagtgatctgcagcgtggacgaacccgtttgggatcctctccgttgctgtgccagcctcttctagggcccggtcacacagcggaacccaccgctgccggtctgtgggcctgtctaagaaccattccaaccaggcaatctctcgagctgcgagcagaggtggcttccatggcttccgatttgaagaaccagagatgtgccttgcaggaaaggatcaacaaaatttctgaatatggtgtccgtgtctgaactgcaccgtctgtacatttcccctgatagagcctcttttggtccttccgtacaataaattttgaatccaccctgagagatgcgcattttgatacgaccaaagttccgttttggattctaactttttttttgtcagcattttcaaatgctaggacaaacattgtaactcatcacaaccataaattgttac

SEQ ID NO: 6182 - DNA, 770 bp, Sorghum bicolor
  Clone ID: SORBI-28MAY03-CLUS36250_1
taaaaaaaagagaggtgcgaattatatatttttaaaaaataaacacacatatgtatatctttgttataagtacgtctgaagaatcgagttagaggtaaatttatcaatccgaatgtttgctaattagcagcgccgggtagcagggggaggttagttcaagaccatgacgtgttgaatcagattgacataatccttagtatgcagactggggtggcttaaaattcaaccaaacaaaattttgggaaacaatacaacaaacttgaaaaattgatagactcattagactgaacacattcgtatattagactcatatgaactagtgtgttgtaagaacctacatacagtacaggatggtgattcagttgcaaatttgaaggccatcagaatagaacttcgctctactttcttcatgaatgctataattgtcatgctttggactatttggaaaatcagaaatgagcttatcttcaacaattctcagattgggattcatggtgcaaatgttctgttttttcaagaactgagactgactagagtgaaagggaacctcactgaacgttttgagcaatggattcaaagtctacaatagattgctgtcttagtctactttttttccttttttttgtctcttagctccctcttttagtttgtggttgattttctgattgtatgctgatgtactcggttttttctctttaataaagctctgtaggggctaaggccccttcagtttcgtaaaaaaaagccgtgcgtacaaaatttgattaaaa

SEQ ID NO: 6183 - DNA, 621 bp, Sorghum bicolor
  Clone ID: SORBI-28MAY03-CLUS36212_1
tctaaattgatttagcacctgagcaagttgtcaatgacatgttagtttcaggattctgcctaggttagtggaggacttggcggacggtagcattgactaaaatttgcccaattttgcctaggttatgggcagatagaagggtttgtttgctgttggaattctgtacagatcctatctcctacagtgcatcaaacaaaaaaaagggcactggaatcttcagctcgtaatggctgaatggaggaaaagaagtaatctagagcgtaggcgtccgtattcaacaacgaaggtgacgatgtaaagggttaatgaagatgggagatgcagaggcgtcagtccgtgtgtatgataaggcgaacttccttggcccatttttttcagataatggcttggttaactttgagaagaaagattcctatgtacagctttcactgtccctaatctcttcaaaatgttaccaacttatgtaacatacatggcttcaaacatatatgtacgtggcttctgttatcagcatgtaaacgcatcagaggctatgcgtgtgtaatagacgcatcctgtacatgtatatctctaggatcattatcttgttacggacaacttgcagtatttactgactcacgc

SEQ ID NO: 6184 - DNA, 648 bp, Sorghum bicolor
  Clone ID: SORBI-28MAY03-CLUS36255_1
acaaccgcaggaacgacggcggtggtgagaactacaaccgcaggagcgacggcggcggcgagaactacaaccgcaggaatgatggcggcggcgagaacttcaaccgcagcaacgacggtggcggcgagaacttcaaccgcaggaatgatggtggcgagatcttcaaccgcaggaatgacggtggcgagaacttcaaccgcaggaacaacttcagaaatcagaatgagtttcctggacgtggacgggggccacctccaccagggaacagttaccatcagaacgggaatggtgtccacccatctcgaccctacccgaatgggaatgggaggttcagtcgcgtgaacaatggccctaagcaagctcctgttgctgcgtagaggcatcaggcggggtagacttacatcaaagtaggaagcgtaaggctacattcaaatgagcggagtgcagggattatttgtagtaggagcattgctgatcagacagcttgattatttttttttgtaccgtgttggtgttggtctcgctatgagattggtagttgcagtcgtccattggtggtaggtgaattttgttgccgttgatgagcttgtcaactggctgttgggactgtggtccgtaacttgtgtcatctgccaggaggctagacat

SEQ ID NO: 6185 - DNA, 649 bp, Sorghum bicolor
  Clone ID: SORBI-28MAY03-CLUS36348_1
gttagattgtgctgctgctagagcagaattgactgctgcaactgaaacagatgataatgaagaagttgagatcctacgtaaagaagctgaagctgcagagtctaaagcaattgaactcaaaacatgctatgatctccaggtggaggatgatgagttcatgtttcagcctgtagtccctatagcattcataacaaattcaacagggcagcacttgtcagaaattgcttcttcattcggcctatctcctcagaagtgaaattggacagtggatttgcacactacgaggtctgcctgttgcactgtgatccaagtcctacctgttcctgcacatattgaagggaagatctgtgctagtgtgaaactctctccttccaggataccctcctcaacggcccttctttaactccagcatttggaatctactccgaactagagtagggatcctagggaagatcaactgtacaacatacattttgcatgctccgtaggaatttagtttccctatgcattttttgtgtacattaagactgtaattcttttgatacgccagttttgattgaattgcaatgacatgccatcatcaaccagtatgtaatcagatttttgtttcaagaaaaaaagatgtaatcagaacaaaatgtccaggaag

SEQ ID NO: 6186 - DNA, 671 bp, Sorghum bicolor
  Clone ID: SORBI-28MAY03-CLUS36854_1
catcaccacgtccaccatcgccatcatcaccgctatgatcatagtcatcagagtttgcagcatttgtcccctgccccagctcctctgcacagcactacttttcccagttgtggtacctgtaaacgcaagaaagaacatagcactcctaagcaccattcatctcccttcaggggtcctcgccctgttgtgcccacagcttctccaaatagttatgaagcatcaggcccatatgtacatccgccatcatttcatccaaggattccatcctctgcacttcctaatgttgtttttcatgcaatgccacccggtatgagaaaccccaagcctcccaacaagttttcatcgatatcacctggagcatctatctcgtttgcctccaggttatcttcccattggtgggtggtcattgcatcgtttctgtactggcccatgttgaagtgatggcatatttctcacccaggtgaagttcttgcgtcagcttggatcaccatttttcaaatgatcttcagcataaaaaatgttagatggtcgtctttggtgatgcattaatggatgtaaatatatgtataatgcagcagagggggtgtttgtggtcaaagccgtaatgtggcgggcccttgtgtccttcatcccttatgttgctttgtacaatcatacgcaaatcaattaag

SEQ ID NO: 6187 - DNA, 750 bp, Sorghum bicolor
  Clone ID: SORBI-28MAY03-CLUS36876_1
gcacgaggtctacttcctcagcaagtccggggacgtggtgtccaccaacatgcagcgcagcgcgtccaagcagtactcgtcggtggtcgtgccctcgtccgctcccggcgacggtgacgcggtcgcctacttcctcagctactcgggcaccgtcgtggcctgcgacacggcgcgccgcacgttcgcggagctgccccgcatcctccccgtctacttcgagtactccatcgacgtcgtggcgtgcggcgccgcggcctacgccgtggtgctctccgagtacctggacacggccagcctgcgggtctgggagttcgcccgggggcgcgtggcggcaggtggccgccatgccgcccgccatgtcgcacggcttccacggcacgcgggccgacatcaactgcgtcggccacggcgaccgcctcatggtctgcgtcacctccgccgaggccagcggctgcttcatgtgcgacgtggccagcaaccagtgggaggagctgcccaagcacgtcaatggcgacggcgaggccaacgagttcttggccgccttctccttcgagcccagagtggagatcaccgtctaagcgtttttattgatcacagtgtgtcacaattgctttgttgattaaggagcctttgttttggttttgctcctaccccgtgtgattgattttctttgtgtgtgtgcatgtacttacgttactaaattgcaatgtcacttttcattgacattgtttttctcagatcgaattacag

SEQ ID NO: 6188 - DNA, 591 bp, Sorghum bicolor
  Clone ID: SORBI-28MAY03-CLUS36908_1
taagtgctgttgaggttcttgctaaagcaaatgcagatttgaatgctaaggacaatgaagggcaaacagcactccactatgctgccgtttgtgaaagagaagacattgcagaattgctcgtcaagcatcatgctgatcttcagatcaaggatgaggatgggaacccagcacaggacttgtgcccttcgagctggtcttttatgaaccaggcaaactgacaacccgaatatacagatatgctaagtgtcatctgccaagaaacatgctaccttacattagctgtatcctaagcccataccgcacttggtcatgtgctctttcgttatggggacatatggtgtatctagtgtcctgtttgaagtgtgggaacttagacaagttgtttgccgcgacatctgctgtacgtggtgccctctgtgaaggttgggaaatcagatgagttgttttttatcgacctcatcgaaccagttgtcaaaagtcaagtccttgcagtattagtgctgggagatacatgtaatgctttactaagaagaattgtggtgaacaccaatggtctgttactgttagtgaaagtaactccaatcgtacagg

SEQ ID NO: 6189 - DNA, 604 bp, Sorghum bicolor
  Clone ID: SORBI-28MAY03-CLUS36887_1
cagcgcgtactacatccgcattcgtgcctctggtgagcagtcacatttaatttcattgcccttctacgatttggatatgtttgtgtttcattttcttacgaattatagtttgtttggttgatgtttggtttcaatctcttcgatcaaaggtttatgtgtattttcgattattggactcccattagtgacttctcatttttgtcatcttaatactgatttggttcaggtgttcctgttgtaaacgagtagaattctgcttttctcaagggccaaagttttatcatgacgactgcatgcatccaagatggtgtgcctagggatcgagttatttacagtggtggcagagacggagattgagagtgggtatgtgcactaccacatcgagcagtggcaaacaggaaacatctgctgagggaatcacaagggttgtaggtggaatgaagtacacaaaatgctgacatctctatttatgggcacatcgatggcgtaaacatgaacagaccaaaaatagaagcaacaatgttcatgcttgaaagccaaagtaaagatgttggttcaacagatagttgtgggtaacttataatgtttagttttaaatctagga

SEQ ID NO: 6190 - DNA, 552 bp, Sorghum bicolor
  Clone ID: SORBI-28MAY03-CLUS40694_1
cgttgttgcaaggatccaggtgctgctgagtgaccgccaccactctgtgccactgccacagggtgacttgggtagcctgatgcagcaggtggaacagcaagtcaagaatgtggccatgctctcggagaagctgaacaggaaaccgttgccgtatcgtcagggcgatcagctccacaggctgcataccgctgcctcgctctcgttcctcgtcgcacgcttgttcatcgatgatcgcctggagcagcagacgctgctgcagatggacgacaccgggcagcggctggtgcgggaggggatgtacctggagcgcaggagcaagtacctggcggccatagcagcgatcaaggacgcctttcagcacttgtcctgcaacgagatgtagattaccgacctgtatatgtacattttgaaggtgtagaactactgcagtactgctagataagaagagcaataagcagtcaggctatgtcatggtgatagagggttccttttggtattgcttcagctgtcaacttctgttgctgctgtgtgtgtctgtataataatagtgtg

SEQ ID NO: 6191 - DNA, 739 bp, Sorghum bicolor
  Clone ID: SORBI-28MAY03-CLUS40746_1
atatcgacaatatgtcatatgaggaactacttgctttagaagatcatattggctcagtgagtactgcccttactgaagagcaatttgccaagtgtgtaaaccaaagtgtgtatgaagcaagaaattctggtagagatgtgaacaagattgcagcagatgatgtgaaatgtagcatatgtcaggaggaatacattgaaggtgaagagattggtacaatgcaatgtgaacatcagtaccatgtgtgctgtattcacgaatggcttagacagaagaactggtgtccaatatgcaaagcttcagctataccttcagagatgaacaagggagacgcatgaatcttggctcagacttgtaaatagcatggatttatgattagaatgatgctgacgcagttcacctcaatctgtggatatgatagaccctctatctctccctggaaccccagcaatcttttgttactgcatctttcatcttcttagcacacccttgtgaaatatgagccctgcttgacagtagtatggtcagaaactcgaaaataatggggttctccttgagaaatctctccggataataaataggaaatggttctcctttgattgagatgttgagttacataatttatccaagtatgttggcataaaaaacattcctgctttactggagaagtgtgttggcttaaaaacattcctgctttactggagaaattctcatggattgtacaggtgctgtaacttgcgat

SEQ ID NO: 6192 - DNA, 841 bp, Sorghum bicolor
  Clone ID: SORBI-28MAY03-CLUS4076_1
ttacgtccgcagtttttttatgttgactgcacacatttgagaatcatgagtaaagaataatggaaatacagtactcaggcaatttttgaatgcccatacaacccaaaggtatcagatggatttgaagtagaatatgttttttaaagtttccattttaattgccttcttcatcatgtgcagctgtgtccattgtatccacaacccagaagtgttactgaatgaactcaaatcgccgtctgatttgctcgattttggcgagttctcagattgcatgaatttcagtactcctcatggcagccccttgcttgatgttgtcaacccaacatttgactatgtgccaccgaagcttgtgagcctattcatcactgacactgggggccacagtccatcttatatgtatcggctaattgctgagtattactcagctgatgatctggtagtgagacggaaggcaacatcttgaaagaagacaaaaagcactgcagagtccccttggtgctctgattggcgattgtgctatcttggccttggctgagcgttcttttgtccattatcatttccagcctgctgagtgatttcgctcacttctgtggatttgcccgtttgtgggtccaattactgtcaaactgcaggaaatcaatgcaagcattctcgcgcatttgttgtaaccattgcggcattttgagtgtaaactgttgaggaaatggggcgtgacgtcatggaaaggattgttttactataggagtggttcaaatatatggttgactggttgtgtagagggtggctgtttattatctggccataggttaatctgtgccttggctggtcgaaattttgtctg

SEQ ID NO: 6193 - DNA, 734 bp, Sorghum bicolor
  Clone ID: SORBI-28MAY03-CLUS40788_1
gcacgagggtttatagctttggtgtcatcctgtgggaacttgctacgctaagaacaccctggcagggaatgaaccccatgcaagttgtgggtgcagttggcttccagggtcgacggcttgatattcccaaagaagttgatcctttggtggcaaagatcatttgggactgctggcagaaggatccaaatttgcgcccttcttttggccagttaacaagctacctcaagccattgcaaaggctagtagttccttctcatcaggagatgccgagcccgcctgccccacaataaatatgggtgaattacaccccttgaggttatcatacagtgaatgagaacaaaggaatatagttttgtcaccatatactagggttcactagtctgcaaaggcatgacttgattgagaaccccaagtatgtacagtagtataggcccatcagataatagccaaagaagagaaaaatggtctgtgtggatgagggtgtttcactggaaggtttctggatctggttcaaattcgaatgagatacaaaaccttccaatgaaagacccccaatccaaacatgcactaagtcggcaattgtatgtcacttcaatgcttatatccctatctttcttttcttttttgccccactgaatgcaagcatgctagaaggcagcatgctcattctgtttggattatggcattagaaaaagcaaatgtacaactcagctttagtcaatcaaatttcactt

SEQ ID NO: 6194 - DNA, 1084 bp, Sorghum bicolor
  Clone ID: SORBI-28MAY03-CLUS4083_1
gcgcgtccgcggtaccatgcaagcaaccggctaatcaaaaagagtttactggaaagaagtctgttgatgaggttcaggaaagattcagaacctgcaaatgtgaccaaggaatcaccagtgaaagctgagaaaccaaacattgctcttgtggatgtagtggtcaaggattctccaggtcaaaactagtttatgtgctaccttttatataaagtaaactgaaaattgtctctgggttgaaagagacttcaactcttcaactaatttggcctgatctccttaccttgattggttcctacaggggaaaggcaacagcttaatgatcaagtaacagatgtgattagggaatcttctggtaagatctagaattctatgcttgaagtataactcgcataatgcatgtagtctaagtgctctttctcctggcaggtcaaactcagaatgttgatgtgacaatgtctgatgagatcaagatagcatcaggcgccagagatcagccaaattctgcaaatagtgaacagcagagttctaaggaagcatcagacaacacaggacaatctgagcagctgaagacagagaccgatgtcaattaaggagtcgatgcctcaaagtcaaatgcctcagatgacattcagcctgcgcatgatgaacaagaaatgaaggttggcggtaaatgaaagtagagatcaagattcaatgaacacaacacagatcctgatgtttagtgaaagtttgctgcctgtaatgtttctgtcaggcttattgggatgtatagctcgagtttttgtgaatggaccaatgctttaggtgcagactcctacctttacattttagttttattcccctgcaagtataggtgagagattaagtagagatacagaaaccccaaaaatatcacctaggacatcagttatagcaccagatagaattgtaaaccagaaaaaaaaaggggagaaagaaacattatttgatgtactttcatttttaggaagatgacatgacttaaagttattttgaactcctggtcttgtaatatggctttttgacatttgataagctctgattcacaggcataggaaattgattt

SEQ ID NO: 6195 - DNA, 629 bp, Sorghum bicolor
  Clone ID: SORBI-28MAY03-CLUS40836_1
aaaattctctgaaaaattcgacagcttctaccgtgacaacgaccatgtcaatgacattgcgaagtgcaataagggtgcacggtgaagagagcctagacaccaatggcttccatcagaatggtctgagcaacgcacgagggtcaaagcgagctaggaagaccaagagatggctctgctgcttaacccctaccactgttggatgattgggacccatcataagagttcattcaagcgaaattgctgatttttgagtgtacaatagcagatagtaaaaaatatagaaatttaatgcttcaacggttacccaatgtgggttcagattacaattcaggaggttcttcatcggttacggttcagatgacaagtcaggaggcaggttcttgctgtcgtagctcgtagataataaatatcttgataaatgtaaagttgtattgttgtaaaacaatatgtaataattcttttcacgagggccctgatttgggttccaggtttgtaagtacagaaacacgcacagggtaagattagttccttccagttagagaaggaattgcagtggcattcagtgaactctcagatctgcaattctgcatcatacttttcccgcccaaaaaaaaaaaaaaaaaaaaaaa

SEQ ID NO: 6196 - DNA, 641 bp, Sorghum bicolor
  Clone ID: SORBI-28MAY03-CLUS37013_1
acggcgactccgactcctccgcggttcagctcaccatcccctcgaggccgcccgcacgacgtcgccggcgaccgaagcggcggccgtagcctcgcgcctccggcgtcggcgagcgcgcccgtccggcggccgagatggcgctgcggcacctcgtcacgggccagaacaactgcaccccggacggcgcctcgtcctccaaccccctcaacgccctcgccaacgccttcctcggccagtcctccaaggcgcagtcaataaaggaacttcctggttctgttagtgttccatctacatcagactttagcacgcctgctcccatatcaaacatccctggtgcagaaaatgagttcaaacaagaccagcgacctcttgcacggggcgctgactttattcgtggtggtcctgctaatgattggatcgagtcttttcggcctccgggggttcctcaacttggagtagaagcacaattccgagattttgagcaaatttataacaatacagggacaacctttcaaccgccattggatggtccaccacaaagagtgttgtctggtgtcttgcattcctttctcacaactggcccagctggtgtgccatttcaacctcttcctgtaccaactgctcttggtttatctgaaagt

SEQ ID NO: 6197 - DNA, 559 bp, Sorghum bicolor
  unsure (1)..(559): unsure at all n locations
  Clone ID: SORBI-28MAY03-CLUS3707_1
gagccagtacacggagatggtggccgccgccgccgcgggcaccaacaacaacccgtcgtcgacgtcggagggtgggtccgtgtcgccgtcgcggaagcgcaagagcgagagcatggacaccgcgccggcgccgcctgccgccgcgcagcagcagcagcagcacggcacgcacctgcaccagcagcagcacccgggcctcgccgcaccggaccagaacgagtgcacctccggcgagccgtgcaagcgcatccgggaggagtgcaagcccaaggtgtcgaagctgtacgtgcacgccgaccccgccgacctcagcctggtggtcaaggacggctaccagtggcgcaagtacgggcagaaggtgaccaaggacaacccgtgcccgagggcatacttccgctgctccttcgccccggcatgccccgtcaagaagaaggtgcagcggagcgccgacgacaccttcatcctcgtcgccacgtacgagggcgagcacaaccacggncagnccccaccggcggcgccgtcgcaggctgcccacgacggttcggnggncccgggcgcc

SEQ ID NO: 6198 - DNA, 664 bp, Sorghum bicolor
  Clone ID: SORBI-28MAY03-CLUS37066_1
gcacgaggtgcccctcgacgactgggcggccgccggcactccctacaccaccttcgggaccttcgccggcgacgagcacccaccaggtaccgcccaccggctccttgcagcgcagcgccgacgctccatctttctcgcagcgccgctcaggctcggcccctgcgcagatcttcaactcctccccccactcgcgctcaggctcggtcccagggatcggagcgccgccccccccccccctcggcggcgtccagcgacggaggggcagtcccaggctcggcggctgcgtcggcgtcggcggctccccctcccgcctctcgccagtcgcctcgcgccctcgcctccgtcctccgcgcaccggccggcgaccctgcgtcatcgttgagaaggccgagaggagcgacatcggaaatttgcaagaatcctgatgacgacaaacggcgtgggtggtggcgggaagcttcccaggaagcgcttctaccgcgcccgggcgcacagcaacccactcagcgactcgcacttcccggtcccaatatcgcccaaagaggtcgacctctcacagcactacccacggtacttccccgccgacaagggcagtgacggcgaggaggctgcagcaccacaacagatccgctttgcagatgtggggtgtggattcggtgggttg

SEQ ID NO: 6199 - DNA, 592 bp, Sorghum bicolor
  Clone ID: SORBI-28MAY03-CLUS37031_1
gctctactaccttgatagaggaattaatctcacggcaagcatcagctgctgacttcacttttgattgtccaacatatgcttctttatgaattatctgtcgatgaaggttattcagttcaacatcatcaccatccacaatgcccaagcaaccgacaccgcaagctgctagatacaacgccacgggagagcccaaacctccagccccaaccactaaaatcgacgactgtgacagcttccgctggccttcgaccccgaagtccgggagaagcaggtggcggctgtaccggtagaccatatccgccgggaggccaccgtccggcgcaaacccgttgctcacgcggctctggcacgcgacactcccgccgcacgcaccatcctctactcctatccccgccgccgcaccgctgactcccgcaggcgtcgcctcgagctgcgattccagcagccgtatccggccgtcgaggtcctcccgctccgcccgaagcttcttcagctcccgctctatcgcctccctcctgccaccgccgccgccgccgccgcccatccctcgcccactgctgccgtgtcgcctcaaccgccgaaatccagtagg

SEQ ID NO: 6200 - DNA, 1185 bp, Sorghum bicolor
  Clone ID: SORBI-28MAY03-CLUS36710_1
agtggccctgctgcttccctcgtcgtcgtccctctcgagagagtcgagagcagcaccggcacacttcggacagggtaagcgtggcatcacgaatctgctccaattccctctcctgctctgagatctctcgccttttcttcctgggatttgagctctttctcgcgctttcccttcgcttcgcttttatcgggatggaaacctacgcatcctgaactcctttctttagtgatgacagtagcagcgcttttgccggacctccggtggtttctcgtggtatttcagcagctgcgtggttgcgttgagtcgagtaggaggaatcaccccccatcaccagtgtgttcaagaagcttgtggaggtggtgagcagttccggttagtctgtctcggctcactgtagtgaggatctgccgacagtttcgcttcacctacttctccgatttcgactatgcagctgccactcccaccggcgctgaattcccccgagcgtggcccgcctgcttccctcgtcgtcgtcccgcccgcgtctgtcgtgtgccgcccccgctcccgtcggcccggagttgaaggcttgggggagtaaaggtgtggtcttgccatggagcagccgcagccgcagcagcagaagggaggagcggcgtctgcgcaggcggcggccgcgaacgggaccgggggcgccgagctgatcggctacgtcgacgtgcacgtgcggagcgcgcgggacattcagaacatctgcatctaccacaagcaggacgtgtacgcgcggctctcgctgccgggggacggcgcgccggcggcgtccacgcaggtggtcaacggagggggccgcaacccggtgttcgaccagtcgctgcgcctgggcgtgcgcgcgggggacgtcgacgccgcgctccgctgcgaggtgtggatgctcagccgcgtcaagaactacctgcaggaccagctactggggttcgcgctcgtgccgctcccggaggtcgtcgccgccgacggcggcacgctcgcccgcgagttcccgctcaccaccagcgacctcttccagaccccctcggggttcctacagctcgagctctcctacatcggggtcgtgccagaggtcgtgcccatctcgcccacgcccaagccggcgctggccgacgacctggaggaggaggagccggagaacaacgccgctgacggcgtcgg

SEQ ID NO: 6201 - DNA, 1050 bp, Sorghum bicolor
  Clone ID: SORBI-28MAY03-CLUS36730_1
agcaaggcggcactgcccaaaccacctctttggccgtatcgcacagcgctcacccatacacgcacgcacacggtctccactgccactccactcccaccgccgctgctacatcagcagcaagcggccggtggtgtagcgccgggcaatccaacacacctatggcccagatgatctccaccatgcctatgctggacgccgccccggccgcgtccgccattatggcgcccaaactgcaggccgccgccgccgcctgcctggacgcgccgccctcgggcatcaccgtcgtgtcgaggcagcacgttcgcccggacgccgcgtccgcgatcggcgacctcacgctgtccgtctccgacctgcccatgctgtcgtgccactacatccagaaggggctcttcttcccggcgcccgacctgcccatgccctcgctcgtgtcgctgctcctgtcgtcgctgtcccgagcgctcgccgtcgtcccggccctcgccggccgcctcgtcacgctgcccgacgaccgcatcgtcatccgctgcaacgacgcgggcgtggactccctccacgccgtcgcgcccggcctgtcgcttgacgactttctcgtccctgacgccgacgtgcccaccaagttgacaaaggacttgttccccatggaccggaccgtgagctacgaaggccaccgtcgcccgctcacgtcgttccaggtcaccgtgctcggtgacggcgccgtctttatcggcatcgtcgccaaccacgccgtcgtggacggcacctccttttggcaattcttcaacacctgggcggccatctgccgcggcgagtcacccaagatgccggacttccgccgaaacttctttggcgagtccaccgccgtcctccgcttccccggcggcgtcggcccgtcggtgaccttcgacgtggacgcgcctctccgtgagcgcgtctttcacttcagcgccgacgcgattcgcgagctgaaaacaatcgccaaccgtcgtccgagcggtggccaagacgccgaggtttacggcaagatggcgcatgaccccaagaatcccc

SEQ ID NO: 6202 - DNA, 789 bp, Sorghum bicolor
  Clone ID: SORBI-28MAY03-CLUS36739_1
ggcccgccgcaatcctccgcgaccagagctagcctaccgtccagccgcacgcgtcctagctagtagataggaagaaggaagctagcttaaggtagctagcgcgcgtgtgtgtcgccgtgccatctcgccgatggaggaggaggaccaggcgagggcggcgccgctgctgcagcagccgctcccgctcggcgatttcgtcgacgacgaagtgggcggcggcgcggccaccaccaccaaggcggcggggcgggcggcggtggagtggtgggtggagtcgaagaagctctggcacatcgtcggcccggccatcttccagcggatcgcgctctacggggtgaacgtcgtctcgcaggccttcatcggccacctcggcgacctcgagctcgccgccttctccatcgccgccaccgtcgtcgccggcttcaacttcggcttcctgctgggcatggcgagcgcgctggagacgctgtgcgggcaggcgtttggcgcgaagaagcaccacatgctgggcgtgtacctgcagcggtcgtggatcgtgctgctcatcttcgcggcggcgctgacgccgacgtacatcttcatggaggacctgctgctgctgatcgggcagaccccggagctgtcgcggctggcggggcagatgagcgtgtggctgctcccacagcacttcgccatggcgatgctgctcccgctcacgcgcttcctgcagagccagctcaagaactgggtcaccgccatcacggccgccgtcgcgctcgccatccacgtcgtcgtcacctacgtgctcgt

SEQ ID NO: 6203 - DNA, 580 bp, Sorghum bicolor
  unsure (1)..(580): unsure at all n locations
  Clone ID: SORBI-28MAY03-CLUS36817_1
atacagggtgaaaacactttacagaagcttgtagcccgaggccagtctttgtctggcttgcagtgtgccaaatgtgtcatgagtcatgtgagccttggactatcagatttatgcgcttgccgctatccatgcggaggacatcatttttcacactgcaagctagtttttgtatggcttaagtttacaagctctgtaaagtgttttcacctgtattgaagagtttgtagcagatatacaagggtggaggcaagagatctcaactcagatcttgctcatagggggagatcaatcctcccccatcatggagactgcaggggcaattgggtttgccgtttttgagagcagtgtgtcttggatgattggtgcagtgagtggatgtagaccccaaatgagggtttcgtgtatcataagaatgtatggtgagtaattgattggattagcatgataggatctaggcctgatcgttatgccattgtattctttcagcaaacttgtgtatcctgacaacacgaaagtgtgtacgacaatatccatcacaccacgaattttgttatgtagccaaaaaaaaaaaaaaaaanct

SEQ ID NO: 6204 - DNA, 589 bp, Sorghum bicolor
  Clone ID: SORBI-28MAY03-CLUS36747_1
ctgtactctaccagttctcgtcgtgggtctctcgcccatccggccatcccccctccctgcgcgccatggagacccaggagatcgccgcggcagcgcgccacttctccgccatggctcgaatcgtcggtccggaccccaaggccgtgaagatgcgccgccacgccttccacctccaccattcggggtccaccacgctctcggcgtcggctctgctcttgccgcggggcgccctggctgagccgccgccacttctcgaccatatctgcgcggtccacgggcacgtggcaggagacgtcgcgctcacggctgcttccctcgtcgagccgttcctggtcgcggagcagcggaataactccggcgaggtaggagcttcagccgaggttggttccggaggtgcgtcttgatgtacttgttgagcaagggagcgctcaagatgggaagtctggacctccacggtggcttccagctcgattgcttgccatggttgatgttccaacagctgctgattctgctttatccttactgagacatgaagagttcatcagaagaccaacatgggatgtaggctggtcattggctgatgctaatc

SEQ ID NO: 6205 - DNA, 548 bp, Sorghum bicolor
  Clone ID: SORBI-28MAY03-CLUS36824_1
cgaaagccgtcccacctgtaaggagggactctgcacagctcaccaaggatgaacaaccctctgttctcttagttagcatcattgatcactatggcggcagcattgccactgttcaagaaaaaatgagccgaggcggtggtggcagcaacatgagcaaacaggcaaggaacttcactcaggaaacaacaactcgtgactgtgaggtagagatgcataatgtgctgcaagctgtggccacggagcttcactccctttcttggttgacagtaagcccggtgtacacagaaaggcggactgccctgcccttccactgtgacatggtcctaaggatgcggcggcttctacactacgctgataagtatctatctcaaccagcagagaagggagagacaacttagaggggtgactaattgtcatgtagctgttaaacaggaaaattagggctggtatggtgctcaaattcagaggtctctgtgtatgtatctagctaggtaggtaggtaggtgagggcacattgacgagctttgtagcctgattttgcagtgaaa

SEQ ID NO: 6206 - DNA, 714 bp, Sorghum bicolor
  Clone ID: SORBI-28MAY03-CLUS37309_1
ttgcccgtgtcgggtctggctccgcgatgatcatgtttccgcctggcctgcctatactggggcgagccaggtctcccaatttttggcattccccctgcctggtcactattcgggtggacctggccagctggctttcggcgctcacgagtcttgtgcgcatgccgggtggccccctccacctcgccttcaatcctcgtgtcgtgtggggggttcctgcctggccccccccaccgctgctgtccccgtgggggcgcctggcccaggttcagggggcaggattgctccctactcttccatcttgcttaaggcaaacgccttagaatggtggaggcaagtcattatcatgtaagcacgaataatgtcatgcttgctcatttaagatccttaactttccaagctcttagccagctgtactgcaaatatagcaagctttgatatgagaagtcggaccaatccttgccgcaaatcaacaggagaagccatggtttgctacaggcatactcatggagatatggcaaacacaagtaacttccacaaatcgaagccagaagagcctttcattaggggaagcatggctcgaggaaactagtattcgcaagtggttgtttcgtttttttggttgcacctgtgaatgtgagtcaagctcttgtttgcttaataatttgccattccatttcctgtatcgaacatatgctgggagaatggatgccagaa

SEQ ID NO: 6207 - DNA, 605 bp, Sorghum bicolor
  Clone ID: SORBI-28MAY03-CLUS37333_1
ccccaatgatttcttagctgaagtggtgagctcaccagagacactcgagcagtagccagctgcaattggtgtacgtacagctgtgggctctaaccaaggtattactacgctggatgttttggaacgaactgagctcattttggatggcaatgctccttttgagactcctgggaggggtggtttctaccacgtcacacgtcctttctccgtgtggaaggcaggatacagccgttgagctatgcctggtgagataggccttttgctgtggttgctgtcacacatttggtggcttatacagcaaatgtgtatcagtggcatggatgcagaacaatgcggcaatcaggcgtataaactgaaccgctggttacagaggtgcatgcctccaacttgtagggggtcaggcttatgtgttatgcccccctgattctgcctttggacggcgccacaatttttgtgtacatactatgcctaggctgcctagatgtgtagcaagtaagtaatgtcaagcatcttcagcaaatcccatgctgaaaactgtaaacctcatcgctaaactctcaagcaagtgcattgtcagctttctgtttaaaaactctcccttcgtc

SEQ ID NO: 6208 - DNA, 737 bp, Sorghum bicolor
  Clone ID: SORBI-28MAY03-CLUS37368_1
aatcagttctctgtaacggaacattttagaagtggtgagagtggtcggatgcaggctcttccgggtgtgttcttcttttatgacctttcaccaatcaaggtcacattcacggaacaacatgtgtcatttttacactttttaactaatgtttgcgctattgttggaggtgtgttcaccgtttctggaatcatagattcatttgtataccatagtcaaagagcaatcaagaagaagatggaaatcggcaaattcaactgatgttgctttcccgattgctgcaattaagtagctccttttgcagctccaagttccagaaatgggtgaatcaatgcacagtggcttttgctctggaactcttggcacactagcatagtttacaaacaattgctcatcagataagtcttggtgagctttccaacttgcttccagcaaagataccagcgagcaagatggccatcgtgtacacttcgatatgttattcacacaagaaaatggaacaattcagaagtgctccatttttgtacgctctagtctaacaagaaaacattgtacttccgtgagctgcagaggtgttcgtgtactgttgtaaatttgtggtaggggggagcctatctgtattatttttctttttcttttttacaattattatgtgtctgtaccagtttttttttctgagacatagcttcgacaggtaaagattgaaaaatatatttaaaaaacattttcaaagaaagcaa

SEQ ID NO: 6209 - DNA, 550 bp, Sorghum bicolor
  Clone ID: SORBI-28MAY03-CLUS36923_1
aaggcgacgagatctacattaaggaaattgggctgtacatgaaggaaggagagaagatatcattctcggagctttctgaaagagcagttttacgtcgtgaagttgcgattggttatgtcaaggacggcaagcagcatattaatcctatcaacaaatcggagccactgtttcttgaaatgaacgattcactcattgtgatatcggagtttgaaggtgaacagccaattgtgatggacgaacagccaattatgatggccgaaggaacttcaggatagaattttcatcttatatctcttcacataaactttaacagctgttgctacaatgaagagataacatataccctgtttataatccttttctttttgtacaaagggaaagcaaaatatagacaaattaagttttgttccttccatagctatagaacttatttggtgcaaatattttactgcacagttcaactacagagttcaactgactgtaaacatagtgaataacacggacatggtccagatgtctgaataaagaaaggataaaggaaagttggtgg

SEQ ID NO: 6210 - DNA, 654 bp, Sorghum bicolor
  Clone ID: SORBI-28MAY03-CLUS36930_1
tctggatagatgcagctataaattcagggaactcagggggccctgctttcaatgataagggaaaatgtgttggtatagcttttcaatctctgaaacatgaagatgcagagaacataggctacgttatacccaccccagttattaaccacttcattgaagactaccacaaatctggagaatacacaggtttccctatacttggaatagaatggcaaaaaatggaaaatcctgatctccgcaaggcaatgggaatgaaagctaaccaaaagggtgttcggatacgaaggattgagccaactgctcctgaatctggatgcctccaaccttctgatatcgtccttagctttgatggtattgatattgccaatgatggtacagttccttttaggcatggtgagcgcattggattcagctaccttgtttctcaaaagtatactggtgagaaggcacgtgtgaaagtacttcgcaactcaaaaatccatgaatttaacataaagctggcaacccacaaaagactcattccagctcatatcaagggaaggccaccgtcatattacattgttgctggctttgtttttatggtcgtgtctgttccatatcttcgatctgagtatggaaaagactatgaatatgatgccccggtcaagttgttgg

SEQ ID NO: 6211 - DNA, 548 bp, Sorghum bicolor
  Clone ID: SORBI-28MAY03-CLUS36948_1
gcacgagggaagacatctcctattccacaggatgacgctcaagggcaagcttctagatactcgaagcgtgatcatagtacttctctgcgtcacagtgaaagtggcatggtagatcaggttctgttaacaacaaatgcggagcgcctgggatttgtcaaggttaggatgcgatctgttcgcataccacaaattggagacaagtttagcagtaggcatgggcaaaaaggaactgttgggatgacttacactcaagaggatatgccatggacaatcgaaggcatcacacccgatattattgtgaatccacatgctattccatcccgtatgactattgggcagctgattgagtgcattatgggtaaagttgcggcccagatggggagggaaggcgatgccactccattcaccgatgtgactgtggataacatcagcaaagctcttcatagatgtaattatcaaatgcgtggatttgaaaccatgtacaatggtcacactggaagaaaactgactgcaatgattttcctgggtcccacgtattaccaaagact

SEQ ID NO: 6212 - DNA, 604 bp, Sorghum bicolor
  Clone ID: SORBI-28MAY03-CLUS36961_1
gcacgaggccaccaccaatccgggcggcctgcttgtcttcttcctcctcccggttcagcgattccttttcgtcttggcgcggggctcgacgccagaggtgattgagaggactccaatccttatcccccacgcacctcccgcctcgcctccgccacacgttccgcgccgtcccctctccacacctctctctccatccatctcgctcctctggattcttcccacccgcccgattcccttcttcggcttgcgttgcgcctctcctcctcctcctcctcctcccccttcttttcttcctcatcaatcactcatcactgctactacttcgttggttccccccattaccggcccactgccgccgagagagattttggtgtgcctactaccgagtctcaatcctataccccaaaaactcgggattctctgctgctgctgctgctgctactactaccagtactattatcctcccgttggccggaacggaatcggttctgtgccggtgagttgccgcggcggatacaacgcgtttccgcgaggattccgcgtggtgaaagaaagaaagatcaggtattttctgcggatttaccgttgttaccgaacagaggga

SEQ ID NO: 6213 - DNA, 645 bp, Sorghum bicolor
  Clone ID: SORBI-28MAY03-CLUS36982_1
gcacgaggggcgaagaagcattagcatcacccctgagattggagatgacattgtgagggcagttcgggctatgaacgaaacactaaagcaaaatcgcctccaaagggatcatgtcgaaggttcatgctcatatgttacggaagaccaaagcaacgccaatgattgcccaaataatgatgatgcatctcggagaattggtgctactgacagtgactcaagaaaccgaactggttctactcagaaggccatgtcattgccttcttcacctcatgaatataggggtcaagttacccaaaaaagtgatgattttataagtaaagagaagatggcattggcatggaacaaagttttccagagctccccatttcttaataagcctttgctgccgtttgaggaatggaacatagatttttccgagataacaattggcacgagggttggaataggtttcttccctggagcttcctcatttacattcactaaagtctacggtatccttattatagcttatatgctcaatatggaactatcatattcttttattgccaaatatgttctttaatatgctgcaaaacctattcagtgcttctattatggtgtgctctctttccactatgtccttcactatgtttgcattgttatctc

SEQ ID NO: 6214 - DNA, 594 bp, Sorghum bicolor
  Clone ID: SORBI-28MAY03-CLUS36967_1
tgctctccttttcttcctccctgcgcctcgcctccactctcccattcggtccagcacgagggccggattctcctcctcgccggcggcggcgatggcgggcaatgacaactggatcaacagctacctcgacgccatcctagacgccggaaaggctgccatcggcggcgaccggccctccctcctcctgcgcgagcgcggccatttctcccccgcgcgctacttcgtcgaggaggtcatcaccggctacgacgagaccgacctctacaagacatggctacgcgcgaacgccatgcggagcccgcaggagaggaacacgcggctcgagaacatgacgtggaggatctggaaccttgcaaggaagaagaaggagttcgagaaagaagaagcttgtcgtttgtcaaaacgccagccagaaactgagaaaacacgagctgatgctactgcagatatgtctgaagatctctttgaaggtgaaaagggagaagatgctggtgatccatctgttgcatatggggacagcaccacagggagctcacctaagacaagttcaattgacaagctatacatagtattgatcagtctacatggtctggt

SEQ ID NO: 6215 - DNA, 733 bp, Sorghum bicolor
  Clone ID: SORBI-28MAY03-CLUS36998_1
gcacgaggggcagccgccctttgctacacaatcagcgcctgtggcacagcagctgccattcatggggccacccagggcaaatgccccagcgtttgggcctccatcttggcaagctcagggagctgggtctggtgctatgcagccacctatgagaatgccaggcattcctggtagcatgcagccaaacacactaggaccccctggcaccccgactataccttattctccacatgctggaacccaggtctcaaccccgtccaaaatgcacccggatcaaattccacggccaatgcctgaatcatcagtcatcatttatgagacccgtcaaggtggccaagcaaccattcccccggctgcatctagtgaatttattgtgaaggacactgggaactgtagccctcgtttaatgcgctgcactgtgaatcagataccttgtactggtgatctcttgacgacttcgggtatgcctttagctctgatggttcaacctttttctcttcctcacccatctgaggaacctatacagcctgccgtagaaaccagattttaataagcaaaggcccaaacaaacagtcctaagtaatccaccgttaattatccctcattttggcacattcacccagtgttccccagcttatcacaaagacaagaaaacttcttgtggactttggagagatgggacccattcggtgttctcgttgcaaagcgtacataaatcctttcatgaaatttg

SEQ ID NO: 6216 - DNA, 743 bp, Sorghum bicolor
  Clone ID: SORBI-28MAY03-CLUS37742_1
cggaggcctgctgcgggtagcgacaatcaccaccaccccggcgccaccaggaggaggtcgcagccggtcgggacgtcgtctcccgcggccggccggagacaccgcggcaggaagatgaggtctgcggtggaagtgtacgccgggccagggttctcgacgtcccccgacccgagctcgctgccgctaccgcagttccccaccaccaggaaggctgtggccgccgccgcggtcgacgccgccgccgccgcgacgcgcgacctcaggcttatcctgcggctggagtagccagctggatggatacatatctcgtctgctggatcaattggtggctccgttttttttttcaaattttttattagctcctactcctatacgtacataactttactactactagtcaacgcacacgcatgatccatcaagctgcatgttagttctggctgccctcctggttccgtccacgctgccgcggcgaggcttccggctcagttttattgtgtggccggcggcgaggcacgccgcggcggccgtgggatcccaccgcgacggcggtgtagaatgatcgtcgcagcaatatactctgtactgtgacctggaagtagatagtataagatacacctatgtatactcatatatgtgtagagtaactgtgggggttcatccgtgtaataagttatcagcatgtaatcctctccgtctctgttcatcaatatacatttttatatctcgagggggggcccggg

SEQ ID NO: 6217 - DNA, 606 bp, Sorghum bicolor
  Clone ID: SORBI-28MAY03-CLUS37822_1
ttccgcaccttcgacctcagctactaccgcggcgtgctcaagcggcggggcctgttccagtccgacgccgcgctcatcaccgacgccgcctccaaggccgacatcctcagcgtggtgaacgcgccgcccgaggtgttcttccaggtcttcgcgcgctccatggtgaagatgggcgccatcgacgtcaagaccggctccgagggcgagatcaggaagcactgcgccttcgtcaacaagcactagcaggcggcggcccatctggccgggacgccggaattgatgagggaaatggctcgatcgaatgcattttgcaggcgttccttctctcggtgatgtggtggacgttgaattgtacatcatcagtgcatggattctgttgtttaatttgtatgttcagttttttttttttttcttgttgtattcttttggttcttttttcatgtgttttcttttttgatgaggtgtctcactttagtctctcgttcagctgtaatcgtgtaatgcgcgcgttttgttcttgtgatctctgcaacctgtaatttactttagtgaatggtatacatggagatatattaataatataaggtgagatatcaatcatatgtc

SEQ ID NO: 6218 - DNA, 688 bp, Sorghum bicolor
  Clone ID: SORBI-28MAY03-CLUS37850_1
actggtgtggagttctccaaaaggttgtgtggtatctcagtgatcaggagtggcgaaagcatggagaatgcactacgggcatgctgtaaaggtataaagattgggaagattcttattcatcgggaaggagacaatggacaacagctcatctatcaaaatttaccaaaagatattgcaaataggcatgttctgctgttggaccccatattgggaacaggaaattcagcagttcaagccatctcccttttattgaagaagggtgtacaggaagcaaatattatatttcttaatcttatttcagcgccccaaggagtgcatgtggtgagcaagagattccctagagtgaagatcgttacttcggagattgagtttggtctaaatgatgatttccgtgtcgtacctgggatgggcgaatttggagacagatactttggaacagatgattatcagtcattgacgccattcttctgtgacgataaaaatcgtgtcaggctcttgtgagagtttgtcaagacaacatgcatgaagctgcggcatattctccaatttttgagaaacttatatctgcatttcaaacactagaatgcacatataatgatgttttctttaccagacactcactgtaccatggaacatacagacagaacacctcttgatataagtggatccattccatttttgtctgttt

SEQ ID NO: 6219 - DNA, 685 bp, Sorghum bicolor
  Clone ID: SORBI-28MAY03-CLUS37159_1
gcaggtgttcaagcagcagttgctgcatatcaaggagctggagctcctcctggttttcaagggccacctgggtttcaggttggacaagcaactacccagacaagcactgcagctgctgccgctgccagtgctgctggttatcaggctggggcagctgggcagggccaggtgcctggtgctcagattggaggcactggttttcagggtggatattgacagaactagtttggcatctgcgggtcgtggttcgttcgtgtggttttgcattcggatggcttttaagtctatattggtgccaaaatgttgcgaaaggcttcctgctgttgaattttacaaccggatttgaatcagatgcctttgtagcagtatttggaggaggaactttcttgaaggattatgtcgttttattgccaaatatgtagttttgctatcgcgacttcattatgtactttgtggatctgtactgggtttcatgtaccaaaatatctgtatttttactagttggctgttacctggtcttatgaaccatgtcaaatggttttgtgggcacaatcggagacattttaactgcagttgctgtgctgtttggaggtatggggtattcatggcttttgccttaaacctggaaatttcttctttgatgttgggttcggcgaccacggcatttaagatcttaaatgtgtgc

SEQ ID NO: 6220 - DNA, 1031 bp, Sorghum bicolor
  Clone ID: SORBI-28MAY03-CLUS3717_1
ccgaagcatctggaacacgcgggcacgccactggctgaccctgacggggacacaaaaggagaaagaggaagcaagtcccccgagaaagcggtcagaattggagtgcaagcgacgcgtcgagctcgtgcccccatcccgttcccgccccgcgcctagccgagagatctgcgccgtcgtcggcaccgatccgtccgtcgactcgccggcgaacgaatagagatggaggagacggcggcggcggcggcggcggcgacggcgacgtctgagaaggcgtcgtcgtacaggtactgggtgcgggaggccaccggcgacgctgcgccgctccccgtcccgcgcaagctcgaccccaccgccaacgggaacgggaacgggaacccgccgcccctcggctccgtctggaatcaggctggaacctgggaggaaaagaacctcaactcatgggccaatggtaggataaaggatttgctgggctctttaggttcattggacttccctacagggaaggcatccattgatgaagtgtccaagtgctcaggcgatgcatttcaggtcactgtccgcaacaagaagagagtaggatataattatgaactaagcttgagacgtccgggtgaatggttaattaaagaagaaaacaagaagatcaaaggacatttagacattcctgagttttcatttggtgagattgatgacttggaggtacaagtaaggttcagtgatgacaagggcctcgcatctgaagacaaaacacggatttgcaaggatctcaagacctttctggcgtcgattcaagagaaaatgcgcgtgtttgaagaagagctcaaaggtagatagcaagtatattagcaagaataggcagtgctaggtaagttacttggcgctgccgtgctagatttgagtaaaacatatcaaattgaggtgttgacgtcttgtggtgtcgccacgttctgaagtcgtctttggatgactggaactgtatgtgtttcatgttatgttatgcacttgctgagatgagcacgtacgaactgtct

SEQ ID NO: 6221 - DNA, 585 bp, Sorghum bicolor
  Clone ID: SORBI-28MAY03-CLUS37197_1
cttaggaaatgtgtggagccagcccatgagaaaatgggagtcgttgattcccagtggattgttcatcaagtcgtcccatcgcttggtaaccagggcaaggcggagaatggaaaagcgccatgggaaggggttagagcacgctgtcgtaaagaatgggggatatttcaaacaaggttgacagatgctgagaaagcatattacttggcgcaagggatcacaccaccaaaatcgacagtaacttagatacatggctgcatacaggcacctcgcgagtcatatggcaaggtttgtgctttgtgaacctggcgcctgcctgtccgacaagtaactgactctgtagagatgcagcaccaaggccagatttgtacaggatcaatctcctttctactcttagtctttcacttggttttttctctgtaccagagtagctcttgtgtaagtagctagcacaatttcggagatactttttgtcttattggccaaatgcagtatcgatactgtcatttctttttcttgttttaacatacaaatgattgcgttggatcagctcttgtgcattcagtaccttattttcatgctctagcc

SEQ ID NO: 6222 - DNA, 641 bp, Sorghum bicolor
  Clone ID: SORBI-28MAY03-CLUS37207_1
agggtctgcaccaaacctcgatgctgtcgcaaaggagcagctggcatcgaagaaggatgcgaaaaagaagcacaaccggatatacaagaaggagctcgcgctctcgatgttgctcctaaccgcggccgcccgaagcttgctctcgaagcagggtatacacttctacttcctcctgttccagggcatctccttcttgttagtaggccttgacctcataggcgagcaggtcgagtaaaaaatgtgtaaaacagaaattgataggtgtggaaaacggtggtgaggcaccatggaagtgcttggggggaggggagggatgtgttactggctcactgccatggacatggcagcagcccttggctgagattcgaaagatatgctttgtgcagctgtaccttcccggatctgtcctgtcctggctgcacggcatgatatgatatccacacgtgaagaggaaccctcctctccctcggaggtgtagatacagtttcctcggcctgtaaaatttgttgcgtcgtgcctcttccaggtccagggtccgtccccctccattcttttgtaacaattctttggtgctcatgtgtggatctttgtcatcaaggatgtaacagcacacacctgttcgcctatacgatcggtgaagg

SEQ ID NO: 6223 - DNA, 652 bp, Sorghum bicolor
  Clone ID: SORBI-28MAY03-CLUS37267_1
gatggatttgcgagggggttgcgaggatttgtgaaggctgcagaacaggagctgaaggcactaagaagggagcaggaaagagtacttgagctggtccagaagacaacagagtactaccatgctggtgccaccaaggaacggaacgcacatcccctccagctgttcatcgtagtgagggacttcctgggtatggttgatcaggcatgtgttgacatcaagaggaaagtgcaacagaagaaaccagcaccatcggcatcgcagccaaacgcagctgctgcccccacggtggcggctgcggctgcggccacaacagcggcgacagcgtcaatgacaaaggaagcgaccgatggtcaagcagcaccaactcagaaaccacccgaagaggcagatagtaaaaggaagagggtcatgccaagatttccaaacctaccagcgcacttcatgaaggatagtgcagattctgattcaagtagtgacgaggaatagattgaacgggtggctgtaaatgattgtttacattgttttgaattggttgttgtagaggtataggatagctgcagactgtacataaagcaatttttacattggttcttttgtccatttcttcaatcaagatccatatcgagagcaccgaatagaattcagaaatttg

SEQ ID NO: 6224 - DNA, 825 bp, Sorghum bicolor
  unsure (1)..(825): unsure at all n locations
  Clone ID: SORBI-28MAY03-CLUS37314_1
gcacgaggcacaaaagcccctcttctttttcatcttcgtctccgatgcctcttgtgtggccttgctcgttctcctgccgcagacagagcggatccacgagcagcagcacgcacatctgagtaggttgcagctcaggatgttcttgcaacaacatctgttagcggagctcaacagccccatggaatttccggatcgacgcgagaggcggcgggcccccccggcccgctcccgccctgcctccccagggcaccctcccgcctcttggcgcttcgctcccccgccgcccctcgccggtccggcggcggtcccctcttgccagctgctgccctgtctctccatggcagcaatgccaggttggggtggtcttatggccttttgttgggacccagtgaaggtttgaagtttgagccacggttagaggaaacatgaggacgaacaagacggctaatggaagtacaaaatgtgaagtgctcggggtgtcaaaagctgccacagtttggagcatccataagtagttgtttcggaagttttcatagagctatatatacaaagtcgactctggtaatgaagttgcatgttatgttgggcttgggccgcgtctttcagcgccgcaagcggagctgtggctgaggaggcccaactggcgacgcgcatggctgcatggtgaccgcgcccagagcggcttttgttcctcaatgtctagaatctcagatttccatttgttagtcaattgagtttgttagtcagttagagaattgtggaagagtcggctatatagccaaaacatttgattaataaatgatcagctggagattgataccatnt

SEQ ID NO: 6225 - DNA, 626 bp, Sorghum bicolor
  Clone ID: SORBI-28MAY03-CLUS37284_1
agctacggaggatttctctcagcaatgtgcctcacaaggtttccagacacgttctgttgtgcagtgtctggcgctccggtgacagcttgggatgggtacgacaccttttacacagagaagtacttgggtctgcctgcggagcacccggatgcttacgagtatgggtcaattatgcaccacacgaagaacctgagagggaagctgctcctcatccatgggatgattgacgagaacgtgcatttcaggcacacggcaaggctcgtcaactcgctgatggcagatggcaagccctatgaaatcctccttttccctgacgagaggcacatgccacgacggcttggtgaccggatctacatggaggagaggatctgggattttgtcgagaggagcctttgagagggtgtttgtatacatttgtttcccccatgtgggctttgacgtttttggcacatgaattcaggttttctcattcacacctgtatttatcaatagtgtagttatcttgattctttcctgtcttggatggttatcagctgtttggcagcgtttacagatttcagaataataaaaaaacttcatatcattgtggtacctctgatgaagtttattttgtcttgtaaaaaagt

SEQ ID NO: 6226 - DNA, 604 bp, Sorghum bicolor
  Clone ID: SORBI-28MAY03-CLUS38003_1
gcacgagggtcagctttaccggaagcttatagcgaaacgtacaactgcctcagacatgcttaaagcctaccacctttaccttgcagcatgcccattcaagaggctttcacattttctttccaatcaaacaatcttgagtatgattaaaaatgcatcaaaggtgcatatcattgacttcggcatttattttggcttccaatggccatgcctaatcaggcgtctctccaagagggaaggcggtccacctgttctgcgcgtcactggaattgatgtacctcagccaggtttccgcccttctgagagaattgaagagactggacaaaggcttgcagaatatgctgcgaagttcaaggtgccttttgagtatcagggaatagcatcaaagtgggaaaccatccgagttgaggatctcaaagttggtaaggacgaagttgtgattgttaattgcctgtacagattcagaaacctgattgatgaaacagttgctgtagacagtcctaggaatagagtgctcaacacaataaggcaagtaaacccagctattttcatccatggaattgtgaatgggtcatacagtgttcccttcttcatcacacgtttccgt

SEQ ID NO: 6227 - DNA, 769 bp, Sorghum bicolor
  unsure (1)..(769): unsure at all n locations
  Clone ID: SORBI-28MAY03-CLUS38022_1
gcacgcggcaacgacgcggttgcttctccccacggcggcatctcctgcgtggcggcgccgtccccgcgagagctgcggcggcgcgctaggcaagttactggacacgggaacgatgggggacggcgccagcggccgcggcggggccggacggcgggtgggggagtacgagctgctgcggccgatcgggtcgggcgcctactcgcaggtgtggctggggcggcaccgggcgcggggcacggaggtggcggtgaaggagatcgccatggagcgtctcagcaacaagctccgcgagagcctgctctccgaggtcgacatcctccgtcgcatccgacatgataacgtcatcgcactccacgactccatcaaggatcatgggaggatatatctcatattggagtattgtcgaggtggtgacttacatgcataccttcaacgccatagaagagtttctgaaaaggttgctaagcatttcatccgtcagttagcatctggtctgcaaatgcttcgcgataataacgtgggtcaccgagacctaaaacctcagaacattcttcttgttgaaaataatgaaaattctctgttgaagattgccgactttggatttgcaaaatttttgcaaccgttcgccctagccgaaacactttgtggttcaccactttacatggctccagaagtcatgcaagctcagaagtatgatgcaaaggcagatctgtggnagtgttggtgtcattctatatcaacttgttactggaataccaccttttaatgg

SEQ ID NO: 6228 - DNA, 668 bp, Sorghum bicolor
  Clone ID: SORBI-28MAY03-CLUS38046_1
aaaaacgcgccccgcacgggcgtccttcttcctccgctcgccgacacggcgcaaatccccacataccccaggcgggcgggcggacttcccagttcccacccacctcctcgcgcgcgcgacgtgctcggctcgcttccacccacaccagccgtctcgctcgccgccagcttcgtaatccccgccgcgagatctcgtcccccgggaggatggaggtgaaaacagtaaaagttagcaatctttcattaaacgctttgaaaagagagatcacagagttctttagtttctcaggggatatagaatatgttgaaatgcaaagtgaatctgaatggtcacagcttgcttatgtcacatttaaagactcacagggagcagacactgctgttcttctgtcgggggcaaccattgttgatcgtgctgtcattataactcctgctgagaactatcagctgcctcctgaagcacacaaacaattatcgggagcaaatccctctactgaatcagcagtcaggaaggcagaagatgttgtcagcagcatgttggccaagggctttgtcctcagcaaagacgctctcaacttggcaagatcctttgacgagcgacacaacatcctatccaatgctactgccactgtcgcatctctggaccgccagtatggcctgagtgaaaag

SEQ ID NO: 6229 - DNA, 530 bp, Sorghum bicolor
  Clone ID: SORBI-28MAY03-CLUS38092_1
gcacgaggatcgtcgtcgcctatggaggcagctcagaccagtcatctcccagagccagcaaaggaggtctggaggaggtactcacaagccaagttaccagactggtggcccaaggttggagcgaccgtgatggaatctgggccagagatggagaagtgggcaagaatggcaaacagattagtccgagcaataattgataatagagtcatggggagggattacagatatgatgatgcaattcaacttaggcaattatgcaaaatatcgggggtaaaggtctgctttgatactgaaaatgctcgtgattctttctacagagcagcagtgaactttgttatagatgattgcagcagagcagcaaaagacatgggtgcagcaaaacttaatggtgaggatccaagggagtttcttgctggtcttgctagcaatattggattagacaagtttcgtgctgccactcttgtatgtgcatcaattgctactcgtacacggacatgcttcttgcaatgctgggctctagagattcaagg

SEQ ID NO: 6230 - DNA, 631 bp, Sorghum bicolor
  Clone ID: SORBI-28MAY03-CLUS37384_1
cgctgtttgtgttggggcaaccagccgccgcatcgccgattgaggcgccggacatgccgcaccttcgttcagggtactggagagcaaggtcccaggccagcccacagacacgaggctataccaacatcccctcccaggaaccaatgcttatgacgcgcacgcgcctcttccagcctcataattttctttacccccgtgcccttcccgttccttcgtgtggccataccactttccgtgacagtttctgccaccaggcgtgacagatgcgccacctctactacgctggggctgggcactcacctccctatgttcttgctcttggtcaaccatgccggcttgcgtcagcaagcctgcgcttagatcccgcgcacttaccccttagtgagagttttccccgtctgccctgtctcctcatgcctggggccagccccctttctttagtgctagcggcgtcatcatgctcctgggttctgctcctccgcctgcaaggcaggcttgtctgaggtgcacctccctttgtttcggcgtcctcaggctcttttgtcccttttcctggtggtgcctctttgtggcgcaaacagttgtcgctgactattatgttaccaaatgacaagggtgagcaacctattat

SEQ ID NO: 6231 - DNA, 680 bp, Sorghum bicolor
  Clone ID: SORBI-28MAY03-CLUS37516_1
gcacgaggctctctccagcgacggcggccgccaggcagatgcagggccgcctccggcgcgtcctccgggcgccgccgcctagaatcctactctaccgcgcgatctcctccccgccgcccggaggcaacggcggtggcggtggcgatggtggcagcggggtggcggtgaagcaggtgacgcgggggaacatggcggaggccctggagaagctgcggggacgcgtgcgggaggccgcattcgtaggggtggacctggagatgagcggcgtcacgagcgcgccctggagagacaccttcgagttcgaccgcgccgacgtgcgctacctcaaactccgcgactccgcggagcggttcgccgccctacagctcggcgtctgccccttccgatgggaccctgccaagtccgccttcgttgcccatccgcataacttctttatcttccctcgcaaggagctccctagtgattgttcatctcatgagtttctttgtcagacaacttcaattgacttcctagcaaagtaccagtttgatttcaacacatgcttccgtgaagagcacaagaggaagaggcgctacagaaatttaatacattgcatcatggtcaaaccgctacatcttccaccaattctgaagaggacggagacatacctttaaagagtgcttctgatattcttttcacag

SEQ ID NO: 6232 - DNA, 622 bp, Sorghum bicolor
  Clone ID: SORBI-28MAY03-CLUS37486_1
cgtgggggtgcggtggcggcgctgacgacggcggcgcgccgcccgtttttgcgcgcaagtggcggtcacgccgtgaggtggtcgattggctcgcgtccttccttccggtgaaggcacttgactcaagtaaaaaattctcaaaatacagatcttttgcggataatgacattgggtcagatgggtatggggaaactgatagctttttgcaccaaaatctggggaaagactgcagctcagacattacatggtctggttctttctggacatgtggcaaggagcgtcggcactatcaagctttttgtcgcaatgggaccacaatctccacccacacttttgtgctgatcttgtcagaggaagaaaatcgctatcttgcatacttggaagacatgtatgaagataagaagggactgaagaagatcaaagtgcgatggtttcatcaaaaccaggaattcgcttgtgctatacctcctcctccccctcatccttgtgaagttttcatcactccttttacacaagtaataagtgtggaatgtgttgatgatattgcaactgttttaactcctgaccattatgaaaaatgctccaatgcgatgcctacttcttctttggccgggatccgttg

SEQ ID NO: 6233 - DNA, 1228 bp, Sorghum bicolor
  Clone ID: SORBI-28MAY03-CLUS37536_1
gcacgaggggcatgcggaccatgaatatccccaatcccaagagaacagagcaaaccgaagcaatggaatgaagcaacaaggcgagtgttgatcgccgatgcgctgctgactggttggtggcgagcgaagcatggccgtggccggagccaacgcgtcctgctccatagccgccggagcctgcccgtcgtcatccggatcctcctcacttttccctcaccaccgtcctagtcgtcctcggcgccacggccgcataggcatagcaaccatcatgtgcaccagcagcagcatgcacgggtacggctatgatagcagctcccttccgtccttgtccctgccattcccaatcccagcgccgcgcggcgtcaccagcaccggcagtggcagccgtttgcgcatcttctccggcagcgccaacccggtgctggcgcaggagatcgcgtgctaccttgggatggagctgggcaagatcaagatcaagcggttcgcggacggcgagatctacgtgcagctgcaggagagcgtgcgcggctgcgacgtgttcctggtgcagcccacctgccctccagccaacgagaacctcatggagctcctcatcatgatcgacgcctgccggagggcctccgccaagaacatcaccgccgtcatcccctacttcggctacgccagggctgacaggaagatgcagggccgcgagtccatcgccgccaagctggtggccaacctcatcacggaggccggcgcccaccgcgtgctggcctgcgatctccactcgggccagtccatcggctacttcgacatccccgtggaccacgtctacggccagcccgtcatcctcgactacctggccagcaagaccatctgccccaacgacgtcgtggtggtgtcgccggacgtggggggggtggccagggcgcgcgccttcgccaagaagctctccgacgcgccgctggccatagtcgacaagaggcgccagggacacaaccaggccgaggtggtgaacctcatcggtgatgtcaggggaaaggttgccgtcatggtggacgacatgatcgacacggccgggaccatctccaagggcgccgagctgttgcacaaggagggagcgcgagccgtgtacgcctgcagcacccacgcggtcttcagcccaccggcgctgcagaggctctccagcggcctcttccaggaggtgatcatcaccaacaccgtgccggtgcagcacctgcacagc

SEQ ID NO: 6234 - DNA, 705 bp, Sorghum bicolor
  Clone ID: SORBI-28MAY03-CLUS37680_1
gcacgaggccgacgactccgagatcccgtcaggcatggacgggctcctggcgaagctccgcagcctggacgcgtaccccaaggtgaacgaggacttctacagccgcaccctctccggcggcgtcatcacgctcgcctcctccgttatcatgctcctcctcttcgtctccgagctccgattatatctccatgcagttactgagacaacactaagggttgatacttcaaggggagaaacacttcgcataaattttgatgtcacctttccagcccttcaatgttctataattagcctggatgcaatggacatcagtggacaggagcacctagatgtgaaacatgatgtattcaagcagcgaattgatgcccatggcaatgttattgcgactaggcaagatgcagttggtgggatgaagatggaagcacctctacaacatcatggtggaaggcttgaacacaatgaaacctattgtggctcatgttatggtgcacaagaatctgatggtcaatgttgtaactcatgtgaagatgttcgtgaagcctataggaaaaaaggttggggtgtatcaaatccagatttgcttgaccagtgcaaaagggagggctttcttcaaagtataaaggatgaagaaggcgaaggatgcaatatttatggcttcattgaagttaataacgttgctgggaatttccattttgctccagggaa

SEQ ID NO: 6235 - DNA, 751 bp, Sorghum bicolor
  Clone ID: SORBI-28MAY03-CLUS37724_1
catgaaatgctaaatatactggaagaaaatgctcgactactcaatcaaatagaagtaaatattttaacatcacaggcttataacaacaatgatcttttccatcacgcaagaaggaacatcaatggtcttctacaaagcatgagccaaattcctggaataatgagcaagatgcccccattgcctgtttcggtggatgaaaggctagctagctacgtactccctcgtgctcctatggcacaagttcttggcagcagtcatttgaaagaagaaccaagagtatggtaggccactgctagacagggaagcagctcaattttcagcaatagtttgatcaaaaatatctcaagagcatgtgcttgggaatctgcatggagaagcataggtgaaagaacaatctggcttttctgatgtctgaaagctatagaagcaacatgatccacttcagcacatggccttaaaagaacgctgtccagcttgccttctcaggatgctctgtattagtgattatgaatttgagataggtagagttttccgtaatctgcagttttcctcaccttggttgcacatatcgattctttttcgggttttgtcctggtgatcgatgttaacagaagtgtagcgtagaaactaaacttgatatgaataattagcgggaaaagcttaccctttttgtcagtcactacaaaggtaaccacccttctgggtgtatctagtattctagttctggtataatgcatgtgcaacccttggt

SEQ ID NO: 6236 - DNA, 684 bp, Sorghum bicolor
  Clone ID: SORBI-28MAY03-CLUS37730_1
tcccggacggcacgccggtgcgcgcgcggcagcgggtgatctacttcacgtacgccatggggcgggacaaggccacctggggccccgactgcctggagttccgcccggagcggtggctcaacgacaagagcggcgccttcgcgggcggcgccgagagcccctacaagtacgtggtgttcaacgcggggccccggctgtgcgtcggcaagcgcttcgcctacacgcagatgaagacggtggcggcggcggtgctggcgcggttccgcgtcgaggtggtgccggggcaggaggtgaagcccaagctcaacaccacgctctacgtgaagaacgggctcatggtgcgcttcgtcgccagggagcagcggcacgagctccgccaccctgtgcctgctgcagctcatcttgcaggggaagattcaagatcagttcgaggtcccttttttttttctgggggatgaagcacaacaccacccgggaaagagtaaaagttactaagggcggaagacgtccaatgcacaaattaatatatgaatgaaaaatgggtgaatgagcccatggatatatatactgtggcataattgtgctatatgtacttcgatcgtttttctcctgtgtgtatatgtaagtacgtgtttgtatcgtgggaaatgccgtccccgatcacaattcacttttcccgtgtgc

SEQ ID NO: 6237 - DNA, 754 bp, Sorghum bicolor
  Clone ID: SORBI-28MAY03-CLUS38241_1
cctactgaagaagactgcacccgccccaaccaccactcccacacgcacaagccttcccatccctcccctctcctccatcctccggccatccatcccctccagcaacccaacccagaacccactccacttccccggtgaggctgagcgatccaccaccacggcaacgacgacgacggcgaccagccaccgcgcgcacggtggcaacaggtttgttctctgaaccctttctcgtagaagccaagctaggaaaaaggaggcctttttttgggagcctttcttgctgctgctatttgatcgagcaagcaaggaagtgtgaccggaaaagatcggagcttttatttcgaacggttcgtcttcctcgttccttgcaagtagggagaacagagatccggagaaccttttttctctcctggattagttcctgtctgttcttgtagagctttctgaattcttttagcttcttcttttgtttttttagcaagctagaaagggtcgtttttaagccccctttcagcctgcaccaaccaaaccattgacccaccatcctcctgttcttcgcttttattgaagaaacaggccttaatttttcccaatttcttcttctttttctgctagtttcatctccagttcagttcttgcaaaccaaaaaagaaaaaaaaaagattcgaccttttcctctttttttcctttacattttgccaatggcagccatagatttgtacacaaaccagctgagctcctcgtcgtcgtcctc

SEQ ID NO: 6238 - DNA, 546 bp, Sorghum bicolor
  Clone ID: SORBI-28MAY03-CLUS38293_1
ccctaaaccatgacctcccgcgccgccgcgaaggcagccctcctccttccgctccacctcctctctgccgccctcggcccgcgcttctcctgtacctccgccgccccgctccgatgggcgcgctccgcggcggcgctgctcgccgtcgcttcgctcctcaccgccatctgcgctatgcccgacgcgggtgccaacgttgaagccgacgccgacgccgacgccgacgccttgcggttggagattgaagcgctcaggctaaaggtcgcgcggctggaatctttactagaggcaaatgcgaagacattggacagtaaggttagtatcttggaggaggacaacaaactcaatgaagcaatggaacgtgaaatccagcttttaatgaatgaaccagacagtacaaagaactcccaaagcaaatcatattctgctggcaacatcaaatctatggaagatgagtatgtcaggagtatcaaacttgatggtatttatcttagaggggcatcatatgcaaggtcctgcttttcacatacatataaacggtctaga

SEQ ID NO: 6239 - DNA, 1459 bp, Sorghum bicolor
  Clone ID: SORBI-28MAY03-CLUS383_1
acctgcacacagttacaaagcttggcactcgcatgctcttcgccccctcgcgcctaccgcctcgcagcctccgccacgctccgggctccccaatggcctccacgctcgccatcctcaggccctccgcgccggccccgctcgcgggccgccgggcgcgggctgccgcgccggcgaccgcgagggtggcgctgtcgtccagatctaggtattcgtcggccagggtgtcgctcggctccgaggttgcagtgggcgccgacgcgctcttcgccgactataagcccaccaccgctttcctcttccccggccagggtgcccaaaccgttggaatgggggcaaaagctcagagtgttccagcagctaccaaattgttcaaccaggcaaatgaaatccttggatatgacttgctggatctttgcaccaatgggccaaaagaaaagctggattcaacagtgatcagtcagccggctatatatgttaccagccttgcagcagtagaggtactacgtgcacgcgatggaggccaagatgtgattaactctgtagatgttacatgtggtctcagtttgggagaatataccgctcttgcatttgctggtgcttttagctttgaggacggactgaagcttgtgaagctaagaggagaagctatgcaggatgcttcagatgctgccaatagtgcaatggttagtgtgattggtctggattcataaaaggtgcaagaactatgtgatgctgctaatgaagaagtagatgacagtgaaagagttcagatagcaaactttctgtgccctgggaattatgcactttctggtggtgtaaaaggtattgaagtagtggaagccaaagcaaagtccttcaaggccagaatgacggttcgcctagctgttgctggtgctttccatactagcttcatgcaaccagctgtttcaagattggaatctgcgttggctgccactgagataagaacacctagaatcccagtcatctccaatgttgatgcgcagccccacttagatcctgacaccatcaagcagattttagcgcggcaggtaacctctccggtgcagtgggaaaccactgttaagactcttgtgggcaaggggcttgagaaaagttatgaactcggaccaggaaaggttatagcaggtattctcaagagaatcaacaaaggcgctagcattgagaacatcggggcttgaagttcagggatctgaagaactcttgatggaactaagctacacaacagaggattagccccccatcaggggtgaatatgaacctacagccactattgtggaacgaagtttccactcatagagttagcgattttttgttacttttttttaacccttcgtggttgaattttgatcttgatgtaaaattgacaactggtctggtctaatgattatatgaacagtgtagttttcataatattgaataacaagcacatgcgtttggg

SEQ ID NO: 6240 - DNA, 687 bp, Sorghum bicolor
  Clone ID: SORBI-28MAY03-CLUS38300_1
gcacgaggcgcggtggaaggaggaggccccggcgcgatggagtacctcaccgcccggcggtcgtccaaggtgtacgacgtcgcaatcgagtcgccgctgcagctcgccaccaagctctccgaccgcctcggggtcaacctctggatcaagcgcgaggacctgcagccggtgttctcattcaaattgcggggagcatacaacatgatggcaaagctcccccgtgagcagttagagaggggcgtcatatgctcctctgctggaaaccatgcccagggtgttgctctttccgctcagagactgggatgcgatgctgtcatcgtcatgcctgtgacaactccagaaatcaagtggaaatcagtggagaggttgggtgcaacggtggtccttgagggggactcttatgatgaagctcagtcatatgcaaaattacgatgtcagcaagaaggccgcacattcatacctccctttgatcatcctgatgtcatcactggacaaggaactgttggcatggaaattgttcggcaactgcaaggtccactgcatgcaatatttgtacctgttggaggtggtggattaattgctggagttgctgcctatgtaaaacgggttcgcccagaggggaaaataattggagtggaaccctcagatgccaatgcaatggcattatccttgtgtcatggcaagagg

SEQ ID NO: 6241 - DNA, 496 bp, Sorghum bicolor
  Clone ID: SORBI-28MAY03-CLUS3862_1
cgtccgcgccgacgtgttcaccatggtcggactgcaggaattcttctacgatcaggtgcccgacaagttgcgcagcctcgggctggcgctgtacctcagcatcttcggcgtcggcagcttcatcagcagcgcgctcgtgtcggtcatcgacagggtgacgacggctaggggcgggagctggttcaacaacaacctgaaccgcggccacgtcgactacttctactggctgctcgccgcgcttagcgccgtcgagctcctcgcctatgtcttcttcgcggtgacatacaagtacaagaacaaaagagccgtacatgcaactgttgagagttagctagagctgtgtggtactggtacgccatacataagtcaatagtataggtgataagatacccaaccaagagagtaaatgtttttttccccctcaattaggatttgtgatcccaacttatctttgaggttgattcccattcgcttctgttggtagggcccatgcgat

SEQ ID NO: 6242 - DNA, 593 bp, Sorghum bicolor
  Clone ID: SORBI-28MAY03-CLUS3786_1
tgctccaaatgagattttactggttcttgatggaacgactggcttgaacatgttacagcaagcaagagagttcaatgatgttgtaggagtcacaggattcatcctgacgaagctcgatggcactgcacgtggtggctgtgtggttagtgttgtggatgagcttggaatcccggtgaagtttattggggttggtgaagggatggaagccctgcacccttttgacgctgaggcatttgttgaagccattttcccataaattcgggttttgtggagaaaaatcatgcttctactgtaaagcttttgactctgtcgactgtggttgctttggctcttcatgtaagttattcttgttgtgtccactgaaactacagtagtgtaggaagcacaaggccagggtaaaatgaattggagtcggagctaagctgagacagaatttgtcttccagtccgtaacgagctaggagctgaagtttttgttggtggagtttgtggccctgtgggtccctgtgtaagaggctggaaactgtaaactttcgaattgccccgggaggattcagagaaaggaatgggaaaatatactcgatcgtatttctt

SEQ ID NO: 6243 - DNA, 720 bp, Sorghum bicolor
  Clone ID: SORBI-28MAY03-CLUS37882_1
taaaagagatgctggggaggactcaaatgcagtgattataacacaagatgggaaagaatttaatattgatgaaatttacaaagctgagtcttcatatattggtggtttgaagtccattgaggagtttcatcacattgagattcctcctaatgctccaccagggattgatgaagagatgctagaggaaggcaagaaaccaagtgagcctgcccaggaaagccgggaggagcaaatgtctgacgtgaatgatcgggaaggaagcaaggcagccagtgctagcacacagaatgacaagttgtacaccgccgagggcatactcgaccctcgcaagaggaaagcagagaagaaacgacgcaaggcgaacaagttcagcgtgctgaacgacatggatgcggactatgatttcaaggtggattatcagatggaggacgcatcggccgccaatgaggacgatgggggtgcacaagcggatgatgaagatggcggggatgaagccaaggataatgagccgatgactggtgttgatgatgcgtgaaatatttagctccatccttgtgtatgagttaatggcgggtagatgttatcggtgatattatcatgtcgagtgccagaaatggcctagtgggggttgcaaaattaacccgcaaaaagttattgtgcgctatagtttgtttaatgaaagatagatactatgagaaggcttgcgttttacctgttacc

SEQ ID NO: 6244 - DNA, 620 bp, Sorghum bicolor
  Clone ID: SORBI-28MAY03-CLUS37907_1
gctactggcggctggcgctgccggccggagccagtagccgcgaccacccctggtgcaacccgctgtcccgcgccgcgccgcgcctggagaccgtcccgctgccgccggtcctggtgtgcgtctcggagacggacatcctgcgggaccgcaacctggagctgtgcagggcgatgcgcaaggcgggcaagtgcgtggagcaggccatgtacggcggcgtcgggcacgcgttccaggtgctccacaactgccacctgtcccagccgcggacgcaggagatgctcgcgcacatcaaggccttcgtcagcgccaggtagcagccgccgccgttcgtcttcgttggactggaccctagctaacacactcgccgtcgccgtgttaatcaatccaccatgcatccaccacctaatcctaatcctaatccaatcgaagagtagatgccgtgtaagcaaccagccttgtgcagtactgtattacgtatcacagtagtatgtgacttcgagtcagctacgacgtgtatttgcagcaaaaaagcgtccaatgcccagcccgggttgttgtagcggtgtcggaaagcaaaagcttatcactaccatatatatatgttatgtatgagctctgct

SEQ ID NO: 6245 - DNA, 690 bp, Sorghum bicolor
  Clone ID: SORBI-28MAY03-CLUS37911_1
tacatgagaatgcattgtgtgtggaggatctcccaaccgacccatcttctcaatctgcatcacaccctcctgaatcctctcgagacatgaattcacaatctttatcttctgaaatggcaattggaggaccaggtggactctggcattttatatataaaagtgtttaccttgaccagtttgtgtcatcagaatttccctcacccataagtaataaaaagcagcagaagagattgtacaaagcttaccaaaaattgtatgcatccatgcatgataaagcaactggtccacacaaaactcaatatcgaagagacgaagattatgttctattctgctggattacccaggattttgaactatatgcagcttttaatccactggctgataagactcaagcaatcaagatgtgtaatagagtatgccaatgggtgagggatttagaaaatgagatattcgtgtatggagaaagcgccctttcctggtgatatattgtcctgtgtgtaagttgtgtctatgttgcatttttttattgaaagtttttgatggttgatgtacttgtaccgacacaggcagtaccatcgttgttggggaggtatatgaggggctgggtttgtcacactttgacattttctcaggagaggtgatcttttggttttttatctgaatgatggattggagcctttttcttattat

SEQ ID NO: 6246 - DNA, 652 bp, Sorghum bicolor
  Clone ID: SORBI-28MAY03-CLUS37923_1
tcgcatttaagattcctttgttccagcttttggttctctgagcttcgcacaacttgctgccccctttatgccactctttgtggttgttagtagcatcaagagaggagcagcatcggtgaaccgggaatctcatcccatggtgaataaagctggaaaggttaataactgtggatctggtctttagttctttcagaatgtgcacctgacggtcatccttagctcatgtccattgttgatgcttgactagtcggaggtgtttaggatctgtttgcagattgatggctttcatggatccttgtatccgtttgaagttagaacactaaggttctaattcattcctttttagttgattctctgttgagtttaggcgccatctggtgcttgtattagttagtttggcacttgaatggaatgtgagctggtcctctttaggttatgccacatcctggaagaccgttgcatcactagcatcaggcatgtccaataagatagtgaggttgaagggctgatgtagttcagtttcgttttgtttgtgatatgtgcagaacaagatactggatactctgggttctcatttatttgagcgcgtgtatttttttttcatgttatgatgacaagtacatgaaatcctgcaagttcatttttaacttcc

SEQ ID NO: 6247 - DNA, 664 bp, Sorghum bicolor
  Clone ID: SORBI-28MAY03-CLUS37947_1
tatggcatccaagatggctgttgatccagataaaagaaggcattcatcatctcggaatggaagcacatcaaggaaggctcttctgtcaagcagccgaggttctggagatcccagtgatccaaatcgcagtagccacctagtcccgaccactactagcagcagccgtccatcgactaatcaaaggcttcaccagtcaactggacttgagggcaggacctcatcatttccaaaagctggaagaatcggccatgatgatcctactatgaggagtattggacgccttactattagcgcagagaggaggaaatgaatctttggaagagcaaaagatctgagctcctcccactggcgagtatactgattcacagaatatccattcggttccagatgtactgatgagcaagttaaatgattctgtgctgtgcatgatgctgagctctgcacatatgagcggtgctcgtcgaatcttggcacagatgatttgagttctgtacattcgtttaactcttcttccaaacgattagcgaagcattttacaccctgttatgagggaccggggatcggctgcaatgtttaagccgtgatggttcaaaatgatgttgactctaatacttatataatgacaatgaaataaaaaatagttcgctaggctagcattaccttt

SEQ ID NO: 6248 - DNA, 1726 bp, Sorghum bicolor
  Clone ID: SORBI-28MAY03-CLUS38_1
gcacgaggaaaaacacggtgttagatttgaaatttgtttttagaaaggtttttaaaaaaatggtcaagcgagagagatggtgacatactacctagcggcattgcaagcaaggtcaacgccgacgcgcgcatcatatactcctgctagcagccagctgctgcgtaccctacccatggtcgtcgccgtcgccgccatggcagccccctcgcagtcgcagagcgtttgcatgatcggaggagatggagaaacgagctacgccaacaacgtccgggtctctctccatcatctccatctcttgctatcaaatacaacacgattacagctcttgcttctccttttttgtcatgctgttataagttaacgtacgtacgcgtgtctgctctctgctggagactatagagtggtgtgcagagcttgctgaaacctctggtggaggaggctatagccgccctgtgcagaccggccgtgccatgccgcgtcggggtggcagacctcggctgctcctcgggccctaacgcgcttgctctcgtgtccgccgccgtcgactccctgcgccaccatcaccgccgccgtcgtcttgggtgccagtcgtcatcgtcaccagagcccaaccgccgccgacgggcggagatcagcgtgtacctcaacgacctcccggacaacgacttcaacctcgtcttcaaggcggtgccggcgttccttgagaagcacatgggagcatcaggcggtgacgacgacgacggcgatggcgatgggccgctggtgctggtgttgggtgcgccggggtccttctacggccgcctcttcgccgcccagtcgctgcacttggtgtgctcctctttcagcgtccactggctctccaaggttccacaggaactggcggatggcgtgctggtgaacaagggcaacacatgggcggggagaacgagcacgccggccgtcgccgccgcctacggccggcagttcgagcatgacttgtcgctgttcctgtcgtcgcgggccgaggaaatcgtgccaggcgggtggctggtcctctcggtcgccggccggccggggaaggacctgtccagccaggaccggcagtcggagttcaccgccgaggtgctctgcgacatggcggcccgtggcgtggtcaccgcggaggacgtcgactcgtacaacgtccccttctatgccccctgcgccgacgagctgcgcgccgcggcggagctggaggggtcgttcgaggccgtccgcgtggagagccacgccgtcctcacctgcgacggcgacccggccaagagcgccgccatggcgaggtctctccgcgtgatcagcgagtccacgctggtccggcatttcggccgggtggacgacgtcgggggcgagtttgccagggcggcggaggcgcgctacagaggccctcccgctccggtcatggaaggcgtcgttcacgtcctgtccctcaggagaaaataattaagctcaggatcgtcacgtccatggatgtatgcaagacatggccgacgacgtcgagaggctcgctcatcgtcaccatggaaatggccgatgctgacgccaatggacagcgtgcatagaattttcttccctagaggcgtgagggtataagttaaaatttcatgcatgtctcgttaccttctttgtttcttcactttaagtctctgtaatttgtactctgaatttcaacaaagttccagtaggggggtcaaacccctcctgttccatc

SEQ ID NO: 6249 - DNA, 534 bp, Sorghum bicolor
  Clone ID: SORBI-28MAY03-CLUS38471_1
ctgaatttatggtaatggtatctttaactgtcaaacatgttctcagaaagttctccaccattgccatgggatgagaaccatgcttacacaagggactcagtcgaattgtattatcaggtttgtgtggatgaatttaattttgcttgaaagtaaacccctacttcctactaagcattatgattacagtttagttaagaaaaaaagcatcgtgtgaagcctcttcattgaacattataacaaaatttgacgcttcattttgtgtatgaacaattgttgacccttttattcttttggatgtgggaaaattctgttgaggttaggtgaaccataggtgactctggcaggggagtcatcagataacaataacatgttgtactgaattccactcacaacacctgcacatttaagctgtcctgtaattaggaaatagtcacaggacatagattaagaacggacatagtttaatccatgattgtgatataattgaagcattagtattgtgatattgtcaatattcaaagtattgtcattggt

SEQ ID NO: 6250 - DNA, 671 bp, Sorghum bicolor
  Clone ID: SORBI-28MAY03-CLUS38568_1
gaggttgttgaactgtccttcacaatatgttccaatacctatctatcagaaataggcttaacacagggtattgtgatgctgattcagtctgctcctgtccgtgttctaatgcttactggcatcggcaattttggtgatgagggaatgaggggcctctcatccgcacaattcttggagacactcgtgcttgcggattgcgaaatgataactgattctgggataagtttcttatcgtgcgcaccgtccttgagcagtctcactctccaacaatgcaataaagtaactgataatggaatggctgagctggtacgttcgcagaaattggagtctttgactgttgtatgctgtcatcggatctctctgaatggcgtgcagggggctgccagatcagtacactattccgcctagtctgaaaacttcccccgttcagaagggagtacattgttccagcaaatatttacacaaaaaggggacatctcgtcatggccagggcggtacaggaagaatgaaataatctttgggcgttatgtttgcctattctttgccgttatattagtagctatatgctgtattagggaaagtagtgactttgaagacgggtgatgctatggtgtattccatccggtaactatgaagttttctgtcaaatcctcttaagttttgaagctcgt

SEQ ID NO: 6251 - DNA, 571 bp, Sorghum bicolor
  Clone ID: SORBI-28MAY03-CLUS38595_1
gtggagccctcatccagatcggagcacgaggcctagacggaacctcgcgctggtcgacgggaggggagaggcgtccggcgaccttgctcggcggctgatggcggaggacggcgaggagaagctgctcgccacggtgcagcacatcgtccagacccttggccgcaccgacaccatgacggaggatatactcaaggtcttctccaactacgacggccgcctctcgctcgacaagctctacgccacgcgcgccgctgcggccgcggtcggaggggctgctggggagcgctccgtgccggcctcgccgcccatgccgccgcccccagtggcgccgtccgccgccgcggccatgcccccggtcacgtcgctggagcggaccgtgcgcacgctggaccggcagatctcgcagttcgtcaccatggataggctcatatgggcggactcagcggacgcggacgcgttcctggaggcggtggacgacctcgtcggcaccgtgcaggagctggacgccgccgggaccaaccgcggcctgctcgaccgcgccgacgagctgctgagccgctgcatggcccgg

SEQ ID NO: 6252 - DNA, 814 bp, Sorghum bicolor
  Clone ID: SORBI-28MAY03-CLUS3860_1
cggacgcgtgggcaagaatccacaaacatatactagcagcgagggagaaagcagatcaaccagccagccagggaggaagaggccaagagggggagtgtcatggcttgcactgtcgcttccaggagggccgtcccgcttgtccgcgcgctggagaagctccttgccgcgtcgtccgcgcccggggctggctccaccctcaggccggtggcagtcgccggcggtctccgcgggtacaacaccggcgctcagcttcgacgttacgaggggcgcgagtcggaagacgatagcgtccgcgagtacgagagccggcgcggcagccgggactacgccgcgcccagcctgttctcagatgttttccgtgatccgttcagtgcgccgcagagcctcggccgcctgctgagcctgatggacgacttcgcggtggcggcgccaggccgtgccggtgcggtgcgccgtggctggaacgcgaaggaggacgaagaggcgctgcacctgagggtggacatgccgggcctgggcaaggagcacgtcaaggtgtgggcggagcagaacagcctggtgatcaagggcgagggcgagaaggagtccggcgaggacgaggacgtcccgcctccgaggtacagcggtcgcatcgagctcgcgccagaggtttacaagatggacaagatcaaggcggagatgaagaacggcgtgctcaaggtggtcgtgcccaaggtgaaggaggagcagcgcaaggacgtcttccaagtcaacgtcgagtagatttatttccaacggcagaggggcacgtactgtaccaaactagagtttctct

SEQ ID NO: 6253 - DNA, 669 bp, Sorghum bicolor
  Clone ID: SORBI-28MAY03-CLUS38123_1
gcacgaggctcatcacaaacctcgcatgaaaaaaaaaaggacaagctgattacacaagcacaaataaccacacatgttttttttttttgaggaacaaataaccacacatgttaggcaatggctagctgaaccaccagcaaagacacgtctgaccacatgactcagcaaatcacacacatacaggtccttgaagatgccgaacttttttttgttgcttgcttgcattgagtagccggattgctgctactgcggtgggtcgtccgtcgtccccggcaccggcagcaccatgccgctgaaccagtggttctcacaagggtaggcggagcagaacgtctgcagcgccgtcatgagcagcagcccgacggaggcgacgagcgtcagcatcttccacgacctgaacacgtacctcctgagcagcttcctcagcctcgccggcaagctcctgctccggtgcgcgttcaccgccgagatgacggcgtccaacctgggcaccttggtgagcctcgtcgccctcgccatcccgttccacatccccgccgcctccttgttgctcttcatgtggttcaccaccacgccgctccgccgcaggatcttcacgtccttggaggtgtcgatgatgccgttcatcagctccgtgtagcgcgccagcaccagcgggccgcgcacggc

SEQ ID NO: 6254 - DNA, 1088 bp, Sorghum bicolor
  Clone ID: SORBI-28MAY03-CLUS38138_1
gcacgaggctccctcctctccgctcctcccaggcggcgtcggtgcgggccggagatccctctctctctccctcctccgttttctccggcgcatatatgggctcgaaatcggtagacgaggtgctcgatgccgccgccgccgccggagtccattactccgcactccgtctggacggcctcaacacccaggtttccgccgcctcgtacgaggaacaaccaacgacgtctggcctggagaatggcccccgggggccctttgttattggtgttgctgggggtgcatcgtcaggcaaaagtaccgtgtgcaagatgatcattgatcagctccgtgaccagcgtgttgtggttgttacgcaggagtccttttattatggattgacggatgaagaattagtccatgtccatgattataactttgatcacccagatgcatttcatacagagctacttctctcttgtatgcaaaacttgaaacgtggcaaagctgtcgacatccctaattacaacttcaagacatacaagagtgtcccaaatgcacggggggttaatccatcggatgttattattttggaaggaattctagtttttcatgactcgcgcctcagggatttgatgaacatgaagatcttcgttgatacagatgctgacgtacggttaacaaggaggatccgtcgtgataccattgacaagggtagagatatcaaagctgtgttagatcagtactcaaaatttgttaagcctgcttttgaagacttcatcctcccaacaaagaagtatgctgatattatcatcccacgaggtggagacaatgatgtggcaattgacctaattgttcagcatattcggactaaacttggacaacatgatctttgtaaaatacaccccaatttgtatgtaattcagactacttatcagatacgaggcatgcacacaataataagggatgctgccacagcaacacatgatttcatattttatgctgatcggttgattcgattggttgtcgaacatggtcttggtcatcttcctttccaggaaaagcaggtcatcactccgactggatctgtttacactggtgtggagttctcc

SEQ ID NO: 6255 - DNA, 896 bp, Sorghum bicolor
  Clone ID: SORBI-28MAY03-CLUS38196_1
cgacgatgacaaggatggggacgacgtctcccagcccagcccccgcggcagcggatacgctggcgagcgcggaagcagcctcgatgacgaccccgaccccgaacccgcccaggattggccgcgcgacaagaagcatctccacgaggacgatgcttcctcttcctggaggaagaggaaaaaacatttcttcatcctgagcaattctggcaagccaatatattccaggtatggggatgagcacaagctagccggattttctgctacattgcaagcaatcatttcctttgttgagaacagtggtgaccatatcaaatttgtcagagctggcaaacatcagatagttttccttgtgaaggggccaatctatttagtttgtataagctgcacggaagagtcatatgaaggattgagggggcaactagagctcatgtgtggcctgttgtggcttagtctgtcaatggctgctttgagaagaatcccagatttgatatggcaacattgcttggtggcacggatgcagttttccaatctcttatacatgcattcagctggaatcctgcgacttttcttcatgcctacacatgccttcctcttgctcaatcaacaaggcaggcagctagtgcagttttgcaggacgttgctgattcaggggttttatttgtgctattgatgtgtgagcacaaggttattagtcttgttggagcacaaaaggcaactttgcatcctgatgatattttattacttgacaatttcattctgtcctcagaatcttttagaacttcagagtcttttgtacccatatgtttgccaagatacaatcctatggcctacttgcatgcttatgttcatttttttgacgaacatacatatgtggctttgcttactacgcgatcaga

SEQ ID NO: 6256 - DNA, 660 bp, Sorghum bicolor
  Clone ID: SORBI-28MAY03-CLUS38197_1
gcacgaggagtctattttgtgggatctgaatgtcggtcttgaacctttgtggcaagagttaagtgattgtataagtgccacagaggcaaaatttgtacacaattcatcactcgcttcccatgccccattgatgcacgcggtagaagttggggcttcatcctctggttcatcttcgcttcctccaggcactcaacgcttgttgccgttcatagaatcgttctttgtcctatgcgagaagcttcaaacaaatcaaccagttacactgtcggattacagtgttactgcccctgaagtaaaagaatctgctggaagttcatcttcaccatcattgaagactagtgggatctgcaatgttacttttataagggttgcagaaaagcatcgacggctactcaatgtttttattcgacaaaatcctagcttactggagaagtcactttctatgatgttgaaagtgccaaggctgatagattttgacaacaaacgtgcttacttccggtcgcgaatcagacaacagcatgatcagcatctttcagctcctctacgcattagtgttcgcagggcttatgttttggaggattcatataatcagttgagattacgtcgtacccaggatctcaaaggtcgtttgactgtgcaatttcaaggggaagagggcat

SEQ ID NO: 6257 - DNA, 612 bp, Sorghum bicolor
  Clone ID: SORBI-28MAY03-CLUS38206_1
gcacgaggcacgttcgctgtgtgaggcccggccggccacgactcccgtccccttctctcaggctctgcgcgaaagcgaaacgagtccacacgagccgcgcggcgtcgccgtccgtggtccgccgccgctcgccggagtagcagccgtagcagggggcaggctagaggcggcggatggggatcctgggcaaaggctcggggtggtgcttctgctcccgcggggccaagctggagcggatcaagtccagcctcctcgccgcaaagggcgccgccgtagccgccgtatccttccccagcggcggcggcggaggaggagctggagggaaaggtgggagtgggttcctcatccaccgcggcctcctgctcaccacgcacggcaccattccctcggccgccgcggcggccatcgccgaggtccggctcagccacggccgcctcctagctcgcctggtgccgcagaggttttttattaccagttctattcttgaccttacaatagttggccttgacgttgtggatgatgacctgagttcacatgggcagcagcctcattttttgaaaacttgcttgaaccccagcttggaccttggcagtacagttttgctactgggcc

SEQ ID NO: 6258 - DNA, 947 bp, Sorghum bicolor
  Clone ID: SORBI-28MAY03-CLUS38210_1
cacgagggcagccccccagcagctcccccagcacgtccctccagcgcaggtccccaccacccgctcgccactggacgcacttcaccatcggcgtcaacgtccgcctgctcgactagctccgctatcaccggcgcggtccttcgttccggtgtcggtggtcgcgctgcggtcgagccagtcgtcccagtgtctgccacgggccaatcctgtgtcgtgggcaggagcgccgccgcgaggtgcgcgataggggtaagatgggaggccgcgaggtggaggacagtcggggtgaggtgcggcgccaccgccaccgcttctgctggatttcgccacgagtggctctgcggctgctcaccagcgatgaatctcgtcggttctggggtgtggagtaggagcactgcctcttcgagaaaagcccgacccctcctgctgccgcgtgcagcagcgaaggacctgcttgaggagttcgaggaggaggcaattgaaggcgagagcatccagagcctcatcttcatggccctttctctcctaacgagctggaatagctagcacgaggaggaggctatagcaggccccaacactgatttaggatgaccccgtgctgtccactaagcagctaatggtgtgaagtaatatgatcttgtcgaacggaaagggccagttgctgaaaagggctccaactttgcagctctgaaggttcattttgactgcatataccgcagcatcaacacagtgtcaagctgcgagtccaaactccaagcaaggccaggagtatcacccacgtgacatggcaaaccatacctgatctttgtgttagttttgctactcatgctctaattattcatcttttatgaagattcatgtagcagtgatattgcgaacatcgttttggaaatgttatttttaagataacgatataacccacgtttatatttatattatcatgttat

SEQ ID NO: 6259 - DNA, 1234 bp, Sorghum bicolor
  unsure (1)..(1234): unsure at all n locations
  Clone ID: SORBI-28MAY03-CLUS3886_1
aagcgagcaacgttagtgtggtagtaacatggtgactgtgagagaggagatgcgtaaagggccatggacagagcaggaggacatgcaactggtatgcactgtccgcctctttggtgaccgtcgttgggacttcattgcccaagtctcaggtttgaggggttgggaaactacaacttaggtagctattttgctattcttagcgcaaagtcgcaaacataaatgtcttcctgtctaaccagccctcttcatactatatgttctctatgttcatgcaggcctcaacaggacaggaaagagctgccgcctgcggtgggtgaactaccttcatcctggcctcaagcatggccgcatgtcaccacaagaagaacgccttattattgagctccatgctcggtgggggaacaggtggtctaggatagcacggaggctgccagggcgtacagacaacgagatcaagaactactggagaacacacatgagaaagaaagcacaggagaggaagatgagcatgtcatcaccttcatcctcatgctcctcactgacataccaagcctgccatcttgacactgttccagtcattgggatgagcagtggtgacactcacaatggtggctgcgtcaccagcgccctcgagaacacacagagtgtcatgggtggataccccatggaccagatatggaaggagattgaggcacctcaggcacctgccttgctgggtattgctgaagggaaagagaagacatgccgtccgatcccctgtcatctaccatcatctgctatgtgggactacaaatatcctgaggtattctggaagatggaagatcaagaaatcatgatgtgatagaagatgaagaaaccttgatgttggcttatttggttatggtaaataaggccctcactattgaaagctgaaggaatacatctatattggtcaggccactcggctatctgcctagcagatttgcagtacttgtacttcctagctatgcttgcattagtatgggtttcagtattttaaaatatacagtgatactggaggtatgcttatgatgtatgtatctattagtgtgcaaaatagtttgtatcagtttgtggaatagtgtgcaatacaaggacgctctatatgcatcatgtacttatttatctctgttgntattgcgccgaacaaatagcagcataatcttgtttgcagttattattcaatagaatatgaatttgatgccaaatgaatatt

SEQ ID NO: 6260 - DNA, 787 bp, Sorghum bicolor
  unsure (1)..(787): unsure at all n locations
  Clone ID: SORBI-28MAY03-CLUS38838_1
taactggcttgtggcagccaagcgttcatagcgacgttgctttttgatccttcgatgtcggctcttcctatcattgtgatgctaactccacctctccatcacagtcagtgaaccaagctgctgttggcagcttgccaccatctttggaacactactattgtacagccaaggcgcaacacaaggttgacacattacggagatgcatccatgctctggaagcacagacagtgattgcatttatgaacaacaccaagccactgaaggatgttgtattcaagttggaggcacgcggtatcaaagccactgagctacatggagatcttggaaagctcgcaaggtctacagttttgaaaaagttcaaggatggtgaattcagagttctcgttacgaatgagctgtctgccagaggactggacgtgccagaatgtgaccttgtggttaatctggaccttccaactgactctacacattacgcccacagagctggtagaaccgggcgtcttgggcggaaagggattgtggtcacaatatgcgaagaaaacgagggatttgttgtaagaaaaatgcgcaagcagttagctgtggccatcaagccatgcgagttcactgaaggcgagcttgttgttcacaaggaggatgtggaataaaatcttcatagtgcacattgactacctctgtttacctgtagtgttttgtaatagtatcgtacattaaaatgctgtcctttggccctttgcttgtcctgctgaattttcaccattgcctgggtntaaagtattggaaacca

SEQ ID NO: 6261 - DNA, 650 bp, Sorghum bicolor
  Clone ID: SORBI-28MAY03-CLUS38910_1
ccgtccttctcggtgttgtcctcgctgttggtacctggatcgctcttaccaccatgtacgccaactccgaggacggtggtatcgtccagaacttcggtaagatcgacgaggttctcttcctcgagatctctctcactgagaactggctcatcttcatcacccgtgccaacggtcccttctggtcctccatcccctcttggcagctgtccggcgccatcctggtcgtcgacatccttgccaccctcttctgtatcttcggttggttcgttggtggccagaccagcatcgtcgccgtcgtccgtatctggattttctccttcggtgtcttctgcgtcatgggtggtctctactacttcatgcagggcagcactggattcgacaacctcatgcacggcaagtcccccaagcagaaccagaagcagcgatccctcgaggacttcgttgtctctcttcagcgtgtttctacccagcacgagaagtctcagtaaactagatggtatatacccggaccaccatcgcccggacttttcactttcgctctgtccaaatttgaactgtattactcgcacccgagtattaagactcctggagtggttgaggaaactttcatacccctagagaacgtctactagacacctaataatacaagt

SEQ ID NO: 6262 - DNA, 500 bp, Sorghum bicolor
  Clone ID: SORBI-28MAY03-CLUS38923_1
gcacgagggtattttcagatttttcaagcttaggaactgggaaggaaacagaagatcccatgctattacagcagctatctgatgcttgcttggtggttgatgcactggagccatctgtaagggaagaactagtgaagaacttttgcagcaaggaactcacctcatataggcagatctttgaaggagcagaacttgccaaattagacaagactgaaagaagatatgcgtggattaaacgtcgactaaggtcaaatgaagacacctggaaaatatttccactttcctggcatgtcgactatctgctgtgtatccagttctgtaagattacaagggcccagcttgttgatatccttaataatctcaaagaaaaaccagatgtggcaactttgttattggcgttccagagaacccttgaatttgaggaagaattggcagagaaattcagtggtggaactacgaatgctagaaataaagagacagcaagtgatgaccaagatgag

SEQ ID NO: 6263 - DNA, 492 bp, Sorghum bicolor
  Clone ID: SORBI-28MAY03-CLUS38936_1
gcacgaggcttcgctgattcaggaaggggaagaccatggcgtcctccgccgcggctccgagcggcgcgccaccggctgggaagcgcccggcctccagcggacgggagggagatcagatggtcatcacgccgctgggcgccggcagcgaggtcggccgctcctgcgtccacatgaccttcaagggccgcaccgtcctcttcgactgcggcatccacccggcgtactctggcatggcggcgctgccatacttcgacgagatcgatccgtccaccatagacgtgctcctcatcacccactttcacttggaccatgctgcctcgctgccgtacttcctggagaagactacattcaagggcagggtgtttatgacccacgccacaaaggctatttacaggctgctgctctcagattatgtcaaggtcagcaaagtgtccgtggaagatatgttgtatgatgagaatgacattgctcgctccatggaaaaatcgaggg

SEQ ID NO: 6264 - DNA, 644 bp, Sorghum bicolor
  Clone ID: SORBI-28MAY03-CLUS38340_1
cagttcagttgcgctgcatttggaaggcgagggcctgcactggtggtggagcaagagcaacagccgcggccgcggcgggaggtttggcgcgagagcagcgcaccgtatggcgggatcaggggaggggggaaacggcggcgtgccggcgggaggtgaagtcgcgatggcgccgggcgtggtgactggcggcgaggaggacgcctacggcgaggatcgcgccaccgaggaccagcctgtcactccgtgggccgtctgcatagcaagtggtcactccctgctgagggatccaaggcacaataaagggctctcgttcacggagaaagagcgggaagcgcactacctgcgaggattattgcctccggtagtgctatctcaggacctccaggagaagaggatgttgcagaatgtgcggcaattccaggtcccgttgcagcgctactctgcgctaatggaccttcaggagagaaatgagaggctgttttacaagctcctgattgacaatgtagaagaactacttcctgttgtgtatacaccaacagtgggggaagcttgccagaagtatgggtcgatcttcagacgaccgcagggcttatatgtcagcctgaaggataaggggaggatcttggaggtactgagaaactggc

SEQ ID NO: 6265 - DNA, 851 bp, Sorghum bicolor
  unsure (1)..(851): unsure at all n locations
  Clone ID: SORBI-28MAY03-CLUS38360_1
ggaattcgagccatgcctccacttacagctaatgggtcgttgccactgttgggttgtttggacgatttactaggcaagaagagcaactgcacattttggctagttggtggacttggtgcaagaggtcttctgtatcatggtttagttggaaagttgactgccaaagctgtgatttcctgtgatgaaaacataataccttctgagttcacatgctggaatacaattaagccttagtgaaagctgagatgtggtctaaacttcaagcatgccgttcttcatctgtaggaaatggaacccttgtagatagccaaagtctgacaaggatggtgcaagacccatggtgatcctggtgcagtgagccagtcactactgctgtccgtccatgtaaacacaaatgccaccacaactctgcaagtaagatgaggttctgcttcagatgcctgagcttgtgttcaaagaattgtgactagcttgtatgtttccctggtgaactcaaatggcagcgctgaagcttggttgagttgcaagactctttctgtcctaggaaacgattggttatcagtggagcataggtccgtctacacatgttcctatacttccatattactctgagacccctttgtgtttctttttctaatttcctactgttagttgaatcatcacttctgtaaacctctcaaaggttatgagttttgcatgagtagagtgttcagaccagtaaagtattctggcattcactaaccagttagatgagatagtgagattgttgctttcaaactagcaaccattttgcatttaccatgtttgatgttatgttctcatgatttaattgattcgcaactgtaagaang

SEQ ID NO: 6266 - DNA, 625 bp, Sorghum bicolor
  Clone ID: SORBI-28MAY03-CLUS38369_1
ttctttttgggtggtaccgtttcaaaatcaagcatttctcttccatatcaccaattcaagattttcatctcatcagcacagaagtttcattataaggcccaagtttttatcagtgatgcgatggaatccaacaaatatagcagtggtttgtcgaacgagccagttacatttatcttggcagatcttcttctcatttctccaatgtggatcgcttggttcatttattcaacatggttcagctcaaggaaatgacaacttgtcggaaaacaggagctgtgcagtctttttttttctttgggggggggggggggggggtgttccaaaggtatagaagtacgaaatatgtgaaatatttgcaatcaccaggaggtttcagtaatattttgtaactgtttgttgaaacaaaatattttgtaactgttctcgatatagaactcagttatcgtatgtaaatgtacgatggattaggggtgggcaaaatacatgaacttatcgtgtgcagtatggtggactaggggtgggcaaaatacatatccaatccccgaattaccaaaacctagacttgaagtacttgaatccaaattcccgatgaaaataatttcgatagtactatacctaaaaaagg

SEQ ID NO: 6267 - DNA, 589 bp, Sorghum bicolor
  Clone ID: SORBI-28MAY03-CLUS38413_1
gcggggctgctggcggtggagtcggcgcaggacgcggtgatccggacgctgctgtacgagcacgggacggcgcgggtgtccagctacggggtcggggtggcggaggtgacggcgcacatctcggacctccggaacacgctggggaggaggggcgtcaaggacgagggcctggtggtggcgcccgagctggggcccgagggcctcaccgtggggaacgtcatcgccggcgaccacctctcgctcgcctacgaccgcacgccagaggagatcctcggcatcgtgtacggcaccggtaaccccgcccagcacggcggcttcttcccgcagggcgccgacggccgcatcgccagggggctcctcgcgtaagcagcagagggatgaagttgtcccctgcacagcacggcgcaggctgtagactagtactagtagtatactatactatacatgtttctgtgttggcgtatgtagttgtggtgtgcccttgagtgtgtgtgcgcgcgcgcgtgtaaactggaggatatacatcaatgttggtggaaataaataaagtaaataaagggttgatgccctatacgcaaaagtcgggcgg

SEQ ID NO: 6268 - DNA, 698 bp, Sorghum bicolor
  Clone ID: SORBI-28MAY03-CLUS3845_1
cgtccgtccaaagcaggcactgtcagcagcgacgaggcagcggacgacagccgcgaccgcgagcggagcaggggaggggaagggaatggaggaggagcaggggaggttgacgacgatgacgccgggggtcctcaggttgttcggcgtggacgtccgctggggcgacggaggggaaccggaggagttgccgatggacctgaaaaagagctccagcatgcccaacctcaccatccaccagccgctgctgccgccgggggaggccggagacggcaaggggtacgcctccgacgacgcggagctggcgtccggccagcagaagcgccgccgccgcaaggcacaggagaggaagaaaggaattccatggacggaggaggagcacaagaaattcctggaaggcctaaggaatctgggcaagggggactggaggggcatctccaagggcttcgtcaccaccaggacggcgacgcaggtggccagccatgcccagaagtacttcctccggcagaccaaccccggcaagaagaagcgccgggcgagcctcttcgacgtcggcatcgctgacttcaactacatggacgatcaggtgccaagccctcagagaagcattgttaccaagccggctcctacgcaggagataattcataccgaccgtggcgatgtgccctatagaggcgacttcggggagattttaggcaata

SEQ ID NO: 6269 - DNA, 1137 bp, Sorghum bicolor
  Clone ID: SORBI-28MAY03-CLUS38446_1
gcgcggggattctgtctctggtggagtctgctcgaggtccctccgcaggccccgggccaccacctcctgcaacatgcatcggcgaggttgctcggccgcgggccgtggaccgtctcgtgaggttggcagtccctcccggtccggagggcgtctcgcccactgacgcagttctcaacgcgccgcgcggggaggtccggctggtccttgtcgccactctacctgcagtgactccatccgccgtgccggcccgccatgcgcgcgcagcgggtcctcccgggttcccccgcccgttggtccgcgctctcctggctttggcgttgacgagggcgtttcagctccggccgcctttttgcctgtccacggctcccgcccttcgggtggtgcctgtccctcctccgcagtcatcattgtctgtgcctgttggtgctgcggctgttaggtgcttgtcgaatggcttggggatcgttactgcccgccagctggtatggaagggtgaaaatgactggcttgaaattactgatggtgtagttggcaagcgtggagaaatgcactcgttaaatccaagtatcacagtgaaagaaagtggtgatattttatctcttgaggagaaatttcaaggtggcactggaatcaactagacaccacctcctgcaacaactatgggcgaggatgctctgtagaggtgcaagaagagtatcgagatgatggcaagtgctctaggtttggaaggcttctcgcgcattgatgcatttgtcaacgtgcgaagcggggaggtgctgctgatcgaagtgaacactgtacctggaatgactccatccatcgtgctgatccaccaagctagctaagggctgggtcacagaaaaactgtattatctgcccactgtttttgttgctgtggcagcagcagcaaaacttatcatgacaataatgtgtggtatggtggcaatcaatcgcaggcactcgcagaggaacctcccgtgtaccctcacaagtttttccgcactcttctggatttggcgtttacaagggcgaaatagctcagtcagccatttatttattttacttacttgtaccgtgcatcggtttgattctctgtatcagtaaagcagacaacattgtcattgtgaggagagtgct

SEQ ID NO: 6270 - DNA, 612 bp, Sorghum bicolor
  Clone ID: SORBI-28MAY03-CLUS39001_1
acacataccgtgccctcctccccgaaggcacgcctcttgagtttcagcggatacttgacctcaagggcttgaagaaagcagaccaacaaactatcctggaggacttcaacaaacacgcccctgccccagcccccgccatcaaacaccctgtcgttgctccgacggtcgcgccaccagttgccacagcatctgtccagatagtaccctcggtggcaactccagccgtttcaatgacgccaagcatggcctccttgaagggagcattggcgaaccaagaggacgttctggcccgagctgccgcgcttgggcgcggagcagccaccacaggtttcaagaggttccttgcattgacggaggcggccaaagatcggaaggacgggccgttccgcaagctcttcaacgcgtaaaatgttgctcgccgttgtgttcatagttggcgcccgtcatgcagtgcacatagatataggaaattctttccacactgtgtacaccgttactgctgttaaccgtcagtgtataacaaccattttgacagaatatcccatcctgcggagagcgagtagctcagttgtagcatggagattttgagatagtttaagctatgagataaga

SEQ ID NO: 6271 - DNA, 608 bp, Sorghum bicolor
  unsure (1)..(608): unsure at all n locations
  Clone ID: SORBI-28MAY03-CLUS39017_1
gttnatcggatcttgtgagtggattggagccattgagctaagctttgtcctcgacaaactgctgggcgttagttgtaaggttatcaatgtgagatctggcgatgagcttcctgaaaagtgcagagaacttgccaggcattttgacacccagggaactcctgtgatgattggtggtggagtcttggcttacacccttatcggagttgattataacgaagccagtggagactgtgcatttcttatccttgatccgcactacactggtactgacgatctgaaaaagattgtaaatggcgggtggtgcggatggaagaagtctgtcgacagcaaaggccgaagcttcttcttaaaagacaagttctacaacctcctactaccccaaaggccaaacatggtgtgaaacctatggtgttcaatatgttactagtgcatgttcttgcaatagtcggtgttatgttattttttaaaaaaagcctcatagattggaagtcatgatttgtaaagttgttaaatgagacatattttttttataaatatgtagtgattagtaaatttgtagcaccctaaaacatcattttttttaaaaaatagtggtgttctcattatgc

SEQ ID NO: 6272 - DNA, 768 bp, Sorghum bicolor
  Clone ID: SORBI-28MAY03-CLUS39027_1
aggaactattcaagtacgccaatcattttgaagaagaaaagcacaggaagttctgttcttgaagaaagcacgataggagcatgccagcagttgggcagctcatcagatgatttgtcagaggatgaaccaaatatcaacccagatatagatggcacatatgtgtttaatgaacatctagacagtttcagaagggagattcaggagcttcttgtttgctacgcctgccctgttccgcttggtaatttcgagagtttatatgagcagcggtacaagaagataattgactatgagagcttcggagtcactggtctggaggagctagttgagaaggtgaaagatgtggtagatttgcatgaggaccaagccagcaaaagcaagttccttattgcaaactacaccactggttagactaattttctgttgtcttgatgtcctagttcagctcctaaagtacttcagctcaagtttcctgaacatgtgttacacatggccggcatcttttttttaccgtgccggtacgataagtgtggatggcatagtaagtgtttgtaaaagctaatctctgcaaacggagagttgtttcttctacgcaaaaggaggattatacgaaagaacagtgaccatttattagttactttgcaaatacatctaattccagttcagtcaaggatgcttccttgttgcttcaggggttagactgtgaatagtgttattgtaaaatggctaaatacggtttgaaaggatcatcagttcgttgccatcatttgt

SEQ ID NO: 6273 - DNA, 628 bp, Sorghum bicolor
  Clone ID: SORBI-28MAY03-CLUS39038_1
ggatggatcggtggtatatgctagtactacctaggaacgctgaaaaccgcttccgggattgggcgtcggccgcgtgcggcggtcgccatcggacacgatggggacggtgacggccatcaggcacaggcaggcatgggatcatcagataacgcaagtgaagtccgtgtacagattcttcttcagctagtagggccagatcccaagaagccggaagacaagaccaaaaacacaaaattaggcatagccgcgtaggtgtcagtcagtctaagctacgtactccagtaggcatcagatgacccactcagcgcagcgccacaaagaagtagcgctgcttaattgtaaaacaaaaccattttttttcttctccttcttcttttttagtagatttttttatgagccactaagccagccagacaacacctataggatggagagaagaaccatgattgggattgtaagattgctagctaggttgtccgcctgaaagcaggctggcagctaggccgaataatccttggacggatggatggattggatgcatcgccggagtcaaaaggaaaccacgtcggcttcccgcccgcagccaaggcccgggacggcgacccctctcgccttgtatttgttttcg

SEQ ID NO: 6274 - DNA, 804 bp, Sorghum bicolor
  Clone ID: SORBI-28MAY03-CLUS39044_1
gaggctgagtgtagggaccctccagtagcttttcggcatatggattgtagcagtgaaggacagtcgagctcgtcacctgctgagatactggagtatggaggtcaagaccagtacagcagcgaggaggaaacgatgtactcagctgaaaccatggaaagcaggaacattccaagccccagggagaaacatgtggggaggagccagagctgtgtcacctacagaaggtggagctctccaaggacctcatcagtgcagaatggaaccttgcgaaagcagcatacactgatccctgtgcggaagacacactcgcagaacacggctctgccacagaggagtcatgactacttaagcccaacagtctcctcagccatgaagaagaggaactccatggaacagcagcagcccgcaaagcctcgacggagcactgtccagtcttctccaaaatggatgttttgatggttctatctatatctagttttgtggtggaaacaatggagcaagcaaatgcctactcggtgaaaacctactgctcctatgtttcctactcaaaacttacctgtaagtcgatgctctcttccctcggttctctacttctctctctggaattcctgtgtgcagaatggcatggataaataaagagaaacgaaaaggaaaagaaaagtaaaaaatcatcacaaaaggttacaaatgatatgtgttgaaggcagcatttgtgagctgcgataagggctgttatcttggtgtgtagattggataagaactggtacagactctagtgttcagcttacaattttgaaataaaca

SEQ ID NO: 6275 - DNA, 503 bp, Sorghum bicolor
  Clone ID: SORBI-28MAY03-CLUS42814_1
ctcttctgcacgaggggccgcgggattccgagtcccaatccggcgtcgcccgccaccgtcgcctcgccggctacaggggtccggtccccgcgatggagccctcgccaacttcctcctcctcctcgccggccgtggcgcggcggttattgccggaggtaaggagggtgcggaagcgggcgctggaggaggtgctggagcaggtccagcgggccgttgagatgctgcgcgacgccgacgctgatctcggcgtctctctgtcggaggacaccgcagcagccccgccggaaggcgaggaggaccgcaagggccatgtcggtgtcgatggagatgacgtggcgacgtcggcgtcggttgcgagtgactccgattacgagacggcacagatgtgtgaccttcttaaatctaaggttggatcgctcgagttccttcacaagctcaatggtattcagaagtctgtacatcaaaatagtgcagttgaacctgatacatcatgggatataata

SEQ ID NO: 6276 - DNA, 702 bp, Sorghum bicolor
  unsure (1)..(702): unsure at all n locations
  Clone ID: SORBI-28MAY03-CLUS42960_1
tggcctatttacttcaagcccgggaacaccaagccctgatccgaaaacatggtcagctttccctgaagagccaaaagctcaagcagctgtgaagagtgtccaccncaggtcagtccgaactctgcgcgcatcaaacagcaacaaagccagctcgcttggacagtcaaatataagttctagcaccgatccatttgcctttggtcaagatagctttaaggctgctccttctggaactgtacttccccagctatcaagcatggggaatacttctcaggtaaataatctgaatgtagaagaaaagaaagatggatcctaccaaccagctggatggactgggttttgattgtgctatagcaatttacggtgatactatatatgtgccaaaagattcaagagtacatatggtcttggtggtgtggcatactgaagatgcagagaggaatgcctgatctgatgtaggtatgtgtggcaacgcttttgtacaattgttctggtgctgagctagcatcataatgcatccagttgtaactttagtgcaaatgtaagttgcaaataattgctagattagaaataggaagatgtttttttccttctgtaggcgtgcttgtcgtgtcatgtctgttcccgatgccctgcgcacgcaggccatatagttataaccatctattgccatgtcatgaataaaaaggttaccatttagtg

SEQ ID NO: 6277 - DNA, 599 bp, Sorghum bicolor
  Clone ID: SORBI-28MAY03-CLUS43093_1
tcaggccagccgcagcaccaccaggaagccgccatgcaagtgtcactcccggacgcttcgctgccgcaatggccgccgcggctagagcatgagccgtcgccaatgctgtcggccgggctcgggctcgggctgccatacgactccacaggggctcaggtgtgcttgccggagctcatgatgggtcagtcgtctctgttcagcgggaagccggctacactggacttcctggggctcggaatgagcccgacgggcgcgccagcaagcagaggtatccccgcgttcatccagcccatcggcggcgctgtcggcatggccgggaccggagctggcgccgccgagacgtttggcgccggacgtggcccgcaggcgacgccatgggagaggaatccgagtagctcgccaatcctgtaacacacttggatggatagcaagtagttgttgaaccccaagcgctgtgattttgggcaaaggagggatcgggagaggaaacaatagacgccaggttggattagcagctagtagtctcttccactgtcagttcttgctgttcttttgtttcttttagctcggtacgaagttacgagtactcctagaacaag

SEQ ID NO: 6278 - DNA, 823 bp, Sorghum bicolor
  unsure (1)..(823): unsure at all n locations
  Clone ID: SORBI-28MAY03-CLUS42910_1
ctgcatgcacaatgtgcattgaagcacaacatagactagcctntgagagattaaacgggagaggatccttcactttcaaggctaaggtgccagctgaacctaaaaagacttgctacaggacaggtgtttggaaccgtgaggatggggcccatgttgaggaggttcttctagttattgctgcaaaagggggtgtactaactcagcgtgttccaaacaacatcaagctccccattgatggcttttttactataaatatggatgatattggtggctatcagatgatgcgtattatctatgcacatggtccaatcattggaagcttatgggctgcaaatggatactatgacagcataactggtgaccatgtgtacagaagagtacgagagaagttcaggaagtcagaggatggtggccaacatgctgtagtttgctttggttataaattcaataagagagccaaggaatcacatatacacataatggataatcatacagaggacggacctttgaggtggatagatttttcagccttcgactattttttcgttcctctggtcacgcctgttgaacttcatcaattacacagaaagaaaaggaaagaaaatcagactattgaagcatgtgtcacccgatgtctttctgcatgggagaagaggattatgctttggctcattgcccgtgagattgagagatattatcgacatccaaggagaaaagatcattatgtgcagattgcccgggttacaccaatgagatgatagaaataaacttttctattattattgtcttgattcttgaacaaatcaaacattgtcattctgca

SEQ ID NO: 6279 - DNA, 636 bp, Sorghum bicolor
  Clone ID: SORBI-28MAY03-CLUS43096_1
gatggactgatgatgaggagaagctattccaaagagttgttttcttagctcctctctccccgggcatgatctcctgggagcgcctgccggagccctgtccgggggatccttgcctggggcgtctgtgctccttgctggtggctgccgtcctctgccaaagcgcccgcctgcgcaggccagtccggtggcctctgcacaagatgtttatggccaagataatggagctcagtgtgaagagtttcacatgtcactgccgaatgatacttaaaacaattttggggatcaaagtgcatctgtgtaggagatgtgtcaaatggatagcagagacttattcggtttgaatctgacatctacttcagatgggtgcttgtcattgagatgctgtttggccatggctcggagccgtaaattgagccacatctggagatgatagttcatgaagttgtacattcttcaactactatgtgttttttgcggcattttgttagcacattgggaacccaactgagcttcaatctgccccctccctcacccccgttcgttagatcaaccttgttgtattgtatgtaccatatgttgtattttcattgttgtatgttcattccagaaactggaatacgagatcgtagagttgcc

SEQ ID NO: 6280 - DNA, 474 bp, Sorghum bicolor
  Clone ID: SORBI-28MAY03-CLUS39245_1
ttcggcacgaggcccaatcggaacccggacccagatctccgaaaaatccccaataacaatctgcggtccgccgttgtgattacaccttccaatccgatcccaagtctgttcgatgcgaatagcagcggcgatttagcgaaccgcgcgttcgctagggttagggtttcgagggtttgcgctagggtttgggcgcaggatggggcggtcgagaggggtgccgaattccggtgacgatgacaccggacacaggtcgaagcggaggagggtctcggggtcgggcggggacgcgacggactccatttcagccgccatcgggggagctggagagggagggggcaagaaggcgctctaccactgcaactactgcaacaaggacatctccgggaagatacggatcaaatgctccaagtgccctgacttcgacctctgcgtggagtgcttctctgttggcgctgaagttaccccacaccgcag

SEQ ID NO: 6281 - DNA, 520 bp, Sorghum bicolor
  Clone ID: SORBI-28MAY03-CLUS39264_1
gcacgaggcctaccctggcctccgctgcgcgtcccatggcgtcgtacctcgccgccttccaccccactctttccccggaccccataacccatccgcatcgctgccctgcgcgccccaaccccaccaccggcctcctccgcctcctcccgtcccgccaccgcgctcgcccccccgcggccgtccgcctcgccgtttctgcctcctcgacctccgccccgcctccatcggcggatcggtcggaggccgcgtcgtcgctggagagatgcctctcggcgacggtgtcgggggcggggatgggaacgggggcggcgccaccagcctcggccccgccgcgcgccccgccggcgatgaaggggggacggaagcagtacggcgcgttcggcgccgtcacgctcgagaaggccaagctcgatctctcccagcggcgcaagaagatcatgcctgagctggcaacaggtggtggtggtggagatattggaaaaaggatcggtcatggtgggggtgatggtggtgatgatga

SEQ ID NO: 6282 - DNA, 924 bp, Sorghum bicolor
  Clone ID: SORBI-28MAY03-CLUS39292_1
gcacgaggcacgatccgcccttcccagacgccgccgccgccgccgcgaacgagatggcggcagcccttttgcttcgcggtctccgctcatcggcgagccgggcacatatccactctctttcccacgcctcctccccgtcggctctggggtcttcccttctacgccgcctctactcctctgcggcggcgtcaaccgccgcctcgcctgctttcacgcccgccggcgtcatggacccgtcccgcatccgcaacgtggcagtgatagcccacgtcgaccatgggaagacgacgctcatggatcggcttctgcgacagtgcggggccgatatcccccacgagcgcgccatggattccatcagccttgagcgcgagcgcggcatcaccagcgcctccatggttacttctgtctcttggaaggaaaatgaactcaacatggtcgatacacctggccacgctgattttggtggtgaggttgaacgagttgttggaatggtggaaggagctgtcttggttgttgatgctggagagggacctttagcacaaactaaatttgtgctttcaaaggctttgaagtatggcttgcgcccaattcttctcctcaacaaggttgataggccttcagtttctgaagaaacctgcaatgaagtagagagcttggtttttgatctttttgcaaaccttggtgctacagaagaacaggtacatttcccggttctttatgcgtccgctaaagaggggtgggcttccttaactttcactaagagcccccctgataatgcaaagaatatgtcttcgttgctggattccattgtacagcatgttccttcaccaaaagctgatcttgaggctccattcctaatgttggtttccatgatggaacgagatttttatctatgacgaatactcactgggagagtaagatctg

SEQ ID NO: 6283 - DNA, 653 bp, Sorghum bicolor
  Clone ID: SORBI-28MAY03-CLUS39320_1
aaccccgagccagctgacaatgcaaggtctggaaacaaggggaagaggaagaaagatgcggattcatgagcatcgtactgacagtgctcctggctatctctgtagattctatctacatttagaagcttctcagttctccggcagcttaacaacgcggtcaggtagattggagatttagatgatagtgatacaggtcacaacctatgtgtggcctcttactgtagattccggtgtcccagcaaaggtgcagtcatgttttacccgtttcagtcttgtcctacttaccggccctgtcattgcgcgacttctgttgttgctaaggtttaatctctgtaaattttattcgagggatggcaccggctagcgctggtgtttgaactgttgcctgatgggttgctctgttctaggggattagatgagatttgctaggtcggtaggatttaccccatttctaccctgcttcattttattttagtggcagcagtgggtagtcgtagttcttggttctttggtgctgggcattgtttgcagatgtcccctgcagcatctgactgcgttagggaataacatgaggagtgctaatattttttttgacatagaagttgtaactaaaccgaaactaataatgatgaatgaaaatgaatccctattcc

SEQ ID NO: 6284 - DNA, 661 bp, Sorghum bicolor
  Clone ID: SORBI-28MAY03-CLUS39296_1
gtggtgagattgattgggtatctcctgagccagagaagtcagtgttgaggccaaattacttcaggtacttccgtcgtgggcagaatgagaaggccaaggagggtgactttgtgattgagaagcctaagaaagtgaaaattgcagagcatgataagttactgaggaagttcaggcacaaggatgctctggtttcagcattggccaagaacaacccgaggagtgttgtggctgtgatggaggagctggttgcaagaagaaagctcatgagatgcattgggaatttggataatgaggaacttggtcttcttttggagttccttcaccggaatgcaactttgccaaggtatgctaagttgctgttgtgtttggcaaacaaggttgtggagatgcgcgaggctgatatccgatctgatgagaagcttagggtgcacatgaggaatcttaagagaatggttgcagaggagattcagatacagcacacactgcagggggttcaaggcatgatttcaccaatgctcgcacttgcaaccagatgaaaaaggtgcttttgtttcaaaaaaggagtttttgttatatgttagtttgcaggaggccgccgcacgcaatatgtactgctttgaaaaatgatgtttgttattggatagtgaagtatgcctgccag

SEQ ID NO: 6285 - DNA, 761 bp, Sorghum bicolor
  Clone ID: SORBI-28MAY03-CLUS39485_1
tctgggcaacatccgccagcatatgctggtggttatctgggggataccagcctacaccacatggacctcaacagtggcagcagcgaccttatggaggtggagcaccccccacaagacctaactcacaccaatcacaaaaccgttatggctccttagatagaagttctaacaagaggtcctcaggtcatggccgacactaatccctaaacccatagggccttatatttgaatattaaggggaaatataataatggatccaaatccttgacaaatcacttagcaatgccttcatccagacaaccccttactgttgtggccctattcttgctagtaacaaatcaataccttaatacaaaaccccccactactgttatagtccagttactgttgttagtaaaacttttctagtatcaagaatgatgtcaccatagccagttacctgttacaagcttctaggtcgacttattaaggactccaaggagcaaatgttgtatactagctttgttgccagaccatcagcaattggtggcgtcagtgttctttcatttgtggttctcattgtttcgtagtaagtagcatgggggttgggtaggtaggtgatcaaaaaattttgaactgtggtgatagtgtatgtaacatatgtatttgtttcctaagatggtagtaataaaatcttgatttctaaaaaaaaaaaaccacaaaaaaaaaaaaaaaaaaaaaaaaaaaaaaaaaaaaacaaaaaaaaaaaaaaaaaaaaaaaa

SEQ ID NO: 6286 - DNA, 718 bp, Sorghum bicolor
  Clone ID: SORBI-28MAY03-CLUS38955_1
gcacgagggcctgctctcaaatttgaggcccaaacccccgtcggccccatcaacacgccgccggccacggccccgacgacccccacccactcccaccggcgccgcctccgtcctcccgctccgtccgcgcgcccgccgccctcgtccggccaggagcgggtggagatccgcctgggtccgagcccgcccgctcgctcctcctctcgtcggaaagtttatatgtggcttcacccatgaagagctgaagatatcgcatgagtagttgcagttagtgtgggtggctttgctccgtgcttggtcctgattgtgctttgccttgcaaaggaaggaatcatgacctctgttgttcagagtgtttcaggtgaccacagggctgaggatcaacaccatcagaagaagcaagctgaacctggggaccagcaagaagcaccagttactagttcagatagccaaccaacagtgggcacaccatcaacagattatgtggcaccctatgcccctcatgacatgagccatgcaatgggtcaatatgcttatccaaatattgatccatactatggaagcctttatgcggcttacggtggacagccattgatgcatccaccgttagtcggaatgcatccggctggcttacctttgcctactgatgcaatcgaagagcctgtgtatgtaaatgcaaaacaatacaatgccatattaagaaggcgtcaatcccggg

SEQ ID NO: 6287 - DNA, 838 bp, Sorghum bicolor
  Clone ID: SORBI-28MAY03-CLUS38969_1
gcacgaggggttggtaggggactccaacctgcctcaagcttcgttggtacgcttccttgtggttataaaagctttctggatacacctgggaatcttttcattgagggagttgttgaatacaccacatcagggtgacagttcagcaggaatttgttgagcttttctgattggatggtctggttctgaattcatgtgatgctttagattgaagatatagtgaatgcaaactccggaccaacttgtcacaaggttctgagtgatgaagaaatggcatggcggctttgccgttgtatctttgttcatcatcttgatgttaagatatgtgatattggatagcccacttgcaggcacgtcgcttcagtatgttttccaacaaaacaggacggtagaattacattggttggatgttccaaacccacctgcaatccagaatccacagaattcttctgaagtaatatcaaccagactcttggcatccaacctttccattaccagaaatctctctgatagagaacttcaatctttactttgttggaatcatttgagacacctattatctcatgcccatatcctgccagatggagtagaggcaatcaaggaagctggagttgcatggagggaactcaatacagcccttgcatatgatgactcagttgtttctgttaatgccagcattcagcagaaggacaaaggaaagcaatgcccttattctatcagaaggatgaatgccacaagattaggtgataggtttgctttaaaacttccctgtggattgattcagggctcttcaataactattattggtactcctggtggtcttctgggtaattttaagata

SEQ ID NO: 6288 - DNA, 872 bp, Sorghum bicolor
  unsure (1)..(872): unsure at all n locations
  Clone ID: SORBI-28MAY03-CLUS38978_1
ttgttttcttgtggctcccccaggctactgctgagagtgaccagcaacagcgagtccgtcgtctctggctagctcgctagctctgttggccatggcgagcgccaagacgaagctgcagctgcagctgcaggagagggtcccgctcccccgcacggcgtggaagctggccgacctcgccgttctcttcctgctcctggccctcctcgctcaccgtgtgtcctcgctgatggtggccgtcggcggcggcggcggcgcggcgtggtgctgtgtcgccgcgctcatctgcgaggcgtggttcacggtggtgtggctcctcaacatgaacgccaaatggaacccggtccgcttcgacacgcaccctgaacgcctcgccgaacggatgagcgacggcgagcttccggcggtggacatgttcgtgacgacggcggacccgaagctggagccgccgctggtgacggtgaacacggtgctgtcgctgctagcgctggactaccccgcaggcaagctgtcctgctacgtctccgacgacgggtgctcggcggcgacctgctacgcgctgcgcgaggccgccgagttcgccaagctctgggtgcccttctgcatgaagcacggcgtcaaggtcagggcccccttcgtctacttctccgagcgtggcggggccgcagccgacgacgacgacgctnagttcttgcgcgcttggacgtccatgaagaacgagtacgaggagttggtccgccggatcgagaacgccgaggagtctctagtccggcgcggcgacggcaagttcgctgagttcgtgggtgctgaccgcaggaatcacccgaccataatcaaggtcctgatgtgggacaacagcagcaacgacgacngca

SEQ ID NO: 6289 - DNA, 836 bp, Sorghum bicolor
  Clone ID: SORBI-28MAY03-CLUS38994_1
gcacgaggaacttgcttgccactggcggtggtggcagcgatcgttgcatcaagttctggaacacacacactggtgcgtgcctgaactcagttgacaccggatcacaggtgtgcgctcttctctggaacaagaatgagagggagctgctgagttcacatggattcacacagaaccaactgactttgtggaagtacccatcgatggtgaagatggctgaacttactggccatacctctcgtgtccttttcatggctcagagtcctgatggatgcacagtagcgtcagctgctgcagatgagaccctccggttctggaacgtttttggagcccctgaagcgcccaagcctgctgccaaagcttcccacactgggatgttcaacagcttcaaccatatccgataggatgagtcatgaggatagtctctttctaaagcagatgatatctgcctaccatcgctaagcaggtggcatgagggagcactgcaatcctaatgcatcattttttgctttcaggagggtcagaaatcaatgacagttcgcttcgtagacgtcgtcttcatcaagtagatatctgcaatgatactggaaccagaacctcgaaatgcagagtcttagagattgaattgcagagtcggtgacttcaggaatcagaagaaaaagatgtatacccctagcctcagaggttgatagcaaatttgttacttgtcctgtgttgtgtatgctgatcattaacagtaacactctgtacaaagtataatgttttcctcctctttattgaacatcaatagcgcctatttgatgtgccaattattgttatcaagacagcgatctttttgc

SEQ ID NO: 6290 - DNA, 621 bp, Sorghum bicolor
  Clone ID: SORBI-28MAY03-CLUS390_1
taaaccttccaaagcattcagttgcctcaaaagttgcactatggaccacggtgatcaaccctttcaccaaatatgccttgttgttaaacccattagctcgaagtttagaagagttgcgtcctgaaggctttttgaatgaaacatcatgctctataatactgaggactgcccttgttgcatcaactgtatgcattgcgtttcttctgccgttctttggtcttgtgatggcgctcattggatctcttcttagtatacttgtggcagtcataatgccagccttgtgcttcctgaagatcgcacagaataaagcaacttgttcacaggtaattgcaagcattggtatcataatattgggcgtcatcagtgctgccctggggacctattcgtccgtgaaaaggattgcagaaaactactaagctcttggacagtttctgtctgcagagtctaccacccgattccaaggatggaactcgaaatggtcaggtttcactacgatcaaaattttgctagaactaccgtgtttcctgtagattattattactattattatttggaccacaatagtctactaaaaaactgcatatcacttgcaataatgtaaggtaatcatgcccccctttt

SEQ ID NO: 6291 - DNA, 887 bp, Sorghum bicolor
  Clone ID: SORBI-28MAY03-CLUS39396_1
tgaattgacaatggacgacatattagaggctaacataggccctgatactccaaaggaaaattgggacctgagcaaacttatagctaagctgcaacagtattgctatctgttggatgatttgacaccagaattgttggagggcaaaagctcaagctatgaggatttgcgggagtacctccgtaagcgaggacgtgaagcttacttccaaaaaactgaaattgtggagaagcaagctccaggattgatgaaggagcctgagcggtttctaattctcagcaatatcgataggctgtggaaagaacacctgcaggcactaaaatttgtccaacaagctgttggtttaaggggttatgcccaacgagatccccttattgagtataaacttgagggatataatcttttcttagacatgatggctcaaatcaggaggaatgttatttattctgtatatcagttcaaaccagtagtgaagaaccaagaagaggaagcatcccaaaagaaggtgtcaaaaaagaaactggacaaaggagctaacaaacttggtgctgcccaagcagcgtcatgatcttcctgtgagaaatgttgctggtgcttttagttgcagtggctgcagtctccacatgtacaaagatggtcgttacgtatgagaaatgtacttcatgatatgagtcagctgattttggtagcttcatactgggacacagctttccagtatttttttgtcttgagctattgttgttattatcagcagatcctgtgcctcagcatatctttgttcatagaatggacagcgtcaattctactagttgtacagaaatagtacatcgtcaatggaagagattttgctcctcaacccacagttttgtataataatgtaattcattctt

SEQ ID NO: 6292 - DNA, 781 bp, Sorghum bicolor
  Clone ID: SORBI-28MAY03-CLUS39418_1
gcacgagggagagatagagcggactgcaataaatttgtcgcgtccggcgatccatctcccacctctgccctgacctcccctcccgcgtgctcctcccgtcacgctcatctctactccccgtgacgaccaggaaggaattcttcttcctccgtcctcgccccgtcgtcttctcacctgcgtgctgcgttcgcggacaaacttcttggttggtgacactgcggagcccgagcctcagcctcgcaggaggagacggagagcggaggagcgggaggagaaagccacctttcttcccgtttcagacaagctcccagctttgaccgccgttgctgctgctgctgctaccgtgtgctccctgagtccctggtgcgtcccggatcggagttcccctccgcacgggacaccgccgggccgggcgtctccactcccctcggatcgatcagccccccccaccgccgccgcaagataggcaagcaatgaagtgcctgcctttcttgcatggagatgccaaagagaaggatcctgtcactaagtcggcctctgtacggtccatgagcacaacatcaacggagcgcgatgtccgctccggttctgacttcacctccttgaatgtttccgacatgagtgccgagtcaataaggaggacacagtaccccagcttcactgaccgcccgcctaatctgagggtgttctcctttgctgaactgaagagtgccacccgcaacttcagccggtctctcatggttggcgagggtggctttggctgtgtgtacaggggtgtcat

SEQ ID NO: 6293 - DNA, 612 bp, Sorghum bicolor
  Clone ID: SORBI-28MAY03-CLUS39409_1
gcacgaggctgaacccccccgggctccccactcgcctagtcgcctgctcgcccctcgcgtcctccgctccggtgctgcgtctccacgccgcgcgatgtcggcgccggcgccggctccggctcccccaatggccgcgccgcgggtggggttgctgtacgacgatcggatgcgcgcgcacgcgacgcctgacggggaggaacacccggagaaccccgagcggctgcgcgccatctggcgcaagctcaacgccgagggcgtcgcgcccaggtgtgtggcccttaaggcgaaggaagccgaggacaaatatatagcttctgttcacagcaagagccatataaagctgatgaaggagattagctcaaagaagtatgatgccaccaggaacaagattgctaggaaattcaattccatttacttcaacaagggttcctcggaatctgctgttcttgcagctggttctgtcatagaggtagctgagaaagttgctgcaggtgagttaagttctgctattgctctagtcagacctccaggccaccatgcagaacatgatgaggcaatgggattttgcctcttcaacaatgtggcagttgcagctaattatctcttaaacga

SEQ ID NO: 6294 - DNA, 617 bp, Sorghum bicolor
  Clone ID: SORBI-28MAY03-CLUS39434_1
ctttgagacgagacgagacgacggcaccgccgagaattcttggatttccagaagccccgaatcggcgaatcatccatccatccatccatcccctcctctctccccgtccagccgtcgtcctcctctcctcccttatcatcgatccgcccggccggtcgtcggcagctgaactcgtcttcctctccgccgtgtcgccgtccttgcccggcctgtgaagcaggaccggggttgagcctttgcacgagcagacgagctagagtctaataagggtatagagagacgtgcatcagttgtcgctctggaggaacctataccaatggtgatggtgagcgttgcgagcccaagcccgagcccgagcccgatggtgcggtcggaggaggacctgggtccgccgtggctgcggccgctgctgggcacgagcttcttcgtgccgtgccggctgcacccggagctgagcaagaacgagtgcaacctcttctgcctcggctgcaccggcgacgccctctgcgcctactgcctgccggcgcaccgcgaccaccacgtcgtgcagatccggcggtcgtcgtaccacaacgtgatccgggtgtcggaggtggggaagctgatcgacatctccc

SEQ ID NO: 6295 - DNA, 680 bp, Sorghum bicolor
  Clone ID: SORBI-28MAY03-CLUS39045_1
gaccgaatccactcctgttagtgctgcgtcacctgatttctttcagttctccatctcctgcacaaagcccttcaatgggctctggtgagcaggcgttagagcctaaacatgagtcagcagcttcacctcatcccgaaaacttgaggcctgatgcattattctctgggaacacagctgatccatccattttcaacaatgccatagcaatgctcatgggcaatggcattaatgctgagtacaaacatgttcttggtgatggagttgtgctcgattcttcctcgtggaacaacatgccacatgcttttcaaatgacggaattcaaatgagttccatgtacttctttgtgattctgaagggcttcttgctgcttgttttggggtcaatatcatggaaggcctcattgattgtgatgctgcattcctgacagtgatccttgagggcgtgcaggtgcagcggctaccatgttatcttcatgtgaatagtccttttgtctaataaagtgcatgaagataaccggataatattttttttgctttgtattagagaaccgtttttgtcatccctgtcaggattatgttggaaacgtgtcatgatttttgtttgaacaatttaatatcggttattgatattgtgctgtgtgctatccccctggtgcatttgcatgtgggtagcaatttgtt

SEQ ID NO: 6296 - DNA, 668 bp, Sorghum bicolor
  unsure (1)..(668): unsure at all n locations
  Clone ID: SORBI-28MAY03-CLUS39056_1
cggcaatgctggcaatgccaagaatgagcttctacaatgctagcaaggctgccgtcctcaacttctttgagaccctgcggatcgaactccatgacgaggtcggcatcacgatcgctactcctgggtggattgagtcggagatgacgaaagggaagcacctgtcgaaggaagggacagtggaggtcgatcaagacacgagggacgctcaggtgggcttgttcccggtgttgcacgccgcccggtgcgctgaggccatcgtggatgccatctgccgtggccggcgccacctcactgtgccattgtggtaccgggcgctgttcctgtggcggacgctcacgcccgaggtgacagacttgagccagagactgttctacggccggaccgccggtggccacagtaaccaggcaaaggccaagaggttgctggagttcaccggcgccaaaggtgtgctccagccggcgtcgctgcacaactcggatatcaaacgggagtagccaaacgctgacagaggcttgtttgttcggcagtacaatctacatccaaataatgtggacctaaatagaacatgttaatggtccatcatnctgtcacgttcgttcggtgggtgaattatttgtgccttaaaactttgtgtacacgttgtgccaattcttctttctgtgagcaga

SEQ ID NO: 6297 - DNA, 748 bp, Sorghum bicolor
  Clone ID: SORBI-28MAY03-CLUS3917_1
tgggtcgcttagaagacgagaaggccagcaggaatatatttgaagccagaaataagcatattacgaatacaataaccatcgacctcgtccgccaacatgtccaacaagctatgaaccttctcaaacttaacatgatggtttgtatttgcatgccatctgtcttactgagggtaattactggttgtggttcagaaggtactgggaagggaaaaataaagcgctcggttatagagcttgcagagaaggaacatattgagtggcgcgaagagaactctggaactgtagcccttcggcttggtgggccaagagagtatcggttccttgagcatgaaaacgattctgactaagcggggaagccttttcaggagactttaacatagattaacctgtgatctaatctatgtatccccgtatttatctgtatttatgtgttatgattatggatacctaggctgtgacgaaggctgtagttctgacacagaagttcggtattgtagttgaagtaaattatggtgtaatgttgatcccaggctgctaactgtgtaatgtagtctgaagctctggtcacctgtctagtttagatgttatggtgtgcttctgtgtacaatgtacgacaggagctgcaatgaagtgtaaaattatcgtgatgttttgttgaagaatatcatggtatgactgattgccaactcatgctgttcaaaataagctttcgcgggatgcatgcctgaaccccttcggataattaacc

SEQ ID NO: 6298 - DNA, 694 bp, Sorghum bicolor
  Clone ID: SORBI-28MAY03-CLUS39184_1
tcggctgtgcaacttacaagctcctccaaagactgacattatgctctctccattcgaaaactacccagaaatggtacttggcgatagcacatcagatatcctaaatggaaattcatctcctcaaacttctgttaaagtcgtgtcaccaaacaagaagcgaatctctcccccacgaatgggtactcggctatctccaatctgtacgattggcaggaagctgattctcaagtccatcccttctttcccttcccttggtggcgacgtaaacaatgaggatcccaaggccaaattgccagcgccttgaatttatcatcttctgcccctcgtggcccttcctgttggttcacaagatcgcccacctgccgaatgcaccagaattgtttctatcataccatcagatagtgatggacttcgtttcaccatttcgatttctcttggtcaacgattatttatgtgatgctataataatccactgtgtgatggcagaattctacctcccaaaatcaccagtggcatttggtttgctggtaaattatgtcttagctcaaaggacgtcgtcgtgtttcctgtgactgtatgtctgtataatttatgttcattatctgggatcaaaaaacgtggaatttgtatgtacctaatgacagaactgttaagattttatttatggaggttgaaccgcaagacttatttatct

SEQ ID NO: 6299 - DNA, 761 bp, Sorghum bicolor
  Clone ID: SORBI-28MAY03-CLUS39197_1
ctcaacgtccatgtctgataccgcaccacagagccggttgaccagtgctcccagtccaagagttcctcctagcccaggggctagggatcagtctggcttttcaaggctcactgacagcaggacgttacactccagcccttcccagcgaaagataaacggctactgatcgcttggcacacatattacatgtgccacgatgacacagctcaggtatcatggcctcgatgaagcgccctgctgtatcttcatactcaactgcccctgcgtggagaagtccaattgttgctctgtgaaatggtggcacgcgaggggtgataatctcattgattgatagcaaacaaaaggctcctctcccataagtttctggtcagtgatttactgtaactcggggttcatttcctctcttgataacgagagatgtgaatttgtgaactatttttctgcttatgttcgccagccgcgatttattgctggggaataattgctacctgcgcaccttagttggatgtgacagtatgcatctctggcgtgcttggttttatgatgttgccagatcggttgtatgcagcctgtgttaaaatgcaattttcggtcctcttcataagctgcaaaattgggatttttttctggtagtttttcaggtacatcgtagtcttgtacggttacattatgattaaaggatatagccttcgatcttggttgagctactagttgatataagcatcgtttggatcactggaattcattggattccataggac

SEQ ID NO: 6300 - DNA, 690 bp, Sorghum bicolor
  Clone ID: SORBI-28MAY03-CLUS39212_1
gcacgaggcccattgccaaacccataaaccctcctcagtccccactagggtttctcccaaaatcggcaccgccgcaatccgccatggccgccgacacttcgaagcccttcttccccgcggcgccgcactcggctctcctcccctccaggagcgccgcctcgcgcgccacccctgagggctcctactggcgcgccttccgctcctccgagctcgtctccgacgccggcttccccgtcaccgacctcgccttcgcccccgctgtggccgacggcgcctccccgaccctcgccgcttcctggtccacctccctgcacgtcttctccggcgaccccctcgagaagctccgcaggatctccgtcgcgggcgacctcgccttctccccgtccttccgctgcgacggcgccctccttgccgccggcgacaagaagggcgtcgtccgcgtcctccgcgccgacaaggccgcggcgggggccctccgcacgctgcgcgcccacgccgccgagacccgcgtggtccggtacccggtcgccggcggcgacaagctccacctcctcaccgccggcgacgacgcgctcctcgcctactgggacgtgccgtcggagacgcccgtcttctccgtccccgccgcgcaccgggactacatccgcggcggtgcggcctcccctgccgatcacaacattttcgccaccg

SEQ ID NO: 6301 - DNA, 853 bp, Sorghum bicolor
  Clone ID: SORBI-28MAY03-CLUS39597_1
gcacgaggggggactggaggagtgggagaggagaggagcaggacctgggagacctcgcttcgcccgtcctccagtcttccttgcttttcgattttgagggtgctgcttgttttatcttaaaatggggtctcatgatggtgaggatgaagagttgccaccacccccgcccgtgccaccagatgtggttcccattaaagctgaacatgttgtgggggaaccaccagcaaacaagccaataaagccaaagagattactgatggacaggcctggtataggaagaaaagggcacctagcccagctctattcaaatcactttaaagtcgccgtgaagagcacagaagacttcttctttcactattatgtgaacctgaagtatgaggatgatcaacctgttgaaggtaaagggattggcagaaaggtgattgataaactgcagcagacatatcgcgctgagctttccaacaaggattttgcatatgacggaggcacgagcctgtttacagttggtgggcttccacaaaaaaacaatgagttcactgtcgtcttggaggacgcgtctactggaaagactgctgccaatgggagccctggcggtaatgacagtcctggaggtggtgacaggaagagagtgaggaggccataccagacgaaaactttcaaagtggagataaattttgcagcaaaggttcctatgagtgctattggtcaagtcattagaggcgaagaaacggagaactccctggaggcacttcgtgttcttgatatcatactgaggcagcattccgcagaacaaggctgccttttggttaagcaatcgtttttctacaacaacccttgcaactttgttgacttg

SEQ ID NO: 6302 - DNA, 674 bp, Sorghum bicolor
  Clone ID: SORBI-28MAY03-CLUS39716_1
gttctgcgcgtcgtcctcgccttgcttcgtacgtcgtcgtccccggcgtccggcgtccgggaaagcggcgatggaggcggcgctgggggcgctgtgccgcgccggagggtggtcgtacgcggccgtctggcgcgcacgaggccaagaccctcggttgctcacattgggggactgctactctgaagatgaggcaaaaacaatggttcagaagatgcttaatctcgttgaaattgttggggaaggcatcctaggagaagctctagtaagcggagagtgtcaatggatttacgacgatacttgccatgtgttgaatcagacaagccatgctgataacagagacttatatctggattatacttggtggcagcatcagtttctgaatgggataaagactattgcagtattgcctcttcagttacagggactggtgcaatttggttccacacggaaggttcccaggagttcaattcttttgaatcaagtcagagatatatttgatcggatgaagaatgcttcaagcgatggtccaatggaatatacccacaactctcttgcatatggtcagcaacctatccttgcttcattgatatctgccaatgacatgctcgtacataataaggtcaacccattgcaaactgagaaacctgaggagaatattgagataacagaatcta

SEQ ID NO: 6303 - DNA, 863 bp, Sorghum bicolor
  Clone ID: SORBI-28MAY03-CLUS39721_1
gcacgaggcgccgctgtcctccacccccccctcccccgccgccggcgcgccggcggcgtcggcccccgcccggccccggccctccgccgccccgcccccgccgcgccctcgcagcgccgccgctgccgcggcggcggcggctgccgcggcggggcgcgcgcggtgcggtgccgccccccggccgcgcccttgggggggggcacctgctgcgttcgctgcgcgggccgggcgacgacgctcggcttcgttctccgcctgcgtcccctcctcttccggcgctggacctggcggggtcggcgcccgcctcgaacgtcttcccttgccgcccttctcccagaccgtcctcggccactcgaccgtccccgcttgccctgcctcaagcagcgcacggggattcgacggttcccactagaccagcaagaagtaactctgttagccgatcatctatccagtcggctctcatgaatggcaacaataggacatcagccctggttgccggcgctgctccggtctcgccccgacccactcccccccggcggcgcggccgctcggttatcgcaccgaaacaatcagttccagctgcacgtccagtgcctgcaagatcctctactcctgttaaaactcgtccatctacaccagcaaaaactcgcccatctactcctacgagaactcgtccaacagcaccaaactcttcaactgattcggctgctgccaagaccacatccacacatagtgtgaggccatcaactccaaattcccggtcccgtattgttcccaactcatcttcaagtgcaactcatgcaataagccgcccgagcgcctcctcgggtacaacaagcagaccagggtcttcctcaggtaat

SEQ ID NO: 6304 - DNA, 1120 bp, Sorghum bicolor
  unsure (1)..(1120): unsure at all n locations
  Clone ID: SORBI-28MAY03-CLUS39840_1
gcacgagggctagctgaggtaactgcttatcccaggaagaaagcaaggtctccttcatcaccatggcaacacgcccgggacctttgacagaatggccatggcaatggatggggaacttcaagtacctggtcctggtacctgcggtgctgcacactgcccacagggtcgcaaccaaggggtggggagaccttgacccagcatatgccaccatgttaccagcccttctgctgaggatgatccacaaccaaatctggatcagcttgtctcgctatcagaccgctcgcagaaagaacgtgattgtggaccgtagtattgagttcgagcaggtggaccgggagaggtcctgggatgaccagatcatcttcaatgggctcgagttctatctggcctatgcaatgatcccgaatgtcaggctccttccgatctggagaactgatggggccatcgtcactgtgctgctgcacgtggggcctgttgagttcctctactactggttccatagagccttgcaccaccatttcctctactctcgctaccactcacaccaccatgcctccatcgtcacagaacccataacctctgtcatccatccatttgctgaacatgtggtatatttcatgttgttttcaatcccgacattaacacccatttttatgggctgtggttctgttctgggcattgtcttgtacattgcgtacattgacttcatgaataatatggggcactgcaattttgaactggtaccaaagtggatcttcaaagccttccctcctctgaagtatctcatgtacaccccatcgtttcactctctacatcacacccagttccgcacaaactactcactgttcatgccattctacgactacatgtacaacaccatggacaagtcaagcgatgagctgtatgagaaatcactgaaagtcacagatgaaacaccagatctggttcacctgacacatatgaccaccttgcaatcgacttatcatctaaggattgggattgcctccattgcttccaaaccatccnacaagccagtatggtatagctggatgatatggcctgtggcttttctatcaatggtattagcatgggtttatggatcgtctgcatttgtcattga

SEQ ID NO: 6305 - DNA, 712 bp, Sorghum bicolor
  Clone ID: SORBI-28MAY03-CLUS39850_1
gcacgaggtaaactctcccttcctccgcctctccggggcccggctccttctcactgccaccgatttgtttgactccatctccagtcctcccttcccttcccacttaattggtcgctgctcccttcctccacggccgatctcgtgccggcgagagggatcatggcgggggaaggggaggaggtgtacgtggcggccatcgaccagggcaccaccagcaccaggttcatcgtctacgaccgccacgccaagcccgtcgcctcgcaccagctcgagttcgcgcagcactacccggaggcagggtgggttgagcatgatcctatggagattatagagactgttatggtgtgtatgaatgaggcagttggcaaagccaaagatggtaaatacaatgtggttgctggtttgaaggccattgggatcacaaatcagagggaaaccactgttatgtggagtaaatccactggccatccactttataatgccattgtgtggatggatgctcgcacaagccccgtttgcaggagattagaaagtgagctatcaggcggtagaacccactttgtggagagatgtgggctgccaatcagtacctatttcagtgctctgaaattattatggttgatggaaaatgtggatgctgtcaaggatgcaatcaagactggtgacgccttatttggcacaatcgacacctggttgatttggaaccttactg

SEQ ID NO: 6306 - DNA, 839 bp, Sorghum bicolor
  unsure (1)..(839): unsure at all n locations
  Clone ID: SORBI-28MAY03-CLUS39329_1
gcacgagggcagaacatgttggtaccaagtctaagttacagtgtattgatcattacacaacagcatacatgaactcaccttgttatcccctcccggatatgtctcatgttaatggcaagaacaggaaggagcttctagctatggctaaagtgcagggtgagagtaaaaaagggacttcactgttatctggagaactgactcctaaggctgaatctccattttctccctccagggtcaaggtggaagatgcacttggagaaggtccagcaggtcgatcaccttcacacatagctgttggtgcaaataaaaaggcttcaaatgtgggacagattaaagatggtgctaatgtgtcaaaaatcgaagatggtcatgtcgatagaagcgttggtgtgaagaagcccagatattctgcagatgaaggcccttcgttgactgaactgagtggatacaatgcaaagagacatgagtttgacccagagtatgataatgatgccgaacaagcgcttgctgagatggaatttaaagaaactgattcggaaaccgatcgtgaactgaaactccgtgttcttcgtatttatctgtccaggcttgaagaaagaaaaaggagaaaggagttcatattggaaagaaatttattgttccctaatcccttggagaaagatcttacaaatgaagacagggaagtttaccatcgctataaggtcttcatgcgttttctttccaaggaggaacatgaagccctcattaggagtgtcattgaggagcgaaaaatcggaggagaattcaagaactnccaggaatgtcgtcctgctgggtgccgcacacggctgaagcaaaga

SEQ ID NO: 6307 - DNA, 572 bp, Sorghum bicolor
  Clone ID: SORBI-28MAY03-CLUS39335_1
accttggcgcagagcaaataagataaactggactggaaaagtaaattgttacccaatgtgcataggtacagatgaaagcataccttgggcgtcatttcaaccagcagcagcgacgtgttcagcagcagccagcagcagaggcgaagcagaggatatggtggctgggccatatgttggcaaccaatgaattgaactaggcacactgctgcatcgaagccctttctcttcactggtttcttggatattggaagaaagggtgccccaggggaaatctaacctggctttgtttatttctcatattttgtttattggaagcttttggagagaatatgaagtgaagttagtgtggagttttctagttgcctgcttccgtttcagccacgtataatgaccgacgttgtatggaaattatttggtgctagatttcgatgtcgtgtttttgatgagttgaacttgattagggtcccttttcttcaaaaagaactaggagttattcgccttttaggcttttaccatatatgtataaatttgaaaataccattactgtgaggtacaagctgggtatatgtaag

SEQ ID NO: 6308 - DNA, 759 bp, Sorghum bicolor
  unsure (1)..(759): unsure at all n locations
  Clone ID: SORBI-28MAY03-CLUS39357_1
ggcctgtatatggcaaggcactggataaatttggaattctctattgccacatggtggagccgcggatggtaaaacttggtgaaaaatttgaaaccccatacagtcttcgtccaatgagggatgctttcaagggaacatttatagttgctgggggctacaccagggaggatggaaatgacgcaatctccactgggtatgctgatttgattgcatatgggcgcttgtttttgtctaatcctgacttgcctcgaaggttggaaatagatggtccccttaacaagtacaacagagatacattttacatccctgatccagttattggatatacagactacccatttctttcatcagatgtgtgaatgtccattttcagcaaaggcttgtttagatttgagtagctagttgctgtaccagtaatatcagaactcagaagaataaatcattggtctggatgcctcattttcatgtacatggacaaagcattatgataattgaattgtgcctccaactattatagtagtaaagagattgagaagaagatgaatcagttatgaagtctgtttaaaaaggcagcctggtttaccagcaactaccattatcctgttgtagtcacatggggcttgcatttttcctccttttgcttccacatgtgtgccaatagttactgccgaagccctgagtttctaagtgaacttgtttgggcgatttgcctgaatattgtgtgtaatgaatatgtgatttgcccattaaaaaaaanna

SEQ ID NO: 6309 - DNA, 710 bp, Sorghum bicolor
  Clone ID: SORBI-28MAY03-CLUS3936_1
ccaaaagaattacaggccttaaaagaaatggtaacgaagaaaacgctttatgaaggcctggaagaggggactgggtctgtgttggacctcattacctaggtggtgagtatttggtcaagatgtctttttgaaagagcctgcaaagatgcgcgaaaaggtaaagatgagcagatgctcaccgcctcatcatccttttgtaacatgtagtagtaaaagaggtgcaattttggaagagtcctaggttcagaaatgttgcttctggccaaaggaaggggggtttttgccgtttcggtagcccacgcgtcccgcccatcaaaagtgtgatctgaactgacaacggcggcttgaatcttcggggcagggcattttataggatgggtttgctatgtcagtatttgtgtgtgttagctggggtgtaaagctggttccgtctgtgcggtcgaacgctgcaaaaggcacgtggacagtggtacctggggctgcgcctgctgctcccctaaacgtactgtttttttttaggaactgaaggcccaaaaaaatctttcagttggttcaggtaaaaagggttggagaattcatgggttccaaaaaaaaaaaaaaaaaaaaaaaaaaaaaaaaaaaaaataaaaaaaaaaaaaaaaaaaaaaaaaaaaaaaaaaaaaaaaaaaaaggggggcccctttaaaggatccaagcttacctacccctgc

SEQ ID NO: 6310 - DNA, 687 bp, Sorghum bicolor
  unsure (1)..(687): unsure at all n locations
  Clone ID: SORBI-28MAY03-CLUS39373_1
acctatctaaggttttattgagagagtgtgacaatgagttgtcaagaaatttcatgaaaatactaagaaccctgcgggagaaggatccttcttatcaccagctatgccgtgtggtgcgacagggtgaacagccaagagaaggctatctgcttctatctaaccttgttgaggaccagatggctggaacaagcagttacgttgattggatactgcaaattcaccgtcaaacacaaagctaatgacgaagaaccaacaggaagtgatgcttgaaattttttgccttactgtatactgctgcagaatgtagattcagctgctgccagttccaaatcaatctctcaaacccatggcagatcttattcacaagccagcggttcaatgtgccgtcctgtaagcagcatttggctggaaagaaaagcttcttactgttaatatttgcccttgtgattattttattttgcagagtgagaatacagctgttgtatcggaataagtaggcagcaaatatcgtggtgtgggtatattatacaactggggtcgtgtagtggcatttggattctttcctgatctgattcctagtccggttcagttacttggcatttgggttataaaaagttccatcgtgtaaactaatttttggctattttagtntgtttgtaacaggagttgtcatttaatttaaccatc

SEQ ID NO: 6311 - DNA, 625 bp, Sorghum bicolor
  unsure (1)..(625): unsure at all n locations
  Clone ID: SORBI-28MAY03-CLUS4008_1
aaatcattaagcataattcttgttagagatgttgatggcaagacctttgcgtccgctctaaatgatgtcattgctcgccaaataaaaaacccaaatgctgaggaagaatcttccctgtcaaccttgcagaatacctttcttgggcgcaatctcaaacagggaacaaacatatacttaacttggcttgaacccaaaagaatgctgatttccatttccgaaaatcaagatccacgtcaagttgatgcagagatcgaatctgctactgttaattatgctctatacgatggcttctttggtaaatccccagtgtccccttctttgagatcatctacagcccgattgctggaagcgcttctgcagtgacaactcaatcgtggtcccatcatttttttttttgagaaactttccatcagtgattgctaggagtggttatttccctacggattgctttacatttccatcattcaacttgcctagcccaacttgctccgtggaaatggatttttcaggggcagtagaaactattaactgcccttggaaattgattttcaggggtggttattgttgtgaaccacacctagaaaatgtttcacatttttgaaagtttncatggcaatttgaaaga

SEQ ID NO: 6312 - DNA, 708 bp, Sorghum bicolor
  Clone ID: SORBI-28MAY03-CLUS40090_1
ggctgaattatacatgcatggctcaagacaccgacttgtgttcaggcaacaagaccttaacctacgacatctacggccaactcgtcctggctgccaatgtaagctacgcgctgtaccattacgcccccttcctgctcaacctccaggactgcaagtttgtccgagccaccttcagcgccattgcctctcagtactgcccgcctctggagcatgaccttgggttagtctctgcgggcctggcgctcattgcctcgggctttgttctctacctcatctggatgctcttcgcggaccgcccccaaagaagggaggaggtgtccgatctggcgtcagggtcgaggatcacaccagtagacagctgctctccgtcgtagcaacgggatgatgaggctgcttaatccctcccgtggtaacaagaatttagtacagttccatggctatgtaaaatagtttcagtatagagttccagtatagttaggaggagaagtatcgaagtgaggagaagagacggaagcacctaggggcaaagccccattttgcagtggagagtaggttgaaaagagctgcttccttctgttgtatgtcagatgcacccatgtgtggtgtatattgttgcaagaacacctggaataatcgatcagaggtgaaaagcctcctcatgacccatcacgcggtgaaacaaagagcactaatgctcttttgtcgcgc

SEQ ID NO: 6313 - DNA, 537 bp, Sorghum bicolor
  Clone ID: SORBI-28MAY03-CLUS40193_1
ggcaacaccgtggaagaaagtgagctggaaaccctcatagacatgcagcttgtggcgctccgcaaggtgttcaggatacctcataagccgttcgatgaaacacagggccctacctctaagaagctgctgactctcttcagatcagggaagcttgggccgttcatccttgacgaccttcctgatgcatctgagaattaacctgctcacatgcagtgagtctttttattttgctctgggcagctgatgttctgcgaaggaaggcattggtacgagctgttactgtaaatggcatcttgcagggaccatctgtgtagcaaaactacgagatgccaagagattcgttcaacgctgctgtatgttatgctgggtttgcgtgagggcagtaggccttgttaatagcagggcatgttgtttatctgtctccctcgttggctgtttggcttggacagaacgtggtctgttttggaattgaaggttagtaacatagtatcaaaggcatggatcggggttacggttagattaatctaatccattttt

SEQ ID NO: 6314 - DNA, 704 bp, Sorghum bicolor
  Clone ID: SORBI-28MAY03-CLUS40157_1
atgacatgctcaagtcacgacttccagagggtagaactgtctacctaaaattctccaataaagacatacctaagatctggataggagataacatagatgataaacagcaacagagggcaccaaaaggaacaacgttcattcctacatcacagtttccacttaagaagatccgcagggattgcacttacttgagtactccggcaatgaagatcccagagacaatggaaaatgttcacacctgtgagaattggctgcccagaagggtcatgagtgcctggcgtattgctggaatactgcatgctctggaaggttgggatatgcatgagagcggcgacgatatgatggacatcgataagacttggtcggcagctattaagcacggatttgctcctctgacaaaatattgattcttctgaatcatagcagacaccagtagacgatgcaggttatgcaactactatgcaaagcaagtttttcggtatgaagaagaagaagaagaagcatcacaagtgcttattattggtttgctagccttgtcaaacagtccttcattgtaatctcctaaagggaaggattaaaataaggggctgaactccaaactctatcaagagctaagtactctggcttgtagaatgcgatatatgtaatatcaacggttatgcagtattgaggtgcagtagtaaaatgtcaataatgtaccgatg

SEQ ID NO: 6315 - DNA, 574 bp, Sorghum bicolor
  Clone ID: SORBI-28MAY03-CLUS40441_1
gcccgcggcggtgagcaaccccgcggcgaggaaatggacgccaagctgcttctccccttcccctccttgcccgccgcgctccacccggcggcggggagggcccccaagtctctcttcctcggcgcctcgctcccgctacacccgccgccgccgccgttcccgctgcggctccgccctcggcgcgcggcggcggtggtggcgcaggccgccgtgaagcgacgcaaggagctgccattcgacaacgtgatccagcgggacaagaagctgaagctggtgctcaagctccggaacatcctggtggcgcagcccgaccgtgtgatgagcctccgcgacctgggccgcttccgccgcgacctcggcctcacccgcaagcgccgcctcatcgcactcctcaagcgcttcccgggcgtcttcgaaattgtcgaggagggcgtctactccctcaggttccgcctcacgccgcccgccgagcgcctctacctcgacgagctccgcctcaagaacgagtccgagggcctcgccgtcaccaagctccgcaagctcctcatgatgtcgcaggagaggcgcatcctca

SEQ ID NO: 6316 - DNA, 650 bp, Sorghum bicolor
  unsure (1)..(650): unsure at all n locations
  Clone ID: SORBI-28MAY03-CLUS39487_1
atcaaggttttataagccaaactgatttggtatggcaaaggttggatgaggttaatggagatggggtttttcttactagcaacttcacaccatttaaggctgaaacgccaagaaatgattcatggaatgaacagcaagctatgacgagtactgctgattatcttgctcaatttgacaacacttctggaaactctgatctggagctagctatagcacttcaacagcaagagtttgagcggcaaccacaaaggtttcaagctccaccaccacagcagcagcagcaacagcaacaaccacctcagacgcagaaccatccgactcaatccggccgatcaggacttgttgttggtccaaggaggtcaaacgtcccaccaccgtcgagaagtgaatcgaagaaagagaggtgcatcgtgatgtaaagataccttcaacagaaaagtagaagaaaaaaagagagataagagaggcattatactgtaaagaaatggtttcttttgcggaggcagtgtctgcgtttagtcaccttgagccattccccatttgagcttctttggttttaatttgtctgatgtatgtaaataacctcagcgaataaagcgtagaaacagatgctgtcnaaagtgatagccccctgcaatgtgatttcattc

SEQ ID NO: 6317 - DNA, 667 bp, Sorghum bicolor
  Clone ID: SORBI-28MAY03-CLUS39516_1
gagaggtctccgcaagaaaacgagcttgccgatgccaaatttgcctggctttgcgcaaaacatgtcaagagcaatgccattgtgatagccaagaacaactgcatgctgggaatgggcagtggtcagccaaacagacgagagagcgtcagaatcgccttcaggaaggcaggagaagaggccaagggagctgcattggctagcgacgccttctttccttttgcctggaacgacgccgttgaggaggcgtgtcagaatggcatcggaatcatcgctcagccaggaggcagtaagaaggacgaggacgccatcgcgtgctgcaacaagtacggcgtgtcgctcgtcctcaccggcgttagacacttcaagcattagcatggctgctcatcttaactttttagggagttagtgaaaaaaatgagctcgggagatgtcataataattaagagccgaagctcttctgttttggaggctgcagcttgtagagctgccctgatgagtagctttcgccacggtatactgcaaattttggattctgtaggcgtatgcttttgctcggtgagctcgtgggggaagtttctcctggtgtcgaataagctgatggatgtgtcgttagtcccaactgaacccaagctaagcttttgcaagttgcaatagcactacctaatta

SEQ ID NO: 6318 - DNA, 672 bp, Sorghum bicolor
  Clone ID: SORBI-28MAY03-CLUS39529_1
atttcatcttcggtaactctatcgcccttatggaacattgccatatccattgcaaagcagcaggatttattactgctcatagccggaagtccacatcagaatctactggctatgtattcttgaggtgtactattactggaaatggagatggtggatatatgttcctaggtcggccatgggggccctttggaagggttgtctttgcatacacttttatggatcgatgcattaagccttctgggtggcataactgggacaaatccgagaatgagcgaactgcttgcttttatgagtacaggtgctccgggccaggctcccagccgtcgaaccgggtgacctggtgtagacaattgctggatgttgaagcagagcagttccttgcacacacttttatcgatccagacgttgataggccatggctcctccagatgatggcaataagagtaccagcctcagcatagtttgatccgaggtcctggttcatgcctcctttgtagcccatttaataaataataataaagttggtggatgcggatgcattttatatttatataagtttgtaaagtttgttcaattggtatcccctttttctcattgagggtggtgggggtagagaatgagagaggttttgctgtgagaagcttgtaacgaactcgagcccgggctgaaata

SEQ ID NO: 6319 - DNA, 1117 bp, Sorghum bicolor
  Clone ID: SORBI-28MAY03-CLUS39539_1
cgcgagctcccactcccatccatggcgaccgccaccgctacctcttcctcctcgctgaccactcctctcctccgcccgaaccccaataccaaccccgctcccagatctctccaactcctcaggagcaggaggtgcgctcgtgccgtgactgccgccgtagccggaggcccggtgccttacggggctgctccgaggcgcgggatttggtcgatcagggatgacttggtggtgccgaggtcgccctacttcccagtggagtctgcggcggggcacgagcgtgggccgtcacccatggtgatggagcggttccagagcgtcgttagtcagcttttccagcataggattatccggtgtggtggccctgttgaggatgatatggccaacatcattgtagcacagctgctctacctcgatgctattgatcccactaaggatatcattatgtatgtgaattcaccaggagggtcagtgacagctggaatggctatattcgatacaatgaagcatatcaggcctgatgtatccactgtttgtatcggactagctgcaagtatgggagcttttctacttagtgctgggaccaaaggaaagcgatacagcttaccaaactcgaggataatgatccatcaacctcttggaggggcccaaggacaggagactgatcttgaaattcagcctaatgagatgttgcaccacaaggctaacttaaatggataccttgcataccacactgggcagcccctggataagatcaatgtagatactgaccgtgactactttatgagcgcgaaagaagcaaaggagtatggccttattgatggagtaatcatgaatcctctcaaggcccttcaaccacttccagcttccagttagtcatgaaatgtgctataactccgtcaaacttttttgtttattgtatcaatgtgtctgctggaactgagtttgcactgcagttttctattagcctggcttcataatattctacatccagaggtttcaaagtttgtaaaatacaagatctacggttagggtatccattcttggcgatggacattggaatttattgacagtattaaagagttggtttaccgcggacttatgtactcgatcaataaca

SEQ ID NO: 6320 - DNA, 706 bp, Sorghum bicolor
  Clone ID: SORBI-28MAY03-CLUS39580_1
ctcatttatgtttggtagatgcttgacttcgacagtctggggaatagcggcagaccgtattgggaggaaacctgttgtcatgtttggcatttcctctgtggttgtgttaaatacattgtttggtctgagtgtcaactattggatggcaataactacgcgattgcacgagggtgctttaaatggtttacttggaccaataaaggcttatgccattgaagtttgccgacctgaacatgaagcgttagcactatcacttgtcagcacagcatggggaataggtctcattattggtcctgctcttggaggttatcttgcactgcctgcagaaaattttccaactgtcttttcaactgactcaatctttggaaggttcccatatttcttaccatgcttatgcacgtcaatctttgctgctgttgttctcataagctgcatatggatgccggagactttgcacaagcacaaagttcatgaaaatagaagtcagaacattgaagctttggaggcccatctgattgattcaaaagaaaaggttgaagaaagtggtagtttagatactaagaagagcctattcaggaattggccattgatgtcatcaataattgtctattgcatcttctccttccatgacatggcttacacagaggtgttctctctatgggctgaaagtgacaagaagtatggtggactgagtttatcatctgag

SEQ ID NO: 6321 - DNA, 606 bp, Sorghum bicolor
  Clone ID: SORBI-28MAY03-CLUS40384_1
ttcgggcccggcgcccgtgcctctccctcttccgctgccggcgcaggggctgtcatcccagccgccgggcccccctatctttatccaatgatgattcctcctcccgtactaccatcctgcatttgttccagtgccctgctacggttatgttccgtttttctatgggccaccaggtgttgcacaagctccacatgaggttgtcaagccagtggctgtgcactcaacacccccattaaacgtcaaagacctttacaatatgtctgaattgagcctgaagggtgactcagatgcaaatggtggagtgcctgcttctcccttgcctccaaagaccgagttggtggaccagagaggcaatctgctttccatggaaaacggtaccagtggctcgtcaggcggactaagccctccagtcacgtggctttggttctgctccgagacgtgcccccatgcgtatgtgcctctgcgggtggattgccctcgcggtttcgcccgtgctggctatacggcgccgtggtgtcctccccagtttcgatgccgcgctctgtgggtctcgccagtttggaagtcatgatctgtgggtaaatatattgttagttgtcataaaaa

SEQ ID NO: 6322 - DNA, 655 bp, Sorghum bicolor
  Clone ID: SORBI-28MAY03-CLUS40408_1
cgtaacatggagctacaaggaaatgtcgatttttcacttccacagcgaagcgtccacacatcagttaaagtatctaatcctgccggaggtccaagcaacatctcattcagtgaagatcctgtagtgaagacagcaaagaaaatccacaaccagaagttccaggagctgacaggtaacaacatcttcaaggaggatgtccctacctcggctgagaagtctctgagctctgcgaagctgaaggagatgagcggcagtgacatctttgctgatggaacgccagctccccgagaatacctcggcggcatccggaagccccctggtggtgagagcagcattgctctgatctgattgctgtcgagggctctaattcggactggctatagctcccctcgtcactgaagcgcgccgagagtgcatctgttgacctcttggctcttgaattgtgccggggatcataatttatgttgggtatcgttagtctaatataatgtagagtcaggagaatctgactcggttgctcgtgtcatctgatacgccggtgtgtgatctcgtctttgattcatgctacattattttgttatgtattagtgcatccgaactagaacttgtgcaataattattttggactcatttccgggcttatggtattatagga

SEQ ID NO: 6323 - DNA, 459 bp, Sorghum bicolor
  Clone ID: SORBI-28MAY03-CLUS40426_1
gcacgagggctcgatctctctcctgactcagataggcgacggcggctactgcgacctcaacgcccttccgtgttggcgcgcctctgctgtcctcgccccggccttcccttctcttcctccctctctcctcgtctccctctctcccgagggcatcgcgggggcagcggcggcggcggcccgcttccctccggtcagcaccactcccgtgtcggcgcgcctctgccctggccttccccttctcttcctccctctctcctcgtctccttctctcccgagggcgtcgcacgggtggcggtggcggcccatttcccttcggtcagcaccacttcacgggaggtggtcactgttccttctgcgcgtgctacaggaaaccctagccgtcggttctgctcaggtcaattctcgctcatccattctcgtttggtaggcctatgtctcctttgattgctggtgtcctag

SEQ ID NO: 6324 - DNA, 714 bp, Sorghum bicolor
  unsure (1)..(714): unsure at all n locations
  Clone ID: SORBI-28MAY03-CLUS40436_1
gcacgaggacacggaaagcagacaaaggcctcgaggttatatggcgtggctcccccactttcggttcatcttctcagagcttcaccaatgccttccctgtccattatagcccaccagatggcttcggcttcgaagttttggctgaaaatgtcatacccgttcaggatgacctgtcactctttgactataacgtccaagaacgtgtaaatgattttgttgctgcagccttagcacaggcaaatgttacacgtacagaccacataatgtggaccatgggggatgattttaactatcagtatgctgaatcctggttccgaaatatggacaaacttatccaacatgtgaacaaggacggccgagtgcatgcattgtattctactccgtccatctacacggatgctaaacatgcatcaaatgaatcttggccagtaaaatacgatgattatttcccctacgctgattcaacaaatgcatactggactgggtattttacaagccgtccaactttcaagcgatacgttcgagtgcacagtggatattacctggctgcacgtcaaatagaatttttaatcggtaggagttccttaggattgttcacttccagcttggaagatgcaatgggtattgcccagcatcatgatgcaatctcaggtactgcaaaacagcacacaactgatgactactcgaaacggattgctattggcgcatcanagg

SEQ ID NO: 6325 - DNA, 702 bp, Sorghum bicolor
  Clone ID: SORBI-28MAY03-CLUS39885_1
gggacactggcaccaagggatctgattccagttcaagcactgacgatgagttctcctcagtttcagacatagatgtcatggtgcatcagtatggcatgctattgctggagatactaaccggaaaagttgcctactccgaagaggaagacagggtttcattggagcagttggcatctctctacttcgatggcaacatgccccttgcggagctgattgacccgagcctcggttcgttccctcaagaagccgcgcacgcaatgtgcgaggttgcaaggtcttgtgtggacccggacccgaagaagagaccacggatggtacaggtggctgctaggatgaaggagatcaccgcgctggggcctgagggagcgactccaaaggtgtcgccgctctggtgggcggagctggagatcatgtcttctgaagctagctagctgatcatggtgaaataaaccaccgtctgaacgtagtgattcatcctcagtctcctcccgctgtgattggcaattctttggtttggtttattgtgttgtggttgcggagcctgaagcagagttgcttgtggtattagaggtttgcttttgcattttccttggtaccattgcgtatgtgtatatgtacggtatatatcatcatagcagtctaacagagaaagcagcaaaaagggaaaaggctgtcttccaatacactacttgagtatatatg

SEQ ID NO: 6326 - DNA, 630 bp, Sorghum bicolor
  Clone ID: SORBI-28MAY03-CLUS3990_1
ggaaatgtgacaattgatacagtaaagaaaatcggagaaacgggagtcacttatatttcaagtggagctttaacgcattctgtgaaggcacttgacatctctctcaagatagacactgagctcgctcttcaggttggaagacgtacaaatcgtgcttgactccaccgcattacgattgtgcacgcattgccacatgtgcaagatgataggagaacacgtggcaaatcagcttaaataacttagcgtgtcgctgagacctctgactgcaactacatgggattcatccttcagtttcatccaaaatgcagtaaataccttaaatttggaacagaataattggcaggacagacaggttgcttccagcatttgttctagcaccaagtttggaagctggaaaagcttgcgttgtgcggcaggtatgcaggcaggcagataggagtacatcttcctgcgcccagccacagctcgacagcaggtaggtttactgtaaacgggatgtcgcactgaacttgcaataccacaaacaaaaaatcgagaataagatgcttatcttactgccttcggtgacaagaagcgagggccataataattaatttatatggaagaataaaagcaagaggttgcaaggcc

SEQ ID NO: 6327 - DNA, 824 bp, Sorghum bicolor
  Clone ID: SORBI-28MAY03-CLUS3993_1
cgtccgggtttgggttcatacattctcaagggattgttcaccgtgacgttaagcccgagaacattctctttgacgaggacttctgtgtgaaaattgctgattttggtattgcctgtgaggagactttatgcgacatgcttgtggaggatgaaggcacttacaggtggatggcacctgagatgatcaagcaaaaggcatacaaccgaaaggtggatgtctacagcttcggactgctcatgtgggaaatggtgtctggtagaattccttacgagaacctgacccctttccaggtggcttatgcagtagccaacaggaacttgaggccaacaatttctccagaatgtccatcggccctcagacccctgattgagcagtgctgcgccttgcagcctgacaagaggcccgacttctggcagattgtgaaagtcctggaacagttccactccattgtctcacagggtggctgccttgaaacaccaaagagcggcacctgccaggaccccaagaagcggctcatgcagtggattcagaaactgaaaccgacgcatagcacctgagtaaccaaagctctcatagttatagcatcgttgcagccgtagtttttgtcaggttgggtatgctcagtagtttagacctgttaaggatccttgattcaaggaaccagtattctaaggatgctcgtagctgtttatctgctgatctgcaatatagatctcacagtagctgtacatggttatgcttttgtaattttcttctcccttgttaaatttacctccaggttattctcatgataacatagcatgtgcccctcactcgttgaggtg

SEQ ID NO: 6328 - DNA, 585 bp, Sorghum bicolor
  Clone ID: SORBI-28MAY03-CLUS39958_1
tatgaaggagaaggggaacgtgctgaagataaccatctgttaggatacttcaagattactggaatcccagcagcccctaagggaacagttgagatcagtgtatgcatggacatcgacgctaccaatgtcctcagggtgtttgcaggggtcgtcaagcctcaaggcccagccactccaccattcatcgaggtgaggatgccaacgctggacgatggccatggctggtgtgggcaagctctagcaaagatgtatgggaagactctcgaccttgctgttcttccaaagaagctgcagccatgatatgtgccttccgtggccccctaagtagctggtgcgttgtgcgtacgcggtggatgctcagtgttcagtattcgctgtgttatggtcccccgtctttgtgtgatcactgtttacatgctgttgggcagtctacagaactgaactaccagtttcatccttgtacaataatgtgtctccagtacatgtgaaatgaatgttgcgcatgttttggcttcattcatagttttcaggagtagttgagtgcttgtgtacagaacgaaactttcagtttcattttttttttgg

SEQ ID NO: 6329 - DNA, 720 bp, Sorghum bicolor
  Clone ID: SORBI-28MAY03-CLUS40039_1
cagaacttgggtggcattcgtggtgcatccctgtttccccagagcattcgctcggctgctgccaaggtccgtccagctcgggcatcagacccggggcatggcatcacaaacagcgaccatcactatattgacaatgcaagtagcgtgaacggacacctctctggggactcaaatggggctctctcacgcaatggtggcagctcaacggattcgccagacagggggagcatcggaaccaaggagaccctgagcgagctggacatctatggtagctcgcgctatgaagcaatgctgctgagggaggacgtgcgcaacacaagctggctgcatggattcgatgacaagcctgaccaaagcccgctgtttgaccaccggttcgagccgctgccagagcccttcagcccgttatgacagctgctgcttgtaaagtatgatcatcactagctcttcgttctgtgctccttttgtgctgcaagatgtgtatgatttcttctgttttctgtcctataattggttggttctgcacttcccccaatcccaaagacgttgagattgcggggtttgagtctattgatttgtccatggagattggttttccactttccacgaattgttgtactgaaagaaagaaaaaagatctataaagaaacaaaaacagtaaaagatttgtaacttgcaagttattgtaatgcctggatgctcgcttcgtgtgatcccgtc

SEQ ID NO: 6330 - DNA, 749 bp, Sorghum bicolor
  Clone ID: SORBI-28MAY03-CLUS40079_1
tagctggagcagtgctccatcggagcccaaggaaagagaatgacgacgaagcttccccatgtgtaacgcctcacccaaacattcggccggttggggaaagcagggtttcagtaacatatctggtcgatcaagatcctggggtcaacagatcggggtcaagaccagatgaccagcagcaaagccctgagagagaggagctggacagcccgaataaaaggcacctgaggaagaaggcggtgcacatggtgaaacatgctgggaaaaccgctcataatctaaagagcatgttcagcaagaagggcctcgacaagagcaaagaagaagaacacagtgatgaggaaggcgatgttgttgcaatgcaaaaaactggcatggaagttgatccttcactaccaagcatttgatgaccttgcgatgcaaaaggacgggttagaaccatagaagttgatccttctctaccaagtaattgatgctgttgatgcgctagagtctgtggctgatgtcacggacgatgtgaggtaaacgcaatctgcgcgttatatgcaagtgaccttggtatgagcatgtgtagaactgtagtctgtaggtagttactgtaaccccaggtgttaatcaaaggctaatcataggctaggcagtgggttgaacttaaacaagataatgatcatgagctttagttcaaaatcttttaaagtggtgacggaatttctctgaaaataggtcccaacgtgaactttttgaaagacaaa

SEQ ID NO: 6331 - DNA, 640 bp, Sorghum bicolor
  Clone ID: SORBI-28MAY03-CLUS40550_1
gcaactccgcaagcagtcccggtcggcagcagtgaaccgagcagaagaggaagagggagcacgcccgccgcccccgcccccgcccgtgccgagtcgaggctgcctcctccgtcgcggcgcgccgaagatgagcctctcccatcgtctcccccacgcggcggcggcggcggtggacccctactacgtgtatgcgccgcacccggacccgcagcggcagggcgtgctcacgctcttcgtcgcggggctccccgacgacgtgaagccccgcgagatccacaacctcttctcccaccgccccgccttcgaccactgcctcctcgagtacaccggccgcgccaaccaggtggttgcttttgtgacgttcttcacccatgaggcggccctgtcggcaatgacttccttaaatggaacaatttttgatccggagactgggttaccgtttgcacattgagctagctaatccaacttcacgtagacctcgtggaggtggcgaagtctaccgagttattgacaaacggactaacaaaacagaaggaaatgctgatgagaatgtcggtgatgaagttgacgaggaagtatgggggggagacgaggatggagccaatgatgataatggtgatggagaatcatatgagccatc

SEQ ID NO: 6332 - DNA, 757 bp, Sorghum bicolor
  Clone ID: SORBI-28MAY03-CLUS40561_1
gcacgagggcgggctacgtctgcctgcagtacgcgggcggggacgccgccggcgcggcttggcgcctcgtggagacgcgggaggaggacggcgacggccgcggccgcaggtccttcctgctgccgctctacccgaagccacgccgcggcggggctacgaagctggccagcggcggcgactggccgcacaattccaccgccaacctcttcccggaagggatgtactacactactgtctctttgggcaatccaccaaggccttattttcttgatgttgatactgggagccatacaacatggattcagtgcgatgcgccatgcacaagctgtgcagagggagctcaccctttatataggcccgcgccagcgaatctagttcctgccagtgatccactttgtcaacgagtccaacatgacaacccaaatcagtgcgactatgatatcagttttgccgacggaagctcctctatgggcgttcatgtaagggataatatgcagttcatcagtgaagatggcgaaagggaaaatgcagacattgtgtttgggtgtggatacgatcaacaaggaattcttctgaacagactagaaaatactgatggaattctcggcctgagcaaccgggcactgagccttcctacacagctagccagccggggtattatttccaatgtttttggtcactgtatgacgagagatcccagtggtggtggttatttgtttcttggtgatgattaccttcccagatggggaatgacttg

SEQ ID NO: 6333 - DNA, 714 bp, Sorghum bicolor
  Clone ID: SORBI-28MAY03-CLUS40579_1
gactactccatgcatctccctccatccatattcgatccctcagctcatccacgcagcactctcattcagagtaaggctactgcaggcagcagggatcaggtgtgatcgagggaagagctaaattaaggtacgatggatcagttggtgaacgcggtgatggacctggtggtgccgccggcgagcatggtgatgctggcgttcgcgtggccgacgctgtcgttcctgcgcggcgtcgagtgggcgctcaagaccctcaccaaggaggacatgctgggaaaggtcgtcgtcatcaccggcgcatcctccgccatcggcgagcaaatcgcgtacgagtacgcgcggcggaacgcgaacctggtgctggtggcgcggcgggagcagcggctgttcgggatccgcgacaacgcgcggcagctgggcgccggccaggtcctcgtcatcgccgccgacgtcgtcaaggaagaggactgccggaggctcgtcgccgacaccgtcagctacttcgggcagctgaaccatctggtgaacaccgtgagcttgagccacgacttcagcttcgaggaggccggcgacaccacggccttccctcacctcatggacatcaacttctggggcaacgtgtacccgacctacgccgcgctgccctacctccggcgaagccacggccgcgtcgtcgtcaacgcgtccgtcgagagctggctgcccatgcccagg

SEQ ID NO: 6334 - DNA, 913 bp, Sorghum bicolor
  Clone ID: SORBI-28MAY03-CLUS40647_1
cagcgactaagaccagttcagtatacaaatctcccttaaatcttgcctcatctgtatctctagcaacaaagacttatcagcctctctcacttttttgctgaacgacatagatatgggattggttcttccggtcctgtgagctgaatggaagaatattactgagtgagggcctgatcacagccgaagatatggaggaatatatcaccaaaggaaaatgcaagaagttggggactaaattaccttcctggtgtatctttcagtgtctattacgatctgcaaattctgattcggatggtttgctcatatctgataatgttgaagtgacaaacctcaactggcctaaagacagagtatttgactggttgcttggaccacttctggtcatcaaggatcaaatgaggaaactggagatcactgaagacgaggagacgtgcttgaggaagctgatcatgacaaacaagaacgagaagccatctgactgggacgatgctggtttcccctcagatgacaatataaagagaggtcagctgcaggctataatcagaaggttgcaagggattgtggccaacatgtcccgagtaccgagtttcaggaggcgcttcatcaacctggtcaaggcgatgtatctagaggcaattgaagcaggaactatcgacggatcgcgtgacatcaagcgcaaagttaaggcggatgttggtactgaaaaattcggcgacagaggtgcagaagatattgccggttcatcaactcaccctcaatcgaatattgacattgtgtgataatgtactagtgtagtgtgcacaattaatatcttttgaacactcctctcctgtgagcctggattcaggatcgcagtttctctagtatacggtttattgggaaagaaacttgttatccccacgtttaagggatc

SEQ ID NO: 6335 - DNA, 726 bp, Sorghum bicolor
  Clone ID: SORBI-28MAY03-CLUS40673_1
aagatcatgggaactatctgtcagcttcattagcatcatcttaattccaatagttggtaatgcagcagagcatgccggtgcagtcatatttgcttttaaaaacaagctggacatcaccctcggagtatctttgggttctgctacacagatttccatgtttgtggtgccattgagtgtccttgtagcatggatcatgggagtcccgatggatcttgatttcaacttgcttgagactggttctttgtttcttgcagtattagtaacggccttcacgctccaggatggatcatcgcattatctgaagggactgctgctgctgttttgttacattgtcattgctgtatgcttttttgttttgagacagcgtggaaatggaagcaacaatgatgtccatcatcagctgggtgtagcaagcaagccatggaggatttagagtgccagagctgacagtagtttctcaatgaatagcatggactttggtttgcacaattttgcatggagcactggaggagccctgtgaagttctgactaaagtatgtagactgcgggaagatgctgtgcatctaatggtgaaagcagaaagcaatcaagcgagacaatatgtaagtacatacaaagactatagctgtaaactgatgcgtatgtcgtattatatagatgttgcttgagaaagtgtacattactgttgttttgttcttccaaccgaggtggtgttatgtggatttg

SEQ ID NO: 6336 - DNA, 619 bp, Sorghum bicolor
  Clone ID: SORBI-28MAY03-CLUS40214_1
ctctcaatcgacctgcgatagttaagaagcccggtattatcatcaaaccaatacaatatgaggaggttaatccccatgagaagcctgatgaaccaaaacgagtcattcagagagcaaccccaaaccagaaagcaaagaaagcctttgccaaacaaggaaagggggcaacttcacaaaagagaaagtgatgagacagtcgtctttttgtcaatggcttcatttgatgagaagcgaagacataaaggagagctgatccgaattttatgttgccacagcgaatttgcaagtgcatgcctccaggagtgtatagggattgttctcatagtgaaaatgggttccagctgcagcgcatgacccataggaaaaggtttcacaccactagtttatgagagcagagaaattttggtacaagtagttgtctttgttatttattgccttcgctaatagctacacatggtccaaatgatatggatgctatatttcaatgatgattagcactggccactggttgactagagtcgcctgtcttgtattgtatggatcccactttttcagacgccagtaaatttggatgatttgtgtatgttcaactcgtcgaacatggaacgaagtgaatttg

SEQ ID NO: 6337 - DNA, 528 bp, Sorghum bicolor
  Clone ID: SORBI-28MAY03-CLUS40264_1
gagcttacagtccatggcacacccaagtctcggatgaaggctcatgttcttctcgacctgttgcgcaactcgccgtactcaagatcaaagctgcaggcagacacgctcgagaacctcgtgaccaacatcgcttcccaaatagacggcgaagaccgtggcggcaaagcgaagaagatgctcgctgagatggtgaaggtcagcatggagcagagcctgaggcatctgcagcgccgggcttccttcgcctgaaactgcctcaggtgacgacggatgccccccttattttgcaatggaaatagaagatagctcaaaataatgagattcctggtgatgccggtccaggccgtgacaaggaccgagtgaccggtctaagcccttcgtatacttatacctaagctcttgacgtagaactccatttccccccttccactcgccaatcttgtgtctcactacgaagaaaagagatctgatttttcttgtcgctgtaagttttcccttcccaaggttttgtgcatgtatcaaaagaag

SEQ ID NO: 6338 - DNA, 486 bp, Sorghum bicolor
  Clone ID: SORBI-28MAY03-CLUS40268_1
aagccggacaggacttatggaatcccctccgaactaaccagcctcatgcaaatgtcccggttcaagccaaaatccaaaatcaacaccttcagtggagataagagcctcccgcaatggaaatgacgtatggagcacaggccaacagtaccctgtcatctcatgtaatcagggtgtacaaaatactgtctaaatcgaaagcacattccatagaagattacattgtttgctgcatttggtgaacttacagctaggagttcagattgtagaagcccacagctgtgtacaaagaagaaaacatagctttagaaacatatatagctgaataagagcttcccagtggaatgtcaaattgtcttcttagtttcttttattctgtgcgtcccaaatgttgcgaaacagcaagggtctactcattttgtaacaataaaagcctgatttgtgggctaaaccaatcctgcaagggtttgtcaagaaactagttatggc

SEQ ID NO: 6339 - DNA, 817 bp, Sorghum bicolor
  Clone ID: SORBI-28MAY03-CLUS40310_1
aattctgttaatgatgacaagttgaagactgctgaacttgtatttggtaggaaaaagtcgacggccacgaagtccagaccaaaagtagttaagttggatactgaggatttcctcagttctatgatgcctagtgcaaatgttccaaaagaagacccgttgtctggtgctctacgtgatgtgctcttgggtagtgatgctaaagcattgtcttcacaaaggacttcagatataaacttggaaggaatgctaaacaaaacaagcagtaatgaatctagcactccacggatagagaatttaggaagccatcctgcttcacattctagtagaacaagtaagcaacaaaaccatgataaagagaaaggtgcaaatcctgctgaaagtgatggcaaagaacaaagaaagcccagaagctctggtagaagtgggcatcgtcagggaaaacataagcatagagaaaagtctagtactcagcctgatactgtacctcaggctccagtcattcaagatttccttctatagcatctaagagactcatctggtacacttcagttacccaatatatgtggatatttgttcattgaagttgaatgcatttcattctcttttgacctggggggctgtttcgtctttgatctgttactggccatgctgtttcatgtttagtcatagcatttgatgcaatttgctccttgataggtctattgaaatatgttagttcatatggcatactgtgagagccagacacagtttttatttagtcactttatgggtacttctataagactataaccctcccatttacttttcaaaattgtgg

SEQ ID NO: 6340 - DNA, 643 bp, Sorghum bicolor
  Clone ID: SORBI-28MAY03-CLUS40302_1
ggctgggtttaacattaaggcgctttcccgtaaaattgctgctgcacttcctggaatggagacactctcatcagcgaagcaggaagacatggttgatgtgaacttgaggtccggcaatgcaaactcgtcccagtctcaggctcaggctgggggatgcagttgttagttgcagtctctgacacttgctgctcatgatctctgagaccctgagcatcagaaagcgttatcactgatgcttccctcgggaaggagagttgattgcctctcagccagtgaacacaccataggctttacccggtgaatggaccatttgcattggaacgatacgttttatgagttctctagtgttatttcctcagtggcctaagctagcaacagtgtatagttgggttggcactgcaaacttctaccattcgagttgggtattagagctagttattggttcatgttgaacttatatattttccatcttgttgcagttagcttgagtcatgtttgctatgtgtaccaaacatgtattggaatttggaatttttgtaagctaaaataaggccagcactgcaatagccccacatgatatccctgaaacatgtatcgtttaaaccatgagatcctaaatttatatcgttcaaacctttgcttt

SEQ ID NO: 6341 - DNA, 502 bp, Sorghum bicolor
  Clone ID: SORBI-28MAY03-CLUS40392_1
tgccgtggaagctgctggtgggccagtaaggctggtgtttttcaacaaacttggattccgggcgctcctgaaacctgagtggttcgagaagaagggccgcctgttaccaaaagcagcaaggcctccgcccaagcagcgagacaaggtcgatagcattggccgcctgccggcaccaacaaagccactccccttcactccagaggagctggaatttgcagccaagcgtgatgccgctcgtatgaccgtgaccgcataagatgggagcacgttggcagccccttttttttttcttgttctacccaagaaaaaaagcatgcccccctgaatgtgcatcccattagctttagggggacatgtataagaatgggctgttgtatctttcttttcccgcaaggaatggactgttataaattgaaggtccattcctcggaatgagacttggcatagtttctgaacttcccttggggtttggattgatgaatccagtttttctgaataggct

SEQ ID NO: 6342 - DNA, 468 bp, Sorghum bicolor
  Clone ID: SORBI-28MAY03-CLUS40840_1
gcacgagggccacggacaacagagccattggcgaactcgctggcctcgctgtcggagctaccgtcctgctaaacgtgctctttgccgggcctgtatcaggagcgtccatgaacccggcgaggaccctaggcccggcgatcgtcgtcggccgctacgccggcatctgggtgtacttcgccgggcccatatgcgggacggtggccggagcctgggcctacaacctcatacgcttcaccgacaagccgctgcgggagatcacccagacctcctccttcttgagaagcgtgaggaggacctgaactggagaagctgccacccaaacaagcaactctctgaagatagatacagttaacagtgctgttcctttatttgtagctactctctctctctctctctccttttgtcaattaatttacatattatatagtaatatgcttggcttgttagattaaaaaaaaaaaaaaaaaa

SEQ ID NO: 6343 - DNA, 818 bp, Sorghum bicolor
  Clone ID: SORBI-28MAY03-CLUS40891_1
gcacgaggagtaagagataatgctgctggtgctattgctaggatgataatggtgcagcctcagtcaattcctctcaaccaggttcttccagtttttatcaaagctttgccactaaaagaagatcatgaagaatcaatgactgtgtatggttgcatctgcagtttattattatcatcacatccccagatccttcctcttgtgcctgatgtcatacatgtctttgcccaagtggtggtatccccagatgagagcgatgaagtcaaaacaaatattggcaaggctgtttctcacttgatatctgtctatggccagcaaatgcagccaatactgagtgcccttccaccagctcatgcaagcgcgctggcttcatttgccagtagaagatgaccaccgaggaccaacttttctttagttccttgttctgcttgattttgttttggttttgccattggttgccatttcctgaggatccgatcactcggatcaaaccagatggagtgcttgcattgctcattggcaaagagtgagcagagttgtccagttggcgcatgcttgattatatggtgagcttggttcctctctttttgagttacattgttgtgcttgctttggagccctgtatggttaaaggtgcacgccttggccgacagcgcctctgtgagtgcatgcctgtattcaggttccggtttttgttatttattatgctcttgtttttgtaattttttgcctgtctttgcaattcattgattgctgttgtatatagaagagagttttaaatagagagaatgtatgactcttcaactggcaaattttgtata

SEQ ID NO: 6344 - DNA, 679 bp, Sorghum bicolor
  Clone ID: SORBI-28MAY03-CLUS40878_1
tttcaaaaaagagttcaaaaggagctgaacttggagatgggagctgtaatcaaagtcaagcgaaaagaatccatcttgactacacgatgggtggccataccgcagctgtgtcttgtgtagcattttcagtatttggtgagaaggggaagttcctcgtttctggcggcaatgatgcatcagtgaagctgtgggattggtcgaaaggattttcctctgaaacaaacagcaaagttgaattggttttgaatattgatgtaaagaaaaaggtaaattggctgtgtactgctccaactgattcagataacttgattgtgtgtgacacatccaaggtggtcaaagtatataatttccggtagatggatcaaggtgtagcctcagtttgtcagacagctatccgagggagtgaagattgtctgaccgctggaaccaatttggtcctaactctggtatccagatattacaagcctggtgctgatagctcctgagtcgagaagtcattggttagcaattcacaatatcagttatggcgtggaacggatctgataaagtatcgattattttgttactggcggatcttattttcttccgatatgtgtgtacaatacaacttccacaggctgctagctagacttatctttttgttgtatggtgaaatgaatttacgtgtttggagaaaaga

SEQ ID NO: 6345 - DNA, 936 bp, Sorghum bicolor
  Clone ID: SORBI-28MAY03-CLUS40900_1
gtttttgttccttgccggtgcttcacataaggtcgtgccggttcgaggaaacgctgtataggtttaaagcttgtttgttctaacccgtgccacaagcgcgaggaatctgtagaagtcgattcgtaccaaggctgaacgagtcgcgttgagcggcgtttcaaactccactacggttggagcgcagaaacggcgtgaccgcacaataaagggatgctgccggcaagacgacgaatgcgattccgtcaggagagaacatccgatcaatttccaatggaccttgaaaggaagcagcatgagtgctgagcaactcaccggcgcggacatactcgtccgttgcctcgctgaagagggtgaaatacgccatagctcgccgtgacgccaaccgaaacgcccacaattcgcctctccgatccggcacgacaccgccgccgccgccgtcacggtagccatgtccaaccccggctcgtctcccgcctccggtcaccacgaccacgagcacaccccgctctgccgctcctgcggggcgcccaccacggcgccgaccccggccccctggtcggggaccaccgactccccgccgccggcgtaccgccccatccgtctcccagccatcaacgcgcccaccaacacggccgccatcgtcctctccccggtcccgcagccgctccccgtgccccccgccgcgccgccccacgccttccaggtccccgccaagcggatcgcctcaccggacgacatcgcccgcttccacgcctcagtccacggccgccacttcctcgggttcgtcgccgcgctgtccgcctccatccacggccgcaagctctcggacccgctaccgtccccgccatccccggccgtcgctgcgctcctcgacctcgtctcggctctcgccgcgctcgtcgaatccatccctccgcttccgcacagctcccggta

SEQ ID NO: 6346 - DNA, 648 bp, Sorghum bicolor
  Clone ID: SORBI-28MAY03-CLUS40483_1
gcgcataaaccctccactgccgcgccgccgccgccgcttcctgtccccgtcggcccctcctcgccgctcgcgccgccctcatcttcccagccccaacgcgacacaccacaagggccgtcgtgatgtcgaagaaaggaggacgagcgaagaaagcggcgggcggcggcgagctgtcccgcttcctagagtcgcatctccagaccatcagcgacaccttccagatgatggcggagtcggctccggtgagcttggagcggacggagtggtctgaggtcgttaagctcggcgaccaggtctccaggcaggccaccgtcgctggaatgctctggagcggtgacttgcctgatgtagagaccctcaaggagaacgtcgatgcttacttcaacatcctacagggatttcttttggtttgccacggaagcatggtcggtgctgggcctactcttcacaagtccatctatggttctgcaaagaacgtggttgactccagcttctcattgttcaagcatgctgtttctgcttgtgaatctcgcagccctgaccgcaacacaactataccccaggtcacaggaactgtatgggaagcttgtgctgctctcaagaaggtgcctacatcaaactgtattgccataggacgagccatgacca

SEQ ID NO: 6347 - DNA, 545 bp, Sorghum bicolor
  unsure (1)..(545): unsure at all n locations
  Clone ID: SORBI-28MAY03-CLUS40518_1
gcacgaggctctccctccctcgctcacacacgcacaaggagagacagaggcgcggcaaggacccgaccgacgcacacccgcgaggccgcgaccgacggagatggagtcgccggaggcctgctcgtccggggagacgtcccccttgtcaccggcggcggcagcggcggcggcggcggagcgcccgtccgaggcggcggcgctgcgagcgctcgtcgaccgggtgcgcgccggggaggtggacgccgcccgcgaggtgcgccgccccaccagggcctccgcgaggcaccgccgcaagctcgccgccgccgtcgacccgctcgtcgccatgctacgctccgccgcgcccgaggctggggaggccgcgctcctcgcgctgctcaacctcgccgtcagggacgagagaaataaaaccaagatagtggatgccggtgcacttgagcccctgctttgttatttgcaatcaagtgatctanatctgcaggagtatgcgactgctgctctccttacactttcagcctcgtccaccaataagcctatcataagtg

SEQ ID NO: 6348 - DNA, 928 bp, Sorghum bicolor
  Clone ID: SORBI-28MAY03-CLUS40488_1
gcacgagggaatggttcaaggcagattaaatgggaacaaccaacccttagtattggggacatgggaaggcctttcctaactaggtctcaaagtgcattagagtcacctcaatgtactcgaagagatgacaataaggatccaacctcagatagcacaagtgaatcgttttcagaggcatgtctgagcatgagcctaggtattgcaagcaatggaaacaggatggaggctacttcaacagcggaaagacctatgctatcgccaacaacagccattgctgaaggaagagaacttgccactacactatctccctatcagcacgcacaaagggctcggcatttcttgacccgcccgccaagggttggtgaaggtgctgcttttgatccaacgagagacatgtttccgcatcttcgtgttgctagaccgcctgctgagggaaggggccgcaatcaattacttcctcggtattggccaagaataacagaccaagagctgcaacaaatatctggagattcaaattccacaatcgttccattgttcgagaaggtcctgagttcgagtgatgcaggccgcatagggcgccttgttcttccaaaagcttgtgctgaggcatatttccccccaatttctcaaccagaaggtcgccccttgacaatccaagatgcaagaggaaaagaatggcattttcagtttaggttttggccaaataataacagcagaatgtacgtcttggagggtgttacaccatgcatacagtctttgcaactacaagctggcgatacagtgacctttagtcgtatagatcctggagggaaacttgttatgggctttcggaaggccacaaatactgttagtctgccagactcacagatttcggctattgcaaatggttccattctcagtgagacactcttttctactgcaaatgaga

SEQ ID NO: 6349 - DNA, 1030 bp, Sorghum bicolor
  Clone ID: SORBI-28MAY03-CLUS40535_1
gcacgaggattcgatgaaaattctgtgaagatagtagcttcaaacactgggtctggggtgtataaggatcaagacctttatgacaagtacattgacatcaaagagatcccagagctttcagtcatcaacagaagcagcaagggggttgagcttggatcagttgtctccatctctaaagcaattgaggtgctatcagatggaaatgtggttttcaaaaagattgcagatcacctgaccaaagtggcctctccatttgttcggaacacagcaaccataggtggaaacatcattatggcgcaacgattgcaatttccatccgacattgtgactgtactactagctgcaagtacaacagtcactatccaggtggcttccaaaacgcattgcctcgccttggaggaattcttgcagcagcctccatgtgattctaggaccctgctgctgagcatatttatccccgattggagttcagatggcatcacctttgagaccttccgagcagcacctcgtccacttggcaatgctgtctcatatgtcaattcgcctttcttggcaaggacttcagtggatgcaggatcaagggaccatctcattgaggatatatgtctggcgttcggtgcgtatggagctgatcatgctattagagctaggaaggttgcgcgtggcctgaagggcaaaacagtgagctcgtctgttatacttgaagctgttcggttgcttaaggagactgttaaaccatcagaaggcacaacacatcctgagtatagaatcagcttggctgtcagtttcttgtttaccttcctatcctcccttgccaatagcttgaatgaatctgcaagggttaatgatcccaatggttcttataataatggagacacaaacggcaccattgagcactcaccagagaagcaacttaagttggacagcaatgatttgccaatacgatcaagacaagaaatatttttcactgatgaatacaagccagttggcaaaccaattaagaaagccggggcagagatccaagcttcag

SEQ ID NO: 6350 - DNA, 1066 bp, Sorghum bicolor
  Clone ID: SORBI-28MAY03-CLUS40545_1
gcacgaggtttcatatttgtacctttctttgctttccaagcatatggatatttgaacatatgtgtacatgggagctcagaggaattgaggccgtggtgcaaagcaaaagttcccttgttgtatggattcattcagagccactactggggagttggtttcttgaggtacttccaagtgaaacagctgccaaactttcttttggcttcaccagtactttctcttgcggtttattctattgtccattacacaaaattgcttcaccgacttttccaaacaagtagcatccacaagcagattatcactgctctcgaggaaaggtccgttgtgtcatatagaagatccgatgatgtgacaattttgagtgaactttctgctggactcactaagaaagcacaaggaaactctacggttaaacagagaaaatcggttgctgccgaaacagcttctgcaacgttccatgatacaatgtcagctaaacaaaatatggaagagaatcaagatgcatgctccatattactacttccatttgttctgcatctagtcttcatgacattcacagccttctttgtgatgcatgtccaggtgtccacacggtttctatccgctagtccgcccatttactgggctgctgcacatattttggcttctccgagccgatcctccaaaagatggggctacttgatctgtgtctatttcatcgcatacatacttctaggtagtctgctcttctccaatttctacccgttcacgtaagaacggtgggggaaccccagatgcgtcatccaatagtgcggttgtctggattgctcatctgtttatcaggaggattatctcaactagttggacctgaaggtttccctaggactaggtaggtgcttccctggttcagcaatattgtgcgttgactacttgattcgctgatgtattcttacatatctggagtacgtatatttttcttgcttcgggttatgatggggccactagctttaagatcacaagttggagatgcaaagacagaatcagtccggacgaatttagctgagctgcaaattccagctcgctctcc

SEQ ID NO: 6351 - DNA, 963 bp, Sorghum bicolor
  Clone ID: SORBI-28MAY03-CLUS41045_1
gcacgagggagcggcgcggatcgtgaccccccgggtccaatcgatcgatggacggtcacgcggccgtccatgagccgctgctcccgtcgccgccgctgcagggcaaggcggcgtcggcggagtcgaagcggctgatgcggctggcggggccgatcgtcgccagctgcgtgctgcagaacgtcgtcaacatggcctccgtcatgttcgttggccacctcggcgagctccccctcgccggcgcttccctcgccacctccctcgccaatgtcacgggctacagccttctcaccggcatggcgacggcgctggacacgctgtgcggccaggcgttcggcgcgcggcaccaccgcctcctcggcgtctacaagcagcgcgcgatggtcgtgctcgggctcgcctgcgtccccatcgcgctcgtctgggcgtgcgccggccggatcctgctcttcctcggccaggacccggagatcgccgcggaggccggcgcgtacgcgcgctggctcatcccgtcgctcgccgcctacgtgccgctgcagtgccacgtccgattcctgcagacgcagagcgtcgtcctgcccgtcacggccagctccggcgccacggcgctctgccacttgctcgtctgctgggcgctggtgtacagggccggcatgggcagcaagggcgccgcgctcagcaacgccgtctcctacgccatcaacctcgtcatactggcgctctatgtgaggctgtcggacgcgtgcaaggagacatggaatggcttctcatgggaggcgttcaaggacctgtggaggttcaccgagcttgcctggccgtctgccatcatgatctgcttggagtggtggtcgtttgaagtccttgtgctgctgtccggtcttctgccaaatcctcagctggaaacttcagtcctgtcaatttgcctaaacacaggggctctgctctacatgataccattggggctca

SEQ ID NO: 6352 - DNA, 627 bp, Sorghum bicolor
  unsure (1)..(627): unsure at all n locations
  Clone ID: SORBI-28MAY03-CLUS41061_1
gcncaagtcgattcacaacccagatatcttggagaatttctccaaggagtacatgtatctggcatgcgttgcatacgtgaagaaggtaaagaaggggccctttgtggagcattcaccgatgttggatgatatcagtggagtggccaattggaagaaagttaacagtgggctgctcaagatgtacaaggctgaggtgcttgagaaagtgccgatcatgcagcatttcctctttggctcactaatcaaatgggaggactaataacatcttaggaaagctcaccaattatctgtgagaattcatgtatgatgtgaggactggttgtacagtggtgctactcagagttggctgaaaaaagaatacatatagaaggtcattttccacctagggtgaatgagcgttctgtatgtttgcataccgtgccatcacacctatcttctggcgttttaaattctgggaacttgtcggttcctgctcagcttgtgcattacttgaggattgccttggttccttgagggcaatgtaatgttagttgaataacacctttgtattgagacttttggcgtagatgaccagagcagcctgtttggttttgctgaatggaagcctgaactgtactcgctatattt

SEQ ID NO: 6353 - DNA, 599 bp, Sorghum bicolor
  Clone ID: SORBI-28MAY03-CLUS41097_1
agaggaagaggagaggaaggaacgggcggaggaggagaggaagcgacgggaggaggaggaagagaggagaggacgggaggaagaagagaagaggagcgggccaggaaggaggaggagaagcagcggaggagagaggaagaagagagggcaaggagggagcaagaggaggaagagcgtgcacggagacgcgaggaggaggaagaaagagaaagggaggaggaagacggcggagggaggaggaggaagaaggtggaggcggacgtggagatgagccagagagggaagatgaggaagagggaggtgacgagccgccgtatagcttgtccaacaaactgaacaaacgctaccgtgctggtatgttcaggagtggctgagcgagcagccgggaaggctcgagcctctgctcgttcgtacaaataaacagggggccacttgccagatcacttgccaggtcaccaccactcgtacagaggaccacctgctagtcggctatgtaggtcgtgatgtgtttgttgtgtcgttcgctaaaccgtgctgtacgctgagtttagatcccgcttgtatgaaatgtaccataaataagcagataagttcagtgt

SEQ ID NO: 6354 - DNA, 696 bp, Sorghum bicolor
  Clone ID: SORBI-28MAY03-CLUS41125_1
aacatctgctagacgacgatgctgacatggcagcgatgcatctgtcggagaaggccgcattccaagcagctagtcagtcgtctagattcgacatcgggacagaactcgtcgaaatcgatggagagggggatgaggatgaagcaggaacagagcaagaagagcaaggatccatgaccttcatgccgaagattgacgagctggagagcttgctggaggtctacttcgtgcagatcgatggcaccctgaacaagctctcaactgtttctgcgggagtacgtggacgacacggaggactacatcaacatcatgctggacgacaagcagaaccagctgctgcagatgggggtggtgctgtccacggtcacgctgctggtcaccagcgccgttgtcgtcaccgccatcttcggcatgaacatccacatcgcgctctacaggatcaccgacctcaacgtcttctgggaggccgtcggcggcacgctcgccggcgtagccatgctgttcctcggtgccatgctctactactggaagaacgggatactgcggtgagcttcttcagcgtgagctgcccggcgtgctgtgttcttgctcctggcttcgctgcgtgcgaggtgttaaatttgtgcagataagttgagttctggagatgagtatattgtaagaatgtgcgccttaatcggcggtggcagaataacgccc

SEQ ID NO: 6355 - DNA, 596 bp, Sorghum bicolor
  Clone ID: SORBI-28MAY03-CLUS41149_1
gtgctagtgcgcgtcgatttctttctcctcctcatcacacgccgccaccggccgatcagatccaggcgcctcacccggcggctccggcgacggtgagtcgccgccggccatgtcaccggcggcggcgtggtgcgcgcagcaccgcctccggttcctcctaccgtccctcttcctcgcgcccgtcctcttcttcctcctgtcgccgccgtcgccgccgcccttcgtcagcctccccgcccccggagagctgcctccttcgggctcgcggctcatatgggcgcagcggcggttggtggagtggcgcccgtgcgggtggtggcggacggcaccagtgcaagctccgtccaggaggaacgggtacatccgaatagactgctacggtggtctcaaccagctgcgacgtgatctatgtgacggaattggggttgcacgtcttctgaacgcaacgatgattctgcccaagtttgaggttgccgcctattggaatgagtctagtggctttgcagatgttttcgatgttgattacttcattgagcagactagaggatatgtggaagttatgaaggacttgcctgtggagatagcatccaaagagc

SEQ ID NO: 6356 - DNA, 530 bp, Sorghum bicolor
  Clone ID: SORBI-28MAY03-CLUS45514_1
cggccgcagcatcgcggtgaagcggctcgacgacctgtcgcaggccgatgaggtgttccggtcggagctgagcgtgatgagcggatcaaccacatgaacctggtcaggatgtgggggttctgctccgaacactcgaaccggctgctggtctcagagttcgtggagaacggctcgctggacaatgccctcttcgtctcggacggcggcgagagcacgctggggtggcgctcgaggtgcaagatcgccgccggcgtcgccaaggggctggcgcacctgcaccacgagtgcctggagtggatcgtgcactgcgacatgaagccggagaacatacttggtgaagctgttcagccgggacgcttactttttctgcgagtcagcagtttttctctcacagtaaatcagtaaaatattactttcagccatgtctttatagataagcgaacgggctaatggttcctgggtaaaaagtgtgtgggtgtcagatgttttatggaatgttgaaagaggtatttggatacgaaaaatattgg

SEQ ID NO: 6357 - DNA, 669 bp, Sorghum bicolor
  Clone ID: SORBI-28MAY03-CLUS45537_1
ttatgccatttcaccaagctttttgcatagaaataaccatttggcaaattgtgacaatgagagcgtggtttctgagtcgggagcacctggttgccatggactcttcccatgctggaaaactgaaaaaacgaaaaggagaaagggaaaagggcagacacggttgaggtcatcttaagttggcaattgacgacgataaaacgagcattgtggccctggattgtagaggaacgtttgaagagatgcatgtgcctcacgaaactgccttgcttcattctttctagaggatttaggaagaccaattcgttaatttccatgcaatcaattctgctgctgagggttcagcattttcagctcgtggactcagcacagggtgataaaagctggatacttcatactcagcagagatgttggacatgcagatttgaacaagtcattctgatccatctatgcttcttgtacagacatttggatgtgtaaccccttgccgagtcgcagggctgaggcgtgaggcggtcagcggaattaggaaatactattgattagcgagttgatgggacgcacttatttttcagcattttttttgggtactgtgtttgagagcagttgaatttactttacatttgttattgtaccaacactttttgttagaaaaaggaagaccttacgtcg

SEQ ID NO: 6358 - DNA, 688 bp, Sorghum bicolor
  Clone ID: SORBI-28MAY03-CLUS45529_1
cccggaaagatatggaaattgatcaactcctgaaagacaaagtcaaatctccaagttcattaacatatagaaatgacagcaaccaacagatccgacggcaatcgggggctggtggatcatgtgaagccgaatgtgaagataacatatctgatgatggttgctcagtagcaggaactgagtgttctgtaggtggtgcttcagaggcgacaccagaacggatgcagaaggccccatcaaggatagccaggttgttcctcactaagaatggccagcctgcaaaccccaagccaaaaccaagggagtctgctctgaaaccaccaggtcgcacgacatctacaggaagccaggcgacaggaggagcatcctcagtgaaacccccaaagaggcggtagagaaataaagattgtagcatctgggggtttgccatgttgatggttgatgagatatgcgtctgtaaaccgactcaggagattgtactgaaacacaacaggtgatgctatgtaagggtatgtcaacggtctgttgagtaatgctgatgagcagccgactataggctggacgtttgatgggaaatgttgttggatgtgcagcaggcgcgagagcaccgttgccttttgagtttaggactttaggcggctctgcagaggccaatggtgttttgagttgcagacgagaaaaaagtataaga

SEQ ID NO: 6359 - DNA, 617 bp, Sorghum bicolor
  Clone ID: SORBI-28MAY03-CLUS45589_1
cagcatcctcaagatcaaagtcgtggagctgtgcaaggatgatgttgctgttcttgcagggctgcctgtgctgtctcgtcttattctagacgtcagaaacaacaatgtctctggccaacaaggaatcgtcttcagtgctgatacatcattcaggcttcttggttacttgagaattccctaccatgctgaatcggggatcaccttcgaggcaggatcaatgccccaggtcgagaccctccggtttctgttgagggcgaacgatgtgaagcgatggggcgtcaggttcagtggcattgagcacctaccgagtcttaagcaggtgctcgtcgatttacgatatggcgactgtgacgaatcagagaagcctgttataagggcagcagttcggagcgctttttatgcccattcatcaccctcgagcgttcagttcgagttctattgactgcaaatacgattaaactagaggtttggcccacgcatgtggctagtagtgacagaccttacaaactgtgtatttatttatctaccacaaaatcttatcttgaccttaattacaaactttatattttttattgacttattttatcatcactcttctttctgtcactatatattgt

SEQ ID NO: 6360 - DNA, 767 bp, Sorghum bicolor
  Clone ID: SORBI-28MAY03-CLUS45601_1
attgagtgagcttgatgaagatagtagacttcaatgtatggagtttgcttctcctgttttgacaaattttgagagtaaagactgtggagaaacaccagcaccacaaaatcttaatgagattgctgaagatagcaggctccaatgtattgaattcacctccccagctcacacagttctccgagataaagcaggtgtagaaaactttgcatccccaagttttgctgtggttgcaaaagatagtaagcctccatcttcggaattcacgtcccctgctcacacagttgcaacattccaaccgtatgcagacgacatgcctacccccaaattcactgctagtgagaggaattttctgctgtctgtgatagagctgacctcaccagggtcaaggcctgaaacttctcagcatccatcttgcaaaagggctcttcttaatagcctttgaaatgtgtttgcataaaatcccaagaccaagcctgctatgcccctcagcataatttggctactcctatatgcatgaagtgtgcccacccgcaagggtttcatagtttgttttgttttgtttgttgtgtatataacgatgcattggtgtggttgtattagcatacaggaatgaaagggtggtggtgtaagtgtttacagcttgtattcaaaatatagaataagtaatattctttgtgtaattaactctgtgtaattcttctctcgggggccggctatcagattactgtgtagtgtgatgtaatggctttcaaaaaaaaaaaaaaaaa

SEQ ID NO: 6361 - DNA, 923 bp, Sorghum bicolor
  Clone ID: SORBI-28MAY03-CLUS41217_1
cccacttcccagctcacacgccgcggcggagcaccaccgcggccgcccaccatgacctccgccttcctctctctgcgcctgcccaccccctctccctcccacgccgcgtcctccccttccctcccctcgcctctgctccggcaggcgcgtggcggcgtggcgtcctcggcgctggtggcgcgggcggcagggccggcgggagcggcgggggctccgtcgccgctattcaacccccggggagacccgttcctgtctaccctcgcagccgcctcaccggaggaccttgcggccgccgctggcggcgagcgccgtggagaggaccatctgccgttcctcgagatcttccagaacgccaagctcatggcctcgcccgcgcaggtggaacggcacgagggctcatacagtcagcacaggcctagaaggcctcctccagatttgccttcattgcttcttcatggccgaattgtttatattggcatgccgttggtaccagcagtgactgagctcgttgttgcccagttgatgtaccttgaatggatgaacagtaaagaacctgtttatatatacatcaactcaactggaacggctcgcgatgatggtgaaccggtcggaatggagagcgaaggttttgcaatctatgatgcaatgatgcgtatgaatactgaggtgttatgccttacatttactatctgcggttcagtagttcaatgttgatcatttggtacagattggtgctaatcatttactggaatatctagtttatgcaaaggtgccctcagtggacataatttatttttaaaaagaagaattttaccatgtatgcaatcttgatctgcctagttctgtacagatgatttaatgaatagcttgttgatcatttgtttgaactggatggagcatctaaaaaaacttgaccagcattg

SEQ ID NO: 6362 - DNA, 782 bp, Sorghum bicolor
  unsure (1)..(782): unsure at all n locations
  Clone ID: SORBI-28MAY03-CLUS41260_1
gcggctctgcggccccgcctgtgccaaatccaaacgtgactgacggtcgccggaggaaggagacacgaagctcaccgcccttcgcctctccttacaatctcgcaaggcggcgtccgacgtcggtagccgctttcccacatctggtctccttcgccgccgccgcctatactcctgtagaaatactcccagggaggagggcggttgctgcttcttgttcgtgttccttcgcccgctgcacgcgggatccatttgaccgagcgacccacccacccacacaccgagagccggccatgggaaaccacagctcgcgagacgggagcaaacacgggcggcgccagccctccttccagcagcagtcgtcggcgcagtggggcgccgggggagggtactacgcccaggacccgcgcgccgactactacggcgcgccggggtcacaacagggaggagggtacgccgcgccgtacccggccccggcgtaccagcccaccgctgccgctgctccggcgccgcaggccgcgaagccgcggcagctggaccggcggtactcgcggattgccgacgactaccactcagtggaccaggttactgatgctctagctcaagcaggactggaatcatcaaatcttattgtcggcattgatttcacaaagagcaatgaatggacaggcaaattctctttccatgggcgtagtctacatcacattagtaacacaccanatccgtatgaacaagccatctcgattattgggcgaacactatcgaaatttgatgaagataatttg

SEQ ID NO: 6363 - DNA, 655 bp, Sorghum bicolor
  Clone ID: SORBI-28MAY03-CLUS41259_1
aaattatgatgcgcacatggccgccccgccggacgagatgtgattattacaacaacaaagtaagcacgagttaggggaggaacggaaagacaagaacaaccagcacagacaagaacaagaagagggctcgtctcggcaggtcgcaggcacacggagccggaggctgcgtcgctggccccgccggcaactgggctaccgcggcgccgccctacgccaagtgcccagttcttcttcgtcggtcccttcggcaggtcttcttcgccggcgacgagcacctaccaaggacagtgggtacatcgctagctattgcttcatcttatctgctgcagcaagtggaggcggaggctttacaaggagttggggaagtatgggcagaagctgctatcaaatctgaaactctgcttggcacaccagtgctggagggatgtataagaaccagctccaggagcttgcgcagaggagctgcttcaatctgccgtcctattcctgcatccgggagggaccggatcatgcaccccggtttaaggccacagttaatttcaatggggagatgttcgagagccccgcgttttgttctactttgcggcaggcggagcatgcggcagctgaggtagcgctcaatgagttatcgaagaggggcccttcgtcgacgctg

SEQ ID NO: 6364 - DNA, 613 bp, Sorghum bicolor
  Clone ID: SORBI-28MAY03-CLUS41295_1
tggtcagaactaacgcaactacctgaacatcactgcagaatgtattctgttatggtttgctagagtatctcactcaactttgcattgttataactatatcttgtttctttattttttttccccttaggaccctcttaggggtggaagagatccattggttgaagacgtgttgtctattattcatgctgatgatgcaattgcacgtcaaaagattgctttagcaccaactccaaagagattagtttatgagtggcaattaaagttggcccgccaaattagtccattctagcaggtacggatcactttaaagtcgtctgtgtgcaaaatatctagtatgaagcatggagaagcttgatctgtggattttgcaccttcttgaggaaagggtgctcggggagccgttgagctggattggatcaggcaagcaaagaattctcgcgtcttctttatttgcacaatgctggtctagcaatacgagaggaagaagctacatactaacatacacgactggaaatggaaaccgcatctctttcttagcaaagctgtatataatgttgtatattgtattgcacaaaggcttgtaatacgttttttgtgcctcgtcccaaaatat

SEQ ID NO: 6365 - DNA, 607 bp, Sorghum bicolor
  Clone ID: SORBI-28MAY03-CLUS40938_1
gcacgaggctctacagcaagctaatgatgagttacagcagaacatctacactttgactgagcaatcacaacaagccaaggcagagatgcaggatgagttgaaggcaatacaagagcacgaggatgcagtgctaacacaactgaagcagtcagagacttcagtacaaaatcttgagaatgaggtgacacgtgctgaaagaggagctttccgaacagctagaaaacaactccaccttggacaagcagtttgaagaagccaggagcaatctgcatgctcaaatttcagacctaggtgcagagaaggacacagctctattagagttacagacgtctcaggcttctgttaggaatcttgagactgtggttgaaaagcaaactgagaacatttcaactctacagcaagctaatgatgagttacagaagaacatctacactttgactgagcaatcacaacaagccaaggcagagatgcaggatgagttgaaggcaatacaagaagagaaggatgcagtgctaacacaactgaagcagtcagagacttcagtacaaaatcttgagaacgacgtgacacgactgaaagaggagctttccgtacagctagtaaacaa

SEQ ID NO: 6366 - DNA, 671 bp, Sorghum bicolor
  Clone ID: SORBI-28MAY03-CLUS4095_1
cggcccggcccgcccacggggcggctcctccccgtcacgctgggccaggtgttccagcggatcgacgtggtcagccgcgacttggacaacatcgtggagctggagctcggcgcgccgtggccgctgccgccgctcgaggccacggcgacgctcgcgcacaagttcgaggtcgtcgggacgtcgggcgtgaagatcacgttcgagaagacgacggtcaagaccaagggcagcctggcgcagctgccgccgctggaggtgccacgcgtcccggacaacctccggccgccgtccaacgccgggagcggcgagggcgagttcgaggtgacctacctcgacgacgacacgcgcgtcacccgcggggacaggggcgagctcagggtgttcgtcatcgcgtgaaagctgacctgacctgaactccgacggatctgccggccggcttgtgtgtgagattgccatctttcttcttcttctccggtcgatttttggtttgtgcgtctgagtctgaccatgttctgccattctcttcttcgtgaaactgaatttgcgattagctgatgtgtaatgaaaaattcgtagaattggattggatatgtagagtggggacatgtgtttgaccggaaaaatggaaattcgtggaattgttcacaagttttggttattagaaaaatgtg

SEQ ID NO: 6367 - DNA, 876 bp, Sorghum bicolor
  Clone ID: SORBI-28MAY03-CLUS40988_1
ggatgccggaagcaacaagcaacacaaaactttggatcgcccatctgtcgtgtgctcgcacctcgccgcgctcgcgagtgcctcccacgcgtgacgcgtcgcactcccacgtcgtgcacgcactcgcgcagtcgcgctcccccagcgctcacacgccaccgcgccgcctcgcccccctatttaggccccaccgccgcctcacgagtcacgactcacgagcacgccaccgtcgattcgcccgcccgcggcccgcttccccgctccatcgctgctcccttgcacgcacgcacggcacccgcgccccggccaaaagccaattcgaatctccccgcttctctgcgcggccccccgccgcggcgccggggccggccgcctccccgaggcccggtagccttaggcgcccccccgcgtcgttccgcgaggacgtcgggcacgccgcctccgagacgtacctcgtctcgcgcctcaccttcaccctcctccagtacctcgggttaggttaccgatggatggcacaactcctttcactcacaatctacgcaattttacttatgccaggattcttacaagttggatattactatttcttttcgagccaggttcgtagaagtgtagtttatggagaccaacccagaaacaggttggatctatacataccagaagataatagtaggccctgcccagtgatggcctttgtaactggtggagcatggattattggttacaaagcatggggtgctcttctaggacgacgattggcagagcgaggaataatagttgcttgcattgattacagaaatttcccacaaggtacaataggcgacatggttcatgatgcttctcagggaatttcttttgtgtgcaacaacattgcca

SEQ ID NO: 6368 - DNA, 547 bp, Sorghum bicolor
  Clone ID: SORBI-28MAY03-CLUS40963_1
gatgaccctaaccgtagttccaccgtcgtccttgacttcttgctccctcgcggcctcgcccgtatggccactcccccgcatgctaccgcctccggcaagccgcgccacggggcagcgcacaagtaattcttgggccacgggcacaccgtcccggatgccacccgcgccaggaagatctagccgccctccatggccacggccacggccacgccaccgcggcggaggcacgcggcgacgggcgccgcggcgggggagtgggcggcgctgtcggcctcgggcgagtggcgggcggaggccatcgggaagcaccagctggtgcggcggacggggctgtcggcgcgcgacctccgcgcgctggacccggcgctgtcgcacccgtccagcgtcatggcccgggaccgcgccgtcgtcgtcaacctggaccgcgtccgcgccgtcatcaccgcgaccgaggacggagaggtagggaaggacgggggcgtctcgccgccgagcggcggcggcggtggcaaggcgctgccgttcgagttcagggcgctggaggtgt

SEQ ID NO: 6369 - DNA, 562 bp, Sorghum bicolor
  Clone ID: SORBI-28MAY03-CLUS40998_1
gcacgaggtcttctacctcgcggcgatccagattccgcagcaacggcccctctcgtcttctccctcgcgggctcgatccctccggattggcgcgtagcgggttcagcgggtattcttaccattttcagattcagctggttgaacaaaactcgtaaagatggcatcagaagggaacaaagatgtacctaatgaaactttgtctgtggaccagtcatcgatttctggtgtaaagcgcaagcgtggccgcccaaggaaatacgagtatcctgtatatgaactaccacagaaggtacagcccctccagagcgccccacctcttcttcactgcacacaagatggctcaagtatggccagccatacatcaggtggcagtgttcatggtaattggtctgctcaacctagaaattcggctaatgtttctcttcaaggtaattctggcaaggataacgttcttggcaagcattttgttggcaagctgaccaagaaagttcctgggttttccctcattacggtaaaagtgaaggacaatcaggtgctcaaaggttgggttccagatgaaatt

SEQ ID NO: 6370 - DNA, 758 bp, Sorghum bicolor
  Clone ID: SORBI-28MAY03-CLUS41025_1
gcacgaggctttggaaccggtgcattccgatctgagggtgcccctgatgggggtctggctgtgactgagcttgctacatcttttgctgcagccaggtctctcgtttgtctatcaggttttcgggaggtcgatccacaatgcacgagggcgatctaccctgtttgtgccaagctcacctcactaaacttcagctttgcaagcctaacggctgcggaactcaagccagttattcgcaactgcaccaatcttcgcactttctgggtccttgatactgtgggtgatgaaggcctacgtgctgtggctgatacatgctctgatctccgtgagctgagagtttttcctttggatgcctctgaagattctgagggttcggtctcagatgttggtcttcaggcaatatcagaaggctgccggaagctagaatcaatcctctacttttgccagcggatgacaaatgaagcagtaattgctatgtcgaagaactgtcctgagcttgtagcgttccgcctctgtattatgggccgccaccgccctgatcgagtcactggggacccaatggatgaaggttttggcgcaattgtgatgaactgcaagaaactcaccaggctttcagtctctggcctgcttactgataaagcctttgcatacattggaaaatatgggaagctaataaagactctgtctgttgccttcgctgggaatagtgacatgtccctccaatatgtatttgagggatgcactaagttgcagaagcttga

SEQ ID NO: 6371 - DNA, 1029 bp, Sorghum bicolor
  Clone ID: SORBI-28MAY03-CLUS41425_1
gcacgaggcaagaaccgatttagttcttacgccaacaaaaaggacagtattgggtgaaaaatgggaagcatttaagaataagatccaaggtcaccccgtctataaaagagtggatgaatacaccaagcctgttgtaacaaagggacaagaggttgctgaagatgtcagggaaagatgggagacaagtgacaatccagtggttcagaaaattcaagacttgaatgaatctttgcttgaagaaacctcagctgcggtgacattcagggaaattcggcaacgagacccgtccttttctctttctgattttgttgccgatgtccaagaaacgatcaagccagttctaactgcatattcaaagggtgatgtggagactctaaaaaaatattgcaccaaggaagtgattgagcgctgcaaaggagagagagaagcttatgcatcacagggaatattttttgatcacaaaatcctgcacatttcagaagctgatgtattggaaacaaaaatgtttggatcttcacccataattatcttacgcttccaatctcagcagatatactgtgtccgagatcgagaaggacaagtcacagaaggaggacaggataccatccaatccgtcttctattcgtgggctatgcaactcatggacagtgacgaggtgccagaagaagaatcctattacccagtctggcggttgcgtgagatgcaacaagctggcataaaagctctcatatagagcatttcatcattttgttctactcttccttcattgaatcagctgctcaatgagcaatgtgcacgaacgttgccctcggtgcaagaaattttccacagattgttttatatatatatatgtcctgatggtagcagtttcttcctattcttttttgctgatgtatctaacgcatgtcactcgcagagttagctgttattctcaatgttggctgagaaaggcttgtaagcagcatatactgatagtaactttgtttttgccccaactggaaatgaaacacacgtcggggtggtgttgtc

SEQ ID NO: 6372 - DNA, 624 bp, Sorghum bicolor
  Clone ID: SORBI-28MAY03-CLUS41428_1
tgcatgtcttcagaggagttgtcaagatgagacgtggtctcacggctcgaataattgatgagacaaactcaatggcagacgtctatacttctttctatgagttttcttcattgatagagtcaaagatagatgacaatgatccaaatgctgctctaacacggagacgtgtggattcaataaagcaaacttgcaagtcatctggtttggtaaagaggagggggtaccacttggacaagtcaccttataggcctatgctgatcatgattgtcctcctgctggtggctattcttttcggggtactgtataccaagtgatgcactttttcctacggatcttgagagaaactatgccaatctgatcctttttgtactctgtagtttccaaaggctgcgggaaatttggaagtgctgactgtagatcgatacggctgcatgatacggcttccgtgactccgttgctgatctcaattcgtttgttgattttgatttctcgtggggtgtatgtgtgttcaagctgttttaagtgagaaaataccctgatatgtatcctacgactacgaacatgtgtttctgttcagttagcagtgggcacactgtagttagtgctgttgtgtttaaatgcctt

SEQ ID NO: 6373 - DNA, 670 bp, Sorghum bicolor
  Clone ID: SORBI-28MAY03-CLUS41445_1
tccaaatcaatggactccattgaagctgcacgtggggagggtaggaaggtattgacaggtgatgctgcccgcttgtggaggaaccgtggcaagtgccctctaacaccaagtgaaacagcatttatcctccaagcgttggacattcctacaaatacaaacatttatttagccgctggtgatgggctaatggaacttgagggtttcacatctgtttacaaaaatatatacactaaatcatctctcctggcccatgaagattttgagaatatgcatggcaacacaaaagctgctcttgactactatgtttcagtcaacagtgatgcctacattgccacattctttggaaatatggataagatggtaactgcaatgcgaacaatgcaaggtctccagaagacactggtcttgagcaggagggattttgcaaactacactgccgctggactagcaggagagcaactggctaaggctatgtgggatgttcatcgagaggaatatatcaggggcaggggatcggctctgcctgagtactgcttttgtgagttcaaattgtagcacttgtgggctagtggcatgaggtttacctagactgacacctgttagcttataatgcaactcgtcgatcactgtgattgtgtaaatatgaatatgctgttactgcaatagtgca

SEQ ID NO: 6374 - DNA, 890 bp, Sorghum bicolor
  Clone ID: SORBI-28MAY03-CLUS41438_1
cttcctgatggtaagctcaatttttgtgtcatgttgaatggacagcaattacgctgctatgaaacagtgaaggtactcgagatttcttgcagctccagcttagatgtgacttttggatcacaagcactacacaatcttgagctgttgaaagtttcctgctgtagtggttcagggtcggtaatgaagttgtctgggctagaaaaactgtctgaatctgaactcaaggaagtccagattaagggttcccatgatgacaaactcaaaaaagacgtggaggaacaacttggcaggcatcaaaagaaacctgttttgaagatgggcacgaggctttcgtccactggggattgtgagctctaatgttatcaagaattagtgactcatgttgttggcttcctcttatttcttcactgctgctcgatccagtctatctaattagaaagattggttatgcaaccatcgtgccaataataaacggtcaaatctgaaagcttcctctttggccacatactgatcagtctatttgtcttgtgcatgtggttcctacagcatagtcccagtttggattccttctaaaagatactgatggtgtgctaatgtttttatatgtatagagaaggctggaacagtgaattgctgttgtacttttctattgctggaacagtgaattgctgttgtacttttctattgcgctcctgtattgtagtttcgtggtgtatcttgctatggttatacacacacacatcagcacaaattctttaccactacagcactacttcagcggtaaatgcttatgctgatttcttgtaagaagagaacactgtttgtaaactgaaaaatattgctagagtggtgcagacgaacaaagttgacaacaaaaaaaaaaaaaaaaa

SEQ ID NO: 6375 - DNA, 823 bp, Sorghum bicolor
  Clone ID: SORBI-28MAY03-CLUS4112_1
gcgcgtccgatttggaggaggatgagattgcaaattatgctttgaacctcgaaaaggtcttggctgaacttccagctccagtcctaaatggtacaacgcttacagtcgaggattttcaccaggaactaaaatgcagtatcaacatcaaacacagggatgagttcgatgaagaaaaggagcctgacggaatggttcttgctgggtggtctggcccagttgataagcaaattaccagtaatggtgagaatagatcagttccatcttcatcgaatacagaagatgttgatggtactgccgaggatatatcagcgaagcctggaatgaagcgtaagctgaacgaaatattagaggcaaaggaaaattttgatgctcttgaaaatccttcggatgttggttcaagcagcgctcaagttgttgaagatgatgacgacgacgagcttgttatgtttgatgaagacccaaggcaaagcaagaagaagagattgcaatagcaaacgataacagctcttgactcccggcatcatggctaacacattgttcaatcataacatctttgataacttatctatgcggtgatatgctaggttgatgttgagacattggtaacaatgcctgagatactttttttttggcctcagataccgccctgtaggattgtaatttgtaggttttaggcacatgagcaactaatgctctgctgacagcctgctgcaagatagcatttgtatctcaagagccaaggtcctgtgttagtgatggtttttgttcagttttgaggggtgaccgggttaaccactaagttttctgtcacattatgtgccat

SEQ ID NO: 6376 - DNA, 515 bp, Sorghum bicolor
  Clone ID: SORBI-28MAY03-CLUS41151_1
actcccaacccgcagaaaaccctcgtcgtcttcctccaaatcactcactcgattgatctctcccctccgaacccgggaacccctcgagctggggttccagcgacccaatggcggacggcggcgacgagtacaagcgcgaggagtcggtgaccctgctggtcatcgtctccctcgccgcgctctcgctcctctccctcatcgccgccttcgcctactactgctacatcacgcgcaaggtctcccgccgcctccactcgctccatctcccgaagcgttccagctcccctcctccgcctcctgcccgggccccgccgcggcagcagcagcaggggaaggacagcccgtccagcaactccgccagcgacggggccggggcgacggcggcggcgatgtcggtggtggttgctggggagaggggcgtgcaggtgttcggctgccggcagctccacgcggccacgggcgggttcggccgggcgcacatggttgggcagggcagcttcggggccgtgtaccgc

SEQ ID NO: 6377 - DNA, 898 bp, Sorghum bicolor
  Clone ID: SORBI-28MAY03-CLUS41159_1
ctatcagttcaagcaattcaggcattgttggagaacaaaggataccctgtcattgttgggattggtggtcctagtggatcaggaaagacaagtttagctcagaagatggcaaatataattggctgtgaagttgtaagcttggaaagttattacaagcctgaacaagtgagagattataagtatgatgattacagctcattggatattgctttgctcactaagaacattatggaaatcagaaatagtcataaagtggaagttccttgcttcgacttcgaaaatttcagcagaaaggggttcaaggagcttcaagtatctgaggaaagtggagtggtcatctttgaaggtgtctatactttacatcctgctataaggaaatttctggatttgtggattgcagttgttggtggagttcattctcatcttattgcaagaatacagagagacaagaatcgtgctggtttttctatttcccagactgaaatcatgaccactgtgtttccactgtttcagcaatacattgaaccacatcttgtccatgctcatcttaagattcaaaacgatttcgatcctgtgctgtctcctgaaagctcgctttccgtgtttctgcggttatgacgcgtcccgtaccttggcgtactgatgcttcgtgatgcctccactggctgcgctgctgtccagtcctttcctgttcggtcctgtgcgctccccggcgtgcccgctgttggccagctgacagaaggtgagtgtatccgggtcagaatttgtgaaggaagattcgcattgttgatacgagagcctataagggaaggaaattttattatccagccaaaggttgactttgatattagtgccagcactgttgcagggcttcttaagcttggctaccaagctgttg

SEQ ID NO: 6378 - DNA, 476 bp, Sorghum bicolor
  Clone ID: SORBI-28MAY03-CLUS41167_1
gcacgagggttttttactcctatgcttgcatatttgcacttagaaatttttgaaatcctactatacagagctaacactcttcaattttccattctcaattagcactgccttggttggtcagcctttgggtgatatcatgaactagctaggttttttgatgtagtgctcgataagtcctttatgacgtatgtaacttccagtaaaatgatgcaatggctaataagtcctttatatggtcccagttaaatgaacaattgttacctatccataatttgttttagatttaatttaccctgattgttctataaagaaaaaaagaataagacttatgtacccaatgcagcagttactgcaaaataacattcctcttttcttctttttattggctctctatagctaatagcctgaaagcaaccatccctatgatctatcattaatatttttgccctgccagtgattgatccttggtgggagct

SEQ ID NO: 6379 - DNA, 701 bp, Sorghum bicolor
  Clone ID: SORBI-28MAY03-CLUS41242_1
gcacgaggcccgcggctcacgctcacgctcacgctcccctcgcctgcgtcgcctccgatcgaatcaggtcggttgctctcgtgcccgatcccgtgtcttgtcctgtcttggctcccagccagcaatagcgcaacgagacgagatcggagggcgacagggcgtggccgcgaggggaaatgggatcggagggacgggcctggaacggcgccgccggcagcagcggccatggcggcggcggcggcggcgtagaggcgaaagcgatcaccgcggctctgtcggccgcggaggttcccaggatggcggtctccgtcgacatctcgctgccgctcccggagatgtcgcctgacatcatatatctctgcaagcaattggtcattgggtggtgtaagattgacagctcccgcttctccatcgagaccgtgtccggaggcatcaccaatctattgctcaaggtttctgtcaaagaagacgacggcaatgagtctgctgttactgtccggttgtatggaccgaatacggacttggtgattgatcggaaaagggaattgaaggcgataccgtatctctcagctgcagggttcggggctcagctacttggaatatttgggaatggagtagttcagtcattcatctatgctcgaacactgtcacctgcagacatgagagatcctaaaatagcagctgaaattgccaaggagcta

SEQ ID NO: 6380 - DNA, 768 bp, Sorghum bicolor
  Clone ID: SORBI-28MAY03-CLUS41246_1
gtgcgcgccgcgcggtctgggcacgcgcgcgtgtcgtgtgccctgacggatcgaagtgtgaggggattacacgaggcttggtgccgacgcgggggcaggaacgtggcagagcacccgctctcactctcgcagtcgaagtcgcatcggcccctctccgtcctcgtctccctgtcgccggtgcccggacgcgccatgtcgtacaacaaggccccgtccatcaccgccgagaccataaatcccagggtcaagatcttcagctacgcaccttgcggggagatcctcaagcacgcagagcggttggagcaggagatggaggaaaaccctggttctctgccttttcaagagataatatactgcaatcttgggaacccccaggttcttggtcagccaccattaactttctttcgtgaggttctttccctgtgtgacaatccaaccctcctgaacagagatgaaacatgtgccttattcagtccttacagcataagaagagctaggaggatcataaataagattccgaacaaagacactggtggatatactgatagtcagggaatcaaatggctacgtcaagtagttgcagacgggattactggaagagatggttttccatccaatgcagatgatatttttctaacagatggagctagctcggcgatcaatttgatgatgcaaatactcatcaggtctcacgaagatggcattttgagccctctaccagaataccccttatactcggcttccatcatacttaacggaggaacaatg

SEQ ID NO: 6381 - DNA, 768 bp, Sorghum bicolor
  Clone ID: SORBI-28MAY03-CLUS41607_1
tatgcaaagggcgtgggatacgtttgagggaccagatggacgagtcattcatcgtgatcgaatcttgatctactgcatgaagcatcccatcgtaaagaagttgaaaactcccaagtgggatcacatcatctttcctgatgtcaaaaaaatccgtgtaccaaaaatgattgttggtacacacaatgaagatgatatacgccaggaagaagagctactggagcctgatgatatacgcgaggaagaagagccgctggagcctgaaccatctcagtctcctccatctgaatctcctcccccagatgcaagtgattggaatcagtgctcctgttctagtcccatcgactcatttgcaccagggtccttgtttatgcatccacatccaggcacttgtggttggcttggggactgaccgtctggcagcataactctcatttactaatgctccctcagtcttaggtcctttttgcaaattgcatgtaaatgagtagcttggacccgtttcaataccagaattaataactgggtttactagtttgtagcacataatccatccatgtccgaattattatttttaataaagatactgagccagtccaggtatacaggtctctttcctaacagacagtagccaactggtggacttcctctcttcatcagatcatagcaatcctccagattggagaatgaaaatctacacacaggagtatgacaattgcactgatcccgcccttcaccgtttgtacaagatcaatagattagacaaactca

SEQ ID NO: 6382 - DNA, 681 bp, Sorghum bicolor
  Clone ID: SORBI-28MAY03-CLUS41625_1
ttctggaggaaaagaatcctcacaggaacccctcgatgaagatgaatttgaaatagaagatgttaaaccaaacagtgattcaacgaagaatggcgctaatgatcaagtttcagagacaaggacacttcaggctggcaggattcctggagatacagttcttaagatgctaatgcagaaagttcaatctcttgatgtgagcttctctgtcttggagaagtacctagtggagttgaacagcagatatgggcaaatatttaaggatttcgatgccgatattgatagcaaagatgtcttgttagagaggatcaaatcagagctgaagaatcttgagagcagcaaagatagcattacgaatgaaattgaaggtatcctctcatggaagttagttgcttcctcgcaactaaaccagctggtcctggataatgctctactcagatcggaatttgaaacatttcgacaaaaacaaactgacatggagaacaggagtcttgctgttatatttctcagttttgttttcgcttgcttagctcttgctaagctgtctataggcattatgtccaaattttgtagattctatgactttgaaaagatccataatgtaagatccgggtgggttgtgttgctgcttagcagttgcatcatatccaccattttgataatacagtaatacaagcattcaac

SEQ ID NO: 6383 - DNA, 825 bp, Sorghum bicolor
  Clone ID: SORBI-28MAY03-CLUS41630_1
ttcctctgcggcgtatggacagcaggagccagctggattgtctcaaacggtgcgtggacttggtgggaaaagcagcttctgtatttttctttccagagggtactcgaagtagagatggcaagttaggtgtatttaagcgtggtgcattcagtgtcgccgcaaagaccggagctcctgtgatacctattactcttatcggaactgggaaattgatgccttctggaatggaaggaattctcaattcaggttcagtaaaggtgattattcgccgacctattcaaggaaatgatgcagaaacattatgttccaaagcaaggaatgtgatagcagatactcttgttctacatggttatggagtgcattaaattaagtgggtgctttggtctattttttttcctgaacgagtgctttggtctattccccagaagactttcagagcacaagtacttgagagttgagtcaaagcttgttgcagatgtaatcatgtaaaggcaagagggagaaaaatggcttgaattggcggttgtaacatgtggtctaatgttgtacaccccacttctttttttgtttgtttgatagtacaaagcgttgtatgtaaaaggcagaggccgtcttcattggatggaaaatgaagcccacgtgaactttttgccgtttagcaaggggacttgctccccggattttgacagttatttatggggaagtggcattacgttttgtatctagtgattactagtggtggacctttaatcaccacctattaaaggggtgacgacggcgagcattggggttgcatggacggcacttggccctgcatctttcatg

SEQ ID NO: 6384 - DNA, 873 bp, Sorghum bicolor
  Clone ID: SORBI-28MAY03-CLUS41677_1
gcacgaggcacggagtctgcaagtaataatcttgatcatcaatcaggtgatgctgcagcacccttgcttgatgaaagccaagaagctgggcactcggaacttccttgcaatggaggtagtaaagctgaagattcttccattgctcatggtcaaataaaggttgatggcacaatagaaactgcaaatgatccttgtttcgaaatatccaatgataaggaggtccatgtcaatgatacagtagcagatccaatacccatgaaacaggagccttgtagcactccccaacagtttaaatatccgtattgggatgaaagggaaaggtggatttggaattcaatttctgagtctcaattggcttacaggaatgacattcaaattggatatttggaaaaatttgaactcattaacaattatttgccacattatcttcctcccttgtttgaacaacatgatgaggcatactctccgcagtttgcagtaggtccaggtagtaatattttgtgcataatggaagatgagatatccagcataatagctcgtgctcttgccatatctgatgaacgccaccatttgatagatttaaaatttgagaatggaatggattattccaagggagagcatgttaaagcaatggagaaatcttatagttttctgtctgaaagttctttcagctcatccccatggtcatctacagattctgaagcaagcttgtcatctctgtcttcattttcatctgatgacttttctggttatgatagctcatctttattgtccccgatgcatccagaaatgactgtgaacgggaaagtgactctcaaaggcaaatattcagtaactgttgtatatgacaatcaattctttgcgcttcggaaa

SEQ ID NO: 6385 - DNA, 696 bp, Sorghum bicolor
  Clone ID: SORBI-28MAY03-CLUS41315_1
gggatgaagtaactaccctcatgatgctatggtggaaggattttattatgatggttgtcctcgtaaagcatgtactactgctggcagctgacttggtttcgtttttcgtattattaccaaaagtgtctgtgtcgtgctctctcgctctttgctccggtctgggttagcccaaaagtttaaacctgacttatcgactcatgccactctcaacacgttgcatgactaactctgggtaggatgatggcgatggctgatgacagttactgaagctgtattgtcaaactctactgaagctgaatcttgcaatatatgtgaaaaaaggggtacccagagctgtgcattcgttgtgaaaacaataatggttaccagctgttgatctgtttgaagacatgaatttcatgtagtggtgaggagcttcaccaaatgatccaccaacatatggtatcatttatcaagtacacttgcacgagtatcacaaaaggcagttaagaagaaatgtgaccatttatcaataaattaggttcatcatgaattgttacgtaatgggacatgtaaagaagtatcttgtaagtctgtgagcccaactgatgtaccaatgttatgttatgtatacatataacattgagattttgtaagccatttttcagagttacagctaccaccgctgttgctattggaagtcagattaacatgccc

SEQ ID NO: 6386 - DNA, 694 bp, Sorghum bicolor
  Clone ID: SORBI-28MAY03-CLUS41326_1
gaagcaacgcgtgccatgctttgtctgataagagttgaaacagatccacaagacaggacccaactgcggctaacagttgcctcgggcgaccaatatttgacattcgagttgaaagagttcgtcaaggaacatttgattgatatcccaaggactcaggctgccccacctcgtgcaccggtccagccacagttgcctgctgcagcacctgccacatacaatgaccctggtgccatgcttgctggattgctatgagaagtaaaaaaaacaaagcaatagtgttgtgatgtacatgacagttgtttaatacgaggatctaacatctccacaagcatcttgctgccaagacgaacacgtggagcaacgaaagggctggcggagtagtcttcagctggattctgaactgagaaagagctagattctttgggggcggtttcaaggcccttcccccttcccctccatggagcagttgccatattgtgtaagcgtaatttgttgtttctcattatcatccccctttggcccatttgtataacttgtattgcccaggtctggtggtggacaatcggtagttttgcgtgttaatataaggtgctaggttttccaccatgccgattgtaaagttgcctttagtgcgcattgcattacgatttgtaccaataaggtcggaatagggaaaggaaattaatagaggttt

SEQ ID NO: 6387 - DNA, 471 bp, Sorghum bicolor
  Clone ID: SORBI-28MAY03-CLUS41346_1
atctggtgatgcggtaaggagccgaagggaaaactctgatcccagggaatgcattgtgacatagctaaaacatctggtgaattttttctttgctacctggccctggatccatgttggagcaatctggataggtcttttagattgcagttctacaaaccaagccaaggtgtgctgaatgggcatcgtacacatggaggagcaatactggtcacaggttgtgatgcttagtggagaaactaaacgggtagggccacatcgtccactcgtttattctgctgtagttttttttattggcattctgctgtagttttaacaagcatggtcaactttctcaattgccgtataccgagtcagtactaaaataaattgtgccccccacccccaggcagcttgtgtaattatgaactgtagacctgaattgtggtgatagtcatgcgacatgtacagaggttttccttggcgctgaaatat

SEQ ID NO: 6388 - DNA, 640 bp, Sorghum bicolor
  Clone ID: SORBI-28MAY03-CLUS41423_1
ctgcttcgtcagcccttcgtcctaacgcgccccccatgttacgccagctggtgcccggtgctggaggtcggcgccggctcgtgcccccgctcctccttctctcctgcctgcttcgggtgcttctggtcttaacgccccaaccggggctgaccaaagtgagtcggccctaacatgtgctctgagtctcaccatctagttttggcggaactggaggaagcaaccgtcacaactcaactgatctgcaatacccctatagtccagagttcatgcatactgatgctgtctttcctgcaagctaaaggaagacagttctcaaaccatttacatcaggaagacctcatcctgctgctctctctgccccaagctgataggctcacagtcctccatctgcatccatcccgtcgcccttttcgggcatctttcctcccagtcgcaggacagggtgtcccagatgccaccgcataccctcctggcccggggtctggcaggcccctgcgcccataagttgtggagggtgttcctggtcctccgtgtctgtcggggactggctgtcccctcgacaggtttttctgggtgctgtcggtgtctgtcgcctcgagaaaccatgagagatcgacaagttttacagaatgtcactatt

SEQ ID NO: 6389 - DNA, 1151 bp, Sorghum bicolor
  Clone ID: SORBI-28MAY03-CLUS4137_1
gcacgaggattggatattgtgttgaagatgaccaaaggttgctggtgtatgaattcatgcctcgaggcagtttggataaccatctttttcgaaggtctcttcctcttccatgggctatcagaatgaaggttgcacttggagcagcaaagggtctggctttccttcatgaagaagcagaaagaccagtcatttatcgtgattttaaaacatctaatatactactggatgcggagtataatgcaaagctctccgattttgggcttgcgaaagatggacctgtaggtgataaaactcatgtctctactcgagtaatgggaacctatggatatgcagcaccagaatatgtcatgactggtcatctgacatcaaagagtgatgtctacagctttggcgtccggcttcttgagatgatgtcagggcgcagatcaatggacaagaatcgccctaacggcgagcacaaccttgttgaatgggcgcgccccctcctaggagagaggcagcgcttctacaagctaatcgaccctcgcctggagggcaacttctcagtgaagggcgcccagaaggccgcccagctagcgcgcgcctgcctcagccgggaccccaaggcgcggcccttgatgagccaggtggtggaggtcctcaagccactgcagaacctcaaggacatggcaagtgcctcctacttcttccagacgatgcaagctgagcggtcgagcagcatgaacgggaggagcagccatggcctcaagacgcagagcccattcgggcggaacgggcagccgcccatgaggagcctctctgatggcccccgcgcctccccgttccgctactcaccaaagccgaacgtgaaatgaggtggtgacggtggaggcacatggctgcggttttctgctggttgaaggcatgcccccctggaggagtaggtgcggtgatgaaacctgggtttgctgggggtgactggttcggggccgtgcattgcattggggcgtcgaagtcgaaccataattaattgatgcgtgttgtagattgacatgtgcacaaaggaaaggatataggcgaaaaaggaggtgtaggtatcggagtttccttggcggatcggatggatgtttgctctgaggttttaactgaatgaatgctgatggaccgttgct

SEQ ID NO: 6390 - DNA, 761 bp, Sorghum bicolor
  Clone ID: SORBI-28MAY03-CLUS41352_1
atggatatggacgactatccagaagctgagaatggggatgatgaaaatggctttggtgaatctctaaagccattctatcacctgaatgcactgagtgatctcctaatgctccccaaggatgtgctcatggataccagtagcaggaaagagctttgccctgcctttagctcatcaatcatcaagaacatcctggatgtctttgtaccagatgaattttgtccagatcccattcaaggttctttacttcaagcattagagttggaggaccacctggaggttaacaagggcatacggtcgatcccatgcagcgcatccccaattttgtacaatgcccctgcatctggggcaatactaagcgtcatcggtgatcctaggaagagcgggtccaccatccttcgcaagtccaacacgagtgatgacgagcttgatgagctgagctccccacttaccttcatctccaacacctcatcgaacccgcttgcaaagctgaagcggatcagcaactcaagcacagcgaggtacaggctcctccatgaggtgtggaagcttgatgaccagtaggacttggtcctatcacctccatggttcctcccttttgtatatgtatatataggttttctcctatgattccggctcatgtataagatttcagtctatttgttatgttatgttatgttacaagatcagaggagcaagaaataacaagggttgaatcttaataaatccggtgtgtctaaatgcaagattgttcaatctgtgct

SEQ ID NO: 6391 - DNA, 614 bp, Sorghum bicolor
  Clone ID: SORBI-28MAY03-CLUS41807_1
gcacgagggaaccagcggctcgcctcttctcttctcctctcctgtcctctccccttcctcgctcaggcaggggacgacgcgcccccaacggaactgctgctactccccagcagagagcagagaggagaagacgagaagatcccatccactaccgcccgctcgccgtcctcctcccttctcgccgcgccgctccggttccgcccgctctgccgcttgctcggcgcaggtcgcctcggattttattcccccacgccgccatccgtctccgggcttgcgtggatcgaaatgggcacctgcgtgtccaaggccgcctgctgctgccgcaagccgaacaacggggttacccacgagaagactgatactgtgacggaggacgaggaggcatacgacctgcctgcgttccaggagttcaccttcgagcagttgcggctagctacatcagggtttgcggtggagaacatcgtgtctgagcacggtgagaaggcgcccaatgtggtatacaaggggaagctcgatgcccagcgccgcattgctgtcaagcgcttcaaccgctctgcctggcctgacccacgccagttcatggaagaagctagatcagttggcctgctccgaag

SEQ ID NO: 6392 - DNA, 653 bp, Sorghum bicolor
  Clone ID: SORBI-28MAY03-CLUS41762_1
ctggaatttgggagtgttttgcagttagcttcatccgaaaacttaaaggataaaaaggaggcttctaatgaatcaaaagcatttccatctgatgaccacttgaaaagcacaaacggaatgcagcagatgggtgatgttgattcactatcttcattatggccaactaataaaccagagcctgcaaatacaaatgtggaacagttgcttgctcagatgcatgatctgtcatttatgctcaaggatgaactttcggtccctgataaacccatcgatcactcgaaaccctgaagtgacaacagcaaaaattgtgttctgttactatcagccagggaaggttgttgttggaagtccaaccttttgggtgctggacgaattgcacccaatattcctaagtggagaaaaccttcttgttccaacagtgtgccttttatcagagcattggtcagcagaggattgtatttgttttctactgttgcttcgctgcattgatcatcagagtcaggttggttccttgactgtccctgagtgaggctgagaatcatgtttttgtctgcctccacatgtatgtaccattttgcggcctgtatgatgtacagagtcgaactgagctccccaatcaatgaattccgtttcagattatttatacatataag

SEQ ID NO: 6393 - DNA, 607 bp, Sorghum bicolor
  Clone ID: SORBI-28MAY03-CLUS41773_1
caagccagaacgctgtggacttcgcgcggcggaagctccaagaccacaacgacctgaggctgtgctgcagggagattgtcgaagaggcgatacggcggggcgccaggggcaacctgacggcagtgatggtctcgttccaccaggatgcccctccccagagcagatggaacaggactagggaaggcagcgtcgcacggagcatatccgccgaagggcttcacaacctcagagtgctcctggaaggccagtgacgcacggtggtgccattgctgccgttcattcctgatgtgtgctacgttgctgagtgttaactgtaagtagcgatttccggtatcttggagctgttatttcttccacggtcagtcgacatgccagggtgggtcactattcttgtccttcagaataaaccaacgagcctgagatctcactaactgattgtgagatgctgtaaataatatgaatgttggagctagttattaaggacgagttagcagtgtgcatccagggggcttttgtggctcagtatgtgatgttttttcccctgattttctgtaaataaaaacaatgattggaattatcgatgtaatcgaactggtgttctattaaa

SEQ ID NO: 6394 - DNA, 637 bp, Sorghum bicolor
  Clone ID: SORBI-28MAY03-CLUS41836_1
cggctcgggccctcagcgacggaggcgcgggcccgcccccggcggccgcgcccgcccccgccgccgccgcccccccccgcgcctctcgctagtcgcctggcgccctcgcctccgtcctgcgcacgcaccagccggcaaccctgcgcacgcacctccctctcccctcccgcctctgctgtaccgtgggagctcggccaccttggctccgccggtgcggacaggggtccttgaaggatatataaaccatctgtccctcagctgcctgattcttgagggatatcatggctccagttgagagcccacagcacgacctccggaggctgcggagaggtggtggcatcgagcgaaagaacagcacgcccaagcgacgaactgatggagatgatctttgtgcaatatgtgatgatggtggtgatgtaatatgctgtgatggtgtatgtcagaggtccttccacctagctgatggaaacagtgaaagatcgaggtgcagagaaatccttaggttaagtgctgaacaggcaaagatgatccttgctgccgataaagattttatatgcaagaactgcaagtatcaggaacatcaatgttttgcttgtggaaaattggggtcttcagacttgtcatcagaagctaaggt

SEQ ID NO: 6395 - DNA, 601 bp, Sorghum bicolor
  Clone ID: SORBI-28MAY03-CLUS41862_1
gcacgaggcctccccgtcccacgttcgccacgtgcgcgccacctcccccaccgcgtccgcgtcgtcggccatactcctccgtcgcgaacgagatcacgggccccagtcccccagcctcatcttcccccgttgagggagcggatcgtgcgaggcggcgggcgcgggttggtttcgcgggccgaccatggggacgctcatccggccggggcccgccgcgtcgcctctccccatcgcttcctcctcctcgtccggccacgtggcggccgttggcggcggcgaaggggcgaggagcttgcggcatcgggtgtcggtggcggtgttccggtccccgagtacgcatgttctggcgacgagatggcgccggcggagaggtacggttgtgcggtcggatgccatcgccggcgccgcggcagctggggattcgacgccggcactgtcaggcctgcaattggctcccagagtcagaggggtttgcttctatttggtgactgcagttgcagcaatctttgtgtgtgtagctatggttgtggttcatccactcgtgctactatttgaccggtaccgtaggagagtgcagcactacatcgcgaagatttgggct

SEQ ID NO: 6396 - DNA, 856 bp, Sorghum bicolor
  Clone ID: SORBI-28MAY03-CLUS41455_1
gctggttctgcactcagcttggatggttcatacacaacaaagagctatcttcaaattattttggagagcttaccagctgatggtaatgtatctattggtattcacaatcaacaagctgcaaggctgcaggaactggttgagttcatcctgtcacagggagggagcttcaattcagattcatcttcgccaatgcgagaaatttcctctacagatagtgttcttgatgatatgcagtccaggataaggaagcttgagagatggaatacgataaacatggttttgtggactatattattgtctgctcttgttggatattcactataccagaaaaaacgtcactaggtgattcgttgaccctcgggtgaagaatgactaattttgctttgagtagtgatccaaaggtttgaaaaaggacactacgttctcaattactctttcaggaagtcgcatattggactctctttctgcaaatgttcagttttttttttcttcgaaatgctctggtgatgtttcagtgctgatgatacagattctccggcagttttactgatagggtaggacgcatacctcattcatggtgtttgcagaagttacttgcgcgccactggcacaaagttgtaatgctcgaaaaaaaatgaaaaacagcatgtagttacaatatctaagacgtgagagatggccagtgttcatgccgtcccaaataaccgtcttatttgtctaatcactccatgtctgtaagataacggtgggaaggtacaaaaatctcatgctgaatgtgtgctcagcgccctctatcgttttcgtgcattgtttaggattttatgttttgcttggaatctgatattttcttggggca

SEQ ID NO: 6397 - DNA, 654 bp, Sorghum bicolor
  Clone ID: SORBI-28MAY03-CLUS41482_1
cttcgctcctgcaaaacaatgctgtgccacaagaacaaaggggcgctgcaaacgggatagctacaacggcaatgtctctgtccaaggcgtttgctccagccggagcaggcatcttgttctcatgggcacaaaagcgtcagcatgccgcgttctttccaggcgaccagatgatatttctgctcttgaatctgacagaggtcatcgggctggtgctcaccttcaagcctttccttgcagttccccagcagtacaaacaatgaaactgtgaaagcaagctgcatgcatatagaggtatagctagctagtgtggtaacatgaagtaggagtgtgccgtagcgtgccaaccatgcatgccgtcagtgcatacatacatacatacatacatacatacacaagactgaaaacagagccaggtgtgcaacggaattcagtttggagtccggtttgatgccgctgttgtcgacttgtgtagcagacccaaaaaaaaaaggaaatctttttgactagttcggtaaatgggttacttggtgtactgcctcgatttcactcttttttttttttgaagcgatttctctctgttgttgcctcgagttgtactccatagtactcggctgccccgtcctaacgtagatcaacttttagagttgcttatta

SEQ ID NO: 6398 - DNA, 1000 bp, Sorghum bicolor
  Clone ID: SORBI-28MAY03-CLUS41496_1
gcacgaggcacaacctgaagagcctcaagcttctgcacaatctcatactattggctccagatctgaaggaaggcgcagccgatctggaaagaaagggaaaaagagacctgctcgccgcagatcacaacagaaaatggatgaattgtcaactgtagaaggtggaagtaactattcttcacgcagagatgatgataatcaagtgttaagttctagttcacgatttgcatcgcctgaggactccaaaaataaacataagtcttctgttgaatctccaatggagataatttctgaaaataagttgcctgcagggcttggtagaaagcctcctgagaagttaaaagaaggttttgttattgctctaaagacaagagataattcaggtttttatgtttcaagagagagggtcgctggcggtggatggtatctggatgtgataccaaatgctacaaagagggatcctgctgctcagtttctagtcactttcagaaacaaggacactatgggactgcgatcttttgttgctggaggcaaactattacaggctaataataagatggagtttgtcttcacaagtcagtcttttgatgtttgtgagagctggatgctcgaagggtccctttcagaatgctgcaaactggttaatcgcaaaaattctttggccgtacttgaagtctatattgaggtccttggagctccgagtgaagatggtgtcgttcggtggcttgattaatacatctgggctatactatcaagagaacactttaaggctatcttatttctagtgaacaatttaggaccatgctgccaaagccactgcccactgttgtcctcgggttaggtcttctctgagtttcctcttgccaaggctcagttttggttgttgttctactgcatggacccgcagcgcagagtcattgaatttttttgactgtctgcttgttgtaagatgtatctgtaatttaattatacagtatgacaagcacagtcactattccctatc

SEQ ID NO: 6399 - DNA, 699 bp, Sorghum bicolor
  Clone ID: SORBI-28MAY03-CLUS41569_1
cagaaggtatcactgaattactgcatcacaaaacgctaccattaccattgatcaaatgcagaaatgtcattgctcttggtgcaaccaatatggttgaactagacaccgagtgggattgtcttctagatactcaggagagtggtttaatgccaacaaaaccttttgtgtcaaagcatctcagcactacagtttcagatgttcaaattgctccggtccttgcaaaactgtgcttagagttttctgatgtttacatagggtgtcatcggatatcaagagctgggcctttggttgtgaatcttactggaaaggataaccagagggtagatgcggctgccgagaagctgacaagcagctttgaaggacaattttcccaagttgacagttgcaaataagctgtcagagtacacacctccctatttttgccaaattctttccgcctgaagctctgagattgtgcaggactaatgatggtgctcaactgctctaaaccgacgaccaaaataaaccaccgagctggtactactcttctgaagctacaaatattatttagggaacataggaattttgtactaggaattggtaactggctgggttctagcatattgtagctttgcatattttgactgggttaagagcccataattatacattccaaatcattatactataatttatacggagtagcataactttactgct

SEQ ID NO: 6400 - DNA, 634 bp, Sorghum bicolor
  Clone ID: SORBI-28MAY03-CLUS41538_1
gcaggccgccgcgcaccccacggcgttcatcccgttcggcctgggcgcgcggatgtgcattggccagaacctggcgctcctcgagtccaagctcacggtggccatcatcctccagcggttcgacttccggctgtcgcccagctacctccatgcgccgacggtactgatgctcctccacccgcaatacggggcgcccgtgatcttccggccgcgatcatgtgagccgtccgatcgcgacaatcgggatatgtgaagagatgatggagattatactaaccttgtcagtgacaattgcgcctggcataatgaccaataaccccctccgcaggctcaggatgtgctgctttgccttgaagagcagagaccataggagcaaagctaagactaccaccagtccaccagggacaagtgactagaagaagcaccaccgtactgtactaagtactaacaaatatatatcctgctgatgctgaagatgccagctgcagcttagattagtagagcagattagaaggcttgaccagtgcctcccaatttttcagtcttttgggttgatgattttccttccttccatctttggatgaggttttgccgggtgtggttggtgtatgaaggattgcaaattgtacacatg

SEQ ID NO: 6401 - DNA, 795 bp, Sorghum bicolor
  Clone ID: SORBI-28MAY03-CLUS41594_1
cattcatccggagaaagtgatccccatgtaccatcacctgtgtcaaggatgcatacatcttcagctggtgcaggtgattcgctctcttctcgtgatgtaacaggttcaactagctgcgcagaaagtcctcccctccctcaaatgcagtcctgtacagatccacgaactaaggtgtctgagattgatgttaatatggagcctgctgttacagaaactggtctatcaagggaccaacctgtcgaggagcctcctcatgcagcaactggggtaaacgatggcttttggcagcagttcctcactgagcagcctggttctgatgcacatcaggaggcccaatcagaaaggcgagatggagatgataaaggcgatcagacgagaataggagatcgggaaaaattttggtggggaaagaagaatgttgaacagatgacagaaaagctggggcatcttacctcggtggagaaaacctgactgtttgtattacttgtagttgtaggtgaaaaaacagttagtacagaaacacataggacgttggtgcctctgacatgtactttgcagtgtatcatatcttcgccacctgcacctgttgactgacatcgaatttgtagtcatacttttttcccttgtactttggtcgtgttaagaatgatgcagagactagttgataatatacttttgttaggagtgctgcattcatacttggtcagtagacatttcttggtactgctgtccacagcttctatgatttttcaggtttgtcgacgtggctatatatgtagatgataatattcactt

SEQ ID NO: 6402 - DNA, 680 bp, Sorghum bicolor
  Clone ID: SORBI-28MAY03-CLUS42100_1
tgatgaagatagtattttaaacaagctttcaattatcaacaaatgcttctctgcagagactgttgaggacatcataaaagcatttgaatcagaagcgagcatagatggaaaccaatggatagctccagtcctgaagggtctgagaagatcatctccaactgcactgaagatcaccctgagatcgatcagagaaggtcggagacagagtttgcctgaatgtttgactaaggaatttaggcttacaatgaatatactacggtctgttgttaatggggatgtttatgagggcattagagctctcagcattgataaagacaatgcccctaagtggaatccgacaacgcttgaggaggtgaagaacgaggacattgaccgtgtgttccagccgttcagttcggagcgggagcttcaggtcccatccgatgattccaacaggtggagcggcaaatacgagaacacagtctatggcagagcttcctagtgactatacaagattccgccttttgtatcttggcagcagggaccgttattacttcgaaccacggcattacggaaagttcggcacgtatgtagttcgagtgtttgtgtagtgagacgttccaatgtatgaactgttgcagagatcacacgatgacacaagaagcaataaaaagtatgataaatttgatgaacaccaaaaa

SEQ ID NO: 6403 - DNA, 719 bp, Sorghum bicolor
  Clone ID: SORBI-28MAY03-CLUS42062_1
catctgagtcccccagccctgttgggaaagtatcatctcttgctacatctgttacagtagccattccacataataaatccatctcaactgtggaaaatgcaaagaactctccagttggaatttccaaagcttcattttctagctcctctctatcatcaaatgatgagtgtcctcctgaacatggttccacaaagaatgttatctcagattctgacattccacaatgaggccactgcaatccagacgagttggtgtcatgaatcttgatttggtggctgagctgtttcatcgatctatcacatttgaagctattggaagaccttttgaaaactttggtatttaattgtagggcagcacgggtaagactgaaaagaaaaaagaatggttaaagaaatatgggttcaaaagcataccggaggttggagattttctcggtaatcaccctaattatctcattgttcacggaaactgagtggtgctaggttatttgtacacttcattttgggggtaccatcgtgctgaaagcagttggtaatatgctagttctgtagtctgtagctcccgctgaaatcagctttatggattctgttatgagctcgatgaacatcaaactctcgtaagtcctatcgaggcctcttgtcgaaaaacttatgctgtgcatagtgaactgatagggaatacgtaactgacccattcaatcccaaattttgtggcggggt

SEQ ID NO: 6404 - DNA, 1245 bp, Sorghum bicolor
  unsure (1)..(1245): unsure at all n locations
  Clone ID: SORBI-28MAY03-CLUS4212_1
cgtccncgggcgcgtgggcggactcctgaaccgactcctgggcggacgcgtgggctagctcagagcaaagctccctctcgtctcagtctcagtctcaggcgctgctgtgcatcnttttgctcctgtgctcgctctcaacaatcaaatggcggcgccaacggcaacggcaccggcaacggcaacggcaacggcgccccccttgtggtgttcgatttcgacaagaccatcgtcgactgctacagcgacaactgggtcgtcgacgccctcggcgccacccgccggttcgacgacctcctccgccacctcccctggaaccacgccatcgatgcgatgatgggcgagctgcactcggacggcaagacggcggaggacacactaggcagcctcagaacggcgccgctgtcgccgcacgtcgccgccgccatcaaagccgcctacgccctcgggtgcgagctccgcgtcctcagcgacgccaacgccttcttcatcgacaccatcctcgcgcaccacggcctcgccgcctacttctccggcaccgacaccaaccctgcccacgtcgacgccgccggccgcctcaggatccgcccctaccacgacttcggcgccgccggccacggatgcaccctcccgacctgcccgcccaacatgtgcaagggcaaggtgatggagaggatcctccgccaagaagaagaagaagaagaagaagaagccgtctcggcggcggccggcaccgagaagaggcggcggaggaggagggccgtggtgtacctgggcgacggccggggcgactactgcccgtccctgaagctacgggagggtgactacgtgatgccgcgggcggggcaccccgtgtgcgacctcatcgcggcctcgccgcctgccgccgccgtccgcgggtgggccggcttcgaggacctcgccagggtgctcctccgcatcgtcgacggcgagatcgcccgcgccgccgccgccgctgaagaagaagacgctggcgctggcgcgggtgtgggcgtgggcgccgtcgtcgtcgtgccggcggactgccgcgcgccgcgtcaggaggcgctcatgccccaggccgtccgcgtgcccaactgatcgtgttctgttacaggtggatgcttggacaatgcgcgccaaaattagtacaagtattagtaataactactccaggatccatggatttgtgctgagtgctgacgactggatcatcatgctggaaattctggctgaaactgaaagcca

SEQ ID NO: 6405 - DNA, 770 bp, Sorghum bicolor
  Clone ID: SORBI-28MAY03-CLUS42218_1
gcacgagggtcatgttcaagatgcaaagcatgaactttcccaggatgttacaaacaaactgaaatcgcctcacagtgaaaattttgatgctgataaaaattgctgggcagcagcagcacaatatgttgctcacgggatactagagtcagaagagcaaattgatacgtcttctaatgccatgcccgaatgtgtgggatatgctggaacatatcaagtcagtgaagaagaacaagtgattcttgctccagaaagtagcgagggatctgcagtcatgtactctactaccacggtttctggatcatatctcgatgttaaaatgcaatttccaaaactttcccctggagaaacaagtatgaaaaaatccatcatcagaaaaggaatagagaagcttcctacagcgtatttacctcagaggaacactttgagtggtcaaaaactgggaccctacaaggtccctgttgcggatgggtctgtctcctaggctacagaaagatcaaggttgcagagcaaagaatgatgccgttgtcacaggaccatgttttgtacgcattatgagttatgtttgttttgttatgtaaatctgaaacttgtactgtgtactttcaaacttcaagaggactgtagaagcgaaaagattgtacgccagattagacagagttgttagtttgatgtgaagttttatgtcaaggtttttaggctaaacatagattgcatgttttaggggtggctacatatgtagggctgctgatcatctcattggaatcaatcaa

SEQ ID NO: 6406 - DNA, 619 bp, Sorghum bicolor
  Clone ID: SORBI-28MAY03-CLUS42807_1
tggcagactttccagtttcacttggggacagcacgcaccgcacgccgcagcgtctttcccttctgctcgtcctccgcctccgtcgcaggtgccggcgctaagcgaggatccctccgcccctccctccggccgtccgtcccgacgggacctcgactggtatcgtcggtcgctgtggcgacaggtgacgggacggcgatatgaagtggttatgttgtaactgccatgttgatgacgaggaagatggccacgacatggaacaggccaaaactcagagcaataagatagaccccaagcagaagtcttcaaaacctcctgttagtcaacctgagccagagttctcccctcctacaattgatgtccctgaattgtcgttggatgatttgaaacaaaagactgatgattttggatcaagcgctctgattggtgaaggttcttatggacgagtgtatcatgctactttggatgatgggaggcaagcggcagttaaaaagcttgatgcatctgaaaatgagcctaatgatgagttcctgaaacaggtctcactggcatcaaagctaaaacatgaaaatcttgttgagatgttgggttactgtgtggatgggaattatcggatacttgc

SEQ ID NO: 6407 - DNA, 793 bp, Sorghum bicolor
  Clone ID: SORBI-28MAY03-CLUS4167_1
gagcttgacaatgccagcgtccgcaggcataatggttgtcagagggccagcatgttgtcagagggccatcctgtaatgtcatttatagataataatcaacagacgttcaagctagatgcagatgcacaggatgactcttgcacatcatttgaggctcatcaggttggtgttgaaggtggtacacatactgatattgctgatggcagtcactacaggagtgacggctttggtggcggtgcagagcatgggttccttggtgatcattgtgacacaaaagagtgggacttcggtttcagtaccggttgggagaagcatgattttttgtcaacaaacaatgtcatagaagaggtgttcgggaagggctccagtgaagatggaagtgacactgctactggccagggccttctctgagccaggcggaggcttcttttcagctgcgatactgtaacagccctcctggtctctgaatttgtacagcaagtagttggctattttgatttaatgcctcacttgttcttataggaatctctcacccctgtccttggatcatcatctgcttgcgattttgatcgcatgattaatgtaaatccctagatgatatcatctgtcgatgatctgttgttaggctgtagccatgtacgtattatctttgttgtgacggtgtctcttgacctgagcattttttccatgtgccagcgagggtcatgtaataaaagttattccttgacccaagatatctctcacccggtgtgcgaatgagtgtaaccagcccgtcgatgtgctctcaaacgtc

SEQ ID NO: 6408 - DNA, 855 bp, Sorghum bicolor
  Clone ID: SORBI-28MAY03-CLUS41689_1
acgtctccccccctcacctctccccttgccacctcacgcgcgctcctgctcttgcgctcttttggcttcgccgaggccaagcataacaaactccctctctctctctctgtgtctctgctccctgcacggaggacggagcggacgcatggggtgggggtggacggcgctggcggcggcaggcgcggtggcgtacgtggtggtgaagctgatggaggtgctgtggtggcggccgcggcgggtggagcggcacttcgcgcggcaggggatcaggggcccccgctaccgcttcttcgtcggctgcgtccgcgagatggtggcgctcatggtggccgcctccgccaagccaatgccgcgcccctaccgctcccacaacgtcctcccgcgcgtcctcgccttctaccaccactggaagaaaatctacggttccacgttcctgatatggttcgccccatcaccgtcaacgacatagtggaggagtgcaagacgttcttcttcgccggcaagcagaccacgtcgaacctcctgacatggaccacagtcttgctcgccatgcaccccgagtggcaggagctcgcccgacaggaggtactccaagtctgcggggcgcgtgacatcccctcccgcgagcagctcgccaagctcaagacactcgggatgatcctgaacgagacgctgcggctgtacccgccggctgtggcgacggtgcgccgagccaagaccgacgtggagctcggcgggtgcctgatcccgcgcgacacggagctgctgatcccgatcatggccgtgcaccacgacgcgcggctgtggggcgcggacgccacgcagttcaacccggcgcggttcgccaagggcgtg

SEQ ID NO: 6409 - DNA, 703 bp, Sorghum bicolor
  Clone ID: SORBI-28MAY03-CLUS41697_1
gcacgaggctgaagaggcaccgggcgaacgagaacgacgaagccaacgccacacaccaccgcacgcacgcgcagagtccagggggcaccagcgcctcttccctcctgtcccgatccgcccgccccgccgctcgccgaacccgatgtcggccgccgacccctccgcggctccggtcgcggccgcggtcgccgacccggatggccctgacgccgtgcggcttacctggaacacctggccacggtcaaaggtcgaggccagccgctgcgtcgtgccgctcgccgccaccatctcgcccgctcgcgtcccggacccctccgcggcgtccccgccgccgctcccttaccctccgctccgctgcaagcctccctgctccgcgctcctcaaccccttcgcgcgcgtcgacttcgccgccaagatctggatctgcccgctctgcttctcccggaaccacttccccccgcactacgctgccatatctgagtccaacgtccccgccgagctcttcccgcagtgctccaccgtcgagtacatcgttggcggagccggcgtccccggggtaggcagcgcgccggcgcccccaccacccgtatttctcttcgtcatcgacacctgcgtcatcgaggaggagctggagtacgtcaagatggccatgcggaaggccgtcgcgcttctgccagagcacgcactcgtgggcctcgtcacc

SEQ ID NO: 6410 - DNA, 535 bp, Sorghum bicolor
  Clone ID: SORBI-28MAY03-CLUS41709_1
gaggaccggaggagcaccagagttatctccggctcgaacccgagatcggaccgcacaagacgagcaggggggcatcgccgactcgccgtgctgcgtcgagacccaagccaacacagcccagccatgtcggcgcgtgaccgcgagacggccgaggcgctggtgcgcctcgccgcctcgctggacggggcggtgctcgggctcggcacggcggccgtcgccgtcgcgtcgtgggtcaagtacctcgccgtctcgggccagctgcgcctcgtcgcctccgcggcgacggcctccatcggtgacgcccgctccctcctccggggcgacggcaacgagccgcggatcgccgcggtgcggggctacgtgcggacccacggctcgttcctccgggccccgttctcaagcgaggcgggcgtcgtcgtcaagcacacccagatgtgtttgttcacagaatggagaggcatctttggatggacctttgatctgcatgctcttcttttcagatcatggaaagagcaaattgtgacatcttttagag

SEQ ID NO: 6411 - DNA, 668 bp, Sorghum bicolor
  unsure (1)..(668): unsure at all n locations
  Clone ID: SORBI-28MAY03-CLUS41742_1
accacgctgcaaaaatccgcgagtgttactgcagcaatagccggtgctcaagctgcagccactcaattctcaaagaaggatctcaaagatgctactagtagtgaaactggtacacaagagcagtcttgggcaagccatggcgatagcagttcagttgatggcaatgtgccgtccattgtccatggcagcactgcatatctacaaaaccagaatcagccttccagtttccagagcactccagcatactcccaaaatccaaattccaagcctcggagaagtcccagactagaatttggtggagcttccaataggcttgttgcagtggcactgagcgaactgaagcagctaagcctgagcaagaaccgagcagggcaagcagttccaagaagctgactaatgcaagctaacaagtagtaggtagtttgaagcgcatgcatgggagtatgtgatagatagaatgaacactttgaatcccttgtaatgtttgccataacccatagggcgagagaggtgtagcattttgctgtatgtttgtagaaagatcgatgatgtctgcagaatttcgtgggatgaaatcatgacggaccgcctacctagccacctaggtataggtaacaaatttctcaaatcaagcacccttttagcttgtactaattaagtatgtncca

SEQ ID NO: 6412 - DNA, 814 bp, Sorghum bicolor
  Clone ID: SORBI-28MAY03-CLUS41745_1
taggaaggaatgatgttggcaaggtctccaaacctggatcagtaaaggtggagaagttgatgaacattgagcgatactccccatgttatgcacatcagctcaacggtcagtggacagttggatgatcatctccagagctgggatgccctgagagctgcgttgcctgttggaacagtcagtggtgctccaaaggtaaaagccatggagttgatagataagttggaagttacaaggcgaggaccatatagtggtggtctaggaggaatatcgtttgatggcgatatgcaaattgcactttctctgcgcaccatggtattctcaacagcgccaagccacaacacgatgtactcctacaaagatgcagataggcgccgggagtgggttgctcatctccaggctggtgcaggcattgttgccgacagttgcccagatgatgaacaacgtgaatgcgagaataaggctgcagcactagctcgggccatcgatcttgcagagtcagcttttgtagacaaagaatagcgtgttgttagaattgcttattagttcttgttcatgtttctttacccactttccgttaagaaagatgtcattagtgggtggagaagagcaataaggaattgaataaatatgggaattgaggttatggcctttgaatgtcgtctgttcagtacgaagctagatttcctcccttcccttagagtatgcaaatgtcttgttagataaggtaggtttagtagagtagtatagactcttaatagaactcctgtggtcctcttgcatattttacatagttatatgctaggtatcttccttc

SEQ ID NO: 6413 - DNA, 614 bp, Sorghum bicolor
  Clone ID: SORBI-28MAY03-CLUS42704_1
cctcgaggatcaggcagtacaggagctcgcactggcccttggtgatggccatgacatcggagcagaacgtgtgggagaagtgcgcacagtcggggatcaacggcgtcctgaagaagccgcttgttctgcaggaagtgaaagaagagctcacgcggattcttcagaacacatgatacttacaaattattggtgggttcctttgctgcctgccaagagctctgaactctgaagtagccaaacatggcgccaccctgactgacgatgaatacgaccccactgtctagcatagcagaagaaaaaatttacaggctctcggaatacataggctgtcgagggtttctggtgtcttgcagcacaattgctggaatatggcaaatggtagtgaaatggcaaatgccgatgtgccttggtgagtctattcagatgggaattgcggtggcctgagaatgaaggagagtctgatacttagtccttcatagaaacctgggtggtggtatatgtaatggccagtagtggcaataaggctgaagttttgtaagttagctaacctggttgtaaggatctaatgtagggagttccacaattgtatttatcaccaccttttgggaatggaa

SEQ ID NO: 6414 - DNA, 983 bp, Sorghum bicolor
  Clone ID: SORBI-28MAY03-CLUS42729_1
gcacgaggcctcggtccgcctgctcctcgcggccgccgcctcctccctccgtcgcctcctcccctgcccccgctgcccccgccgccgcccccccgccccctccccgcccgggccgcctgcccctcccgccggccgccggctccctccccctcgtccgcctcccccgccgcctccgcggcccccccgtctttcgcggctcccgggccgagctacctgcccgcgcgcctcctccgcctcgggcacaccctcggccgggacccgtccttccgccgcagcccccccttctgtccttcgtccatggcggatcgtctgctttgcaagctcccaacggctgcgtcgggagtgcagatgggtccgttcgtgccgtcggagctggcctttgcggtctgcagtgatggcagttcgtttggcttgcttggtctaattgtccgcttggggtgagcttatgctctcattgatggcatcgaagatattctttgctgtttgaagaaaaataattatgaaatgcatgcttttacaaattatccagtatggtaccaattaattgaggataagctaaagctctcaaagtatttgtcttggacattttgttcctgtaaaactggaaagcgcaaaccttcgcccgagttttatcttcaagctttggatcaactcaatgttgatccagcaagctgcatttttattgatgataggatgttaaacgttgaagcagctcttagtgtaggaatgattgggttgcagtttaagagtgctaaggcactacaggaggacctgtgtgctctgggagttgaattacctcctcttgtttgcgaaggtgaagcacaagtacaataaggttgtgttgtgccctatcttgtcttatgctcaaccaaaccacaatacaaatgtgcatagtatatagtgctctttctttgtgagctatgccaataaattattgtactctcatctgaatctctatcaaaataactgcatatgttaaccac

SEQ ID NO: 6415 - DNA, 915 bp, Sorghum bicolor
  unsure (1)..(915): unsure at all n locations
  Clone ID: SORBI-28MAY03-CLUS42767_1
taccacatccaaggaaggcagcaggcgtgcaaattacccaatcctgacacggggaggtagtgacaataaataacaataccgggcgcgttagtgtctggtaattggaatgagtacaatctaaatcccttaacgaggatccattggagggcaagtctggagccgccggacctcacccgctgcgccagcgccgcgcgcatctcgctctccccgcaggaggccgaggacttcgagcccaagattcggcaggtcgtggattggtttgggcaacttcaggcagtagatcttgagtccattgagccttcacttagagctggtacaacagctgatagttctttgagagaagataaacctgaaacattcgataacagagatgccatagtggaggccattccaagttatgatgatccatatatcaaagtgccaagagtgctgaacaaagaataatctgctgcctgtatatcaaaattgttagaatattaaaactctgcgccatttgtacaatgcagcatggttaaacataatgataaaatctgcaaaaagattgaacgagccatcagcaagctgaattttgattttgcgtatttcaatttgataatgctgtgattgaacagagcaatcagcaaccttgacacagcaattcttgttgctgtcctctgctctggagcaagctatcatgggtattggatgagatggaacaatcgagtagagcaggcatcgatgagtatatcggatttgactcagaatttccagcggatttgattcagaatggctaggttggatgtctgtaagattgagttggttgttccctttatttagcgaggatttgtgggcttgtggctgttttgtaatccgtactgagcttgaacctttcttctcnccccttaatacaaaacagtcgttttgtaactatactga

SEQ ID NO: 6416 - DNA, 954 bp, Sorghum bicolor
  unsure (1)..(954): unsure at all n locations
  Clone ID: SORBI-28MAY03-CLUS42768_1
catggagctcatattcatggagtccaatttaattctgaactgtttcaaactaatctggtagctattggccctggcttcgtttctggcctctgagtggctccgtggggaagcctgctaccttattttggcttccttgtttgccatggccgtttggtccctacgcctttgttctctaaggccccgattggtcgtcccctatctgtttctggtgggatctgtgctggcttgctccttgattctttgggtcaaccacccctcgtacccgtctgtggtctgttgcattgcctcaagctctgtgagttttccgggagtgctgtcacaccatccctaggcctggcggttggtgcacttggcgcgctcgttttgagtttctgcgctgagttactttggtgcgtgccccctcctctccgcattttggtggggttggttcttgatggatccccagcggcactttctggaatcaaaggtggtgatcttatttcaacgcttgatggagttgctttgtccaatgcacaagaggttctatatattttatgaagtttgttttcaaagaaatttagttttctcatgtttatcctgcaaaatcaagcactcatttcgattggagctctaccatgacatttcaatatttcatccaggcaaaggatctaatgctgacctctgttattttcnaaagttatcgtgtttgcacatgctttcacgtgtaggaacacataccttttcgtgttatagaaataatgcgtaagggcagctggattttttaatggggacatatatcttttcattctgatggtgggataggagcttatcactgaataattaacttgcaaaacaatgaacaataattacaggttgaaatattattttttactgcgtatgtcccacaattttgagttctgagtatatgcttattcgttaggaaagggtatatgcttgtatgaccggacaaggtca

SEQ ID NO: 6417 - DNA, 628 bp, Sorghum bicolor
  Clone ID: SORBI-28MAY03-CLUS41939_1
gcgcgggggcagagcgccgctgtgctcctgtgctcgcgctcactccgactcaccgccgtgagcccccatggacggcccccgttggacggaggaggtggacgacctcgtcgacgccggcgacgtcgacggcgctatcgccctgctcgagtccgtggtctccaacctctccacctccgccgcagccgctcccccagctgccgacctccgcctcgccacggcgctcggcgacctcgcgggcctgcacgcctcccgcggtaacaccctccgcgccgacgagctccgcgcccgcgccatcgtcctccgatcccgcgccgctgcccccggggccctaggagataaggagccttcagagaaatgttcatcacaagagagtcttatgggtttgaaggactctgaaggctcagctaatactgatgataaaaacaatgaagatgaagaggatgattgggagtctattgcagattgcggtgcacttgatgacacactagcgcgctcccttgagcaagaagctagagtaccttcctgtagctcgtcagagagaagtggcaccccatcttcagggcccaaaaggaggggtaggggctcatttctttacaataagagtgttctatacagtgaccagtgtggt

SEQ ID NO: 6418 - DNA, 648 bp, Sorghum bicolor
  Clone ID: SORBI-28MAY03-CLUS41966_1
ttttcctcttttcgctcgcggctagcttcaccaaacccaaaccctaggccgtggaggtggacggacggaggacgcagtgagaggggatcgccactagcgacagcatgcgtggcgggtactccggccgcggtggtttcgctttcgctggcgggcgccatagcagcagccgcagcaatgatggcagcggataccacgggaatccttgcctgacgatgcatcagccgtgggcgtcgctgctggtgcacggcatcaagcgtgtggagggccgctcgtggccatccccaatcacaggccgcctgtggattcacgcagcatccaaggttcctgaccccgacaccatcaaagccatggaggatttctacagggagatttatgccgtcaatggcatcactgacatcaagttccctgatcattaccctgtctcacgcctccttggctgtgttgaggtggtaggctgcctcaggtctgaagagcttgtttgctgggaacatgtgcccgagtctgtcaggcttgaagggctgactgacttttgttggctctgtgagaatccacagaagttggtggttccgttcgagatgcgtggttaccagggtgtctacaatttagaaagaaggatctatgatggggctgtgaagggcctttcacctg

SEQ ID NO: 6419 - DNA, 891 bp, Sorghum bicolor
  Clone ID: SORBI-28MAY03-CLUS42007_1
gcttgtcccttcgagtcatctgagatctcttccggaagactggaagcttccgcgctggcgcggacgcgcggtgatgactatggaccctgctccggcggcgaacggcgccgcggccgtagccggaggaggcatgaagcggcagggcggtagatggtggtacgcggcggccggtgccctcattgtggcgctcctcgccgtggccgtgagcttttacagcttccggggcatcccctcctctccaccaggaggctgcggctgccctgctgcaaggcacgacgccggaatggtggaggactgctgctgcgactatgagacggtggacgccatcaatgaggaggttctgcatccgatcctacaggaacttgttaagttgccgttcttcaggtacttcaaggttaaattgtggtgtgattgccctttttggcctgatgatggaatgtgcaagcttagagattgtagtgtctgtgagtgcccagagaatgagatccctgaaccattcaagaaaccttacagtggactttctccagatagtatgatatgccaagaaggaaaaccacaggctgccgttgataaaacccttgacagcaaggttttcaaaggatgggttgaaactgacaatccgtggacatctgatgacgaggctgatagtaatgagatggcttacgtgaatcttcaactgaatcctgaacgatacactggctatactggtgattcagcaagaaggatatgggatgccatttacaaagagagctgtccaaaatttccctctgttgtcctctgccccctctggagggccgtgtacaagcttatttcagggttgcactcctcaatttcagtgcatattgcttatgattatcttcttgacgaatcgactaactcatggggacaaaa

SEQ ID NO: 6420 - DNA, 640 bp, Sorghum bicolor
  Clone ID: SORBI-28MAY03-CLUS42034_1
cggcctttttatcatcaatttagtctcgcggtcatcttcagtgagggaaatggttgtttcaagacttaaagcggtctttgaacacctatactcactgcaacttgaagaagacataaatgaggttttgtttgcgtcgccgagcgaaagatacctagaaatcaataaccttgatgcaggagcttccaaattgcaggagttactcaaaattccagtggatgtagaatcagatatacagaagttgcaaaagctccagtaacagtctcacctgataccgaacaccatccatttgcatccactagatttaggtggtgttcagtttccgcccctggagggcacaccaaaattgcccccagttttggctcgtggaagccaaattggggccagctgtttcggccacgagagttttgtccaactgtgctatagaaaaattttggcctacctaaaaccaaagacaccaaaatttggtttgaccctgattgggcctaggctgagcgcatctcaaactttttaccctcaacaatttaggcatgttttcccgtatgtttgccttgacaactctgcatggataaaacaatgcactgtacatatttagaggatgcgagtggaggaaacaaaatgtgcatcatggtctctgatggtt

SEQ ID NO: 6421 - DNA, 594 bp, Sorghum bicolor
  Clone ID: SORBI-28MAY03-CLUS42059_1
ggcttcctggctgctgcgagacccgccgtttgctgccattcgtgcttgcgctggtgcgccgcttcgtcctggctagcctggttccccgtagaggcgggtgtggggccctgactgggcctttatcaacacccctcgatgtcatgaagacaagattgatgattcagggacaagcaaaccaatatagaggattcattgattgtgcgcagactatcatgcgagaggaaggtgctggcgcatttttgaagggtattgagccaagggtactatggattggcatcggcgggtcgatcttctttggtgttctggagaaaacaaaatcggttctagctcagaggaatatccgtaggtgagaggacgaaccaaagcttttgccatcatgataatctccctagggcacgaggcgcaacttcgcctggccagagattttggagcagcccatatattatatgtaatttgtgccatggaattgtacttgagatccttgaggaccagatggcgcctcgaaataatttttttaggaccgctggcgctacctgcatatctgttccctcgtaattaggttctctgtcgtatgtacgtacgtacttttccgtg

SEQ ID NO: 6422 - DNA, 602 bp, Sorghum bicolor
  unsure (1)..(602): unsure at all n locations
  Clone ID: SORBI-28MAY03-CLUS421_1
cgcgtccgcagacgcgtgggcagactcttgttcggaagcgtctacacttgtctcttggctccgcgatggcggtgggttgcttcaaccccgtgctctcgccgctcgttccttcgccgccgggtaggcgcgtccgagcggcgctgcggtctcagtctcaccagccgaccgcggtctccctccggctgctcccgtgcggcgtggcagctggtcgtggcacgcggcggctcgtggcggcggcggcggcagagtcgcaggccgtgcaggagcagccggcgcggactgaagagtccggtgaggccggcgggggcggtgccgccgaggcgtcctccaagctcgttctggtcgttggcggtgcctatcgggttcgggggagttggctaagttcccatggatggaagcataccacatgtcaagtcaacataaaagtactcggcacatggactgaaactntgantcatnatttccatattccctattactcaacatgggtgactttgaacatcagttctcccaaccgtccacatgttatccaagcccttttcttcctcaatatctcttcccatttatgcatgcgaatttaacattctcttcctcagcatttt

SEQ ID NO: 6423 - DNA, 685 bp, Sorghum bicolor
  unsure (1)..(685): unsure at all n locations
  Clone ID: SORBI-28MAY03-CLUS431_1
natcatggttagcaatcctgcaattcagttcatgctgtatgagactcttctgaagaaactgaagaagagacgggcctctaatttgaagggagctgatggactaactgctcttgaaatttttcttcttggtgccgttgcgaaacttggtgcaactgttgttacatacccccttctagttgttaaggcaagacttcaggcgaagcaaatgattaatgatgacaagaggcatcggtacaaaggtacatttgatgcgttcacaaagttggtacaatatgagggtctgacagggatgtataaaggaatgggcacaaaaattgtgcagagtgtttttgcttctgctttgctttttatgattaaggaggagctggtgaagggtgctcgactattggtgactggtaacactagtctggttaagaaactaccatcaaagccatcaagatgacctacgtctgtcagccatcggaagcgttagtatatcttcctaaaaggccattattattcgcataaaccgcaaaacagagtcgacaagatatagaggtcacctctgctttggagatatcaactgtaggttacacaatagccagtatgaatattgtagggaccaaagactatgttggatagattatttgtatcatttatgtaaaatgtatcctggaagatcggaacaaaaggaaataaataagca

SEQ ID NO: 6424 - DNA, 1020 bp, Sorghum bicolor
  Clone ID: SORBI-28MAY03-CLUS43117_1
gcacgaggctcagaagttgttggactgagtttagcagcattgaatccgacaaactagagaatttggttgtttgcaattgtataaagcaacctgtagatgtgtttgctatcagagctcgtcgtcttgcatcgctgtccgtgaacctgagcattcctttttcattatatgcagggaattcgcttgtgagggcatcactctcttggtattggaaacctgaaaaattctctccacgaagtggagcgatgcttcttggcagcctctttaatgtgactagtttcgaatggaaaggtttccaagcaacggcagttctagatgaagtatttgatgaggttcctatatttcacaacttgagaaacttgtctcttaactcatgttttatcaacaccaccaaaagtggtgtgtgtcaattgaaggctctagggagatttctacataagtctcctaatctggaggagcttactttgaagagttttaaggtggtgccagttgttgaacatgttgatttccctatactaaaaaacctgagaaccttgtgcctgcatttttgcattttgaacgacaatttccagatattgcttcattgtctgcggaattctcctaatttggaaaagctcaagatagcaggttgcaagctctcagatgattccatgggagggaaaggaaaggccaagtcgaagaagacatattctagaaacctggcatgcttccagtgtctgaagctagagtatgctgaaatctccggctgcgaaaaagatgccagtgttcccgaactggtcagctttttgttggcctttgctgcaccaacgattactataaaagtttcaagtctatgaattgcttaccagcctgacgacactaggtggccttcttgttatcttgtttctgacaaattaaacttcctagttgtaaactatctaccaggcaacaaatgtacttgtacccgaactcaatatgggagtgcttgaattgaaacagtgctgatctgtggccagaaatgctgcctgatatcctagaatgcag

SEQ ID NO: 6425 - DNA, 690 bp, Sorghum bicolor
  Clone ID: SORBI-28MAY03-CLUS43134_1
ggcgtcgccatccccgctccccggtgtgccacgcctcggagctccccgcactgcggcgacctctctccctgcctccctcttcagcaatctgcacatcacctaaagcgcaaccaaatgctctccgccaccatccccgcgcacccggccgccgccacaccgctgcggcgaaggtacccgcttcggcctcgccagccactctgcgccccaattggcacggcggcgacgaggcagtggatggcgacggcgaggctctcggccacaaacgcgctcgctaacctatccgttgagagtgcccccgcggcgcctcccaagttctcgttcccgatactggtgaatagttgcactggtaaaatgggaaaggctgttgctgaagcagctgtctcggctggtcttcagttagttcctgtatcattcagtgccatggaggtccctgatggaaagattgaagtatgtgatagagaagtttgtattcatgacccatctgaaagtgaaaaaattctcccttccattgttaaggagtacccagatctcatagttgtcgattacactgtgcctgatgctgttaatgccaatgctgaactctattgcaaattgggtttgccatttgtaatgggcacaactggtggaaataggcaactgttgcacaaaactgtgcatgatgcgaatatttatgctgtgatatccccacag

SEQ ID NO: 6426 - DNA, 593 bp, Sorghum bicolor
  Clone ID: SORBI-28MAY03-CLUS43248_1
gcacgagccccggccgccagcctacgcgatctttctctctcttggttcccccgttcccccgcgtgcgttctctctctcgcgcgcgatctctctcgtggcgacgagtgggcggccgccgccgccgccgccccccacgcccaagtcgtcgttgggcccttacccaggtgttttcgggggccttcgccggcgacgagcacacatcaggtttctcgttgcttgttcaggctccgatttgtgcttcatcaggaactattgcagtatctataggagcatgctttgtagtggggcatcctcactagacaatagtgatgggtttgtgtcagaaatctcaatgtggctcaagatataaccttctcgtgtcgatagagtgagattcattattagtggaaccttctggtgttggtattgctggaagttggaaagtaagagcacgttcatttttcagtttgctgaagtaaacgattttgggatgggtctgcctcaaattcatgtggttaaggaggaagagcctactgaagtgggtacacctgtaaccggtcctatcaatggcccctgcgattcgggtaaactctgtgtgggaagctcaagtagaa

SEQ ID NO: 6427 - DNA, 527 bp, Sorghum bicolor
  Clone ID: SORBI-28MAY03-CLUS43152_1
gcacgaggctcaagtcacgcttgctcacagtcaagtccgctctatctctctcctctatccaagccagaaaccccccgaaaacatcccccggccatggcgaccgcagcccaggtcgccgccaccttcctctcgttcctctcctcctcctcctcctccactcaccaccccgccccctcctcctccgtctccctcgtgacgaaccctgtcctacctgtctcccttcgggccgctggcccacggctcgcctcccgcctccggggccgccgcgtcggcgccgccgtcgcccagctccccaccgcgcatccggaagtagcttctggggagaagaagatcagatggtcatcaagggcggtgcggtcttttgcgatggcggagctggaagcccggaagatgaggtaccctaccacaggcaccgaggggctgctcatgggcattcttgttgaaggaactagtggtgcagcaaaacttttgcgtgctaatggaaccacacttctcaaagtgcgtgacgaggcagcgaatgtgcttgg

SEQ ID NO: 6428 - DNA, 1005 bp, Sorghum bicolor
  unsure (1)..(1005): unsure at all n locations
  Clone ID: SORBI-28MAY03-CLUS42266_1
gcacgaggctcaggcctgtttaccattgataaatgctgccttggatgacattgtgaaaggaactttcctcagaggatgcctactgaatattggaattccaagtgcaccatctgcaaataagggtttcaagttgaccaaacagagtggatacagtcctgctcaaagttggcaagctgtgtcagcaagcaggccctcatctgctactcacttcatgggcatgcatcaaagcctcggtattcagctggcgcagcttgggaaggatgcatctgcagcaggagctgcacgtagagttagtgcccaacgaaagacggttgaggttgagtctgttgcagcttctggtaaacaagagattcgagaagtagtgaagaagttattccgtgctgagtttgtcgagaagcaacatgaaggtttagatgaggatatcgatttgagagctttggagaatggatttatatctgtcacccctctgaatgttcatgggcaagtggagcctgaaatgggagccccagcttcagattggctctctgcagctgtatctctagataaagaaaaggacgctgctccagctgcagctgagcaacaagatgttgcagctgaggaaaaagaagctccttagcagcctaacaaacacgcagacatgtacacactccgtaggtgtcttagttcctgtggcgacagcgatcttctctctcttgtttaccagtttggtttgtttagtattttgccctcaatatttgtttggtgcaatgtctatttttttgttcatcttctctaccgattactggcttccttggccgtgcaaatgatttgatgcagtggccctacattttggatgtaacaatgtaggctacggcaattaccagatgaatactgcccatcccccactattttttttttcagtgtggtttattctaggaaggtgttgtattcagcatgggatatgtgattgattttgtcttgctcccgtctgaactatgggcaccaaatgtttttgaccgnttgtaa

SEQ ID NO: 6429 - DNA, 1299 bp, Sorghum bicolor
  Clone ID: SORBI-28MAY03-CLUS42293_1
gtcattgataatgctgagactcttcagcctggtgctatactatccatgggaactgtgggactccaggcaaagcataaatcctcctgtgtcagatgaggttctttgtaaggagaagcactgtgaacgtattaagtttttctgcttggattcacgaaatgatcaagggcaaacaacccaagagaaggataacctcattcgatcctgcccggttattcttttgaaacatgccagagagggaatgcctgctctagggtggtccatcattctacctttgagttgggtgaaacctttctggctctttctagtatctcatggtgcccgtgcaattggcttaagggagagacggtggattgcatcaaagttcagaatgccatgctttccttatgattatccagacagcaaagcgtatgcagcgcgtgcgtccaaagaagctgctgattttgataaagtatctgagcgctgccctgttgccaagagacctccaagagttcctgtgcctcctttatggcattgtatcatgacttcttttcataaagatgatgtcatattgggttttcctgaagtagacgacttagtgcgcgctaatatgatattacccaaaagcttatctgtacattccaaatctggagatgcagaaccattgcaagcaaatgttgcatccttgcaacttcatgtgccaagaaccgcccaaatgttgagaccaatatgtggaagaatttgatatgaaatatctgatttcatcatctgacatgaacgtggattctgatcaacccaacttagcttctaatgacactgtcaaaatgccacgattggtgagtgaattatgccttacaagggttctgatccgagctttcaaggaaggttcttttgaagagggtgctgttgtttgtgccccgcttccttcagatctttcagcttggaaaatcagatcaaaggaagaagaggaagaatgcgtagaaaaatgggaactccagcttcctcattcccatgttagttcttatttctcctggtttgatcctagcaccagcagccttcagttgcctacagatgacgccgcacgggtggcattcaggtggccgataggctttgtcaccagtggcttcatccacggaagtaacgggcaagacgcagtcgcggtcgcattctgcgaggcaaagcttctggcagtactgaggcgacagcaatgggcgcatgaaagcttgcagagccgggagatctgcgtcctcgtcaggaacgcaagatcaggtgcgtaccgacgagcgctggccactatcgtcctggagcatcaggaatcagacc

SEQ ID NO: 6430 - DNA, 967 bp, Sorghum bicolor
  Clone ID: SORBI-28MAY03-CLUS42320_1
tacccctgctcttccagttccaaccggcagcccgcccgccgtggcgccgctggccgggcgccggccaccaagccggggcggcgagaatgacccggcggtgctgggactaggcccgcggcgccggggcggacggctcggcctcccccgcctacctcgcccccccctcccccgcggcccccgccgccccccccgccgccgccaccggggcccggagccgagctcagggggagatcgatttcggcgtcgtcgttgacaagaggcggcgcctgtcgccagaggaggacggcagcgccggctgcagcaattctgcggtagcagatggagacaacaatcacgtggtgtctgttcagagagcgcggagcagtgaggaggaggaggaggagaggcccaggaaaggtgccagttcgagcaccactccgtcttgccaggttgacggctgccacgccgatctcagcggtgccagggactaccataagaggcacaaggcgcgtggagcgcataccaggacgactgtggtctgcatcaagaatgtagagcatcggttctgtcagcagtgcagcaggtttcaccttcttcaagaatttgatgaagggaagaagagctgccgctcacgtctagcaaaacataatggaaggagaaggaaagttcaaccacaagctgctgtgaatgggaattccatgaatgaaaatcaatccctaagtagcgccttattccttctgttaaaacaactttccgggctagagtctggtagctcttctgagcaaatcaatcatcctaattctttggttaacattttgaagaaccttactgctattgctagcacacagtcatatcaagatattctaaagaatgcaaattcaaattcaataccgtcaaatgctgctaataatgctgcaaatggttctatcatgcatgagcaaactatacggtcaactcctatcgggagggaatcattagcagaagagcc

SEQ ID NO: 6431 - DNA, 431 bp, Sorghum bicolor
  Clone ID: SORBI-28MAY03-CLUS42460_1
gcacgacgcccacgcgcacgccatggacgccgcgcgagctcgggctcctcttccgtcgtcgctggcgtggctcgccgtgctactgctcctcgtcgtggcgacgacgacgcccggcagggtcggcgcggcatcgtcagcggcgacatccgcgagcgaggcggccgcggggtgcgactgcggcggcgcggcggaggcggaggcggcgatcatcaaggaggaggacgcgcgcggggcgctgcggctgaagctcatcgcggtggcgtccatcctggcgtcgggagcggcgggggtgctggtcccgctcctgggccgctccgcctccgcgctgcgccccgacggggacgtcttcttcgccgtcaaggcgttcgccgcgggggtcatcctcgccaccggcatggtgcacatcctgcccgccggcttcgacgcgctcg

SEQ ID NO: 6432 - DNA, 670 bp, Sorghum bicolor
  Clone ID: SORBI-28MAY03-CLUS42352_1
gcacgagggtttcgtgagctcaagaaaaagatttctgaaactgttcttggaggtttgctctcgccagtttccactatccctactttatctgtccggctccaagatctgaacttggggagttcttggtgcagagcagagcaatccagcaaaatcgcccggcgatttggagctggaataatccttccatggattcccggtccggccatggagcggcggtggcggccgtggtgttggtttcttggctgtgcttcgcggcggccggcgttggtggcacgagggcgaactggggcacgcaggcgagccacccgctgccgccggaaacggtggtgcggatgctcaaggacaatgggttccagaaggtcaagctgttcgacgccgaggagggcaccatgaacgccctcaggaagagcgggctggaggtgatggtcggcatccccaacgacttgctgttgacgatggcaaccagcatgaaggccgcccagggctgcgtcgcccccatcgcctccggccgccgcacccctgggcgccccggcccggttgtcgctgtcgggttcgggcctttcgtcgaggctgacaagggcaccctgccgcgaacttccgtgccgccctgcgggatctttcctggtgctcgcctgccagccggcctgcggaatctcgggacatcaaattc

SEQ ID NO: 6433 - DNA, 721 bp, Sorghum bicolor
  Clone ID: SORBI-28MAY03-CLUS42652_1
caaggattgaggagtccatgtcagtagtcaacaatgagatattgcggcggcacttcttggagctgacgaccaacttccttgcgccttttgggccgtatctgagaactacaacaccatcagaagggagttcaccttttgttgacccgccactgctaccaccatttcacgcagatgagtttatcaatggtttggctgctagaggtccagggaaatttttgtccaaacggatgaggtccaattggttggacctatacaggagattccttgaaggccccaatttcatgccctggttccggcaaagacgtgctgctgcagagcaagaacagcagaggctctggaggcaggctcgcatgaatgttgacattgaaaagctaatgtcaaatatgtctgaattagagaggattgattcttttaatgctgttgagcgttatcttctcagagagatggagaaccctgggaaaggaactgatccaataggagcatgccaaaagttgaaggtagacctccaagcagcattcaatgtcctgccgaaagacatgcaacagctcctgctctccaatcctaaaagagctgttcttcttcaaggtagtcaagaaaaggccctggggcccaacggcattgtcacccagacaagtttgtagcagttctttccccccttctgtaacattaccattgtgactaattttcccacccataatacaaagttacatatttactgagt

SEQ ID NO: 6434 - DNA, 725 bp, Sorghum bicolor
  Clone ID: SORBI-28MAY03-CLUS43398_1
gatcctgatgagcatccaaaacttgcatctctgggcatgcagctggctactgaactaaaaggctcattccttggtgcaaacatacttggtgagatgttaaggtccaatcctagtgctcagttctggcacgccatcctgtcaagcgtaagagcgctggtacaggaacacatgttttcccttggggtacaccctgaagacctccttgagagaaatgttcctgttggtttcactaatgtttcccttgtgggtgctcaaagtcaggggtgtctggtgtatgatcttagggaggctgaccctggacaagaagagctaccactgcctacgtcgcgagaagtactgacgggtgtcaaggttcctgctgaggagaagtttgatgtgctggtggatggttggaattggaagttttcttatgatgggatgcttgatgtgccagcatggaagtctctgcatgcgtccctcctttcagcgacaatatctctacctcattgaagccaaagatcaggtcgtcaggtgtatgtgtatgcctagaatcacccatgatcttgtttgaaaaagaaacatattgatgtaactgcatcatgaactagtgtagcgtacaatttgtggcctcttaggctgctctcttgttgttagcattttggatacctaaaatacagtccaaggccttgtaccaagaacatgttgctgtagataacctctcccaagtcccaaccttactgtcgttt

SEQ ID NO: 6435 - DNA, 548 bp, Sorghum bicolor
  Clone ID: SORBI-28MAY03-CLUS43393_1
ccaggacctgtacacgccgcccaacagccgcttccactccgtcgacggtgcgttcttcggcacaacctttggctgtttgttcttcatgaccttcccggatctggatatcgggccccgtctcgacgagtccatcacccccgcgctacaacaacgctaccctggcctgactgcttctgcggcctcgcgcgaaaacgtcaaccaacaatttgagatcaacggcatgcggaccgcgaacttctccccgggcctgggaccgggtaaaatttatgaatcgcgcatgtatgggttccgcgtctcggagcggtcgcgggtcggtccgcggatgaagtggctgcggatgaagccgacagacatcagggaactggacgagatggcattcgtcgagaccttgcgccggcggaacaaacagatcgcagaagaggagggcgacgaggaggaggatagcgatacagagatgcaggcggcgccggcgtcgaatacgatcgaggggaggaagaaggcgccgatacgacggcgacgaaaggtatgggggagtagagggaataaaa

SEQ ID NO: 6436 - DNA, 763 bp, Sorghum bicolor
  Clone ID: SORBI-28MAY03-CLUS43537_1
gaactagagatgcttctagaggcttactttgtgcaaattgatggcacacttaacaagctatcacatctgagggagtacgttgatgacacagaagattatatcaatataatgttggatgacaagcagaatcagctgctgcagatgggagtcatgctctcgactgctactgttgtcattactgctggagtggctgtagttggtctttttggtatgaatattggcatatcactttacacagacccaacaactgaggaggaaactcgagcagcaaacagaaaattttgggaaactactttcgggactgttgctggctgcgtgattttgtacatcatagccatgggttggggaaagagaagtggattactgcaatgaggtggaagcatgagtgttctgcacccaatgaatactgggttgacaaaattctccaaaatgagagattgcattggcatgcagctttatcatactgctgccggggaaatacgtctcattccactatgccgggaaagaaacatcttgtgtaccgctagtagctggtaatgtgtgtgaaataaaactgttgtacaatttgttgtcccctcacctctcatggcaactcagtaattttgtacctgtttaccacgcgaggtgcggttttgctcttgctattgtaatcatttctgtaactgttgtaactgtatctagcggcctgtaacatgtaaataatgtatactatcttaaagctgcaagtgaatggagagtgtcttgtctccctattctgccagcc

SEQ ID NO: 6437 - DNA, 703 bp, Sorghum bicolor
  Clone ID: SORBI-28MAY03-CLUS43514_1
atcaccttctggtgatcctcttcccaaaagtcttgaggagcttgagcaggttctaatgcttggcctagaaaagcaacttccaatggtggtggctaatccagattatgtcactgtcgaagctcgagatctccgtgtcatgcctggcactctggcagctaaatatgagagccttggtggtgaagtgaaatggatggggaagcctgataagatgatctatacatcagcgatgtccctaccaggtgttgatgctcatgaatgtatcatggtgggtgattcactgcaccacgacatcaaaggagcaaatgtgtcaggaatcgcgtctgcgttcattactggagggattcatgcagatgaacttggacttggtgagtttggagaaactgctgggaaggatgccatcaattcactgtgcagcaagcatggatcatatccttcttatgttttgccttcattcacatggtagaaacacgatctgtacatttggttttaggtgcactggcaagtgatttaggcagatgtttttatggaaatgccacacaaggatcaagccattggcggtatcattgtacttaatgattactgtggttgttcaatagtcgctgttaatttgatagatagaagctggatgtactatgctatggcgttaagagtttgagtaataaggtatacaggaaacaataatccaaatgaggcattgttattc

SEQ ID NO: 6438 - DNA, 834 bp, Sorghum bicolor
  unsure (1)..(834): unsure at all n locations
  Clone ID: SORBI-28MAY03-CLUS43531_1
tagttgacaggatagatgctcacaacagattcactcaccgtctgtatcggccttcaactgttactacagaatacagagagcacgtaaaagatctttcttgtttgtccaaagatttccagagaattgtccttgttgataacaacccatacagtttcttactgcaaccattgaatggaataccatgtattacattttcagctggacaacctgttgacgatcagcttatgggaacgatatttccgctcctcgagcacctcgctctgcaaaaagatgttaggcctggcacgagggaaacgtttcacatgccagagtggttccaaagacaaggaatcccacaaactgaacaggcagtttaggaattgcagccaccgcattggattattgaaaggctcaaaacctgctattgtacagtagcatagatacacgaagaccttgttcacatgtttgaagggagggaaagagataaaaaggaattgtaatttagcgcaatgatagatctctatttgtgacgtgaatcttgttttatggttgtatagcacttatttctgttttgtaaaacagtctgcacctcaaccatcgctttatacccactcgccctgcatccagataaagcaaacactcatgaaggtgccaaagtgagtgccagacaggcaaacactcatgaaggtgaggaaggtgccacagtgatgcaaccaaagcaagtactgcgagcgagtcgatatctgcgccagatagccgagggcttcaaaaattttgcaaagtttcacattgaattttgcgacacatgtataaaatattaaatataaataaaaataattaattgcataanaaaaa

SEQ ID NO: 6439 - DNA, 490 bp, Sorghum bicolor
  Clone ID: SORBI-28MAY03-CLUS48234_1
ccgagttccccgtcaacacgctgtaccggcgcggcggcggcgaccccagggcgctggagcagttctgcagggacaccgtcatgaccatctggcactaccacggcggctgccaggtcggccgcgtcgtcgaccgcaactacaaggtgctcggcgtcgaggcactccgcgtcatcgacggctccactttcaacgcctcgccggggaccaacccgcaggccaccgtcatgatgctcggcaggtacatgggcgtgaagctcctgaaagagaggatgctgctggaaccatgaggcaggaaaaaaaaagtccagtctgatatctctgaaagcgcgcgtgtgctgcctgcgtttaaccttcagtgttcttttagtgacgaacgaacaagctattggagatgctaattgtaatggatgaattccacaccaattaatttgcacagaatgtggatggtatttatcccgtccatttcatgtctaaaaactctattgcgtcg

SEQ ID NO: 6440 - DNA, 611 bp, Sorghum bicolor
  Clone ID: SORBI-28MAY03-CLUS48236_1
cgcactcaatcggccagggccactgctcctccttcagaggccgcctctccgagccgtcgagccagatcaccccggcgtaccgcgacctgctcaactacaagtgctcccagggatcgaacccgcccgtggacaacaacgtccgcgacgaggactacgacgtggtggccaagttcgcggcggggttcaccagccgggtgcgcaagatccccgacttcctggacaactccttctaccacaacaacctcgccaagatcgtcaccttccactccgactggacgctgctcacgcacaaggaggcgctcggccacgtcgtcgagtacgccgagaacggcacgctgtgggacgaggacttctccgagtcgctgctcaagctcagcaagctgcccatgccagcaggaagcaagggagagatcaggaagaagtgcagcgtcgtcaaccaccgcctgtactgagcacgcaacacgtacttgttcatagatgaagatgagccataaggttgcgcttttttcgtttcatccattcttttgattctcattcgttgtacgactcatctttttgtgtatttcacatgtctgccaaactctgcaataaaaccctttttcttttgttcc

SEQ ID NO: 6441 - DNA, 794 bp, Sorghum bicolor
  Clone ID: SORBI-28MAY03-CLUS48250_1
gcacgaggcacaagctttgcttcattgcctggaatgtgggaaagaacgttaactgtgaatggattttctaaggcttttgctatgactggctggagactcggatacttagctgcccctaaacatttcgtcgcggcctgtggaaagatccaaagccagtacacctctggggccagtagtatatcacagaaggcagggcttgcagctttgaacctaggttatgctggtggtgaagcagtatcaaccatggtcaaagcattccaggagcgtcgtgattacctagtaagaagctttagggagctgccaggagtaaagatatccgaacctcagggagccttctatttatttatcgacttcagctcatactatgggtctgaggtggaaggttttggtaccatcaaggactctgagtccctctgtttgttcctgttggaaaaggcacaggttgcacttgtccctggggatgcatttggcgatgataagggcgttcgcatttcatatgctgcagctatgtcaacactgcaagctgcaatgggaaagattaaagaagcaatggctctgctcaagccccctgttgctgtttaacaaaaccaacatatcgctaatcagttgtggaccagggcttctgcattgttgtatcataggaaatatattcaattgacgtaaaataggatccatctacttccctttttggaaaaattatttctgctgtcatttggctttggtttgtatctgaagaattggatatacttgctataatttaaataaactctgccaatggatttttttttacctgc

SEQ ID NO: 6442 - DNA, 560 bp, Sorghum bicolor
  Clone ID: SORBI-28MAY03-CLUS48279_1
gcacgaggtatccatggagaaattttgataattatttctttggacagcatgatcctgattctcttctctcttgccgccatgatggcttctatcaccaagctgcctgttcttgcttgcattgttgccaccaagaattcttgcctgtacagggaaatcacatgggcttcaatgatcaaagggcaccatatcttctgaacggttatggggcttatcctgtggacagtcccttacttggtcagcaaagatacagtagaagagccatcaatactaccttgcagcagaatcacatgagggtcaacgttagcaagaagcctgcacagacttgtgagccggtcgcaggtggtgcccctttcaccatatgctgcaattgctatgaagttctgcagataccaaggaaacagtccctgtcaggaaatgagtacaaattgcgttgtggatcatgctcacatgcaattctagtcaagcttgatggaaacaggctcaatgtatcagaaattgcactaggtacacatttatctgatggacaggaaaatgacatgggaaccgatgggcaaactccg

SEQ ID NO: 6443 - DNA, 874 bp, Sorghum bicolor
  Clone ID: SORBI-28MAY03-CLUS48298_1
gcacgaggcctctctcatcttttgaatatggcaccatcctagctttgattgagtctgatgcagaaggcattgggggaagtggctttgttgaatgcatcagagagcatattcattcgggctggcaatgtcgcttgactgatgaacagtttattgctgtaaaagaactgcttaagatgcccgtggctcttgctaactcccgcaatgacctggcgaccattagagatgctcttgaggtttctgctgaaatgtacagaaaagacccaaacaatgttcaagattacgttcagcgccatctattatcattgtcagtatgggaggagcttcgcttctgggatggctacttcgaatatttgatggaaaattgttccaataagtcagcaaattatgtaacattagttactgcacagctcattctcatggcaactcacatggctggattgggattacctgacattgactcttggaatatgattgagaaaatagccgagagaaacaacttgggttataagcagcttatcaaacttagagcattgctcacacatctgcaacaactccggattggctattggggggttgctacagggaaaagccaaccattgcagtcatatggcatggcttcacctcatgcgattgatgtgtctgatgaaagccaacaacctgctgaagcatctgggctgggccgaagttgggtgcaaagtatgttcagcagagacagaagtttaagagccacctctttcaaccgagctagtgatgcaaatgctgttgctaccacgggcaaaactgacatctcagctgcacaaaagaaaactcaaactaacatgaggacccttagaggacatacaggtgctattactgctcttcattgcgtaacaag

SEQ ID NO: 6444 - DNA, 619 bp, Sorghum bicolor
  Clone ID: SORBI-28MAY03-CLUS48335_1
gcacgaggggttggtaccgctcgtcggtcaaatcaacaccgaaccataaccaatctccttgcggaggtggatggcgtcgacgtcgggggatacatcggcagcggaggctctccgccgcggtcgcatcctctccagccgcctctacctcgacggcgtccccagctccaaggcacccgtggtctactcgccggcgtatgacatcgagttcaacgggatcgagaaacagcacccgtttgattcggcgaaatggggtcgcgtccgcaacttccttgtggacgcagggctcctccagaacgatcggatcatcgagccgctggaagcctccgaggatgatctgctagtggtgcactcagagtcgtacttgaacagccttaagagcagcgcgaaggttgcccgcattgtagaggttccagcagtggcactactacctaacttgcttgttcagcaaaaactcctttatccatttcggaagcaggtgggtggctccattttatcagcaaaacttgcactagaaagaggatgtgctatcaacattggcggaggcttccaccactgttcggcagaggaagggggtggcttttgtgcatatgctgatatttctctgtgcatccattttgct

SEQ ID NO: 6445 - DNA, 837 bp, Sorghum bicolor
  Clone ID: SORBI-28MAY03-CLUS43717_1
caacacttccctactcccccgaatctcccactgcagcgcggggctccgccacgccaatggcgtccccgccgccgccagaggccgcaccggctgaggcggggctcgagagtatggagggcctcgtcctggacacggtcatctcaagggccggcgcgcgccccgcagcggcgctcgcctgcgccagcacgcgcctccgcaccgccgtcgccgacgactccctctggcgcagattctgcgctgaggacctggggctcgacgcgcccgtcgatccggagggtcagcctctcccctcgttccaggttgcatataaggtttggttggagtcttttggcatgtaccctctacctatggtaaagagagtgaaacaattttggacttcaatgaaaacttggttgtctgaaaactttcccgaggcatacaaaacgttgtgcaaaggtgtttctgaagctcaattaaagtcggcagaggatgatcttggtttcaagctccctatgcccacaaagctgttgtatcgcttttgcaatgctcaactgccttttagtgaagaccatgatgcaaacaaaagcatttccactcatggattgattgggggctatgcattttatgatcattgggtgaatgtgcatttgtcacctcttgagcaaatagttgaagagacaaaggacttctatcgggagttccctgatgtctttaatgggcgcaacttcattgtagtggcgacttcatggtttcgtccgaaaacgtttcttctagattgctcaaatggtgaactttatgttggtacatacaacttacctataggaggaatgcttccctgtgtccctaaagcattgataa

SEQ ID NO: 6446 - DNA, 559 bp, Sorghum bicolor
  Clone ID: SORBI-28MAY03-CLUS43786_1
gcacgagggtcgcctttgattccttcccccgtcttccccccctcagatctgcgatccttatcccccagttcccccgtcctctcctcggcctcagtcggggagacgcagactcctgttccaatgatttcgtaggtgaggattgagagagagtctggaggctgccggctggtttggtggctcagccaagcggggcggtggttccacgccgttcttgccgcctggtgccgccggagcttctgtgttgaagcctgtgttcggagtttctgcgttgaaggctgtgttctgctctgctgattgggaaaaaaaactggtttggtgcagatatttgatgccgcgttggttccagggaccgggagctgggtgcttgtgtgaatttggctttcctttgatccgattggtgcttaatttgagcctgtggaggtttcttgggatcagggagttggtctccgtcgaaggagattgctagcttgcaggctcatagccattggcgccgaacttgcctgtcgtacggtctttcctgtgccagagttgaatttggcggagaaatttgctgctgtga

SEQ ID NO: 6447 - DNA, 780 bp, Sorghum bicolor
  Clone ID: SORBI-28MAY03-CLUS43889_1
gcacgaggcgcgtccccatctctcatctccgcggcccgtctcgtctcccactagggtttggcactttggccgccgccatggcgtcggcgtcgcgcgcgctcctcctctcccgtgcgctccaggccggcgccgcgtcccgccgcgtccccaccctcctgcgcccgctcgctgcggccgcgagcctcctcccggcggcggcggcggcggccgcccccggcgctggggtgcgctgcttcgcgacccagccggcgacgtcctcgctgcgggactcgtccccgaactgcaccaggcgcccgcccaaggagacgatcctcctcgacgggtgcgacttcgagcactggctcgtcgtcatggagccgccgcctggtgacgcctccaaccccgatattacgcgcgacgagatcatcgatagctatatcaagaccctcgcccaaatcgtcgggagtgaggaagaagctaggcaaaagatatattcggtgtctactcgtcattactttgcctttggtgcccttgtatctgaggaactctcttacaaactcaaagaaatgcccaaggtccgctgggttcttcctgattcatacttggatgtcaaaaataaggactatggaggagaacccttcataaatggggaagctgttccttatgatcctaaataccatgaggagtgggtgagaaacaatgcccgtgccaatgaaagatcccgtagaaatgataggccccgcaacttcgacaggtcaaggaactttgagaggagaagggagaacatgcagaacttccaga

SEQ ID NO: 6448 - DNA, 768 bp, Sorghum bicolor
  Clone ID: SORBI-28MAY03-CLUS43893_1
ctgcccgtccgccccctccccctgcccccaccgcggcctccccctgcgccgaccaccgccgctcccgcgcccgggccccgcccccgccccgcccgcgcccgatccccccccggccccccccggacgccacgctgccgctcgggcccctcgggcgggccgggggggctcgcccccccggggctcgccggagtccggcgggggctcgccccgggcggccgggcgcccctggcgctgctgctgggcccgggggtgatatcgctgtcccagggctcgtccctgcctcggacgtcgctgcacgactacctccccgccggagttactggcctcgggaagcgttcgtcgtcggagcatgctgatggaaacagcagtggcgctgtagttggggaggaattgtcgcagggtgggcgggaacccttagtggagcagaatggtcagggtggtgacgcgaattcaagccaaacttctgcagttacaggaaagttggatgataacgagccggatccagttgcttccagtgatgccacagcaattcctgacgaatctcaaaaggctgagcaagatacttgcgatctatatcgtggagagtgggttactgattcttctgggcctcggtacccgatcgactcccgcccttgcatcccgcgggcgcgtagttgccccgcaaatccgcggccgcacaaggactctcaggtggcgcgtcgggtccccgaacagtgtgacctcccacgctttgatgcaaggaagttcttggagttgatgagaggcaag

SEQ ID NO: 6449 - DNA, 473 bp, Sorghum bicolor
  Clone ID: SORBI-28MAY03-CLUS43927_1
gcacgagggttagaggtagctagcgtggtagtatattgtgctatatcatatttgaattaactatgatttatgaatgtgcaaatttcatgatacttcggaacgatcaagatttctgatttcaaaagggaaaaaaatgcttcggattcttttgcactacagagttaaaataaaaatgcttcgatgcagcatggaatatgtcagcagatgaatcttagatatagttatgcccatgttttgcattacttgcctgtacagactaacaagagttgctttcgtaaaacgcatggaatctacaaagattttactctgtgctgtattgctgtggaatgctccacccctgtaacagtgtctaaggtaactgcttttgcccatgttttagggcttcaggagataatggtaattccttgtctattgctgtgaagctctcctaattttatccttacagtgctcatctttgcactgcagaaggagga

SEQ ID NO: 6450 - DNA, 1223 bp, Sorghum bicolor
  Clone ID: SORBI-28MAY03-CLUS43135_1
ctctctctctctctctctctcgctagtcgctaccctctcgctcatacgactgtcgggccgccgccgccctaggccagggcccaggtgctgaggctttccttggtctcttcgtcggcgacgatcacccaccaggaatattggagatgtgccttcaacactctagggctcgattgtctccagacgagcaactcgctgcagaaagaagttttgccttgtattgcaagccaattgagctgtacaatattatccagaggcgagccgttaaaaatcccccttttattcaaagatcccttctatataagatacaggcaaggagaaaaaagaggattcaaataactgtatcactttctgcaagtgcaaatacacaagcaccgaatatctttccccttcatgtacttttagctagacctaccagtaatatttcgcttgaagggcattctccgatatatcgattcagtagggtttgcttgcttacaaattttagtgaatttggaaataaaggcaaaactgaagccacattcatcatccctgatgtgaagaatttgtcaacctcccgtgcttgcaaccttaacattatattaattagctgtgggcaagtaggacaaattattggtgaagatagctgctccgggagcacgagggaaagatcttccctccaaaagcttgaagggaaatgttcctggggtaaaataccgactaatgtacttgcatcctctttggagaaatgtgtgactttaagtacaggagatgctgtggatttggcttcgacagttacaatgagcccaagcttcttagagccaaaatttcttgaacgagacaggtgtttgacattttgctctcataaggttgatgctacgggttcataccaattagaagtatgcatatctgcagaagaggctggtgcaagagaattacttttgtctccttattattgtaattactcatatgataatgtcccaccttcgttattaccagaaatcataaggttgagagctggaaatgtactttttaattacaagtactacaataatacaatgcaaaagactgaagttactgaagatttttcctgcccattttgcttggtaccatgtggaagcttcaagggcctgggatgccacttaaactcatcacatgacctgttccactatgagttctggatatctgaagagtgccaggctgtgaatgttagtctgaaggctgatgcctggaaaactgagtctgtg

SEQ ID NO: 6451 - DNA, 607 bp, Sorghum bicolor
  Clone ID: SORBI-28MAY03-CLUS43260_1
cccttcccttcccctctcttccccgaaagagaggtcgcagacggaacccttccaccctccctgaccttcgattcctctgcgatttccccccgcgcgctcgccgattcctcgatcgactcccgcgcgattcgctttctggtcggattctctgcccccgaagcatgcagccggatcagcctgtgatcagcttgcgccccggcggcggcggcggcggcccgcgcgccggccgcctcttctcccccgccttcgccacctccggctccggagacttcctccgcccgcacggcgggggcgcctccggcatctccaagatcggcgagtcacattttgagccacgcgagcgtgttcgttacacaagagatcaacttcttgagctgcgtgagattggtgatgtgtctgaggacattctaaggatcaagcaagagattgatgtagagcttcatggtgaagatcagagctgggttcgcaatgattcagctattcaaggacaagcccaagcccaagcccaagctcaagcacaagcacagaatcggtatgctgagactgataaccgtgattggcgtgcacgatcagcacaaccgcctccggctaatgaagagaaatcttg

SEQ ID NO: 6452 - DNA, 994 bp, Sorghum bicolor
  Clone ID: SORBI-28MAY03-CLUS43294_1
cctactggatccccttcctctcgcctcgtcagtcgccaagctagcctccctcacaacagcaagccggcgaccggtagctcggacctcggcggcgtcgctccccctcttccaaaggcgcgcgtgcttttatgctcgcggcagctcggttcgtggacttccctctagtagcgctctccgcctctcgccctcggacgacctttctgcgaaagcgaagattccggtatggaggtggaggcgacgcccacgacggccgtgtcgtcttccggcggggccgcgcagctgccgccgcccggcccgcccgccaagaagaagcgtgccctccccggcatgccagatcctgacgcggaggtgatcgcgctgtcgcccaagacgctgctggcgacgaaccggttcgtgtgcgagatctgcaacaaggggttccagcgggaccagaacctgcagcttcaccggcggggccacaacctcccctggaagctgcggcagcggagcggcaaggaggcccggaagcgggtgtacgtgtgcccggggcccagctgcgtgcaccacgacccgtcgcgcgcgctcggcgacctcaccggcatcaagaagcacttctgccggaagcacggcgagaagaagtggaagtgcgacaagtgctccaagaagtacgccgtgcagtcggactggaaggcgcacgtcaagacctgcggctcccgcgagtaccgctgcgattgcggcaccctcttctcccggagggacagcttcatcacccaccgtgccttctgcgacgcgctcgccgaggagagcgccaagggcgcgggtggaggcgcctcccgcggaggacgggagctcggcagccgccgtagttccgccaccggtgcccccgcctccgcctgcgccggcgccactgaggcagcaaccgcccccgcctgcgccgcatcatgcggagcaacgcaatgaaccggaggccaatgcgaccgagcccgtccagttcgcgccgccgccgccacaggtg

SEQ ID NO: 6453 - DNA, 1178 bp, Sorghum bicolor
  unsure (1)..(1178): unsure at all n locations
  Clone ID: SORBI-28MAY03-CLUS43319_1
gcacgagggtggagtcgccggtggcgcactcggagcagtcgagctgaccgagctgagtgcctgacgtatttattggcttcctcgccgcgtcgagcaccagcaccagcaccagcaccagcacggcgaccgaccaacactcccgtcttccagccccgccccaactccgagtcgaagcatggaagccgcggcggcgtcagcgagagtcctgcgcgtggccgccatctgcggctccctccgcaaggcctccttcaaccgcggcctcctccgcgccgccgcggaggtgtgcgaggactccatcccggggctccgcgtcgacgagctcgacatctccgacctgcccttgatcaacaccgacctcgagaccggcggcggcactggcttcccgcccgccgtcgaggccttccgcgccaaggtctgccaggccgactgcttcctcttcggcgcgcccgagtacaactactccatcgccacccccctgaagaatgcacttgactgggcttctagaggaaagaactgttgggcagacnaacccgctgcaattgtgagtgcaggcggtggctttgggcgcggggggtcacagtaccatctccgtcaggttggagtattcttggatcttcatttcatcaacaagccagaactgtgcgtccaagcatttcagcaaccacccaagtttgacagcgatggaaatctgattgatgctgaaatcagagagcggctcaagcaagtgctcttatcccttcaggccttcacactcaggctccagaaggactgaatcaactcgggaccattgcttccctgagaagcgtttatggctctggcacgtcacatacctcgcttgggacctgtaaagcatttgccaaggatgttttcattaatcaagaacgaaagttgggggctcgaagacgatcagataccgtcctagtctcaaccataaacgatgccgaccagggatcggcggatgttgcttataggactccgccggcaccttatgagaaatcaaagtctttgggttccggggggagtatggtcgcaaggctgaaacttaaaggaattgacggaagggcaccaccaggcgtggagcctgcggcttaatttgacaacacggggaaacttaccaggtccagacatagcaaggattgacagactgagagctctttcttgattctatgggtggtggt

SEQ ID NO: 6454 - DNA, 797 bp, Sorghum bicolor
  Clone ID: SORBI-28MAY03-CLUS43380_1
gacttcgcagcaccaagcagtcaaatgggaatacaagacagaactcaccctggaccattcttccctcctagcaatcagaaccccaaccaaggtttccaaaggccttttgatggcaggcctatgaatatgatgggtcagcctcggatgcatcctccacctccacacttccatggagccttctccaggaatccatctcctctcgagttccctgcagggttccagggggtctggccagcagtacaagcacctcatatgccggcaccatcaaatccgtcaaatttcctgccttcccggacatttcagttgaggccaccgccacaacaggatatgtctggtgcaggtggcaacaggcagggtggcaatcaaatctacaacccttttgcaccaacagcagctcagagaacagagacggaccctgagtatgaggatctcatggcatcagttggcgtgaagtagcgctggctgctgacccctgatgtgtgggaagtcaatccaagctgtggttaactggtgacacaaacacaatggctctattgcttgccaagatgtgcgagttactaatctcctatgtatctctagatgactagatagtgaattccatcaaaggcagatcctggaaataaaaatgagtggaccttgtttgagaatgctgttggggtgtcgaaggttgtgttttggcatcacaataacctcatgcatgttactcccggcatcagttgatgtttattttagggagaggaatttgtgaaccttgttattaaaagagctggaagaaaatagagtttatagtgcttggt

SEQ ID NO: 6455 - DNA, 623 bp, Sorghum bicolor
  Clone ID: SORBI-28MAY03-CLUS4334_1
gcgacgcgtccgacaaatgaaagtattacgtcaagataggaacactgtttgctttattgaatttgaggatgtgggggctgctacatctgtacaccaaactctgcagggtgctgttattcctagttctggtcgtggtggaatgcgaattcagttttctaagaatccctttgggcgaaggaaggattcagctggtggccttgcgagcgttctgaatggagctcctgtgaactgattgcagcctgaggggggatgtatcttgaactttagcatgtcatcatggatttcatactaccacatctaatttatgatctgcatacttctgctgaatgcgctctctctcatgtgacatcttcatttgatggagcatctgggacatgatcatcatctatcatcatctttattaggtggaggttctggggcatgatcatcatctggtagacattgcattgtcaccaaaacatgctggtgttacttttttttaatctttgtagcttgtgaaggccatcctagatgtcttgtagatgtgcatttggcatttgtcatggacattactctttgtagtactattattatgtatttcacctatgtgtagttgcaacattttgtgtgtccattgtaaggtt

SEQ ID NO: 6456 - DNA, 943 bp, Sorghum bicolor
  Clone ID: SORBI-28MAY03-CLUS44069_1
gcacgagggagcgccgtgatcgatccccgcgcccgatccccttcctggacgagagcggccgcgtcccgatcccctccctgcacgagagcgatctcgcgccctgatcccctccgtggacgaccttcgggaccgccgccacctccctagatgaccgcggccacgagcgtccgcgctcgcaccgtcgggccctggagcagccgcgacccgatcccctccctggacgaccgccgagaccgcggccatggacgaccgtcgcgaccgcggccacaagcgtctgcgctcgcactgtctgtccctggagcggccgcgccccgatcgattcgttctcgcaccgtcgccagccattgcccttgccctcacgccacccttgcgaatcctcgtcctcaccctcgtgccgcagtcaccagccattgccctcgtggactccgatgtggcaatggtcgactgcaacgccgagtgggcggcccttgctgccatggccaccacagtgccagctcccgcacccatccaggcaatcacaattcaacagagggagggcatggaaacattttggatggagctaccaaggttgatactactctttagaattacaaatctctcaagcttgtgccgatccaggccgagactgcagctgctgcaacggaggacgatggtatccccatggtggacctgctgtcactgtgcgaccaccacgacccttatggccttcgagcttaggtgaattcatgatcggcctggtcaggatttcgctactgttgctgctcgtcgtggcgcgcctcccgcggccttggctggccggcccccgccattgtgccgcccctacccccgttgtgctctctgcaacggtgttgcctcgcctcaggccacagcctcacaaggtgtttttttttttgtcgaatcactcttggcattcctgaacaaggaattgttgtttttaaaaaaa

SEQ ID NO: 6457 - DNA, 632 bp, Sorghum bicolor
  Clone ID: SORBI-28MAY03-CLUS44087_1
atccaggcttacagctttcgagttggttcatgaaaaaatacctgcaacactgatagcagattctgctgctgctgcattgatgaaacaagggcatgttaaggcggtcatcgttggtgctgatcgaatagcagcaaatggtgacacagccaacaagattggcacatacaacctcgccatctccgcgaagcatcatagcgtccagttctatgtggcagcgccagtaacttccattgatctctccctcccatctggagatgaaatagtcatagaggaaagatcacccaaggagttgctgaactctgaaggtggtctgggaaagcaagttgctgcatccggtatatcagtctggaaccctgctttcgatgttactccagcaaatctgatcactgcaatcataacagaaaagggtgtgatcacaaaaactgatgctgatggatctttcgacatcaaaggattccttcagcctgcaaaataatactctcaagtgtgcgttgtttttgaatgaatgacataaatgtgtggagcaacaccattgtattctgttttctctatacaataaaattgctctggtgaagctcatgtgacaaggatgtgttcacgcctattctggagtaataaagatctttggaatc

SEQ ID NO: 6458 - DNA, 677 bp, Sorghum bicolor
  Clone ID: SORBI-28MAY03-CLUS44225_1
acattctccttttcaaaattcatgcacacatggtttataatctataagccctctctttattcttcgagccacgccagtacgccacaccacaccggtacaccacgctcggcaagggaagggaggtgcggctgcgaagtaggcgaggggaaggagaggcaaggcggcgcggcgggcaagatgtttgacgatcaagacctgggcttctttgccaatttcctgggcatcttcatctttgtgttggttattgcgtaccacttcgtgatggcagacccgaagtacgaaggaaactgatgtcctctcgcgagatcttatgatctgaaggccaaaatagagctatactgttagttaatgctagcgagatcaattgacattttgagtgcatatcatggaagctggacatggcattttgactttacccatgtttttaatatgctgaatcagtaaatcctggagaattcaaaaggttattctgagtactgcagttggttgttgtttctagtccttgtgtcgtgctttttatgtctagcgtgttcgcttgaccttatctgctaaatctgtcagatattcaacaatgtttttctctcacaaacagtactttcagctatggcttttctcaaagcaaactgtctatttagctatttattatttggttgttagcgtgtcagcaaacaggagac

SEQ ID NO: 6459 - DNA, 421 bp, Sorghum bicolor
  Clone ID: SORBI-28MAY03-CLUS44175_1
gcgcacgagggcgcagagcaacagggcacacgcacgccagactagaggctccgagcgagcgcagccgaggagaaataatggccacggcgacggccctctccctcagcggcggcggcggcggcactcccctgctccgcgggcacgcggccttggcctcggggcggtgctgcgcgttcccgcgctcgcggtggaggccgccgcgcctgtcggcctcccgcgcggacgactcttcgccggcgccgttcgagatgacggtggagggcgcgttgaagctgctcggcgtcgccgagggcgcgtccttcgacgaaatcctgcgcgccaagaattccgtcctcgcctcctgcaaggacgaccaggacgccgtcgcccaggtcgaagcagcctatgacatgttgcttatgcagagcttatcacagcggag

SEQ ID NO: 6460 - DNA, 1022 bp, Sorghum bicolor
  Clone ID: SORBI-28MAY03-CLUS4427_1
ggcgtgcgccgagccatcagcagtgcccgccaccgacagcgataaggcctcgccgagcaacgccaccggggccggagcagcacacccgaaggtgaagaaggagaagagatcagtggacgtggaccggtcgctgccgttcaagaaacggtgcaaggtggtccaggtccagcaggatcacgctgcggccgtcgcagctcctgccgcggccactgacaggccggctgtcgtcgtgcagcaggcggccaccgccgccgaggttggtgacgacgactcctgtccgagcagggacctgcttgtcgaccacattggtgggctcatcagctggagcaggagtccgccggcggctcccgcatctgcagatgctgcctcctgcagtttccggacgtcgccggcgttgccggtgcagcaggacgagatcacggacgctgccatgctgctcatgacgctgtcctgcgggcttgtccagagctgatcgacgatcgatctacctctacaaaggccccagcaccataggctttttgcagctagctacctctactcctctagctagtgcctctgactgttagtgttaccgttagtgttgttaccatcgtcgtttaccgtacgacctgtagtgttttttttatttggcttcttgttcttgttgccagtgtaacccgtgtcactgttcaagtcatgtgattcgtttgatgagagagagagagagagaagagagttgagagaacgggacgataggagcgagaagatcacgagtggaagtgatgaggcaaaatcgtgattatcatctctagctacaatagccaggacggcgatataattattgcatgtagtgtgagactgtgaggtgtttcagttttgagtgcactagttttttcccccatgctgtggctgtaacctggtcagtggctgctattgttatttattcttcattctggttgagttttttgtaagggagctaaaaataatggcaatctggagacatatcgtgccaaggcgtgcctgtgttcttgcgactcgctcat

SEQ ID NO: 6461 - DNA, 929 bp, Sorghum bicolor
  Clone ID: SORBI-28MAY03-CLUS43556_1
cagaacatcctggggggcctggggaaaaatttatgttcacttactcaattcgcatgtcagttccagaggcatgcatgctaggtggtgtgtactattcttgctgccagctttcctcccgccactggaccatcagatcgtgtgacagggttgtttctgatgtgagcggaggaggtgttattggacagtatcctgtactgttacctggtgaggatgagtttgtctacgagagttgcacgccactgcccaaagtacctggatctgtggagggttctttctcgtttgtgcctggcaagttgatccgacctgaagggaagcctttcgaagtcatggtggcgccattccctcttgaggtgccagaatacatcttctgatgatcacagcaagaactaaatgtatgcttgctagttgcatcgccgtggtactgcttgttggggaaaagtttggatggtaagcatgatcttgttggagtaatgtaaaataagaaaccgtgtgctcttacttcatgtagcaatcaatcaacacagccaccagcaaatgtgccgcatatcagttgcacctgtgctgggctagtgtgctggaccagactgctgtggagatatcaactagcaggcttaggctccgatccaacatgatatcccacggcgagggcgagggcgagggcgtctcgtgttgcacaaacctcccctttcctccatggctcagttagtagtagcttaaggacaacaggaacatgtcgacatagagcgcttgtgctttatgtgcagcggaggactcgtggaagcattctcttattgttgcaatatggctcagtgtgtttgggcacttgagcgagaagagcttgtggaccttatatgcgagatctcaggctaaaagttggttggcagagattttctgaggttatagccggacaagacaagagcagttgaatt

SEQ ID NO: 6462 - DNA, 966 bp, Sorghum bicolor
  unsure (1)..(966): unsure at all n locations
  Clone ID: SORBI-28MAY03-CLUS4363_1
cgtgcgcggacgcgtgggtgggaaaagaaaagcctgtggaggaatctagtcctgaatatgagaagctgggaaatggatatttgagctagaaaatcatttancanaggcccaaaaacaagcataccgtcttgtgaaaagacacagagaacttgggcaatccttggcggacttcggaaaggcaattaagcttttaggtgcttgtgaaggagatttgatggaaaaggtgttttctgaagttggttctaagtcagagatgttgtcaataaagctgcaaagagaggcagacaaccttctctttaactttgaagaacccttgaaagattatgtgcgtgctgtacaatctataaaagccactatgctggatcgagccaatgctttcaggcagcactttgatttggatcaggagaggaagtataaagagcttaaccttgaaaaattgaagttcatgaaccctgagaagtatgccgaagcagagtctgagtttagagagttgaaagcagacagtgaggaggccacaaagaagtttgaacacatagttagactaatgaatgaagagctcgctcgtttccaggagcaaaagacggctgatattggactcgcattccatgagtttgccaagggtcaggctaagctagccaaagacattgctgatgcttggcgcagcatcctcccaaagcttgaagcttgttccacatcgtaaatgtgatttgtgtttcctcgtgatgtttgggataggggctggcagctgttgatttttaggctgtttttccccagcctgttttgacactgattcctgtatacttgaactgcggtttggaaatgctccatctgttagattcagttgacatcatttcttgctgtttgagcttgtaaccatcttcttttctttagatcaattgacatagctactggaaccacgtaataatgatataatcaataatgaagaaatgctgtaccatgggcaat

SEQ ID NO: 6463 - DNA, 1031 bp, Sorghum bicolor
  unsure (1)..(1031): unsure at all n locations
  Clone ID: SORBI-28MAY03-CLUS43700_1
gcacgaggcaggagtgaaagggtcaggagtcaatggcgtagtttatgcttctgaacctttggatgcctgcagcccgttaacaatcaaggcagtcaagggcccaccatccccctttgcattaattgtaagaggcggttgcacattcgatgagaaagtaaaaaatgcacaggatgctggattcaaagctgcaattgtgtatgacaatgaaaatagcggggtcctggtttcaaaaatgttgcagtggctggaagctcaagtggcatacatatatatgctgttttcgtttcgaaggcctcangagaggtgttgaagaatttttcaggccatactgatgtagaggtgtggatactacctacagctcggggctcagcctggtcgatcatgggaatctcattcatatcgctgcttgccatgtctgctgtattagctacgtgtttctttgtgagaaggcatcggataaggagagaccaccctagaatcccagaagctagagagttccatggaatgagcagtcaattagttaaggcaatgccaagtcttattttcacaaaggtgcaagagcacgacggtacatcgtcaatgtgtgccatttgtttggaagactatagtgtcggagaaaagctaagagtgctgccttgtcgtcacaagttccatgcagcttgtgtggacttgtggctaacttcttggagaacattctgtcctgtatgcaagcgagatgcgatgagtggagtatcagaatttcctgccacagaggctacccccttgctttcttctgctgttcggttaccttctcggccatcttcattcaggtccagtgtggcagcctcccctccaaggccaataagccgtcatccttcatcacactcagtttctcgtgcttactctgtttctagtacgccccagtctcccaacccctttagatctcgcacaaacttacctggcatccatacaagcagaagcactgcagaccttgcaaatatgtcatctccgcaccctcgcatctcacatttgtcatcggcgcactcccttgt

SEQ ID NO: 6464 - DNA, 947 bp, Sorghum bicolor
  Clone ID: SORBI-28MAY03-CLUS43697_1
atttactgtgctgtcctacatattcttgctgatacatatgcaacaagtgatacatacagctattgtccaacttgggcacttacatgggcttatagaaggcagaatttgctgcgtgaaattattggttaccatgctgatattatctgccttcaggaggtacaaagtaatcactttgaagaatttttttcaccggagcttgataaacatgggtatcaagctctttataagaaaaggacaacagaggtgtacactggaagtcctcaagccacggggggttgcgctactttcttccgacgggacagattttctcatgtcaaaaaatacgaggtcgagtttaataaggccgcacagtctttaactgatgcaattattcctgctgctcaaaaaaagttggctctaactcgtttggttaaggataatattgcgctaattgcggttttagaagctaaatttggtaaccatgggactgaaaatcctagtaaaagacaacttctttgtgtggctaatacacatataaatatccaccatgaccttaaagatgtgaagctatggcagattcataccctcctaaaagggttggagaaaatagctgtcagtgcagacattccaatgttggtttgtggagattttaattcaactcctggaagtacgtcacattggcttcttgcaaggggcaaagttgatcatttgcatccagatttggcaatagatcctcttggaattttgcgcccactaagcaagctgacacaccagcttcctctggtcagtgcatactcgtcattcgtgagtatggctggtgttggctatgatttggatcaccagcgaaggaggatggaccccgcaacaaatgagccattgttcacaaattgcacaagggattttactggtaccatagattacatattttacacagcggattcattgactgtggagtcattattggaact

SEQ ID NO: 6465 - DNA, 595 bp, Sorghum bicolor
  Clone ID: SORBI-28MAY03-CLUS4367_1
caagggctggggctacgcgtactgcgacatccgggggtacctggcggcgctggacatcatgcagagctactacccggagcgcctcggccgcgtcttcctcatccacgtgccctacgtgttcatggccgcctggaagatcgtctaccccttcatcgacgacaacaccaagaagaagttcgtgtttgtggcggataaggaccttgataggacgctccgggaggccattgatgactcccagctcgccgagatctatggcggcaagctcaaactcgtcgcgccgccggcaaattaaacggcaacaactgaaaacggatccatcccatgaactctgcaatgcagctgagcagagcagagagaatgcagcagcagagtacagtacgcgagctagacggacggacgctcgaatacgtacgggtcagagaaatatatatgtatgtaaatcgtagcagctaggagaattagcaattgcaagtgacgacatgtcatcttgtacaagacacgcggaatgaaagatgcatggtttactgtatgctgtcctatgtactgtaaccagccggtgatgagtggcaataagattattactacacttctctat

SEQ ID NO: 6466 - DNA, 670 bp, Sorghum bicolor
  Clone ID: SORBI-28MAY03-CLUS44421_1
ccttaaaaagctatataggaagacattcaagcaggaggagatcggcaacatcccaactctcctaattggttcagccgctggtgccatatccagcactgccaccttccctctcgaggtggcccgcaagcaaatgcaggtaggagcagtaggcgggaggcagatctacaagaatgtgttccatgcgctctactgcataatggagaaggaaggggtcagtggcctgtacaagggtctcggaccgagctgcatcaagctgatgcctgcagcaggcatctcgttcatgtgctacgaggcctgtaagaagatcctggtcgaagacaacgaggatagtgagtgaagctgaagcatgtatgcccctgaggaaggggtatgagtatgactgatgcggaaggctgggaggtgggggtactataccctagtcatatcaactgatgaaaatgtagatctaagatatttgaacgcctgttagatcaagttttggctcagttttgtgttgaaatccataaacaatattcttacacgatggtgcatgttgcgggggcaattttgtcatgtggccatgtctggttctgtcgtagtgctcgtaatttttgctgtcgctacatttttgaaactctaatttttgtaacctattcgctcagtcctgaaataagtgacgaaagcatttttt

SEQ ID NO: 6467 - DNA, 700 bp, Sorghum bicolor
  Clone ID: SORBI-28MAY03-CLUS44379_1
gcacgagggcatagccatctgcgccttaaccttctggattggtgacattatcgtgacatacacacttcctgtgatgctgaatgccatcgggctcgctggtgtctttgggatatacgccgtcgtttgcatcctggctcttgtatttgtattcatcaaggtgccagagacaaagggcatgcctctcgaggtcatcactgagttcttctccgttggagcaaagcaagccaaggaagccagggaagattaatcacccagacccagatatcagcatcgcttgcggacttgcggtaattttgtggtttgcatacttcgctgtggttgaatcctgtgatgtcttgtgaaagaaacttgaccgacgaagtggggaccgggggaccgcagggcacctaaagagatgatttggctgtacattgtgaggcttgattctgtcatagactggccttcagaactaggaaggatgtgtagatcatcatctgttatttttttttttgcttggagactttgtgcttgtgttcgttggtttttttttttgggggcctatgtaactagtggtgtatgacagttatgctattggtttctttgtgttgtcaacttcatctctgtcagtactgtatttgcgcagcgagtgcgtggaaatcctgttgttggcagaatgctagtgcagttgtgttttcagtttattggtagctggtaaagtgaa

SEQ ID NO: 6468 - DNA, 901 bp, Sorghum bicolor
  Clone ID: SORBI-28MAY03-CLUS44422_1
gcacgaggatattctacaggagaggacaggcgctctctcactgacgcaagcgaaacgagcagagcttcgtccacctctcaagaagaaggaaggaaggcatggaccgcacctacaagggcggcatcaaggcgtactggaagcgccggggctactaccgcatcgacgccgccgccgcgcagcgccgcccgccgctccccaccgcggagctcggaggtggcggcgtcgcccaggccccggaggatggctccgggcggcgccaccgccgtcgccgcgggtggcgcgtgcggcgcggccaggtgctggggcggcggctgctctccgcgctgtcgccgcgccggtggctcatgcggctccgcgacgcctacgtgtcggccatgctgcggctggcctcctccgccgccgtcgtcgggtacggcgccgccggcgggccctactgcgccaacgcgacccacggggccgtcgtcgcgcggccggcgcagctcaaggagtacgacgagaaggtgctggtggagatctacaggtccatcctcgctcgcggcgggcctctccccatcgccgccgtcactaccgacggcggcgacggtgcgcctgccgccgccacgctacggctacctacggctgtttgagcttgagcggaagaagaaaacatgtaatactcttcatgtcgcgacttgtaataagctgtgactttcttgcgcctcacaagcatttcttcattctcaattcgatcgatcatcaagtcttatgacgatatttgcaccgaagtcttatactatgttatgaattagtggcatgtttggaatccaaagtctggtgcatatatatttgcaccgcgggtaacaggttctgtacttctgtatagttttgcctgatatacaagtgcgaagtgcaaaccatagtt

SEQ ID NO: 6469 - DNA, 644 bp, Sorghum bicolor
  Clone ID: SORBI-28MAY03-CLUS44597_1
tggatttcttctcttctcccccctcgcttgttcgtcgcgtccgcccccggctcagatcaagaaaccgtgtcctgtcgtgcccctgggaaccatcggggatcgattgccgttcctctcccgcacctcagatcgtacaacgacggcggcgttcggaggtctacgtgctcttttcggcgggtcggctcgcggatcgggcggtgtctggttgacggcgaggcaacggcggcggcggtcgtcttggatcgggagtagttgagtctgctgagaggtgcggagatggtggccgaggcggaggtgatgcatcagacccccgtgccggtgctagaggtgcagtaccaccggtgcgtgacgacaaaaggggttgaagacgtcgtcgggatgtccgcggcggcggcggcggccgtagccgcgcccgcggaggtcggggttgaagtcgaggtcgaggtcgaggtcgaggtcgaggtcgccgtggaggtgcctctcatgggattggagcagcctgatgctgcaccaagtgtgtctatggacgtgctacagtttgtgcccaccattcgatctggtagctttgccgatattgggcctaggaggtacatggaggatgaacacatcaggatagatgatctttctgctcatcttggctcact

SEQ ID NO: 6470 - DNA, 625 bp, Sorghum bicolor
  Clone ID: SORBI-28MAY03-CLUS43899_1
aaacccttcccccccccttcctcgagtccttcggaagcagagagcgcgggcgcgacacaccgatcaggcgcgccgaagcatcagtggcagccgacgatcatctcccggcgccggccagctcctcggccaccgcgccggctgcggccatgtcgaagaagaaggctgtcacgacgatgacgctcaaggacttccacggcggctccatcccctccgagctcccgctcccctccgcccccggcgtcaccccgcgccccgcggaccgcaccgtcgcctccccgtcccccgtcgccgcggcggtcgcacggccacgcgtaccggtcgcttcgcctaccgccgctgcggcggcagccgcgatgccttccttcctcaccaacccgtcccgcatcggccgtcacttcgacgaggacgagcgcacccccttcgagcccgccgcgccgcgccgcccagcgccgtccccgacgtcgttcgcacccgctcccgtggtggcgctcaccagatccgggcccgggaacgcgtggggcccgaggaaggaggcctctccggcgtcttcccctgtgggtcctgctcctgcctccgccggtggccagatctggtccgcgacacgcatcgcccaggccagcgcagt

SEQ ID NO: 6471 - DNA, 460 bp, Sorghum bicolor
  Clone ID: SORBI-28MAY03-CLUS44019_1
gcacgaggctcgtgccgcgtcgtcctcctgctcctgccctccagctaataaggcccggcggcgaggcgatagcagtgctagctagtgtagtagcgccgtaccacagacggggagaagaatggagcccccctcctcgcccgcgcccctcttcctggtcgtcctcttcctcctcggctcgctgctcctgcaggcgcgcgccgacgacccctacaggttctacacctggaacgtcaccttcggcgacatctacccgctcggcgtcaagcaggaggggatactgatcaacggccagttcccggggccgcagatcgacgccgtcaccaacgacaacatcatcgtcaacgtcttcaacaacctgccggtccccttcctcctctcctggcaaggaattcagcagcggaggagctcatggcaagacggcgtgtatggtaccaactgccccatccctccgggtggcaat

SEQ ID NO: 6472 - DNA, 867 bp, Sorghum bicolor
  unsure (1)..(867): unsure at all n locations
  Clone ID: SORBI-28MAY03-CLUS44048_1
gcacgaggagaagccaaaaaccccaagccggacgcctcccgtctccctgtccgggcgcaccagcctacctcgccgccggagacatgaaccagcccgtgcagaagaacaccctctacgtcggtgggctggcggaggaggtggacgagaagatcctgcacgccgcgttcgtgcccttcggcgaggtcaaggacgtcaagacgccgctggaccagtccacgcagaagcaccgctccttcggcttcgtcaccttccttgagcgcgaggacgccgccgctgccatggacaacatggacggcgccgagctcttcggccgcgtgctcaccgtcaactacgccttccccgagcgcatcaagggaggggagcagggatgggctgcccagccaatttgggccgatgcggacacttggtttgagaggcagcagcaggaagaggagatgcagcggctgcaggcagagcaccgtgcagcaatgcaggcagcagagaagctgcaccagggagaaacctggctgccgaaagggagggcgagaaagaagaagagacagcagatcccatggctgctgcagaggctcaggctgtgaaacaaagttcttaagaaccgggatatcaatttcataacatatgtgctacattggtggncccctttgccaaatacatgtttctcagcagcgtggctacaatatgactaacgaatcttgtgagtgctgtttgcttagctgaaagaatcctatttctcacttggatctgggatttttatggatctgtctcttttttttttttcatgttgaggttgcagaatcaagcagagctttactaaaatgctgtggttccctatgcctacatgttgcattgtcccaaggactttgcaaa

SEQ ID NO: 6473 - DNA, 196 bp, Sorghum bicolor
  Clone ID: SORBI-28MAY03-CLUS44031_1
tggactccgtccggtgctgctgctgctgctgccgcctgctggtgccttgagcagtgcgatcgggtcggatccgtagggtgttggcgggtgcaggtggtggctggttgccgatcgatcgagaccggtgaggatgttggcggtgttcagcggcgaggtggtggaggtgcccgcggagctggtggcggcggggagccgg

SEQ ID NO: 6474 - DNA, 633 bp, Sorghum bicolor
  Clone ID: SORBI-28MAY03-CLUS44068_1
accccccccgccgccgccgccgccgcagctggcgccggcagtgtcgtgcccagccactgccagttcttcccggccgccgttgaccggacgagccagagcacatggagcaccgccgcgccgctagtcaccagagagctcttctgatgacatggcacccatccatgtctgtcgatcgaccaagcgatcgatcttggcatggcatgtggagtaggggagattgaagaagaagaagatgaatgcgattaggagaagaacaacaggttctggttaggaggatctcgcaggtggtggtggtggactggcgttggggtaattaatcaattaattaattattacagttaatcaatcaggattcaggagacgagaggagattgttttgcttttcttttctttccttgttttttttttcattttcgatgaattcattcatcagttgggtttctgaaaacgacgaatgagcaacaaacaaacaaaacaaaagatggctgtctgctttttcctggacgccgtgttatgtaaaaccagctcacctaatctctgctgctggttggtgaaaaataacagcgttgagtgattgtactagctactactactaattgtttggtgaagaaagttaatgggaatgaaaccttc

SEQ ID NO: 6475 - DNA, 670 bp, Sorghum bicolor
  Clone ID: SORBI-28MAY03-CLUS44072_1
ccgaccggaccgacgccgacgtcgcagtacgagcactcgtccatcccggccacggtgaagaagatcttcaacctgccgcagggtttcctgacgaagcgggacgcgtgggcggggacgtttgagggcgtcgtgcagaagaggaccgagccacggacggactgccccgagcagctgccgacgccgacgaggatcaggcagacggaggccgacgaggaggccaagctcagcgagttccagcaggagatcatccagctcgcgtccgtgctcaacggggaccaccagctggccagcttgcaggacaggatcagggacgaaatgaacgtcagggaaggcatcgactacatgaaggccgccgtcaagcgctacttcgaggccggcgcgtccgccaggcggatgggcgtcgacggcgagcagatcgtcaagatgaggccatccctcaccaccaggatccagcgcccatagagacagatcaaattaaagcatatataggaattattggactggtcattgtgttcagaaattaaattggattccatatatacggatcacagtcaattaggatgtgcccgtgccctgtgctagatcaaaacatgggtgtgctgtacaaatgaatgctaattggtttggaaatacatacagattcgcactgtgcttggcagtactactgcca

SEQ ID NO: 6476 - DNA, 1001 bp, Sorghum bicolor
  Clone ID: SORBI-28MAY03-CLUS44891_1
gcacgaggatttcaacgattcataagccctgtgtgtaactgggcttactgttctctatcccttagttactggttatatgattgtgagatattaaattttgtgttaactcttttttttttgcagtttttcttatctgaataatacgattcataagctgtaattttttcagcaatggcatgttgtcccatcgagttcacattttacaatggatttttgcttcttgctcacactatgcctcaatttttttaggaatgcagtattgttgtcccacccagttcacattcggcaatggcatgttatcccatccggcatcttggcagtactgtgatcctagcagtaatgcagcgtggcagatgaattttacggagacgatgaaagaaattccagtatttacagttatagtcaatttatgcatgatttgctcgtgcatgattccttattttgttatctgtaatttagatcaaggaaactattttaagctgtatatttgtgtctaacattgttaatctactctttgtccatggtaactaaattagctcctggctttttgccttgtgtgcgtggcggcgttttcgggcctcgtcgtgcccacgtcgggccgttccctagtggtcgccccctccgtcttgcggccgccacctgacgcccggcccgctcgctgtggcccgaattgtttctcttctcgaagcccacacccgccggccctggcggcactccgcccactggtcacctttgcgccttgttctctttgtgggttgtgattcctgtgtattttagtgccagtaaggataacacctgtgaatgttattatctcctccagtaaggacaatgatataagtttgcctttctgttttcctgaatttatatgacgacactgcaaactcaagttgtcctaacctgagatctgtagttgtcctgaatacattttaaaactgtagtactataattcagagatcagaatataatgcccacatgtgctatctctgtcctgctctgaattg

SEQ ID NO: 6477 - DNA, 1058 bp, Sorghum bicolor
  Clone ID: SORBI-28MAY03-CLUS44893_1
aatagcacaacagcaaacaaattttcgcggaccaacttattgtcaacactgacacgaaagttttatgatccatacatacgacatgagtagagtaaactatcaccgaacaaaagaacacggcggccgtggttcacttcttggcgatcaccgcgccgtggtggagcgcctcggcgagcctctgcagcgctgcgtgcgacgacccgccctcctccacggccttccggcacacggccttcatatccgcggtcttctccctcgccctcctcccctgctcgccgtcggcgtccatcagggaccgcaccgcgcgctcgagctccgcggcctccacgaagttgtcccgcttcctgtccaccttgagcggcacggccacgcccatatcggccaccagctccagcgcgttcaggtgctgctccgcgtacagcggccacggcaccaccggcacgccgtgccacaggctctccagcaccgagttccatccgccgtgcgtcacgaagccgcccacggcggggtgcgccaggatgtccttctgcggcacgagggtcggccacaccaggcccttgcccttggtcctctccaagaacccctccggcaggagctcgtcgaggttcgcgtccgtcgggtgctccgccccgtctggggcgccggcgccggagccggacgcgtccgaaggtgggccccgcaagacccacaggaaccggtgtccgcaccgctcgagcgcggccgtgatctccaccacctgcgacggatcgaaccagcccaggctcccgaagcagaggaacaccactgaccccggcggctgcgcatccagccacgcgacgcattcgtgagacggcgagcggtcgccgagcgacagcacggggccgatcgggtacaccggcggcgcggggcgaccgggcacgcaccgccccccggcgacggccgctagcggccccggctcgagctcgtccgcggtgttggcgatgatccccgtggcgtccatgaagcgatcgccgaggcgcacgaaccaggcgtagttggggctcttcttgtccaccacggggcacggcatggactccggc

SEQ ID NO: 6478 - DNA, 825 bp, Sorghum bicolor
  Clone ID: SORBI-28MAY03-CLUS44903_1
gacggcagcgcaggtccacgcgggcgcagcggaggcaacgcgatggtggctcgccgcttcgtggtccggcatggccccgccgccgcagccggtggctccgtcgagcgggaggaggaggaggagcacgaggtggagtacgatacggagcacggcctcgacgtcctccgcctccagatcttctccctcaccgcccgcccgcccgacctccagaagatcgtggtggaggcggatgggttggtggtggacgacggcaccgatctggaaaccgtctctgagcgcctgcgcctcctcgctatcggcgaggaggaggaagacgccgccgcagcggccagggcgcaggaaaagtccgatgaggaattcgcacggatgctacaggcggaggaagaggcacttctcctacaacagtacagtatacaaaatgatggtggagatgtgtttagacagagagttgagccttacatgcaccaggttctgatgtatgaagatccagtgggacaagaggcagcacgtaagacagttccaatatgcgaactggaggagaaggcattggtttcactggccaaggaagggaatttcaatccttcgaatgatgaagagaagcatggctttctgctgcaattgcttttctggtttaagcaatcattcagatgggttaatgcagcaccttgtgacagctgtggtcgtgagacatccaatgttggaatgggcaccccacttacctcagagatcaaatttggcgcttcacgtgttgagatttataggtgtaaccattgttctagtatcacccgtttcccaaggtacaacgatccacgtaagcttatacaa

SEQ ID NO: 6479 - DNA, 1090 bp, Sorghum bicolor
  Clone ID: SORBI-28MAY03-CLUS44304_1
gcacgagggcgagctcggcatcatccacacggatttgaaaccagagaatgttcttctggactcgacaattaacccggccaaggacccagtgcgctctgggttcacaccaatccttgatcggcctgtggggaaccagtacggtggcacagtgatcagtttcagtgagaagatgctcaagatgagagcaagacgtgcagtggctaagatttcacagagacgggtttccattggtggggttggggcacaactagagaaagagaggtgcctggatgggatcagcttgaagtgtaagattgtcgattttgggaatgcctgctgggctgatcagcagctcgctggtgaaatacagacaaggcagtatagagctcccgaggttatcattggttctgggtactcgtattctgctgacatgtggtcgtttgcttgcatagcctttgagcttgccaccggtgacttgttgtttgctcccaagaattgccagggatgcagcgaagatgaggaccacttggctctgatgatggagactcttgggaagatgcctcgggagattgctacctcaggaactcgttccaaggattactttgatcggcatggagatttaaagaggatcagaagactgaagttctggcccctggatcgcgtacttgtagaaaggtataatttcactgaacctgacgccaaagggttctctgactttcttcggccgatgctagatttcactccggagaacaggccatctgctgcgcagtgcttgaaacacccttggcttaattgatccaacgctatacgaaagtctaaccggtagatgtttacatacatactaagtgcatgcgttgtcgaaggctcttttgtgactgggagtgcaggtatatccacgaactttgatttaaccaaggctgagaatcaggagccactttttaggtgcacggcctgatgaggacgcgacatattcagcttcttctttcttcactgtatgcttagcaagcgtttcgctggtgtgtttggggtgcagactgcagagataatgcgatgttaacctgcatgtgtgttagtagggccaaaatattgatgtaatattattctttggtaa

SEQ ID NO: 6480 - DNA, 603 bp, Sorghum bicolor
  Clone ID: SORBI-28MAY03-CLUS44315_1
gcacgaggctggcaccggcaccggcaccggcgcggggatcacgacccccggggccctgagcccaccgttcggcggcacgggcgcctacggcccgtcaggagcaggcagcaccgactacaacgacgccgccaagccgcgcgccgccgggctgcacgtcgttgccgcccttgccctcgccaccgccgccgccgccgcacctctcctccgctaggaggtgcgccgcgcggcacggtgccaactgggctggcgggcgggcacgtcacgtcggcggtggcgacgcctcccggcagcgtgcatgcgtgcctgccttgctgggttttgatcgatcaggcgtcgtcagtgtagtggtagtagcacgggggttattgctattcaactgacctatgtgtctgtctctctcctttgctcgtgctagtggtggccgccatgtgtgtgtggtggtgctttgtactccggtagagatctagggattcttttggtagttccggacatacgtgtcgtcgaacgtgttccttcagccccctcttttgttttgttccttcctatttgtgttttaggctgtgtttactagaactatgctagtgtttggtggcggccaccttc

SEQ ID NO: 6481 - DNA, 683 bp, Sorghum bicolor
  Clone ID: SORBI-28MAY03-CLUS4432_1
cgtccggccactaggatcaccatccctgagataagaaaccatccttggttcttgaagaacctcccagctgacctaatggatgacagcacaatgagcaaacagtacgaggagcccgagcaaccaatgcagagcatggatgagatcatgcagatcctggctgaggcgaccattccagcagctggttctcgtggactcaaccagttcctgaacgacggccttgacctcgacgatgacatggaggacctagactcagatgccgatcttgacctggaaagcagtggggagatcgtgtatgctatgtgacagcatcgaatactcagcaacgaggcaatgtgtatcatcaaccgcgctcagatggctctgttgcgtcaaaggttaccaagataatacgcaaggggtgtgcgctgctggcagttgtattgtacttgcaggtatctgctgcatatgctgctcacgcctgatgccgtgatgccccttttctatcatcccgttgtgtttggctgttgtttggtgcacctccagtgttttacaacagtttagccctttggaattgctactgctagaacctcgttcatctgagaagaccctttgtttctgcatccccgactaagggatagcgatgtacttgtatcattacactgtttgtatcatacgtattgggtgtaggaaaataaagaaactcc

SEQ ID NO: 6482 - DNA, 587 bp, Sorghum bicolor
  Clone ID: SORBI-28MAY03-CLUS44338_1
tgcctcgaaagaccctgcaccgtcgcagccgaagtgtgcgggcacgagctgtgcgtcaagtgcgcgctggacctgtgctcggtgatcaagtcctacgacgtgccggggatcgccggcaccatcccgtgcccgctctgccggagcggcatcgcctcgttcaggagacgggcggcggacgaggacgagcctgacgtgaacgccggcggtggccgacgtcgcggcgccggcggcgaccatcaggcgtcgtccagcccggagaagaaacggagcatggattcggaccaggaaatcctccccctcttctttactcctcccgccgtcctgtcctgaccggcatgcatttacaagatgcagagaagctacttcgtcagtagaaatctgcagggtgcagtgcagcatgggtagatataaatttacacagcagagacacacagattgtttggttctgtttgttgatgcttgcagacggcatcggtggatgtttattttatttttatggtggttcacatcacatggcattagctagtgtaacatattggtttgttgtaaaaagataggaaataacattcttttgctgtaaaaaaaat

SEQ ID NO: 6483 - DNA, 1107 bp, Sorghum bicolor
  Clone ID: SORBI-28MAY03-CLUS44344_1
gcacgaggcgcgccatcgtcttcaaccgcctcgagggtatcaaggacaaggtgtaccccgaaggaactcacctgatgatcccgtggatcgagaggccgatcatctacgacgtccgcgcccgacccaacctcgtcgagagcacctccggaagccgcgacctccagatggtgagaattggtcttcgtgtccttactcggcccatgccagatcagctacctaaaatctacaggaacctgggggagaacttcaatgagagagttctgccttcaatcattcatgaaacactcaaagctgtggttgctcaatacaatgccagtcagctgattacacagagagaggccgtgagcagggagattaggaagatcctgactgagagggccaacaacttcaatattgctctggatgatgtgtccatcacaagcctcagctttggaaaagagtttactcatgctattgaagccaaacaggttgctgcacaagaagctgagcgtgccaagttcattgttgagaaggccgagcaggacaagcgcagtgcagttatcagggcacagggtgaggctaagagtgcagagctgattggtcaagccattgccaacaaccccgctttcctggctctgagacagattgaagcagccagggagatctcccacaccatagcggcctcaagcaacaaggtgttccttgattccagggaccttttgcttgggctccagcagttgaatgtggggggcaaacaaaagaagtgaagtgatcgtccagcccagtcccacactaccgtggaagagagtagtttaagatacagaatggtttcagtcgatggttttatctgcaggtgaacaaaatcgccccatgttacagtcaacctttttttgctgtatctagcatttttctgtgggaatcactggaaggagggccaatgcgatgatttacttgtgcgctgctgcgttagtttctgtgtattaccctatgtttctttctgcaaacatatatgcatcataggctgtatgtttcattctggaaggcacatatgtactcttcatcaggttagagacatgaatccataaagctggctgatgaggtcaagctcatcgacatggtttgaaagtt

SEQ ID NO: 6484 - DNA, 953 bp, Sorghum bicolor
  Clone ID: SORBI-28MAY03-CLUS44988_1
gcacgagggcaagttaatattggaagcagtgcatacaaacatagtatgtctgacttcttgagggaagtcagcgaagttccagacattggtgcatctgatgtcattgctgatgataagcttggcaaaggaggaaagtggaagatggaagcgaggaggaattaaagaggacaagaaacgaagcagaaaaccatacaagcaatggcagaagctgtgcgaggggttgtgtgagaggctgccgcggtggacatggaacttggcgggggtgtcatgactcatgaacaattcgtggagaactaatctagcaagctagccagcctaaaagtctactacaccaatgagcagtgccagggcttccctaaggaacattgacttgaatttagatccaactgatgaagagtatgagattacagtgccaccccaagcccagtcataagctccagcaactaatttagctgcagccaatttaggactaattgctccagcaactagttccattgcagccactacaggaccatctgttccactttctggggcttgggaactgcctgacatgaacaatgggccctgtccagtttgctttgtcaaaaaaccatagattggagaggatgaggattatgacaatcaagactagctccgccttcatagcttcagagtggataagtaggatagcccggacaattgtaggttgagcttaactctgtagaaattctcatgtatcatgcgtttcatagccgccgaagctgcagatgtatagcttataatgtacccggaatagaaattggctatttctacatagggaaagtcgtgcaatgaaaaatgcaagcatgatttggggaggggttttttctacttgtaacaaggaagaattatctactccatctgactagttccgagttcgagtcctgggcaacccatatggaaaatgaaaagagcaatctgagtttttaatgttt

SEQ ID NO: 6485 - DNA, 643 bp, Sorghum bicolor
  Clone ID: SORBI-28MAY03-CLUS45066_1
gcacgaggctcacttccaaccgggccccagcccgccacgagtccacgctcccacctgctcctcgtcgccgccattagcgcgccccgacctcgcctttctccatctagggtttctctctccgtctcctcccccatcgaatcggagcttccccgggggtcatcgcggtctcggaagcggacgcgccaagcgtatgactacgacgccgcgccgccaccagagcgagaagtggtagcgaggggtggcgtgtcgccgccgtggagggaggacgaccgcgacggacactacgtcttcgatctcggcgagaacttgacccgccgatataaaatcttgagcaaaatgggagaaggtttgggttttccgcaatctgtcgtctcctcttctgctgggtatcttcgctattattctaatgaagaggactgcgagttggattttcgtaggtacctttgggcgtgttttggaatgctgggaccgtgaaacacgtgaatatgttgccataaaagttgttcgcagtatccgcaagtaccgtgatgctgcaatgattgagatagatgtgctcaatcgccttgcagaagatgagaaatacagttctctttgtgtccagatacaacctgatcacttaaagtataaccctattctatttctg

SEQ ID NO: 6486 - DNA, 677 bp, Sorghum bicolor
  Clone ID: SORBI-28MAY03-CLUS45107_1
gctcggcagagaggcaatgatgcttacctgaatctggtccaaaagaagattgataagcatcttggcaaaggccatgttgtcctcggtgttccgagcagtatatgctctgtaataactgatggtgttaagcctggcgatgttagcctcgagatctgcaggccaatgtctgcagcagtgccaagttgcctcctctgcagccgtcaggcacgggtgtatccaaattctaccacaaaaaccttcctttataggccagcaatgttgactgtgatgggagtcgctgtggtttgtgtctgcgtgggcatactccttcacacctttcccagggtttatgctgcacccacattcagatgggaatcgttggagcgtggagccatgtaagttttaggatggaataaggctagctgttgtttgtaagtcgagagttttagtgtggtggctaagatcaaaggaacatattaccgtgtgaagttcctttgtatttaaagcaggatcctgttgcagtgttgctgctgtaagcttatatatcgtcaatatcaactatatttacagcctaacgtgcttccattccattcatccatttgattgtagaattcattccatgcggagattttgtgaaccatcagaataaaacatcttttttgtattataatcgttgagacataatattcttggaagtc

SEQ ID NO: 6487 - DNA, 683 bp, Sorghum bicolor
  Clone ID: SORBI-28MAY03-CLUS45194_1
ggcttgcccgtcccccacttctccgcgccgcctccagatcgagcgcgctagggtttcttcctctgcccctcgcccgccgccgatggcccagcgctcgcgctcgcgctcgagggcgcggcgggacccagacctggacgaagatggttccccgccttcccggcagccgcgccccggcgccggcgacgaggacgacgaggacgacgagctggggaacgaggacctcagcctggagatcgtcgcgcgcgcgcagcggaagcagcgcggggcgtccggcgccggggtgcccgggttcgccgacctgctatcggtgtcctcgggcgacgaggaggtcgacgaggacgccgtggtggagctcgctgaggcggatgagccccggaggaaacagaagaagaagaaggagcgccggaagcagaggaagaagcatcggaaggaggcgaccgaggttgctgctgcggcggtggccgtagaggaggaagagaaggaggtttgtagcacccaggaggggccaattgggacagccgactcggtgcttactgaagatggggctgatgtccctgcatctgacaatatggttctgcggaagctccttcgcataccaagatactttgatcctggggaaacattgttggatacttgctttaattgtagtgaggaaggacatgttgctgcaaactgcccaatgg

SEQ ID NO: 6488 - DNA, 676 bp, Sorghum bicolor
  Clone ID: SORBI-28MAY03-CLUS45111_1
tgtggtgaggaaggtcacttcgcacgtggctgcacaaagaatgccaagtccaatcggtcgaaaggcaagtcatcatcacacagtcagaggaaggaaaaatggaaaaaggatgccagtgctagatcagctcctcatgatgcccgtaaaacaagcaaaaggaaaagtccccattttgaggaaagaatggacacacctcgtcataaatccaaatcaagaggtgggtggactggtggtgatgatgatgatctaccattgaagaagtacaaatccaatgggtggggttctccatctactcccaagaagtcttacacaaatcaccaattcctgtctggtggcgactacttcactccccagtcttcacgaaggcacaaccatggcaccacgtcaccgagctcaaattattcacccagtgctaggaaacatgggttctcgtcatcaagattcgccaccagcaacacccatgtccggtttggaaaaatttagctggatgcatgtgcctgattttgttgtttgtttagccatagcccatagatagcaattatctcctggggatgaactcaactgttgcttcatgccctttgatagttgttttgtctgagattatatatgtaaccgcggttcaaactatttttttctatactgtgagcaaagcttccatggcatggcgttgccctcc

SEQ ID NO: 6489 - DNA, 1213 bp, Sorghum bicolor
  Clone ID: SORBI-28MAY03-CLUS44654_1
agggaggtgaggggtaggtgaagtgggagtgggaaggcgcgcggaggggaggacaagcatggctgcggccgcggggaggaaggtggcggtcgccgccgtgcagttcgcctgcaccgacgtcgaggcggagaacgtcgccaccgccgagaggttgattagggaagcacacaagaaaggtgcaaagattgtactcattcaggaattgtttgaggggcactatttctgtcaagctcaaaggatggatttctttcggcgcgctaagccttacaaaggcaatccaactattataaggatgcaacagcttgctaaggagttggaagttgtgatacctgtcagttttttcgaagaagcaaacaatgcacattataattcggtggccattattgatgctgatggcactgatcttggactctatcgcaagtcacacattccagatggaccaggttatcaagagaagttctatttcaacccaggtgacactggctttaaggctttcaaaaccaagtatgccacgattggtgttggaatctgctgggatcagtggtttccagagtgtgcaagagcaatggcacttcagggggctgaaatactgttctatcccactgcaattggatctgaaccccaggatggtaacctggattcccgtgaacattggaagcgagttatgcaaggccatgctggtgccaacttggtccctctagttgcttccaaccggattggcagagaaactgttgagactgagcatggcaagagcacgataaccttctatgggaattccttcattgcaggaccaactggagaaatagtgaagcttgctaacgacaaagacgaggaagtgctggtggcagagtttgacttggatgagatcaagtcgactaggcatggttgggggatattcagggaccggcgccctgaattgtacaaagtgctattgacgttggatggcgagaaataatcataagctccaatctcgtgtgtgtggttatctatccttgaaatggatacggctcagggctccacaataatgggaaggcaccagcaggctccactgagtgctgccaccacatcaatggtagtttttctccttcctttccctgtccaacaatgctttgcctgcatttgtacaagccatctgggtgctttgtgatatttctccatttcatattcagcagaatatatccttttcatgcaatgtaatcctatggcagaggaa

SEQ ID NO: 6490 - DNA, 717 bp, Sorghum bicolor
  Clone ID: SORBI-28MAY03-CLUS44655_1
acatgcttggcattaacagacgaccagctgattgttggtggttcgacatttggaagtgtagctattgcagatcaaacctcaggacagaagttaggtgttctgaaatcagcttatgcaccattggcaataagatccttatctttctgcacaaattcacatatgatatttgctggctcgtcagctggttatgctcattgctggcacgaggggactttgaggcctctatgggaaaacagagtcagcccaaatgtcatctacagcacacgtcatttgcctggtgacacggcaacactagcagttggaggcattgacggtgtgcttcgcattatatgccagaaaaccggtgaaaccattcgatgccttgtcgtggacgcagaccgcccagcagaagccgcatctagatccaggccgcaaatagagaagaaacctgttcgcaggattgaccctgatgcgcaggtggacagcatcccgagacgcttgcgccctcagattaccagcctatcggttggcatgaagaagattgtgaccacgcatggcgaaaactacatcagggtttggaagttccgcccaaaaagctcgtgaaaagggccagttgtcggtaatcgagttatctggtagcccactgttcgtaaccctgtaatgttgtttgctgaacataagatggtgtggtgtgtgacctgcatttgtaagaaaatagcctgaaatataggttgttgt

SEQ ID NO: 6491 - DNA, 707 bp, Sorghum bicolor
  Clone ID: SORBI-28MAY03-CLUS44732_1
ttccttactgatgatagtcgcctatctctgatcatggactcccgtataaaagggcgctttcctactaaggctgctcggatagtagcagacatcattctgaaatgcttgcataatgatccatccgagaggccgaccatgagggatgttgtggaggctctagcaagagtccaggagataaaggttccgtgcagatatcctttgcaagaaccttctgctgcaccaagaaaagtaatgctaaaatctacatccctcaatggaattgtgcctcatcatcctgtcataaccttctctccatcgccgccttcgcataaccagcacttgatttcaccaaggtcatcaacatctgccttgtttcatccaaggacatgctcttctactctggatgatcccggtgtaagctctataaagaaaacacctcctattatgcgtaggtctagcgttgaaggcttttgattgtccatattgttcttttatttctttttctcggatttatttgtttctttgttagcctagtgattttagctgtgttctgtattgtaagacaagtggccttatgtagtgcccttgagtctcgagtaataactaagcagagcaggatgaattgtaaatagtatcaggttgtagatacctttttgtgctctaattgggtggaagcagcgtgctgagtctgagtaggccttgtaacctcataaataaactcgttcccc

SEQ ID NO: 6492 - DNA, 718 bp, Sorghum bicolor
  Clone ID: SORBI-28MAY03-CLUS4477_1
caactgcggcgacagccgcgccgtgctgtgccgcggcggggacggcgcgccgccggtgccgctgtcgtcggaccacaagcccgaccggcccgacgagctggcgcggatcgaggccgcgggcgggcgcgtcatcttctgggagggcgcgcgcgtgctgggcgtgctcgccatgtcccgcgccatcggggacggctacctcaagccgtacgtgtcgtcggtgccggaggtgacggtcaccgaccggtccgacggcgacgagtgcctcatcctggccagcgacgggctgtgggacgtggtcagcaacgaggccgcgtgcgaggtggcgcgtccgtgcctccgcaggggccgcgccaagtggtgcgccgaggccgccgcgctgctcaccaagctggccctcgccaggcgcagctccgacaacgtctcggtcgtcgtcgtcgacctccgccggaggaatcatcactagttggatctgtgcagtcgccagttttagtagtactagtagtacaaggtaggatgatggatggtgcacaaaaggatttcgcgggtgacgggtgtgtactaattgggttttttttcctttctttttcatcaaaaaaaaaaatattttttttgctgtactctccctgaatcaaaaagttcagaggagcacttagattagttattatggtggaaccggaattgatccggatccatttggaatgaaaatgaagtgttgctt

SEQ ID NO: 6493 - DNA, 639 bp, Sorghum bicolor
  Clone ID: SORBI-28MAY03-CLUS44802_1
tgatgataaaatatcctgcaagcttatccgtgacagcttattcctatttttttgctacaatctttatggtgctaactggagtatctgcaactaatggactacacgagtgggcgctgacgaaaactgaggtcatagctgttctgtatgctggaattgttgcgtcttgtttgagctactcaatcatgacatgggcaaacaaaattcttggaccttctctagttgccctctacaatccgctccaaccagccttttccactgtcctctcaactatttttcttggtgacccagtttacatcggaagcattattgggggagtttccataattgttggtctatatctggttatctgggctcgctacaatgaagagcaacgagcacctatggatggttatttggaccctcttattgtggataatccaagaatccccaagacagaagaaatctccttcatatagatccttaaatgatcagcgaattaaatgggttgtgctcggtgacctcgaactaccgtcgacactacccttgtaacaaaactactctttctgcttaatgaaaaacatgctttggcatgatgtcttatgtttgttaaactttacatatatattctaacaaagaagtggtcaaaaattcccattgggg

SEQ ID NO: 6494 - DNA, 511 bp, Sorghum bicolor
  Clone ID: SORBI-28MAY03-CLUS4481_1
cgaattcccgtcgaccgacgcgtgcaaaccccctcattcttattcttcttcctcaaccgtcatgcactcagcaatcgctagaccttaccatctcagagtcactctcatgcgcacacacagccatggtttgtcgctagcacagtagaagcaagaaggtgcgatccgcccagatctggtcgctgccgctcctcctgctccttccagctgctgatccaagcgcgccgtgagcatcgtccaggagcaggtgcgtcgtcgagtagcaaccaggggcacagactaagaaacgcaatcccacatcacgggagagtgctactttttctcttacaaatttcctgattggttttttaccccacaaagggtagggaccgttcttggttatctatgttctctttgattttttttttttgttgatttggggtttggcttcctaaattttttggagatatatgttcttcttgaatctattttggtttctgaagacaggggaagcgagatctcgagagagggagac

SEQ ID NO: 6495 - DNA, 1385 bp, Sorghum bicolor
  Clone ID: SORBI-28MAY03-CLUS44871_1
ccggtgggggattaattgtcattggatccatgaaatggccactttcaaggttgctagtgtatggctcgctgaactctgacggggaaagccgtagaggcacatcggaaaattcaaatggtacttttaaaggtggagttggtggtggttctggagggtcaattcttttatttcttcaatggcttctgctagagaaaaactcatcattatcggcatctggtggcaatggaggtgtatacggtggtggtggaggtggtggtggtagaatacattttcattggtcgaatattgctactggagatgaatatgttcagattgcttctatcaatggtacaatagcatcaagtggtggatctggtaagaatgacggacatttgcgcgaggatggaacagtaacaggaaagaaatgccccatgggcctatatggaacattctgcactgaatgcccagttggtacatataaaaatgttgttgggtccaattcatctctgtgcagcccttgttctgtggataatcttccaaaccgtgctgaatgtatatatgtaagaggtggtgttaccgagccgccatgcccgtataggtgcatatctgataagtacaagatgccaaactgttacacaccacttgaggaacttatgtatacttttggtggtccttggtctttttcaattatcctttgtttaacaattattcttttggcacttgtcttaagtgctctaagaattaagattggtgagagtgatatcacataccgggcaacaaatgcaatccacaatgatggctgttcttctttcccctcgtggctttctttggctgaggtacctggggctagcagggcagaagaaactcagagccatgtccacagaatgtacttcatggggcccaatactttccgagagccctggcatctcccctactcgcctcctgatgcaataattggaattgtttatgaagatgctttcaaccgttttattgatgagatcaatttggtggctgcatatgagtggtgggaaggatcaatacatagtatactttctgttcttgcatatccttgtgcctggtcttggaagcaatggcgcagaagaaaaaaaatccatcgtcttcaagagtatgttaaatctgaatatgatcattcatgtctccgctcctgcaggtcacgggctctatataaaggcttgaaggttggttcaactccagacttgatggttgcgtacatagatttctttctcgggggtgatgagaaacggcttgatgtagcatccaccattcagaagaggtttcccatgtgtctaatttttggtggtgatggaagctatatgtccccatactacctacatagtgatacattgctatcaaatcttcttggccagtatgtatcgactgcgatc

SEQ ID NO: 6496 - DNA, 881 bp, Sorghum bicolor
  Clone ID: SORBI-28MAY03-CLUS44857_1
gcacgaggaataaatgtaaggatgatatttgtacgatcatgtataccagcggaacaactggagatcccaaaggtgtgataatcacaaacagggctatcattgctggtattatgaccacagaacacctcctcaaagagacagataaagtggtaagccctaatcatcttttttcagcacaaatatcaagcatgattccagcctattagatctgtggtactaatttcttctgtagtttcacacatttgtacatcaccaaaggcatctgtgatcaacatctattgtaaaatttatcatggtttcttcctcagttgatttctttagttaaagtaatgttacactgctgatattaatactattgcagatcacagaagaggattcctatttttcctaccttccattagcacatatatttgatcaagtaattgagaactactgtatttctaaaggagcctccatcggattctggcaaggggacattaggtatctgatggaggatgtgcaagtgatgaaacccgcaatattttgtggtgttcctcgtgtttatgatcgtatatatacaggtataaacatgaaaattcagtctggagggatgatagccaaacacctttttcagtatgcatacaactataaacttaccaatatgaagaaagggctgaagcagcatgaagcatcaccatttttcgacaagatagttttcagcaaaattaaggaagggcttggagggcgtatccgtctcatgatagcaggagcagcacctttgccagggcaaatcgaagagttcatgcgggtaaccagctgcagcgttgtagtacaaggatatgggctcactgagagttgtgcaggatgcttcacgtcaatcgccaatgttttctcaatgatag

SEQ ID NO: 6497 - DNA, 830 bp, Sorghum bicolor
  Clone ID: SORBI-28MAY03-CLUS45396_1
gcctactgaagaaccgcactgtcgcacgaaccctagctagccgtccctgcccccgccttcctctttcggagctgctggattcaccccccacctctctctcgcgggtcccgggccggcgcggacgcaaggcaaaggcaaaggcagaggcggcggaggtggcgctgcagtccaccactgagcggccatggtgcttggcaaggtcgccatcgtcatcggctcaggaatcgtcggatcagtactcacaggcggtgagtctggccttcccgacttcagggatgcaatctctggtgctttcaagttcttgaccgagggtgcaaagcaaggcaaggatgggccgtcgaccagcagtccacatactgctcagttgttgacccaggtcaatcatctcagagaggagcttcagatgttgtctaaatcaaatcatgtcgctattgtcactgttgatggtagacctggccctggtgcatatggtataacagctgttgttattggagctattggctatttattcataagatggaaggggtggaaactttctgatatgatgtttgtgacgaagcgtgggttatcagatgcttgcaatgtagtggggaaacaagtggatcaggtttcagaaagtgttaatgttgcaaagagacatcttgccggaaggattgatcgtgtagattgtagtttagatgaatgccgagaaattacagaagccacaagggaagaggttacaatcatccatggagatctaagtgccttccagaaggaaatggaaacagttcatcttgtagttcgtagtttggagacaaagcttgggcgcctagcttatactcaagaccgga

SEQ ID NO: 6498 - DNA, 696 bp, Sorghum bicolor
  Clone ID: SORBI-28MAY03-CLUS45407_1
gcacgaggagagaaaccagcagcagaggatgaagtaaaagagtcactaactgacaaccaggagcacggaattggagaatcaaatgttaattcagtggaacaagtgactgaagaatgtcaacaggagaaaccagcagcagcggatgaagtgaaagagtcgccattagtgaactccatggcaccattgtattatgcagcttcattagaggattgcacgaggctgaaacaatacacagcttcgacccatcagaatctctatgctgaatctcctgcatccactgaggacattaacataagtgctctgactgcatctgtggaaagtgaagtggcaactgagaaagatggcccagttgacagtcaggtgcatgaaactgcagctttagaaaatgtggaactgaaagatgatgtttcttgtgctgaaaatgagcataacttatcgggcagccctgttcatttggaggatccactagtacctttgaaggatgtagaaaagcatgatctaactcccgcaaaggactttgtcgtatctaacacagaagatcaacaagaagccagggatatccgcttgcaggtacaagatgtggattccatggaagattcaggcaaagtaccagatggaaccatagaggcttcaaccgatgatgatttagaactgggtactgcagatgtagaaaagcatgatcaacctaacttgctg

SEQ ID NO: 6499 - DNA, 655 bp, Sorghum bicolor
  Clone ID: SORBI-28MAY03-CLUS45469_1
ggagcaaagacctgagcttcagtccatttcattgctgttggattatttcattcgtgaacttgccttgaggaataacttcgagtttgtccaggctgttctgaaattgtttttgaagatacatggtgaaacaatacgacggcactcgatgcttcagaataaggtgaagaagcttcttgaggtccagagcttagtttggcagaagattgataagatctttcagggtgcacgatgcatggttacattcctcagtaactcacaattttagtagcaggccagagctccacataccagggtatacttggtgtctaatacctgcacaaattgtggccattggattgagcaagtgggtatagttgagttttggagacggcagtaaaacagatttggttgttctcaagcatggcagtccaagctgtccgcacagatattggagcatcgttcagcagcagccatggctatatactttatgcttacagttttgatgttgcagtaaagctgcaaggagttcacttggtaaacattgatagctaccaaaaacagctccatctcatgatgtaacatttttgtagttttacatttctgtcatccttttgtcacaaactgatgtatcaaacaccgtgttgcaagaaacgcgaagctttgtcattgctatttg

SEQ ID NO: 6500 - DNA, 620 bp, Sorghum bicolor
  Clone ID: SORBI-28MAY03-CLUS45511_1
ggtgttggtgaagaagagaaggcacatcaatggaagcgcttcagtgccacaaagcccgattggtgtgctggatgcaacatgcttcagctttaggagcgaagatgcaacactaggatcatcacaatcaaacaacatcagtagtagtgacaacaacaatcaagcttccaagaggagaaggctaagcatatcaccaatctgagtagatcacaaaccgtacatatgtccgttggcagcgtggcattgcgcacttgtttatgcattattgatcatcttaacctcagagcttgtcagggcaacaagtagtggtacaaaaggatccagtgaagcattgtaacaagcagaggatggtgtcagtaataagttagtaccagcttcttgatctctgagatgaaagaggtgaggagaaaggcttcttcctctagaaattttgaaattcccttcctcaccggcacccttgttttattccttttctttttatcggtatctgaaggcatttgcggggagatccttgtggatatgagattggagatgtgaggatttgagagagaaatcaacaaaaaagattttcagttttgttcctttgttctttgccaactatattaaaaaaaacttgttgtgag

SEQ ID NO: 6501 - DNA, 535 bp, Sorghum bicolor
  Clone ID: SORBI-28MAY03-CLUS44915_1
gcacgaggctgggctcggggagaatggctagcactggtaagggtaaagtctgtgtcactggggcatctggtttcatcgcctcctggctcatcaagcggcttcttgagtctgggtaccatgtcctcggaacagtcagagacccagggaatcacaagaaagtaggacacctctgggttttggaaggcgcaaaggagaggctgcagcttgtgagagctgacctcttggaggaagggagctttgacgacgctgtgatggcttgtgagggcgtcttccacactgcatctcctgtcatcactaaatctgattccaaggaggaaatgcttaattcagcaataaacggcactctgaacgttctacgttcatgcaagaagaatccatccctcaggagggttgtcctgacgtcttcgtcggcgaccgtgaggatcaaggacgaagccgacctgccccctaacgtgttgctggatgaaacatcatggagctccattgagtactgcgagagtctccagatatggtatgccgttgcaaagatcctagc

SEQ ID NO: 6502 - DNA, 948 bp, Sorghum bicolor
  Clone ID: SORBI-28MAY03-CLUS44918_1
ccaaccaagcccgcacgagacgagccccgagaccgagacgtctcgccctcgccttcttcctcccctcccctccccgaccgctgccgcccgcgacctctcgccgaaaccctaacctaccttagaccccgccgcgccgcgccgcccaaggaaggagggagggggagggagacccacgcatcaaagggcgtccgatggggaagaagaagaagcgcgtcgacaaggtcttctgctactactgcgaccgcgagttcgacgacgagaagatcctcgtccagcaccagaaggccaagcacttcaagtgccacgtctgccacaagaagctctccaccgcctcgggcatgtccatacacgtcctccaggtccacaaggagtccgtgaccaaggttcctaatgcaaagcctgatagggagtcaacggagatagagatatttggaatgcagggaattcctgcacatgtattggctgcccgcacgagggaagaggaagatccttcagcaaagatggccaaagtagaagtgccacaggtaaggcctgttattatgcctaattcgctaggcatggcatttcctccgcgaccagcttatggtgtagcacctccaatctataatcctgcacttaatcctttgatggcccgtcctccaatttggcctggtccaccagcacaagcttggtatccacaacaagcagcatatccacaacaaccagcagtttcagttcctccagtagttgctgggctcccaccacaacaaccactatttcctattcagaatgtgcctactcctatgacatcagcacctgctaatgtacttcaaacatcgtttcctatggcccctccaggagtaccgtcacctgttgctcctcaggtttcccagcctttgtttcctgttaacacttcagctgtcaatggagctgcaagttccccatttttagcatctgtggtacctggaa

SEQ ID NO: 6503 - DNA, 609 bp, Sorghum bicolor
  Clone ID: SORBI-28MAY03-CLUS4496_1
actttgcaagcattaaagggagagatattgggagacaaaatagcattcgttgaggcatacgatgaatccctagcacatttaatatatgcaggatctgatatcattctttgctcttcctttgaagatccatcactgcaaacagcgatgaaggcaataaagtatggttctgtgccggtacaattaaactttcccagcgatgaatcaagggagttggaggggcatgattgccccaatacagcaatgtctcagtacatcatctcaacctatggagatctgtctctttctcaaacacttgatgactttaacaatgacccttcacattgggatcggcagattaaggatgggatggctaggggttcgtcatgggacatgaagtgctataacccgtccggggatgcttattcctctataaggaagctgtgaactgggcatgctagagaagcacaccccaaattaagggtaccattttttttttgcatataattagattaacatttaatttcttagatgaacatttaatcaagctaaaggtcagtaaataaacaaatggtatgtacagctgctctggatttcaaaatattctccaatttactgtggtagttagtgtgc

SEQ ID NO: 6504 - DNA, 706 bp, Sorghum bicolor
  Clone ID: SORBI-28MAY03-CLUS44976_1
taggaatagcaagcagagattggcttacttcagcaaattgaggctgaggctgctggctgttttggtgactgcaacagccggtaatgttccaaacaaactggtggcaatcactcatcaattattcaaatatcatttctcaacgggtcctcaagcaggacattcatggtatttaacccttattggttatgtgatcaggcattattgtatggcccatgatatcgcttcaatgccactgcaagcaagcatcgaggatgtctgaggaagttctcatgtgcctgccaaatctgatgactggatgagtcatggccgacccagtatatgccttgctgtgcaattatttcggcacaatttgccttgctgctttcctgatcggagatcgacccccttgagtcattggaacaacatatatctatcaaagcaaagccaatatatttggcagttatggggcgatctgtcactggaaatggcttgccactgacatgcacgaggacatggaaggatagaacatatcgccaatcaaagcaaagccatgtggattcatattaaacatggtggtccatatatatatagcagttaaaagtattaaatccctgattcccttagttctttgtaactgtacatactacttttttggcctttgtaattgctcaaactactttttggcattcattaggcagctgtcttgccattctgtccatatatcata

SEQ ID NO: 6505 - DNA, 925 bp, Sorghum bicolor
  Clone ID: SORBI-28MAY03-CLUS44985_1
tttcgctgtcaatcggatgttctttccttacgctcaggcagcttgttttcttgttgatcatggtctggatgtgtatcacacagatcatgtgatcacacaatttggaatgccaatggggcccttccgattagctgatcttgttggttttggtgttgctattgccacaaggaagcaatattaccagagttatcctggacgatgctacaaatcaatgattcttcagattcttgttgaggataataggacaggtgaatcttctcgtaagggcttctatgtatatgacaataagcgcaaagcctctcgagatcctgatttgggaaagtacattgaaaaatcaaggaacatggcaggtgttatgcaagatcctaagctgatgaaactaacagacaatgacattgtggagatgatcttctttcctgtggtgaatgaagcctgccgagtgcttgatgagggaattgctctcaaagcatctgaccttgatgtagcttccattatggggatgggtttcccttcttacaggggtggactaatgttttgggccgactcgcttggtgcgaaatatgtgtacgacagactggatgcatggtcgaaggattacggggagttcttcagaccctgtgaatatttagctgtgagagctcgtcagggtgtatccctggctgccaaggttgatggtgtcaagtcgcgactctagggttttgttgttcatttgtccggtcatgcttatacagacttgggcctcggtgtcattgagttgttgtgaaaacccttgagcatcaggaattggactgtcacaatcatgcagttgcaaaacctgcacaagtgaatgatagggagcctagcgaagtagaaattgcatgtgccttcgtgggattgctgaggatctacagcaggaatttcactgaaatattatttgcagtttgtg

SEQ ID NO: 6506 - DNA, 598 bp, Sorghum bicolor
  Clone ID: SORBI-28MAY03-CLUS4499_1
gttctgatatgcttccacctaggataactgcaaaaatattggagctggaaactgtaacacagtctgaggctataaggaagcgctatcggtttttgagtcatttctcattaacaactacattccagttctgtgaaattgacctgagtgatatagtatctcctagctcattggctccattcttggatgaaatcaagaagcgtgagaaacaaagaagacgaaccgccaagaaggaagaaagtgagagagcaaaggcagaagttgctgctgctgtgcaggcatcagctatgcggtgtcagtatgcaaattccccccaaagtcacaacgatgtcatgttctctctggatgacttcgaagctctgggaaacaatgctgggccatccaccagtccacgagtcagtgaaaggaagcttttctctgacgtaacacgcctgggttttgcatctgctcaagactcacctcccctaagactcggaactggggatgccaatggccaaagtgaaaactcgagagaccaagggccgttagcgacacctgcattatcatttgccagcatcatatcttccagtagagccgtggctgcagctgacaactcggagat

SEQ ID NO: 6507 - DNA, 711 bp, Sorghum bicolor
  Clone ID: SORBI-28MAY03-CLUS45641_1
gcaagtagagaggaaagagctggagaagcaaaaacaaagggaggaagagaggatggagatggagaagaaaaggcaacaagagagggaggaagagagacagagggggagagagcaatatggaaggaaaggcagaaatgatgtggagagagacaacaaaaggaaactgatagatgatcgatatgatccaaattcaagtggagttagagaagagggatacaaagaccgtcagaacagagatgacaatagatggcaggaagagcgagttagagaagagggatacaaagaccgtcagaacagagatgacaatagatggcaggaagagcatggtcgacacagtagatatatggatagtcacgattccaagaggtcaaggcgtgatgatgacttacattaccattcaaggagggattatgaacaacgttattctagagatgaacatagagacagaaggcgtcactaaatccatattggtgaagagagcaacgcatcttgaagaatacccgttctagttggacttgttctcagttctcacccataattttcagccctggatcttttctgcggtagcaagaccacccatcagtacccccgctgcagcattaagctttgtttttgtttgtatcatactttttgttttattattacgcgaagaacaaaatctccaatatgtaatgtgttgtggcacagacatgaatggcagaatgtttgtgg

SEQ ID NO: 6508 - DNA, 1075 bp, Sorghum bicolor
  Clone ID: SORBI-28MAY03-CLUS45651_1
gcacgaggggatctcttgggattcaccgtctcatcgagtccttgaaacattacatggcggtaaagatgaacctcggcgatcctgactttgtgaacgataacgaggttgtgtctgatatgatttcccccaaatttgctgctgaactgaagaaaaccatctatgacaacatgacatttgcgcctaaacattacggtggaaggtggaacatccttcaggaccatggaacgagccacttgtccatcgtcgacagcgagcgaaacgcggtttcgatgacgagcaccgtcaactcgtacttcgggtcactgatccattccccacgcacaggcatcctgctcaacaacgagatggacgacttctccatgccggcgaacacgacggagaattctccacccccagcacctgccaatttcgtcagccccatgaaacggcctctctcttccatgactccgaccatagttgtcaaggacgggaagctggtgtccgcagttggtgccagtggtggcagcatgatccccgctggaacgatcgaggtgttcatcaaccatttcgtcaagaacatggatccattggcttctgtcatggcgccaagggtttatcaccagctgatcccaaacgaggtcaagtacgagaactggacgacggtgaccggcgaccacttcgagctcgacgccgcgacgagggccgacctgcagaagagaggccacgtcctgaagccgctagccggtggaaccataagccagctcgtggtgcacaacgtcgggcgccaaggcgacctgaccgccgtcagtgaccccagaaaaggcggtgtcccggccggttactgagcaggatctctgtcgaagcacggtgaagtagcccggccgtgctgatgcctgtgtgacgtgagacggagtcaggagttatacatagatacgatggattaaagacatttgacatatgcaagctggacgtagctcatctgtttaggctcttgtggtgggacatggcaactcgagttaatcatcgattcagctattcctatttttctatgtttatttattttagtatttgataatttaacaatggtatttgtccc

SEQ ID NO: 6509 - DNA, 608 bp, Sorghum bicolor
  Clone ID: SORBI-28MAY03-CLUS45707_1
aagattcatcacaggagttccagcctagaaggataagtttgcttgccccattttcccttggatggcgagacaagaacaagggcaagcagaacggcactgatgagtcaacaaacggtaagctcaataataacaccgatcaaggggttgaaacacccaaaaaggacgatgaaaagaaaggtgattcaccaaaagaggactcaccaaaagagggtgaacagatgatccaaacaccccaaagagacagcgagcccagattagagacgcccaagatggatagtgagccaccaagtgtcgaaacgacgacaagcaatatgaatgggcaggaagaccagttggaggaaataaaattggattgacatcctgtggctggtcttcaccaatgttgctgagtcacaacataaggtgccattaaattatgtattggtgtattcattttcccctcctttgtacctcttttcttttaggtttatagattctttgaaccataacctgaggggagagaatgaataagttatgtttgcctgttatagctttgttgatcgcctgtaagttatcagtacacatggaaaagacttaccaaatagaagattatcacaaaagcaattttg

SEQ ID NO: 6510 - DNA, 658 bp, Sorghum bicolor
  Clone ID: SORBI-28MAY03-CLUS45733_1
gggagaaaagaaaagagctcaaaagcaaggggaggcctcctccgcccctttttctcccctcccaattcacacaggattcactcgcccccccaggcccagttgtttcttttagtgccgcccccattccgctctgatccgagcctttcgctcaaagcctccagcttttccaattgtttggtcacttcgggaatcaaggaataagttcttgcgctgtgcgcgatagagagcctgatccacccttccttccccatatcctcttcccctggcatttcgctctgtgcgtggccactgcaagcgaaggattttggcctggtttctctcatcttgggtgttccaaattttcgggcgagatcttcgcctcaacgaggttcctggcttttctggtgatattggcggctcttgttacaagtccaaggaaagaatttggaggccatgggggtcccttgcgaccggttctggtcgatttctcgggctgttgaattcaagatgccgctctgacccaccgctgcctggtttcttggaggaaggaaattttgcttcaattgggcgtcgttgttgagctacagccctcctccagctcttgatccggtccatggggctctgccatggcaagccgacgcaaatcccggaggccgaggcggaggaggatccccacgta

SEQ ID NO: 6511 - DNA, 1152 bp, Sorghum bicolor
  Clone ID: SORBI-28MAY03-CLUS45774_1
gcacgaggcgcttcgtcgcctcctagctacctcgtgtctcccgctgactcgccggcgaacgctcgcctcttggagatgccgcccgccgcggcgacgctcctccggcgggccccagcggtcccattcacggcacgccgtaccgctgtttcccgctcgggcatggcgcggcgtctggtgacagcgagcgctggggccggcgggcgggcgccggcgtacggtgggctgctgctcgacgccggcggcacgctgctgcaggtcgcgcagccggtcgccgagacgtacgcctccatcggccgacgctacggtgtgatgaagcctgagaaaagaatcatggaggggttcaagcgggcattctcggcgccatggcccaagacactcaggtaccagggagatgggcggccattctggagaattgtcgtggcagaagctaccgattgcaccgatgacgattactttgaggaagtgtatcagtattatgcacatggagatgcttggcgtttgcctgttggagcagacacagcactgcgtgagctgaaggatgctggagttaagctagctgttgtatctaactttgatacaaggttacggaaattacttaaggaccttaatgtctctgatatgtttgatgccattgtggtatcatcagaggtcggatatgagaaacctgctccagagatattcaagatagcattagataacattggtgtggaagccagcaaggcagtgcatgtaggagatgatgaagctgcagacaaggcgggtgccaatgctataggacttgaatgctggctgtggggtgatgatgtgaagacattttcagaaatacaggacaggattctgacaacagatgatcctcaatgagtgtggatttagcatggtgcaagaccgccacgacagttgtttctttattccttcctttttttttctcttaatgccttcttttcctttcacctcttgtgctggcatgtccattttgctttcatgaaataagctcattccatgactactgctgtcccgtcacattcttttgcattctgtgatgaacacttttattcgtcacaggcagcagattgcagatgagtcatgagtgattctgcttgctatgtgaatgtgatttgcatgtaaacattatcctaagtacaagtgataacg

SEQ ID NO: 6512 - DNA, 737 bp, Sorghum bicolor
  Clone ID: SORBI-28MAY03-CLUS4502_1
gccggccgggcggacgcgtcccccgcccctcctcttcgtcctcccggacaccacaccagcccctgcaggctgcagcttccccggccgcggccaagccagctgcctcgctcgagaagcacagccaccagggcaagctggaggatggccgcagtgatgaaggctctcgcggtcgcctcgccggtgtcggcacgggcagcgcagcagccccgtcggtacgtcgcaggtggcgctagccagcttcagtcgtcgttccacggcgtgtcggtgcagtgccctgggcgaccgcggcaggcaaccccccggcggggggtgcaggtggtgatgatggcggctcggccgtcgatccagttcatccagggcacggacgagcagacgatcccggacgtgcggctgaccaagtcccgggacggcaccaacggcgtggccatcttcacgttcgagcagccgtcggtgttcgactcgtcggcggagctcggggacatcacgggcctctacatgatcgacgacgagggcgtgctgcagtccgtggacgtcagcgccaagttcgtcaacggcaagccggcgcggatcgagggcaagtacgtcatgcgcacgccccgggattgggaccgcttcatgcgcttcatggagcgatactcccaggccaacgccctccagttcgtcaagaactgatcgatgtactcaactccactcatgagctgacgatcgagcctgctttgagagctctctcgatcgat

SEQ ID NO: 6513 - DNA, 502 bp, Sorghum bicolor
  Clone ID: SORBI-28MAY03-CLUS45252_1
gcacgaggcggggtcctacgatagcgcgggcgtcgccatcttcgccctgctgctcaccttctacctcttcgtgcgcgccgtcaacacggggtcgctcgcctgggcgcttgcctcggcgttcggctacttctacatggtgtcggcgtggggaggctacgtgttcatcatcaatctaatcccactctacgtgcttgtgctgcttgtcactgggaggtattcgcagaggctctacgtggcctacaattgcatgtatgtgcttgggatgttgcttgcgatgcagatccgttttgttggattccagcatgtgcagtccggggagcacatggctgctatgggagtcttcttcctcttgcaggttttcttcttcttggactgggtgaaatacctgctaaatgatgccagactattcaagtcattccttcgaactactcttacatgtgtgattactgttggcaccctggctcttggaattggtactgcatcaggttacatctccccttgg

SEQ ID NO: 6514 - DNA, 1047 bp, Sorghum bicolor
  Clone ID: SORBI-28MAY03-CLUS453_1
gcgtccggcaacagaccttataactgagcatcctgctgcaccagactatttcgctccaaaccgagccctgtggcaagcgtcgtttaatgctttctttgggctgcttacaaagtattgcgtgagtaaatttgacagcatggttcatactatgcacaagcaccctgctgctgcaacagttatacacaaggaacttccagttgagcttctgcgtgccagtcttcctcacacagatgagcaacagcgcagactattgcttgagttcgcccagcggactttgcctgtcgctggccatagttctgacgggtgacagggcatctgggtggaaacatggcatctgaaacaataccaagttaaagtggtcagcaaatatgagtgcgctagatgcgtttatttattctatcatacaggcctgcccaacgaattgagtgttccttgtgcctgttccactaatagaggttacagatgtgaccctctaaggagtaaggagcatgagctacaattgagttgggtgcagtatgggcgtgctggtgttaagtggatgtatctcccaggtttggatcataaagtccctttgttaggaaaccgtattctctctgcattgttgcatcacacctctagatagactaccaggatagtttccttttgcagggctgtgttttgttggctctaggagggaactgaacccctgctgtttctagagccagatttagtggctgtacagcacgttccttgaaggcaatgcccaacattgcaacaaaatatttcaagctgtaggtgtttcagtttgcaatatctgtagtggtgtcaaggcatgcaagattcttatttcactctggacttggaggttctccgtgaccacgaaaaggagtgccaaaaagatgtggtaacacatgtacactagcaaacgcttggaagttggtccttggttttgtagccatttgaagattgatgtttcttttttatcaggttatattatattcgtaactggatacaattattttttgaagctgtcaagtttgtaatgagttcattgggattcctgctata

SEQ ID NO: 6515 - DNA, 670 bp, Sorghum bicolor
  Clone ID: SORBI-28MAY03-CLUS45313_1
cgcggccccgccgcccgagagcagcagcagcaacaagatgttctccgacgggctcacccccgtgctcgactcagattgtgctctctctcttctgtcatcccccgccaactcctccagcgtcgacgtgagccggatggtcgtccagcccgcggcggagcacatccccatggcgcagcccctcgtccccagcagcagcctccagcaccaccaccagcaccaccagttcggcagctccccgggcggctggttcgcctgctcccaggccggctccagcgccgtctccggcgcgggcaccggcaccggcggcttcgcctgccccgccagcgtggagagcgagcagctcaacaccgtcctggtgcccagcaacgacgccggccacgagatgaactaccacggcatcttccacgtcggcggcgagggatcctccgacgggacgtccccttcgctcccgttctcgtggcagtagcttcttccgtccggttcaagcgaccagtagtgatcggtgttcagctgtagtgatcctgttctttctgtgtttatttattattattattctccctgtcatttgctcgtttcttcgttttgcatgcctgatgcatgcagcctgaaaaaactcgcataaaattagtgccgaatttctcctgaaaccgttctgatatcttactgattc

SEQ ID NO: 6516 - DNA, 725 bp, Sorghum bicolor
  Clone ID: SORBI-28MAY03-CLUS45325_1
aacggtcttattcatgagtgtgtcaccagtacatatgcagagtgaaggttggggcagccccaatgccataaaatgcttctccgagacacagccagcaatcaactacacgaaaaaattggaggtgggcacggattgggatctctttgtgactgctcagcgcgtgacgaggtcaatgaagaaggtgccggtgcacttcatcaacataactgcgctgtcggagatccgcaaggacgcgcacacttccgtgcacacactgcggcaggggaagctcctgactgcggagcagaaggcgaacccgaggaagttcgcggattgcatccactggtgcctccctggtgtgccggacacgtggaatgagtttgtttatggtcatattgtgtcgagcccgccgcagcagcagcagcagataaccgaggatcaacctcacagatgacagctagagatacttcacctggtagcgcaatttagtgagaagatttgtgatcgaggccataatttatttttttctaggtttagaagcctatgctgctggttcacctaagcatttgttggaaggtaagatcgcagtatagccaacaagcagctgtgagcagccacgatcacctgaggagccttctcgcagtgtctgaatgtggctgttcgagcctctgaggggaatgcgcgcttctgtgcagtgcttctcgtgtttctgtctggcaccgtggcatgtgtacataattttacca

SEQ ID NO: 6517 - DNA, 1233 bp, Sorghum bicolor
  Clone ID: SORBI-28MAY03-CLUS45365_1
gcacgaggtccctgtctgcttccctcccctgctgtggcactgcgcctggccgcttgccctctccccctcaccttcacctcccccatcccgcaaccgcacgagcgttccctcaccaagaggagaaaaaaagagggagcgaaggaggcaaaccaggcggcgggacagcaacgcgacgtgcttgccattctctcgaggagctcatgcaaggtgtaagtcttactgcaagaagggcagttgtgcatgttattaagacccaaatatagcctcacttgattacactgcacggggggttgaaaacttgagatacagttgatcttctggttaagagtatggcttcaaggttatcacatcagctgagcaatggcctgtatgtttctggtcgacctgagcaacctaaggagaaggccccaaccatttgttccactgcgatgccatatactgggggcgccagcaagaaatctggagagctggggaagatgtttgatcttcatgttgagaagtcaagaaaatctggtcctctaggaaatgctccttcaagaaatacttcatttggcggtgctgcttccaactctggacccgtctccaatgctggtggtcgttccaactactctggttctctttcatcttcagttcctggtgctggcggatcagccagagcaaaatcaaactccggaccgctcaataaacatggagagccaacaaagaggtcatctggtccccagtctggaggagtgaccccaatggcacgccagaactctggcccccttccacctgtgcttccgacaactgggcttatcacatctgggcctatctcttcagggccacttaactcgtctggtgctccaaggaaagtatctgggccacttgattctgctgcatcgttgaaaatgcgggctacttcctttgctcacaatcaagctgtttctaatctcaacactgaagatggttactcaattcagggaagctttccgaagccaatactctgggctgtgattctgctctttgtgatgggttttatagcaggtggcttcattctgggtgcagttcacaatgcaattttgctgatagttgttgtggtgatatttggttttgttgctgcacttcttatctggaatgcttgctggggtaggagaggcgcaattgggtttgttaatcgctatcctgatactgatctcaggactgccaaagatggacagtatgtaaaggttacaggggtatgtacaatcctcgtgc

SEQ ID NO: 6518 - DNA, 949 bp, Sorghum bicolor
  Clone ID: SORBI-28MAY03-CLUS45919_1
gcacgaggaagacattgatgaggtagttgttgttgatagaagtttccttcatggagatttagttgcctctgcctcagacccaactggtcagatggggcttgttttggatgtcaatcttgtggttgatttgcaaggtgccaatggcgatacgataaagggtgtatcttccaaggatttgagacgaatcagggaattcaatgtgggtgattatgtcgtctctgggctatggcttggtcgagttgatgaagtgctagataatgttaatgtgttgtttgatgatggctctgtatgtaaagttaatagggcagatcctatgcgcttaaagccagcatttggcccaattcatccagatacagcttgtcctttttatccaggacagcgtgtgaaggcagtgtcatcatctgttttcaaaacatccaggtggcttaatggattgtggagagcatgtcgtcttgaaggtactgtcacaaaagtggaaagtgctgctgttatagtctattggatggcatcagcacactttgctacagatcagcaacctgttcctccagaggagcagaacccaaaggaccttactcttttgtcttgtttctcatatgcaaactggcaattaactgactggtgtcttcctcaccgacacacttcatgtactaatgataccatggttaattctgataaacatacaaggcagatatgtacatgctcacaaagctcagctccactgtctgatattccagaatctcaagttgatgttcaggctgaacaagatcaaatgactgatacagatgcaggtcacaagcagacagatgttgattctactgcagatggattgagtatgtcggatggagataattcatgcatagccaaagaatcagaaacaggaactagtgtatcaagcatcccaaagttgggtccacaggacaatgcaacatccagaaaaaagtttaggaaa

SEQ ID NO: 6519 - DNA, 742 bp, Sorghum bicolor
  Clone ID: SORBI-28MAY03-CLUS45920_1
cctctatcttctccccgatccaaatgcaggcgccgccgccttttccctttctccgctgcgctctccctcgcctaaaatctgaagcccgcctatcccatctccctcccccaatctattgcgttcttgccgccctctagtctctcccggattccacctgcccagatctcttccccgcctgcctggtttacgcccgcaatgttgctacgctgctgcacgaggtaatcccgtagcaaggaggacgcggcagctcgcggacgggctagtctctgttcccgcgccttgcccgcccatcagctccgacaatcgcggacgggattgtcgcaaggtgcacgcggtggtccacgcgctgccagccatcccctggtcctgtgcgccgccaactgaccaaatcgacggaggaagccagtctgctcgtatctccctgacgccgccggttagagctcctgcgcttcttcaggcttgcgtcatcattgtgtttggctagagagtttgatttcttgtctgacagcagagcaataactcaagacttggtaaatggtgaagccctgtccaagaagcacagagcacagcttttcctcaaccaagcctgtaggtgaagaattccgttagaaccaagctactcaacacgcccaaagaaaaaaaaaggcttgacaaagtgttgctactgcaccaatcccaacaaggatgtgctgcattgaaccacgaggttgacacaagacctacttcaccgacacaagataag

SEQ ID NO: 6520 - DNA, 602 bp, Sorghum bicolor
  Clone ID: SORBI-28MAY03-CLUS45951_1
gcacgaggcctaggagcagccgcctccacgtgggtgaggcggaggagggaggatgtcgtcgctcagccgggagctagttttcctcatcctgcagttccttgatgaggaaaaattcaaagagaccgttcacaagctggagcaggagtccggattctatttcaacatgaagtactttgaggacgaggtcatcaatgggaattgggatgaggtggagcgctacctcggtggattcaccaaggtcgacgacaaccgctactccatgaagatattcttcgagatccgcaagcagaagtatctcgaggcccttgataagcatgatcggtcaaaggctgttgaaatcttggtcaaggaccttaaggtctttgcatccttcaatgaggagttgtttaaggagatcacacagcttctgaccttggaaaactttagggaaaatgaacagctctctaagtatggcgatactaaatctgcaagagcaataatgcttgttgagctgaacaagctgattgaagctaaccctttgttccgcgacaagctacaatttcccaacctgaagaattctaagctgcggacacttattaaccagagcttaaactggcagcacc

SEQ ID NO: 6521 - DNA, 611 bp, Sorghum bicolor
  unsure (1)..(611): unsure at all n locations
  Clone ID: SORBI-28MAY03-CLUS45998_1
gcacgaggcgggaggcacgaggcccctctgttttttcttctccctttcacccccgcgtgcgcgctcactccccctcgttcgtggcgacgcttgagcgaccaccgcagcccgctcgacgccaggtcttcgccgtgccgttcgccggcgacgagcaccctccagcgtaaggaggggagccggagatgttctactcgcagttcatattggccaagaagggccccctcgggaccatatggattgccgcgcacttggagcggaagctgcgcaagaaccaggttgcggacacggacatcggcgtctcagtagattccatcatattccctgacgttccaatcgcacttcggttatcaagtcatcttatgttaggcgtggtcagaatctattctcggaaggtcaactacctattccatgactgcagcgaagctttgctgaagataaaacaagctttcaggtccactgctgttgatctacctcctgaggagtcaactgctccgtatcactctataactctgcctgagacattcgatcttgatgattttgaactgccagaagctgcgtttcaaggcgacactgatcatcatgtgagcacaanagaacagatcactttgcaa

SEQ ID NO: 6522 - DNA, 540 bp, Sorghum bicolor
  Clone ID: SORBI-28MAY03-CLUS51219_1
aaaccggatacaaagctgcaactacggactacagcttgatggccacggccaagtcctatttccgaacactggagccgaaaggcatacatgttcagatactgaacatcacagagctgtccgactaccggaaggacgggcatccgaccgtgttcaggaaacagtttgctcctctaacgaaagagcaaatcgcggacccagccagctatgcggattgcacgcattggtgcctccctggagttcctgatgtctggaacgagtttttatatggctacctcgtgcaccaaatgatgagtaaattgtaaaatgtcaggtttgttttaccccttatatataataataataataataatgtacagatggcatactccatttagattaggatgctcttgcgcagagaatggttggacctattacatttacatgtacatgtacagacagagaaaagcaaggatctgtttgcgcatcccctaatgggatcactggtgtactatttctttatacacatataaccgaagcaacatggttttgtaagaaatttgt

SEQ ID NO: 6523 - DNA, 694 bp, Sorghum bicolor
  Clone ID: SORBI-28MAY03-CLUS51248_1
ttagttcatgtcaaaagctttttttgctgatgcaccgtcagctgtcagcggtgcaaatgatgaaaatctgatgaaaataacatcatgcaggtagacaatataggctgatgaccttgctcacctattagcgtacttaccattataatttgttcctcggattttgtgtttatatatgtttaataattttgtttttttgcaggttctaatttctatgattgctcttgttatacaatatattcagtacagactcatgccctatctggttgtatgtaactatcaggaccgcatcatcgtacaagagatacttttaacaactcctcaatggacacctcagacaatgacaatcaaggttgagaatccgaccaccacagcaatgttccattgatcgtttgtacaactacatccaaatgtacaagatgctccaatcaagttgctactaaccttgtatactatctgtacctagcactctgaaatacttttccatagttactacaagccccactagacgccgctgcatctacttgctcctagccctgtattatattttgacccgatgaaccgtagtgctttggtatgcctaccgtacttcatggttttatcaaactaggtttttctttgtatatatgtagaccaaaaaacatgtgccgtcaaactcctgccaagtactaattacctccatgtatagtatctgtat

SEQ ID NO: 6524 - DNA, 685 bp, Sorghum bicolor
  Clone ID: SORBI-28MAY03-CLUS51316_1
tggtattgctgtctgttgttgccttccttgtatcatagcaattctctatgcagtatctgaccaggaaggagcatctgaagatgacattcgtcaaatcccaagatacaaatttcggcggaccgacgagcctgaaaagcaagatgttgaccccatgggtccttttggtggaataatgacagagtgcggcaccaatcaacctattgagaaagtgcttgcagctgaggatgcagagtgttgtatttgcctatcggcttatgatgatggtgcagagttgcgcgaactcccctgtgggcaccatttccactgcacctgcatcgacaagtggcttcacatcaatgcaacatgccccctgtgcaagtacaacattcggaaaagcagcagtagcagtggaagtgaagaagtttgaatgcagtgcgcttgacaacgccaatctgtttcaacttcgtgactgtgccattgctaatgtaactccaggtctttgatcagtgtaaatttttgtatcaaaaaatgtgctgatagagtcaattatgtattaaagttactcagagtgctgtccgtatgtcgtataagttaataaatagttgggtgtgcatctgtatttactgtcaggaatatatgattagttgcactgtaacttgtattcttttgagtgattcggcgttttcctgctggcagttgtcttcca

SEQ ID NO: 6525 - DNA, 1016 bp, Sorghum bicolor
  Clone ID: SORBI-28MAY03-CLUS51339_1
gcacgagggttgtgaaagagtcctttatggacctgaaggttgatgaactcattctgcaggttatgaaggataaatcaaaaactaatgtgcaaagcttgtacgatgccatacgtgttctgttgacacctgatgacaaccgagtagtggcttctcaggtatatggatactcccggagattcgctgaaatcggggttgcagaagttcttgtcaatgcacttcgtgagcaagtcgctccttccagcttgccatctgcttgtgctgctttaaagtcgattgcagtcaatgatgaaatatgtcgttccatatctgaaagtggtggaattgatgtgcttcttcaatgcattgatgaggctggtgagcagaagaacaaagttatagcaagatcttgctgctctttgttgtccaagcttgctgcaagcgatgcaaacaagtctgctatcattcagcgaggtggtttcgataggttcctaaagttgacgtccagattttctgaagatcctgctatagttcaagaggttatgtctatggtgacggtcctcacactgaggtcaccagaaaatgcagcacgtgcagtggaactaggctttggaactctggcgatacagtcaatgcaaaggttcccctcctctggccagactcagaagcaagcatgccttatgattcgcaatcttgttgtccgaaaccctgagaacaggaccaaactgcttaatgatggtgcagaaaagcttattagaaaggccaaggcgttgcacggaagctgtaaagatgctgcctcgtctgccttgagggacctgggcctagacaattacaatgcatagacaccgtagcccataggaagtctacgtagagttattttggccatggtaggatgtttgaaaattacaatggcgtgagttatcaggtgccgcactgaaatgaggcattaatggtcccagttttgtgtgcaacccaacttcagggctattacatggtactactaccagctggctatgcgtaaaataactccattgcatgac

SEQ ID NO: 6526 - DNA, 649 bp, Sorghum bicolor
  Clone ID: SORBI-28MAY03-CLUS51322_1
atggctgcaaatgcccagatggattcaagggtgatggtaagcacaaatgtgaagatattgatgaatgtaaggaaaagactgcatgtcagtgcaaagaatgcaaatgcaaaaacacatggggaagctatgagtgtggctgcagtggaggcttgctttacatgagggagcatgatacatgcataagcaaaaatggaggatcagaagcaggctggggcttcttgtgggtcgtcttcttcggccttgttgcagcaggaattgcaggatatgcagtgtacaagtacaggatccggagatacatggactcagagatccgtgccatcatggctcagtacatgcccctggacaaccaaggagatgtccagagccattctcaccatattgagatgtgaggtggatgcagacttgatgagaggagaccgacacttgatctagcttatatacacttgaattagatgtgcataaccgtaactttcttctgtagcattcagtgtccttgaacaatttgtatctgtgtggtttctgtgttaggttgtaccatgacatggtcttgtttagtaataattgtcatcttttctttcggcggcactaaaggagatggcaaacgggcatgactaaaacaagaaaattgttacgtttgtggtcaaaaaaa

SEQ ID NO: 6527 - DNA, 1236 bp, Sorghum bicolor
  Clone ID: SORBI-28MAY03-CLUS46279_1
ttttcgggttgtatcaaggtgctagcaatcatgaggagctgcataatttgatgaaagcaactgtcatgatccgtaggttgaagaaagatgtcctttcacagttgcctgttaaacgtagacaacaggtctttctagatttaagtgagaaagatgtgaaaaatgtccgtgctctgtttattgagttggagactttgaagatcaaaattgagtcttctgactccaaagagacgatcgactctctcaggtttgcttaccagaatattgtcaataagatctatactgattcagctgtagctaaaattccagctgtgttggatttcctgggtactatgattgaggcaggttgcaagttcttaatatttgctcatcaccaacccatgattgatgccattgagcaacatctttcgaagaagaaagtaaagtgtatcaaaattgatggcaagacacctttaactacaagacaaaccttagtcacaagtttccaagagaacgatgacatcaaggcagcagtgttatccatcaaagccggaggctatgggataactttgacagcagcgagcacagtaatctttgctgagttgtcgtggactcctggggacatcattcaagctgaagatcgtgcacatcggattggtcaggtttcatcagtcaacgtatattatcttctcgctaacggtactgcagatgatcttatgtgggactctgtgcaaggcaaacttgagaatctggggcagatgctggacgggcaggagaagacgctggacgtttcccagattgacagcaggccaagcccctcgaagtcgaagcagcagaagacactggacggcttgggaccaagcccctcaaagcaacagaagacactggacggcttcctcaagcggcccaacacctccacgtccatggaactggaccgcttgggaccaagcccctcgaagcaacagaagacactggacggcttcctcaagcggcccaacacctccacgtccatggaggagggtatgcccagccccagcacgaagcggcggatctgagggacaacggcaccggatcaaggctcggccacatggctgcctttttgttgtattgtaggacgtgtttggactaggcacttgggcactggacagacggtcgtagccgtggaccgtggctgcagcagcatcagccgctaacatattatattttggctttggttgtctgtacaatgccatggtctaactcttctaatgacttggttct

SEQ ID NO: 6528 - DNA, 564 bp, Sorghum bicolor
  Clone ID: SORBI-28MAY03-CLUS46280_1
cttgaatcttttgacttggccaatggagggtccaaaactactgcaaagaagaagaaagaggcatctcacaagcatcacaagaagccccagcggaagaaggatcggtcctggagggttggcaatgatggtggagatggaacagcagttgtaagggtgtaccagaaacctgctgttaatttgtccacggtcagtgcaagcggcagggtctgatgcctcaacttactgcttgcagttgcacaaccactcggcacacatgggcaagagcatgtgatcttttactgtaacaatggctgaagctacttcgatggaactgagaaaagagtgctaagcatgagagtttgcaaaaccttggaaacagcgggccctgaacctgtgtagcccttgcggcctaaccatatatatgctttgagttgtagcgtggtagatacatactacatcaggtggcatgtgctgttttatttgtttccatgtcttacatagttgcaaatataccttgatatgtgaaaaataaaaattattcagatgattgatactgttaagttgcaatgttgggaattttttttt

SEQ ID NO: 6529 - DNA, 628 bp, Sorghum bicolor
  Clone ID: SORBI-28MAY03-CLUS46296_1
gcgcccgaagcgggcgcacggtggtgaagggaacatgggctttttcccggcggagagcgcatgaacccccctcccccctgaagctgaactggccgagcaaagaaaatcgtggaggggcagctcctgcgaagcacaaatcctatgttatgggggtacactaacgcaactgagtgagtggttttggttggtcgcgagaagtttggcacatgggggaacgccgcattacccacccaacctggggaattggccaagacgtgtttgacgggaggcttggaggcactggcatgtatggtggggggagcccaggaggaggccaggattgaggaagcagagccgatctgagttgttgtgaagagaggaacgcagtgagtgctgctctaagggtcccaggacggaggatggatgagtctgtgttgtgggttgctggacaaggacgcgtacaggagctgattgaggaggccggagtggaagattctgcaggggatgatgacgatgatgtagtaggttaggccaggttgggtgtgtaggaggcattcccctttgtaacagcctaatttgtacattcttaccatctttgtcttattgattgatcgaatgaatcgcagacctcctgcgtttgcatccatcc

SEQ ID NO: 6530 - DNA, 746 bp, Sorghum bicolor
  Clone ID: SORBI-28MAY03-CLUS46322_1
gcacgaggagaagacgagcgcagggagggaaaaggaagaggctccgggaagaaattcagagagggaggaggggcggagggccatgatggcaggtgtgggctgtggcgtcgtaggtggttaaagcgagaccgcccgcccctcgtcgtccggtaaaaagctctccaaagaagctgctctccctttgcgctcttttctttctttccgttggttgctttttcccccttccctgccctactcctccttcttcttcgtctttctccggacggctttggggaaagcggtgatgtgaggttgccatcactcacgcctgctggatcgctagatgctgcccgtctttattacggctgtcgccgagctgggctgcggcggacgagggggaggtgaggctctcgtgcgctggcttctcggtctatgagcgggcatcagaactggtcataataatcttcggaaggcaacatggcggaatcgaaggttgtaagcgttgatgccagaacgacaaagatcagaaatgtccccattgctgtaaccccagaagggttctggtgctgcccgtcccaggctgtgctccagaagacggcgaagaaccaaaaccagcaggcgaaagcgaaaaccaaagggggtgcctcgcctcttgcatcaaaggcctcatcaattcagagggcaccaacaatctcatcagagagaaggactcactcgactccgacaagggctaaaatcaattcagaggagcagaggtgcttgctggc

SEQ ID NO: 6531 - DNA, 755 bp, Sorghum bicolor
  Clone ID: SORBI-28MAY03-CLUS45793_1
gcacgaggggttcctgaaatcaccatcgacgagcaggattttccgaggagcaggagaagaaggcgggtagaaagttggttcctgctcccgcccgggcgtgacctcacacggaatggtcgttgcttcgccggggacgacgcaccgggaggaggcgcgcggcagcgggggggatggtcgataggagcagcagggccgtgctcatcggggtcaccgccggcgtcggggccgcgctgctcgcgtcggcgtgcgtgctcctcgccatctggctctaccgccggcgggccagcgtcgccaccgcacggacgcgctccctcgagtcgccctcggcgacgctgcgggacaacggcaacggatgcgccagcctcgactccagcgtctccgtctccgtggtctccgagagcgtcgccgactggggccacccgccaccggccaaacgcgccgcgttctgggcctggagaggaggcggtggcgccggccacaacggcagggagccgccgccgctgtccgtctccgggatcccaaaataccattacaaggatctgcagaaggctaccagcaactttaccacaattctggggcaaggatcgttcggtcctgtgtacaaagctgtaatggccaccggtgaagtggtagctgtaaaggtgctcgcgagtgattcaaggcaaggggaacgagagttccagactgaggtattgcaatcttttttgggtgcaccattcttcgggttttgttctaagcaacttatctgtattggt

SEQ ID NO: 6532 - DNA, 448 bp, Sorghum bicolor
  Clone ID: SORBI-28MAY03-CLUS45801_1
gcacgaggaaggaatattgtgcacgcatgcactcactgtactgagacaggagcttgtgccgatgattccacaaaaatacatcattcatcgctggtgcaaggactgtaaacaaacctgtgcttccatatcccagcctgtgtcagcaggtaatcaggaactgggaagctatgatgatctgtacaaacttggccaccaatactttgcagaagttgtggaatttggttccatgaactcacaatcaaaagaatatgctttgtcaatcatgagggaaatcagggataaagtgatttcatatgagaagtcactaacagatcaaagggttgacagccatgtttcaacagccaactttgcatacaatcctgtgaacgaggattttactgatgatgctttgcccatctctcttagtacaaagggctgggatcttacccaaggccaatccaagcgttcc

SEQ ID NO: 6533 - DNA, 1103 bp, Sorghum bicolor
  Clone ID: SORBI-28MAY03-CLUS45818_1
ggaaaggccactgggatcctaagtctcaacaaagaagcattcttcattctggacaaaaggtccatgatgctttccaacttaagcgaggctcctacactgatcttcctcctgccaaagtttcagagatgatgcatccaagaagtttagataatgcccctactcaatcacttcttagagttgttaatggcattctagatgagagcattgagaggaaaagaggagaaataccacaccgtgttgtttatttgcttaggaatgttgttcaagagattgagcaccgcattgctattcaagcggatcacataagaaatcaaaatagcatcatcaagactcgggaagacaagtaccgttcaaaaattaaagcactcgagacattagtaaatggcacaaatgaagaaaatgagatgacagtaaatcgacttgagctagttgaggtagaaaaatcaaaacttgatgagaaaagaaaactaggtgaacaagacatggttcgactgatgcaagaaaaagagaatgcagaaaatacaattgcttcccttcagcaagagatacagatcttgagtaggatgcatgaacagtaccgtgaaagaaaggaaacagaagccaggcagatggaggaacacatggctatgagacttaaggatgctgagtttcttttaatgcaatcaaaaaagaaagttgaagaaattgaatcagcttcccaactgaaatctcaactttggagcaggaaggcaaacattttgcagagttttatggataatcaaaaattgtccattaaggacataaggatatcatctcagtccattaagcaagaaatgtttacgcttcaaatgaaatggagggatgaaatatctaacattggacatgatttgaatggcttggttgatgctgctgacaattaccacaaggttcttgctgaaaatcagaagctatttaatgaggtacaggaactaaaaggtaatatcagagtctattgtcgtgttagaccatttcttcctggtcaagatggaaaaacaaccgttattgattatattggtgaaaatggtgagattctcatcacaaatcccttcaagcaagggaaggatgtgtgtcgtatgttcaagttc

SEQ ID NO: 6534 - DNA, 565 bp, Sorghum bicolor
  Clone ID: SORBI-28MAY03-CLUS45821_1
gcacgaggccaacccaaccacccgcaccaagccaaaccagggagacacagcacgcggcgcggccacgccgagcgcgcctgcctgcctgggctcccctccccttcgcctccctcctccgatcggcctcgcctagctgctgctactgcgcgcgcgcgcgccgccgccgcggtcggacccgggaggagggcggctggtggtgggcgggcccgatggagtgggcatcggcggcgtacacggccgcggcgctggtgtgcgctacggcggcgtgcgtggtcgcgctcgcgcacatctaccgccaccttctccactacgccgagccaatctaccagcggttcatcgtccgcatgatattcatggtcccggtatattctgtgatgtccttcctttcccttatcctccctgacaacgcgatatatttcaattctattcgagagatctatgatgcttgggtcatctacaattttctctcactctgcttggcatgggtgggaggtcctggtgctgtggtggtaagtttgagtggccgaagcctaaaaccgtcatggattctgatgacttgctgcta

SEQ ID NO: 6535 - DNA, 595 bp, Sorghum bicolor
  Clone ID: SORBI-28MAY03-CLUS45825_1
ctgaaaacaaccagtgggcactctagtcctcagggccttgcttcattgtcctccaggatgagacccaatgaaaacatgatttatgccgagtgtaggtctgttgatagagcattattggaatctgctcaaacaggtatttcttctgagcaaaaggctatgaactgtggaatctcagataaccttacccgaatttggaggaagtgcatagagaactgccactccaagacgttgcggcagcttctctatgatcatgggaaactagcatctgtcaaagaatgtgaaggtaccattgttgcttttatagcatttgaagacaacgatataaagtttcgagcccaaagatttattagcagcatcagaaattcaatggaaactgtactgaagtgcaatgtggaagtcaggatttgtttaatgcaagaatttcttgctggaggactaaagcatgagacatacccggatgagacagctgaatctgatgtcttgagttgttcaacgaacagtgagcgtcgaaagggtagtctcaatctatcaggtgctggtgcggtgcagtcaagcaatgttcccatgatcatctctgatgagaattcaggaatgc

SEQ ID NO: 6536 - DNA, 660 bp, Sorghum bicolor
  Clone ID: SORBI-28MAY03-CLUS45885_1
gcacgaggcacagttctcacccaccaggccgggcgggcaacccaatctcccgaccatcacgtcgcgtgccgtgcgttctcccccgcatccgcccctgcgttggctgcttccggcccctccggaccccgagttcaaaaattcctccattggcgcccaaacaccaaaccctagcctcgccccggcccgccgccccctccggccggccgggctcgccagtcaccgtcgcacgcggcggggggtccgcaggcggaacatgcggtgtcccgagccatggcgaccgggcccgatctgagctcctcctcctccggcgccgccgcggccgcggccgtacctgacgctgccgccgccgccaggaaggaccgccacatcgtcagttggagcgccgaggaggatggcgtgcttcgtgctcaaatcgcacttcatggcactgataactggaccattatagccgcacaattcaaggacaagacggccagacagtgcaggagaagatggtacaattatttgaactcagagtgcaagaaaggtgggtggtccagggaagaggatatgcttttgtgtgaggctcaaaaagttcttggaaacaagtggactgaaattgcaaaagttgtctctggaagaactgacaatgcagtgaagaatcgcttttctactctgtgc

SEQ ID NO: 6537 - DNA, 902 bp, Sorghum bicolor
  Clone ID: SORBI-28MAY03-CLUS46768_1
gcacgaggcggatccgctccggctctgacgacgagatgggctccatggaagcgtcgaccgcaccggagaatggctccgccgccggtggcggagccgggggcacggcgtgcaacggggccggcgcctcgtcgaacggaggaggcatggagaggaggctgaggtcctcggctgcgtcggcgtcgtgggcggcgcaccttcccctggaggtgggcacgcgcgtgatgtgccggtggcgcgaccagaagctccacccggtcaaggtcatcgagcgccgcaagggctccgcttcctcttcccccgccgactacgagtactacgtccactacaccgagttcaatagaagactcgatgagtgggttaagcttgagcagcttgatcttgatactgtcgagaccgatgtggatgagaaagtagaagataaggcaacaagcttaaagatgacacggcaccagaaacgtaaaattgatgaaacacatgtggagcaaggacatgaggagcttgatgcagccagcttgcgggaacatgaagaattcacaaaggtgaaaaatattgcaaagattgaacttgggagatatgagatagatacatggtatttctctccttttccaccagagtacaatgactgcccgaagctgtttttctgtgaattttgcctcaacttcatgaagcgcaaagaacaacttcagaggcacatgaagaagtgtgatcttaagcaccccccaggtgatgaaatctatagaagtggaactctgtctatgttcgaggttgatgggaagaagaacaggtttatggacagaatctttgttatctggccaagctttttcttgatcacaagacattgtactatgatgttgatttgttcttgttttatgtcctctgtgaatgtgatgatcggggatgtc

SEQ ID NO: 6538 - DNA, 544 bp, Sorghum bicolor
  Clone ID: SORBI-28MAY03-CLUS46791_1
gggcgctcttatatgaaggcgaaaagtgggtctagcctgatgaagcggattgccataaacttcatctacgagtttttgacgaggaatagccgaggtcctgcctacgcggctaacgtgccacatgtttccacccttgaggtaggaatggtttgccaagtctgatagatataatgtcactgtggccatgtcaagttgtatacaggtaaaaatagttcatcttatacttgtgtatatatagatcttaacaaaagggttagattgttgatgaagcgggacattattgtggcctgcgagtgcagatgttggatagacgaagtgtgcatagttttctgttttctctgtatattcttttgtgttaggctcttccttgctctgctttttcaatctgccaatgcccatgttgatatgtgctacagttacagagtagagggagaccatttttgtgttcatgaatcggtttgtgaccaattaattgtatgtactgtatcagaatctgaataagtttatgatgaaattgtttcattcgagttctgagaggggactg

SEQ ID NO: 6539 - DNA, 814 bp, Sorghum bicolor
  Clone ID: SORBI-28MAY03-CLUS46831_1
gaggagttcaaaaaagctctgagccatgttgattcccaagtgaaaaatgctccagcaacagctcaggtcgctgcgcaacaaggacagtatctcgctgaatgtttcaacaaaatggaaaaatgcaaagaggatccagaaggccctttgcgcatgacaggggggtctggccgtcactttttccgcccatttcgctacaagcatttcgggcaattcgcacccctgggtggagaacaagccgctgcagagctcccgggcgactgggtctccatgggccacagcactcagtggctctggtactctgtgtatgccagcaagcaggtgagctggcgcacgagggtgctggtggtttcagactggacgcgccggttcatattcgggagggattcaagccgaatttagcgcgccccgccgccgagccagatgcatcggcatcgtcgtccttcttctgcacagggatttcttttgaagaataatcgatttgctgctggagcttgagcaagcaaagctgttcctgtttcccgcctcgcgccaggtcctgccaacgaaactgctcttctttcatctgtgtctgatgcacggtgttccttttccttgctcctgctacatggtggcagtggctctcaacatgtgaagcaggcaagcagctttggaagaaagaggcccacttttttagctttcactgtagccccgtttggaacatggcatcagattcttgccgcgagaatcgaaccacttcacgtgaaattgtcgcgagccattgttcgtttgcacacatgccgtgcaagttcgttgttatggagtgaactgttgctgc

SEQ ID NO: 6540 - DNA, 632 bp, Sorghum bicolor
  Clone ID: SORBI-28MAY03-CLUS46877_1
cgtcattcgtccacagtccaaaattgaccctgagcagatacgagctcgtgctaagcaggctgtccaagaccagcgtcggctgaagatgaacaagaaattgcagcagctgaaagcgcccaagaagaaaaaccttcaggcatcgaagctcagcgtggaaggccgtggcatgatcaagtacctgtagatcactcactgtggcatctgcagtcagcagtgccctgcacatgatacagtgcctgcagggattgctgaattagtatgaagcatcctcccaccatccatggcaaacagctcggcatcaataattgcttggatcttttatccaagtatttttcttgcctggtagggtgcaacatccgtgcttcagaaaccggatggtttgggcactatcaattgcagaggcttctactatgagcttgcataaacaatggcgcctctcaagcagagtggtgcctttatattgtataataaatatttataatgcttgaagggttgaagttcggttgtttgtacttgaaggaagttatgccttgtgaaaaatcaaaacatagtgcgacaaatgattaattgtgcttaccaaacggtaactcaattttgataaatggcaattcttggagtcttccatctaaaaa

SEQ ID NO: 6541 - DNA, 691 bp, Sorghum bicolor
  Clone ID: SORBI-28MAY03-CLUS46017_1
gggagagacagaagtttgggcttcagggtggctttgtcacaaacccattagccgagccaaacatttcttcagtagggaaaacaatggttactcaagaaggcaggaagaaggatacaactttacaaaagtcaaggatgggttaggcatgatgaagacattctgttccaagtgtgagctggtcgagtttgcttattatcatggaggctgctgtagttctcttctccaccgcaaccttttttcctaaggaatgggcgctgttattttcggaagcttttccccccatcagcgctgaaagcatggtgtgcgcgtgaactatggctctatgggagtcactctaaagctagctgtttgagtactatgctacgctgctcccgggagctgcattcacatcttgaggtgggtcgccagggaggcttcttgatcagacagcctcgcttgacaccgacgcaatcacgcaaggcctcccctggacagtcctggactacgctgggtttgacatgagaacgaccactgtgtttgtcatatcgtaactagaggaacatctagctttatggtagaacgtaatcacaatgtatcaccattcctacggaattatggatgcgtcttgtaaataggccggataaagcgcttctatgttcgcgagcttcttttgtttaccatgattccaagagtgcgccttttcttttctcgc

SEQ ID NO: 6542 - DNA, 706 bp, Sorghum bicolor
  Clone ID: SORBI-28MAY03-CLUS46039_1
gaccccatcgcggagctgatcgacgcgaacacaaagctgctgaagaaggcggaggagttcacgtcggcgggtggcgacggcggcggcgacgtggacctgcgcagccggagccagcgcaagatcctggagcgcgtgcgcaagatgtcggagaaggccgggcgcctggagctggagctgcagcggttccagcacgcgctgctgcggcacgaggaggagcgcgcggcgcggcgagcggccaaggcagcggtggccaccaccgtgcaggtgcagcggcggtcacgggtgcagctggtggagtacctctacggccggcggcgcgacagccggcggcccaagcagaaggcccgcgggccctcctgctgcatgagggccaaggccatcgacgactgaccgtgacgactctgctctcagtttagtcacccaagctggttaaggttaattaatctggagaagatgcagtaactttgtttttggttaaaattcgtgtcgtcctagtaggtaaataattgttactgaactgatctagtatgtcgggttctttttttttgttacctgaagtaaaagtaaggtactaaggtctaagatgtaaatggtagtagcctagttggcagccatgacagtggcaactgttattccctcgtccgtaaatttttcggcatgtaaaatttcagaccgtaatcttcagtctcattgttttccagttctc

SEQ ID NO: 6543 - DNA, 635 bp, Sorghum bicolor
  Clone ID: SORBI-28MAY03-CLUS46052_1
gcacgaggatcagctggtgtgaagattgaggacaaactgatagtgaacaagcagctcagggtcctgattagcggtggggccatgagtgggaggggagatgtggcgtatggaggccgcctcgaagcaacaatgagggacaaagattacccgattgggcggatgctttccactatcgcgttatctgttgtggattggcatggggatctggcaattggctgcaacatccagtctcagatccctgctggaagagctagcaacttggttggccatgcgaatctaagcaacaaggggactggccaattcgggattcgcctgaacagctcggagcatcttgagatcgcactcgttgctctcgtgccaatattccaaaacattatgaagctgttacagaattattactcagaatctggctagtattttttccatttaagcctgagaaaacagtgagcagagcatcataggttaaaatctagcataaattagaactttttactttcaatttattttgttcttttgttaccaacttttgtaactatgctctccctgggctctttctttttgtgacagtactcatctaatgtaaggcttttccctgagctctttctgatgaagctggattggagaattcatcgttc

SEQ ID NO: 6544 - DNA, 767 bp, Sorghum bicolor
  Clone ID: SORBI-28MAY03-CLUS461_1
acgcgaacctccccgaagccgccgcgaccgatcgagtgaagcgaagcgtccccgcgccgccgccgccgcgccgccgaaacctccttcctcctcctacgccatggccaccgtctcgctcactccgcaggcggtcttctccaccgagtccggcggcgccctgccctctgccaccatcctccgcttcccgccaaacttcgtccgccagctcagcaccaaggcacgccgcgcctgcagcaacatcggcgtcgcgcagatcgtcgccgccgcgtggtcagactgccccgccgctcgcctacgcggcgaccgaggtcagcgcagtccccaacgctgcctctgcgcagccgtccgccgtcgtatgggccgagcgtaacctgctcgtctgcgacgccagcctctagggcaccgggggggagaggctgggaagaaggatcgccacggatgcgatcaccacgccagtagtgaacacgtcggcctactggttcaacaactcgcaagagctaatcgactttaaggaggggaggcatgctagtttcgagtacgggaggtatgggaacccgtccccgcgggcatgggtgcagctgtggcgcgccctggtgcgcgcggcccccccggtgggcgcggcgtcgccgccgcaggctgctgccgctaggcttggtgcacttgtcccagctggtgggcacattgtcaccaccacagattgctaccgcaagacaaggatttacatggaaactgagctccctaagaggggaatttcgatgactgtcatt

SEQ ID NO: 6545 - DNA, 603 bp, Sorghum bicolor
  Clone ID: SORBI-28MAY03-CLUS46199_1
accccattattccagaggaaaaagactaatggagaccatggggcatcatcatcatcatctcagccttttgcacagcagcagcaattggctgtacagcaggacagttatatgcagagcagagctgaggctcttcaaaatgtggaatcaacaatccatgagctgagcaacatatttacacaattagcaaccatggtttctcaacagggagagctagcaatcagaattgacgataacatggatgacacactgactaacgtggagggagcacagggccagctcctgaagtacctcaacagcatttcatccaacaggtggctgatgatgaagatattctttgtgctgatggtgttcctcatgatcttcatattcttcgtcgcttgatcttctgcatcattctgcccgagatgctctggctgttatgcgtagtattcttttatttttactcatactacaccgtgtacacaattttcaccctggatgataagcaatcgttcacccttttgtggtcatgtaaattgggaggagttccagtacttatatgttactcttggttggtaatatctcccactatatatttgaatatttataatgtaacaattcgct

SEQ ID NO: 6546 - DNA, 728 bp, Sorghum bicolor
  Clone ID: SORBI-28MAY03-CLUS46227_1
gcacgaggttcagatgttaggccagccggaagggaaagaagtgtgttcccatcaaattcaatgactatgcaaaacatgtctcgcgaaatggaacagctacgtcgtgcaaatggaaggctagaacaagagaatcatgaaaaggacaacgcactacagcaaaacaaagttcttgtagacttggtattgaaactttgtgaggacacatgaagggtagtaccagaagaagcgttacgacgcttgtccgctacgcaagcaattgcaaccggttcttctcatgctgtctcagaatctgccaacaatgccaatgattttgggcacaccaatgaagaccttcatgctacaattgttgccaacaatcaaggttccgacaacaatggagatgatgcatcgatttgatggtgctgtttagttgcaaaacatggatgtgatggtggtttcttcttttgtagtgttgtgcttttgcacattaactagtaggaggctctaatctttagctgtggtaatgcttttgaatgtaactagtagcgctctaatctttagttgtggtcttacttatatgactcaatgatgcgctggtagtttagtcatcttggttgaaacttgaaccgctgagatgagatggtaatgcttttgaatgtatcgacgtcagaacatttggacatcgtctatggaatgtgttgaatatttggagcccatattgtgatgtatcctatatgtattgatgtcag

SEQ ID NO: 6547 - DNA, 794 bp, Sorghum bicolor
  Clone ID: SORBI-28MAY03-CLUS46247_1
gcacgaggctcgtgagagcaatcctgatgccccatcaagctcagcgtctgtaccaagacctaatgtcaataatctgacagcacatcttggaggcatgcgtctgcatggatccgctagctctactggcacagtggagctgaaccatcacgatgtcatccagaacggatcaccttctccagtagctgaagaaagttctggtcagcagtagttacaataagatagtggctcggattcacaccatgactgcaggggttttgtccgtgcgcgagtgacagagcacaagtgattttttttttggcaatttttggatgggaggcatgattgcaaggggcgtattagattgacaagcaaatgtgtttactggcggtcaggtaagattttgctttaccttgttatattcagacgtagtgttgaagatttggggcagttggtgaaaaggatgaagcagatagttgaatacgaaggtggtggtatctggaggcgcctaggatgaggaggaaaccatggaagactgaaacaaaattacgaaagacgagtgtgataagttagtagccctgggcgggctgatggcttggtaagcgagctcaatatccatgtttactggggtgggtttgcacagggggcttggatgctattctggtgttacgatgaactggatggttttgctcggcgataggatggatgttgtaggacctccgatttttgatggaggagctgaactttctcacttggagagtcagggagtttgacttgttttgtttttgtggtggttaaagtaagagatgctgttagct

SEQ ID NO: 6548 - DNA, 791 bp, Sorghum bicolor
  Clone ID: SORBI-28MAY03-CLUS47120_1
gcacgaggctcgataggatgactacatcagaagccatcaggaaattggttggatcctacagcaggtcccaatactactacgctgcgagggagaaagttaatgatatctcgagaatgaaaggaactgtgctggattcaggtggcagccaggctagcttcctgatgcaggcttgcaccctgaccaagcgctcgttcatcaacatgtcacgggactttgggtattactggctcgggctcctgatctatctcctcgtgactgtttgcatcggcacaatctacctggatgttggcactaaatacacatccatcctggccagagcttcctgttctgcattcgtctttgggttcgttacgttcatgtccattggaggattcccttcgtttgttgaagaaatgaaggtcttccaacgggaacggctgaatgggcactatggtgtcgcggcatttgtcatcagtaacaccatctcagcaacgccattcctgattctaatatgcttcttgtcgggaactatatgctactttatggtgcgcctgcatcctggtttcgaacactatatcttcttcgtcttgaacctgtatgccagcgtcacagtggtcgaaagcttaatgatggcaattgccagtgtcattcccaatttcctcatgggtatcatcataggggctggaattcagggaatatttatgctggtgtctggctacttcagacttccatacgacattccaaagcctttttggagataccccatgcagtacatcagctttcattactgggcactgcagggccagtgccag

SEQ ID NO: 6549 - DNA, 754 bp, Sorghum bicolor
  Clone ID: SORBI-28MAY03-CLUS47146_1
caacaaacggtactacttcgatcaatcaccaaagaaagaagacacaagtatatattgatttattggcgtcctacctactatacgcctatgcatgcaggtctagtgtaatgttctagtccaaatgcgaagaaatgcatgcttgcttgtccacgatccagccgcacactcctcgtccttagcatatgcggaatcccaaatttaacccccactggagaagcaggagcagtggtacgacggtgttgataagagttgcaggaggagaggcccgagttgctcctcgctcttctgctgattggtctcctctctcatcccatcatcgtcttcttcgagagataagaataaataatactatatggccatcatactcgtacgagcagcgtcgccggcggggctctccgacgccgccggcatcatcagccaccatgggagtctccagtgctcctctctgcctctgctcaacaagaggccggccccggcccggcggtggatgctctgctcgctcaggtacgggtgccttggcctcgaccccggccgcccctccccgcccgccgtctactccagcctcgccgtcaacccggcgggagaggccgtcgtctcgtccgagcagaaggtctacgacgtcgtgctcaagcagtcggcattgctcaaacgccagctgcgcaagccggtcctcgacgtcgtcaggccccaggaggacctggcggagatgccacgcaacggcctcaaccaagcctacgaccgctgcggcgagatc

SEQ ID NO: 6550 - DNA, 689 bp, Sorghum bicolor
  Clone ID: SORBI-28MAY03-CLUS47169_1
tcgctcggccgttccccagatctgaacccgaaccagtgaaccacccagccctgatggcctacaccacctcgccgtcgccggagcggcggcggtggcggtggcctgggccttcgctgccgccacctgcgtgaagctcctcctcgtccccacttaccgctccaccgacttcgacgttcaccgctactggctcgccctcacgcacgcgctccccgcgcggcagtggtacaccgacgcctcctcccagtggacgctcgactacccgcctttcttcgcctacttctcccgcatcctctccctccccgcgccgctcgtcgacgccgccctcgtctcagtccccgtgcccgacgcgccgcccttcgcgcatctcctctacctccgcctcactgtcgctttctccgacctcctcctcctcggttccgtcctcttactggcgagggacgcgcggcggaagcagcggccgttcctcgctctcgcgctcgtcctatggtcgccggcgctgctcgctgtcgaccatgtccacttccagtacaatggattcctcatggggctgctgctgctctcgttgcacttcctcgagcaggggtgggatcttgccgggggagtcgtgttcgcaagtttgctctgctcgaagcacctgttcctcgtggcagcgccggtgtactttatgtatctgttccggcattattgct

SEQ ID NO: 6551 - DNA, 1023 bp, Sorghum bicolor
  Clone ID: SORBI-28MAY03-CLUS46328_1
gcacgagggagcacacggatcttctcacgacctacaaatcctcttgcgttaccttcttccacgccggaaggtttgacaaggtcaagattgtgcgagagtcgatgaaccggatgattgaggcgtggaaggagatcccgggtgctgaagaggacgagtgctcctccgctccgccaccagcgtcccaatcacaacgaagatcttctcttacagggagtgcaagtgatgggcgatatccagctgcttcgctgggctcaaactctgttccatcatcaacaaggaggagcagattacctgtgagcagatcatctccgcctgatgtgtcacccagtgtcaccaaaacaaatagtccttcgtccatcaggaacaagaagctgtcaccaccttcatatcgcaaagtgcgccaagcaaataattgtgactacaaggttgagattgctgttgctccggatgctaccccaatcaaagtggtgactgaggagaagctactgaaaggcgccagggtgagagacagactggaggctaggagaacactcttccaaggcagcgaggataggtcagccaagctggctggacacaaagcagggtcacgagttgttccgtacgagggcggtggtaatttggaagagatttcagaagttgaaggtggatcagaaaggtatacagttcataaggatgagagcttgtcagaaataaggacgcagctccttcagattgaaaatcagcaaagcagtttactggatcttctccagaaatttatgggtaagtccgagaatggtatgaattctttggagacaagggtgcatgggctggagatggctttggatgagatctctcgtgatttggccttctcttcaggaaggatgtcaaacagggagcctgatgtaaagacgtgctgcattctgagtccaaaattctggagaaggcacaatggtggtaggtcttcctcaaggttttctgcctcagacccagcaaacagctcagacgagagcagaacttcttacaaatgggagagacagaagtttg

SEQ ID NO: 6552 - DNA, 1173 bp, Sorghum bicolor
  Clone ID: SORBI-28MAY03-CLUS46330_1
aagcacggcttgctaaacacgaagaaaagagaagccgctctccctccgcttcccccaaaccccaaccatggcagccgccgccgattctgccgccggccaaaaccctaaggacgacgagcggcacgtgctcaccgctgactccgacgccaggttctcggaggaggagtacgaagaggatggggaggaggaatacgaggaggaggaggaggaggagctggacgggccggcggccgaggcggcggagcgggagcgggtgcagtccgtgttccggcggctgtcatccaaccccgtgggcatccgcgtccacgacgtgctcatcaagggaaacaccaagacgcgggacgagctcatcgaggcggaggtcgccgacctgctccgcgccgcacccaccgtgcaggatctgctccgcgccgccagtgtcgccaccgcgcggctgcacagtctcgacgtcttcgacaccgtcaagatcacgctcgacgcggggccgcccgagctgcccggcaccaccaacgtcgtcatcgaggtcgtcgaggcggccaaccccctcactggcaccgccggcgtctattcgaagcccgaggcaagatcttggtcgctggaagggtcacttaagttgaagaatttgtttggctatggtgacatctgggatgcatcagggtcctttggttgggaccaaacaacagaggttggtgttggagtctacctaccgaggttcaaatcaataccaacaccattgatggcccgggcatctttgtcatcacaagattggctgaagttttcatcatacaaggagcgcctacttggcctttcatttggtttgctgtcaacaaggaaccatgacttgtcatataaccttacatggcgtaccttaactgatccatcgcatgtctcatcaaaggccataaggaggcagttagggcataatcttctttctgcattgaagtacatatacaagattgataagagggattcacatcttaggccaacaaaaggatatgcgtttcagtcaacttctcaagttggtggtctatggaatagcaaaggattgagatattttcggcaggagtttgatgtgcgtggtgctgtgcctttgggattttataatgctgctctcaatgttggtgttggagcgggtgtcattttaccacttggagggggattcatgaattcgac

SEQ ID NO: 6553 - DNA, 508 bp, Sorghum bicolor
  Clone ID: SORBI-28MAY03-CLUS46344_1
gcacgaccgagacagagagggcagtgaagggagcccgtgcggtctcccggcgtgcatcggaaatggtggtggtggacgcgtcggagttcggggcggagggcttcgacccgaagcggtggatcaacgcggcgctggacgcgcggcacccgtcggagcctctcgatcgcttcctcgccgacgccgaggagcgcctgcgttccgcggccgacgacgccgcggccgcgctcgagagggacagcggcgacgccctccgccgcgtcccgctggcatgccgcgacgcgctacgcctccgcgacgacgccgtcgccctacgctcccacctcgcttccgtcctccagtccctctccctggccgagggctcatccgcagaatcaatagctgcactagcgcgaattgatactgtgaaacagcgcatggaagccgcatacacaacattgcaggatgctgctgggttagctcagttgagccagagtgttgaggatgtgttttctagtggcaatcttccaaa

SEQ ID NO: 6554 - DNA, 998 bp, Sorghum bicolor
  Clone ID: SORBI-28MAY03-CLUS46503_1
gcctactgatgcgagcgactcggcctcgaggaggagtgactgacactggagtggtcgagttgtgtgatgaatcgcagtggaaaccgtgagagtgtgaccgagatgctctgagcccaatcaagggagcaaagactccggaagcgacacgccccagtactctgctgctgcttgcttctacagtcccctctgcctctcttcttttccttattgattgattggtgagccgagccggagtgtgatgcggcacgggggtgcacattagcaccgttcacaaatcataaataaacctctgaagaccaaataaacgtttcagttagccagctctgaaggaagatacaggcttgttcataagatagtcatggcagagttcaagattggtaggctggatggccagccaccaaggattagaaatgtgcccattgccgtcaccccagaaggattctggtgctgtccatcacaggccgcgcttcagaagacagcaaagagcccaaaccagcagggcaggactagagggggagcatcccctgcgccatcgaaggcgtcctcggttcagagggcgccaaccatttcttcagagaagagagcacagtccactcctactaggtctagaaccaattcagatgagcaggtatgccctcctgcagatgctgttgctgcccctgatccaccaaaggtagtacctgtaccagcacctgagaaacgaccaaagcagcataagatctcggtcggatttgggcagcttggcacgagtgatctgaaggttgtgctgcatggcaaggaaggggtcgctgtgaagatgattgttcacaagaacatccttgctgaaaatagtaccttttttgccgatagaatctcgaggcagtctccggtggcatgcattgaggtgccagattgtgaggatgtggagatttatgtcgagactgttgggttgatgtactgcaaggatgtcaagcagaggcttatcaagcaaaatgttccacgggttctgcgaatcttga

SEQ ID NO: 6555 - DNA, 983 bp, Sorghum bicolor
  Clone ID: SORBI-28MAY03-CLUS46672_1
gaccgcatcccccatcgtcaccctcactgtgccgccgcccgctcggctcccacgcattctcgctcgccgccgcctgcccctatgcatgcgatctcctccccacactccttcaatcctccccgcacctctcctttgccgatcgccctgcgacccccaccacatcggtgtctgtatctgcgtccctgatccggctcgccctcatctggatccattcaccggcgacgaagacctgcggcagcagaagctgggagggcgcccgcacgtccctccccctgatcctgcgaggagcaccaccaggtgttccaatcctttctcctccccccctccgtgccgcacccggcgcctcacccgcgcacgcccggtcgctcccgcctggccgtccgcatcccttctcctaccctacaatgtgaaactgatggttgatttggtgatgaactgaggttaagttcagtgaaaacaatatcgttgaagttttttcttttcaatttgcaaacatggatttaagattggtatgaatgtctgcattgtctcccagcagttatatttttgtacttatttctctgtttattatggaacaaatgggtctgtggacaagatcagagagcagagtaagagcagagtactaaatttactgttcatttcaaaatctttataatgcatttcccatctacacagcagtggaaaaataatttaagcagtgcatgggtgatttttattttttcctaaatgaaactgactacccttttctacgtacatgattctgctgttctgcttcttaatgtggattcttagcaaacccatggagaactggccagcgtccttagtgccaagatggttattgatcttaatgtatgagtctttatttcttgagtgcggccttcttattttggagttagcgctgtgcgtgcgctcttgtaatcatgtgtttattctgtaatggctagtatggcttgctgatgccatgtgtctatctagaatgcatg

SEQ ID NO: 6556 - DNA, 866 bp, Sorghum bicolor
  unsure (1)..(866): unsure at all n locations
  Clone ID: SORBI-28MAY03-CLUS4658_1
ctgtgagtaggattgaaattagtttgctaatcaattacctcctgttctaggataccaaatggtcaaagtgcatccacacataagaatctggagattcaaagtagaatgcaatgcaagtaacttgcaaactttgtctagcaaatttctttcctaattttctgttactcattgctcttagctaattttcaacttatcatgtctaaataacaatcatagcctgaccatattcatatgccttctagattgcaattgtgaaaagcatttttgttttcaatgtggtattgttcataggtgtggtgacaaaatgcctaatttcgttgatagtgacaagagtattttccagataaatgtcctaccggcgcacaagcaagcgtgctcaattagctgccgttgtcgcactatgagcatgcccaagggaggcagcgaccagtgtgggtgcaccgcaatgagtgggtgtcttggcgaaagatgacccaattcttttgtaggaatgagaaatcaatgggtgtgcgtctgtgcgaccagctctagctctcactcattgcgaggtggggatggcctagaggttgccaatacagaattaggagtgttgaagaaaactgaatttcagatctccattctatctcctgtcaaccttcgtggctccatcattgcaaactgcggatcaggtgattggtgtaggcagaggctttccactccccagcctccttccccaggcccgtcaagatccaacggtgcccatagcaataacgctgccagatccggtgtggcatgttcagatgccctgctcttaaattacatggttntccctcagtatgatgtctgctttccaattgatttagtcataaatgatgtttttcagttct

SEQ ID NO: 6557 - DNA, 1002 bp, Sorghum bicolor
  Clone ID: SORBI-28MAY03-CLUS473_1
ccacgcgtgcgtatgtgaaagattagtgatcttatcacaatattgatctctttttagtagctgtatagtatatgttgctatgaaaaagttgggtttcagttctcagtttctttggtacctactataaaaatccacttaaaatcctaagtaaatgctttcatgatgtagtctcacccaagcaaactacttctggacagatgactactgctattgccattgaagatgtcagaagagaagtcagaatattgagttctttgacaggccacagcaacctagtgcagttttatgatgcttttgaggatgaagaaaatgtgttatgcaaaggaggtgagctgctggacaggattttggctagaggtggaaaatattctgaggaagatgctaaggttgttattcaccaaattctgagtgttgcttcattttgccatcttcagggtgttgttcatcgagatctgaaaccagagaattttcttttcatgtcaaaggatgagaattctgccttgaaagtcatagactttggtttgtctgactttgttaaaccagatgaaagacttaatgacattgttggaagtgcatattatgttgctcctgaagttctccatcgatcttacagcactgaggcagatatgtggagcattggagtaattgcatatattttgctttgtggaagccgccctttctgggcacgaaccgagtcaggaatttttcgagctgttctaaaagccgagcctagctttgatgaaatcccatggcctaccctttctgctgaagcgaaagactttgtaagaaggctactcaataaggattaccggaagcggatgactgctgcacaagccctctgccatccatggatccgtggcacacaggaagttaagattaatctagacatgataatctacaggcttatgagggcgtacttaagttcatcttctctaaggaagtcggctttgagggctcttgcaaagacactgacgacagatcaaatcttctacctaagaagag

SEQ ID NO: 6558 - DNA, 656 bp, Sorghum bicolor
  Clone ID: SORBI-28MAY03-CLUS47309_1
actctcgtcgctcgcctttccccaacttttctcccccactccgccagacagacggtcactcgcctccctcgctgagcccgtcgactgcctctacgctctctctcgccaatccttcccaccccaccgatcgctcctgaagcggctcaactgcctccggattttctcgaggctgaaattttggtgtcctgctccagccatgggtagcaggagatacgacatcgatacgaggagatgtgggattcactcagcaccaactaaatcaatgtatctggatgctcaacaagttgtcaactgccaagccacagtgagagaccacgatgttggttcctgcgctgtgaagcatcacttcccgtctccaattgtatcttggatagaagatctttcaagctttggcaatgcttcttttggccctgactctgagtatgtggatgagcaagccagagcttcggtgggacagtcttcgacatcaagtaatttgcatgacatgcaaatatcagtgagattgacagacgaattcatggagcttgcaaaggagaatacaagcaaaaatctagagacttgtggaattcttggtgcttcatttagggatggaacttactttgtgacaatgttgattataccgaagcaagaaggaactgctcactcaggtcgcgtgt

SEQ ID NO: 6559 - DNA, 757 bp, Sorghum bicolor
  Clone ID: SORBI-28MAY03-CLUS47390_1
cagcaatggcatcagggcagccttcagagaggctgacatattctgggcagtcaatattctttggcggtcccatgctgagtacccctggcatgagcagccagaggaatgaggcaggcacaagggtacgccccgagggaagcagagatcctaatgcccagcagcgtgacatccggggcgagaaagcaaggacaggctcctttccaatatttgctcctgggacgttccagaggaacccaccctttgacaaatgacttgctcctgctcatgaagttcatctgaagtgcgaaggatgcccctgaagagttgacagatagttggaaggctgctcttctgggattgccagacggacggacaaggcagctgttggaatgaatggggctgctggcacttggcaggccataatgaaaaccacaagtatcgctcggagtcagtgctgacttttttcagtgctgggagagcgatggagtgactgatgtagtacaatgtgttcgtgttagggattcatcaggtatctgatgcgcgacagataggaagagctaatttctggtgatgtcaaacgaacgccgatttgcagctgactttgtagtgtcgtttgccatcactgtgtgtgtgtgccatgggatactattcgacatgtaaaatgttagttcaggtgcactttcggacagtgctcgggcgtatttgcttgcttgtaccaggtcttgagttttgatgcttgtagcagcatctttctaggcatgccatctttctatgggtg

SEQ ID NO: 6560 - DNA, 767 bp, Sorghum bicolor
  Clone ID: SORBI-28MAY03-CLUS47427_1
tctgaaattgctgactgggaccttggtgccggcatatacatagacttctacgttctaaagaactcaatgcaagaaagaaatgccatggatgattcggattcactcgaggagataagtgaatcatgcagaaatttctttggccgattaaatgattcattgttagtctggggaagcaaattacctgttgagtcaagggcatgctactcgaagatggcagaggagctatgcgcgcttctcgtggacaccccaagcgagacactgaatctacccatgggatgtcttcagacaatgctcaacgctccagttcctgatgaaatcaggtcgtcgtacctgcaggatgcactctccgtcttcaccgaaattctttgcagcgattcatagcagagttcaaatcaaacatgtctggtgttcagatttgtcccgtaatctgagtgaaggggagtgaagcctacaaggccaaaacacaccaaagagtttgtacgtctcatgtgtggtactagaaaattagaaatgtataatctgttgtttccccggtgaactaggcacgccgtgtgaactactgaaaacatgtatctggtttttcgtggcagagagtagagtaccaggtcttgtgaactgttgacctgcgcgctgtatctgcatccaagtccaaggggtgttttcctcggcttatttttcgtgtgattattacggaaaggacagcgttacggcgaccccgtgtatgttttgggatacattcaagaatattgaagaatccgtgcaggctc

SEQ ID NO: 6561 - DNA, 1040 bp, Sorghum bicolor
  Clone ID: SORBI-28MAY03-CLUS47336_1
ggatccccgagtccacctctttcacccagcccggcgatccggccgcgctcccgcctcgcctcgccgccggcgaccgaccccacgtctgcccggcgatgtcctcctccgtctccattgcggcggagtgggaccttctctccgaccgcttctaccgccgactcacgctctactccccgctcccgtggtccgccccagctgcggccggcgcgacctcgtcctcctccggcgtcggcggtgctgtgatcggtcgcctcgacctgtccacccacatcgtcgccgccgcgccctttggaggcccgatcgctgccgtccgcgacgactctaagatcgtgcagctccactccgagccctcccgccggcgcctcctcctcttctcctcctccgcccacccaattgcctccgcgccctgcccgccccttctcccgcgcctccactcgctcgccttctccagctccctcagcctcctcgcgctcctctccgacggctcgctcctccgcttccgcctccccgatctgcaacccagccctagctccagtccggttcccctgctcccgccggactcaggtggcgtcgccgatgctcaattctggggcggtggtgtagccatcctcacggaagacaaccgcgtcgtggtggccactgacatcgaggccgacgaccctcacccccgtgacctcgccgacccagacatcggtgacgaggagcatgttctgtgtatggccgtggtggagccacagtttgtcatgtcggggagcccgggggtattgcttgcggttggcgaccgggtcattgcggttgacgaggatggcgtacaggtgcttggggtggagctggagattggacccgtgcagaagatggcagtgtcacccaatggcaagcttcttgcagcgtttgcacatgatgggcgccttctcgtgatccccactgatttctctaggatcatattcgagtatgagtgcgattctgcactgccaccagagcaaatagcttggtgtggactagacagtgtactcgtatactggcctgaggtgctgttgatg

SEQ ID NO: 6562 - DNA, 503 bp, Sorghum bicolor
  Clone ID: SORBI-28MAY03-CLUS46891_1
tggccctccggcgcatgcaagctccgcaggataccatggaacaaggtattcataacactgaacgagtaagggacagtgcaagcggaagatataaggatcttaagataccatgggaatggatgctcgactctggagtcataagccaactaaagaaggcttccttgaagcttgcaaaagagtacatgaaccgcattgtcaacacactgaagtcagatccatttgcgaatgacgaggagctacttctgcaaggtgtccgctttgccttccgcatacatcagcttgctggtggctttgacgaaggatgcagaaaagcatttcaagaactaaaaacttatgcaagcaagtcagagtgatcagaattcaagtgcgtccaaataaagttgagatcacacatagattatatgagacacatagattattaagttttgccgaggttggctcaaaggggactccaccaaatcttgaggacaacgctcaattttataaagtttaatttatttggc

SEQ ID NO: 6563 - DNA, 580 bp, Sorghum bicolor
  Clone ID: SORBI-28MAY03-CLUS46953_1
tctggatatgtttgtttgtaatcagaaatttatttaccagtttcaaggtacatatggtatagccaagaagaacaaccaacaggacatcatggatacacttgtgatcagttccctggtaatccattgtgattcatcggttttaactgtagttgtgtgctaccgtggcttcagctcctcactgggaagctgcataatagcatttcagatctcaagcaacattgcttcccagcctgatttggcgctccactccattgttttgagggaaagattgtgatacggtggacaataatcaagtctgatgtagttgtaatagctaatctgtaattttagtgtacatggatagattgttctttcttcagagtcagaaggtttgcaaatgtttgcatgccatgctacagcgtggtgcgatgtttaaacaggacagccatacaggttaccagatctgagttagattgggcagagagggatctgagccatttcatttgctctttgcagagcatgaatgtaaggggttgtgttgtgaaatattgaatttgttataggtatttgtgcaataaattaagttttgcttaattcagtg

SEQ ID NO: 6564 - DNA, 657 bp, Sorghum bicolor
  Clone ID: SORBI-28MAY03-CLUS4701_1
tcgatctccgggaatggaggcatatgaaggcatgatagttggtgagcactcacgtgacagtgatcttgaggtgaatcctgtgagaactaaagaacttacaaacatccgtgcccctggaaaggatgaaaatgttcgtttgtctccacctcgattgatgagtttggaagaggcaattggatatgttgctgcagatgagcttattgaggttactcccaaggttatacgtcttcggaagaagtacttggattccactaaacgtaagatgatgaaaaacaagcccatggattaaaactccagagacaccaaattacatcaagcactgccagtactactgtataagttatcatccaaaagacagcacttatgtataggttggtgttcaatgttgaagagcaaccaaagttcttcaccagatgacacattttgccagcagtttcgcccaggttttaggttcacacagggttggaatgatgtttcatgtggttgggtactaacagaataagcccatcatcgcagctactggaggcaggatccacgccgtaaggtggttgtatctatttataacctttttaacggtgatattttaaacacccatagatatactttgaagggtgtattattttttggaagttcaagaaagaaagtaaagaaaggcag

SEQ ID NO: 6565 - DNA, 732 bp, Sorghum bicolor
  unsure (1)..(732): unsure at all n locations
  Clone ID: SORBI-28MAY03-CLUS47027_1
tgcaatgggaaacgagcgagctgcactcaaagtgaagtccgagttcaaggttcntgataagaggtggtactggcttaaaacgtgcgctttagccacagttggaaactgggatgctttggaaaaattttcaagagagaaaaggccaccaggaggctataaaccttttgtggaagcatgcattgatgctggtcaaaaaaatgaagctgtcaaatatattccaaagttagcagatcctcgtgaaagatctgaggcatatgctcggatgggcatggcaagggaagctgaagaagcagcctcacaagctaaagatagtgatgagctatttggccgcctaaagattacacttgcacagagcagtgctgccgcctccatttttgacacattgcgggatcggctatcttttcaaggagcgtattgatctacgtggttgtgttgtagttgtaggcccggatgtgcgcctttatgttttgagcagatcggccttctatttgttttttgctctgttgtatgtatgaagatttaacctcagtgtgaatagatgtccatagaaattgccggtcacagaactctacagcgagagcacgtgtggttcaccagtgacattttggatttctgggatcgaggatgcgtagacccgttagctggacgaaggaagtggcgcgggtaattttctgccccccgtttgggacaccccgtgtgccaacttttgaatgagaaataacattttgaatt

SEQ ID NO: 6566 - DNA, 863 bp, Sorghum bicolor
  Clone ID: SORBI-28MAY03-CLUS47030_1
tctccaagtttatgaccccttcagccttcatttttctatatgagaacaatctcttcttgacattccgaaacagaactgtcgctgtatggaacttccgaggagagcttgtgacttcatttgaagaccacttgctttggcatcatgattgtagcaccaacaatatttacatcactagtgatcaggatcttattatctcatactgcaaatccgaagcagtggctgaggatggtacagttattccagttggatccatcaacatgagtgagattatgactggcaagtgtatcgccaagattactgccaatgatcctgccctaagtgtggcccctcacagaaatgatcgcagcaagcggtccttgggctggagcaccgttccagaagctctggaggatgtcacagcactgttttatgatgaggacaggaacgagatctacaccggcaacagtcatggactggtgcatgtatggtcgaactagatagtaacatgtgcatacatttcgcccttttggtttgacttggctagcttgacttcattctgtataatccccggcttggggctcacctagcttttgtatctggcaatagaatgtgtttccttgagcaattgtgaatgcaaattgttcttgtaaatatcctgtgttcgtctaccttactcaagtaacatagaaattagcctccaaatctaactttgttggatgcatcctgccatgtttctggcagaaagagagtgaagacctggagctctgacctgctgtttatgttattgttattttcacatgtgtaggatttgcaaaatggttgtgttctgttgagagcattgttgtcagaacttgctacttaagttagttgtggttcttttgtct

SEQ ID NO: 6567 - DNA, 782 bp, Sorghum bicolor
  unsure (1)..(782): unsure at all n locations
  Clone ID: SORBI-28MAY03-CLUS4712_1
gtcgacccagcgttcttgccattgtcctaacctgttccattgcgggggggtggtgaatgcatattcagnaaaactctgattatgaaaaagctgagctattgatgaaagatctgaggtcctctggattaacaccaaacaaggttatattgaccactttgttaaaggtgttttttaaaggcggtctctttgagaaggctggggaactgctaactgaactggaagcctcaggctttgcacaggatgagatgccatactgcatattgattgatgggcttgtcaaaggtgggaagatacaggaagcaaagattctatttaatgaaatgaaagaaaaaggcgtcaaatctgatggttatgcatttagtatcatgatttcagcattacacagaggtggtcatcatgaagaatcaaaacagcttgcaaaagaatttgagtctgagaatgcatcatatgatctggttatgcttaatacatcactgcgcacttactgcagcaccaatgatatggagagtgtaatgaggatgctaaagaaaatggatgaattgaacatatcacctgataatattacatttaataccttgataaggtacttctgcaattcaaaggtttatcacctagcatacaaaactgttgaagatatgcatacaaagggtcatcaattaaatgaggagctttgttctcatgtaatggtacagctaggaaagggaggttttccttctgaagcattttctttgtataatatgttgagatacagtaaaaggacagtacacaaatctctgcatgag

SEQ ID NO: 6568 - DNA, 570 bp, Sorghum bicolor
  Clone ID: SORBI-28MAY03-CLUS47062_1
cagccaccgtgatgatgaagaggaagaagggaaggatcatcaacatcgcatcagtttccggtatcatcggcaacgtcgggcaggccaactactgcgccgccaaggctggggttattggcctcaccaaggccatggccagggagtacggaggcagaaacatcaatgtgaacgccgtagcaccgggctgggtggcgtccgacatgaccaataaactaggggacgatgtggaaaggaaggcgctcgagaccataccattaggacggtttgggaggccagaagaggttgccgggctggtggggttcctggctgttcatcctgccgctagttacatcaccggacaggtgctcactattgatggtggcttgtcgatttgaagggcttcatgccactagctcatttctctccattttgtaatgttctgcatgaaaatacctcaagtacaagtaaaacttattattgataaaaatatactcatgctatgctatttttccttttattctgaggatcttgacagtgttttggctacgtaaaagtgtgacattttcaccggtaacaagattccctaaattt

SEQ ID NO: 6569 - DNA, 647 bp, Sorghum bicolor
  Clone ID: SORBI-28MAY03-CLUS47835_1
gcacgaggcttatgaacattagggctcctacaaatagtagcggtatcaatatgaaaactttgcagccccctcaaactactgctccacatgtcagtgcagctcctgctgtcccagtgccttctatgttgttaaaggacattgctgtgaacccaacattgcttatgcatttgatccaaatggaacatcaaaagaagtcagcatcagaaactcagggtggcatgtctagtgggatgagcaacaatggaattgcaggcatggttttcacacctggcaatgctccaaagaccacagaagctgcacaagtcccctctgttaggccacaggttccagcgcagacaccttctttgaactcacaaaatgatggtggaatccttcgcatgaagccccgtgatccacgacgcatcctacacaataacgtagcacagaaatctgatgcaatggtcttggagcaagtgaaaactaatggaattacccagccagactctcagggcaccaaggaccagactagttcaatgccttctcaaccaactttgccatctagcgttgcaaggccattcacaaacacaaaacatgttgatcctgtctctaattcacagttagctgctacagctataatggctcctacacaacaagctttgggcagcata

SEQ ID NO: 6570 - DNA, 749 bp, Sorghum bicolor
  Clone ID: SORBI-28MAY03-CLUS47881_1
tctggctacttttgccgtctccaccgcccttctccaaagccccaaccgactgccgcgttccctcccaaaccccgcccctcctctcctccagtgacagcctccttcctaagcctgcgcctcctcgggctccccccctccagcccgtgccactgcacttgctgtgccgacccgagctgcggtcgagtgagtgagtaatggagccgcggcggcggcggccaccgaggctgccgctccatgtgctcttcttggttgccgctgcttggccgctcgggagctcagggactggaagctttggagttggtgctgagagcaatggagcttcgtctagttttaggaattcaaggagactgcagcagattggagacagaaacgaagatggcctatttcatctcccacatccacggactctcacgcacaagagcagatctcatagaagagttccagcaccagcaccagcaccagcatctgctccagcaccatcaccatccatgtcgtcaccagaaggctcaccgtctccatcaccacatggttcacaatcaatgccacgtcaatcaacttcgcatcgtcatccatccgtggcccctccacatttggtcaggcctgagcctaggcaagatgaaaatgatccaatagttgatactccacctcattctcgtcataagaattcctggacaacctatggtttagttgcagcggggattgctgttttccttttggtatcagcagctagtattctctgcttccgagct

SEQ ID NO: 6571 - DNA, 1224 bp, Sorghum bicolor
  Clone ID: SORBI-28MAY03-CLUS47897_1
aaaataattgctttgcgtgcggcatcgatttagtcggaacccaaatcgagggtttcgcaagcgagatcgtcgccggtgacagggacgagatggacgccggcgggggcggcgtcttggccgccgtactctgcatgctgctggtcttcgctatcttccccctcctcctctggcgccgccgctccgatgccgccaccgccgataaccaccgccacccgccccagcccctccaggaggatcaagtgctgcacggccgcgcggcggcgcgacggatgcgtcggaggcctggggcgcccggggcaggctcctctgccgcgtcaactagccgcaatgttgtagaggacgacgcggagagtgatgaggaggaggtccccgaaggtcgcaacgtccccagatcctccaaaaaggagaagaaaaggcaagagcgagaggcgcagcgtcaggctgaagaagctgcacgggattcaaggaggagtaaacaagaccgatacgatgagatgaggaggaagaaggatgaggaacgtgaggcacaagagaggcaattggaagaagaagctagggcacggaaaacaaaggaagaggaggctgctgctttagagtttgagaaatggaaaggggccttttctgttgatgctgaaggtacaacagagagtgagacacaagacgatggtcagggtttgctccacaactttgtggaatacataaagaagcagaagtgtgttcccctagaggacctggctgcagagtttaggatgcgaacccaggactgcatcaaccgaattgttactctggaaagcatggataggttatctggtgtgatggacgaccgtgggaagttcatctacatctccactgaagagatgaaggcagttgcagagtacatcaggaaacaagggagagtgagcatatcacatctggccaacaactcaaaccagtttatcgatttggagcccaaggcccagtacgaggaagagaggcagcaagatgacagtgcagcagcgggcacagaaccatgagaattccttggcctggcaccagcaccatgtagcatactcttgtgtttctgcgctcagggatgtctgacttcttaagttgcgctaacatggttctaagttggacactggccatatatgtagtggtataatgtacttgtgctgacatgctaaataccatcataccatgtagaacagagaacttgagggtttgaattgagagcggatactgaat

SEQ ID NO: 6572 - DNA, 596 bp, Sorghum bicolor
  Clone ID: SORBI-28MAY03-CLUS47898_1
gcacgaggaaaacacaggagcagcagctgccattaacttaagccatctcactcactccagccaccctgcagcctctgcaacaagcatcgctgcatgccagcatccacgtagcagctgagctgagctcatggttcagttagcagcgatgaagcgggtgaaggggcgggccccgctgtcagtggtggtggcaatcatcggcggcctggctctcgcgggcatcatcttcaccgaggacctccgctcactcactgagatcatggagaagaagaaggggaaagacaaggagcagaagaggacgacgacgtctgtacatgccaggacgaggacgacgctaacgcggccgggggaaacaaaggtgacgcggccgccgccggcgaagacagcgttcgacccgagccggtgcagcgtgacggaggggtactgggcgtacaacaggtccaggaagctgctttacacggaccaaacttgcccgttcatcgacaggcaggtctcttgccagaggaacggcaggccggacagtgactacctgtactgggattggcatctagacgagtgcagtctcccaaggtttgacccggcggcggtgctggagaagc

SEQ ID NO: 6573 - DNA, 948 bp, Sorghum bicolor
  Clone ID: SORBI-28MAY03-CLUS4717_1
acgggctgttcatgggcggcggcgggaagctcctcgccgcgcagatcatccagatcctggtgatcgccgggtgggtgagctgcaccatgggcccgctcttctacgcgctcaagaagctggacctgctgcgcatctcggccgacgacgagatgtccggcatggacctcaccaggcacggcggcttcgcctacgtctaccacgacgaggaccccggcgacaagagcggggttggtgggttcatgctcaagtccgcgcagcaccgtgtcgagccggcggcggcgacggcgaccagcaaccaggtgtaaaaatcagaagcaaattaaaaccgatcgagctgaagttacgtgcttgcctttttcagtgtgtcatcgcgtattcatatttgattctgtgctcgatcgtatctgccggtactgtttgggcaatacttcgccacttcggagtcgcaagaatttgtctaaattactagaagaagaagagtatggcgacgaagcacgcacgtgtgtgtgttttggttggggtttgtgtgtacatgtgtattttacagtccggatatggtagtggttaggggctagggtttatctttggctaataatgcgattatttttgtggtggaatcttatgatcagaattcgatcgtcggaaggtgtggcgggcagagctgctggtcaagataggtggcttctatgaggtttgaaatagttggacgattctgtcctggggtctttgcccatccatcaataaacttttggcttgttctttcaatctagtgtctttgaggctcgtgccttttatatggaggagtgcatgtttatgtcaaataatattctgccaaaaatgccacaaatatataattgctccaagtgaataactaaaaaaatagcaaatccaattcccctgtaatcttcttcatacctggagaaaacgttgttgtcaaatcaaaatata

SEQ ID NO: 6574 - DNA, 799 bp, Sorghum bicolor
  Clone ID: SORBI-28MAY03-CLUS47183_1
gcacgaggctgacttcccagtgtggcggcaggagccgcggccagctcgtccggctggcccgaggcagcgcaccggcacctccaccgctcccttccccaccctcgtgtcctctcccttcctctctctccccgtgaccatgactgtgtctggcctgaggaaaccctaggtgccatgggggcctccgatctggccgcagcgaaccgaccaggccctgctggtggccgccgacgtggttgcgcgccctccctcgccggtggaaaccagaagcttctctcttcctccgtcctcttcccgatgttgccaccaggggcgaccaagacggcgatgggcgcgaggcgcggcatggcggatggccaccccctctctctcccccgcacgaggccgcggccgcgtggcccccctccttcccctgctcaggcgggtcagcggtgcagcacagcgtggcgcccgcgggtaccgctggtgggcgcaggtgcggcctgctgtcacccgtccaccggtgtggcttcttgtggtcgggtcctcatctctttgccatggctcctaatgataaaggcaccaggtagccttactctgaatctgatttagcctttccatatgtatattctctgtgtatcatacatatttgttctcaagatatatttacctgatatattgtaacttctaattaaatttgtcatgctacatcgagttctattttaattcgcagcctttccatatgtatattatctgtgtatcatacatatttgttttcaagatatatttacctgatatattgtgacttctaattaaatttgtc

SEQ ID NO: 6575 - DNA, 581 bp, Sorghum bicolor
  Clone ID: SORBI-28MAY03-CLUS47197_1
gcacgaggcacacactcgcgtttgcacgagggtcccgtgctctcccgtctcaaaaccctcccctcctcctccgggcggcggtggtggcggcggccgggcgtcttctccggcaaggtctccccctactcacgagaaaatatggatggacctgttgatgaccctgtggagaacaacctcaccggaggtcctagtatccttggcaatgaggaagaagccaatacttatgctgatgtgcaagtcaaggaagaaccagaaaagctctatgacgaggaatccaaggacctaatgcaagatgagttgggtaaccaagagcatgcgaacatgaacaatgaagatgtgggaggtcagaacaaagaggaccaagctacccccacagaccacggtgtggaagctggggtgaagcagcaggatgctacagttcctgatgacaagaagtggcctggatggcctggagagagtgttttccgtatactggttcctaccacaaaggttggtgccgtcattgggcgcaaaggggatttcatcaagaaaatgtgtgaggaatcaagagctcgcatcaaggttcttgagggaccaccagc

SEQ ID NO: 6576 - DNA, 583 bp, Sorghum bicolor
  Clone ID: SORBI-28MAY03-CLUS47198_1
gcacgaggctcacttacaaaacatcacctttaatgctaccgctatatgagtgaggaggtaggagacatatatagtgcacgaggcccataccaccatactgtaacctcgtctcctctgatgagaaagagatgatgagagagggtgatgcatgtgttacgcttctaagaagcaagctccatggtctggtcgaaaggaaccgtgctctggaagaggagaacaagcaattgagacaccaagtgagccgattaaaaggtcagatctcctctcttgaaggccaggatactgataagaagatgctatggaagaagctggagaattctgcaaccagcatcagctactccaaggaaaagcagtttgtccaaagcaatgatgatgcaaaggaagccatggatctcaacagctcattgtgtcacagaaggcagcaattctccagggcaacactagtgagatcaagggcgccaagggttccaaatccaccgcccaatccgacatgcacccaaccaaagacaactgtcagagaggaaggatgcatggcccctcctcctcctccaccacctccactaccttccaagttgcagaggag

SEQ ID NO: 6577 - DNA, 741 bp, Sorghum bicolor
  Clone ID: SORBI-28MAY03-CLUS47211_1
gcacgaggcactgagctgttccgtttcttttccacctttgcgttttgtttccattcaatagagaattcctttgtgcttgtgccttctctgtagctttcaggagaataaaaatttggaccttctctcgcaccagcgttctttccttcttccttggtttcatgctgacaactagggctgatcttcaggagggcctgttcttggtttggttcctgagagtgattcataggtctgggattatatattggtgtcgttcttgtttttttggtgctcatccgttgctaaagaagcaaaccatcaacccatcagctttactgcaagcactcttttgcctccttttctgttcttggtgttcttggtgagtcacagtgccagacagagtttcttctttaggagtcgtgcactatgggtaattgctggtttaaggggaatccatactttaacagggtttcttccaatgcaaccaaatcagaatctcccaaaattcagagcccatcggagagaactgaaaaggaggactgccagctaccatccaacccaaaagaagtggaggcgctgagaaaggatacagcctgcaatcctttgatagcattcacatttgaggagctcaagagaattaccaaaaatttcaggcaagattcattactaggggggtggtggatttggcagagtctacaaaggtttcatcaccaaggatctccgtgaaggattagagatagaagagcccctgagagttgccgtaaa

SEQ ID NO: 6578 - DNA, 622 bp, Sorghum bicolor
  Clone ID: SORBI-28MAY03-CLUS47262_1
gcacgaggccgggcttcaggtgcggccactcgctcaccgccgccccgcccaccaagggccacggcccgcggctcatcctcttcggcggcgccaccgccatcgaggccggcgcgtcctcgggcctccccggcatcaggctcgcgggggtgacgaactcggtgcactcgtacgatgtggagaagcgcaagtggactagattacatcctgctggagagcctccatctccgagggccgcgcacgctgcagctgcagtgggcaccatggttgttttccagggtgggattggaccagcagggcactcaacagacgatctctatgtccttgacctcacaaacgacaagtttaaatggcacagggtcgttgttcaaggggcaggccctggtcctcgctatggtcactgcatggatttggtagcccagcggtatcttgtcactgtttcgggaaatgacggaaagcgggtattgtcagatgcttgggctttggacacagcacagaaaccatataggtggcagaaacttaaccctgaaggtgataaaccttcagcaagaatgtatgctactgccagtgcacgctctgatggcatgcttttactttgtggtggaagggatgcttctggcacgcc

SEQ ID NO: 6579 - DNA, 680 bp, Sorghum bicolor
  Clone ID: SORBI-28MAY03-CLUS48126_1
tagctgatctagcatccttgagggcaggaatgcacaagtttgaagcatactacattgataaccttgtggggaataaacaagcttacttggagagatctccaataaactctgtcgaaaacttttcatgtccagtgattttgtttcaagggttggaagacacggttgtatccccagatcaggcaacaaaaatatacaaggccataaaggacaagggccttcccgttgctttggttgagtacgaaggggaacaacatggtttccgcaaggctgagaacatcaaatttaccttggagcaggagatggtgttcctggcaagattagtgggaaagttcaaggtggctgatgacataactccaatcaagattgaaaactttgattagtccttgtaaacgtttcaaacggcaccagtccttattttctgtttacctgctatcaactgctgaactgatcagcttagatgcaacttggtgcacctcttgggcagatttgcccagctgttctttcaattgaaatatttgtcttgttcgtttggttgataagccatgacagaaagtattgttcgctgattcgttgcgagagaaaaccactgttgaatgactagtagattcagcgtgataagttcagagtgaatgtcattacgagcaacaattgaagcaaagctttcctggtgttggtctgtt

SEQ ID NO: 6580 - DNA, 400 bp, Sorghum bicolor
  unsure (1)..(400): unsure at all n locations
  Clone ID: SORBI-28MAY03-CLUS48162_1
acgacaggatgagaagcgaagaggagtagntgcgggcattgntgcactttgcatagctgcagcggtgatctcttcatctgttgtctacctttggtggaaatgggtttcgcttgtgaagcgtccaatggcatgaggatcgagtacgtctgatgtatgtatatagccgattcttcaatttccatggcatgcgaatgggcccatgttttttgtctgtgcgtgtgggtgtttcgtgtgctgaggttagttgcaagcgtagccaagatgacatggatgtacagtggcctttgttgtgcgccgagtctgattttaggtctccagtttggtttcacgatgattgtaacccaggaaattatctgacattctactactaatataatatgcaaatttctttgatcaanct

SEQ ID NO: 6581 - DNA, 498 bp, Sorghum bicolor
  Clone ID: SORBI-28MAY03-CLUS48095_1
tccccagggggctcgtccactaccagaagaacaacggcggcagccccgccgcggtgctctccgccttcgacagccagctgcccggcacgcagcccgtcgccgaggccctcttcggagccgcgccgcccgtgcccaccgacgtgctcgccaggagcttccagatcgacggaggactcgtcgaggccatcaagtccaagttcccgcccaagtaataaaggcctgccatgttcatgttcatgttcatgcaatgcaagcgccaggtcgtcgatcgatcgatggtattattaataacgaaagtatcacttcgattgtattctagccgtaaagcaaggtgtgatgggtcatttcgttgggttctcgtctttagttcttggtgaggtcaaggtcatggcaccgacggttcgcagttgttgcgcctgaatttctgcatgagccatatttgtacgtgtaaggtggtgtgtatctttcaattaatgcaaatccacagaaatgagggcc

SEQ ID NO: 6582 - DNA, 744 bp, Sorghum bicolor
  Clone ID: SORBI-28MAY03-CLUS48199_1
tgacatgttcatcagtttcatccataaccttgagattgacacggaattaagtaggccctgtactgtggagggtggtactgcaggtatttcgtcagaatctaccttcccaaatgatccacaaccgaacaatggctcaagtgttactactccaggtagatgcacagaaaattctgagaccgaggcatacgacactgtcaacaccagagccagtcaggcttctactcccacaagcatcgctgtttctgaaggagatttgctgcagcctgaaagcattgctgacggtatcctgcttaacattgtgaaaagagatgccttgcaggctcaaaatgacagcgtaactgaattggccgaaagctcctgcactgaaacatatgcggaaacttgtgacaccatctcagggtctggcactgctgaagataacaaggatactgctgactcaagcaatcactcacttgatattgatgcttttgtagtttcgcatcaaccttcagctgatgattagattcttcttgatttgagaggtcattgtatagcatgctcactacagcaacgctcacttgctctatttaaagggcaggggtagcgtatatgtacggatgcaaatcggcatataggccacgggtttagggatacccatacactatgttaatgttaatatttgcattcattgtgaaattgttggttgatgcatgtgttaagatgtaccgacacgtttttgcccaagtgttggaaaagacagttttt

SEQ ID NO: 6583 - DNA, 1400 bp, Sorghum bicolor
  Clone ID: SORBI-28MAY03-CLUS4743_1
gtttattccagcccccccaagattatcacaagttgataaagctgctctgccttcttcagaacagacacatacatctccggctactaattctgaagctcaaggggcaactacttctaggaaggtcacagtcagctcagtgttggaggtttctgcagcatcgaggccttcaagtgctcctgtgttaccaacaccaagatcaactgcaccagctgcttcacatattcaaacttccacattgctatcccgctcgatgagtgaagcagctgggagaaggtcagtaaatgatccttccttttctgccccatcttatactccacagacctaccgaaatgcaatagttggtaagactggtctggctacaacctctgcaagccttgcatatcagtcttcttctctgggtcaagataatgctccatcacagcctctatcagcatatgcatcaagtacagcagtcatgatgcctcctgctggaagcgctgagcagttgtcagctaggcatggattcaggtctgggtctggtaagttagaaggacatgacagctggcagcagtggaaaggtgacagtaatgttgatatgcatctctggagggatcacgctccttatcaacaaatgaccaacagtcaagcatatgaccaatctctgagggacgatacttatcatcaagcatgcagcagaggaacagagaagttcagcatgcatgcaggactgcaagctaggcagttccaaaccgggacacctgccagtcatgtctggcaccaaccacaggggccagtggcagaagaatttccacaccttgacatcataaacgatttgcttgaagaggaccagatcaacggcagtataccagagtcatttcgtcaagattacaatgtgtttggcctgccgttttcgccgagaggaaatttgtcagatatggaagtggcttctgttagaagccccgctcggttcaatccaaccaagtacgatggtggattctcgggggcttatgacataaatgctgtcaatgggttgagggagcggcagtttccctcgttagatagttactctaatggcctgtctgacgtgagtgcttcaaagccttggctgaatggctctgctagtccatcggtgagccttggggttaacgcaaacggataccacccccaggtgggggactaccccaatctgggaagtggtgtgaatggagtctccttgtggcgccgccatgccaacgggcgctggtaatgcgagagcctgtatacaatcatacagtcagaataatgtttgttgtaacagatggtttcaggcctgagctgatgtgccatgtaattaaaagttttaagttttaaaagggaaagaaaagagatacatcatgtaaagtctgcgccttgattaggctaatttgagtgcgtttctggtt

SEQ ID NO: 6584 - DNA, 656 bp, Sorghum bicolor
  Clone ID: SORBI-28MAY03-CLUS47452_1
tacaaggtgaacagttgcatgaacatggggaacaatacgccgaatttcatggcccctgttcatcccggtgatctcatgcaaagcattagcaggagtgcgcagccaccagcattggctcccattccgcccttgaccgagtccgatgtggcacagccgcctttgcctcctgccagatcaaacagcagtacagttccgacgcaatcacccgcgagcaggacgcatgcctgtgctgctcacatcccagtccttgtcacactggcaatactttgcacttggcgttccctggtctgagcttgcaatgcaggcagagctggagcaccgatctactaatcagatattcttccccacctgtagcagtagttcgtttgttcagtgaatttgcatctaggggtctgatgcggaatgcctatgacactcctgtgagctctccctgctgacatttcagtacatatatactatgtgggatgggtaatatattttccatttcttcttctcaagactattgaccatgtcctcacaaagaaattaggctatggtcatatgtaagcaagtaagcaactcagattgcatagttgtatgctatctgtttgagccctatgagccatgaactgttatgttctgaacggctgagaaatatgaaaggatggatgtgtttc

SEQ ID NO: 6585 - DNA, 685 bp, Sorghum bicolor
  Clone ID: SORBI-28MAY03-CLUS47500_1
aaaggatactaggctacccacataaccatacaaatctgtttgaattaaaccaatctgatagatttggtgccatgaaatttgcatttcagactgatacattgtcatattttctatcagtcctgaaaggcatgtatccagatggaataagagtgctatccatctacagtggcattggaggtgcagaagtaacacttcatcggctaggcattcctttaaaatgtgtaatatctgttgaggaatctgaggtgaataggaaaattctaagaaggtggtggtcaaaaactgaacaaactggagtgctaaggcagcatccgggaatctggaagctcaaaacacacgtgattgaagacttggtgaaagagtttggtggttttgatctgattatcggtgggaattatacttcttgcaaaggtggtaatacagtaaatacgacaatgggcttggattccaaccgcttctatgagtatgcccgtgttgttaaaagagtaaggactgcagttggactcagttgatgagtccatctttgatgaagagcgcacatcttcataaaactagcctgtaggaggatgtagaatcatctgatgtgtaaatgtaggatgctatgagtaaactttgacaagaggatggtacaagtaaacttgacaagtcttgggacttgattattgcaagtgattgacctaccttc

SEQ ID NO: 6586 - DNA, 728 bp, Sorghum bicolor
  Clone ID: SORBI-28MAY03-CLUS47716_1
ctactgggtctctttctgtctctgactctctctctcctaccgccgccagcccgccaccaatttgccgtgtctcaccgccggcgacctctccgccggcgacggcgcgtaacaaaccagccgtcctcacatccaagtctccatccaccagtggcgccgtccccctattccgctagtggtattgaactgctgcagagcggagatccgtccgcccatgaccattgacccaccagcaggcccttgatcgatctgtcattctcttggtaattaacccacgcttgctcggaggaacgctgcagggcgcaagaaatgcagagggacaccggcgccggcgaccggacgccgggcaccccgagcccgacgcacggtggccgcctcaggcaccggaagcgctccaacgaggtgcccagcgatgtgaacacggctaatggcgccaacctgctcttgaacgatcagaacaagtacaagtcgatgctagttcgtacctactcctcactgtggatgatggctggtgtcgtgttcttgatatatatggggcatctctacatctgggccatggtggtggtcgtccaaatcttcatggccaaggagctcttcaaccttctccggaaggccaatgaggaccggcagctcccagggttcaggatgctcaactggcattttttctttaccgcaatgctgtttacctatggccgcttccttagccgccagcttgttaacacggtaacctc

SEQ ID NO: 6587 - DNA, 582 bp, Sorghum bicolor
  Clone ID: SORBI-28MAY03-CLUS47741_1
gcacgagggtcgcagcacagtcggcacgagggttcccccctcattttccttccacccgccgtcgcggcgccgatagagcttggcctgaaaggcgtaggtggaggaggggatggaccggatcgtcggcagtaagtacaagctaggccgcaagattgggagcggctcctttggggagatctacctcgcgacacacgtcgacacctacgagatcgtcgccgtcaagatagaaaacagcaaaaccaatcatccacagttgctatatgaggccaaactgtacaatgctcttcaaggagggactggtatcgcaaacataaaatggtgcggcattgatggcgatgaaaacattcttgttatcgatttactcggaccaagccttgaagatctgtttgtttactgtggccggagattctcactgaagacggtcttgatgctggcagatcagatgataacaagaatagaatttatgcattctaaaggctatctgcacagagacatcaagcctgataatttcctcatgggccttggtcgaaaagccaaccaggtttatgtaatcgacttcgggctcgcaaagagatatcgtga

SEQ ID NO: 6588 - DNA, 480 bp, Sorghum bicolor
  unsure (1)..(480): unsure at all n locations
  Clone ID: SORBI-28MAY03-CLUS47727_1
gcacgaggtaataatcggggcgcccgcacccctagtcctcgctcccacacccgtacgcttcgccgcgcgtcgcttttgccacccatacgccagcgccaccggccgacgtcgcgggattcgccggggacgccacgccaccggccgcaggcgaccaggcagacgaggaggagggtggtgttggtagggtgggggcggcgctgggtggncgacgccgcgggagatgaaggccaaggccctccccttcatcgccttcgagcacaagcgagacgcctatggcttcgccgtgcgcccacaacacctgcagcggtacagagagtatgcaaacatctacaaggaggaggaagaggaaaggtccgacagatggaagaattttctggatcggcaggctgaggatggagaatcatctggagaggatgccaaagttgcaccatccaacgaggatgaaggagctgctggcaagaatgccaggacagagccaag

SEQ ID NO: 6589 - DNA, 519 bp, Sorghum bicolor
  unsure (1)..(519): unsure at all n locations
  Clone ID: SORBI-28MAY03-CLUS48356_1
gcacgaggcacaacgccccagttccctccgtcccttcccctgccgccgagagccgccgcccaggagatcacgcggctcgtcggtcatggagtccgtctagcctccgctcggccgcgcccgctccaagcagccgcagcggtgatcaggaactcaacttattgcaggttgagatgaaccgtccatcgaatttcatgcctactcctgaacaggatgttctggatgtcaagcccttgaggacattggctccaatgttccctgcacccctcggtgtcaatacatttaaccagtcaaccacgccaccattggtattcgtcactcctgctggacaatttcaagggggttttgatgcttggagcaattctgctgctaaatcatttttcgctttcggcggtgaggatgctagtggagggaaggctcacaaatttggtgatcagaatactggtggtggcaaggctcccacttttggtgatcaggatgcttttggtagccagaatatcgccactggtgtgcangatgctg

SEQ ID NO: 6590 - DNA, 865 bp, Sorghum bicolor
  Clone ID: SORBI-28MAY03-CLUS4834_1
gcacgaggcttgcttggtgttgaaaccagaagtacaggcttcattttctccattggaaaagaacctctgaaaacccgtccttcagtgtttgctctgggtgaacgaataaacattctaaaggaaatcgatcagccagcattgatacctcatatagctgaagcgaagtcacagaaatactcatatgaagttcttttcagaagcttgcagaaacttcttattgacactgccacttcagaatacctgtttaccgatgatttttttggcgaagaatccatattccatgatatatttgcaggaccgattcaagttgtagatgaacacttcaatgctgtactcctgaactgttatgatgcaattggcataatgcttatgatcagaataattcatcagcaccagctcatcatgtttaagcggcgaatcccatgtttggactcttacctagacaaggttaatatgtcactctggcctcgcttcaagatggtgttcgacttgcatttgaacagcttgcgaaatgcaaatattaagactctttgggaggatgatgtccatccacactatgttacaaggagatatgctgaatttacagcttctctagctcatctcaatgttgaacatggggatggtcagcttgatttaaatttggagcgattgcggatggctattgaggacttgcttgttaagttggccaagatgtttgctaaaccgaagttgcaaactatttttctgataaacaactatgatttaacaatttccattttgaaggaagctggaactgagggtggcaaggcacaacaacactttgaggaggtccttaagagcaacatcgcaatatatgtggaagagttgctcctggagcagttcagta

SEQ ID NO: 6591 - DNA, 724 bp, Sorghum bicolor
  Clone ID: SORBI-28MAY03-CLUS4840_1
gtccaataaaaaggggggaaaaactttttttttcttttttttttgctcccttccccccctcgcttcccccgaatttgatgcttaaaccctcgccgggaggagcaggaggactccaatcccgacgccccgcgccaccacctaccgctgcgcccggatctccgacgccatggccgccgcgccgcaccagaccggccccgccgcagatagcatgattccgctgcagtcggaacctgtacttgagaataacccctccaagagtgcaaacgccaaggaccagattctttctggtgcagagaatgtgtctgcaggcaatgcacgtggcgctagctccttgaaatcgccaaaaggcccgccagagaagcctagctctgtcggaaaagctggagaacagccttttgtctaccagcaaaatgtgtatgcaccgcagccacaaccactctatcctggaggatacatgaatccttcaggacagtgggaggaatatccccattatgtgaatatggaggggctccattccgtatctcccggaatctacaatgacaaccagtccctcatgctatctcctggatatgcaagcaacccccaaatgatgtatggagcatattctcctgtttccaccgttggagatggccaacaatacttccctgtgcactatcccttctcaagtccttactatcaaccaccagcttctcctagcatgggatattcaagctctgcgactggg

SEQ ID NO: 6592 - DNA, 614 bp, Sorghum bicolor
  Clone ID: SORBI-28MAY03-CLUS48444_1
gcacgaggcataggtagacagtgttcttcttgtggtgaccttgacagagtgcagagatgggagaagctgaagaagcaccaggagtcagcaatggtgaggcactggagctcctcatgtccatggcgtcctcttcactggcctgctctgtctcacagttcccagcaaagtggcagtccatcaaggacaagctccatcagctctgctgcagcctgaattcactgtgcagcggcgtcggcggcaacagcgacgtcaacgacgatgacgaagaggagcatcctttgttggccgagcttctgcggctggcttcagcaactgtgaggagcatccaggtcgttgcttctcagtgcagcgacgggtcatacacgggtggaaggcttcgtctgaggagcgacctggacaacctgagctgcaagcttgatgcgcacatgaagcagctcaaggagatggcttcgtccggggcaccctcgccgtcgaaggccattgtcgccgtcaggcccagcgccgaggccagcgtaggtgagaaggcgttctacctcaaggatctcttctccaggatcaggatcggtggcaccgtccagaggagccaggcactggccaccatcagagagctcttg

SEQ ID NO: 6593 - DNA, 749 bp, Sorghum bicolor
  Clone ID: SORBI-28MAY03-CLUS48458_1
gcacgaggaaaccctcaaggccccatagaagatgggcagtacattatgttatttggtactgttatatcttccaggggaatcaaggttaagtccactttaggttttcttgaggtggttgctggttgttccatagtcgagtctgaattgagctcttcagttgagggtactcactccggagcagagcagaagagaattcatttgcacctcaagaaatttttcagtggcacgcgtttctcttcccaatattttcttaactgtatgtcagcaaagcacaaagagggggatcttgtttatgtcagtgattaaaaaggcgcttgctaatggccattatgagttgaaggaacacacaattgacgctcttgaaggagaaggggaacaaagcactatgtttgacaggaaaccacaccctatatacccatcaaaagcgggattaaaacctagtctgctgggcctttctatctctagggccttgaagatactgaacccggatgttgatcctatgcctcctgatgttctcgttgaattcaacttgcttaatctttttgatgcttacatgggaattcacaaacctaaggatcgatctgaagctgatttagctcgaagaaggcttatatttgatgatttcttttacctccagttgggaagactatttcaaatgcttgaagcagttggtacgcgggttgagaaagaggaattgttatacaagtgtaaaaatcatgagctaaatactgttggtgtagacgattggt

SEQ ID NO: 6594 - DNA, 613 bp, Sorghum bicolor
  Clone ID: SORBI-28MAY03-CLUS47934_1
aacggctgccacaccaacacacacacagacagacgggcgcaggaagaggagggggaagaaccgaaggaggaaggagatgagagggaaataatttagcagcggaagaggaagaagcagcagcacgaggtgggggaagcggcagcggggttctggctgaagtattttaaggtctttattatcagtgataccagtaatgtgccttgcctcttgtacgtgattgtacaaggcaatgaacggaactcatccctggacctccatgtccgggggtgcatgttctaaccttggatatgccagggacatgaatggtaatgttccaattagcaccacaaattcctctgggccaagtattggagttagctcgttggtgactgacgccaactcgtcactttccggtggtgctcagttacagccaagtactagcatgaatggtgattcattgatgcgtgttcctgcatcaccaatgtcattttcatccaataacatctctggctcttcagtcattgacggttccatcatgcagcaaagtccaccccaagagcccgggcggtatcgggcggcttcagctgtttcagcacctcctccgtgcgctgctggcgctgcattgcatgctcag

SEQ ID NO: 6595 - DNA, 487 bp, Sorghum bicolor
  Clone ID: SORBI-28MAY03-CLUS4794_1
ggagactggtgccaagattgtcattagggggaagggtagtgtcaaggaagggaagctgctgcagaagagggacctcaagccggatcccagcgagaacgaagacctccacgtgcttgttgaggcagacacacaggaggcactggacgcggctgctggtatggtggagaagctgctcaccccggtggatgaggtgctcaatgagcacaagcggcagcagctccgggagcttgccgcacttaatggaacaattagggatgatgagttttgtaggacatgtggtgaggctggccacaggcagtatgcttgccccaacaagatgaacacgtttaagagtgatgttcagtgcaagatctgtggggatggtgggcacccgactattgattgtccggtcaagggcacttctgggaagaagatggacgatgaataccagaacttcctggctgagcttggtggtgggagtgcacctgagtccatgaacaaatctggt

SEQ ID NO: 6596 - DNA, 638 bp, Sorghum bicolor
  Clone ID: SORBI-28MAY03-CLUS47979_1
gaaaagagaggctttgttgaagctcattcagatgatggcttacttgaaatatttggtctgaaggaaggttggcatgcttcatttgttatggctgagcttatcaaagcaaagcacattgcccaggctgcggctatcaaatttgaaatgaggggtggcgagtgggatcgagcatatattcaaatggatggagagccatggaaacaaccactcttacaggagcactcaaccattgtggaaataaacaaagttccctatcattctctcatgataaatggggagtaatgagatttccctatgtcaatcagggttgcattcatagatcgttagaattgtgtacagttcaggagcagcgcgcactagattcttagaacttggtcgactgcagcgaggatgcatcatgcatgttcggtggcctttatggtgccatggccggagcatgatatgacaccatgcattgttgtattgtatcatatgcgttgttgtatcccaagttctttttttaaggaaacaagcttgatctgtttgtattgtaacgttgtgtgtcaaatgcaaaagaataatctggtgaaaaacactgtattaactgtcaagttggacagtttgccgtttgcactgtcctatagaatgtttatttgcgt

SEQ ID NO: 6597 - DNA, 695 bp, Sorghum bicolor
  Clone ID: SORBI-28MAY03-CLUS48012_1
gaagtttcaggggctttgactgataatcccatcggctggttctctaccaggtacctttacaccgacctgtactcatcgctgatgtggaccggcacggagaccccagaggggagcgggaactacacctcggccgtgaaaccggtgagctgctccaagacctcgccgatcgcctgcgagtccaccactgggagcacggacccgctgctcggatacatcttctcgtttggtgaagataacagcagggatgtcttcgttctggcgagcaagggcgtgtaccgagtcgtcaggcccagcctctgcggctacacctgccccgcagagaaactgccgactggcaacggcacgacaccaggcgggccttcatctttcgctcccgcgacacggctagcgaggtcggtggcagtcgctttggcgttgattctatgtgtattgttgttgtaaccttgagatcatgagatgtgcagccctttccccaccggtggtatcatagttccctttggcggttgctgtgcaggcagccttggcaggcgattcagcttgtattgcgtgtaatgtagtagcacgattggttttagctgaagttttctgggaaagcacgtcccccatagcgtgttttgtcctccttgatctgctcataattttggtggacgctggaagcattgatcggtgtcttaaaggggaacggcgtcttttga

SEQ ID NO: 6598 - DNA, 801 bp, Sorghum bicolor
  Clone ID: SORBI-28MAY03-CLUS48037_1
aagaagttcctcatttctacattcagtgttttaggaactgaggacgtgtcaaatggagatgaaactcagaaagatggcttttctgtcagcactatcacgttcaaatagggggggatccctttgcatgttgtgcgccattgctcttaatcctctgccggactctgagtcgttgcttggggtttttaggctacttgacctcctcgatttcttttaaacatttgttcatcactatctgcacttacagtttcttctctttttaatgtagttcccaaatctgtaaattgagaagcattgctttagtgctttttatattgattctaagcgatggtcccatatatccactataatgtggctacatcacttcaagagcttttgcgtgtacgggttcctgtgtagctgtatagatgtgcctattcaagtgcttatcgatgtgaagggactttgccactatgatgactagcaatcctttgaaaacctcaaagttgtaaaccgtgtagttttctactattttgtctctaggtctgcgaacctactactgccgtgagacatttggatagacattctaagctactggcgaaggcgttccataatcatattttctgattgtaaactgtaaggctatataatgtacaatggaatgaaaccagaggtgaaatatggaagatgagatagctgcataatttgtaccatgcatgttgatatgatatgcttgatattagatgctaatgccattgcaatatgatatataccaatgtttgtgcttagattagaaccttacaatttgattatattattataatt

SEQ ID NO: 6599 - DNA, 920 bp, Sorghum bicolor
  Clone ID: SORBI-28MAY03-CLUS48093_1
gcacgaggctgtggtgtcctccatgaagcagcagatggtggaggagctgctcctgtgggtggaggagctgctcctatgggtggaggagctagagcaggtgaatgcatgactgctcggcgagaaggaggccgcgaagaaattgaatggcatcttcagaacacactgggtgtcgcatcccattcaaagatatatccaacaccaacaatgaaagtggaccaatgacatccaatttgcagccagatgacagtagtagcaagcttaaagaaggggaacactacatgctcgtgaacggagtcggtaccaatgctggcttgctatgtgggggcctgccgtccttctccgcagctgatgtcgcaccggagatagagccgacatgaccgatgtggacctacgaacacctgacatgaccgatgtggacctatgaacacctactgatcaagcattgtagtccgtcgtgaagcccccgttgcccattccagatgtaggacgggttctactacatggaatccactgtggatagctgcatcgatcgactaagtccactaggcgtactcatttgcttcttctacatgggatcttttacttgagcctgcggtttgaactacagagtcttctgttcgctcgaagatcaagcctcatattggattggatacagtactaaccgtagaagcatatgccagcagccaatgatgaaacacttctacgagtatgtgatgatgaagccatatgcctcacaaatcaaagttggagaagagataggcgaatcaaaagttggagaaaagaacagcagcatgtaaatttctataactactgaaagaataaaaatatcctttgtaactatgtctcatggaaagttacgttgaagagaactgagacatgtaaatctctatgattaataaagaaaaaagatattcctttgt

SEQ ID NO: 6600 - DNA, 792 bp, Sorghum bicolor
  Clone ID: SORBI-28MAY03-CLUS48978_1
gcagagcaagacttggagtgtgattgagaacatgtctgggggtttaaatggagtgagcggtgcccccccacttgttgcagtggtcaagaaccagctgtatgctgctgattacagcgagaaggatgtgaagaagtatgccaagcagaataatagatggatcacccttggtaaattgcccgagcgatctgtgtccatgaatggatggggccttgcattcagggcatgtggtgagaggcttattgtaattggtggcccaagaacaccagttgggggcatgattgagctaacctcttggattcctgatgacaagccacctgtgtggaatttgatggacagacggccatcaggaaattttgtgtataattgcgctgtgatgggctgctgagttcacttcatcaagagtctgcacagtgatgtttacaaagagaggtatgcacaaaggcaggcctgtttagcttcagcactccttcatgagtttctgcctttgacctgtagctgatgtagttggcatcagcagagcagcagcaggatcttgtaacccttgagttcatacatcagtttccgccccagctaatccatttctttcatttacatttggatcagtcttatgatctagaagatgataccatgcaaaagatgtcataccaataatctagaaacattaaatttcagaggccttccatcattgatgatgacagcaagttttcatattcccttgtctatgtctgcaacaaaagtagtgaccatcttgttattagcatatttctaatttttgagttatcatatatgttc

SEQ ID NO: 6601 - DNA, 485 bp, Sorghum bicolor
  Clone ID: SORBI-28MAY03-CLUS49014_1
aaatgaacgatggaggatacctcaacttctcaagcacccattcctcaatccgccagttccaaaggatctaccgccctctgacaatgatccatgtaggttgctcatggagaggatcagagtccactgggataatccggtggttcaaaaattccatagtttaattcaagaactcgatggggatcagtagaaatgggtttttaacgatcttgatagatactcgatctagggcctgggtagtggtggcactagtgtttttgtttctgtatcgttcctgattgataggttatctgttgtaatttgtaaatagagtagcggcattggttgaagacgtcggagcatattttgatggtgccctggcattttttgcttcctggtgtttggaggttgctgtaagactttgtcagaaatggcaggtagttaacgtctgtcatggttcgtctggtggctgagtcgtggcagaaagtactgttggctgatttgttgtg

SEQ ID NO: 6602 - DNA, 703 bp, Sorghum bicolor
  Clone ID: SORBI-28MAY03-CLUS48990_1
catattatgatatttcgtcatgaatactaactacatgcataaaaggattaaaatattattgagattacacttatatttatatttgtcatgcttaaagatgctattatatttgtctgctggttccgccactgtatataactctattaaactgttattccagaggaggttttccaaggttccaacccaggttcctactcctatccgtcccactctccctcaagctattgcccaagcttttgaagagtttggttcattttggtcaccaaagcctgatatggctaaggcagttcaatttgcggaggagatctgcaaggtgctgaaagatgtaccggaagaagtggcaatagccaaagcttctgggctagtggctgagttatctagggtcctgaatgtgtccacatttgagacgaggttgtctcaggctgagcttaccatcaagacttatatgtagacgaggttgtctcattgcgatttaacgctgtgtactaatagtagcgcgatgggattgaattctgctggtagcgatgaacgctgtgtagtgaattgtgctggtagcgatgaacgctgtgtagaagtgcgtgtggtgcccattgaatgaaccctgtgtgttcagtccaatgtggctggatgatggaggattacttttgtgtagttacaaacaagtattttcgttgctttaatagtaatgaaattctgcatttcc

SEQ ID NO: 6603 - DNA, 889 bp, Sorghum bicolor
  Clone ID: SORBI-28MAY03-CLUS4894_1
ctgttggccaggctgggactcaactcaacgcccccgatcgcctccgtctcccaatcccgagccgcccgtgcgcccgtccgccgcggccaccacccgctccgcccgcccctcctcgtcaccagcggcggcaccacccctctgctccgccaccgcgttcacgcgctcccgtcgctgtcggccccgctcccctatttatatccccaccccatcccacctccccgcctgccttaggcaggcgcgcatccagctcctgccccccttttcctctcctctcctcccgaataaaatttcctggacccggggcgcgctctcctcgctcccaaaggaaggaaacctatctatcattccggcggccgatccatctatccttccggccagggagagcaaggaataatcaatcaatcggccagtggatcagtcggaggaggaggaggaggaggagagccggagtccgtcgtccagcgccgcgcgcgggttgatcctttgcgtctccccggccctgctccgcggcgacgccttttgcggtgcttgcgttgcgtcgaggaagcgagcagaatctgcgacgagaaggaggagcacgagaggcatccatcgggtcgcgcgggcgtccgtcgcacggcaagacggcggcgttgaagatgcgggtgctggaggaggacctcttcccctccaccccaggcaaggtgaagatcgagcgggcgggcgccatgaaccggcagctccaccgctgcttcgcgtccaccagcaccatgttcctgtgggcgctgttcctcgtcgccatgacggcgtcctacctcagcttccagtccttcgtcgacacctcctccaagtacttcgccgcctcatggggcggcctgcactgggagcggcagatccgcgcgtccgccgc

SEQ ID NO: 6604 - DNA, 462 bp, Sorghum bicolor
  Clone ID: LIB3476-001-Q6-K2-E5
ccagctcctgccctccttttcctctgctctcctgccgaataaaatttcctggacccggggcgcgctctcctcgctcccaaaggaaggaaacctatctatcattccggcggccgatccatctatccttccggccagggagagcaaggaataatcaatcaatcgtccagcgccgcgcgcgggttgatcctttgcgtctccccggccctgctccgcggcgacgccttttgcggtgcttgcgttgcgtcgaggaagcgagcagaatctgcgacgagaaggaggagcacgagaggcatccatcgggtcgcgcgggcgtccgtcgcacggcaagacggcggcgttgaagatgcgggtgctggaggaggacctcttcccctccaccccaggcaaggtgaagatcgagcgggcgggcgccatgaaccggcagctccaccgctgcttcgcgtccaccagcaccatgttcct

SEQ ID NO: 6605 - DNA, 461 bp, Sorghum bicolor
  Clone ID: SORBI-28MAY03-CLUS54103_1
gtttaacatagatattattagagaacatggaagaaaggatcggtactatgtcattgacatcaactattttcctgggtatggcaagatgccaggatatgagcacatgctcgcgggccgcctcctccccctcgggctaagcaaatacaagaggcatctaagtgggagctgaagcgtggagaagattctacttttgagatggaggctatcaacagatgccagccaggccatgtaacagtggcaactagataggttttccagtttgtacatagcaaggggatgggatgggtcttagcatgaatgaggtgccgatgccttaactgaaggcacataccagaaatcatggaaaaatgcagtgtttgggccggggcagtatctgaagaaaggttttggctccgcacccagcctgtgtaaaatcggttttaactcagtgcccaacctgtggaaatcgttttactgagtcc

SEQ ID NO: 6606 - DNA, 1013 bp, Sorghum bicolor
  unsure (1)..(1013): unsure at all n locations
  Clone ID: SORBI-28MAY03-CLUS54230_1
gcacgaggtacctgtctcacagcgtacaaaagatgcttctgacactcagcagacaaaatccagcagcgtgctggtagacaaaacatcggaggttcaaaatgtggccgagaagcagcatgatgctaaggtgatcaaacctcaggaaccgtgcgtctctgaaaagcaggccagtgaggctgagaaagagaatggagtacaggaaagtcattgcagtggcaatcacaatcagagccatgacgatgcagccaaaaatgtaaccaaccatccaccagcttcaagcttgaaggcaggtgcagaggggaaacagcagtactggaagaaggttgaaaatccaaagcagcatgcagacagcagtgctgctgcccagggctcactgagagcacctgaaaagcggctaaatggagttagcggctctgtgagagcagttccagagggtggcgaggagcagagggtcaccgccaaacttggttctctcaagatcagttccaaggcagtggaggctgaccataaaactagcacagttggtgtggagaagcggctaaatggagtcagcagctctgtgagcacagttccagagggtggcgaggagcagagggtcactgccaaacttggatccctcaaagtcggttccaaggcagtggaggctgaccgtaagactaacacagttggtgtggtgacaatcggctcgatgccggtccgggttgacagttgtgacgtctagtggccagcaggagcttttgtttttggcttcacaattttttgcccttctgggttaatctttggtgcccaaggcttctattttcctttcttttggtagaatgcctgtcttggttggcggttcctagcttctatatgtcattaaaaaagggtgaaaaaaaagatgaacaattaggttctagtttcgttgggtgaaaagcntagttttgcaggcagccattctgatgggtggtggctggtatcttttgtggaaagccccgaagagactatgatgtgttcgttttaatgacattatt

SEQ ID NO: 6607 - DNA, 940 bp, Sorghum bicolor
  Clone ID: SORBI-28MAY03-CLUS5435_1
gaagattgtggaaatagtagattgattcatcaaggacaatgggaagtgctggtacaccgctcagttgattatacagagatcaggttcagggagtagcacctcagatgaggactttgagcgtggtcaagaggaagtacaaaaatgcttaaatggattctctgatgtgcctgcagaagccgtatacactgatacaaaactttcggcaaacatcaatgaaaaaactttcatgaacagtcaaggagatggtaaaatggaatcgccaaaatgtctaaatggagcatctgaactgcctcaggaggctaccaattcaaaaggagaacttccacccaaccaaaatggcaattgctgcatgaaaagtggaatggacaatcatattgctaagggaggtgattctcctgaggcctttttggatgatcaatcaggtccaatctctctcaatagacagaaaacttcatctgaacctgctacagaggtgcctcctgatactcttgatgatgctataacgaaactggagaaagtagcaaacaaaatcagaaatcttgaaagtctcatgcaatttgtgggatctccaccatcaaaggtggcaaagtcctcttggaagtttctggacgacacattagcaaaacacaagtgaagtcatgtttattctgtggctaggatggtgtggtagaatagactgatcgacccttttgtagatttttcctgttggtgagcgagcgatcccttgcagtttgtaagttatccaacttgttaaaggtgcttttggaaagtactgctgctgccaaaaaaacaaaaagtcaatcacacgagtagaaccaaaagttgcttttgcaactactttcgctagtacaatttttgtaaaacctgctttcacaactacttttggtagtataatttcacgacactttaaaaaaaaaaaaaaaaactcgagggggggccc

SEQ ID NO: 6608 - DNA, 787 bp, Sorghum bicolor
  Clone ID: SORBI-28MAY03-CLUS54379_1
gcacggcgcgcggacgacatggtcaaatttggcccatgagatgacagctgagttccgaagtctatgtgctgaagaggcatatttgcagcaagagctagagaaactacaagatatgagaaacaaagcaaaacttgaaggcgaactctgggatgaacagctctcaggctcatctgggcagaactctcatttggtttctaaggcaactcgtctttgggaatcaatattggctcgcaaaggccagcatgaggttttagcttctggaccaattgaagatcttatagcacatcgggagcacagataccggatatcaggatcacagttactagcagcgatggatatgagttcaagtgttccacattctgagttactatcatctcgagctggcgaaacttctccaattttgggcaagcaggaacagatttctcagctattccaaggaaaggaagaagccctttcaagatcagatgataggaatggacgtactcaacaaactgttgatgtagctgaaattcttcgccgctggactcatgctttacagcgtattcataaacaatctcttcatttggccaaagcgaatgatggagaggggcctgacttactgaggagtgcactcgacggagaggccagtactcattctgattcgttaactgcaacattagctgaacatcgccagcatttagtcagtatacagggtctaattaatcaactgaaggaggctattccggcaatgcagcagtctattgatgaactctcagaagaagtgaatagtgtatctattaactccatg

SEQ ID NO: 6609 - DNA, 347 bp, Sorghum bicolor
  Clone ID: SORBI-28MAY03-CLUS54467_1
tatttctctctctcacacacacacccacatatatatatatatatatatatatatatatatatatatatatatatatatatatatatatagcctctgtttcattccttggttagacggagtcgtaagatgggtacactttttgatggtggtcgtaaccaccttatatataacttgctatgctagtgctagagtaggtttcgttgtacgtgaatgatcgttgagctgattgggctcaaatgagcgctgtatctgtatgtatgtagactagaagggaagaaatatgaggcatgcatggatgaatgaatggagtgagttagtcactatcgatcatcacgtattcttgatat

SEQ ID NO: 6610 - DNA, 520 bp, Sorghum bicolor
  Clone ID: SORBI-28MAY03-CLUS49355_1
gcacgaggagaagacgataacaactaagcacgggagcaggggaggaagtagagaggacggcgcgaggcttggccgtgccggcgagttggggcgtttttcctgcggtcggagatgcgaccgttgggacccgggagacagcgcagttcggcttcgggttcgggggcggctcccgcgacggcggccgccacctgagcaggatgtttagctggaacgacgagcagcagcaggtaggggatgcaatatggactgagttcaatgagagtgaggaccatattatgccttatcctaaaggtgcagaagatagtacgactcgcaagaacaatgaaaaagaggtggctagtattgatggcatcactgaacattctgaaggtgttcaaactggacttcaacggatggaaaagcaaactgcaaatcagacaagtgcacatttttcagccacacgaattgacatggaatcctggcctgaccttccttccctgaatcctacacttgatagaaactatagtgatgacaacataac

SEQ ID NO: 6611 - DNA, 821 bp, Sorghum bicolor
  Clone ID: SORBI-28MAY03-CLUS4937_1
caagaattctagaatctctctcctctcctctcctctctttaagaggggatacagagtaggggagagacagagggggcagagagcgatgaacgcggcggcggcggcggcgcggaaggccgcgggcggcggcatggcgcgcgcgccggcgctggtgctagcgctggtggcggcgggggcgttcctgatctcctacaacttcttcgccatgctgttccgcggcggcggcggaggaataggcggcgcggcggcgtcctcggggacgagggaccctgtggtggccatgccggcgtggatgcgcgaggcggcggacaccgaggcgcggcggcggcccttccatgtggcgctcacggccacggacgcgccctacagccggtggcagtgccgagtcatgtacttctggtacaagcggatgcaggcgcggccgggcggggaggccatgggcggcttcacgcgcgtgctgcactccggaaagcccgacgggctcatggacgagatccccaccttcgtcgtcgacccgctgcccgctggcaaggaccatggatacgtggtcttgaatagaccgtgggcatttgtgcagtggcttcagaaagcaaagattgaagaagagtatatactaatggcagaaccagatcatatatttgtgaaacctttaccaaatttggcccatgacgatgatccagcagcatttcccttcttttacattacaccatcagaacatgaacaaattatccggaaatactatgccaaagaaagaggtcctgtcacagatattgatcctattggaaattctcctgtaatcattaagaagacacttcttgaga

SEQ ID NO: 6612 - DNA, 495 bp, Sorghum bicolor
  Clone ID: SORBI-28MAY03-CLUS49377_1
gcacgagggtcgcccgagtccaaggccgtcattggcaaggccggggacggtaaccggatggtcttcttcgagggcccgtcgctggcgcacgaggtggaggacctgctccgcgcctccgccgaggtccttggcaagggcgccttcgggacggcgtaccgggccgtgctggaggacgccaccaccgtcgtcgtcaagaggctcaaggaggtgaacgccggccgccgcgactttgagcagcagatggagctggttggccggattcgacatgacaacgtcgtcgagctccgcgcctactactactccaaggacgagaagctgctcgtgtacgattactacagcaggggaagtgtatccaacatgcttcatgggaagaggggagaggacagaatgccattggactgggaaaccagattaaagattgccgtgggagcagcaagaggagttgcacacattcacaccgagaacaacgggagatttgttcatggcaacatcaag

SEQ ID NO: 6613 - DNA, 788 bp, Sorghum bicolor
  unsure (1)..(788): unsure at all n locations
  Clone ID: SORBI-28MAY03-CLUS49431_1
gcacgaggttggaattaggcagcggccgccgttgcgtgggagagagcaaagtgaaccaggccgaaaccgaagctaccgccaccaccaccacacccgcccaccgcagcaacgccgggcccttctcgtctccctgtcccctagtcccaggaggggatcccggcggcggcacgaggcggcggcggagccggagggaagggggcggcggcgcccgtcccgcccgggtcgaggaagctggtgcagagcctcaaggagatcgtgaaccgccccgaggcggagatctatgccgcactgcgcgagtgcggcatggaccccgacgaggcggtcagccggctcctctcccaagatactttccaagaggtaaagagcaagcgcgacaagaagaaagagattaaagaggttcctgagacaagatatcgatcggcaaatagttctactaatcgaggccttagaagtggtgcagatcgaggtggacggagcaattctgtgcactctagctctactgataacatgacctcaaggccaccagtctcagggtctggaacggcatcagttaattccagtcagaggcaaacaatggcaagttcctctgcaaacaaacatatggttactgatggaccagctgtatcattgcaatcatcgtctgggtttcagcatggtggttggtctgggacgcctggtcagttgtcgatggctgacattgtgaaaatgggtcggcctcagggcaaggcttccagcanacctgtggtcacagctgacagaggttatgctggacagtacccatctttggc

SEQ ID NO: 6614 - DNA, 458 bp, Sorghum bicolor
  Clone ID: SORBI-28MAY03-CLUS4946_1
gctgctgctcccttgccggcacctctgcctgtgccgctcgtgcgaggccgccgtggacgcgtgccctgtctgctcagccgccaagaacgcctcgctccatgtcctgctctgctgaagcataccacgttccagcacgccgatgagcatggaagggaagccaaggcctttaatttctccgagaagctgcctgctgctcgacgacgatctgttctcagcttccgcacttggatcactcgatcaagcaaggggcaaatcatacagctgcaatctgttagacaaggaaaggacaaggtggatggagttttgacatctaaatgagatggaatcatgcctcaatttgttcatgttatcagcctggcaaagcaatcttgtgcgacgagcttgcagtgcgacaagccgacaaacactgctctgatacgcaaaaatctggcgatggcaacaaggtttgtgtagcttga

SEQ ID NO: 6615 - DNA, 750 bp, Sorghum bicolor
  Clone ID: SORBI-28MAY03-CLUS48527_1
gcacgagggctgggccgcggcggctgcatcaacgccgggttcttcacgcgcgccggggcaggctacgtcagggccgccgggtgggatcccagggaggtgcgcgcggcgtaccggtgggtggaggacgtggtcgcgttccgaccggcgctcggcccgtggcagaccgccgtaaggaggggactcctggagaccggcgtgctgccggacaacgggttcacgtatgaccacatcccggggacgaaagtcggcgggtccatcttcgacgccgacggcacgcggcacacggcggcggacctgctccagtacgccaaccaggacggcatcgacctgtatctccgggcgagagtgtccaggatcttgttccgttacaaaggaacgaagccggtggcggaaggcgtggtgtaccatgactcgcgcggcaacgcgcacacggcgtacctgagcccgggcgccgccagcgaggtgatcctgtcggcgggggcgctgggcagcccgcagcagctgatgctgagtggcatcggcccggcggaccacctccgctcgctgggcatcgacgtcgtcctcgacctgccgggcgtcgggcagggcatgtccgacaaccccatgaacgccatctacgtgccgtcgccgtcgccggtggaggtgtcgctaatccaggtggtgggcatcacccagttcggcagctacatcgagggcgccagcggggccaactggaacagccacccgtcgggcacgcagacgcagcctcct

SEQ ID NO: 6616 - DNA, 708 bp, Sorghum bicolor
  Clone ID: SORBI-28MAY03-CLUS48593_1
gcacgaggcatgcagtcgatggaaacagaatagaaaggagcaacgtacacaagtctgatgctgctcatggcacgggggataggcttcccaaacacaccaggatagtggtcttgaaacctacctcagtaattacttccacggagcaatctgagcaaaattatcatgctgatctggatgattctgaagcacctggtctatcaaggcatttgagtgatgagatagattggtcagtgcatggaatttgtcgacaccacacagaatctttgcagggttgcatacagtcaaatttgttcagcgcagatagaccataccatcggtatgctgaagaagagagtgactcggatattggaaccccaacatcacatcattcttgggagtacatctaccagtttagcaatccttactttggctctttgagccatgcttcttgctcccctgagtcacatgtaactagggaggctaagaaacatgcttctgacagatgggcaattgttccatccagtgagatatcccagcaaaaggtaccagtgcgaagaagtttgagcacacttggtgaaatgcttgccatgcctgatatgaagaaagaagaggttgctgatcaagcatctcctgacgctaatacccaccagttgtgtgaaccaacaggcggtgtatcatctaattctgctgttgatgaaggtgagggagaacgctccctcaggaaaatct

SEQ ID NO: 6617 - DNA, 631 bp, Sorghum bicolor
  Clone ID: SORBI-28MAY03-CLUS48596_1
gcaccacgcggccccattccccgattccaatccttcctccacacccccaccctcccccgtccgcctccgcctccacgtccaccaccctccaatccgcgcgcgccaccctatcccgattgctacctcctcgtggtgggcgccgctccgatccgcccgatccgcgctgctcctggggttccggcgcgcggcggcgagcggcgggggcggcgcaggaatggaatccgaggacgacatgcacgacgcgaacgattccgccgaagacgacttctacagcggcggggaggctggtctcgccgccagcgacgacggagacgccgactacgacttcgcggaccacgactccgacgactccgcggaactcctctcccacagacagcagcaaaattacagtatattgagtgaagttgatataaagcggccccgaggggatgacataaatagggtttcaactgttctttcaatttccaaaccagaagcatgtgttcttctccgcaactataactggagtgttagtaaggtgcatgacgaatggtttgctgatgaagagcgtgttcggaaggttgttggtttaccagagaagcataatgaaatgccaaatgacagagaagtaacatggggaatatgttttaaa

SEQ ID NO: 6618 - DNA, 484 bp, Sorghum bicolor
  Clone ID: SORBI-28MAY03-CLUS48679_1
gcaccacgccgcaacaacctacccgcccgcaaggccgcagcgatggccaccgtccaccccccatcgccggcgggccccaccgcccctcttccgccgcaggaggaggaggaggaggaggtggagcgacacgtgggggacgccgtcccggacccgcccgccgtcgtctccggcgaacccgacgcggccggagcggaggcgagcggcgggggcggcgagatcgccgcgctcgacaagcagctcgccgtcgtcgtcggcggtggcggcggcagcggcgatgagaggaggctggccggtgccggggccgtggccggggccgtggctgctagcgcagccgcagcaggcgggggagggaagctggtggcggaggccatgcgcaagtacgccgcgccgcggtcgtcaaagttccacggcgtcaccaggctcaagtggagtggcaagtacgaggcgcacctatgggacaacaccagccaggtcaagggccgca

SEQ ID NO: 6619 - DNA, 838 bp, Sorghum bicolor
  unsure (1)..(838): unsure at all n locations
  Clone ID: SORBI-28MAY03-CLUS48663_1
ccggcgggcgaccatgnngctcgtcccccaccccaaaccctactntctcctcttcctcctncctcgcctcgctcnggccccngcggtcaccngcggtgccgnttctccgggcctcgacgccttncctctcgtcggcagccgcgccccgcccgtccggcggcaacgacaccttcgccgccctcccggctgccctccggcgggcgctctccgcccggacctccctcctcccttccttccttctcaacctctctgccaccgtccccgtccacgtccgcctcgccggctcctccttccctgcctcctccgggcggtccctcccttccctcgtcaacgccgccgtctcgtcagctcacttcctctccagccgccgcccacaccgtctcgcggtctcccacaccctccaccttgacgtcaccggccccgtcgcggcgtccaagctcgcctctagcgctggcgccgccgtccgcgcgcatctcgacaagtcccccgcgccgttccaccataacgcgctctccgccgttccctactcgctcgtcgacgatctcgtcgccgaggactaccgcgcgctcgccggttccggccccgctgaggccgtctacatctacttgctcgaccttggcaagcagccgcgccagtacgcctacaccgcggcctcctccggcgctgacgccagctcgcctgggtactcgcgctgcctcggccccgtctgggctggtaaggaccggtacatttggatcgacctgngtgctggtccggtgaactacggtccggcactctctggcgatggcgtgctcccccgtggtgagttccaccctcttgccacccttcacggcaggcc

SEQ ID NO: 6620 - DNA, 755 bp, Sorghum bicolor
  Clone ID: SORBI-28MAY03-CLUS48957_1
gcatttcaatttgcacctcgcaggacagctctttgtttgccacaggctccaccagcggcatcgtgaatgtgtacaagagggatgattttcttggtgggaagaggaagccactgaagacaatcgaaaacctgaccactgacattggcgaaatgaaattcaaccatgatgcccagatcttggcaatcagctcaaggaaagagaggaatgggatgaggcttgtgcacgtcccgtcgttcagcgtgttccagaactggccagggcctcggttcagccttcactatccacggtgcctggatttcagccctggcagcgggttcttgtctgttggacacgcgggtggaaaagtccttctatacaagcttcaccactataaaaacgcatgagactaggatggttacttggcaaaacccagttttggcattatgtttgtactcttgaacactccatgaatcaagtgtatgctgattcgttccagtcattgcactttacgctttgctgccactggtttcaatgcttgatacatgctggcaatctcgtacttctcttttttagtcgtatgcagtttgttatgctgctattgctctatggtggttgttgattgcggaatttcagtttcctgttactgggcttatgggagtcatcctggagtctggagccatatattatgtgagtatacatgggtatgttcattgcagtcagactctgaatcctttggattggatgtatgcaagcatccccttttgtcttccgagctg

SEQ ID NO: 6621 - DNA, 635 bp, Sorghum bicolor
  Clone ID: SORBI-28MAY03-CLUS49673_1
aaactaaaagagtccatacataaatggcctggaattgaatacaatgtttcaaggtgcaaatcgatttttataccaataacgcaactaggtggtgccttcattttgatcatattgaaccaagagacaaaaacagtatacattttggaccctaatcctcctaatccaatttacaagtacaatccaaacgcaaaatatgtgaagatacttcaatgcatttctgaaaacctacaaaaagccatggcaaaagcatgtccagagcctaaatggaaagaagatattttcttatggcgtcaaattattttaactgatattcccatttacaatagggaactatctggttatctcgtttccatgttcatgactgcatggaaaaatgaagcactggaaattacagaaataaaggatgcctacagtatcagaaagcattttttgggacagctattgactatcaacgaaaatgaatgtgaagataacttaccaactggagttcaagacctcattagatgtataaaatatactcagatttagagatagtcaaataccttccttatatatttataatgtaaaccatttatgtacaattattacagcacttgaaaacggctgagtatcagtccaaacctattttcttacct

SEQ ID NO: 6622 - DNA, 595 bp, Sorghum bicolor
  Clone ID: SORBI-28MAY03-CLUS49684_1
gggttatgccataatccgggagagcacctacttccttgattctgtggcaccgattgccaaaggaatgagatggagctgcgagaagcataacaccgagaacaaggctgacaaggacaagatcctcatctgccagaaaaagctttgggcaggaaagcagtgacgacaggatcatcaatccaggtgaactaaacaagacctaagtagccttaacctggatggatggatgatgatgagtaaatctgctgctcaagggcatccagatcagctcaaatgtgctgtggtctcggtcaacaaggcagaggcgcttcaccgttcagtacacatggaagatgaacaagtactctgatacaatgcaagaaggtttacaattatcaaaataaataagctgagtaaaactccgtataggatccaatagttagtactatttgtcattaatcacacagttaattctttttttgtaccacaacagttaggggtgggtcgattcataccatgatgagcaaatataagttactccacagagcatggttggtgctgtggttgtaattgtaataattgtaatagcgggccatatatttatttaacacatatgggg

SEQ ID NO: 6623 - DNA, 644 bp, Sorghum bicolor
  Clone ID: SORBI-28MAY03-CLUS49690_1
gaccggattcagccagatacttggagtggagcttatcaatgctgggggaaagagaacagggaggctccattaagaaccgcatgcccacctggagtgcctcttgatttagtcagcaacttcgagatcaaatccttcgatggttgcgcaaatccgcacttgggtcttgctgctattgttgctgctggcatcgatgggctaagaagagaccttaagttgcctgaaccgattgaatcaaacccttctgaccacgcttccaaactgaaaaggctaccgcagaacctgcaggaatctgtagaatcgctttctgcagataaggttttccatgaattaattggtgataaacttgtcacagctgctatagctatacggaaggctgagatcgatcacttcgcgaagaatccaggtgcatttaacgatctcatctaccgttactagggccaaagaacagaatgagaggctacgttttcttggacatggcaaggggtttcactgtatgaccaaccgagagactatgtggacgaataaattttgttccaacggttaacttcggattctcatatcctgtgactgaacttgatacccagtgtttctcttatcaaatacagtataaaggttctttaaaatgtgaaacgataagcacatgt

SEQ ID NO: 6624 - DNA, 604 bp, Sorghum bicolor
  Clone ID: SORBI-28MAY03-CLUS49731_1
atatcattggactctcattgttccttggcatctcaatccctcaatacttcaatgaatacacttcttcagctgacggccgtggacctgcccggacaaacgctggatggttcaacgacatcataaacaccgtgtttgcttccggcccgacggtggcgctaattgttgcttctgtcctggacaacacattggagttcaggggctacgagtccgaccgggggctctcatggtttcagccattcctgcgtcgccataaaggatactcggaccccaggaacgaggagttctatagcttcccaatcagggttcatgacttcatcccaagccgatttctctgacttcagatgactgctgttacccgcagcagtgcatgtaaatccccgtgctcttgttaggcttactcctgtgacttgtagcggttggttctagggggatatgggtaaaagaatgtttagggcatttgctttgtttgactcttttgggctgagaaatggttatacatgataatgtagagagctctgtgccagatacatggttttgggaaggattacagaagaatagcaccttacatgttgatgggttttaaatgcaaggcatgtttagtttt

SEQ ID NO: 6625 - DNA, 550 bp, Sorghum bicolor
  Clone ID: SORBI-28MAY03-CLUS49142_1
atgagataggtgatctcccgattgagaagtgtccagcaccagacattggtcaggagatgaaacaaaaggttgacgattcaataaaaattgttgacatgagcatcaaagaagcagcgtaccatgcctggcttgggtactacaactcaattgctgacataggtagagataaaaccatgcttgccgacttagcaaatcgatttggtgcctcgatcggcttggagaaacctccagcgatatatcggaagaccgcactgaagatggggctgaaggatgtccctgggattcgaataaggaaatgacttgctcctccgttgaaaacgcagcatggatttctgtgttttcttagtttttatcctagtgtacagattcaccatcatagtctcggtgatgagtagtgtttgttctattttcacctatgtaatggcatttctgtatactggtagttccattgatcagcttccttgaggatgctgtactgatgaataagacgggcttccatgcgaattattgtaatccaaaacggtgtttgaaacatgtagctgtgcttttc

SEQ ID NO: 6626 - DNA, 777 bp, Sorghum bicolor
  unsure (1)..(777): unsure at all n locations
  Clone ID: SORBI-28MAY03-CLUS49207_1
gcacgaggcaggctcgaggcagaaaagcaccagcccgtttgactcttctgtgttgctcgttaagaagaaggataatacttnggagattctgtgtggattaccgtcagcttaactctatcactctgaaaagcaagtaccccgttcctctcattgacgacttgctggatgaattgggtcaagcctcttggttttctaaactggaccttcgttccggattccatcagattttgttgcagccgggtgaagagttcaaaacaacgtatcaaacacatttcgggcagtttgattttcgtgtgatgcctttcggcttgactggagctccgggtacctttcaggaggctatgaattccactttagctccgttcttgcgcaaatttgtgctggttttctttgatgatattctcatttatagcaagtcctatgaggaacatttgattcatttgcaacaagtctttgaactgttacaagctcatgactggaaattgaagttgtctaagtgtgccttcgctcaacgtactattaattatctgggccacatcattagtggtgagggggtggccacagaccccgagaagatttctgctgtctctaattggccggtgccttcttccgtcagggtgctccgggggctctgccgctggccgggcttcttcgtaagaattccatctttcaatggacgttcgcacatgagcagtctttccaggccctgaaatctgctttggtgaccgccccagtcctcgcattgcccaatttttcacaaccattttgcattgaaac

SEQ ID NO: 6627 - DNA, 1227 bp, Sorghum bicolor
  Clone ID: SORBI-28MAY03-CLUS49227_1
gcacgagggtcaaagcaagggaagaagcaggaaatggaacgaaaggaggtcaccaaggaaccactgagtgctccaaaagcactggtgaagagatcatcccgcttcttcccggcatctttcttctcctccaaagttgatggagagtttacgcctacatcagtctttcgggggttaatgaaatcagtgcaaaaacaggttccgaagcttgttgttgggatattgcttcttggttcaggggcattcttcttaaatagagctgagaagagtcaactatttcagcagcaaggcattgccacaagcattggaaaggtaacctccacaacaaagcccatagttcgtgagatacggcaaattccacagaggctcgaggagctaatagagctcttacctcatcaagaggtaaatgaggaagaagcttcgctttttgacatactgtatttgcttctggccagtgttatttttgtaccattatttcagaaaatccctggaggcagtcctgttcttggatatcttgctgctggtgtcctcattggtccatatgggctctccatcatccgtaatgtgcacgggacaaaggcaattgcggaattcggagtcgtgttcttactatttaacattggacttgagcctcctggggaaaggctaagctcgatgaagaagtatgtcttcggcttgggatctgctcaggtgctggctactactgcagctgttggtatgatagctcatcgttttgctgcactaccagggccagcagcaatcgttgttgggagtgggttggctctgtcatccacagctgttgtcttacaagtattgcaagagcgtggtgaaagtacgtcacgtcatgggcgcgctacattttctgtgttattgttccaggatttggctgtggtggttctgttgatattaatacctctcatatcacctaattcttcaaaaggaggggttggtttccaagcaatagcagaagccatgggaatggctgcagtcaaagcagtagctgctataactgccataattgctggaggccgtctgttgctccgtcctatttacaaaataattgctgaaaatcggaatgccgagatattttcagcgaatacactccttgttatttttggcacaagtcttcttacagcccgggctgggttatcaatggcacttggagcttttttggctggcctgttactagcagaaacggagttctccttgcaggttgagtcagatatagct

SEQ ID NO: 6628 - DNA, 607 bp, Sorghum bicolor
  Clone ID: SORBI-28MAY03-CLUS49270_1
gcacgagggtccctcgacagtgccgaggcggaacctagcagccgcccgccgcccctcgcccccatccaccagcacaaacgcaatccgcaagggccaatcgaccgccggccgctgcggcgcagccgcgccgccagcctcctggcccggccgtccagcgcctaagccaggggcggcaaccagcgcgcagcgcgggccgccggccagccgcccgcgcccattcacgccagctgttcatccagtaggaaacggccgcaaggaatacggaagagggaagccgcatccggccactgactccgatctcccgctagtcaaccccaggtagaccggtcctcctcgcctgaccacgacggccatctcgcacgcctacttccacgttccacccaactagacaagtcttctctcccaggcctaaccttcctccccgcggcgccgcctctactggtattgcactggcgtgccccgacgcggaaagacgtggagatccaccgaaaattggattgatttcttccttcctcggttctccatcctcagcctgcgcaagatccgtttgagttggccgccccccagtggactacccaaggtgcggtggcatccacccaggttgaag

SEQ ID NO: 6629 - DNA, 497 bp, Sorghum bicolor
  Clone ID: SORBI-28MAY03-CLUS4928_1
agtgcaagtgcaaatcatcactcggctcgtttcccgaaccttcctcctcgacctcgacttatccccatgggcaagtccggcgcaaaaaagaagaagccggccgccgccgccgccgcggcggcgaaaccgccgcccgcctcggctgagcagaaggcgacgccgccgccttcgtcctctttacccggggggagcggcggcgcgtcgcctcaccaggcggtggacgccggcgtcctcttgcgccgcgcgcacgagctcaaggaggaaggcaaccgcctgttccagtcgcgcgactacgccggggcgctgcgccagtacgagctggcgctccgcctcgccccgcgcgggcacccggaccgcgccgtcttccacagcaaccgcgccgcctgcctcctccagctccggcccgtggaccacgaggccgtcgcccaggagtgctccctcgcgctccaggccgagccgcgcttcccgcgcgctctcctccgccgcgcgcgcgcgct

SEQ ID NO: 6630 - DNA, 572 bp, Sorghum bicolor
  Clone ID: SORBI-28MAY03-CLUS4933_1
aacaccttgtgcatgtcttgtctgctaacatataccggacaacttcagaagctctagaatcttttgactacattgcaaaacatggtaatttcagttttactgagaggtttgccgtgaagtatgctggtgctgtagccatgtacatggtatctaagaagctaaagaagaaatacaacataactgatgagcgtgcttcgttgtatgatgctgccaatacatggatcgaagccctgaatggaagagatttcctgggtggctccaagcctaacttggcagatcttgccgtcttcggtgttctaagacctatacggtacttgagagcaggaaaagacatggttgagaatactgaaatcggtgattggtaccaacgcatggaagttgcagttggagaaccatcaagaatacaggatgcagaaggaaactagaattttgacaagacattcttttaaagaatttagtggaacctgtgcctatacatggaggctattcaaaattttgcccaaattaagcgtatgcaataatgctctgccagatttcaagttctagcaccgaggaacagtgttttgattggg

SEQ ID NO: 6631 - DNA, 645 bp, Sorghum bicolor
  Clone ID: SORBI-28MAY03-CLUS4998_1
acccacggaaaatacaatcgagtcgagggaaaaaaagctcctggcccttttcttgtgaagtcgtcctcttcttcccgtcgcttcgccgtgccgcaccagggaggaggagaggaggcttggccgcgaagctcgccatgatctcgccggagaggagctcgtcacagagcccgcggtcgccggcggcggcggcgggggcgccgttcctgtcgatatccgtcacggatcccgtcaagatgggcaccggcgtgcaggcctacatctcctaccgcgtcatcaccaggaccaacctccctgaatttgagggaccagagaaaattgttattcgacgctatagtgattttgaatggttgcatgaccggcttgctgagaggtacaaaggcgtttttatacctccccttccggagaagaatgctgttgagaaattccggtttagcaaggagttcattgaattgcggcgtcaagctctggatttattcgttaacaggatagcttcacaccctgaactcaagcaaagtgatgtcttgaggacatttttgcaggcagatgaagagataatggatagggcaagatcttacgagactggtatttttaagaaaccagcagatttcttacagatgtttaaggatgtacagtcaaaagtcagtg

SEQ ID NO: 6632 - DNA, 1686 bp, Sorghum bicolor
  Clone ID: SORBI-28MAY03-CLUS5_1
cagagatagaggagcaatggctggttcgtcttcaatggacactgaagctgcaggccaacagctcaagcatggcagcggctacagcatcccggctactgctcatgcggtggacacagactcgtggcagcaggtgagcctgctgatggtgatcggcttcaactgcgcctacgtgctcagcttctccaacctcatgatggtgcccctgggctgggcatggggcgtcgcctgcctgctgctcgtcggcgccgccgcatggtacgccaactggctcctcgccggcctccatttcgtcgacggacagaggttcatccgctacagggacctcatgggcttcgtattcgggaggaacatgtactacatcacttggttcctgcagttcaccactctacttttgtgcaacatgggcttcattctactaggagcaagagcactcaaggcaatcaacagcgagtttacccacacccctgccaggctgcagtggttcgtcaccgcgacgggattcatctacttcgccttcgcctacttcgtgcccacgatttctgccatgaggaactggctcgccacgtcggccgcgctgacattagcttacgacgtcgctctgctggctatcctcatcagagatgggaaatcgaacaagcagaaggactacaacgtccatgggacccaagccgagaaggtgttcaacgcgttgggcgccgtcgccgccatcctcgtctgcaacacgtccgggctgctcccggagatacagtcgacggtgcgggagccggcggtgcgcggcatgcggcgggcgctgcttctgcagtacaccgccggcgccgcggggtactacggcatcagcgtggcggggtactgggcgtacgggtcggcggtgtcggagtacctccccaacgagctcggcgggccaaggtgggccgccgtgctcatcaacgccaccgccttcctgcagagcatcgtctcccaacacctgttcacggtgccgatccacgaggcgatggacacgcggctgcagcggctggacgagggcatgttctcccggtacaacctcacgcgacgcctctgcgcgcgggggctcgtcttcggcttcaacgtcttcgtcaccgcgctgttcccgttcatgggggacttcgtcaacctcgtcggctccttcgcgctcgtcccgctcaccttcacgttccctagcatggccatcctcaagatcaaagggaagagcggcgggagatgtaacagactttggcattgggggatcatcgttttctcctcggttctctgcgtcgctaccaccgccgccgccgttcgtctgatcttcaacaatgctaggatctaccacttcttcgctgacatgtagtaaggagtccaaaaaaaacacgattaggtgatattgccacttctcaattttttttttttgttttggtgaggaatgaaagggtcacctcatgtttggtaaggacgaccacatgcatgatcaataagcatcatgtagtcatcctatcgaaatttagaaatgagcttattgtggtggaccacctcctcaaaacaaagatctctgttcttaattaatgcgagcttaaagacaactcatgcctatatatatatatatatatatatatgctctcaagctcatgcctatatatatatatatatgtaatcgccctcaagtttattaatcaattattgtgtatttagttc

SEQ ID NO: 6633 - DNA, 594 bp, Sorghum bicolor
  unsure (1)..(594): unsure at all n locations
  Clone ID: SORBI-28MAY03-CLUS50048_1
aaaattagagttgtgaagcgatttgatagccctagagcgagaacggtttctagtaaaggtgagtgtctcgtgaaaaatcaactatgggcatcaaaaggcaaaatggatgttgttgctgggaaagagaacaaagtacaaaacccaaattctaagacatgtttgattgtttcacatcctcaagggcatatagagacaaaagtgtttgacggaaatgatgaatatggaattcaaagcagcgaacatcatgaagacgtggagaatgagagaaatggggatagctccagtgatgaaagtagcccttagaacaacacaagttggggtgtttgggttttacttttgcatgaggacacataagtggagggcaaataacattattatgtacagatacaacatgacttgtttgaaagggagtgtgcgcccatcgacaactactttattatgttttgggtgattgcttgaacaacaacactagttgcggtgtcatcatcttgtcttgtttattatctgttctctcgtgtacatataagctatacctcaaagtttataaatgtaattttgcgtgactattgaaagcaaagaaatcattttgtgctn

SEQ ID NO: 6634 - DNA, 880 bp, Sorghum bicolor
  Clone ID: SORBI-28MAY03-CLUS50052_1
ttctgggtgctgttccacctctacccgttcgccaagggcctcctcgggaggcacggcaagacccccgtggtggtgctcgtctggtgggcattcaccttcgtcatcaccgccgtgctctacatcaacatcccccacatccatggccccggcggcaagcacggcggcgcgatcggaaagcacggcgccgcccaccacggcaagaagttcgacctcgacaacctctcctacaactggccgtgaagcaccgggcagccagccgccgccgccacccagcatctatcgtcaagcatgcacatacctgccctgatgatgatgatgatgatatggtgaggcggccgcgaaggagaagagtacgtttccgtccatccatccttagtactacctggtgattggttgatgaagagtgaagactacacagcaaccccacacagcatttgatcgacccagcgacgtacccgccaaaatttgatttttcttctttcttctcttctttttgcccccccaccttctcttcattcttttttcttttagttttgtccagaaattgaaagatgtgttgatttgatttagttttttaattaccgtacccgtggtaattaattatgtacctacttatatatacattacattacattacgccgaagaagaagaggaaggaggaaggaatccccttgtataagtaagaagagagaaatgcaggggaatgtaggaggggcttacgggtggggccggggtgtcagtgtctgcctgtctgtactgtacatgctggagtggagaggagtcacatacagagagagtgagaggggtctaggtcccggctttgggttggtattcttttagtatatggaacacaataaatttaatttcattcttttctgcg

SEQ ID NO: 6635 - DNA, 814 bp, Sorghum bicolor
  Clone ID: SORBI-28MAY03-CLUS50090_1
ctgccatgaccatgagcatggacagcacaagcatgaccatggggagattgaggagccagaaaaggactgccatgaccacagccaccactgctgccatgagcctcatgacaaggacaagactccagctgagccagttgaagaggtcacgatttcaattgctgcccttcccaaagatgaaggccaccaccacagcgaagaacacaagggggagccctgcgggaaggcgaaagactgcggtgttcctgctcccactgactgcgctgcgagcaagaactgctgcagcgtcaaaggtggagacacctgctcgagctcgcaggctgcgtgtgccaaggagaccagcccgtgctgcaggagctacgtgaagtgccccaagacgacggcgacggtgacgaggagcagctgctgcggccacagccacaccatgctgaagctgcctgagatcgtggtagagtagtagcctagtatggtgggaattccaccggggaagaagggtgtgcacatatgagcatgactcgccggcgtaagatagactaagatcggcggtgcagggtgtttgatctagtatattctagttactatatatacttactatatagatttgctaaagaaaaaaaaaagtaggattttgaccaagcaggggtctgaaagggagggctctgcttggttttcctgcactgcttctcggtttgcaacttctgtgtgacaactcttgagtattggtgctgcaatggagactgtcacaaacgaagaatataactggtgccggccagggccaacactaatattcagaaactatccatttagcccctttttt

SEQ ID NO: 6636 - DNA, 571 bp, Sorghum bicolor
  Clone ID: SORBI-28MAY03-CLUS4953_1
tacaaaacaaatttcttagatacgatcgatagccatggtggtcatccatctcctcatgcttttctcttattatgctgctgctgtggtgtcagatcctgtggctcgtcaagagttatccaacaatacgaaccgtcgttccacagcactccagctacggccagagtactttcccaacgagcgactctaccaagcgtaccttgtcatccagcaattcaagggcactataactagtgaccccaagaacatcacctcaacctggatcggtcatgacatctgcggcgagacgacctacctcggtttctactgcgcaacacccccagggttagatgacaaggtaacagttacggaggttcttttcaacggatttggcctgcgtgcacccagtttgcacggtttcatcgatcagctccctgatatcgcgattttccatgctgcatccaaccactttggtggagatatccctcaattagacagcctgcgttacctgtacgaattcaatgtcgctaagtacgacctccagcctctgcacccttctaattataatgggggcatgtttgctggggcagttgat

SEQ ID NO: 6637 - DNA, 448 bp, Sorghum bicolor
  Clone ID: SORBI-28MAY03-CLUS4952_1
agcaacttctggttgttcaaggcatgattctccctccagtcaaagtgtccatgctgggagtggcagccctgtatctcttgaagacagccactctggctctacaaatggcaatggatcacctgtgagtgcatcgtgtgtcactgaggaccctactgatctcaagcagaaactgaaggatcttgaggctgcaatgctgggtacagacccagagatcgtcaacagtctcgagatctccatagcagaccaactttcgttggagcccgaggagtggaagcacatgatgagcatgcccggagggaacctgaaggagctgctgattgcctgcgctagagcggtggaatataacaacagctacgccattgatctgatgatcccagagctgaggaagaaggtttcagtgtctggtgaaccacttgagaggctgggagcctacatgggggaaggtctt

SEQ ID NO: 6638 - DNA, 584 bp, Sorghum bicolor
  Clone ID: SORBI-28MAY03-CLUS49567_1
cttggagatggataggatattaaggcccgagggcacagctatcatccgtgacacagttgacgtgctcacgaaagtccaggcaataaccaagcggatgcggtgggaaagccgcatcatggaccacgaggatggccccttcaatccagagaaggtcctcatggcggttaagacgtactggactgccaaaacggaggaggagcattagcacacaggcgacacggctcactgaaaacctgaaccaggcttgttctaccagttgggaggatggcatcagggttttgccgtctcagtgtagtatgggaccgcctggtcacatgttcctttcacctttctgtaattctttgtagctgcaatcagatgagaagctgagggaggagtttgaggggtgattggacctctagttgatacaggaaaaacggttttgtagcaggggaagaattcgctggtcttgcataggttcctggccctgttccacgaggggttgagctaggttttagtctgtaatatgatggcaccgagcaggcagtgttaccgtatattggagtgacactaatagtaataggtatttattcagttttcctctt

SEQ ID NO: 6639 - DNA, 652 bp, Sorghum bicolor
  Clone ID: SORBI-28MAY03-CLUS49597_1
ccagaagctatagatctcgcttcacgtttgctccagtattcaccaaatctacgatgcactgctcttgaagcgtgtgcacacccattcttcgataagttgcgagaaccacatgcaaggttgccgaacggacggccatttcctccgctgttcaactttaaacaggaactagcaaatgcctccccagagctcatcaacaggttgatcccagaccatgctaggcggcatcttgggctcactttattgcccactaccggaccataggcaaaggcctctatggtgtttaaaccttgctcttctgatgcttcgttgtgccgaaggcaacctacatgttcctcacattcaaggtgtagaatctgaccattattggaaagccaaacatgagctggcgccaatgtgttgcacaaggagatgtgctatgttcgtgcagccagcctttgtcacctgttttaatgcaaaatctgattttgtctaagtagtgagagggaaggggttggtgtattgttaagctactgaaggaattcagtccctgctattgtattactttctcccaacgttaaatgttgtagtgcgcctgtaagtgttccatattccctgttgtcagtcagtgtaattctgtaaatgttattaatggaaaattatatcgtgctatggt

SEQ ID NO: 6640 - DNA, 682 bp, Sorghum bicolor
  Clone ID: SORBI-28MAY03-CLUS49617_1
gaaaggagagcgccatggcacaccagcagagcgactgctggtagcaaacaatccaggatctcagaagaataggccacacacaatgtttgcaagtggtccaccgacccaaggtcttccaaatggtggtccgcctgtgccacgcccttatggcaatggcacaattccgggacagattcaacacatgcgccaaccacctccaccgcctgttggacaattcccccctccaatgcagatgcatgggcaacctgcttggcccgctcaacagcctatgccgccccccatggcatcgcaactccagtacaggctcccaatgaggcctccaccaccaaacatgatgccccctccggtcagcatggtaaggccgccacctcctcccactggtatgtcagcaccacctatgtggataccacccccacccccgccacaacaaggtggaatgcctccgcctcccatgtctatgccgccaccgcctccaccatctggttaaacacatgcagaggaaagtaccgtctggtcaatgtgcaagctgtaactgtagactaaggatcctttcatatatcttccctgtaacttgtcaacgcaggtgaagatgagatttgagggtttacctgacatatacaaactcaagattaacagctatttatgttgtgttgaagatgaatgaattttgtgatttcttccc

SEQ ID NO: 6641 - DNA, 540 bp, Sorghum bicolor
  Clone ID: SORBI-28MAY03-CLUS49661_1
actatatagactattcacaaccatatatcacttttcttcttcctagttcagcagcttcctttcttaggtgctcatcagcttaaccttggagatgaactgatctgggaggttacaggttgaagggtgaatttgtgttgtagactgagtcttataggttaaggttcaattttcatttatggtgttatttgtttattgcagacaatccatctctcctctgctcctactgctggccctggcatcctgacctcctgttgctaatgcctctcattcaacctgttctacatgccgaggtgaagcaattggcagccttgagagtggctagagatggaacgccgatgtagtagttttttttccaacacaaattgtattatttctgattttaaaaaaagtaatatagtttggcctatgagctgttagaaccctaatgttttttttatcccaattaagggtttttagcttccataaattgtatgtgatttgtggaataactcagacggagccacaaacttcatgtgttcaaagtgcaaatcttggaatctt

SEQ ID NO: 6642 - DNA, 851 bp, Sorghum bicolor
  Clone ID: SORBI-28MAY03-CLUS50320_1
gcacgaggcttcccctgaccaccgccgtcgccgccgaacacatctctagtcagcttccactggagcacgccaccccgaattcttctctccagtcgttgccctcctcccctacccccatatattaaagcaggttcgcagatccacccggagttgatcgattccttcttctatttcttgccaacaaagcccaagcattcttggatggactccgtcactggctgcgacggcggcaagaaatcggattaggacgaggtggggatcagggtattcgtcttgggaaaggggatggggggtctctgctcgaaggtctcagctgtagacaagtcaccgagcgacaccgcgcttggccggaaccaggtcgccgatcatgagccgggggcgtcgctggggttggagaagccgccggtgtccggagaggcagctgcgctggcaaagcggctggacgagcagcagcagcaatctttctcgttccgcgcgagcgtcgtccctggggttgcttttcatgccggcgccagtggcgaaacggggtccaggacctcgccgcagctgaccaggtcgctgtcgcagagggctggtgtgggcaaggcaaaagccggcgctggcaaggtttcagaagtgagctcaattttaggtagggctagcactgttgggcttgaaaaggcagtggaggttctagacacactcggcagtagcatgacaggtttaaattctagcagtggttttgtgtcaagttctgcggcaaagggaaacaaaatagccatgctggcttttgaggtggcaaatactatagttaaaggctctaatctgatgcgttctctatcggagcctagcataaagcatctgaaggaggt

SEQ ID NO: 6643 - DNA, 783 bp, Sorghum bicolor
  Clone ID: SORBI-28MAY03-CLUS50348_1
ctgatgtactttccggaacatgtgggcagaatttgaatgggaaaataaggtggcagtgaacactgtgattcaggatgagaaggaatttttgaatcacattatcaagtcaacaaacatgaagtgtctgacaccaccgtctgcactagacggagaatgtggtttccttgctgctaatctttatgcaaagagtgtgtttggagaggatgctttggtgaacatcagcattgagaagcaacatgatggcaagctcagtggttacatccggataaggagcaagacccagggaattgcactgagcttaggagacaagattaccctcaagcagaagggtggcagttaactgtgacaagtgtcgcagttgtatcatcatttttctcttttaggaaatgcacgtgcctgagaataccagtgacgtggcattgaactgagtataaatgctttttgtacaaaaggatcaaagaaagagataagaggccagttatgaggaagtcacggtgttagatccctgagcatgaagttctcggtcgaagatccatgttgctgtagtaaagatgctgttgcagcttcctttcctgataaaataacaatgtagaaatagttgtgaagtttatgttgatttctcgacaggtagatcaattgtgatgtactattatgaatccctcttgttttgatgttatatttcacttttattttaattttgtggtcttgaaacagaagttcggaggtggtgttgtccccttattttttttatagagatcaatttgagcatgttctgtcccatgt

SEQ ID NO: 6644 - DNA, 1125 bp, Sorghum bicolor
  Clone ID: SORBI-28MAY03-CLUS50393_1
aactgatcttgttgtccgctttactggatatgatagatggtttaagacatggagctccgcactgttgttacctaaactcaggaggctcctgatcgctgatgtgccttcatcctgggatgtttcttggccccgtctcctcatcgaagcggcaccgtgccttgagagccttcacatccatattagccgttgggaagaggatccttgtgatgacatcgtatggcaatcccctaagttctgccacaatcagcttaaggagttggtgataactggttttgaaggaacagaaagacagatttactttgttagctttgtcatgaaagtagcaacaaagttgcagtctgtttctttgttaaaaaatgggcttgttcagggcagaggccattgggactgggacatggtgaagcagcaacaccaatggggcaatgaagaaagaatcaacatacttaaccagattgctaaagatgttccttgctcaacaactcctgttcaagtggttctggagtaacctccaacaagtgtcagttaaaaatgcacaagttatgtgtatgcataatggtgctcccaatttgacagatgtaatgtttgcatacttgtaattcaacacatacattatgcctattagtattcagttcgtccagtttatttctgtgctatgaagctcatgaaagatcattgcatgtatatgttctcttcatcttcactttttttatgcttttattttatatatacatattgccaacttgtacccataattttcttatctgttcccgtcagtgagatgataagaggaatatatgcttcaaattttataaacactgttgcaggttgtttccttgtacaaaaagggcatgttcagggcagggaccagggggtgttaggactggggtttggtgacacagcattaccagtgcaaccataaggagaaagtcaaactactgaactagattgctgataatgtttggaaaccatggacatatatatttaagtcatgtactgtcaaatactaagttaatgccatattgagatatttaatcaaacttgctactgaattctaggtgtatggcataccttttttaattaaaaaggaaaaaaaagtattgagtttagcaatttagattcagattc

SEQ ID NO: 6645 - DNA, 584 bp, Sorghum bicolor
  Clone ID: SORBI-28MAY03-CLUS50410_1
ccaaggtgacacggcaaggttcagttcttacggaagaatgggatacgttcacatcgacgatgttgccagcagccatatcctggtgtacgagaccccccatgccaccgggagatacctgtgcagctccgtggtgctggacaacgacgagctggtctccttgctcgcgaagcgatacccagtattccccataccccggagactgaacagcccttacggcaagcagtcgtaccagctgaacacgtcgaagctgcaggggctgggcttcaagttcaggggagtgcaggagatgttcgacgactgtgtccagtcgctcaaagaccagggccacctgctggagtgccccctgtgatgaagattgagggagaaagaggtcttgtccccgacaagaacaggccagagccaaacacagttgggtcgcgtccagaactcgcttgctccctgtcaatttgtttcaataattccatgtcatgtcagcgtccttgcgtgaactgctgctgtcagttcatcgctcacggaatctttagaaagaaaaaaggtcatagctcacgggttctagcactacatgaataaaatgtcacgtcgcc

SEQ ID NO: 6646 - DNA, 596 bp, Sorghum bicolor
  Clone ID: SORBI-28MAY03-CLUS50507_1
aaagctatatccattaatttcttttatcccaagtgttggcatgtcagaggtcttctgttggaggctcaattcttgcacaaggaagccctgatggcgttctctttcgccctctcaattgacccagattacgtccccagcatggtttgcatggcaggaattctccgagatattggagggaattcgctatcaattgcaagaacttacttgcgcaatgccctccgtttagagcctacaaaccaccgagcttggttgagtcttgggcttgtcctgaaagctgaaggatcgctgcaggaggctgcggactgcttccaggcagcatatgagctcagagaattgtcaccaattcaggacttctctgagcaactcccgatcatgctgcattaggaacttatagcaaaggatgttcacagtttttttatgtggattttttccacatagttatctcagttatttatttatcgcttgcaaaggtaggaagcatatatgattttgtgaatgtaaattaatccacttatgttggtgagcaaatttttccgctcttgaaaaccgcaaagttatatatgattctccagcagcataaagctgaactttcttgc

SEQ ID NO: 6647 - DNA, 751 bp, Sorghum bicolor
  Clone ID: SORBI-28MAY03-CLUS49692_1
acaagaatttcaagtcatccaacattttattggatggtgagctgaacccccacctctctgattctgggtttgcaggccttctttcaaaccaggaattccaggaatcagatgagaactccggatacagggcacctgaggtgatcttgtctggtcagtactccctgaagagcgacgtgtacagcttcggagtcgtcatgctagagcttctgactggccggaaaccgtttgacaggtcccgaccgcggcctgagcagtcactggtgagatgggctactccccagctgcatgacatcgacgcactggaccagatggtcgaccctgcgctgcaagggctgtacccgtccaaatccctgtcccgcttcgccgacgccatcgccctatgtgttcagcccgagccggagtttcggccgccgatgtcggaggtcgtgcagtcgctggtgcgcctggtgcagagggccaacatgacgaggatgcacgagagccagtctcggcgccacggcgaatccggcggggactacgagttttaagcgagacgaagctgtggctgtcctgtaaatacataagtatattatgaaacaaaatgtatttagagaactttatttgccgtgctcagcggacagcggctgtgaaaatctgtgtcgtttcaagacgcaatttgccacgctactgcttcatgttgatcgcaattttcctagacatttttttttctaaaggtaaatagttataaactctcctggggagttttccgggg

SEQ ID NO: 6648 - DNA, 528 bp, Sorghum bicolor
  Clone ID: SORBI-28MAY03-CLUS49734_1
atcttccatgggaagagggggactattcaccttcaaatacattactagtggatgattctccttacaaagctctgcgcaatcctccatatacagcaatttttcctcgctcctacagttacttgaactggaatgacaattcactgggtcccggtggagaccttcgtgtgtatctgcagaacttagctgctgcagatgatgttgagcgttttgttcgtaataatccatttggtcaacccttcattactaagagcgatccgcattggaacttctatgctcagattgctgatagacagtgtgcacccttcacatgttgtgcttcaactcccaaggatcactgcttttaatgggagttgcgtagttatccacggtcaaagatcatgctcttaagtatagagtgatcttctcggagtagtttgctggtatccctgtactgaagattacagggtctttgtgctatataggccttgtttagttgccaaaaatttttggcaaatgctactgtagcatttcgtttgtatttgcacaaat

SEQ ID NO: 6649 - DNA, 613 bp, Sorghum bicolor
  Clone ID: SORBI-28MAY03-CLUS49839_1
ccaccctcccccattctccccctggcctttctcagccccgtgacccgtctcgccccttctcgcctagccgccgccgccgccgatgggctctggggaggagccgtcgcagatgcggagggcgctggtggactcgctcgcgggcgccatctctgggggcatctcccgcaccgttacctcccccctcgacgtcatcaaaatccgcttccaggttcagttagaacccacaacctcgtggggcattcttcgaagggatgtatatggaccttccaaatacactgggcttctgcaagcaaccaaagacattctcagagaggaaggtttaccgggattttggagaggaaatgtaccggctctgatgatgtatatgccatatacagctatacaattcactgttttacacaaactaaaaacatttgcttctggttcagcctggcccgtcggtctcgcgccgtcgggcccttccgtttcccgcctgcgtggcgctcctgcaggatgtcccgctccgtgagggcctgctcccgtgctcctccggtggtctctgcttgcttcgccggcgggtccctacgtggtcccctccatgcgatctgcatttgttgatataattaaaactcgt

SEQ ID NO: 6650 - DNA, 685 bp, Sorghum bicolor
  Clone ID: SORBI-28MAY03-CLUS4988_1
gttctagatcgcgagcggccacctttttttttttttttctatgcatctcaagttctcaaccatatataacaacaagctgttcaacacttggtggcctgcctcgtcgtcgtcgcggacgctgcaaatggcagcgtcccccacttcgatcaaccaacagtccaacacgaaaaacgtctgatacacaacaacaaaacacaacgcgctctactgtccaagaagcctcttgacgccggccttctggtccgacgtgagcctcgccgggaacttgatgtcgaacttgatccggaggttgcccttcctggacgggtccttggggatgggcatgccctcgccgcgcaccacctcctcgtaccccgggtggatcacggagctgatgggcaccgtcaggctgcgcccgtctagcgtcgtcacgtgagcggtgtaccccgtcagggcctccgccagcgggatcttctgggtcaccaccaggtcgttgccatcgcgggtgaacaccgggtgcggcttctcgtcgatgatgaagacgaggtcggccgggatcgtgttgggcgtctcgttgcccttctctgggaaggtgatcttggtgcccttcttccaccccggcttcacgtcgatcgttaggatctcttccactgggattgtcttcccactggcgtcagcaatttctctggaaatcttcatcttcttg

SEQ ID NO: 6651 - DNA, 930 bp, Sorghum bicolor
  unsure (1)..(930): unsure at all n locations
  Clone ID: SORBI-28MAY03-CLUS4994_1
ctcatgcgttctctcacgcgtgcggctgctgcaacctcgaactcgccagaaagggaaaccgtatctgctcccgtcctctcgtgttggtgccggcgactgctgatcaaccaaagcccagaccggataccggcacgtggagggcggacgacgctcatatctgaggcgctaggagcacgaacacgacatgcatgtaccatgagaagctaaacactgccagcagaggctgcncttgacgtgctccgccgggtacttgaggcagtgcttgcccacatctctgaaaggatcatcgagctcttcttgaacgattcagtaaagcggttcaatgccaatgcagtcactggtatagatactgatctcaaaatgtttgagacgtttgcagagggcatgtctagcctgttcgtggactcaggtcaagaatctgcaaaaaatgaaatgaaggctgcactagtggaagcaaggcagctagtgaatcttcttttgagcaatagtccagagaatttcctaaatccagtgattcgtgaaaagaactataacaagctagattatagaaaggttgcaatcatctcagagaagtttagagatacctcagagagttacttctcaacatttgggacaaggggtgccaggcagaacccaaagaagaaatctctggataccctgatcaagaggctcagagaagccagttagataccctccctgctgtaagataatatacatgcaactggcttctcacatcctcttcttttcgtgaaatagtctgtatctggtttgtgttatgcctgtttcagtcgttaatcttatgctgtaattttttctgttgttagattctatgtttcatatgtggggatatcttcctgttgattcttttgcccaattactatatggttgagataataatatgtcataatggttaattttttccgtgaggan

SEQ ID NO: 6652 - DNA, 1547 bp, Sorghum bicolor
  Clone ID: SORBI-28MAY03-CLUS49930_1
tgacacaggctattttaacatgtccggtttctaacaggccgttgtgttgctctccatattgtatttcatcaactcaagatcattgttgtgctatctgtgttaggcttcagcagttaaagagaatcaatgagtaccttagctatcagtggtcaggattcattgctttcagcactgcttatttaagtctattatccatgacctccatgtgtgcttctaatgttacttcatcactttaactgccttgcttatctaagtagttgtgcatgtctgctttacctattgtattatcagcatattccttttattagaattagaactttttgttatttctatagttaaggcttcatttacggtctcacctcattttcttaaccgaaaaaagattcaaagaagtgcttcctgtctctattgcatgtgctcgagggtcggtagtgtcatatataactgaaaattattatgtacataatgctatgtgtttttttggtcagacagtactgaaaagattcttcaatgctgatagctgtacatcatgactatgcataggccaatgcctgcaggaatgaaactggttacagttaagagcaacaattgcatagacatacattcaattggctgtgttattcatgcaaatgattgaattcagatgtttgcattttttatgcataaaaattatacaaacatttaagtggagagacatttctatgtgtttttctctcctttttccttttatcatcttttcttggattttgttatcacttctcaccacatttccttcctatatatgcctcgtgatcttgtacatatgatatatgatgttagctgttcttgtccttttattatttttctacaaagaagtggcgataacatgtcacatattttgcccttttattattttgcctctggttacagaaacatgtttctacaatggcatcttcttgtatgcccacatatatgtgtcagttctaccaatgagtgtttaaattaacttggagaaggtagacaatgatggaaggttctgtgagtcttcaaaaatgtttctaaacattttttggcaggttccttaattcttctttatgtttgtatgtatgggcaaccaacatggtttgagatcatttcagattacatcagagtttccatgaaagcacttttggtgtatggtgcatgtgacgaaattaacagataagctcaactgaaccgcccaaggctccaataagtcaggtgcacaggttcatctgctgctctattgatttttattgttttaattctagctatatatataagtccacccaacagcattgcccaattgcagtagcgcatatggtaagtgcaattaactaatacttaaatgtagatgaattctttagtttagacatagctatttgcttcatccgacttggtgcttgctttgactgtttttttggaaccctatcaggattaggggaggtgtgattgcctgtttacttttttggtacctgatttgtacagcaacattggaagccttgtttttttgaaaggttccatgcatataggttgttctaattcacatc

SEQ ID NO: 6653 - DNA, 1090 bp, Sorghum bicolor
  Clone ID: SORBI-28MAY03-CLUS50855_1
ttgtcttcgttgtaagagtattttccactcgtgagttggctggggttcagagtattgcgtctgaggtgatggaagtgttcgccgaaatgccctcaagatgccgcatgctaaactgtggcggtacattgcctgctgacaatggaggaagttggtgatgacgattggctcaagagggcgctatagatgcatggttaggactcatgaggctgtgggggtcctcatgtttacaaaggccaaactgagcaacaatgcttgcaaggagctcatcgaggcagcatgggacattgctgaccaaagtttaaatcctgaaggtggaatcacactacaaaaattcaaagaaatcctatctcaagtatttgttggccaaacttgcgtcctataaggcttccgtcaccttgtcgaagcaggtgatccctaccaggatgaccaccattctttacaggaatcactctctttcatggataaagtgaaggcgtcatctaaatccgatgaagattatgaagatttttttggtcatcatatctgagtcaatggcaaaaaagatcactgatcaagagacatacctaaaggcgtttgtctttcttagtggtttgtcgagaacaattagatagttattttacaaccatttgtctttgtaagtaaagagagctatccgccagatgaaaatcatagtgcaagtcatagcttggatggtaacgaagaaacatgtacttcgtgcatctccgacttcttgcaaacatctacaagaggtgtgtcagtttcccgagaagtttgtttatatgtttttttgaaggtgggcgcgagctccaccacagcctcgtcctctccttcccggtcgctggcaagccacaggcatgaggaagggcgggcccgagaggtggtttccccccccctgttgtcacctccttcgtttttccctaccattgccagggtcatcctcctgcgccatcatcccgtccgcgtcgtttgatactcgttcctccgtacgggatgagcccttcggcgcttctttgtcttgcatttaccggtgctcgtaggatgtgtatctttgagttttcttcttgttgacatttcacggaaaggtctatct

SEQ ID NO: 6654 - DNA, 441 bp, Sorghum bicolor
  unsure (1)..(441): unsure at all n locations
  Clone ID: SORBI-28MAY03-CLUS50873_1
gcacgaggcttgtatcagcaagaggttgatacactcagaattaccgccttcaaatggtttcctcatagttgaggcaaatggtggcttgaatcaacaacgcatttcaatttgtgatgctattgctgtggccaaaattcttaatgcaactcttgtgacgccagcatttcatttgaatagcgtttggcgtgattctaggtaaaagtttatgtttacataataatcagagatgtattttgagtaactgaaatgtggtatatgccttcctccttttcttttcttggaaactagttttttactagtgctttactatactaagttgggggacagttacttctgttattagtctcctttgcaagtgtttttctcgttaatctttcataacaaggctggaatgaataagttaaatggattatgatcccttcctattgcacgcggnncttt

SEQ ID NO: 6655 - DNA, 909 bp, Sorghum bicolor
  Clone ID: SORBI-28MAY03-CLUS50892_1
ccgggctgcaggaattcggcacgaggatcctgttgttgccagtgcagcccttgttagtggcatctacttgcttcaaacaagtccggaagttgtaaaaagatgcaccagggaagttcaagaggctgtgcagtcaagagctgctcttgtgcagtttcatgcccttgctcttcttcaccaaattagacaaaatgatcggttggcggtcagcaagcttgtcactagcttgaccaggggttcagttcgctctcctttggcccagtgcctacttattcgctatacaagccaggttattagagagtctggcgtgaatcaaggtggggatcgtcctttctttgatttcctcgagtcctgtctccggaacaaagcagaaatggtcatacttgaggctgcaagagcaattactgaactgaacggtgttacaagccgtgagcttacacctgcaatcactgtgctgcagttgttcttaagttcatccaaacctgttctcagatttgcagctgttcgcacacgcaccagggttgcatcaactcatcctttggctgtcacaaattgtaacatagacatggagagcttaatctctgatcagaacaggagcattgcgacccttgcgattacaacactgttgaagacaggcaacgagtcaagtgttgatcgtttaatgaaacagatgaccaactttatgtcagacatagctgatgaattcaagatcgttgttgtcgaagcaataagatctttgtgcttgaagtttcctctgaaatatcgctcattgatgaacttcttgagtaatattctacgggaagagggtggatttgagtacaagaaagccatagttgattcaatcattatactcattagagatattcctgatgcaaaggaaagtggtttatttcacttatgtgaattcataga

SEQ ID NO: 6656 - DNA, 553 bp, Sorghum bicolor
  Clone ID: SORBI-28MAY03-CLUS50899_1
tcttctgggaatccactagagcctgttagtgatacagctgccaaagattcatcagagcctagaagtgacatgcacgaggaaaaaactgcagaatcacaaaataatgcagatcagtcagttgagcagtcaccagaaccgcaaagcgataaatcaactgagaagccagaagtgcatcaaagtagcacacctagtgatgagctttctaggcttcaaagtgatgcaggtgctgataaactatcagtaccatcatcagatcctgagagcaatgcatctgtcagtaagccatcagagtctcaaactgatgtgattaccatggaggcaccagaactccaaattgatgctcttcctgataaggcaactgatcagccagtgaaacctcaagatgatgcatctgctaagaagccaatgggaactgaaagtgatgctgcttgtgataaaccgtcggagagcagctcagatactgaaacacttcctgtatgccatcagaacagcagcataaccactgatgaacctgtacagggtgacatttcttatgagacaccacatcagagaa

SEQ ID NO: 6657 - DNA, 608 bp, Sorghum bicolor
  unsure (1)..(608): unsure at all n locations
  Clone ID: SORBI-28MAY03-CLUS50114_1
ctgctgncattgggatgacaatcaaagaagcaaagaaactagagcattttttctgccagacctgtacagctgaaaatgggaagatggttgagaattcacatgaagctacagcgcaatcggaagaaaagccggtggagtcaaaaaggcggcgaaggtgatggccctgctgattaaatccatgctgggttgtacaaagccttcccaagtttgagaacctgtaattttattgttcgtcgcagtttgtggttcaggggtccccctctaatgtcaggcacacagtgtacatagcttgcaacctgatcagattgttgtattagagcatactaggatttgtgtggtggtagcatcggcagtcggactattggagtatatgtagagttgtatggcatcgtaatgccagcagcatcaggtgatcaagcttcctctgggcattaggactcctgcatatgatcgatccagcaataataatacttccatgcagctgcagctggacctggctagtcagtcactagtaagttgtcaggaaaaacttttgtattgtcatgtgaaccttttctgaaatcctgtgtaatgcaagcatcttagtgtggtacttgcaaaactgttgc

SEQ ID NO: 6658 - DNA, 674 bp, Sorghum bicolor
  Clone ID: SORBI-28MAY03-CLUS50187_1
tgactacgcaaggtggaaatttccctcatttccttattgggcatagaagatacttgtatggtggccatgcgaagacaattaagcctgataaaagaagattggccatactctttgatagtccacgtattggatggaagtcactgaaacggcaattgttcaatatgagagcacatagtgacgtgaagggtattgaaataaaaagagcaaatgaatctgtatacacctttccatgccctgattgcatgtgccgttcaaacaaacaagaacactccaaatccatcgtggccagatagcatctaatagttgtatcttagactcgattcactgaccccaattctttctcggcgttgtggcatacgcactccttattctccatatgctgtctggtggtggtgagatgtttcatgtcctccaagcacccctactgaaccgttgctcatccattccatcctccccagggtggcttctggctgtatagcctcgggcaactgagatatgtcaaattctttacatctaaccctggcactaacaatacactgatccatgtctagaatagatgtatgtaaccatacctagggctattcctcaatagccatagtgttaatctgtctgtgtagtactaagatccccttgtaccccaatgtacattgctcaactaagaaggattagggaag

SEQ ID NO: 6659 - DNA, 593 bp, Sorghum bicolor
  Clone ID: SORBI-28MAY03-CLUS50209_1
cttttgtggaatttgtgatggctgaaagtgctactgctgctctcaactgcagtggtgtgatactgggatccttgccaataagggtgagcccgtcaaagactcccgtgcgtccccgcgcgcctcgccagctgatgcactagatgtcgtaggtacaggaggtgctgatggcactgcttatatataatagagatagacatatatatgaaaaggggaggaaagaagtcgcgacatgtgtcttttgtttttaagttatgggctcggccttttttttttcttgcttcaccgttcctccgtgagtaaagcgcctgcgcccggagccagagagatggggaaatcccgggtcgaggctgggtcctttttaccttgcacttgcacatagaggagagcttcttactagaaggaagcatggggtcggtctgcctgatgatgctcttgtccttgatgcaacaaaggcaaaactcctggacttttaccctgtgttcagttgtttgctgtgtcctggttgctactgaaaaaaaaacataaacttggggattggagactatgaactcttgcttaccgttatatgccctacaaaaccttttggttgcttc

SEQ ID NO: 6660 - DNA, 545 bp, Sorghum bicolor
  Clone ID: SORBI-28MAY03-CLUS50294_1
tactgggctccaatcctccgcctcgtccgtcgttccccgcaccttatcctctccactttacagtacctgctctcaacttctccctatctcaatggcatccgcgaatgccatctccaccgcctccctcatctcgcccctctcgcagggcagggcgaggagggccaggaatggccggtcacagcgcttcgtagtgcgtgcggaggccaaagacatcgcctttgaccagaaatccagggcagccctgcaggccggcgtcgagaagctcgcaaacgccgtcggtgtcaccctggggccacgagggaggaatgtggtgctcgatgagtatggcagccccaaagttgtgaatgatggagtcactattgcccgggctattgagctgtatgatccaatggaaaatgctggtgcagcattgattcgtgaggttgctagcaagaccaatgattctgctggtgatggcactacaactgcttccgtccttgctcgtgaaatcatcaagctaggccttctgagtgtaacgtctggtgcaaatcctgtgtcacttaaga

SEQ ID NO: 6661 - DNA, 627 bp, Sorghum bicolor
  Clone ID: SORBI-28MAY03-CLUS50302_1
ctttctctctgtctctctcgatctccctcacagcgccgtcctccctactcctccgcccagaagcctccgcatccggcggccaccccttcctgctcctcctccataggccaccaccttcacatctggcgccctccccgccggatgttgccccttggcgctcctccccttctctctggcgcccccctctctcagcccggtgtccagatctactggtccgagcacaatcgcatcaggaagtggcagctccgagcacagtttaatttgagtgtccgagatgagcccgtattccggccgccaaagtcttggtcaggccctctgcaggcgacgagcagccacaacaacggccacgtatgcttgtttcttctcttcccttccttttgtgcgaaattgaggatccctaatttaggctatttggttatacatattcgaaactgatctgatataagcccgagcgttggcggctgggcggcgggaggtggcctcaggttccggcagttcacgttgccgctcgtttccagacctggtcatgtcgtggtctttgtactttccttctgccactctctaccgtcacctcccctattggaatatgaaaattatttgcaaagtactagttatgcaaagcccact

SEQ ID NO: 6662 - DNA, 485 bp, Sorghum bicolor
  Clone ID: SORBI-28MAY03-CLUS5030_1
gcacgagtcccagtcgtggttcgtcctggtcacattcgctttgaaccagcaggtggagaacccaacaaatcgccagcaaaggaattacagggcacattccaatggagtgcaacaatgagcaaaaagaagggccagaagtggggaatgaatagctcaaacaagaaaagtgctgatattggctatcatgcaggaatagctggaagcgacacagaagttaacaatcatgtcatggacattaaggttactaaaaatgacttttgtgctgtcagtaatcgaaggaacaatgaaggcagtaatattgagatgtccagtgtgaaaagtgttgctaatgaagaaaagtctagtggtgaacctttcgattttgagagcttgtaccccctaacgcgtcttccaaaggagggagatctgattgcctacagattggttgagctgtcttccatgttgtgtccggagctgtcttcgtaccgtgtcggaaaagttcttat

SEQ ID NO: 6663 - DNA, 653 bp, Sorghum bicolor
  Clone ID: SORBI-28MAY03-CLUS51060_1
ttcgccaccggccaccacgccgccacgccaaccctagggtctacgctacgctacgaggaaggaggagcaagagggaagcggcaggtcgatggtgtccatgagcacgacgccgcacccgctggatccgtcggtcccggccgtcgccgggggcggcaaggaggaggaggaggaggcggggcgggcgcgggaggaggccgccgccgccgccgccgcccccgcggcggtgcccgtgccgacggttgggaacgacgacgacgacgacgggccccggagggtgcgcaagccctacaccatcaccaagtcgcgcgagagctggaccgaccccgagcacgacaagttcctcgaggcgctgcagctctttgaccgtgactggaaaaagatcgaagcatatgttggctccaagacagtaatacagatcaggagtcatgcacaaaagtactttttgaaggttcaaaagaatggaaccggtgaacatgtcccgcctccacgacctaagcgaaaagctgctcatccatatcctcagaaggcttccaagaatgaaccaaactatgggctcaagacagattcatcttccatccataggaactctggcatgaatgtgtctgtttcttcatgggctcatagttccatcccacaagctgttgcttcaacga

SEQ ID NO: 6664 - DNA, 671 bp, Sorghum bicolor
  Clone ID: SORBI-28MAY03-CLUS51061_1
gcacgaggcttctatgccctatgttcagaatagcgagtctgatttcacaggtgtgtcatgtttcagccatatggataaatcattccgcaccggccctgatagagtgaatctttccagtgtcacacaatctgaggctagtctttaccctactgatcctttgcaacaaggcgactttgcaccagtaattaaacaaaacttccaaccattacatagttcagacaaagtaccatttttcaaggagcactcgtcctgtggaaatgatgttttgaggaacaaaactgaagcttcttttgtggaaccacttgtgtattcaaatcgtcaagaggtgtacactaactcaacagagcaaataggtgctgaacaatttcaatcaggatgtggccaacaggacaatgatgccagagttcagacagcatcacatgaaaggcatcaatcttcaaccttgtgtgaaaaccagaactctcattcagaggtcttgcaaggagttgctgcaggctcaacgcataagttcattgatattcaaaaggggccaccagaagctcaacaaaatggatcaaaagcaaagaaggtacggggccgacctacgaaaacttatgactgggacagtttacgaaaagaagtgctttctaatggtggggataaacaaagaagtcatgatgcaagggatactg

SEQ ID NO: 6665 - DNA, 496 bp, Sorghum bicolor
  Clone ID: SORBI-28MAY03-CLUS51102_1
gcacgaggctgacatactcctcctcttcctcatcggctcctcccctgtagagagagaacccagagagagaaagggggagcgagctctgagatggggaacatctgcggcgggaaggatcgggtggccgaggatttcaggccgtctagcccagggacgacaatgacctccaagacgagcggcagcctaaccaccagccagagcaccacagggaagctctcctccgtgagcagcggcttcatggcgtccgccggcagccgcagcaccagcggcgggttcgtcgacgagggggccaagtaccccgacggccagatcctggaggctcccaacctccgcaccttcacattcatggagctcaagacggccaccaagaactttaggcctgacagcgtgctcggtgaaggcgggttcggcagagtctacaaaggttgggtggatgagaagaccatggccccgaccaggaacggcaccggcatggttgttgccgtcaagaagcttc

SEQ ID NO: 6666 - DNA, 679 bp, Sorghum bicolor
  Clone ID: SORBI-28MAY03-CLUS51196_1
agtgccagctgcctgggctcccgcccccgccgccgccgcagcagcagcaaccgaggcatcagcaccaccagcagcagcaggggccgacgcggtgggagatgttcgacctgctgtcgtcgctgccatccacgtcctcggcctcgtcaacgaccaccgtgagctccacggcgtcctccggcgcgccgccgacgaaccgcctggactggatgctctgactctgagtgcaacccgtcaccggccaccggccaccaccagcgcaaaagcagcagcgagtccgatgtggggggaaagcgagagggcgagtgcagatgcgatgcttgtgtgccaagaattgcaccctctgcctgcccaccctgcccggcagaaatctggtagctctcctgatgaggccatgattggatttgggcaggcaggcaggcagggctacgctagctttgatcacacaactgcattgcgctgcatggtaccgtaccagccaattctagttcatcaatcaatcattcatgtgagagtaatttttttttcttcttcttcttcttctgttcttcttgttgctgttcatgaaacgtttgagattcttttgtgtgcatactattcagatagagaaagataaggagagaatgagagagttggttagggcaagtgaaatgtattcagattgggaataataagctagttg

SEQ ID NO: 6667 - DNA, 736 bp, Sorghum bicolor
  Clone ID: SORBI-28MAY03-CLUS51200_1
cagagttgaagatgtgcagcgtctacttcaagtcaatgagtctcgtggctttccaggcatgttgggaagcatcgattgcatgcattggaggtgggaaaattgtcctgtggcttggaaggggcaatttacccgtggcgactatggagtcccaacgattatcctggaagcagttgctgataaggatctcaggatatggcatgctttctttggtgtgcctggttctaataatgacatcaatgtgctgaatcagtccccattattcattgaagcattgaaaggtcaagcacctcaagttcagttttctgttaatgggaggcagtataacacaggctactatcttgctgatggaatatacccagaatgggcagcctttgtgaagtcaataaaagcacctcagatggagaagctcctcaactgaaaaaagacttaattgagcatatttggcaaaagtttgccaataggagaaataactagttgtgtgtgcaatatcctctttctttaaaatgttcctgttgggggttcttcctgaatgctagatatggctaaataaattgagactctggatgctagatatatttccaagtcattagtgtaatagttagttgctcatggtagtagccttaagcttttaaatttgtgtgccccctttggtctatcttatgctgtgaacttgatgtaacagccattatattttaccaaggaacaatattaatgcttattgcttcagtcgataata

SEQ ID NO: 6668 - DNA, 563 bp, Sorghum bicolor
  unsure (1)..(563): unsure at all n locations
  Clone ID: SORBI-28MAY03-CLUS50618_1
gcacgagggattaaagagctgtggngaagactatngaaaacaattcttctattaaagccaatcttgtaaaagattttgacaaagggaaaccatcttttggttgttttagtctgagtttttacctgacagcccctttttggccaacgaggtcctggtaccggctgctaaagccgagccacctggagccgtcgatgaggttgtcgacgtgcacggcgagcttgagggagctggccgggttgtggaggacgacgtggaaccacaacctagggacggtttgatcatgttttgccgtactacgcagatgaagtcaccatagttgtcggtcggcatgatgaaggagtcccttgactttggtgttaccggattatggattatgagtgttgcttcatttgtgtattgtctgtgatataggctatatatagtaggacatatgggtaattgtgtattatctgtgatataagctatatatagtagcagatatgggtacgtatgtaattttctaaaacacaatcagcccattgttttttaatattaaaaaaaaaaatccgagggggggncccggt

SEQ ID NO: 6669 - DNA, 674 bp, Sorghum bicolor
  Clone ID: SORBI-28MAY03-CLUS50660_1
catcgattgacagaatcgtcccacaagaagctcctagtaaatgccgagaaaacagtaggcgctcagatcaatgatgcagaaaccaaaattgcagaggtccagaaggtaggtcaaaagcggttttcaaagctcacatatgccttattgaccaaatgctcatctctttctgacactcctgcagagagcacgcaagaggatgaatggcctgaaatacgtgctcaaggagctgattacagaaactgcagattgactgatcgaagttccttcgctctgtccaagtacatatcacaggtgcaaagattaggaagcacaggatgcgcattgcaaacacgtctaagggttccatttgaaaggggtacaggagaatcatgatgcacgtaggttttgtcagaaattgagttttgcaaagactttttttttacttccagatgtttatagtatcattttctgggccgtaccttcggttaggattttcgctacctggtcgatgtgcatagtgcactgctgtgttggttgcactatttcgcacgagtgaccaaatactatacacagaaaaccgcaacacctaatgtctttcagctgtatgtgacctacaggagggtgcactgttgcccttcgttcttcccaaactctgttaagagctggaatactaatgttaaaaaaaaaaaaaaaaa

SEQ ID NO: 6670 - DNA, 647 bp, Sorghum bicolor
  Clone ID: SORBI-28MAY03-CLUS50662_1
gtatctcttagaaggcctcaaacgcctatgtgaatatactattgcgaaggatgtgaatcttgataacgtatctgacatgtatgacttgtccgaagcctttcatgccgtgtcactgagacatacatgcatcttgtacattctggaacattttaacaagatctgcaccagagccggttctccacagctgatccagcgtgtcattccagagctccgcaatttcctaaccaaggcactgagttcatcaagaagtccaagcccaagcgacaggaactcgcagatttgatttaagtcccaattcattgacaccgacgccgtcatctgaccaaagtttgctggagatcctgtacagtaacgtttctggctctgagcgttcgatggtatctattgtgtgtacatggtggccgggtccttcaaattaacatcagcagtgtaacaaacttttctaagatttagtagaggatatgggtaaagagaacctgtgtcttagtcatgcatcgagccatcgaccagcttacactgggataggctgtagttggatgttcctaattcgtcggtcccagctttgtttctgagtttagtgtttctttccagttcacagttcagtgtatgcccccatctgtttaatgtatgaagcttgagcaagttag

SEQ ID NO: 6671 - DNA, 603 bp, Sorghum bicolor
  Clone ID: SORBI-28MAY03-CLUS50682_1
ggcaacttatgctatgtatttggagctttaagaggcttttggggacatagtaatcaagatatgagaataaaggtaaatgggggagaatggggaactgtccataaagtcactgccctgtgcataggaaatgccaagtactttggtggtggtatgaagataactccaacagctgatccatttagtggcacccttgaggttgttattcttcaagatttcaaatggtacgactttcttctgaagctacacaggctctatggaggcacacatctatcagtgaatggtgtttcgtcaatgagggttcaatcaattgaagtagaagaggtgacgggtagtggtggcatttttgtgcaatttgatggggagcatttcggctttctgccaaccaaattttcagttcttcctggggcagttgatttcttctgctagatccccatgctctcccttcctattggactggcagaacgatgcacgattctgtgtcagatcagtgctttgaaatgatatggcaatcgagtagctgcattcatcgccactgtacatgagcaatgtgacggtcttgtttagttcactcaaaaaatcaaaaacttttcaagattttccgtc

SEQ ID NO: 6672 - DNA, 1059 bp, Sorghum bicolor
  Clone ID: SORBI-28MAY03-CLUS50734_1
gcacgaggcctcgtgccgctggtgctgggcgcagcagccgtcttcttcgagcacatccgcaagatcggatgcatgtactctcggccacaggctggagaggtccaccgtctcggatgccttcttcgaggaccccaactcgctcaagaaggttccctgtccttcggatttttatcctcctaggaaatacatttcgttgatagttcctgcctacaatgagaagcatcgacttcctgaggctcttatggaaacactcaagtgcacattcagaaatggaaccaataaaagagataaaggtcatgaaagaatttcggaagcagtcaactcagctggacatgatgacatggagatgaactttaccttgggtcagttgacagaatggattcactgaaccttgctggacagttcaatgcttcttcaaggccaactcccacttctctaactatagttttttcttcttttgttctgtttaacaggtggctagctgctcttttgcagttaccaaatgcattttgttatactgctactttttccaaaccttttctacaagttgactaaaaatttgttaagaatgattgagaaatccttcttgtaggaaaaaatggtgcaagatcagagctcctacattgatctgctcctatgcagagccgttggctgcatgctgcattggtttctgcagcttattcataggacgtgtcagttgcagctcgtaaaccagtgtaggattttgctggtcttctgtcaaaatccattaagatgccgagcatgtgccttctagaggacgctatccatttggtactgaaagcacatctatactttagcttccagttttctcatctccctcagcagttgtgttcggctcatagttgcaggggaatacttcaaggctcttgagtacctggatgttctgtcatgtccttaggttacaaaagatagctgcgagaacaagtgcgagaccagtgttgtatcctgctggctataagttgaattctatggcagtttcctagaatttgatccatctgctgagacatgcttctagaatgaaactgtgacctcagttct

SEQ ID NO: 6673 - DNA, 1172 bp, Sorghum bicolor
  Clone ID: SORBI-28MAY03-CLUS51485_1
ggtggccgcggtggcagaggggttcaccgagaagcccggggcggagcccgtagaggagcggccggaggcgccggcggagagtgcgggggccgagggttggtgtgatcacgcatgtgggtggtcaggagggccctcagggggcgtgcagggcggtgctggcggggaggcctgtggggggtgccacgctggtggagccacctctgagagtggtgatggtggacccgatggagtggccgtgcctcgtcaggttgcgtaccctgccggggctgccactcggctggcgcgacccctcgtactactgaacgtggtggacatcggggggggcgttccccgctcgagccccctcccggccttgccccacgccccccaggctgtgctcccccaggtgtctggcccccgggctgggtcatgccccgctccggctgcggtccccacgcttggctcgcagggcccagcggcctccaagtctgcgggtgaggcgccgggctcttcctcctgtccccgggggggcggtccctcgacagattacataccttgccttgacaacgagaaggctagcacgaggcttcgaactactaaacattatgaacatcgtgagaggcattgccctgaggagcctcctacctgccttgttccactcccagaaggatataaacgcccaattgagtggccaaggagcagggacaaggtatggtacagcaatgttcctcacactaggctcgcagagtacaagggacatcaaaattgggttaaagtatcaggtgactacctcctgttccctgggggtgggactcagttcaagaatggtgccctccactatattgatactattcagcaggcactgcctgatattgcatggggcaaacgaagccgcgtcattctagatgtcggttgtggagttgccagctttggaggctacatgtttgatagagatgtgcttaccatgtcttttgctccgaaagatgagcatgaagctcaagtacaatttgcattagaaaggggaattccagcaatatcagctgtgatgggcaccaagagacttccataccccagcagagtctttgatgtcattcattgcgctcgctgcagggtcccttggcacattgaaggtggcatgcttttgctggaattgaccgcttgttacgccctggtggttactttgtctggtctgc

SEQ ID NO: 6674 - DNA, 465 bp, Sorghum bicolor
  Clone ID: SORBI-28MAY03-CLUS51518_1
gcacgaggcagtcttgactccccctccccctttctctctctctctctccggcggggcggccggaaatctccccaaattcagctggtttcacgggagagatcggccggtgggggggaaaggacgagtcttgagctggatttcttggcggattggctcgcattcgcaggaactgtgtgtctgtgttcaggaacggggagatgagctgcttaccgtgctccggttcgtcggggaaggaggccaagagcttggcggcgctctcgccgacgccccggcctgcggcgaaggcagcaccagttcgatcaaattcacgtgcttcgggctccaagaaggaagattctgtacctgttcgcagaggaggaaacattccacatggcccggcacagattttcactttccgggagttggctatcgctaccaagaatttcaggaaagattgcctattgggagaaggtggctttggtcgtg

SEQ ID NO: 6675 - DNA, 494 bp, Sorghum bicolor
  Clone ID: SORBI-28MAY03-CLUS51477_1
gcacgaggcttccttccccgccgctcgcgtctcccctctcccgaaaccaaacccctcgcactccaactcctcaatctgagcagtgtagaactctctcgccctactccgaccgtcaaaaaaatccaatctttccgctcccctccgacgttctcggaggccgcacggctgcaagattgatcaatcctgcgcggatcgagccgcagacaccaccagttccaatccaatccccagctgggtgcttgcggaccgcagagcagagcccggacggagcatggggtcccgatccgccgccagcgcggcgctgcggatatggctgctggtgtccgtggcgctgctgctgggctgctgccagggaaggttcgtggtggagaagaacagcctcaaggtgacggcgcccgacgacctcaagggcacctacgagtgcgccattggcaacttcggggtgccccagtacggcggcaccatggtcggcttcgtcgcctaccccaaggcca

SEQ ID NO: 6676 - DNA, 471 bp, Sorghum bicolor
  Clone ID: SORBI-28MAY03-CLUS51555_1
gcacgagggctcaccggaactctgcgcacgaggactattgtttctgaggtgtggaactattgttagtggagatagtaccgggagcgtacagttttgggatagccaccatggaacacttctgcaagcccactcttatcataaaggcgacgtgaatgcactaacaactgtgcccagtgagaacagggtattttctgcagggtctgatgggcaggtgattttgtacaaaatgtcaaaggatgaatttggtgctactaaaaatgtggtcaaagagcaagttcacaaatgggtctatgtgggatatgtgagagctcacactcatgatgtaagggcattgaccatggctgtacctatctgtagagaagatacattacccgaggaaaaggtggtgaagattcgccggcgtgaaaaacatgaattcagttaccacaaatgggctcatcttggtgttccgatgcttatatctggtggtga

SEQ ID NO: 6677 - DNA, 826 bp, Sorghum bicolor
  Clone ID: SORBI-28MAY03-CLUS51580_1
gattttcatttttttacctccttcggctgcgtctgcgtgctgcccagcccagcccatctcgtctcagcgataccggccgccgccggcgaccttcggtctatcgaactcgcagcgccccaacgccggtgatcccgctgggcggcaggaggagacgacgggtgccgcggagcgccgccgccgcccgatctccctcccttgggcggtggactgcgtcattgctccgtagacaccctctggtccgtcccgtgacgtgcctccgccgcaaacccgctcgatcagcctgaggctggggatctaccgggacttggatagattcatttcaattcaaagctgggcagatggcgcagatccccaatctcgacaacgcgccgctcaaccttgcggctctcagggagcagtcgcagaaggacctgcttggcatcctaaaaaatataagggggaagaagtgcttggtcattgatcccaagctcgctgggactctgtcactgattgtgcagacatcgctgctaaaggagtatggtgcggaattgcggattctctcgcccgaccccttgcagacggaatgcccaaagatcatatatcttgtgcgctctcagctaagcttcatgaagttcattgcaagtcaaatcaagaacgatgaacctaaagggctccagagggaatacttcctttaccttgtacctcgccgcaccgttgcttgtgagaagatcctggaggaagagaaagttcatcagagactgacattcggagaatatcccttatatctagttccattggatgacgatgtcctgtctcttgaacttgaccattctttgcaggaatgcct

SEQ ID NO: 6678 - DNA, 633 bp, Sorghum bicolor
  Clone ID: SORBI-28MAY03-CLUS50935_1
gcacgaggcttcccttatcgtctcctctccctttcctcccctcgcaaccccgatcgaatcgcccgaaccatttcacaggtttgtgcatcgatctaggcttgcgcgaggatccaattccatcccccctcccccctttgagcttgcgttcctcggagtcggagttcttcgcgagccttttttccccccaccgatttctttttggcttatttgtgcgagctttctcaagagcagaagaggcagtttgcaattccgatgcgcccaggcctcaagatccaatcctgaggccttttccgagctatccgcatcgatctgtgcaagaggatgggtaacgcgggtaccaacggtggaggcgccgccgctggtcaccgccgtcggagctccagccaccgccagggccaccaccaccaggcgccgccgcctccccagccgcaggagactgcgcccaaccgctacgtgttcgcggccgccacgccgtatccgccccagtaccctaaccccaacccgccgcagtactacccgcagtacgggaactactacccgccgccgccgccatccgtgccggtgccccttccggcgccgtacgaccaccaccacaggccacccaccgccgcccccggcgagttcccgcccccg

SEQ ID NO: 6679 - DNA, 591 bp, Sorghum bicolor
  Clone ID: SORBI-28MAY03-CLUS50940_1
gcacgagggtaccgcggacagctgaattcagccaagcaatatctgctctgagtttgtcaggtccttgagatgggatcactcaagatgactgaaaaagctcccggtgctgcactgccagagtcttcatgtgcctacttgcttcaagaactcaagatgatatgggatgaagttgggcaaaaccaaaatgaaagggaaagaatcctggaagagcttgagcaggagtgccaagaggtttacagaagaaaagtaaatagtgcaaatatgtctcggattcagctgcatcaagcattagctgaatctgaggctgaatttaccaacctgctgctatcccttggagaaagatcattcccaggacgtcctgagaaaatggcaggcactctaaaggagcagctgaattccattacacctgccctacaagaaatgcagatgaggaaggaagccagagtaaagcagttcatggaagttcaaactgaaatacacagaattgcttctgaaattgcaggacgcttagggaatgaagctgtcactgtgaatgaagaagatctgtcactaaagaaactcgaggagttccaaagcgaattgcaaagactg

SEQ ID NO: 6680 - DNA, 459 bp, Sorghum bicolor
  Clone ID: SORBI-28MAY03-CLUS5098_1
accattagaatgtgagaaagagagggaaactgccgcccaggcatctatctatctatccgtcgccgccggccatgccgagatcctcctccacctcctccaactccaaccccggctccaagcggatcctggggagggcgatggccaccatcctggcgctgccgctgacaccgatctccaaggcgaagctgggcctgctcctcttcaagaagcgcgcgtcctccgccgccaggcgccgctgctgctacaactacaagccgttccgccactacaactacgcctacgtgggggagtaccagttctcgccctcccactccccgctcctcccggccccgccggggccccccggagtcacggcctggcggagggccagggccgccgccaagaggcgccggagcagggccagggtgatcctcgcctccctcttttgcggcggtgacgagctccacgtcgccgtgctcg

SEQ ID NO: 6681 - DNA, 539 bp, Sorghum bicolor
  Clone ID: SORBI-28MAY03-CLUS5101_1
cctccccccctctctcttcccccggggcggggaacgcacttctccatctccgtctctagggctccattcccctgcacctccgccgccgccggatcccacctcgcctcgccgccgacgccgcttcgtcatcagaatcaccggattcggtggtgtttctcggctgcctcagcttccgcggggggaggcccctggcggcgctccccgccgccctccggccttcgctgagtcctctagaagctggccattgctgagacttgagaaggctgctgctgagtatatggtatttgtgggccattgtgctgtccatgcgagcggagagcatgcgtggcaactgtgcttcgggtgatgcccctgaccagagtagctgccgatgcattcggtgtgttgacaatcgcactgtttgcgctgtttgctgctctgggcctcttctgcattttccagtcagtctacttcaggtgtcggattcggagaggaccccccttcctttcgcttggttactttaacgggccatgggtgactcgcattgctctgattctgat

SEQ ID NO: 6682 - DNA, 356 bp, Sorghum bicolor
  Clone ID: SORBI-28MAY03-CLUS5090_1
gtttgtgctactacgggccgcacctgcagagggtcatttatgcccaaaagccacatctgttagagctggtggaggaagggtctgttccagaggcttctgctgatgtggagatggaggaggtggatgtcagcggatggctcgaggccttcgcggcgcacccggcgatcggaaccacctgggggggtgtctccaagtggagcaaggaggagcaatcggcagcgctctcaacagccacggattcgacagcccaggagctggcagagtggaatgccaggtacagggagaagtttggcttcgtgttcatgatttgcgcatccaggaggactgcgcctgaggtcttggctgagcttaagagg

SEQ ID NO: 6683 - DNA, 602 bp, Sorghum bicolor
  Clone ID: SORBI-28MAY03-CLUS51051_1
gcacgaggacattcagcccccgcgggttgatgagaatgtgagctttaaagatataggtggactatcggagtatattgatgctctgaaggaaatggttttcttcccattgctgtatccagatttttttgcaaactatcacatcactcctcctagaggtgttctgctttgtggcccaccgggcacaggaaaaacattgattgcccgtgccttagcttgtgctgcctctaaagctggccagaaggtcagtttttacatgcgcaaaggagctgatgttcttagtaaatgggtgggagaggctgaaaggcagctaaagttactttttgaggaagctcaaaagaatcagccgtcaattatattttttgatgaaatagatggcctggcgcctgtgaggtctagcaagcaagagcagattcacaattcaattgtttcgacattgcttgctttgatggatggccttgattcacgtgggcaagttgttttgattggagcaactaacagaattgatgccattgatggggcattgcgtagacctggccggtttgaccgtgagttttattttcctttacctggctatgaggctcgatcagaaatactggatattc

SEQ ID NO: 6684 - DNA, 657 bp, Sorghum bicolor
  Clone ID: SORBI-28MAY03-CLUS51813_1
gtccccgcctccttcgccccgccccagccccacaccccgccagcccgccccgcaaccctcctggaacccgaggacgcctacgagccccgcccgcacccggggtcccacgatgcctcgcgtgctccccgcccaagtcccccccatacatggtccgatgatgttcagggggcctctaaggacccggaccaggcaccagagcccgccgcaaataccgcgggggccagcgagcggggctgctgcacacgccgccgctcaccacgccgctcagcgccctgctcacctccggcttccgcctcccccacgacctcctcagcgagctcctccgctggcccggccgctggcgctacgcccaggccgcccgcggggccgccccggtcggccgcgccctggaggatttctacgtgcggcgcctgtacctgcggatccaggattgctttggtaggccgatcgcaagtgcaccagatgcctcaacctgggttcctacaactaccttggctttgctgcagcagatgagtactgcacaccacgtgttattgagtctctcaagacatactcagcaagcacctgcagtgtccgtgtcgatggcggtacgaccaagcttcacgctgagctggaggagttggctgcgcgttttgttggaaagcctgctgctatcct

SEQ ID NO: 6685 - DNA, 569 bp, Sorghum bicolor
  Clone ID: SORBI-28MAY03-CLUS51775_1
gccccgggcttaagccctcgcaccaaacaatggcggacgccggcgccgagcttgtgctcctcctctgcccccgggccccgccgcggccgtcgcttccgcatagctccgtatatccactgcggccacggagcctgctcagagctcccccccgcctccgccctcccatctgtctcaggtgccgcgcgctcgacgccagtaggccggttgcggtggagagggagcgggagcgggacgaggaggacgggctcgaggacgaggaggagtcctacttctcggtcacctcgtcggggctctcggacgtggactacctcggggagagcaccaggggggatttgaacgtgcggagggagcgcctcgaggcgcttggtgggaacggcaagtcaactttgcatggtcctactgaggagatagcttggaaggaagcgggagaagctgaaacattgcttcatgacttgggaattgcagccccattttcagtaagacactcttctcgcggaattttctgcaccaggacactaaatcttcgatctatcagtgtggttggctatgatatggatatacattaattc

SEQ ID NO: 6686 - DNA, 524 bp, Sorghum bicolor
  Clone ID: SORBI-28MAY03-CLUS51816_1
gcacgaggctggccgcgggctgagaagatggtgagctcaaacaagggcaaagtatgtgtaactggggcttcaggctttattgcctcttggcttatcaaacggctgctcgagtctggatatcatgtggtagggactgtcagagacccaggaaatcaccaaaaaacagcacacctttggaaattacctggtgccaaagagaggctgcaaattgtgcgagctgatctgttggaagaagggagctttgacaatgctgtcatggactgtgatggcgtcttccacactgcatcccctgtgctcgctaaatctgattctagtagcaaggaggaaacgcttgttccagcagtaaacggtactctgaatgtgctaagatcgtgcaagaagaacccatttctgaaaagggttgttcttacgtcttcatcatctgcagtgaggattagggatgatgatcagcctaatatctcactggatgaaacaacatggagctctgtgccactctgtgaaaagatgcagctatggtatgccct

SEQ ID NO: 6687 - DNA, 591 bp, Sorghum bicolor
  Clone ID: SORBI-28MAY03-CLUS51818_1
gcccgcgggctgccctcggctccgtttccctccgctgctgctctctctgagccttggccttcgcatgctctctatgctcctcttccgttcatagccccggccttcgtcttcctccatggatccgcgctaaatgcattgcgagattccagactggtagcatttcttcctgttccatctgccgcaagatgtaagcaggctctcacttgacattcagaatataccctcagatcttcttgtctgagaaaagcgacgccctttttggtccgagcaatggaggagagcttcgtgcccctgcggggcatcaaggacgacctccacgggaggctcgcctgctacaagcaggattggaccggagggttccgtgccggtatcaggatcctggcgccgaccacctacatattcttcgcgtccgcgataccggcgatatcgttcggggagcgggcggccccggccgctcctggggggcgcccagccctccgggcgctggcacccactcccgtgcgccgccgcctccactccattgtgggagggcagcccctgctgatcctgggagttgccgaacccacggtgctcatgtacacattcatgttc

SEQ ID NO: 6688 - DNA, 518 bp, Sorghum bicolor
  unsure (1)..(518): unsure at all n locations
  Clone ID: SORBI-28MAY03-CLUS57752_1
gcacgaggagcatgcccacctctaataatcaatttaccgaggcagttggtttaaacgaccgcgtcggttaagtttgattaatcgagatagttgttttaagttgaccaaatcggtaaatagattaatcaaggcggttgggtttgggcaaccgcctcggttaatcaacattaaccaaggcgagcgcattagattatccgtctcgattaatgattaactaaggcggttgttgggccagctgcccggccacgaataaccgaggcggctaaccggcccaaccacctcggaggccattttgaaatgcctaggttttttttgtataatagtaacaatgtttgcagatatgtgaaccaaatattttcatatagcttttatataattgaataaacatctgccttcatccttgctcataagtgaggaattagaccacatgactaataattacaaaaaaaagttctcactcatgcttagagcagaccagttctcacactcatgcttataacaggtcatccatatnagag

SEQ ID NO: 6689 - DNA, 918 bp, Sorghum bicolor
  Clone ID: SORBI-28MAY03-CLUS5776_1
gtgtgtgtagcgctgtgcgtctttgcatcctcagcatccggggagcgcctgctcgttctggggggaaaggacagcggcgacggcggggaggagttggacctgaagccccggatgcattctcccgagatacagctacactgctagagcacactatcactaatgtttgcctatgacaatggagtcacctacaactgccgctggtgatgaactcgagagctacttgtccttgggtttgacagtatcctgctcagggaaagatagtgctgagtttccaaaggttctgttgcttctctcagcgtatcttgacaagaaggttcaggagaatgaagagttattagattccagtaaaacaaaggagtcaaccactatctttcatggtcagagggtgcctgaacttagtataaagctctatgcagaacgcattttcaagtatgcaaagtgcagcccatcttgctttgtgctgggacttatctacattgagagatatctacagcaaccaaacatttacatgacgtcatttagtgtccatcgcttgcttattgcaagtgttgttgttgctgccaaattcatagatgatgcttttttcaacaatgcatactacgggagagttggaggaattaccacaagagagatgaatatgcttgaactggatttgttgttcagtctggacttcaggctcaaagtggatatagagacttttggaagctactgcttgcagttggagaaggaagctctggttcttgttttggagagaccaattcaggtccaagcagccaacgtgactaaacacctgatttgtaacagcagtgccgatgagacttgcaaacacgagctcgtgcgggaaaggtacagcagtcaggctgtccatggttgtagctggtaaatctgatttgacagaatagttttgaaaaaagtgtg

SEQ ID NO: 6690 - DNA, 602 bp, Sorghum bicolor
  Clone ID: SORBI-28MAY03-CLUS5793_1
caaaaagggaaaagaagggttcgggggaacgccgctcgaatccgtaaccctaaacctccccaaaaccctcctcgcctccctcccctccatccaatcctcgagacgagcgcgcgtgcgaggaggaaccccacggagatggcggcggtggcaagggttttccgcgggtccctcttcctcatgtccccggcggcgggcacgggcaaggcggcgggagccaaggcggcggcggcggcggcgaccaagaagcggaccaaggcgccgtccacggagccgagggtgccgaccgggatctcgaagccgataccggtgtccgctgagttgagcaggttcgccggcggcgcgcccgaggtcgcgcgctcccaggccgtgaagctcatctgggcccacatcaaggctcacggcctgcaggacccagccaagaaaactgagatcaactgtgatgcaacactcaaaagcttgtttggtgggagggacaggattggaatgctggagatcatgaagctactgcgtcctcactttctggagaactagaagcggccctggagccagcgatagtgcttagtctacgacttatttggatgggcctctttgtgatccatgtg

SEQ ID NO: 6691 - DNA, 613 bp, Sorghum bicolor
  Clone ID: SORBI-28MAY03-CLUS57856_1
gcacgagggacccatcttcactcccacgagggctcagtctcagatcccgaactaccaaaccctggcggaggaaggcgggggcggagaaaagagatcacgatcgctaatccgtgaccgcagcgggcgggatggcggcggcgctagctccgggggtgtcccggaagttgaagaaggtgctggagacgcggacggacaacccggatctgctggcctcgctgggcgcgctctccaccttctacgtccagaacaccccgcaggcgcgccgcaacctcaagtcttccattgagcagcgcgcactcgccatcaaccgccacttcctcgacgcctcgctccccgcccacaaggcgctggatcgcgtcgagggggaggtgcacgcgctgaacgactcctggaagaagatcgaggaagcattgagcagttgcagtgcaagtactggggacataattagtacaacagagaggttgcaacaggaacttgaggttataactcagcgtcaagaaattgtgtcatgcttcctgcgggattaccaactttcaaatgaagagataaatgcacttcgggaagaagagatagatgataaattcttcaaagcattgctgcatgttcaagaaat

SEQ ID NO: 6692 - DNA, 520 bp, Sorghum bicolor
  Clone ID: SORBI-28MAY03-CLUS52133_1
cctgacatgtgccacgatattaaagaatgcagcactgtaagatatatgttatataaagtctttttaaaaatatatgttccacttatagcggtgtttgtttacaggttctattgccatatcatcacgatagactctattttgatagctgttacttgattttggtttggagggcagtgctcccatgtaatgcatcttctaaactgtggatgacaatgttggaaccaaaagagacaaggccactttggatgatacaaccaacagaatcaacaagctactatacaagattcgatccatacagatgtgtggctcattggcgttaaacatgtgtggagttgcctgtggtagacttgatttgtgttatgagatgggatttggtggcctctggtacggttcaaccaaatatatgagacatggttttattgttccttttcttattcgtgagtgtattttggattatattaattatcatatgcaattgtctgagactataaactatgaaaaatatatcgttgtttttatt

SEQ ID NO: 6693 - DNA, 613 bp, Sorghum bicolor
  Clone ID: SORBI-28MAY03-CLUS5234_1
gcacgaggggcttcaggactacctatgttcaatggtgggaggagcgatgagttcgctcgttattcttctctcatgtggcttcgagatggaaacagaggggctcagtcactgaacttccagggacttggagcatcaccatggcttcagccaagaatagattatccattgatgggtctgaagccagatacttaccagcagatggctgctgccgcactggaagaaattagagctggggatcatttgaagcaaacatcttctctactgccagtccaacagcgtcaaaatcgtccgggtggattagatccttggtatggaaatcctgttctacagcagatgcaattccaatctcagcagtcatccctgcaagctgtgcagcaaggttatggtcagaatgcaagcgaatctggtttccttcaaaatcagctgcagcagctgcagctgcaaaagcagcaggaggcagcacagcagcagcagcagcagacacaagttctgcagcaacaatcgcatcaggaaatgcaacagcacctctcagctagttgtcatgatattgctaacgtagcttctggcgtgaccgagtctggatctgctcgacaatcacaatcttgtttgcttc

SEQ ID NO: 6694 - DNA, 562 bp, Sorghum bicolor
  Clone ID: SORBI-28MAY03-CLUS52339_1
gcacgaggccacttcaaagtatgatcactgagaaggtagaaagtgtagcagccacattgaagccatctcaaagtgatacagcccctcaggagatcttggagaggaatatggatactgagaaaatattgcaaagtgccatggctgttgagaagccacctccaaccaatttaatcactgagaagccatcaataaaagatgcttcagaggagccagttcaaactaacgaacaatctgagcagccactgaaaactgaagaggttgagaagccacatcaaagtgaaaagattgctgcggagacgaaagggaggcacgaggctattgagaatatgctagagcttgaaagtaatgccactaaattaaacaaggatcactcagaacctgaagggctttcatctggtacgaatcctccagacttccaaagcaatccaaatgctgggcagcaattagagtctaaaggcattgtggctgagaaggaagctgacaatataatggaagctaaaaatgatgcagttgctgagcactcatcacaatctcaacacgttgcacctgctgaggttccaaa

SEQ ID NO: 6695 - DNA, 602 bp, Sorghum bicolor
  Clone ID: SORBI-28MAY03-CLUS52379_1
ctcaatcactactactccaccttccttgtacgcttccaccgtccaggcgtccaccccaaatcaaccatgattcgtctctgtcccctcctcctcctcctcctcaccgccgccgccgcggcgtccgccagcggcgccgacgaggcgcacgtctccatcgcggtcgcggagaagggcctggccttcgccaaggacgtgcttatcggcgaggccgtgcggtcgctaaccccgctccgcctccccggggtggagaaggctgtccgcgtgcccttcctcggcggcgtccgcgtcgccgcctccaacatcacgctcttccacctagacgtcggtgacaactccactatcttccccggggactcgggccttctcgtcgtcccctccggcatcaccgccaacatcagtatgcactggagctactgctacgattcgtggttgtttcctatagagatcgccgacagcggaaccgcctcgatcctggttcaaggaatggaagttgggataaccatggttataaagaacaacaatgggagtttggctctgtctgcttcgcagtgtggttgttatgtgaaggacctagtgatatccctggatggtggagcatcttg

SEQ ID NO: 6696 - DNA, 811 bp, Sorghum bicolor
  Clone ID: SORBI-28MAY03-CLUS51583_1
gcacgaggctttttcctccatagaaaccataacattcttctccaccttgtttctttccaagcccaccatggcctccaagctgagtttcaagaggacagacagtctcgcggaaagcatgcccgatgcgttaaggcagagccggtaccagatgaagaaatgtttccagaggtatgtttccaagggaaggaggctcttgaagaaccagcagctcatagaggagctggagaaatcactggatgacaaagtcgagaaggaaaagcttgttgaaggcttcctaggttacattatttgttccacgcaggaagcagtggtgctaccaccttatgttgcatttgctgtcaggatgaatcctggcatctgggagtatgtcaaagttcattctgaggatctgtcggtcgaaggaatcacaccatctgagtacctcaagttcaaggagacattatatgatgagaactgggccaaggatgacaactcactggaagtcgatttcggtgctcttgacctctcaacaccccatctgacactgccatcgtccataggaaacgggctccagtttgtgtccaaatttatgtcttcaaagctgggcgacaagcctgaaattagcatgaaaccgttgctggactatttgctttcactgaactatcgtggcgagaagctgatggttaacgacaccatcgatacggttaacaagcttcagacagcactgctacttgcagaggtatttgttagtggtttgccaagatacacgccattcctgaagtttgaacagagatttcaagagtggggattggagaaaaggtggggtgacact

SEQ ID NO: 6697 - DNA, 835 bp, Sorghum bicolor
  Clone ID: SORBI-28MAY03-CLUS51593_1
aaaaaaaaaaaaaaaaaaaaaaagcgagcggccctgcatctttgttatcccgtccggccgggcgactccagtgaccagttcttccccctcgcgctctcgctctcgcgtggttctcccgtgcccccggcgtgagcgcgctctttctctcgcgggctcgtggcgacagccgccgccgctgccctacgccaattgctcaggccttctttgggcccttcgccggcggcgagcacccaccaggaagcctttgaatctgaacattgataggcgtttgcagagagaattgataaatacatcatcagcctgaaagaatgggttatggcatgagtaggctagaagatgaatactatgagcctgaagggcagaatactgatggatctggctcagttcaagtgaacaatgagtttgcagaactgcataacgatatttttcatatgacccgaatgagatcaagacttactgaaagctacaagtccatgggtaccaacagaggcataatatcaacggccaagttattatctcaaagggaaattgattgttctggaaagaggatgttctcttctggtgaccgtgcatttgttctaggtcgctatgttccaatgaacggccctcagttattggataggatggattctcgtgcttatgtttcgcagttttctgctgatggcactctttttgttgctggttttcagggaagtcacataagaatatatgatgctgatagaggctggagcatacacaaagacattcatgctaggtggttgagatggacaatcagtgatgtatccttatcacctgatcagcggtatcttgcctactctagtctggcacctattgt

SEQ ID NO: 6698 - DNA, 1239 bp, Sorghum bicolor
  unsure (1)..(1239): unsure at all n locations
  Clone ID: SORBI-28MAY03-CLUS51614_1
gcacgagggctactaaaactgaaatgggaagaaacatgttggctcagcagcgcatgcagcaagctatgatggcaaacaatgcggccaataacttacctgacgggagtgcaaggacatctaatcatgcaggtggtaacatgccatctgacaaccagtctcatcaagcttcccagtcagttggtgctgcaggttctcacgatggtggtaatgtccaaggacaagatccggacagatctactgctgaaggtggcacaaatactagtcatgatcaaggtcaacagagttctacaggtgcgcacggcgcacaagttccactaaggcgtaatagcggacatgggtgggcaacttctgcagcaagtgcatttgatgctgcaaaagacataatggaagctcttagaagcaaacatactaatctagccaatgagcttgagcttttactgtcagaaattggatcacgattcgttactctgcctgaggaaaggcttcttgctgtggttaatgctctgcttcatcgctgctacaagtatccaactgcaaccactggcgaggttccacagtctctcaagaaggaactctctggtgtatgtagagcttgcttctcacaagatgctgttaacaagcatgttgattttgtgaaggagtacaagcaagattttgaacgtgatcttgacccagagagtgctactacttttcctgcaacccttgctggcccgacggagagattgaaacactggaagaacattcttcagagtaacgtagaggatcgggtcccagcagtattaaagctggaggaagaaagtaaaacacttcgggattttcatgttgttgatattgaactcccagggcagtacttcacagatcaggaaatcgcgcctgaccacactgttaagttggacagagtcggacctgacattccaattgtccggaggcatggcagtagctttcgacggttgacactcattggttctgatggttcacagcgccattttattgttcaaacatcactgactccgaatgctcggagtgatgaaaggatgctgcagctattccgtgttctaaataaaatgtttgacaagcacaaagaatctaggcggcggcatctcgctatccatactcctataattattcctgtttggtcccaggttcggatggttgaggatgatttaatgtatagcacttttcttgaggtgtatganattaactgtgcacggcataatagagaagctgactcgcctatta

SEQ ID NO: 6699 - DNA, 663 bp, Sorghum bicolor
  Clone ID: SORBI-28MAY03-CLUS51722_1
ccaaaaaacttttcctcctccccctttccaccgcgccggcgagccgaagcgacgcggagtaaggatgccgcggaccaccgtggtggagagccccggctgcccgccgctccgtgccctcaccactgacatcatcggcctcgtcaaagtcgtcgaggcccacacgaagccggcgggcgccgccaaggtcgtcgagacgtggggcgatcctgacgcctcccgcgccatcgtcgctgcctcccttgccgatcgtgccgccgaccccgtcttggctgtggcaaggaagaacggcgtggttgagttgctgaatcccctgaacggggatgctctggctgctgtcaagaccgtggggccatcaccaaatgatggtggcgcagaaggtgatcccctcgccgcattgcaccttttcacaagacaggcttcagactcgatcttaggaacgtttcttgcctgcacggagcaggggaaagcttctataaggtccatcacgaaagaaaatgcagcttcgggctcggatgttgggccatcagccacatgggatgtgtgcagtggggccaatgtgcaattttgctcagttgatcatggtgaaagctatgcgatgtttggagggaaaggtatagaagtgaacttgtgggatatcacatcttgtagtaagatatggtctgc

SEQ ID NO: 6700 - DNA, 719 bp, Sorghum bicolor
  Clone ID: SORBI-28MAY03-CLUS517_1
gtaccggactcggagagtccgggctacgcccacagatccgagcatcgaccacgagcgtgagcaaccgcccacccatacgtccacggctggagccggcacagcaccgggtcgacgcactccaggctgagctcgaagcatcaagggtcgagcagcagaggatggccgagcggttggaggctcaagagcgccagcgagaggccgaccagcttgcccatcagcaacagatggcagaaatgatagcgttcctgcagtcggttggggcccagacgggtgtagccctgccagctacgctactggctccacgtcaaccctctcatcctccgtcggcgggttcgaacgtggcacctgttatttctccaacacctggcatctcgccgactcctccagatggtggctctcctgcggtacgcggcctaggtgtccctcatatcaactgggggccttcacagtgatgcacttattttttttaaacatgtgaactttgtggaatgtggttattgaacatgtgggacttagtttggatgtatgtgaacttagtttggagtatttgaacttggtatgatggacaaagtgatggaaatgataagtcttgtggttggtgtggttgaacttgttacgatggacaaagtgatggaaataatcatttatgtggtatatattgccatcgatgtcgattatgtgaactataggctcttggatgtgaaatatatgattttctt

SEQ ID NO: 6701 - DNA, 588 bp, Sorghum bicolor
  Clone ID: SORBI-28MAY03-CLUS51731_1
gcacgagggcatacagaatgcaaacactgatgtatatgaaattttggactctcatttatgtttggatgtcagctaacatttatctataacagcagcctacgacctgttccctctcttttgtttatagcgttcttagtgctactcgtacttggtaaactagataactgtggtaagatgcctgggtaagtagatttacgtgtatataataccagattgtaattaatacaataatcttctgaacatagtataatggggagataggatttcaagttactattagtagcctcagctcaatagctgtaagatagctctgaatctcatcatccaggtgcaagagcaacacacggtgagcacggatttctctctctttattttttcccaaaggagatctagcaagttgatcatcatctctagcagcttctgtggacacctcttttaaattctgaagaagtgaagaggttcttatcatgtcattgtctcattgatcaataattaggaactctaaagggaaattgttcgaaagaagagactaaagtgaaacaaattaaaattatgacaacagaatataacatttcaagtgacgtagca

SEQ ID NO: 6702 - DNA, 582 bp, Sorghum bicolor
  Clone ID: SORBI-28MAY03-CLUS52552_1
gcacgagggccttccgcacgaggcttacgagctcatcagtatggtttaacctgccatgtgccacagctctcattgttttgttccgctacatatcacttgattatgaccttcgtagaaagagcacaactagcacagatcatgccagtcattcacttgtcaaaacgaaaattactgaggtaaagaaggtccttcatcagactgaaaaggatggaaaattagattggaggagcaaggttaactctcctccagttgaagcagcatttgaacagttcacaaggcaccttatcacagaatgggtaacagatctttggtactcacgtgtaacacctgacaaggaaggtcccgaggaactcattactatagttaatactgtcctcggggagatttcagttcgggcaaggaatgttaaccttatcaatctgctgatcagggatttggtcgatcttgtatgcaataatttggaactttatcatttctgtcaagccaagattggaaaagagaagtttgtgaaccttccttcagagcgtcgtgatgctgaactgaaaatgatccttctagctgaaaacaagttgcatccagctt

SEQ ID NO: 6703 - DNA, 544 bp, Sorghum bicolor
  unsure (1)..(544): unsure at all n locations
  Clone ID: SORBI-28MAY03-CLUS5258_1
gcacgagggtttcctctacctactcatgaggcaattgtgaagaatggttgccccttggcttttgagcgtaatttagttccctggcgtccgaagcaattttcacttaattgaacagtcctttaattcagaagctgttgtgtaaatcttttgtaggtggagaatggagaaaaacgagaagaaatgctatatatgaagggacctcagacagaattccaaagatatattcggtcatttaattctggtgtgtgattgctcaggggggtgtggaaaggacttggattttctttttattcggtgtcattgaataataggttctgatggctagaaatatttattttgtacactagaataatattaagatgacggtttccatttttgagggacaataaattagcttgtatgcttttntaatggtattttgcatttactaaaattggtttgaacataacctatttactataaatgggaggaattttgttaataaaataagtataaattcataaatataggtgaaaaaaaaacaggaaacaaatgcncgagatat

SEQ ID NO: 6704 - DNA, 493 bp, Sorghum bicolor
  Clone ID: SORBI-28MAY03-CLUS5262_1
agtagagattctacaattcatggtgatgaatctgatctgatgtccacagataatgaggaaaaaatggcagttgaacgtgagatacatgtaaattatgaggaaccaattaaaggtgctgctgtgacagaaacatctgggcagccacaacatccaaatcttgaccatgaactagatgcagtaggtatactggataccagttctgcactccctgtcagtaatacaagacctctttctcctgctggacagaaccagcaaatgcttaagatgaccacaacagcactagataactgccttcttgtgcctagtctcaatgatctgatggctaagcatgagcaagttgagtaccatgaagctgatgattacccggccacttatgatccccaggtaggatcagattctcgtgaggagattaatcatcacctgggggatgacaatcgaaccctctgtattccacctaatgaatccgaatcgccagcaaactccaataaagatg

SEQ ID NO: 6705 - DNA, 661 bp, Sorghum bicolor
  Clone ID: SORBI-28MAY03-CLUS52594_1
gcacgaggggattacccaagagagtcttgctccagtgcattcaggttagaactggagtctgtgaggcctgagccacaggcacctttggaagactacaggctccatctcgagattttgcctctacagttgcatcttgatcaagagcaacttaacttcctaatcaatttcttcaagaatgattcatgtaacaatgacgctcatttgcactgcgaaaatgagactgtgcacgaggagaacacaagcaatggaaacaatacagttgtggatgaggcattgcttcctttctttcagaaatttgatgtaaagccgcttgttctgcatattaattatataccccgtcagtttgacccgattgcactaggcaagggaaattatgcagaacttctcaacattcttccatggaagggaattgatttgaagcttaagcatgtttctgcaatgggtgtttatggatggaacagcatcggtgatacagtagctgcggaatggttggaagacatttcgaaaaatcaggtgcacaaattgctaaaagggcttcctccaataagatcactagttgctgttggttcagggaccagaaaattggtctctttgcccatcaaaagctacaagaaggatcggaaattgctcaagggagtgcaaagaggcgcagttgctttta

SEQ ID NO: 6706 - DNA, 762 bp, Sorghum bicolor
  Clone ID: SORBI-28MAY03-CLUS51865_1
gcacgagggtcctacgccgtcttctggaaggccatcggcgccgccgaccctgtgcatttggtgtgggaggacggttgctgcggccacgcgtcatgctccgccggatctgaggctcctgaagaagctgggtgtgagccgggcaccagtgtgtgcacgcttgttaaaaaggttatggcctcgcaaattcatgtcgttggtgaaggtgccattggccgcgctgctttcactggaaatcatcaatggattgtccatgatcctgctgccaatgatcacaatctcagacccgaggttgctgctgagatgaatcatcagtttgcagctggcattcagactattgcaattattcctgtgttaccacgaggtgtactgcagctaggctctacaagtgtggtagcggaaaataccaaccttgtgctccagtataagaagctgtgttctcacctcgacgtgcgctccagcttggctccaccggcgtcggttgatatccacgctttcccgactgggattactatataatatatatcgttctacatgtcttgaagttgttctctgccattattatatggccatgatgtactactttatgactgtattactttgttgactggtcaaatgttctgttcccttgatctctgtatataaactatattgtcgtgagatccgaggagacaaaaccttcttgtggacagtagcggaaccctgaaaagaaaaacaacttgtgataattgtgctctatttttgcacttaggattgctgtgaaag

SEQ ID NO: 6707 - DNA, 723 bp, Sorghum bicolor
  Clone ID: SORBI-28MAY03-CLUS51881_1
atttgcacttcgcggtctcctcggctcgccgcctcctctgctggtgttggattcggcgagcgcggggcgtgggcgcgtggactggagcgcagcgggggggatccatgcggcattgggatcgacgacgactctcggtcctgcagtctacctgattgaattgtgtcccgacagaagatccctgagagctagagctggttttttttccctacattaagttaaattatctggcagccgaagatgtccgcgatcatgctatgtgcctgcagccgggaccagtccaagtttgaagatcttcctcgatcaccagaatctcttgcaacacgtgacttttcagcgaattgttcttcttcaaagatggcaagtcgagaaacaactcctgatgatagccaagtaaatgaagtagaatcagacctaaaagaaaccctttcactaaattatgaggaggcccgagcattgctaggtagactggaacatcagagagggaactttgatgcagcattgcaagttcttcaggggattgatataagaagcctgagaccgcgaatgaccagtgctattgctgaaagtatcaagcctagaacgcccccacgctcttcaagaaggaaatcttcacaagtgaatggaatgctcatgcatatgtcaatgcattctgtaagcttgcttctagaggccatactgcttaaagcaaaatctctggacacccttggtagagtagcagatgct

SEQ ID NO: 6708 - DNA, 622 bp, Sorghum bicolor
  Clone ID: SORBI-28MAY03-CLUS51895_1
gcacgaggccacctctcaccagtgacgtgacatctcccccaccctcacagtcacactggcacgcgcgacggcacacgctcagctcagccatggatcgcgcgcggcacaggagctccctcagctccgagcgcttcctcggctccttcgtccgccccgcagccgccggcgaacagtctgcgtctacggccttcgagcttgacgaggacgacctcttctccgcaggatccggctcgcccgagccgccgcagccggtgcgccgcccactcatcctgtcctccgtccgccctgcaaaccctagccctcttccacgcctacgccgcccgccggagggcatcctggacgccctccccgagcgccgccgctcgccgcctccgtcctcttcgtcgacgtcctcgtcccccgcttccccggctgcggcccctgcccgcatgatccccgccgttccccgcccggcgccgtatatgccgcaatcattgccggtcaacgtccctgtggcgcggctgcggaagccgcccgtggtgatggtgatgggggaagcggaggatgaagacgacgagatgctaccgccgcacgagatggtagcgcgcgcccgggctcgggagtcgccgatgacgacgttctc

SEQ ID NO: 6709 - DNA, 917 bp, Sorghum bicolor
  unsure (1)..(917): unsure at all n locations
  Clone ID: SORBI-28MAY03-CLUS51967_1
gcacgaggtgcagctacctttccttggccccctcaaaatcctccaaccaatcccaccagctgctcatctcgaatccgcccggagacctcccaacaccctcaccgtccacccagttcgtgcagctgcccggcgctcagggatcggggaaaaaaaggcgctttggtggttcttgcgggcgaatctcgcggcgattcgctcagatttggatttagggtttaggtggtggtggtggtgatcggtctgtgccgccgggagagatgtcggcggctgtggcatgcgcggagagggcgaccaacgacatgctgatcggcccggactgggcggtcaacatcgagctctgcgacatcatcaacatggatcccggacaagcaaaggacacactcaagctcctaaagaaacgtcttggaagcaagaattcaaaagtgcaaattctaacactttatgtgctagagacgctaagcaaaaattgtggggatattgttcatcaacagatcgttgagcgtgacatattgagtgaaatggttaagatagtagcgcgggggccagacttaaacgtccgcgagaagatattgagtttgattgacacatggcaagtggcatttggaggtccatccnggaaaatataaacagtatcatgtggcttaccaagaactcagggctgctggtgttgattttccacctcgtgaggaaaattcagtcccgttgtttacaccacctcaaacgcaaccattaagacatccacatctatatccacctccaggtcaaagctatgaagatgctgccatacaagcttctcttcagtctgcccctcctgcacctcccctcagtctgagtgagattcaaagtgctcgaggtattgtggatgtgttagatgaaatgttaaatgctctggaccaccggcatcctgagggtgtaag

SEQ ID NO: 6710 - DNA, 425 bp, Sorghum bicolor
  Clone ID: SORBI-28MAY03-CLUS52131_1
ttccgagaagctgcagaatgtggagctacagttgttagtggtctggagatgtttattcggcaagctatgggccagtttgagcatttcacgggcatgccagtggatgattacaaattccgagcgattgcaagttcattggacaatcctaacaccatgaagcctcgtctgtgagagattcatcaatggccacgaacttccttattttttccttttcttttttagatttggattcagtgaccagtttgggtttcagcaattgtaaattaaatgttttgagctgaaacattttggggggggttatttggatcagcataaaatttgcattccggccaagtgtgcccatcaaagaacagcaagaaagctttgcatgcgattttgtagtaggaaaaatgtggttatttgaatcaagcatggtgttccctttg

SEQ ID NO: 6711 - DNA, 603 bp, Sorghum bicolor
  Clone ID: SORBI-28MAY03-CLUS52103_1
ctcaggcaaagggagcgggttctgttctcagtttcctcaccggttcatgggctctctcaaagcacgtcgtcgagaccaccaagcacttcagcgtaacagtcagcttcgggagcgtgaagtccctcatcagcctgccgtgcttcatgtcccacgcagcaatccctgctgcggtccgcgaggagcgcggcctgaccgacgacctcgtccggatatcggtcggcatcgaggacgtcgaggacctcatcgccgatctggaccgcgcgctcagaaccagcccagcatagaaaggaaagaagtagtagatcgttaggtcacgtgagatatcttgatgattcattggtggactgcttgagtgataataatgaaataatgggaacgttttcccctgtgtgctaggagtgttcaccttgggtgcccgacgtgtggagttgtgggcttgtgtgggctgtggccaccggtagcagttgccgcggcgagccaacatgcctgtggttcttgttcttccatgcatgccctagattgtgcgccctggaattctgtgctgctacttcccaattttgcgtggtgcactacaagctcaaacaccaagaatctttgaagctc

SEQ ID NO: 6712 - DNA, 787 bp, Sorghum bicolor
  Clone ID: SORBI-28MAY03-CLUS5213_1
gaatttggttggctattgtgctgagggaggggggcatatgttattgtatgcatacatgcctaatgggagccttgcatcacacttatatggtgaaaacagtgcaccactgaagtgggatttaagagtgaacatagctctggatgttgctaggggtttggagtacttgcatgatggggctgggcctccagtagtccaccgtgacatcaaatctcctaacattttgctggaccaagcaatgcatgctagggttgctgactttggattatctagagaggaaatggttactcgcaacggagccaatatacgaggaacttatggatatcttgatccagagtatgtatccacacgatcattcacaaagaagagtgatgtgtacagctatggtgttttgctattcgaactgattgctggcagaaacccacaacagggtctaatggaatatgttgagcttgtaagcctccacgctgattgctctaagtagattttggtttgaggatattagcttctccagatgctgattacattgcattctaccacaggctgcaatcaacgctgatgcgaaaactgggtgggaagaaattgcagattctcggttagaaggcgcatttgacatggaggagctcaatgacatgtctgctgttgcctacagatgtgtaagccgcgtgtcccggaagcgcccggcgatgcgagatgtggtccaggctctgacccgtgtgttgaagcgcagccgcagcaggaagcaccacagcaacaggcattcacaggcaaggccagacgatgaatctgt

SEQ ID NO: 6713 - DNA, 543 bp, Sorghum bicolor
  Clone ID: SORBI-28MAY03-CLUS52745_1
acttcactgggaagcaataactgttgtagatgctgagcccaacccagaatcagaggagaacgaaatgatcttgatcatccggaagaagttgtggctaccagaagcaggctcgcatgtttccagcacgtaattctttttgttcgagtccctgttcctctcccagcatctgctgctcagaagccgagaagtgacgcgcagctgcaccatccaaaatgattcgacccatagctcctgagatagagtccagtcattatttctagtcctaccgcccacatgaagatagattatttatgaggatacggcaaatatgtagcaggcttggattaaaacaaggccttttttttgtctctacagatatggtattggagtctgttctctagtttggttaggaaataaacattcttttcgttttaatcttgaggctcatttaggtgtttcatgtctatttatttggtatagtctgtagtaagtatatttggtgtttacttgaaagaactactgtacgcacattttgggaaaaaaaaaaaaaaaaaaggccacagt

SEQ ID NO: 6714 - DNA, 681 bp, Sorghum bicolor
  Clone ID: SORBI-28MAY03-CLUS52778_1
tatgatggagacatgtacttggaatcagcagaaaggtatgatccaagggagggcttctgggtccggcttccaagtatgagtactaggagaggatgccacaccttaactgtccttggagataccctatatgccatgggagggtatgatggggacaaaatggtttctagcgtcgagatctatgaccctcgtcttaatgcctggaggatgggtgatccaatgaaccccccaagaggatatgcagctgccgtttatcttgatgatagcttattcgtaattggtggcatgcagtccagtgtgcagatcttggatactgtggaagtttacaatgcaaattctggctggtcagtccttggttttagttctattgggaagaggtccttcgcatctgctgttgtcatgtaattgctagtcaggagtttagggttcacatcaccaaattttgtaacatggctgccattacaaggaatggttagcataaatcagggtaaacaacccttttgaagcattttggtcaccaacagcgagatacgtcaacatggcggttcgaacttctacttctaaaatcctcgttcgccgactagaaactgcccattccccccattgtggggatgaacatttttgtcggataggaacccccaaactgatgggagtataatgcaaaagaatcttttgtatcgcgtt

SEQ ID NO: 6715 - DNA, 399 bp, Sorghum bicolor
  Clone ID: SORBI-28MAY03-CLUS52899_1
aagaagccaaagtttaggtgaatcagcaagtcgcgtgtgccaaagcgcagcagcttcaagggagccccccctccaagaagccagttcaggttaatggggtccctgctggttgctgtggccccgtagcttcttcctgaccctccccgtccccggaatagacatgtctgtaggagtgtcgtttgttatctctagtttattttggtattatctgcagtagcttagtccatttaggtgaaatgtgacagctgaactttgtggatgaactgagcgagtgaatttgcatcattggggaaaggaattaagttggttgattcgttaatatgctcagggatgtaatattttcctagttactagtgggacgtccaggctgtataatatttatttatgcttgctgttgat

SEQ ID NO: 6716 - DNA, 905 bp, Sorghum bicolor
  Clone ID: SORBI-28MAY03-CLUS52816_1
attcaaagaggggctctgctagttatggtgctcatgagagacaagtatgggttcagaagtcaagttcaggctcgtgagtttgttcattgatgatactcccatcaaaacaggtattgcaagtcgtggagaagtcttggattctgcagcgcattcttctttgttagctgttgatcctgtgaagtatgttaacaaaatgtccaatggttaaatgctgccatgaagtgcaatctcagatttgtcaatcgaagtctcagctatagctgaaaagagagcttgctgatttgattcacagaaatagtgaagtaacataacccggcatgtaggtagctctcgataactttgggcaagatttgatttgggcccaaggttgatatttctggagcaatggatggagattaggttggcatcagtacctcactacctcgtgacagtggtcacatatttccaagacccctggaggctacatgcaccctcagcaatttgtcagagatggatgtaaatatctctagagaaagaagaggtctggttctgattgctgtttacaggttagaggtgcagcgtatttacaaagagatataagagttatcacttgtcagactacctggtttgctaaataaaggtgaattttagttactagattatgagaccctgtgttttgactgctgcaatcgtggtttgcggcagcagaaaggttacctagagtgtaaaagtgacatctcattttggggttatggttccgactaaatgggatgtgacgtgtgaggttgttttgacgcctgctgtgtgctttgctgtcatgttccaccagatgacccagggtttatgtcgtgttagggaacatatgctgtacagcatcaaaggtgcttactgtttcaaatcttaaaaagtgatgatgttgtctagct

SEQ ID NO: 6717 - DNA, 575 bp, Sorghum bicolor
  Clone ID: SORBI-28MAY03-CLUS52903_1
ttttgatgccaaaacatggcaggctttccctgacacaaagactcaagcccgaccaaaggtcgatcatgcaactaatgggagccaaaacataaacaagaacataacatcaggtgcttcccccgatgcgtggggttttggttccgataatttcagaacatcagcagcagtaagtgctacacagatcaacagggccgctgcccaagggagctcatcccaaagatttaatgctggtgtggccaagaaggtagagcagccatctggatgggctggtttttaacttcacgtcgatatgcgttaaccatcattctggtcaaaatttgcaatcttccctactcagctgctgttgccgacggagttgtgatctttgccggccacagagccatcaaaataggttatcttgagtgtgtaagtcattttggttgaggcaacttagacaagtgattcatgggatcacttgaaattacccgttaataagtaaatatatatatattgacacgcattgtgcgtatttctttgtatgattatttgaacttgtaacgtctacttcccagtgccaacgccaagatgtctcatga

SEQ ID NO: 6718 - DNA, 1143 bp, Sorghum bicolor
  Clone ID: SORBI-28MAY03-CLUS52387_1
gcacgaggctcgctctcaaatccgcccagtagccgccgcgccgcctacaggtactatgcagctcaggcccgcgtcgcgccgtcgccatggctcggtcatgtgagtctcctacaggtgcaggaggcgccgcagtcagcaccggcagcgccatggtcgctcctcggtcctactagcaaagatcaggagttggggattgtgctgccactctgctgaaagttgagacaaggtggacaggttgtggtgtttccctgcctgttagagtctgtagttctgcgttcctgatcaactgctcttacgcgattgttgtcatctcaatctgtttcgccaagcatggctgggcaaacggcaaaggcaaaggaagcaggaaaagatgacagacaagaacctggagcgcgggcgacgaaagagaagctactgccgtctcacaagcagcaagagcctccagcttctgtggtggacaaggattcttctggtgtctcttcagtccctggtgatgagtcgccgccagtcctggatggggattctggtgagttaaaagaggaggaaaacttggatggtaatgggaataaggaaaagaaaacgtctcaaaagagcagtacaagtgacggctttgcttctgctaaagtgagtgatgggacaagtagtttgaggaagactagtggtagtgcgacgatgagcacacgggctgatttcactgagagtgggaagagtagcatgtgccgtgcgagcacgaggcagtgacattagtgatgagagctcctgcagcagcatgagcagtgccaccacaaagccacacaagggggaatgattcaaggtgggaggcaatccatgtggtgaagtccagggataatgctcttggtctgaatcattttaggctgcttaagaagttgggttctggtgatataggaagtgtgtatctctctgaattgagtggtacacggagttactttgctatgaaggttatggataagacttctttggcgagtaggaagaagctgcttcgagctcagaccgagcgggagatcctgcagtccctggatcatccatttctaccaaccctgtatactcactttgagacagataagttttcatgcttggttatggaattctgtcctggaggggaccttcatactcttcggcaaa

SEQ ID NO: 6719 - DNA, 620 bp, Sorghum bicolor
  Clone ID: SORBI-28MAY03-CLUS52235_1
cgacggcttcaacgtgccggtgcgcgtggcgccctcgggcggcggtggagactgccgccccgcggcgtgcgccggcgacgtcaacgccatgtgccccgcggacctccgcgtcgtcgcctcgtcgtcgtccggcggcggcggcgtcgtggcgtgcaagagcgcgtgcggcgcctacggcggcgcgcgctactgctgcaccgggcagtacggcacgccggcgacgtgtgggcccaccaactactcgcaggtgttcaagagcgtctgcccgtcggcgtacagctacgcgtacgacgacgccagcagcaccttcacctgttccggcgcttccacctatgacgtcaccttctgccctgggagctgattaattaatgcccctagaagactgctagatatttcttcaaaaaatttataatagggaagagatcaagtagaatcaataataacatgttgatgccgtgatacgtagtacacgacacaacacacatagattgatgaaggaaattaatttattccatggaaactggaaaggagggtggttcaacgctctaatgaaatgttttcaatgcttttgtaccgttgccatattggatggatgatgcaagacttcaacatcatttatt

SEQ ID NO: 6720 - DNA, 1036 bp, Sorghum bicolor
  Clone ID: SORBI-28MAY03-CLUS52428_1
ataaagattcagatgatgaagtcgccctggaagcttgcgagttctggtctgcatactgtgatgtgagtatgccacctgaaggtttacgggagttcttgccacgcttaatcccgactttgttgtcgaacatggtatatgcggatgatgatgagtctcttgatgatgctgaggaagatgaatcctttccagacagggaccaggatttgaagccccgcttccatgcctctcgattgcatggatcagaaactggagatgacgatgatgatgatgctgtaaatgtctggaacctgcggaagtgtagtgctgctgggttggctcgtcgctctaatgtgtttggtgacagcatccttccaactttaatgccattgattgagcaaaacttggcccgaacagatgatgattcttggaaggagagggaaactgctgttttgtgtctaggcgctatagcagaggggtgcattagtggtctatacccgcaccttcctcagattgttgccttcctaatcccccttcttgatgataaatttcctcttatacggagtattacatgctggacgctctctcgatacagcaaattcattgttcagagccttgatcatccgaatggacgtgaacaatttgataagattctcatgggattgctcagaaggatattggatactaacaaaagagtgcaagaggctgcttgttcggcgtttgctactcttgaagaggaagcttccgaagaattagtaccccacctggaagtaattttgcagcacctcatgtgtgcctatggaaaataccagagacgaaatctccggatactttatgacgcccttggtaccctggctgatgctgttggagcagaattaaatcaggcgaaatatctagatatatttatgccacctttaatcacgaagtggcagcaactttccaactctgacaaagatctatttccactccttgaatgctttacatctgttgcacaggcattgggaccaggatttgctcagtttgcggaaccagtgtttcaaaggtgcatcaatcttatcca

SEQ ID NO: 6721 - DNA, 1046 bp, Sorghum bicolor
  Clone ID: SORBI-28MAY03-CLUS52527_1
ggcctagcaagcgaacagcccggccgccgcaggcaaacgcagcgcagagggagcagagcggccatccactgccgtcctgttccgccccagactccagaaacgcacgcgcgcgccccgcgagcagagcacttgactgactgactgactgaggcggcggccggtcggtcgtgatccgccccgctccatggcgcggtccaagaacggctgcctcaagatcctcgtctgcgccggctccggatccgatcccgccgccggctccgacgccgacgccgacgaccaccccgacgagaacaaggccatatcagataaaagcagatggagctttcgtaggaggtctacaaggcatcgagttttgaagaactctgatatctcagaacctgaaactcttagttccagtaaagcaaaggctgacattacaccaagcaacaatgtttatacttcaacatattcttatgcctcggagaagcctctgcaacatgacaagcccgaggagaagattctgcatcaagagccagaggagaagcctctgcatcaagagaactctgatgaaaagttgatggagaagccaattgaaaagcctatcaacaaacttatggaagagccagctgaccagatatttgaaaaatcaattgaactacctaactcaaaagataactgaatcaccaactgacgagccagctgaaaaaataaatgatgcaccaactgaagaaccagctgaaaagataacagagacagcatatgaaaatacagctgaagggaaaatagaaaatgcaacagaagagacacccgaaagggcagttgaggaactaattgaagagccagatgaaactatttctgtctcgtcaactgggcctaagcagggggaaaacacctcacttgttgaaggaagcagtgcagaccctgaggaagatcatttggattctgcagctactaatcttcagcctgtcagtggtacttgcattgcaacggaagagctactgaatcagaaggatctggtgaaactgcaagctgttatacgtggacatctagttagaaagcaggcttca

SEQ ID NO: 6722 - DNA, 461 bp, Sorghum bicolor
  Clone ID: SORBI-28MAY03-CLUS52509_1
gcacgaggcgtcatccgccttccccgctcgctcgcgccggcgcgcgatggagggtctcatcaaggggttggtccatgtggcaatcgacgccgtggaggacgccgtgcgggagagggaccacggccgcggcggcgacgacgacggcgaggcgccgaggaggaggagggagccccagcgcgccgacccggacgccgacggcgacgaggaggaggaacgcgacgagcgatcgcggtcgacgtgggccgaggtcgtctctgagcagaagggcagcgacccggacgagcgccgggaccatcggagttcggggcgggacaatcgccatgagaggatggaggacgagggttggaaaagggccgatggtcggaaccagccgcagcaccccgcaggccggcataacaagtgcgaggggcaggaaaggtgggatggcggcagccggcgccctcagcaacagcagcaggcac

SEQ ID NO: 6723 - DNA, 1017 bp, Sorghum bicolor
  Clone ID: SORBI-28MAY03-CLUS52546_1
gcacgagggttacgtcggcaggacgggcggtccagctcccggcggcggcgcttcctctccccttcgccggcgacgagcaccaccaggctataggcaaagtttgtcctgaactgttcgtcatggtggaagactgggtattctctgctttaatagtggcgtttctagcgttcataacaccttgtgagtcattctacttgccaggtagttacatgcacacatatcagcaaggggaggtgatacgggcgaaggtgaactcgctcacttccattgagacagaactgcccttcagttactacagccttccatattgtcgtcctcaagatggggttaagaagagtgctgaaaacttaggcgagcttctgatgggtgatcaaatagataattctccataccgtttccatgtaaatgtcaacgaatctctgtatctgtgtaccacaaatcccctggagggggccgcggcggagctcctcccgcgcccgcgccgggttcgtcgccaggtcggccggtcccgcgcccggcggccgcgctgccgctcccctgcgccggcggcgagcaccatccagtggacaggctatccagttggttatattccagaaggtacttctgatgtttacatcatcaatcacttgaaatttaaggtcttggtccataagtatgaacaaggcaaagtaaaggtagttgggactggggaaggaatggaatttatctcagaggctgacagcgatgccaagtctggatatgagattgtgggatttgaagttgtcccatgcagtgtgaagcgtcctgaagccatgtcgaagtttaatatgtatgataaagttgattccgtgaactgccctgtggagttggaaaaatctcaattggttagggagaaagagaagattacctttacgtatgaggttgagtttgtaaacagtgatatcaggtggccatcacgatgggatgcatacctgaagatggagggttcgaagattcactggttttcgattatgaactctttgatgggaattctatttt

SEQ ID NO: 6724 - DNA, 575 bp, Sorghum bicolor
  Clone ID: SORBI-28MAY03-CLUS53356_1
tctccgccaccatcgccggcttcttcctcatcagggggctcaacgccgagcccgaccagttcgacgccgacgccgacgagtcggaaaccccccgggcgcccctgcctctgcattccaaggttggatcggctgtgaaaacagggttctggacgatggtggacatggcaagtgggcggtacctctggcgcacccttgttgcccaacctgcgaaatcggaatccgataaggcccggtgacgaatgctcaattgttcataaataaattatctcatctcgcggatggagtgccacataggtgaagactggtagtctggtacaatcctgttgttgttacatattggtataatggtgttggtgtgtaatatgagatggtggaagatgttacacggggattatatattaaagtaactttgcaaaaaatttcatgtgttgagccttgtgttgtgtaagactggaagtgggtgctatgctggaaatgtgtactttggccatgagatttgggtcaaggtttgcaggttttgtctttcaactaaacccacgcttaaatgtgggacttgaaaatagaaacaagtgaga

SEQ ID NO: 6725 - DNA, 478 bp, Sorghum bicolor
  Clone ID: SORBI-28MAY03-CLUS53363_1
cagatagttctgctgaagtggcggagtgattcagtatttcggttggtcaaaaaggtttgagttaagttattcaagaacagggagtatggtgcaccagggactacattgcatcttccatggcccataaacagatcatcttcggcttcagtgcacaatgaatttctcgatatctttgtccgtgtacggtacaggatcctgctgtcgacagaatcaagtaccccattgaacagaatcaagtacgggcagctgtatgaaatgcaagattgcaacgaactactagtctgtatgaagttgaaacggcaatttagtggatgtatttattacgaagttgaaacggcaattttttgaatagtaactggcaaacggccctgtcccattttccataaaaatatataaaacactatgtgctcagcttttggattccaacgttgtaaccttgctcagcatgaacgagaaaactacgtaaacaatagctttc

SEQ ID NO: 6726 - DNA, 662 bp, Sorghum bicolor
  Clone ID: SORBI-28MAY03-CLUS53408_1
aggttcctgggtttccggagaagtgtggtgctagaccgacggaaattagttgaacttctagacctgtacaccaacaagacaatctcttgggacaattttgcatcttctgttcatgaagctcataaggaccgtgtagctcaaccatcctgcaggcgaaaacttgaaaacagaccaaaagaagaggattacttctatgctaacccccacgaatgcctagccaattcaaccttgtgcagctaaactgagtttgtggtttccgtaaggtgatcagatgagcttgaaattatttccaagcaggcagtggtgcagtcgttttgatgtcgtgttgtcgagggaccgaagccagcttacacagcccatcacgatcttttgactttgcattccttattgccctgttgtataggtcagtttttcacttccctattgattcgttcaccttccaacatgccaaaaggggcctgtttggagcatgtaaatttaggtttgttgtctaccatacttgttcattggtgactaactcgtgctgctaggccaaagccaaagggttagctttttcttcttttgctattttttataatttttacaaattcttagtggaattatcaccttttaaaatgtgctatgtcaaagcagggttgcggaacctgcctgccccttttttt

SEQ ID NO: 6727 - DNA, 502 bp, Sorghum bicolor
  Clone ID: SORBI-28MAY03-CLUS53477_1
ctggtgaagcttgaagagagtgatcacatacggcatggtcgctacacatgctccatctgccggtaccctatcattgggtcacggtttaaggaaacaaaacactcattcagcctgtgcaaccgatgctacagtgaagggaaggttccgtcagcctacaagttggaggagtacaggttcaaagaatacggtaacgagtctgaggccctcatcgataagtgcatgtgcttcaatttacattctaagaagctggaaagtgatgcttgatcatccaaactttgatctcaagtgcttaagcatgaatctgtgtattttctaggtgcaaagatgtctagttagctctcccactctcttgtaaactaaggtggctcgttcggagttaaatgtgtcccggttactaataaccctaatgtgttagctgttgttttaagtgtacgggaacgagtaaatgtgaattccatacactctgttgccccagtccaaatacaatcttgctgacccttgc

SEQ ID NO: 6728 - DNA, 570 bp, Sorghum bicolor
  Clone ID: SORBI-28MAY03-CLUS52642_1
gcacgaggctccatttcaaaaccgcgcaggaccttcgcgtctcttcccccctccctcccccgctctgctccgctccgctcctctccgctccaaaaccctaggcggcgcccgcccggagcccggatcccgcgtcccgctcccccggcgcctccgcccgtcgcctgctcccccgatggaccccgcggggccgcgcgtgggcacggatcccaccggatcgggagccgcgccgccgcgcgaggaattggacgggagaggaagaggaggagcgtgcagcggcgccgcagcggtggaggggagcgcgtcgcggctggcgggcgctggattaggagatccgagggctggaattctggaatctttggttcaagctgaagcatatttgcacacatataccatggatgttcctcagttgactgctgaaggtgccacacaatgtggagatagagtgtctttattgccccagactggggcacttcagtcagtaactccttgtctgaccttgggccgcgattccaatgcaacatcaatggagaagttgcatggtaatgagtccttgccatttggtaaggagaa

SEQ ID NO: 6729 - DNA, 958 bp, Sorghum bicolor
  Clone ID: SORBI-28MAY03-CLUS52657_1
ttaacaatgctttgcaaccaaatatgccgttctcatatggaagcagctgtggcagttttggtagccatggtagctttaatgataatgctggcatcagctatggaagctatgattttaacagtgtcaacatatataattcgccgatggatccttctgggtttaatttacgttcacaacttgggggatcatttcttggatctagtccggatattcgacgaagacctcatctctcacatggtggtggcattcggttaagccctggtggtccagggcatatgtctcttggggccagtccatcacaatttacaccgcccaattcccagatgcaaatccccccacggcctaatggaaagtatggtgcctctccttcaagaggtggacatggctcctcgttgggaaaggttgctgctgtaggccaatacaataggaggaggaaccagggttatccacctatgccagtgccaccacatgaacacacatctcaactgatccagggacaccaaggagatggtgtcagtactgctcgcgttgatgcacatggccgaggaaattctagttacctacacaatgcactccctaattctagtcattatagctggagatctcaaaggggatttggcagtggtttacctttggacccttcttctagtcatggttcttttccacccaccaattacaatggctttcctttacactccgatgcgtcagcagatgcattgccctccacctcatcagtaccagatccagccgattgggatcccaactatagtgatgagtcgctcctgcaagaggatcgatcattgtcagctgggttaagtggtcttcacctgagagatgcaagtggccaaacaaacagatctagcagattggcacctatccaaagtcatgatattttaagttcaaacccttcgcctttgaatcaaagaagtggacacctatttcatgcatcatccctggg

SEQ ID NO: 6730 - DNA, 601 bp, Sorghum bicolor
  Clone ID: SORBI-28MAY03-CLUS52652_1
gcacgaggccagaccagggcaccaggccaccacttcgccatcgccacggctccaccgctccacgtctcggcttttgcttgcttgcttccttccttcctccttccctccctcccgtctggctcggcagattgcgaccgggcgcgccgaatctccaggcgagatcgcgccccgcatctgacgccagcggcgccggagcccacggcgaccgcgggcctccgcccccgatctagaggtgcgcctccttaccgagattcggcgagcttcagcggcaaggaacgagggacattggagtggttagattggcttgtctgggagggatcggagccggacctgcattttccgtgaaacatttggagagccatacccaacaaaataagcaccggtatttcatcctttgtcttggtattccaataatgtggaaactcaatccctttgggggtaaagcacagagtgggctggatggtcgcactattgatgttggaagtgtgaagatcacagtacgaaatgccattgcacaaggaggtttctcttgtgtatatttggcatgcgacacagtacatccatcaaagatgtacgcattgaagcacattatttgcaatga

SEQ ID NO: 6731 - DNA, 493 bp, Sorghum bicolor
  Clone ID: SORBI-28MAY03-CLUS5268_1
gggggttcttccaatcaccatgctggcaatgccatggatgacccggcagcggttgcggcagaattccagcgccgctgggttcccccgcagccaccgggcgtcattatgccagaggctgcggcggccatccggcaggccaggttggttccgaggcagcagcctggtgatgggcacctgagggctgatgttccgagaccattggagtctgccatggcaacaacagagcacgtgaacggtgcccctgaagcacctggtggagagttgccaagccacgatggtggtaccatgactgctaatgccagcagctgtggtgggagtgaagagcagcagcaggaagccgcttgagtgaagctttttggacgcccttcgatctgattctttgataggatcttgcacctgtgtgtatagtgtatgcatctgcatatgtttgttgacgtatatctcgtgtacgaaactgcagctgtatgtagatatataaagtgatattttggac

SEQ ID NO: 6732 - DNA, 585 bp, Sorghum bicolor
  Clone ID: SORBI-28MAY03-CLUS5270_1
cctcctcttctcgtccggagccgcggccctcgcaggtcacaacatcgccgcctcgagccctcctctccttgtcgtgtcgcatcagatcccgcacggcgcccgcccaccccgtccccggcggccggcgccccgacccccgccccttctgccgctctgtggttctgccttctatctcaggcttacattatttggcctccttcttgtcctgtttctggatctaccactggatatcgtcgtctggtcgaaccaccatgggtctgctggcgttgcagcggctcatgtccctacagcgcgaccggcagcggcgtcaacagcgaacccaagctctgaatggatcgattgattcatcaatggatataagaaagtgctcaccctgtgaacaagacacccatggtgattctcatgctgccaaaagaatgatgtgttcaatcccaacccttccggaggacattttgcaacatatacattccctgttgccactgcgtgatgctgcccgtgctgcttgctcatctcatgcctttctacgtttctggcgatgtcatcccaatctaaccttaaactggcatatccttggctcaaatgcaa

SEQ ID NO: 6733 - DNA, 532 bp, Sorghum bicolor
  unsure (1)..(532): unsure at all n locations
  Clone ID: SORBI-28MAY03-CLUS5273_1
tgctctccctgcagatccccaatcaccagatgatgggcttatgagtgagccagcagcagcaactgttaccagcatcatcaccaccactgcgaaagagcctaaagaaggggctccaaactcccacaaatctgagaaccaagctcagctgccaacttcacccaagctagccgatccaccatggacatgtcgccgaaccccgacagcccctcgtcaggagggggcaacggcatcgggccgagcagcggtggcgcgtcgccgtccgttggctccatgacggcgccgcagtcgccgagccggtacgaggcgcagaagcggcgcgactggaacacgttcgggcagtacctgcggaaccaccggccgccactgagcctggcgcagtgcagcggggctcacgtcctcgagttcctccgctacctggaccagttcggcaagactaaggtgcacggcccggcgtgccccttcttcgggcacccgaacccggcggcgcccggcccctggccgctccgncaggcctggggcagcctcgacgccc

SEQ ID NO: 6734 - DNA, 667 bp, Sorghum bicolor
  Clone ID: SORBI-28MAY03-CLUS53762_1
ctgttggcctctggagtccgcagctgctacgcccgggccaacacgcactctctcgcacacagccgcggggggcggggcacagtgacgcgggcggaggagcgggcgccgagctagggtttccctgatccggcggggccgggttgcgggcggaaaccctttgctggattccggcgccggaggcgcagtgccggtgccaccccgaggccggcgggttggggagctgggggcgcgcggcgacgcgggctcagatctggtatgaccgacggcggcgaagacgggaatgcggcggcgcccaggggccccgcgcgccggagggggcccgtgcgggccagcctcgacgccgacgagttcatcgcgctgatgcacggctcggatcccgtcagggtcgagctcacccgcctcgagaacgagctcagggacaaggagagggagctcggggaggcgcagacggagatacgcgcgctgcgcctgtcggagagggcgcgggagaaggccgtcgaggagcttacagatgaattggagaagatggctgagaaactcaagctgacagaatctctcctcgaaagcaaaaatcttgaagttaaaaagataaatgatgagaaaaaagctgcattggctgcccagtttgcagcagaagcaactttgcgaagagtacatgcagcccaga

SEQ ID NO: 6735 - DNA, 498 bp, Sorghum bicolor
  Clone ID: SORBI-28MAY03-CLUS53800_1
attgccttctagtcgaactgacgaactggcaggcacctggcaggatagacacatggctgccgcctttaccgtcatctctctcctgctatcggtctgcgtccagggcgcggctcccgttctcggcttcacaaggagcgacttccctgaagatttcgtcttcggatccgccacctcggcttatcagtatgagggtgctgttgctgaggatggtaggagcccaagcatctgggataccttcacccacgcaggaaacatgccggacaaaagcaatggtgatatagccgccgacgggtacaacaagtacaaggacgatgttaagctcgtaattgacagtaacctggaggcatatagattctctatctcctggtccaggcttataccaaatggacgaggtgctattaatccaaaagggttagagtactataacaatctcatagatgagctagctacacatggcgtccaagtccatgttatgattagccagctcgatccccctca

SEQ ID NO: 6736 - DNA, 998 bp, Sorghum bicolor
  Clone ID: SORBI-28MAY03-CLUS53809_1
cctcctgggtcccacgccgcgtccgcgatcggcgctcctccggccccctgcgtctcccggccgctccaccccccggcccctcggcccccccctccctcggccgcgccccagaggtagagtcctccgttcccctgggttccgccgccgcccctcccccagcggccagggtcgtggagccctcccccgctgccccggcctcggcggctcctgccgtcgccccagccctcccctccgagccgattccgtcctccccccccgcccccgagccccggcctaccctggccgatccgtccacccctgcgcctggcctgtcgattactcgattgtggtggatccaattctgcttttgtggtaatacttctcgtttcctccacaaatctgcaccgagcagcggccatggtgaagaagcccaacggcgctgccaaggccacggcgacttctgccgacgcggcagcccagccatccaaggcgaatccgtccacccctgggtcggtcaaggcccggcctcccctggcgtgcccgcccacccctccgactggcaaggccacgaagtttaagaaggtgaaggtcaaggccaaccgcgagaagccagcggttgctgccgcagctgttgacaaggtcgccccggtaggcgcaggcactggtgatggcgatgcagatgcatcggcggttttaccgcagccatccaatgttgctgaggcggtgcaaaagcagccatccgatgttgctgatgaggcatcgcctgtggtgcaaactcagccatccaatgttgctgaggcatcacctgtggtgcaaacgcctaagtcaaccacttttgctgaggcatcacctgtggcacagacacagaagccagccactgatgctgaaggatcggtgcctgcaccaatgccagccattgctgaagcatcagcttcgtcgccaaagccaaagccaaagccaaagccaaaaccagctcatgctaatgctgatgctgcagctgcaatttctgccagcaaggg

SEQ ID NO: 6737 - DNA, 539 bp, Sorghum bicolor
  Clone ID: SORBI-28MAY03-CLUS53823_1
gcacgagggttaggatcacagaaaagctcttgcagatagggagtttgaagcattacaggatagaatttctgggaagatgataaattttcaaagagtttcttgcataaatgggactgttccactgtccccatcattaatgtcagctgaggaactttgttctacatgcaaggtacagattgtaattcatcacattgtttgtttctttggcactgttcttttccatttcatccaactggatttattgaaattggtagacaaaatgttttaaattcatttttatatgttctacgttcattgaagccttcataataagaagaaacgtgtaaatagttttgttggtctatagatttcctatgtccccccccaaaatactttcacatttgaacttgcatctgtttgatgtatacctctgaccactatttctagaatatatattctaagaatccttctattttattaggttttgcaaaatagttgctgatacaaatctacacataatcttacatgcttataaactaaatagtatacctagctattgt

SEQ ID NO: 6738 - DNA, 699 bp, Sorghum bicolor
  Clone ID: SORBI-28MAY03-CLUS53061_1
catcctttccagcatttggttgggaagattctattacgtctttggcttcctgtttattgtcctcttcctgctggtcatagtctgcggtgaggtttctctggtcctaacctacatgcatctttgcgtggaggactggaaatggtggtggaaggccttctttgcttctggctctgtcgcgttctatgtgttcctctactcgattaactacctggtgttcgatctcaggagcctgagcggacctgtttccgccacactctaccttggctattccctgatcatggcccttgcaatcatgctctccactggtgccattggtttcctgctctccttctacttcgtccactacctcttctcgtctgttaagattgattagaggtgcccactgcctctttctgcaatagagtcatctgatcatggtaagagttacccccttagaaatactacacaataaatcaaatgaaaaaatgatacatggcaacggccatgacttttggtcatgattaattcaatcatttagcatagcacagttactcaagttgaaacttatttcgtaggaatgattgtaagttcttcagctatgtttattaccctttgtaatactattcagttttgcttgccctgggcatttgtgagcagtctttggtgttggaacacttgagatctattcaatatgaaaaggagctattcatttacagttgt

SEQ ID NO: 6739 - DNA, 796 bp, Sorghum bicolor
  Clone ID: SORBI-28MAY03-CLUS53087_1
cggatttccagtggtcgatgagccacctctgtcagaggctccagaacttgttgggcttgtgcttagatcccatctgctggtcttgttgaaaggcatgggcttcatgaaagagaagatgaaaaccagcggtagcttcgtgctgcaaagatttggtgccttcgattttgccaagcccggctcaggaaaaggcctgaagattgaggacctgcccttcactgatgaggaaatggacatgtacgtcgatctccatccaatcacaaacacatcgccgtacacggtggttgagaccatgtcacttgcaaagcccgccgtccttttccgggcactgggactaaggcacctgctcgttgtgccaaagaccccagggagacctccaattgttggaatcctgacgaggcacgatttcatgccggagcatattcatgggctgttcccaaatatacacaagtcgcactaatggagcactcattcagtaccatattttctttgccgtcgtcgccttgtagctagctgtacgaaaacgaagctgcttttgtccaatatatttgctatcagccatctgccttttgttttccattttattctcttctggagtactccgaaatcatataatcactgaataatattgtatttgttgtaaagagacctgtccccatgcaataatctggcagtactccagaaggaacttattctacgttccattttgttttcttgtagagcatatcaatatgttgatttgcaacctgcaaaaaaaagaccatgttggtttgcaaccaaagatattatgctttggtgc

SEQ ID NO: 6740 - DNA, 698 bp, Sorghum bicolor
  Clone ID: SORBI-28MAY03-CLUS53227_1
ctggcggatttgttgttgccggacgggtcaatggaagtttgaacttatctagggcaataggtgacatggaactgaagcaaaatgaacttctgccggccgagaggcaaatcgtgacagctgaacccgaattaaaaacagtccagctctcagaggatgacgaattcattgttttagcttgtgatggaatttgggattgcatgtcaagtcaagaagtagttgattttgtacataaacagctaaagactgaggataagctatccagtgtgtgtgagaagatgctcaaccgctgtgtggcacctacatctggtggtgaaggatgtgataacatgaccgttattgtggttcagttcaagaaaccagcttcagctgttgccacttccagcaccgagcaatcttctgccactgcagaagagatgcggcccaacgagctggatggcccagacaaccccccgaagtaggcgtaagtggcacaccgtgctgtggagctctaaccggtggatgatagacaaaaaggatagtgagtggtgtatataagaaaagggattctattcgacaatctcttatagggtttgttccttccttctttctagtgttcagagccgtcgcaacctgtaatacatggcatgttggttcataaactggggttttgtgaaatgcattgatgagtgtcagaaagttagcttggctttcaaaaaaaa

SEQ ID NO: 6741 - DNA, 751 bp, Sorghum bicolor
  Clone ID: SORBI-28MAY03-CLUS53271_1
tctcatggaagggaagccgaatcctgaggtggacagctatttgctgtttgatccacgggcccttagatcaggaagtggtgggcagttcaaagggccattcagagaagcaattgtcttcatgattggtggtgggaattacattgagtacaggagcttgatggagctggcagaatgctcgcagccttcaaagcatgtcatatacggtgcaaccgagattgtcaatggggtggagtttatcgagcaacttgcagaattggggcagaaagcagggctgtgtggtggtgtcaacaaccctccaccgctacagtaaacaggctctttccttgcatcccaggcctttttgatgttgaaaccttagactgaaatttaacggtagtgaaattccccaaactgagaccgccttggataagttatcaatatatagcttttctttcatatatcctttgaaccttgtcagatgatcatcagtttccttctctggtttttgttttctcagaatatgttagtagtgtaatctggtttgcaatcttttgcactggttacagtttcagaggagcttgtaaatccagttaaaatgaatccatgttctgcagggcagatttctttgatggacctgtttgacagcgtgcaaacagttttgtggtgtgattttcttaatggtctattcatctggtagttgtattgcagtcttgggtgagcattgcccaagacccaactctttgtcactgaaaaaattatttcattttatttc

SEQ ID NO: 6742 - DNA, 617 bp, Sorghum bicolor
  Clone ID: SORBI-28MAY03-CLUS53286_1
gtgctgcagccagtgcagatgatgcagatcttgatcctggtgttgctgaacttcctccgagaccattgcttgagatcttggcacgagagctgcgccgccgactgggtcttagattattcaacattgatatgattaggcagcacgggacaagagatcgattttatgtcatagacatgaactactttcctgggtacggcaaaatgcctgggtacgagcacgtgttcaccgacttcctgctgagccttggccagaaagagtacaagaggcgaccaagctatggctcgctaagctcaggtgaagggtgataagtgaggaaggctactcggcggggggccctgtatatgtctagcatccgcaaaatgcgtgcgtacagaagtacttgtgcatgatgggagatgatgggtcgtggagtttggcatcactgcatcacatcagtagttgcgataaaagaagcaaggactgttgtcaggctgtaattaaaattgttgctttacatgtgctaactgttcatgcttcagaataattttgtttgtctggatgatggccgatgaaatcgagctacttgtagaatttatgactgacttgaatctcgaaataaacggggaatttggatttgg

SEQ ID NO: 6743 - DNA, 530 bp, Sorghum bicolor
  Clone ID: SORBI-28MAY03-CLUS53351_1
ctaaaattgatgtcattttagttggctatacgtgcagtttgtggaggatggagaagagagagtagtagttggtagtttagaccttaatcagtgtctttggctaccagatgaattgactggaaagaagcctggggtaaatgaagacatccagacaagagcgtacctaagcaatgtctgtgttgccaaggaggttcagaaaaagggcttaggctatacattggttgacaagtccaagaaattagctcgtgaatggggcataacagacctgtatgtccatgtcgctattgacaacatagcagggcaaaagctgtacgagaagagtggatttgtttatgagggcgaagaacctgcatggaaggctaggtttctggggagaccacggagattgcttctttggctcgatatgagcaaagtgcctttgtgatcgtgcatgtaaatacatatttataatcatattcttgtgtttgttacttttatcattcgatcccaaatctccaaatgattgcagtctgaatcatccctcattcctg

SEQ ID NO: 6744 - DNA, 708 bp, Sorghum bicolor
  Clone ID: SORBI-28MAY03-CLUS54056_1
gcacgaggccattcccaccggccaccaccgggcctcgtcgtcgccgcagcccgcacctgcagccgccatgtggaggggcggcgccaccgccgcctccgccgcgagggctctccgctcgcgcctcctcctcgaccccatccaccacccggccacgtcgctcggtcctattgcttcgacgcgtacctcctcctcttccacctcgtccactgccgcggcgaacgccatcgttgaagaagcggcggcggcggcggcggcggctgtatccgtttcacagcataccggatccatctccgacgcgctgcggcactacgggaactgctactgggagctctcgaaagcccgcctcagtgctcttgtggtggcaacttcgggggctggctatgtgctcggtagtggcaacatcgtggacattgctggactttgttgcacatgtgctggtacaatgatggttgcagcatctgcaaataccctcaaccaggtgttcgagataaaaaatgacgctaaaatgaaaaggacaatgcgacggcccctgccatctggtcgcattagtcctgcacatgctgccatgtgggctacaagtgttggagttgcaggaacagctttgctggcctggaaggctaatggcttggcagctgggcttgcagcttctaatcttgttctgtacgcatttgtgtatacgccattgaagcaaatacaccctgttaatac

SEQ ID NO: 6745 - DNA, 764 bp, Sorghum bicolor
  Clone ID: SORBI-28MAY03-CLUS54064_1
gcacgaggtgaaaatgttgcagctggaaaacatatgccttcagctcaggttcaaagaacaccagatagcaaccatgttcccggaccttccctggatggtggtgaaggaaaaggtagcaccttctcaagagcacaatgacgggactaggaagaaaggcagaaggccaaacaggaaaggtggcctctgcaatgccgttgcatttgctgttggtgttggtcttgttggtgctggattgcttcttggctggactcttgggtggctactgccgtagctggaagttccatcatcttcgatatgaccataaaggtgacaggacaaatgcctcctgtgcaaactaaattgaatggcaataggtaagctccagctccgagtctctgcttcatggagagtgaaaaagggcagatttttggaattcttccacggtagtctgttgatttggtgatggtagcttgataccttatgttggttcctgtatatataggatctggtgtacatactgccagaaactggatacctaggttggtagtgtgggtgtgggtgtgggtgtggatgtggatgcgatgcttatctgtgtgttgtacatagggtcagtggtggtctggtggaagatgaaatcagccgacttcaacaacgtatgtgctagtactgtaaatctgtagcttttatttgcttaattaatgtagcagaaattgtgttaatccgtgtaatgtgtgttgaacgtatttgcatgtcttctccctagtggttatggaccgagtctattt

SEQ ID NO: 6746 - DNA, 642 bp, Sorghum bicolor
  Clone ID: SORBI-28MAY03-CLUS5407_1
cggactcgtgggcaaccatggccccaactctaacgcgtgctgataggctggttggccaggttcttggtgaagttggttcactacctgatgtttatgtagagcttgagatcaatttcttcctactccggaggctgttgggtgtgaggacgaaaggtacagagaaggcagggaaggtgtcgaagctcaccaagggcgagatcctcatgcttaacataggatccatgtccacaggcgcccgcgtgctcgctgttaagaacgatctcgccaagctacagctcaccgcacctgtctgcacgagccgaggcgagaaggttgctctgagccgtcgtgttgagaagcattggcgcctcatcggatggggccagatccaagccggtacaacacttgacgtaccaccgtgcccgctttaaactgaagcgtcatactcagacgtgccctgaagctgtgagtgccaaagagaaaagatgagtttgttggtagtcctccctttgtgttactgcagagccaaagtcttaggccactctagttttattttgttttgttcaattttggaggccacttccattatgattcctgtgaccattagcaggtcggaaaccagtattgtgaacattgtgagtacggcatatggatcagtattcc

SEQ ID NO: 6747 - DNA, 638 bp, Sorghum bicolor
  Clone ID: SORBI-28MAY03-CLUS54090_1
accagtcccctccccagctcccattacttactaccctttcagtgagacgcagacagaatctcagatcgttggatacgaagaagatttaacaggcatgcagaagatcatagacagggttcggtctcagagcattaatgtgactccgtcgagtgagattccttaggtgtggaggcgaaccagaaacatcttgcttgcagccagatctgactgtcaaattgtgatagggaagatgtgttctgaaatcttcttgtccggtcatgttggcttcaaattaagcacatcatggatagagtctacaaatttggaggcgtaccagaggatctgtgtagcaaaaatcgaggagattttcattccatggcattctatgaacggaacctcacgctttacatcgtcaacttgtggatgtaatgcccttgtttgtagaacacaaacagactctgaactgaacgcttgtgatccatgtgatcctgtacattaacaatcttgtacactaaatccaggagtagctaaaggagccgacacaagacacatatgctcgtcgatataataatgtgtttcggtgtatatggcgagcatgaaaggaagcatgtacaaatgtaacaattcatttttgatttgatgcttgtgtatgcatgctc

SEQ ID NO: 6748 - DNA, 630 bp, Sorghum bicolor
  Clone ID: SORBI-28MAY03-CLUS53424_1
ctcagaagttgctgggagttgggcagtggaaacagggccatctgtccatggggagaacgaatctccaaggagcttgggagatgctgccgatgctacagagcaagacgaagatggaggtagcgaggcagctgatgctttgttaactttggtgaattcagagggccaggcggctgggagccagaataatgttgagcatgccagttccaaaataaccaatgatcatcgtgttcttagtgccatgattggaattgttgatcctgaattcaggaagcaaatgtccagaagtggagttggaaatgaggaaccgatgtccgacgctgagacggatgaaggcgttgaggaaggtgattctgattcagatacaggttcagatggcagtgacagcgaggaggctatggttgaggattctgttgggtagcttaaacggaactgactgttcattgtaaatgtctcaattcgtttgtgtacctttcgttgtatgagcttgtattatgcgtagcataagcccctcgtgcatttgtttttttattcgttattaagtgtcttcagcagctcttggtgttgtacgaaatcgagaccttttggtcttcaacacacaaataaagatatttacttgctccgttccaaatt

SEQ ID NO: 6749 - DNA, 576 bp, Sorghum bicolor
  Clone ID: SORBI-28MAY03-CLUS53492_1
cttcaatacgactggaaatcggctcagtagagtgagcaggagtcagaaaggtcgcacctgatattatacagttatccttgctgggtccatcactgacaacacaaaagttacgtcgccacaacctgccctccctcggaagtggcgggttcttactgatggtgcatgctacatgttacagcaaaaaggaaacattagcgatgatcggtacatgttacaacaactgtctgtatggctgtgttcctttgtattccgcctgtggaattcatgtctgcttaggcgatcctaccgcaaaaatgagatctgtgaaatgagagcctactttcacttgtgcccattggggcaagtgttggcggattccaaactggggggaagatcagagcgtctttcccctgttttttcgggttggatgacgatgatttctctcttccagtctgtactcttgtgtaccatggctctccgtaagttgtgaaagcatgagtacctatttccacctttgatggccaagaatctcattgtagctgtgctatactatgtataagctgttatttactagtggaaagcatcaggaaaatttct

SEQ ID NO: 6750 - DNA, 509 bp, Sorghum bicolor
  Clone ID: SORBI-28MAY03-CLUS5360_1
gatttgccctttgcgtgttcattatctatgatcattgcatgtgacgccaaattatatactatcatttctgagcacatgccctatttccaaggattacattgccatacactttggttgtgtacggtcacttttgcctctcctatttctttgagtttttgggcatcaattttgtgctttcttgtgctgtacttgctttcattttggcacaattaatgtttccgttcacatttttagcaccatcgatgatgcttgcctgttgcttcataagaagaaacattgttcatccttttctatccagtcttgtggttgcatcaataatcacagtgttctcttcagacctgtaggctgtatatttatttggtatgtaatttggaccagcctattgccatattttccttcggtatgcatgagattaattttgggtgttatggagacagctgaaagtcgctggtctgtggtacattggtttgtgcagcaatcacaatagaatggatatgttcataatttca

SEQ ID NO: 6751 - DNA, 1020 bp, Sorghum bicolor
  Clone ID: SORBI-28MAY03-CLUS53752_1
tccgtgcttgaagttgtggtcaaagacaaagatttgattaaggatgactttgttggctttgtgcgatttgatttgaatgacgtcccaatacgtgtgccccctgacagccctctggctccagaatggtacaggcttgttggtaagagtggagataagtccatgggtgagctcatgcttgcagtttgggtcggcacccaagctgatgaagcatttcctgatgcctggcattcagatgcggcaacacttgaagatccatctgcagtaacgcacatgaagtctaaagtttatcatgctcctagattgtggtacctgcgagtcaatatagttgaggcccaagatgttgctatatttgataagacccgctttccagatgtatttgtgagagcacaggtggggcatcaacttgggaggacaaaacctgtgcaggctagaaatttcaaccctttttggaatgaagaccttatgtttgtggctgctgaaccatttgaagatcaccttgttttgactcttgaggatcgtgtagctcctggcaaagatgaactgcttggtcgtgtaatcatacctttggcaatgattgatagacgtgccgatgaccgtattgtccatggaaagtggttcaatctcgagaagcctgttcttgttgatgtggaccaactgaagaaggaaaagttctctactcggcttcatctccgtctctgtctggatggaggttaccatgttcttgacgagtctacaaactacagcagtgacttgagaccaactgccaagcaactctggaagccgtctattggtttgcttgaacttggtgtccttggtgctcaagggattgttcccatgaaaactcgagatggaaaaggttcatcagacacctactgtgttgctaagtatgggtcgaaatggataaggacacggaccatcatgaacaacccaaatcccagattcaatgagcagtacacctgggaagtctacgatcctgcaactgtcctgactgttggtgtttttgacaatggccaacttgga

SEQ ID NO: 6752 - DNA, 680 bp, Sorghum bicolor
  unsure (1)..(680): unsure at all n locations
  Clone ID: SORBI-28MAY03-CLUS53720_1
gcacgagggaagagaaggagcaggagcccttcgccgtgcccacttccggcgccttctacatgcaccacgacgggtttcaggaggagaaccgcggcagacgcaggcgaatgtttggtgggaggaagttatgggatgctaaagatgatcaagcttgggtgcatgacagatttgaggagatgaacttgcatgatgatcgctatgaagaccagcggatgtcaaggggccgttttagaggtcgtggtggtcgaggtaaagcaagaggtggtggccgtggtttctccagaggtggaaagcagcgcaattataatgatcacgaagatggcaacaaccaaaaccgccccccaaaggtagtgagagggagaggacctcggcgttatgaagctgttgcaaggaacagtagagaggttgttggatcccaacgaaaacaagcagctagatttcgagaacctgctccaaatgctgcagcagccagagattctggtcaagtttcacatgcacagccagaggctgcccctcccaagaagaatgtcatcagttcgagcctaaattctgcgtccccaccattttatccctctggtgcagctactcaagattttccagtagcagctcanaggagggacatacaaacagggggttctaataagattcctccatcttccatgaagatggatgataactca

SEQ ID NO: 6753 - DNA, 742 bp, Sorghum bicolor
  Clone ID: SORBI-28MAY03-CLUS53678_1
acttcagagtctggagcaaatatcacaatttcaaaagaggagtttgaatctctaagccgaaaggttgaggagtcagagaagttgagtgagatgaaagttgctgctgctatggctcaagtggaagccatcagagccagtgagaacgaggcaatcaagaaactagaagctgcacgcaaggaaatggaggaaatggaattggcaacagaagaggccctaaagagggcagagatggctgaggcagccaaaaaggctgtagaaggtgagcttaagagatggcgtgagaaggagcagaagaaaactgcagaggctcatcctttggcaggggcagaagaacttggaagtgcatctccctctgtacctcagacttctgctgggaaagcttctgagaagaacgacgggcatcaaaggaacagcagaacgctacttaggaggagcttcatgctgccaaacatcacgagcatgttccataagaagaaaagccatcctggcagcagttctccctcgtaccttcctggggaaaaatctgtgtaatctatcctaagctcttgtttgggaattgaaatttccaaactaaacgcatgctttgatgctataatctgtataaatccgtgtacttccttgcgccttgcagtaaatttctgacataattttaaatttgcttgtacccctatttttcggcactacttccgatgagtgcattgtacctctgtgatccactgttatacttccgcaacaggtctta

SEQ ID NO: 6754 - DNA, 998 bp, Sorghum bicolor
  Clone ID: SORBI-28MAY03-CLUS5438_1
gcacgaggaggcttacaaatgagaatagacttccgcacttgttgctatatgggccacctggcactgggaaaacatctacgattctggctgttgcgaggaagctatatgggtctcagtatagcaacatgatcctggagctcaatgcatcagatgaacgtggcacgggggttgtcaggcagcagatccaggattttgctggcgcacgcagcctctcttttggagcgaggccttctgttaagttggtcctcttggatgaagcagatgcaatgacaaaggatgcacaatttgcattgcgaagagtcattgagaagtatacaaggagcacaaggtttgcactcatttgcaaccatgtcaacaaaattatccctgcacttcaatcaaggtgcactaggtttagatttgctccactagacggaagtcatgttagagagcgtcttcaacatataataaaatctgaggggctcagtgtagatgagggtggcttgacagccctagtgcggttaagcaatggtgatatgaggaaggctttgaacatattgcagtcaacacacatggcatcccaacaaatcacagaagaagctgtctatctttgcacaggaaaccccatgccaaatgatattgagcggatagcattttggctattaaatgaaccattttcaactagcttcaaacatatatctgacatgaagatgagaaaaggtctggccttggttgatatcatacgggaggttactatgtttgtgttcaaaatagaaatgccatctgatgttcgtgtaaagctaatcaataacttggctgatatcgaatacaggctaagctttgcatgcaacgataaactgcagctgggcgcactgatctcagctttcacagatactcgcacggctatggttgctgctgccagctaatttcagcaatgtgaaggatctccgcccccctctggaatctgaagatgaagcacatctatattttgtgggtcatcgtcttgcctttagtgagca

SEQ ID NO: 6755 - DNA, 942 bp, Sorghum bicolor
  Clone ID: SORBI-28MAY03-CLUS54496_1
gcacgagggttaagacaatgaccaagctgagttcttcaggtattctgttcgaagttcacatggcagctgaagagttgcaaaaaaagattgatgagaagtcttatcttctggtgaacactgaaagatgggattctagcaagcaagctcaaggaatcaaagaagttttaaatggcacccgtgctgtggaaaaggaaaacaagaacaaagaaaacaagaatgatggcaccagtgctgtggaaaaagaaaacaaagccaaagaaaacaacaacggagggatggaacctaccatggttgatcaaactttagtccatcagtcaaagagctttcttgcaaattcatttctgagcagatatgattcagcatcaacaattgacggttttaagccactactgtcttggcctgctcgtagatcattccatccaaacataccacttgaagatgaggattcccaaacatacgaaagtgcaagtgccttgtccttggctacatttgcatcacttctgattgaatttgttgccaggctacagaatgttgttaatgcatttgaagagttgagtgagaaggctaactttaaggatcctgtggaggagccttctgcagttagcacaagtgatgttagggttttcgataaaatacgcaaattggtaggattctagagttgacactgatgacaacctgcaaggcttcagtttcagatggccgaatcctgttttggcatccagtttccgtttttttaaaaccttacggaacatacactaaacttgtaaatgtacaatcagatgattgcaagctgtattgctggagttcagtttacagccacagaaatcatcaatagggtaaaatgctgatctttgcatccgctgtattgtgttttcagcgccttgtaaataatgttacaccttgctgattgcacatatgtatactgcgtgaagggttcaaagt

SEQ ID NO: 6756 - DNA, 687 bp, Sorghum bicolor
  Clone ID: SORBI-28MAY03-CLUS54637_1
tctgggcacctcgtggcgcgtgctgctcagctgcagtgctgccttctcttgacttgctcccccgatctcgctcgccttgctccccgtccccgatccgtccattcatctctctcaggcgcacgtgtgtgtcagcagctccggcgtcgatggagaacctgctgtccagcgcgtcccacgagacgctcccggacagcttcgtcttcccggcggagcagcgcccgccggcgtcgtccgccgccgtcgagctccccgtcatcgacctctccggcccccgcgacgaggtccggcgagccgtccttgaagccggcaaggagctaggcttcttccaggtggtgaaccacggcgtgccggagcaggcggtgcgggacatggaggcctgctgcgaggagttcttccgcctccccgcggaggacaaggcggccttctactccgaggacacgggcaagcccaaccgcctcttcaccagcaccacctacggcaccggcggcgagcggtactggcgggactgcctccgcctcgcctgcgccttccccgtcgccgccgacgccaagaccaactggcccgacaagcccgacggcctcagggaggcgacggagaggttcgtcgcgccgacgcgggcgctgggcatggagctgctgcggctgctgtgcgaaggcgtgggcctccccccggactacttcgaggggg

SEQ ID NO: 6757 - DNA, 657 bp, Sorghum bicolor
  Clone ID: SORBI-28MAY03-CLUS54657_1
ctggaaacgcacgtagctcgtttttcttatatatatttcgatctctctctatatatatatcttgtataataatataggacaggaacagaagaaacaatatcgcaaagacatgtccgtagcattctcactgcactccaaagcaagactcaagagttgcaccgggaacaggaaacccagtaggatcggacggaagaagagggagagggagagagactcgatcgacgagtaatcgacgacggtgacaatcgtcgtcgtcgtcactcgtcgccgagcagcagcgacttgacgatgacgtcggccatccctggtgccatggggaagaggtgtccggccgtgggcagctcgtggtatcgcacccacggcaggctctcggcgatgtacctcgacatccccacgggcacgatgaggtcctcggcgccgtgccacaggtgcaccttgccctcgccgcccgggaacgggtcctccagctccaccgggctccagctccacttgccgaagccgaccatcatgtcccggtgcaggctctcgtactccccctgctgccgcacctggtgggcgtgggttctgtaggcaaagctggggatgattgccatgtcggccctggacatgatggccgggttgaaggcgatgacgctcgacgccgggaacagcttctgg

SEQ ID NO: 6758 - DNA, 658 bp, Sorghum bicolor
  Clone ID: SORBI-28MAY03-CLUS54666_1
gtgatttgttaagcttttttggctgtgcgcctgcgagatcgaatgtaagattcatagctaactaaaggattctcggatggaagcgactgccatgtcgccctgaattgctctggccattcgatcttccgttggatggctgagattgtgtgcagcggattttgcgatggaaaaactgcatcacaaccacaactctaattcttctcagcctataaaaatgaaaactgcaaagatgttaaaccagtatagacgcctgcttccatgcactttccattatttcgtactcatgtatcattcgttgtgttctagattcaatgtatgataatagttacatattatttatccaggactccaaggacaacatttaatcttctaatgttgcatccacgcaaaatgcacactgcagtatgtgcttttgccttaaccactagataaatgttgccaatacaatcaaaatttgcaaaggctatctcctgcatagattaataaatttttcaaaaaatggtctttctccttgttcatgtatttccatgacttgagaccaatgaacaactccagttccttagttctcaggctataaaaatgaaaactgcaaacatgttaaaccagtatagacagcgcctgcttccatgcactttccattattttctattcatgtatc

SEQ ID NO: 6759 - DNA, 478 bp, Sorghum bicolor
  Clone ID: SORBI-28MAY03-CLUS53834_1
gcacgaggcgtcaatttccatccccttcgcccgcccaaccgcggccatgtctcgacgcggggcaatgtcatcgaccgccgccccgcgcgcgcggctgtcgccgccggcgcccgcctcccacccgccgccgcggaaacgtggccgctctccatcatcggctcctggaagcacggcgtcatcgtggcgcgcgtccgccgagaacgccgtgcccctcgaccaccaccgccgccgctggcacaacccggagcgtgcccctggtcgtgtctggcagcggttccgcgcgccccagcttgccttgccctcctccaggctttgggtttgctcggaggacgcttcgacctccccctccggagatgcctgcactatcatgtcatacaacatcttggctgattacaatgctcagaatcatcctgacctttatttggatgtcccctgggatgcactgaggtgggattcaaggaggcgacttattatccgt

SEQ ID NO: 6760 - DNA, 651 bp, Sorghum bicolor
  Clone ID: SORBI-28MAY03-CLUS53879_1
aaaacagccgccagcaacgcgcacgaggcccactctcccacggcctcaccgccctccagtcgaccagtccccactacccatcaggccgccctcgcgaatcttctagaacgttctcgaaccgccggcaaccggaatcgccgccgtccggaaccgctctaatgcccgcggcgatcgggaggcggccgcccgcccgccgggcctaggccgcgcgtgcgatggcgaggtcgaggcctagggtttggctcgtggcgggctgtgccgccgtcctgctgtgggcctccgtcgcgcagctcgtcgccgtcggccgccttctccagccttttggcctcgcgggcgacgccgttccctcgccgccaccttccgcgcttccgcccccgagaatatacaggagcaatggttatctgaagatatcttgtaatggtggtctgaatcagatgcgctcagagatatgtgacatggtggcagttgctcgtcttctaaatctcactatggttgtcccagaacttgacaagagatcattctgggctgatcaaagtaattttggagacatatttgatgtgaggcatttcatcgactcattgagagatgaggtgcacatcattaaacagcttccagagaagcttggtccaacagattcagacattattatac

SEQ ID NO: 6761 - DNA, 606 bp, Sorghum bicolor
  unsure (1)..(606): unsure at all n locations
  Clone ID: SORBI-28MAY03-CLUS53962_1
gcacgaggctcctcttccacccaccttccccccccgccccaaaaacaccagcagatctaccacaacgcctgctcggccttgctcggcgcttcttgggccgagccctagcagctagtcccgatttccgatctcggccaccaccaccaccacctccacctcccctatatatctcacaagttcagctcctgctagcctatcaggatggctgaggaaactgccaatgaagttcaggtggcacaagataacgagattgtccccggcaatgaggcaatccaaggcgatgaatttgtccatggtgatgagttgatccaaggcgaagagttggctcatggtgaagagctgccccaaggtgatgatttggttcaaggaaatgagctggttgtttctgaggtagcaacccctcctactactggaaccagacgtaggagaaaaaagtccttggtatgggagcacttcactattgaagccgtcgccggtggggccacaagggcctgctgcaagctctgcaagcaaacctttgcttacagctctggttcaaaaattgctgggactagtcatctcaagaggcacatcaccttgggctcctgtccaaagataaagaatnca

SEQ ID NO: 6762 - DNA, 1013 bp, Sorghum bicolor
  Clone ID: SORBI-28MAY03-CLUS53975_1
gcactcgcaggcagtcgccctcgcctctgcggtctcaaacccgcgcacacgcgccgcgagcgagggccaggaccaggagggcacggaagtgggagcccgcagcttcttgtcggcgcggggcggggggttgaggcgagccactccccttccgccgattcgactccctcgggtcccgggccgtcgtctccggcggccgcaccgacggatcctctctcgccgaatcgcccggttgcgggagtgatctagtggtttttttggtctgcggcgggggtcgagatggaggacttgctgaacacggagatcgggaagaacgactatgactggcttctgacgccccctggaactccccgtgttcctgcattagatgctgctgagaaagccccaccctcaactgtgactaaacgtactgttaacagatcatcctcgacaactagagcatctaggctttccacttctgagacagagaatgggcactcgacatttcccactaggccagcacggagtatatctgtctcccgccgggcagttcaatctacaccaatgtctagcaacagcaggtcatcagtcctcagtgcaaacatttcctctgttagttcaagacctacaaccccaagcaagcggactgccactcttactgcatcaaaggcatctgttctatcgtcacgtccagtgccaacacggtcctctacacctgtcaaagcccgtctgtctacaccaactaatactcgtccatccactccagtgaaaaaccgtccttctgtgtccaactctatgaccaactctgttgttcccaagaacatgtcagcacaaagctcaagatcatcaactccaacctctcggtctcgaaccttgtccagttcatcttcaagcagtacaagtgcagtgagtcgtcccagctcatcctctggtaaagttcctgcaataagtcgtaccagttcttcatcaagtacagttccgtcagtgagccgttctagctctcggtcatccacacccactcgtcagcctgtcatgcg

SEQ ID NO: 6763 - DNA, 662 bp, Sorghum bicolor
  Clone ID: SORBI-28MAY03-CLUS53984_1
agggtcccagtgccaagaggatgagatcggacgacatcgcagccgccgcggcccccccgcggccagcgccggcgccggaggcgtcccctgccgggccgcccaccatccccacaatcctccgcccgccggccgcggagatggagctgctgtgtcccagtgccaagaggaggagatccgaggacctcgcagccgatgagccccagccgcgggcaacggaagccacggaggcggccaatcttggacctgcaacccagagcgaagagccgccaccgccgccgccgtcagaagctgctgctggtggtggcggcggcggcggcgaagacgacgtcgaccgcatcagcggcctccccgacgccgtcctcggtgagatagtttcacttctctccaccaaggaagctgctcgtacccaaatcctcgcctcccggtggcgccacgtctggctcgcctcccctctcgtcctcgacggcacagacctctccaccgagcccatggcctaccgccgcgacgataagaagtttaacgctgacaacgaggccctcgccagcgcggtctcccgcatcctctccgcccacccgggccccgcccgccgcttctgcgtcccgccgcactttctccaggaccgtcccgccaccgtggacgcctggctcagctccgcggcgctt

SEQ ID NO: 6764 - DNA, 540 bp, Sorghum bicolor
  Clone ID: SORBI-28MAY03-CLUS5404_1
cggacgcgtgggctacacgccaccattagtgatctgatcgaagagttactgaaccatggcgacgacgtgctcgctccttcccatgaataacaactccctaccatgcctcctcgtcgtcgtcctcctcgctgtctccctcggcgccggcagctgctcaccgacggttcacctggttggcggcggcggcggctacgtcgacgacagcagcagcatcgacagtgctactgatgatcagatgatggagcggttccaacgctggaaggtagagtacaaccgaagctacgcgacggcttcggaggagcgccaccgtttccaggtgtacgccggcaacatgcggtacatcctggcgaggaacggcgaggacccctcgtacgagctcgtgagacggagtacaccgacctcaccaccgacgagttcatggctatgtacaccacggccacgctagcgctggacgacggcttcgacgacgacggcgacagcaacgacggcggcgacggagacgacgacagtgatggcgatgatggcggggactttgacacc

SEQ ID NO: 6765 - DNA, 702 bp, Sorghum bicolor
  Clone ID: SORBI-28MAY03-CLUS54018_1
gcacgagggagcgcccccccttccccttttcccctcctcgcagtcggcggcgcgcccccgagaagcttttccgccccctctccaatcgcgagtcttccggcaactaccaacgcacgacgagttttcttggcaagagaggaactaggagaaacccttccgcgtcccgttcaaccggcgccgtcgactccaccggtgcacgccgtcgcgagctcctgtccgcgtcctcgttctccttgctgctggacccgctactggagatcgacctgattcctcccgtgctgtcaattggatattagccaggctttcaaggtagagaaagaagctttttgttccatcatggccttaccaactccggcacctgttttgtttaatgagaacctacagataaatggaggtaagagggctgatggactaagggccaaagggctgaagccatccgagaatcctggcaagcaagggaggagagctcttcagaatttgtccaacatttctagaggcactggtttgaaggacacttccaccctgaaagagaagtccaagcagaagcctcgtagtaatgtgaccaacactattaaaggcactgctttgaaggacaagcctatcctgaaagagaagtccactcagaaacagaggtcagaagctcttaagaacccactgaaaattttaactgatgaagagatcaaaatgtgccatgagtgggct

SEQ ID NO: 6766 - DNA, 433 bp, Sorghum bicolor
  Clone ID: SORBI-28MAY03-CLUS54847_1
gattggcagatgacaaaggagaagttattccacaaggtccggcagaggcacatgagggcctctctcacctctatgggcacaaacagattctgccttgtccaatgtgtgaaacgtgaggaagtgggggagggtccagccttgggagaccatgatggttgtgttctccatttgaccatatttggcctcaagtacaatcacaagggagagcttcaaaccacagatcaccaccagtccacacgctcctttatagtgtctaggtatagggatcactttgctcctattgcattctggatgtagaagctctttggtttgttgcgatatgttgtgcctcctgaatcctctgcttcattgtcactggttcttgtcatgcattgtcctgtgagctacataaggaaatcaataaatacttttttccccgctgggaagttgtgct

SEQ ID NO: 6767 - DNA, 778 bp, Sorghum bicolor
  Clone ID: SORBI-28MAY03-CLUS5482_1
gatgcgcccggcggccttcccggctcctccgtccggcggcgccctcgccacctcacccaccagctcgccggagatcacgagaggggccaggccctgcccgcgctcctcgacgccgctcgcccgcctgcccgcccgccatgggggacgccgcctccggccgcggccacgtcgtctaccctccccgctgcgccgaggacatcttcgaggactaccgcgcccgccgctccgcaatcctctctcccccctctctcccccttctgctaccctgaaccctaataacccacttggaagctcgaaccccaacctcacccgattgctccctcccttcgttcgcagaggtcgaggtcttctacgcgcaatgcgatccaggtgagatggccctacagatgcaggccccgtcgtctctcctgcacacgccagcgccggcgccggcgctgctccggtcctcgttctcgtcttccctgtggtggcggcggtgatttgcctaggatcagtgcctcatgtcccagatctgagatggcttggatccgggatgggaggaggggcagggtgtccgtcggaggcgccccaggagcaacggcggtggcagcggaggcggggcctagggactcaccgtgctctgagcagcggcacagtgagcgcctcatgctcaaaggcgagggtggcggcaccggccacgacgacattccaaatggatggcgtctccgaagaggtggtgcggctttctctgtccctaagcagattccccttcacaaaagtggacgcgggggcttccaca

SEQ ID NO: 6768 - DNA, 814 bp, Sorghum bicolor
  Clone ID: SORBI-28MAY03-CLUS54947_1
gcactttgagacgacgacggaggcgggggaggaggaggccgcgagtctggaggcggcgaggatgaccggcgtggtgcacgttcggggtaagatgaggttctacgtgggcgacgacgccgggtggttcgacaaggtcatgctcgggttctacgagttcctgcacggcatctgtcgctccgcgctgccggcgctggggacgccgctgcaacagcgagtcgagatcggcatgctgtacaaggtttgatccatcaggttgtcagtgctcaacgatcaaatggccgggcaagaaccagtatatacgaaacatcaaaatatataaggcaatgagtatacccgtggcgtgtcaactgtcatagtgatatgatagtgtgcaagaaattcgcatgcatgaagagaacctagtaaaagctgcaaatgaaggtgaaaattaattttgccagtgtttgtatggcgtggcatggtaattgatggtacagaaccttgtttacctttttcagtggtacaagtttgccatggtttgtctgctccgcagcagtactttttggttgccttattcaaaatagaacagtggcatgcaaaaaggtgtcatgaggacaatttacatagtacaattacatctcatcaactattgttgcacggctgaaaacaaagccctagctagcttcccctttggcgtccaatcatcggaacagcaacagtgcatagccaaccttggtttggtcattgattccatttataccatcttgaagcgaagctaaaaacatagcctcctattttaatttgtgtgtgaacggaaagctaaaacataattgtc

SEQ ID NO: 6769 - DNA, 889 bp, Sorghum bicolor
  Clone ID: SORBI-28MAY03-CLUS55035_1
aatcgcgcataccctgcaaccatgcatggggccttattgagtgggttaagagaagcttccaaaattcatcgtgcctcagaaagcttagtgaattctgaccagaagaagaattcattgcctaaaaggctcaaaccacccaatggtgcccttttggatctgttcttggagccagacctagaattcgggagattctcattcgtgttctcctcattgacacctgatgatccagaggctacagggatacttcggttttcacttgacaagcgtttctttctgcagcccaataatccggagttagatggggatcaaaaggactacagctctgcatctggggccttccatttgtatgccactgtctctcgagagcaggcagatcagctacagaagtcaagcgaagatgatagaactaggctaggagtgttatgcaaggattttagtgtaaagctaatgggttatgataatacatgcgatgtaggtagcgatctgatttcgagcatcttgagtgcacggaaagccaggaaactgctgcagcacccaaagaacttcaagatctcacgttgatgtgtaccagttcgtgttttcttttgtagaacagaatgcgttattttgttatgttcaagacaggctggtggagcttggaatttgctatgacgtgtacagattacaaaccgtgtctcgctttagcaggaactgggaatctggaatgctccatgttctgttcttcacttgtaaaaattgctggtcatgtgacttcagactttagttggttataggctttgtttagttccaaaaactttttagttttagatactgtagtatttttgtttttatttagtaattattgttcaattatggattaattagatttaaaagatttatctcgtgattt

SEQ ID NO: 6770 - DNA, 591 bp, Sorghum bicolor
  unsure (1)..(591): unsure at all n locations
  Clone ID: SORBI-28MAY03-CLUS5501_1
ttcctatgctatagctaaatgattacggatttacacattgttacttatttggtacgacacccttaactagagtttgggttgcttagcgttatttttccaccattagtaacggttgctatttgataatgaggcatgcagaccaaatctggtgctcgtattcagttaataccccaacatcctccagagggtgttacattgactgaaagaattgtacgtattactgggaataagaagcagattgaaattgtaaaggatttgatcaagcaagctatgaatcagacattttcaaagcatacaaaccaatctggcggatatggtccacaaggttaccgacctcagggtcatggtgctggttctcagtgggggccacgttctcagaatcatggctatggatacccacctagaggtatgcctncacctcaaaactacaacgcaccctacggtggctacccgccgcagggaccaccaagaggtggtatgggctgggaccagaagcagggccctccaccccattcttcgtaccaagggtggggtgactactacaagcagggctctcagccatatgatagccaggcaacaagctacccttct

SEQ ID NO: 6771 - DNA, 310 bp, Sorghum bicolor
  Clone ID: LIB3476-027-P1-K1-A10
cccacgcgtccgatttaactgcaatgtgaacagtctggctgccccttgatggcttcctattacctttggctttatgttagtttgtagtgtctgttatttacttccccttttggtttctaacatgctttcttgtacagacattttcaaagcatacaaaccaatctggcggatatggtccacaaggttaccgacctcagggtcatggtgctggttctcagtgggggccacgttctcagaatcatggctatggatacccacctagaggtatgcctccacctcaaaactacaacgcaccctacggtggctaccc

SEQ ID NO: 6772 - DNA, 565 bp, Sorghum bicolor
  Clone ID: SORBI-28MAY03-CLUS60938_1
gcacgaggcgcgcctgtatgtatgaccatgcattatatgcctcaaattgaaatttagagttggactcgatctgaaatttgaagtgtctctatagtctagctttatgtgaccaacttgcaaatttcacacctcagatatgatattttttgtttcagttcgttggctattaccatggcatgttatcatggtttcagagcctttgttctacggcactgtgatagaacttcctattgtctgcatggtatgctggttgaagacgacatacagatattatgtttttgatgtcaaaaatatagtttggctttctagatttcttctcttgattaactccaattttctaatgtgattattttgggttttataattactagccaggttgcttgttctagaaatcatttgccattcatccaatttcatcatctatgctattgtgctttatatttttggcaccacgcagccacaacacatttgtctttcactgcctatttacactgtctaattataatgtaatgtcctgtataccaacttttgctctttcttttgtaggttccctttctaggttttc

SEQ ID NO: 6773 - DNA, 1157 bp, Sorghum bicolor
  Clone ID: SORBI-28MAY03-CLUS6102_1
gcacgaggatggggatgaagagttcttatacatacacttcgatgatgaagctttacttagagactgggcagcttgaaagggtgcacgccatgttccaggacatggaagagaaaggtgtgaaacctgatacgttcagtgtggagagtatgttagctgcgtacattgctgctgaagatgtcgagggggttggtaaggtgctcgacaaggccaatccacatgaaaagcttgtgaagtggcatggacaagctttggcagcgagcttgttcatgaaatctgggatgcaggtgagagctgtcatggctctcctggaagccgagaggcggatatccccaaagagtagtaggatcgcatacgctttcttactgaagacatatactgatctggggatgtatcctgaggttggacgaatttggagtgtctacaaatccaaagtgccaccatccaacacgatgtacttgtcgaggataagtgcgttactcaagatgaatgacattgatggggcggaagcaacattgaaagagtgggaaacagtgtctcttcgttatcatgatttcagattaatcaacttgatggttgatgcttattgcagagaaggtcttgtggagaaggcagtagctcttgtggatgacgccatcaagaaagggaggacaccttatgctaatacttggtataagttggctggtgggttttttaaaaccggtgaggtatcaaaagcagtggacatgacaaggaaggctcttgaatctgcgactcctccatggaaacctgacctaacaaatgtgctaatgagcctggagcacttcatgaatcaaaaggatgtagaagcagctgaggagattgcgagtatgctacagaagctgggtcctttgactaaggaggtttaccattgtttactgaagacctatgtccgtgcgggaaagccagtgtccgatttgctcgagcgtatgaagaaagatggccttgaggctgacgaggaaacagagagaatgcgagtagatttgcacccgttgtcgatcactaaataatccattttctctgttcatgtgttccttctttgttcttgagctcttctcattagcttgacacgtggccactactcctttcttgtatgtggtggcctcacagggcagtggtaatgtggaccagtgttaagaaag

SEQ ID NO: 6774 - DNA, 811 bp, Sorghum bicolor
  Clone ID: SORBI-28MAY03-CLUS61057_1
ctctgcctgccctcccccctgcgcccgctcccgctttgccttgcattcccccccccccccccccaccccccccccccctccccaccgccggcacccgcgcccccgccccccccccgcagcgccccctcccgctcctcggccaccccccccgtccccgccgtccgggggctgcaggtcccgcggcgccgctcccctccgcccccctcgcctggggcggcgccccccctccccgctggcgcgggcggcgctcccctccccgtcccctcccccgcccgtcggcccgggccgcgggcgcggcgcccgccgccccgtgaaacaggcccccgcccccctgccacggaggccctcgccccacccgacctcacctctcccctctatcccttggccgtccacctgcttcctgcccactaattcgagccgttctcgttcttgcaacaggcaggtcttacatatctcgtctatcctggagcgtttcacacacgcttcgaacactccttaggtgtctattcgttggctggaaaggctataaataatcttaagacatacctgggagtggaccttggcattgatcatgtcgacatgcagactgtaaagcttgcaggtctgttgcatgatattggacatggacccttcagtcatttgtttgagcacgagttccttccgcgggttgatcctggctcatcctggtcccatgaagatatgtcagtgctacttttggacagtattgttgacaaacatgcaatagatattgaaaacgattatctcaaaacgatcaaggacatgataactgccagctctaagcatgccatca

SEQ ID NO: 6775 - DNA, 664 bp, Sorghum bicolor
  Clone ID: SORBI-28MAY03-CLUS61060_1
gcctctcccgcgctctcgcgccccgcgcccggccccccgccggggccgccgccccgggggtggagcggtgcgggccgagcgtggggatggtgctggtgcagctcttctacgcgctggtggacgtggcactcaagacggcgtacgggctgggcatgcgccccatcgtcttcgtcgcctaccgccaggggatcgccgccgccacgctcctcctcgcgtcgctcgccaccagggggtgcacgctgcggcccatggccgtcggcgcccggggcttcgcgctcctcttcgcggcctccctagcaacgccgccggcccccggctactgctggtcggccccccaacccgcgccgccgtccccggcctggcccacccccccccccgccccccgcgcgacgcgtccatgcccctccttcaggggcctcgaccccgcggcgccgcccatctccaggcgccccgccaacctcgcccccaccgccacctgcgccgtcgccgccgccttcgggctgctctccgcggctccagggcgcctcggcggcgcgccccggtccgccaccaccgccatcggcctcggccgcgccccacccggcgccttcttcgggcgacctgccatcgcccgcccctgccgctcctcctggcgcccgccgacctggagatctggaagcttacc

SEQ ID NO: 6776 - DNA, 621 bp, Sorghum bicolor
  Clone ID: SORBI-28MAY03-CLUS61154_1
gcacgagggttgcttagcctcaaagcggagctgtctgcctacatggtgaagaaactgactgaagaagctgaaggagtttccaaggagcatgagtctgaagattctaaacacattagcaactctgttaaggaagctctagcatcgaaacagaaagaacttcaggaggtcaaagcggacattgagaaggcaaaggctgaggccaacgtgctaagatttgctgccatgacactcagatcagaactggacaatgagaaagcttcacttgttgcgttgcaacagggggaggctatggcatccgttgctgtttcttcactagaagctgagctcaatcggacgaaacaagagatagaatctgtgaggtccaaggaagcagaggccgaagaaaaggtggtggagcttcccatggttttacagcaagcgactcaggaggctgaggaagccagggtagcagctcacttagctcatgaggagctgaggaaggccaaggaggaattcgagcaaaccaaggcagctgcagctgcagcagagaccaggttatctgctgttgtgaaagaagcagaagcatctgcagcatcagagaggctagcacgtgaggcggttcaagctttgcaagagagcaaa

SEQ ID NO: 6777 - DNA, 822 bp, Sorghum bicolor
  Clone ID: SORBI-28MAY03-CLUS55421_1
ttaaaggttggagatttcggccttagcaagatcatcagagcgcagcatgcgaatgatgtatacaagatgactggagagacaggaagctatcggtacatggcccctgaagttttcaagcaccggaaatatgacaagaaagttgatatcttctcttttgccatgattctatatgagatgatggaaggtgatccacccttctccagctacgaaccttatgaggctgctaagtacgtggcagatgggcatcgccccattttccgtaaaagtcataccaatgagttgaaggatttggttgagctatgttggtctggggatatcagtctgagaccatctttcttggagatcctcaagaggcttgagaagcttaaggagcattattcgcatgagaaccactggcatttgttccagtagcagtgcttatatataattatatattctttactacaactggtgtcttgaatggggttttctcgggagatctgacattgatgaatgtacaaaattagctgcctcgagaaaggtccactgagactgcaaaaattttcttgctgttttacgtcgatgattctgctaaacaaaacagaagctttgtttgtaccacatcctctgcaactttgtctttaggttttctcgttagttgattctctccgtgaattatgaaaaatcttgagctattagaccatagttctgcagcatataggttgatacggggggttcatagatcagatggtttcctttttctattcttttctgttgccaggatctttatatgcttattattgagaactgtctcattggcaatgggaagtaaatttaccgtgc

SEQ ID NO: 6778 - DNA, 721 bp, Sorghum bicolor
  Clone ID: SORBI-28MAY03-CLUS55477_1
ggagcattgccaactgtcatgcgcaatggcacaaatcaagcggcaatgttctcagccaagaacacatttgatattgttctatggaagaaacatgaaggggacgggaaggtgctcctgccacggcagtcaatgatctctgggttccttgcaggaacagcaggccctgtctgcacaggacccttcgatgtcgtgaagactaggttgatggctcaagggagaactggtgacatcaaatacaatggcatggtgcatgccatacgaacaatatattccgaagaggggttgcgagcactgtggaaaggcttgcttccccggctcatgaggattccacctggacaggctataatgtgggcagtggctgatcaggtgatgggcctctatgagcgaacttatctgcagccagttcatatttgaccatcctacttcagtgctgcactgaaattttttggttggttctcatgattttgaatcggtggttagacgtggaagccgtccattaagtgtaaactgttccagtgcctggatattcatttgttcattgcctagagttgggtattgatggaagcaatgaactcttgtactactattttgttgtcaataatcatgaaactccctatttggagtgggaggatatttccgttgtggtgactattatggttataaactgcagtagccagtagcatctgtttgtatgattgaatctactcctatgttcatctgg

SEQ ID NO: 6779 - DNA, 972 bp, Sorghum bicolor
  Clone ID: SORBI-28MAY03-CLUS55531_1
tcatttggccatagactagagctacttttgattcctcaatatttttttcattaattactccggattccttcatttccatataaagatcatttccttcacgagtccgttcccctactccgccaaatacggatacgcctccatgagctttagcaatgttattgattaattccatgatgagtactgttttacctactcctgcccccccaaacagtccgatttttcctccacgtcgatagggagctaaaagatcgaccaccttaatacctgtttcaaagatagataatttcgtatctaactcgataaaggcaggcgcagatctatgaatagggaatgttgcactagtatccacaggacccaaattgtcaataggctccccaagaacgttaaaaattcgtccgagagtagctccaccgactggaacactgagaggagttcccgtgtcaatcacttccattcctctcatcaacccgtctgtagcactcatagccacagctctaactcgattatttcctaataattgttgtacctcacaagtcacattaatttgcttatcggcagtgtctcgactcttgactatcaaagcattataaatataaggcaacttgcccgggggaaaagtgatatccagcacgggtccaataatttgatcaatacgccctacgcttttttcttcaattgtggaaaccccgggacgcgaagtagtaggattggttctcataattatcacataattttcaaaaaaaaaaaaggaatttatcgaaatttttttttttcttgttgaataatgccaaatcaaatcaaaaaaaaaaaatatccaaaaatccaaaagtcaaaaggaaatgaattagttaattcaataaaaaagaaaaggggactcgcacttgatttcgttacccaagcgaatcccattcaatcgtttacttatggaatgagtccgttggaaagttcaatcaattttttcatataccagta

SEQ ID NO: 6780 - DNA, 487 bp, Sorghum bicolor
  Clone ID: SORBI-28MAY03-CLUS5546_1
cccacgcgtccgcccacgcgtccggcaaagatgtattagatgaagcaacaacaatgagactactggaaagttacggaagagtggatgaactagtgtactttgctggtttgaaggagcagtatgaaattgtggttcatcattacattcagcaaggagaagcaagaaaagcattggaagtgcttcaacggcgcaatgttcctgtagaccttgtgtataaatttgccccagatttgatcatgttagatgcttatgagactgttgaatcatggatgatggtgagaaacaagttgaatccagggaaactcataccagcaatgatgcgttatgtgagcgaaccacatgcgaagaatgaaacacacgaggttattaaatacttagagttttgtgtgaaagatttgaacaatgaggaccctggagtgcataatctgttgctatcactatatgccaagaaggaggatgaatcccagcttttgcaatttctcgacac

SEQ ID NO: 6781 - DNA, 571 bp, Sorghum bicolor
  Clone ID: SORBI-28MAY03-CLUS54710_1
atctcctcttttctctctctccgagtccgctccaatgccgttgcctctctcctccacctgccgcttctcataaacgcctccggccgcccccccgggcacaaaccctagccctcaaccacgccgagctcgccggaacccgcccaacccgagcccaattccgctcgggtcccggccgatccggcggctccccaccagcacgatccggggcagcgtccccccgcggatgctagcctgatcgggtccccacggtcgatgggttcgcccgggtccgccaatggcagacgcggcgagtacgtgaggatcccggaggaggtggaggtggcgtccaagggggagggggatgccgcggcggccgtcaaggcggccgcggcggcggagtgcccgagggtgctgcggtgccgcgcgatccggtggtgggccaaggtcgccgtgctcgggatcttccttgcaggggccggagctgctgcggtcgtcttcctcggcccgctccttatcaagaaggttgtttcacctattctttactgggaatcaacaactttcagcagaccagctattgctctaatatgttttg

SEQ ID NO: 6782 - DNA, 512 bp, Sorghum bicolor
  Clone ID: SORBI-28MAY03-CLUS5467_1
gactagtatcaggatcgggagaccgtcctgagaagctccatcaagagtgccttgttcacgcgcttcttcaggtctgctcattttgtttcagccttcacattctaaaaatttccctttatgctattaacatgtgcttttataattgtattttctaccattttcacactacttaaagctcatgttgtagcatgcccgttttccctctatggtactgtttgcagctctattacattatttctagtaaaccttgctttcatactttgttgtgaattgtgatacatgtcttttcaaaactactgcagaggcccttttcctgcaccgttgatggttgccccttgagctatagcaggaaggatcatttgaacagacatttacttactcatgaagggaaactatttgtgtgccctatcgaaggatgtggccgaaagttcaatatcaagggtaatatgcagagacatgttcaggaaatccacaaagatggctctccatgtgaaagtaagaaagagttcgtc

SEQ ID NO: 6783 - DNA, 459 bp, Sorghum bicolor
  Clone ID: LIB3478-003-P1-K1-A10
gtttagtaggccatttgtggacatatgaatgcgtgaagcattggatcccatagaactccaatatgcaatatggcctcgaatggactagtatcaggatcgggagaccgccctgagaagctccatcaagagtgccttgttcacgcgcttcttcagaggcccttttcctgcaccgctgatggttgccccttgagctatagcaggaaggatcatttgaacagacatttacttactcatgaagggaaactatgtgtgtgccctatcgaaggatgtggccgaaagttcaatatcaagggtaatatgcagagacatgtgcaggaaatccacaaagatggctcttcatgtgaacagtagaaagagttcgactgtccagacgttaactcggggaagactttcaaatatgccgtccagttcaagaagcacgcataatcacatgtccatctggaatacacagaagctatc

SEQ ID NO: 6784 - DNA, 782 bp, Sorghum bicolor
  Clone ID: SORBI-28MAY03-CLUS54670_1
gcacgaggggacgacgcggcggtggccatggaggtggtccggctgaggcgggagcagcgagcgatcgaggagcaggtggccgcgatgtggcgccgcgtgcaggagacggagcggcggcccaagcagatgctcgcgttcctcgtcaaggtcgcgggcgacccgcaggtgctgcgccgcctcgtctccggcgccaccgacgtcgggaccgacgacaccgccgccgccacggagccgtaggacgccgccaacgtcaagagggcgcggctgcttctggacgccggcggcggcggtagcgacggcgccgtcgacttcagcgggttctgtagcaccggagacgaagcagacgtcgggttcaccgattacctgctgcagccaccgccgtacgtgttccccgtcaacagcggctactgatggcggagcggtggtcgcttgtcgtcgtgtgcgtgcttcgtcgtcgttagttgcccctcatcaccaactgcttgcgctggacgtggcaacggcgggcggaggcctagccttctgaccggccgaggggctggttgcctggtggcacagcaagccgccgatggcgtccgtgcgtgccttgtgactcgtgggcgccgccgccggcggggagccccacgtgcgtgtccaggcacgcgcgcgaggcggaataattaggagggggtggtacaaaagtgtaaagcctttggtttaggaggtgcttgctttccgtttccctttcttcgccctgtgtgatgtgaatactacggagtaccaaacacagcagcagcaatgct

SEQ ID NO: 6785 - DNA, 849 bp, Sorghum bicolor
  Clone ID: SORBI-28MAY03-CLUS5479_1
tgaacaggaaaaattgtttgggtcaaagtcgagccctgccctgtccttgaggaaggtggttggcgctcggaccaatggtggcggtgatgcagccaatggcacgccagtttcttggttgtcggccctccagagccgtggcggcaggaccgtgagccaggatgggaggagggatgctagcagaccagtggcccccgtgaactacgctgccgtcgccaaggaggatgtgcctcgcaggcgtcgacatactgctcaagtcaatctgtattatgaacttgcgttgggcgcattgaagaaggtgcagcatccgtgcatttacaagctatcaacaaaggagcatgaaacgacaatgagggggtttttgagtgatagatttatgccagaacaattttcatgcgcccatggtccactgatttactagaacctatgcaatgttggcaccaatgagtcaagacaaggactatcaagtggaacaagtgtagtggaatcaggctcccttcagtcgaggtgcactgttaagacagtgtatgagattgtatcatgatttgattcaaggaagaaagaactggttgaaacaacaggatttggtggacttctgaagtttccacaccttaaaaatacaaacaggcgattctaaatatttatttttgtttgtgtatttaattagtgaaaaataacatgattgttaaaaatagtatagattcttaaaatacccaacattttatttatgaaaatgtcaagctgctggtcctctgttcatagcggggcagaaataaaacatatttactgtagtgaagtgattgtatgaggatgtgacttttgttaaatgaatgagattttggttagttcttg

SEQ ID NO: 6786 - DNA, 845 bp, Sorghum bicolor
  unsure (1)..(845): unsure at all n locations
  Clone ID: SORBI-28MAY03-CLUS54749_1
gcacgaggagttcgtctacgtcggcggcctccgcgacgacgtgccgcccgcggagcacgacgaggtcgcgcacgagctcctcgagggcttcggctgcgtgcccaccttcctgcccgccgacctccgctcccgcttctaccacggcttctgcaagcagcagctctggccactgttccattacatgctgccactgtcgccggagctaggtggccgcttcgaccgcctcctgtggcaggcctacgtttcggtcaacaagatcttcgccgacaagatcctggaggtgatcagccccgacgaagacttcgtgtgggtgcacgattaccatctcatggtgctcccgacgttcctgcgcaagcgcttcaaccgggtcaagcttggcttcttcctccatagcccgttcccgtcctccgcgagctacaagaccctgcctgtgcgtgaggagctgctccggtcgctgctgaatgccgatctgattgggttccacacttttgattatgccagacacttcttgtcatgttgcagcaggatgctcggattgaagtatgagtcgcagaggggctacattgctctggagcacgacggtcggacagttactatcaagatcttgcctgtgggagttcacttggagcagttacagtcagtcctcaacctcccggagcttggggtcaaggttggcgagcttctgaaacagttccgtcatcggaatcggctgctgttgcttggtgttgatgacatggatatctttaaaggaattagtttgaagcttttggcatttgagcagctcctgatgcagcatccagaatggcggnnaagggtggtgcttgttcagattgccaatccagcaa

SEQ ID NO: 6787 - DNA, 1064 bp, Sorghum bicolor
  Clone ID: SORBI-28MAY03-CLUS54816_1
gcacgaggcccaggcatgcaccgccctcttcgaatccgcgacatgccgagctttttggtcgaggagaagacgcaggacggcctgtccaagatgatcctccagtcgatgcgcgggctgtttcagcagatggacgaggagaagccggtggttctggtgaacacgttcgccgcgctggaggacgacgtcgtgctcagagccgtccagccatacatggacgtcgaggtcttcgccgtagggccagcagttccattattgaagaagaaggacgacggaggagcaagcgaagaacgactagcacagatccatctcttccagcacgacgagacggcggcgtacatggagtggctggacgagcagccggagaagtccgtcgtctacctctcgttcgggagcttgctgggatacacgagacggcaagccgaggaggtcctccacgggctgcaggccagcgggcgaccatacctgtgggtggtgcgcagggagggccgcgccgaggaggtggatgacctctgccgcctgtcgacggcggcggagaagaaggcggcggggatggtggtggagtggtgcgaccagcagcgggtgctggcgcacccatcggtggggtgcttcgtgacgcactgcgggtggaactcgacgctggaggccgtggtgagcggcgtgcccatggtggccgtgccgagctggtcggaccagccggtgaacgcgtggctggtggaggaggggtggcaggtgggtgtccgggcggagcgggacggagaagggacgctgacgagaggggagctcgcgaggtgtgtggagctggtcatgggcgccggtgacaaggcggtgcaggtgagggcgaatgcgagtgggctgaagcagagagctcgagaggctgttgctgcaggtgggccgctggaaacgagtctcaggagatttgtcgaattcatgcaaaagtaataagtattttatttttgacttttgctatttatctattgatatatatttttacgaaatttattagatttctatatatttgattgtgctttaggatttgtactacatggtcgtatttataaaaaaaa

SEQ ID NO: 6788 - DNA, 779 bp, Sorghum bicolor
  unsure (1)..(779): unsure at all n locations
  Clone ID: SORBI-28MAY03-CLUS55767_1
agcacgagagaagagacgcggccagcgcgagggctccgccgcccgcctgctcgctcttcctccgggtcgccgccgctgcgcccagttccgtcacctccagctccgttttgacccagcgcggcagcggtctcctcccttccccgcgtcccgcttccccccgccgccaccttaccgcggcatggtcatcgaaggccgcggcctccgcttcagtcgaaatacaggatgactacgcggatgagatggacgcggtgaacattgcgcaggacgttacccagttaattggaaaaacaccaatggtgtatctcaatagtgttgctgacggttgtgtcgctaatattgctgcaaagctcgagtacatgggaccttgccgaagtgtcaaagataggattggattaagcatgattaatgatgctgaagagaagggtttaatttctccagataagaccattttggtagaaccaacaactggaaatactggtgtagccattgctgctgtggctgcagcaagaggatacaagttgatagcaactatgccttcatcaatagatgtcgggagacgtgttcttctgcgtgcattcggagcagaggttgtgttaactgatcctaccaaaggactaaaaggagcctttgataaagctgaggaaatagttttgagaacaccaaatgcgtatatgtttcagcagttcaataatgaggccaatagtgagatccactttcaaaccacaggcccagaaatatgggaagacacgttggggttctgttgatatacttgttgncag

SEQ ID NO: 6789 - DNA, 851 bp, Sorghum bicolor
  Clone ID: SORBI-28MAY03-CLUS55729_1
gcacgagggtcataactttgcgaaagaaccattggtgcagttgtaagatgtgaaagtataggtccaccgaccagggctcaaatcctatgtgcacaaatattaaagagagataagttttttttttaaacgagttaaagagagataagttttttttttgagagtcaacgggggggaggcgatccccacctgtaaaataattttattttagcccgaaacggctcgtaagttttgatgattacagtgcacaggtcaccatcaacaactggatcgccgcccgcaaggcgagagccccggcccccggctcctcggggcggggcgctggcgcgggagtccccccccctccgccttgcttcggccggcgctcccttcccctgccccggctcctcctgcaggtgcagtttgcattatccctggatctcactgattagtcgcatgtgagctgaacttgcttttctgaaaattggaacttcagtacaagtttcagataggattcagggagaaatgatctcttttaacaatttatttgggagctcgctgcagccttctctcaagttttacagaaaatgcctgacaaataacccatattttgcgctgaccatgcattcagttacaaagcccttgggtacagctatgatggtgaagagggcacgtttgaagccgcatgccacagacatgaagcggaacccccaggtacatgagctttacgaattggtttatagacttccagagaaccttagctggctgttggcaccaccagaagttcctaaaagacctacctcgaagaagaaaaaacaaaaggatgaaatagtgactagtaacagctttggtgtgatcttggagtgggagggagt

SEQ ID NO: 6790 - DNA, 577 bp, Sorghum bicolor
  Clone ID: SORBI-28MAY03-CLUS55875_1
acacgcggagaaaattgcgaagcggaaccgacagagggtgagagagaaagagagagagagaggagagagaggagggagggggcacgaggggcgagagaagatgcgctgcgccgccgccgcgcttgcggtcgccctcatcgctgccgtcgccggcgcagccgccgcggggtcgccggccgcgggcacgtgcgcgcggaggggcgcgccgccgttcctcgacgccgtcggatcccgctgccccttcgtccggatcgagccgtccccgcctctcgaggtgagaggagaggctgttgatactgagttgaaccttcgaaggaggggtgcttcatacttcattctcttttatgctgcatggtgtccattttcgagcaaattccaaccaacatttgaagctcttagcacgatgtaccctcagatacatcactttgctgttgaagaatcttctgctacaccaagtttgttttcaagatatggagtccgtggtttcccagccattctttttgtaaatgagactacgatggttcgatatcggggttcaaaagatcttaactctctggtgaatttctataaagagact

SEQ ID NO: 6791 - DNA, 805 bp, Sorghum bicolor
  Clone ID: SORBI-28MAY03-CLUS55932_1
gcacgaggatctaaccctagtcacccgcgccccccctccactccgcccccgtctcctccctcagcggcggcggcggcggcggcggctgctgctgctgctgcggcatcggtgtcagcgaagatgtcgggcggcttcttccgggggacgtccgctgaccaggacacgcgcttctccaacaagcaagccaagctgctcaaggcgcgggggttcgcgcccgagcttgaccatctggtggatatgtcaaaggttaagatggacgtgatgaagccctggattgccaagcgagtcactgagctccttgggttcgaggacgaggttctcatcaacttcatctatggcctcctcgaggagaaggaagcggatggaaagaagattcagatccagctgacaggtttcatggagaagaacacagtgaagttcatgaaggagctctggagccttctcctcagtgcacagcaaaatgccagtggggtgcctcaacagtttctggatgaaaaggaggctgagatacagcagaaaaaggcagaggatgataggattgcacaggagatccaaaagaagcgagagaaagaggcaaaggactcagaactggaaaagaacaaaatgacggatggggatgctggtaactcaagatcctttggtgatccagttggctctgctttaaatagtacaaatttcaatgccgacgaagaaaaagacaatgatttcaagcgcagcttaagaccaaagaacaggggaagtcgcagatccaggagcatatctttgtcgccacgcggtaggcaaagatctatttctcccagaaata

SEQ ID NO: 6792 - DNA, 671 bp, Sorghum bicolor
  Clone ID: SORBI-28MAY03-CLUS55961_1
ggataaggatcgagaagcttgcgctctctcctctcctcggccctctccgtctccagcctccagcctccacccatggcggctcatcccctcctctcctccgcggcgctggtttgttgccgtcttgcacctgcaggcgctgtaggggaaaggagccgcgtcccccggctgtgcgtgacgacgtcggcacgcccagctgctcgagcgggcgggagggcgaggtccctgagcgtgaggtgcgagcagggagccaagggcggcgccggcgccggtgggctggacgtgtggctgagccgcggcgccatgctgggcttcgtcggggcggtcgccgtggagctcaccaccggcaaaggcgtgcttcagaatgtgggactgaccgcgccgctgccgacgctggcgctggcgctcaccggcgtggtcggcgtgctcacggctttcctcatcttccaatccgggacgcgggactgatggacgagagctgccggcatcttcctagctcccaactcccaagaaggcatgcatatgtgtgtatatctatgcagttgtagttgtgttcatagaaaggggatgcagaggaagttggaggagtaacacattatggaaaagaaacgataattaattgttaccaaatgtgtgttttcagtactcctccttgaaggagtaaattgcatttt

SEQ ID NO: 6793 - DNA, 618 bp, Sorghum bicolor
  Clone ID: SORBI-28MAY03-CLUS5516_1
acttctcctccgtcctcgccgcatcagctcctccagcctcatcacaacaggctggtaccggcggcggcggcggaaatgtgacggagccggcggcgtggacgccgcggctgaggaagacgttcctggacggcggcggcatcgagcactggcgcgggcggcggctggtggggcggttccaggtgtgcgcggtatgcacctgctgcgggggccagcacgggatgtgcatcccggcgccctgctgctacgccatcaactgcaacatccccaaccgccccttcggcgtctgctccttcaccccgcgcacctgcaactgcttcaactgccatctctagcctagcctagcctagcctagccgccatggatgcagcaaaggaaccaaggtgtggccaactgctgctggagtgctggatccatccatggttttgattgtttctctttttgagttgagttcggttgccgatggaagggaagggaagggattcgtggtgacagattcgttaatttggggaaccgattggaagagttcatcatcatcgcataattaatactagtaccgttagtagtatatacactcctgtcctacattgtagccatgactcatagtaggcagcagtaggt

SEQ ID NO: 6794 - DNA, 605 bp, Sorghum bicolor
  Clone ID: SORBI-28MAY03-CLUS55213_1
cctagtagtacattatcttactgctatagctaggaacagaatcgaagatgtattgaataagtgaaaactataaaaattctaaaacatggaaattgatactctgagaggtttggaatggaggaaaagaaatacaggaacatgagcacatagcaagagcgaaaacaaaaattccttcccttaggttgaaacgatggttttagtctccactaatatggtttcctttcaacaaaaattaactcaccgttcctttgttccaaacactatgatgtactaattccttttctttggaaattattgtttcagaattcctttgaaagttgtttgaccaaacagtaaattacctacttgccctaaatccagtccacttgtgtagtcatccagaaaagataccacaacaagacaggcagttaatagatcgaataggacgtactgctgattatttttgtttcacattaattattagcagaaggttctaattcgagctgggaacacatatggtttctagaaatggaattaacccaaggccccaataagctcatctagctcctcataattgatcgacacaacccctcagcaattcgtcgccggaaaaaaaaaaaaaaaaa

SEQ ID NO: 6795 - DNA, 631 bp, Sorghum bicolor
  Clone ID: SORBI-28MAY03-CLUS55227_1
agatctacgacgtgcgcggcatggtgcgccagttcaacaagaacctcaaggtcggacacactgacacatggacggcgtgggtcgacggccgcaacgacgtggtcaccaaggcgtgcgacattgccatcaccaacggcttcccttactggcagggcgttccgatcaaggaggctctgcagaagaagacgttccagaactcgtactggagtgtgcagaagcacgtcaaggctgttaacagcaaggctgctgtttgggttggtgagacgggttggcctactaagggacctaactaccagaaggccgctgctactacggctagtctgcagagctactataacaatattgggtgctggttgtggaagcagaaggatgccagtgggttctggttcactgctttcgatgcgccgttggctacgcctgaggttgagaagtactttggtattgcgaacaaggaccgcaagctcaagttcaccctcacttgctagatggagcgtatctgatttcaagtatattttttgaagataggatctggctgggaaacaggcgctggagactcatagcatatacattcattcatagactatttcattcaaaagccagcggggtaaaaatataatggcattgtaattcc

SEQ ID NO: 6796 - DNA, 470 bp, Sorghum bicolor
  Clone ID: SORBI-28MAY03-CLUS55297_1
gttctcggccgccggcatgcaaggcgacggcgtgccctcctcgcactaccaccggggcctcagcgccgccaccgggttccagctcctccacgacctggctggctgatcgcattagcatggcaaagggacggaccgcgatggtcagagccgaacgagtgctttaatttgctttggagcttcacgcggccgcttgacggggatgtgccaacggcagcagctagcggatggcattggcatgggcgcatggcgctcgcgcagcttgtgcgctttggatttttgtagggttttagattcctctcccttcaattcttggcagggtctctgctgtctatatgtgtaatcagtgtgtatcgcttcggtgctagctcggactcgcctgattcccttactgttgcacgctcgcgccaacacaaaaaactttctaaaatttagtattaagtcatcatttaaaaaaaaaaaaaaaaaaaaaa

SEQ ID NO: 6797 - DNA, 683 bp, Sorghum bicolor
  Clone ID: SORBI-28MAY03-CLUS55372_1
gcacgaggcagcagagaaaccttctaagaggcaatgcacatatgctgaccctgcagatgatgcacttaatcagaactacaatatatcatatctggggaagatggacattctgactgagcctctaactacaaaacaaggaaatgaatactcaataccaaaatgcttaaaagtgttacatgacatggacgatgtgtcagatgagatgaagcatcttgcatttcatatcctcaaggatgcacccaatcgagagatttttatgagctatgaatcaagacttcgtggtttatggttgaagaaggaagttaccaagcttggaacataattgactccttgtgagaccagtttggattcttatatccttattacaagaactgggattctgagtctttcttattgtggcagcacagtaataaagtcgaaaatctgctttgcatggtaatgcatacaaccatcttgacataccatcccgcacagatgccatgcaaaataagaatttgccatgatattggtgctagatataagaagctgacatggaggcaatctttgtaatatagctatgtactttgcttggtattgaactgagaaataggtatactagctctattcattgggtatcttctgatgggagcttttgcttcagtactgctgccaacataattgccatgcgaaatgtatctgatgct

SEQ ID NO: 6798 - DNA, 641 bp, Sorghum bicolor
  Clone ID: SORBI-28MAY03-CLUS55384_1
agagtttcggaagtctccgcagctctatcccactggcccacttggtgcgcctttcgttcctgtgggcattgccccaaccgctctggtagtgcttggcgaggcgccgcgccaggttctcggcgtctcacttggctcgcccatcgctccctccgccccggctccttcgcctgtgcttctttctcatgcctcaggcaacagcaatcatgtggaggcattgagagtatatcttctgtcaaggtctctttccagattgaagaacgatttccaaagtggaaatggcatgattacggtcgacagcattgaaggttatccaccaatcagcttacagctaggaaagcatgtttttctaagtgcaggggatttttatctggctactcgatcctaatttcgtttgcagcaccccaattttgactgattcacccattattttgtcgcaatcagcttgaacagcttggttccatttatacatggcaccaaagtcatgtattcacattcatcagttaaaggttgaaaaatctcaatgtatgctataccatgatatgcatctgtgccccctgggcacatgtgaattttcaaataccaggctatgggcttcccatgatatgcgtctgcgcccctgggcacatgtgaactaaggtttc

SEQ ID NO: 6799 - DNA, 547 bp, Sorghum bicolor
  unsure (1)..(547): unsure at all n locations
  Clone ID: SORBI-28MAY03-CLUS56203_1
tcatgccgccgatggcaaatttatggcattccatgtgcacatgctgctgctgcactgctttcatgtggtgaagacccccgcctctatgctcatgactgcttcagcgtaatgaagtaccgggaaacctattcccagccaatatatccaattccggacaggagccactggaacaattcatctcccgggttacaaggtgtagtcagcaaggctgatgtgatccttagcccacccaatatccggaggcctcctggtcgacccaagatgaagattctaaagatagagagcatgaagcgtccgaaacggatcattcagtgtggtcgatgtcatcttctagggcattctcaaaagaagtgctctttgcggatctgatgcatatccattgatgtacactgaactttgttttattgataatttaggaatttcattcatgcttgttcgtatcaggtgtagttagttcttttgtgttagtacttctgtagttctatatagctctgcctctgaaatcatgtcgacgttgagcactttttntattgcactgaaagtttct

SEQ ID NO: 6800 - DNA, 735 bp, Sorghum bicolor
  Clone ID: SORBI-28MAY03-CLUS5619_1
gttctctcccttgtctcttcctagttactactaggacgaacccaaatccaaacccacctgagtataggggaaagtgaaggaagagggccgccaggcttagggtttctcgacgcctccttcctctctccgccatggacgcgcagcgagccctccttgacgagctcatgggcacagctcgcaatctaacggatgaggagaagaaggggcacaaggagctgaagtgggacgatccggacgtgtgcggcccctacatggtccggttctgtccccacgacctcttcgtcaacaccaagagcaatctcgggccgtgctcgaggatccatgatctgaagctcaaggaaagctttgagaagtctcccaggcatgatacttatatgcgacggtttgaggcagagcttgcacaacaatgtgagaaattggtgatggatttggatagaaagataaggcgtggtcgagaaaggttggctcatgattctgctgtgccaatgcccttccctggacgcagtcccgcgcggctggcagtccgcgcagtgctggccgtgtggctgctggtgccctgcggggagcctgggcggcctgggagagggcatgaggcggaggcacttatgagaagggttgacattctaaatgctgagaagacagctttagctaaccaagcagacaacaaagtggctatgcttgagaagaagatggaactttgcgaaacatgtggatcattcttagtttctgatgatg

SEQ ID NO: 6801 - DNA, 653 bp, Sorghum bicolor
  Clone ID: SORBI-28MAY03-CLUS56253_1
gccagttacatcgggggcaaaggctaatgcaattgctctcaagaatgctgtaagctcagctgttgatgtcatgcaagttttgggctcatctgtttgctgcatgctttcaaaggtcacggacagcacatccttggtttcagaactctctgcagtagcaggacaagagaaggccatgcttgatgaatgcagagaactcttagctacagctgcaaaactgcaggtgcaggagtcgagcctacggacacatcttgtgcaacagagacaaaggcaagggttgaatttggcaacctgaacaagatgcagaagccccaggccatgccattgaacagatacaactaggcaagttgaacctgcaactataagaactgcaaacagaaaagaaatctgtagagacgaataacaaatgttaaacatcccctggagattcatggtgtgatgcaacagctaactacccccagtgcatagatatgacaggtttactgaacagacctcatcatatgtaaatggttttcaccatataatgcactcccagccttttctagtaatttttttccttatttttgttccttgtatagagtggagccctattctttccccattgtattttttgacatttggaaagaaatacatagaagaaagggatgggctgacaa

SEQ ID NO: 6802 - DNA, 759 bp, Sorghum bicolor
  unsure (1)..(759): unsure at all n locations
  Clone ID: SORBI-28MAY03-CLUS56257_1
atntctggccccatgcaccatgtgaagatttgttgcctgcactcgacggttcagcaacagaaatgatcaacggggtggtcgtgcaaactggcatgcatgcaaaagtttcctttgaacagctaggcgacattacgataccaaaggcagtagattgccttcgcagggatgtggcagctacctcatatgagattatgtggaagtccaagcatggcagggcataccttcaggttgggaagaccacatggagagcaaccgctcaagaagaccgaggtaggaaacaccataaacgattgacgggcaagaagctgctaggatgggccagtgcgaacaatgagttcatgtgctcgtggattagacatgcacctgtccagttgcagagcttagtggtgcactggtttcagaaagaaatacaattgccgcaacctttattattgaaaactaattcctgcttccattactgtccaatcatgctgttttcattgaaagataacaggtctttggtaataaggacaatcaagtcgtccagcaagttcaatggttgaagaacttttaattccttgtacttcagcacccttgatgaacaaactatagctgacccattggtgtgttttgtaaatgtaagactatataggggctttctgaagaatatactagctatttatagggataatgagatgccaagattgagatgtgtcattgtaattgcagtatattgagttattgtcgcattgtcaacgttggtgaagtttttttattgtc

SEQ ID NO: 6803 - DNA, 696 bp, Sorghum bicolor
  Clone ID: SORBI-28MAY03-CLUS56329_1
gctgatgagttgagaacaaaggttgcagatgaatttatcaagaggcgagcagagactgaatggtttgttgagggggactttgatacgtacgtatctcagattaggaagccacatgtctggggaggtgagccagagttgttcatggcttcacatgttcttcagatgccaatcaccgtttacatgcatgataaagaagctggtggtttaatagcgattgctgagtatggccaagagtatgggacagaagctcccatccaagttctttatcatggttatggccattatgatgccctgcagataccaggaaagggtggtccgaggtcaagattgtagcatttgtagctctgaatttaaatggcagtgacgcagcggcaagtcgatggtgcacattacctatgctttggtggcaaagacagatggccataattcagcttggtccttttgacatgctggaggtggccacggaacggacatctgctcagctctcgtgatcttcagatgctcctgacttcctaaacagcgcgacaattatgaggagttgtcctggtttcgttgaatgtactgctggagtagtggagtcaaaagctgtatagaggtgaaaccattatgttgaaccaagtaccagactgtgggctcgagtgaaaccagcggcctccgcccccgctgctcgcgtaacagcttcacctgctggattcc

SEQ ID NO: 6804 - DNA, 1082 bp, Sorghum bicolor
  Clone ID: SORBI-28MAY03-CLUS55534_1
acgccaactcatacgtcgctgctcgaggaaatggaggtcgcgacggcgacggaggcgtcggcgccggcggcgagcggcggcgcggcgcggcagactcacccattcccgtggctagacgctgccatctcggagccctactacttcctgcacctcctcgccttcttctcttacttcgcggcccgcagcgcggcgctctccgccgacaacggaggcgaactccacgaccgcctcctccgtcgggagatccaggcagtgctcgtgttcctcgtgctcttcgtagtgaagattgtgaaagaggaaacctgggaaacattcattgctgactcattgctttatgcgaagggtttattgctggcagttactttggttattgattattggctggtctttgcctactttctgggatttcttgttatatatgctgtagctcaacagccaccttatgacggcctaggccattcaaatcacttgaccccattgcaacttgaaagtctgctaactgaagagccaacatcaagattttggctggtagaattccgaacttcattttcagcaaaatgtatacaagcaagcagcgttctgcctgaactttctattatgtactcgaacaagaacatctcttttggaataattgacctcgggcatttcccaaatgctgcagcaaaatttgggatatccatgtgggatcatcttcccacttacatattgtttgacaaggtgactgaagtttctcggtttccagaaatcacaagtgaatcaaaagtatttgtgccaaaagttactaagaaacttctttgccagcattttgatcttgacagacgattgattggatacctatctacctgatctgtcagctatcccagatgcctcaaaggatggggccatttccttttttgtcgctgaatcggacatctgtgtggcagcaatcagttcaggggtatcttgagccttgtattattcgatgatttgcttatgcccttttaatcaaggccagtaaactttgtggtgaaaaaaacacatatttttgtctaatctgtcagctactgaattatagaatttcactaccatgcagagatttctgt

SEQ ID NO: 6805 - DNA, 835 bp, Sorghum bicolor
  Clone ID: SORBI-28MAY03-CLUS55551_1
gcacgagggcagtttccagtctaatccgtatcccatctcccgattcccaagccgccgtgaccgctccatttcttcttccgcggcgcccacctctcgccgcctcgcctgcaccggagtgcccgcgcacctgcaaggtctcaaacacccagagatggcaactttcacatccccagttctctgcaacttcatgaccatccaacagaagagcacgcctctgctgaacaacaacagcacaaaacggccccagcacctgagcttcccaaggacaagcaggagcgtgccgacgacattgccgggcttcagagcgaggcaagacctgcgcgtcgccgccgtctacaaggtgaagctcgtcggccccgaagggcaggagagcgtgatcgacgtgccggaggacagctacatcctggacgcggccgaggaggccggcgtcgagctgccctactcctgccgcgccggtgcgtgctccacgtgcgccggcaaggtgctggagggctccgtcgaccagtcggaccagtcgttcctcgacgacacgcaggtcggtgccgggtacgcgctcacctgcgtcgcgtacccgacgtctgactgcgtcatccagacgcacagggaggcagacctgcactagcctactaggtagtccggttagctccattcggattcgatcttgagttcttgacactgactcgcttgcacttgtgctcttgtccttgcagctaggtagaactagtacattcttgttcacaaaaaaagaacatagtcttgtttagttcaccaacaaaattcaaaaaactttttaaaatttttcatcacatcaaatcttgtggtacacgcatgaagc

SEQ ID NO: 6806 - DNA, 747 bp, Sorghum bicolor
  Clone ID: SORBI-28MAY03-CLUS55663_1
cgcttttccaccttccccccccgtgcggcgctcccacgctgagtcgctgaccacgtgcgcctgctcctctctccctctctcgcgtcctccgcagcacagcccagagcccactcgcgtcggatcgcgcgcggggaagggcatggccggcgacgacggcagcatcgggagcgggagcggcggcggcggcggaggcatcagggacagggaggatgaggtccacgtacagatcgcaggatcgtccaaacctgaaacttcatctactaacggaacagctcctcaaaactcccataccaggcattggcattggtggttgatggtagctctgaacattttcttcctcgttgctggtcagacagcatcgacactccttggtaggttctactacaaccaaggtggaaacagcaaatggatgtccacatttgtccaaaccgctggctttccagtattgtttgtcgccctatatctgttccgttcaaagtcgccttctactcaaacaaccaccagtaaccctgagacttctgtcaccagaattactcttatatacattggcttgggcctcatcattgctgccgatgacttgatgtattcctatggcctcttgtaccttcctgtatcaacatattcgctcatatgcgctagtcagctggccttcaatgctgtcttctcttatgtcctgaatgctcaaaagttcactgcattgatcctcaactcggtaatcctccttaccttttctgctgcacttcttgg

SEQ ID NO: 6807 - DNA, 299 bp, Sorghum bicolor
  Clone ID: SORBI-28MAY03-CLUS5566_1
ctcccatccatttggaaccagatttgactagtctctctgaaggagacagggaagccttgggatatattcttgaagcagcaatagttattgatgacatattctatgaacaagtatggaatagtaacaaaatgcttcgagactggctgaaagcacattctgaatcctcatcattcgataaattgaagtgggcgtatcattccattaataagagtccctggtcctgccttgacgagaataaggcctttctatcgactgcagattctgctgtgaaattactcacagatgccacgaagccagtt

SEQ ID NO: 6808 - DNA, 1061 bp, Sorghum bicolor
  Clone ID: SORBI-28MAY03-CLUS5571_1
gcacgaggtactggccggtagggatgtcggccatggcggcgggccgccgcctcctccatctgccggggctcgagctgtgcctgcggtcccgtgcgcttaccctcctctcctcctcgcgggcagatgggatggctcgttactggcgcgagcctccgcgccggaagcttgtgacctgtcggcaaggtgctttcgaagagggaaatgcagtgagggataaggctgtgccgatttcagatgaactgctcggccattgcaaggatgccaatggcagggctctagacctagagcccattggaaagagctctgccaatgagtctgtgcaattgtctttcgaagaggaggagagtgacgacgtggtgtgcgaaattagcgaaagcttggtgcgagatgtggagaaggctgcaattgaattgcttgctgccagagctttcactgtttctgagcttaggaagaaactacgaagtaagaagtatccttttgatacaattgatgctgtaattgctaatttcaagtcaaggggtttgttgaatgatggtttttatgctgaatcattttcgcgatcccggtggctatcatcaacatggggtccaaggcgaataaaacaggcacttcgccaaaagggtgtgccagaggcagaagtgcacaaggcaacaagacgagtgtgacaggatgtccatggccatggaaaagaggcaacgtttggcatatctgaagcttccatggatctatggtttgctcaggcatctctacagtggcagcgtgggcaaagcttgaccctggagaatcgccgtgcacgcattgtgaggtggcttcagtaccgaggcttcaactgggctgtgaccaattccatcatcaggaggctggaggctcaacaccctccctgactcatctgctttgcaagttagtgcagtgtattactcttgtttctgattaacatgctcagtcaacagcgggacaagaacacaagacctgttggctattgctttgacatcatatttcagatatccggtttgtgaaatgggaatgtgaactctgactagatgaatagtgatgaacgcccc

SEQ ID NO: 6809 - DNA, 923 bp, Sorghum bicolor
  Clone ID: SORBI-28MAY03-CLUS55698_1
ttcggcacgagggaacaatccatccagcgagctagaaaaaggatacgaaaccaatccaatccaggccggagcgcgagcgaactccggaaagctctccacgcgggaggcaagtactgacggaagcgaagcccaaggaggagggagggaggggtcgccggcggcggtggcggtgggacgcgccgatgcgcaagtttcaggactccgtcaaggccctccaggccgacatcgatcacgccaatgagctggcgtcggaattcctgagggactacgacggctcggtcatccagatgcggatggcctacagcgccgtcgcgcatttcctcgtgcagtggaccgactgcaagctggccggcgcgctcggcctcctcaaggttatgctatacaagcaagccgtgaagaattgtgccgctggcacgagggaggccagcatcagggagttctacggcatcattttcccgtcgctgctgctgctgccgagcggcatcaccgagctggacgacaggaaacagaggaaactctgcctgaagaaattcaggagcagggatgagcagctctcggaggtggacacggagagggagctcgagtgcgggatctgcctcgaggttagccgcaagatcgtgctgcccgactgtgcccacacgctctgcatgcgctgctttgaggactggaacgagaaatcaaagtcctgccccttctgtcgcgcctgccttgaggaggtgaagccaggcagcctgtggatgtacactgacgacagcgacgttgtggatatggatactttgactagggagaacattaggcggctgtttatgtacataaataagttgccacttgtagtcctacatgtagttgaccttgacatttacgagtaccgcatcaagtaaactacaactgccccgtgttgataaaaaaaaaaaaaaaaaaaa

SEQ ID NO: 6810 - DNA, 886 bp, Sorghum bicolor
  Clone ID: SORBI-28MAY03-CLUS56874_1
gccactggttacgctcccatggctccaagcagcatgttgctctccttcgcctcccattccttgtgatctcccatcaccacctattctgaatcaccaccttcaccagttgtgatgcacccatgcctgtggctccgtgctcgacgcgcccctcccgcggccccccgccctggcgggcgcgcgcccgcgccgccccgccctccacgcccgcggcggcgcccccggcggcggcagcggaccggcaaggcggagagctctgctcccccgtggtatgcggcggcgtgaacatctccttcccgttcgggatcatcgccgaccgcgcaacggaggccaactgtggggtgctcgggttccaggtccgctgcaccaacaacaccccctacctcgggtcctacaaaggcgactaccggttcaagatcctcgacatcttctacggcgacacctccttgctcatcgccgacgtccacaagctcgaagatttcaacgcctctgcttcttcttctttcaaacaaccctgctactccccgaagaacaactgctccgccaagctcggctacccgttctcgatcagccctgctaaccagaacataatcttctacaactgcgaggagacgccgacgcaggcggtgcggcagagccgcgggctcgtggacacggcgtgcgggaacaagacgctggttggcgtcgcccaacgtcccgacgtgcctggcagctacttcatggagggttgcaacgctaccgtcgtgccgatgcttgtgaggtccggcgaagcgaacccagcaaactacaaggagctcatcagtgacggattcctcttgacatggcaagagcagccgttgccgccaccgtcgccgccgtcagcagccggtgtcaacgggaatggcaggaa

SEQ ID NO: 6811 - DNA, 662 bp, Sorghum bicolor
  Clone ID: SORBI-28MAY03-CLUS56986_1
accgcccaccgccaaaaaaaaaaaaccactcacagagagaacgcgcgagggaggacaagagcgagagaggggcagaggcagccgcaaggcaggccagcagctatcccggagcgtcgcctctcgtcgcctcagacccagggctgcttcccccgccggtgctcgctcgctcgacggcggcggagcggcggggccggtaggccggtcgcctgcgcccgcccgtccttcggagttcggaagcgtctccgcatgggaggacaacgcttgtgacagtgtgatccactgatcccatagctgccctattttccgtctgcaagcagatgcaataatggacaaccttgggcgagaaaatggcaggcaaaggcctgaccaatataaagcggttcatactcagtggatgatgcctcaaaggcagctaaaagaccatcatagtatgaatctcctggcactgatgaatgagaaggacagtgccatccgagagagagaccatgctcttgctgagaagaaagctgctatagctgagcgagatatggcattcgcccagcgggatcccgcccgcgctgagcggtttgctgcgattgtggggaggggcaatgcccttgctgcacttgaactcgcccgcacaaatgggtttaatatgaataatgggaatggattccaccaag

SEQ ID NO: 6812 - DNA, 1153 bp, Sorghum bicolor
  Clone ID: SORBI-28MAY03-CLUS5694_1
tactggacctcagatatattttcttcttttcccccactctcactcgtcctcatcaactcaatccccctcttctctccatctcaaccctagccgccaccgccgcggcaaccgccgttgacaagctgcatccgcgaggtagtttaaagcttaacacgaggtgggtcaggagacggcggcagcgcctccacgcgctcgtgcaggagcgcccgcgcctagggtttgggtgaaggccacgacggctacgcgaccagtgtggtaaccagatgggtgccaggttctcggagtgatctacgggcctgcgccgccgaccccgacctcttcctcctcctcgccggtcccctgcctcaccgttcgcttcggtctgtcgggcttcgagtcccctggccgtggccgggtccgctccgtggtcgctgcggctgcgctctccttcgtcccgctgcgctgccttgcggccctgcccagtgcccgccccgcccccgcctgggctggtccggcccctggttcccgcgcggcccctggtccccctgcgccctggcccgccgtgcccgtgcggcttaagtgcatctcgcttgcagctcagggtccgcatggatgcttggtgtgctgttccggttggcgttggtgtggcagccctatcttgggtgctggtcggctcccctgtgctcgcgagtaatgcctccctcctgtgtgctgcccgcggaccggtctccccccctgattcctctgcatcaaattaaagtgagcttcgggagcaactaggagctgaagctaaggctgttgtacgagttgagctcgacgatctcaagaggagaagtgaaaaagtagaggaacggctcgcgaggacacaaacggagatggaggagatgaagaagctggcagagatgaacaacaaggcaatggagcaggacaacgcgctgctcaagcgtatcttgtccatcaacaatgcttcttcgacatgagagctgcttagctgctggtagtaggactgactaggaactgtagctacttgtgcctggcatcctgctcatttagattttggaatgacttgtgttctcgtgctttgcaaatgttctatttaaaccaagtgtgtgtggtgaactaactttagcagtaataattaagttatgagtaatggatccttagttttatgcat

SEQ ID NO: 6813 - DNA, 390 bp, Sorghum bicolor
  Clone ID: LIB3476-009-P1-K1-F9
gcgcgacctcttcctcctcctcgccggtcccctgcctcaccgttcgcttcggtctgtcaggcttcaagtcctctgaccgggaccgggagtgctgcgaggacatagcggctgctctctccttcgtcctgctgcgctgccaagcgtgccttcccagatctcgcccagcggagacaaggtcatgtctgtcatcagtatcacacgtggatgttgaactcccagtggccagtcccatagtggcagtagggataaagtggatcttggttgcagatcacggtcaatatgaaagctttgagagcagaacctgttggtgaaggtgagacagaagtatctagtgtgcacgttgagtcccaagtgctctctaaaaatagctccctcaagagtgttggcatc

SEQ ID NO: 6814 - DNA, 907 bp, Sorghum bicolor
  Clone ID: SORBI-28MAY03-CLUS5706_1
tctagatcgcgagcggcgccctttttttttttttttaatactggattaccacagttccatttttgccaggaagaaaactggttctgtcgtggaaagaatcacaaagttccataaaaactaaaatgtaaaacccagcgcaacattgccaatctttgatcgcttactgaagttcatctacgtcgacagcaatttcaactccagtgtagatacataccatgatatagtcttagattggaccatgcatgatccctatgtctttctttatcacgaaaagcctatgctgaaaccattgtcagttttggtgacatccatactaccaaactcatcaaagtctgaatccgagacaccatccctgtaattaccccattcttccattgagctgtcatcatcgtcatcctttgatgccgggacttgtaatccttctataggtgccggcaagggctcttccataaagtaccgatgattcaacaggtcagcagcactggccctctttgttgtgtcatagcaaattagctgctttatgatgctaacctcagtaggagatctgttaggaagacatgcttcaaggcctgccggtttcccaactttgttaaagaaaatcttgttgtaatctggcaagtttgaacagcctggaaatgtttcttctgttatatcacccaggacattgatgattctactaatctgatcaatatccgccatccctggaaacaaaggctctaatttcagaagttctgccaaaatgcatccaagcgaccagagatcaatctctagcccatagtttgttgacccatataaaagctcaggagccctgaaccacctagtaccaacacaagaagtgaaggcaccagaatcttcacctatgccttccacattgtatgagtcggaggctcggaatggatcatcttca

SEQ ID NO: 6815 - DNA, 618 bp, Sorghum bicolor
  unsure (1)..(618): unsure at all n locations
  Clone ID: SORBI-28MAY03-CLUS57035_1
gcacgaggataaaaacaggaggattagttgtgtggacaaaaggagacatacattttgtctataaaggaagcaaatatcagcaaaacgcaaagcatagtcacacttttgtaactaatgttcataaaggttctctcgtaaaacaaaatgttcgtggtgaagcagatgatgcttttcaagaaaatgatcagagcatttgtggccagaaggatgaagaacctgtcaagggaacactatacgagagggaagtcaatagactattggacactttgggccctcgatttgttgattggtggtgggacacaccattacctgtggatgctgatctcctcccagagttcattccaggctttaagactccatttaggcagtgccctcctggtgtgagaccaacactagctgatgaggagctgacatacttgcgcaagcttgcgcgccctttgccaacacattttgcccttggtagaaatacaagattgcagggtttggctgctgctatactgaagctttgggagaaaagccttatagcanaaattgcagtgaaagtaggtatccagaatacgaacaatgaacaaatggcatggaacctgaagcatcttacgggaggcactgtgatattga

SEQ ID NO: 6816 - DNA, 637 bp, Sorghum bicolor
  Clone ID: SORBI-28MAY03-CLUS56085_1
tgttagtggttacatgtttggcaagggtgtttactttgctgacatgttttcaaagagtgcaaactattgctgcgcttcagaagcatgtagatctggagtactgcttttatgtgaggttgcattgggcgatatgaatgagctactaaatgcagattacaatgctaataacctgcccaagggaaaattaagcacgaagggagttggtcaaacagcacctgacatggtcgagtctaagatcactgacgatggtgtggttgttccccttggcaaacctaaacaggaaccttccaaaaggggtggcttgcgttacaatgagtacattgtgtacaacgtagatcagataagaatgcggtatgtcctgcttgttaacttcaacttcaagagacggtagatgctgttggcctgttgcaaagagctgaaggtgttgccgagatctttcttagcagaacatctgtggaattatagcaccaaaggtttcatcttaggtgccgtcatccaaattttctgagcagatttggttgcctttgcatttagattttggtttcaggcttccagcccgttgatgactaatgctgagtgtatgtatatatgatccatcgcacatccatcttcccatgtagttaaaaaaaaaaaaaaa

SEQ ID NO: 6817 - DNA, 693 bp, Sorghum bicolor
  Clone ID: SORBI-28MAY03-CLUS56089_1
gcacagggccagtagtcatatgcttgtctcaaagattaagccatgcatgtgcaagtatgaactaattcgaactgtgaaactgcgaatggctcattaaatcagttatagtttgtttgatggtacgtgctactcggataaccgtagtaattctagagctaatacgtgcaacaaaccccgacttccgggaggggcgcatttattagataaaaggctgacgcgggctctgctcgctgatccgatgattcatgatatcttgacggaccgtgacgatgaccatgactattactaccactaccgtagcggtagtggcagccgcaggagcagcgagagacaccgcagccacgacagcgacgggagccgccgtcggcgcgggcgatccaggagccggagcaagagcccgtggagggaaggcagcgaggagcggagggcaaagattgagcagtggaaccgcgagcgggaggcagcgcaggtgtaggcaggttcccctgtgactctgccggctgcagcctgcaggttgctgcagtactgttggcattgctagtctgacaggctgctgaagctgtcatcatgtattttagttatgtattgtagttttaggccttgtttagttcgtaaaattttttgtttttggctactgtagcatttcgtttttatttgacaaacattgtccaatcatggagtaactaggcttaa

SEQ ID NO: 6818 - DNA, 685 bp, Sorghum bicolor
  Clone ID: SORBI-28MAY03-CLUS56165_1
gtcgcgctcaaggcaacgaatggcattgtcgaggaggccacagaggaagagctcatgaacgcaatgtcactcgctgaccgcactgggatgtttgcttgcccacatactggggttgcgctcgccgccctgttcaagctcagggaccagcgcatcatcgggccaaatgatcgcacggtggtcgtcagcacagctcacggcctgaagttctcgcagtcaaagatcgactaccatgatagtaagatcgaggacatggcttgcaagtactccaacccgcctgtgagcgtgaaggctgactttggcgccgtcatggatgtgctgaagaagaggctcaagggtaagctctgagcgcctgtgtttggctaacacttctccaactccaattggttactgtgtgccaattgtgttctgcatctgatttccaattggttactgtatgccaattgtgttctacatctgattcaaatgcagtggattccgcaggtgctagtttttaggtggtatcttttagacttcaaaatttatgtttggggtaggctatctgtttgagtttagcagggagtggctatctcttgcaagaccgggagtggttacctcttgtactatgatgtgttccatggagaataagtgatcgtgttgctgttggattgaataatcatcactcgctcgtctgcccttgtgcatgaac

SEQ ID NO: 6819 - DNA, 1128 bp, Sorghum bicolor
  Clone ID: SORBI-28MAY03-CLUS56174_1
cctgaaagtacaggcttcaaaggctttccaagaaacgtacctgatgttccaaagcttccagactgaacagctccctgacttcccaaacttcagtgacacaacccccgtgaatcatgtgcttggatcaggccagttgcttcgagtaaggggacgttgcactggagattacaggaggattgtacagttcaggatggagaggggtttggagaactggacggtggactgctcatgtggtgccaaggatgatgatggggaacggatgctagcatgtgacatatgtggagtctggcagcataccaggtgctcgggtataagtgattttgaggaagtccctgaaaatttcatctgcaggaagtgtgctacacgcaaaggaaaaggacgtgggggtgggggtagcaacggtgatggaacaatggaggttagtgcggctgggaggtgcaaggatgagattggatcatctgttggtggtgcaggcaagtttgggcgcatggcaacagttggatgactgtacataatgtagtgaaatgtaaatagtgagatggagagtagtaaactgcacctaaaggcttttgtggaccttgagtggttaatggatcttgtcgctgaccactgatgtgatgttaatctattctccttgcagttgcacccattgcctgatgtccatctcttgtgatgttaatcgattctccttgcagttgcacccaatgtctgatgtccatctcctgttcgaagcatatcagacttccttttcatggctgcctactaaataccataacaaaatccaagcaaatggtgccagaacagaggagctggcttcagatatatccaaagcatattatagaggacatactcctcgcctttccagcacctgagcagcgattagggctgcagccaccagggcgccgaggaccccagccaccgaccttgcggcagccgcgagctcgagctagcgccagcctcgggccctaatccgcaccgctcgccggacccgatcagcgcgattgcttcctgggatccaatgaggcgtggagagcatcgggtcccgacaggcgtgctccaactcgaacccttcacagaagatcagggtcggccagcggtgcagcccgtgaaggcctcccgctcgtcagc

SEQ ID NO: 6820 - DNA, 714 bp, Sorghum bicolor
  Clone ID: SORBI-28MAY03-CLUS56181_1
gccttcgtcgcgggcgactcggcgggcggcaacatcgcgcaccacgtcgccgcggagctcggcaagggcggcggacggcggctcgcccccgccgtccggatccgcggcgcgctcctcctcgcgccggccttcgccggcgaggcccgcacgcgcgcggagctggagtgcccgcgcgacgcgttcctcaccaccgagatgttcgacaggtacgcgcgcctcgccctgccggacggcgccgacagagacgaccccgtgctcagcccggcggggccgcgcgcgcctgcgctggaggccgtggagatggcccctgtgctggtggtggcgggaggccgcgacgtgctgagggaccggaacaagcagtacgcgcggcggatgaaggaggagtggggcaaggaggtggagtacgtggagatcgccggcgccgatcatggcttcttccaggtcgacccgtggtcggagcgcgccgacgaggtcgtccgcgtcgtgcggcggttcgtcgtcgagcacatggactcggagtaggacggttgatggtgagggcctgagaggtgacctggcctggctggctgcctggctgacggaggaccaatcatgatttgttgcctgccactgggatcatgaatgaatgaataaatgaatggttttgcttttcttctttgtgcggtggtgtcatttattttcttgattatgatggtttgattattctatgttgag

SEQ ID NO: 6821 - DNA, 605 bp, Sorghum bicolor
  Clone ID: SORBI-28MAY03-CLUS5726_1
gccggccgggtcgcggctcgcaaatctgcaaagagcccaacaagggttttagaggacaacggaccccgtcgatggcggcgacggctggcggcgcgcggcgagccctcgcggcgctgcgctccggctcccagtctactatctctgcaacgctatcccgccaggcggcggctcgctctccggagctggcggcggcgtccctgccgcgcgcctctccccggcgcctcacgatctcgagggtgccggttgcggcgctcggcggcgtgcagggttcgctgatgccgatgcacaacgccaccgcgtcggcgctgctcacctccatgctcgggcttaagcctggctcttggggctggctctccgaaggatttgctacacccctataacaggaatggtgtatccgtcacaagagcctgttttcacctttgtgctagaggattccaataacacttttacgtgccttgcggagtacacccttggacttttgcttttggaatctgtactaaaatttgcgaccaaatacttatggtctcatgtgccaattttcttaattctatgatatcgatccctcgaattattcgtattaaaaaaaaaaaaaaaaaaggccccta

SEQ ID NO: 6822 - DNA, 551 bp, Sorghum bicolor
  Clone ID: SORBI-28MAY03-CLUS57276_1
gcacgaggcgcacgaggctctaaggtaaatctgcgaggaaaccaatcccaaagagcatggcactctggagtgctgtgggtcaggtggcaagcatcgcgcagcttgctggggtcgatgcctatgggctcatctccatgatcgtggaggccgcaaagatggtcaagaggaaccgggagacctgccagctgctggcacgccgtgcaaggatgattggggaccttctacagcagctcgaaaggacacaactgatgcaccacatggagacgaggaacccagtggagcatctggaggagacgcttcggcatgcgtatgttctcatcacatcctgtcgtgacagtagctacctacacaacttctgtatgggagggaagcaggctgatcagcttcgtgaggtgcagaatgagatcaccttctacctccaacttttcccccttgtcagctttgttgacaacacccgtacctgggagcggcttctgagtagagcttgtcctttgtgcacaagggaaatcacagatgagttacatgcagcacatcatgtggaacatgaagat

SEQ ID NO: 6823 - DNA, 881 bp, Sorghum bicolor
  Clone ID: SORBI-28MAY03-CLUS57284_1
gcacgatgattctctggaaacatttttaagatctagaaggaacaagagaaggggcctttatggtcatgttgctggtcttggcgattctggttccatactctacaaaacagggcctattattggtcctggagggcatatcaatggcaggagcccatacaactcccaaattcgagatatgaaccctgcagacaaatctgcatcaaataaaaagccaaggctactttatacatcagcagaactagctgctatggaggtgagggcaatggagtggctcgggcggttgcttaggagatctggtgaagcactctttctgcttcaacttatttgccagcataatgttgcccgtttggctcagacgctgggcaatgatttacgcaagagattagttcagttaacatttcatcaattggtatgttcggaggatggtgatcagcttgcaatgcgtcttatttctgcactcatggagtactatattggcccagagggcagaggaactgttgaagaaatcagtacgaagttgagggagggttgccctagttacttcaacgagtcagactacaaatattacttggcagtggagtgccttgagagagcatctatgactaataaccccgatgagagagatattcttgctagagatgctttcaacctcttgactaaaattccagactctgctgatttgagtgccatatgcaagagattcgagaacctaagattttacgaggctgtagtccggttgcctctgcagaaagctcaagcacttgactccaatgctgatgttatcaatggtcaaattgatccaaggcatcatgataccataatgttgcagcgtcaacaatgctatgagattgttatgaatgctctgcggactctcaagggtg

SEQ ID NO: 6824 - DNA, 625 bp, Sorghum bicolor
  Clone ID: SORBI-28MAY03-CLUS57312_1
gcacgaggattaagtgctacgtacagggcatacaccaccgatgatgagagaatgagacacaagccagaagagttggacattgttgaatggcactatctggtgatgtattttggtagcgaagaatttcaggtttgatgacatttattttattcttgccaattgtacctgctaaaataaaggatatgttttgaccaattcactatttttaaaaataactccgtgtgtagaggattagcaacaagaattctcgtaatcggcacaatagaaagataaaccatgtgaccggatcaaagtctttttctcagttaagctatgagaaggtaataacttcaaaagcacatgtacatgcttccttacatgatgaaatgtcactaatttgttacattctttccacactagagggatccactaactggtgatgagccaaatgatttggacctttttatgatgacacacactaagaatggggacgggacaagccaagaatctagggatgtctatgataatgcaagcaacaaactttcagagagggaaacaaatggagatataattatcatctcagacgtggagcaaaaccatattttccaggtagcctacaaggaaacaacaaactgcaaatcaacta

SEQ ID NO: 6825 - DNA, 520 bp, Sorghum bicolor
  Clone ID: SORBI-28MAY03-CLUS57285_1
gcacgaggcctcccttcgcgacctcttcctgacgtttccccgattcctccgcgctaagccgagcaacagcgatggcgacggagtgcgctgccgccgcggccgatctggccaccggccgtccccgcaagcgggcgaggtttggctgggacgtggcgccagctgccgaggctcagataggaacattttgtgggcaagaagttggtgatgtggccagcctgctattatcagcaaatccttccgaccatacttgttcgtctctgctcccgaagggtgtggctcgaaatgcttcccctccctggagagaagacgaccaaggtggccgtggcgtttttgctggtgcgctctgtttggcctctcgctgctgcagctacggtagagtgggtggtcctgctgttgctcgcgtgctgggatgctgcggccgagcacgctgtgcgatggcggctctggtttgtcttccctcgccatagttgtactgtctgccagcagcgtggcccatgcttgtccggctgtctgcagaaaa

SEQ ID NO: 6826 - DNA, 722 bp, Sorghum bicolor
  Clone ID: SORBI-28MAY03-CLUS84486_1
aggcaatgtagatccaagggtcaattttcttctcgatcagaagactgatactgaaaaatatgccccagtagttaacattgacaaggcatttgagtcccctaacactcatgccgagtgcttcacatatttgcggcaatatgcgcagaattcttctgcgaaggctgcttgtatggtggcacctaagagcatcatttcctacccacaggtctggaaagggcaaggatccagaaagtggaagcttgaccagagtgacgggttctttgtacaatttgaatcaccagctctgaggaagatatggtttgtgcctagcacaaaagagaagggccgaacaatgtgcaggagccctgaggccttggacatcggcatccatgaagtcctcccccgtatgttcaaggaagcagctgcttaacttaagcgaggggcaaatgaacaattgtcgatggatggacggatggatggattcctgatcctgctcagccttggttttcgtctgtcgtctgaaaaatagccggctgttttctcaggctgaaagagagagagagagagagcagcttgcctgcctgtattgtgaaagttgtaaacagtggaatgggatctgtgtaagggcttcctctgcgccgagccgagggactcttgaaattttgctgctcatcagttgttttgctctgttatgcagtgagcgtgtggtaaaaaaaaaaaaagaccaaaaaaaaaaaaaaaaa

SEQ ID NO: 6827 - DNA, 681 bp, Sorghum bicolor
  Clone ID: SORBI-28MAY03-CLUS56316_1
agaacatgggtactctatgagcaaggacgtttagaagaaatcgtagatatcgacatcggcgatgacctggatgttgaggaggcatgccggttcttgaagattggcctgctatgcacacaagatgcaatggcccgtcgtcccaacatgaccaatgtctttcggatgctctcaggggagaagagaatcaacatagacaagatcaccaggcctgccatgatcactgattttgcagatctcaagatcagcaacaaggagcaaaggtcaggcgagacacgctctcccacgacggctcccacgacgaaatcattcaccagcacagaaccgttctcatcgtcagagacgcccacacagtcatccatgtgaaattgtgggcgtaagaagcagatattttttttttgtttcagtttgtatagtgtgtgaatgtggtaggtgggctaggttacatgaattttttgatgagtttgttgtttgtttcgttatgaggaaagatctcataggtctcttattgcatctttgattctgtaaatatttcaaaatgaagatgatcgagataagctttgcacgattctcattctcgaactacttggagtcttggactgctacaacttcagtgattatttgtatcagttcaccttgtatctcttggatttttgtcccagagaatacgaacgatagttgctt

SEQ ID NO: 6828 - DNA, 593 bp, Sorghum bicolor
  Clone ID: SORBI-28MAY03-CLUS56439_1
ttcgaccatggcctcaacgccaggcatctggtggagaagaagttgggcgtctaggtggcacgggatgaggacgatggctcgttcacggctgaagacgttgcagctgctctgaggagggtcatggtgggggacgaagcccaggagctcggggcaaaggcccaggagctcgctcaagtagtcggaaatgacgaagtgaatgatcagtgcgtgcgagatttcctccgctgcctgtcggaatacggcaccggcagcggcaggcagcaacaaggaatcaaggatgatagttccgttcaaaccgctacacacgacgcgacggtcattgtttccgaagccactctccgtgcggagagttcaacatccctgtaatgtaaggctgcaagattgcccagcgcctacacacacaccgccgttattgtgtctgaagctactctccatccggagaattctgtaatatgggagccgtttgtactcctgtcagctagatgctgctaataaaatcgtttgttgtcaaaaaaaaaaaaacaaccccttagttggccaatgcaactaaaactagttaatgctataagaattaaattcaaacaacttctcac

SEQ ID NO: 6829 - DNA, 743 bp, Sorghum bicolor
  Clone ID: SORBI-28MAY03-CLUS56618_1
aacctccaattaatccttgaatgctccctactccctagtccttgctgaaagaggcgcccttgtcaaacatctcttcgttgtcatggagaagagtccagagcttgcacaaatgatcttgccaagatcagtagcgaagcttctgcaccatcgtctcagttccgagtttgcaggcctgcaggataagagcaccctgctgcaaccaaggcaaaacgagaccatcaagtacaaggtgtttgctggtacatggaatggcgcgggcgttgcgccgccagatgatctggacctcaaggattggttggacaccacggcaggctcctgcgacatctatgttcttgggttccaagaaatcgtgccactgaatgcgaggaacgtgcttggtcctaagaagagatcggcggccatgaagtgggactccctcatagctgacgcactgaacaacacgagaagacgaagacaacaaggaggaagaggaggagccatgtcaggatgcagagaagcggcgcactcagaacggcgccaagaccaggacgtgttcaggcgcgtcacgagcaagcagatggtcggcatcttcgtctcggtctgggcgaggagcgccctccgccagcacgtccgccgccaccttgccgtctcctgcgtcggtgccggcgtcctcggcctgctgggcaacaagggggcggtgaccgtccggttcgtgctgcaaggaaccagcttctgcttcgtctgctgccatctggcctccggca

SEQ ID NO: 6830 - DNA, 1085 bp, Sorghum bicolor
  Clone ID: SORBI-28MAY03-CLUS56638_1
cgggtgcctggctgggacggcccgggacccaggcgggcgggccgccacgccccgcggcggggacgggggggccgccgcgctcctcggcgcccagggggggcagggagcgcccccgcccccgtgctgcgcgcaggcctcagggtgcgggcgccggggcgggcggcgcggcccccgcgccccgccctcggccgcctccgccggcgcccctccccgctcgccggcgcccaggcagcgcgcgtccgtgccccggcttctttgctcgcgcaagcctccggggtggggctcctccggacgcctggtgcggcgcccggcctccgcttcgctgggttgggagctgtcccagctccttctcgcgcttactgccttcctgcctccgtgcggcctcttcgatgctggtgcctggtcgctgggtgtggctttcccgaacacctggggccgcgtcctggctccgcgtcgctggaaggcgaaccttcccagcgccttcgcgctcctagctctgtacgacctccctagcgccagttcggtgcccgggtcctttctaaaggtgggggatgcctgctcggatgcgcgcccgtctcgtcgccgcgccgcctagcaccagggcttctcaaggctaaagcattgctagcactgaaagactacccgtccggttcctcagcgtccggattcgttctaagcgtagttggggtcaacttggctgctctgctattacgtggtcgcgcctactattaccttgctgatcatgatgtggcctccaggcactaccagaaagggctccgtcttgatccagagcattcagaattgaagaaagcatattttgggttaaaaaatcttttgaagaagaccaagagtgctgaagataatgctgccaagggtaaactacgtgtgtctgttgaggactacaagacagctctagcaatggatccagaccatactgcttataatgtgcatctttatcttgggttgtgtaaaactctggtcagacttgggagaagtaaggaggcaatcagcagctgtacagaagcactgagcatagacagtgaacttgttgacgcacttacacagagaggtgaagctaaacttct

SEQ ID NO: 6831 - DNA, 662 bp, Sorghum bicolor
  Clone ID: SORBI-28MAY03-CLUS56734_1
gcacgaggaggaggtgcccttcaacgtcgtctggctctccgtgtccgtggcgttcgtcatggccctcacggtgagcatgcacatgcgctgatcaacttcttctcaagtaaaatcgctggggagccaggtggcgttccaggcaatggtgtccatcgcgacgctgggcctgtacatcgcctacgcgctgcccatcttgttccgcgtgacgacggcgaggaggtcgttcgtggcagggccgttccacctcgggagattcggcgtcgccgtcggctcggtggccgtgctctgggtggcgctagtcaccgtgctcttctgcctgccggtggcgtaccccgtcaccaaggagaccttgaactacacgccggtggccgtcggcggcgtgctggtgctcagcctcgccgcgtgggtgctccacgcccggttctggttccgagggcctatcaccaacgttggttaatattgacgttgtttgtgtaggcttggatagtatgtactttcaatgcatgcatgttattatatcatgtccctctgttctaagtatgaatatgaatatactatacttagtttttttgtcatttggtgattccgggctacgatctagggcttgtttagttcaattttttttaaatcgacactgtagcactttcgtttgtattgacaaa

SEQ ID NO: 6832 - DNA, 1007 bp, Sorghum bicolor
  Clone ID: SORBI-28MAY03-CLUS5683_1
gcacgagggttgatactgaaggtgaagatttccacctcccagagggtagactgagagaacttggtttcaccttttccttcccggtgaaccaaacatcaatatcatcaggaacactcatcaagtggacaaagggcttttccatcaacggcacggttggtgaagatgttgtttctgagttgagcagagccatggagagacaggggctagatatgaaagttacggcgttggtcaatgatacagttggcacattggctggtgggagatatatggataacgatgtagttgcagccgtaatattgggtactggtacaaatgcagcatatgtggagcatgcaaatgcaattcctaaatggactgggttactgcctaaatctggaaacatggtaattaatacagaatgggggagcttcaaatccgacaagcttcctctttcagaatacgacaaagccatggactttgaaagtttgaaccctggagagcagatatacgaaaaaatgatttctggcatgtatctgggagagattgtgcgaagaattttactgaagttggcacatgacgcttctctatttggggatgttgttccatctaagctggagcagccatttatattgaggacaccagatatgtcagccatgcatcatgactcctcgcatgacctcaaaactcttggagctaaactgaaggatatagttggggtcgcagatacttccctggaagtaagatacattactcgccacatctgtgaccttgttgcagagcggggagcacgcttggcagctgcaggtatatatagcatcctgaagaagataggccgggacaaagtaccaagtagtggcggtaaaatgccaaggactgtagttgccttggatggtgggctctatgaacattacaagaagttcagcagttgcgtagaagcaactcttacagacttgctcggcgaagaggcctctttctccgtggttgccaagctggccaatgatggctctggcattggagctgcttttctt

SEQ ID NO: 6833 - DNA, 688 bp, Sorghum bicolor
  Clone ID: SORBI-28MAY03-CLUS57628_1
caatacaatacaatgggtccaagatttactgttgttgggaatccagctgaaagctttgatccacaaaagatgataccgcaagcagcatatccatctgatcagaggcttccacttccaagaactggctttcctaattctactacacccagaagagggactgttccaaattatcaaggcatatcatcctacgttggagtgccgatgacttatcctacaagtccagtgtttcagggacaaacgttgcctggagtattgcctcctggtaggagaaatgactctgttggatttcagtccccctcaagaaatatcactgatagtcctgggattcaagggcagcgagaaagacagaagtttgatgaatcaaagacctgctctttcttagaagagttaaagtccaacagagcacgcagggttgagctatctgacatcacaggtcgtatagttgaatacagtgctgaccaacatggtagccgattcatccagcagaagttggaaaactgcactgccgaagagaaggcagctgtgtttgcggaggttcttcctcatgcttcatcattaatgactgacgttttcgggaattacgtgatccaaaagttttttgaacatggaactcgtgagcaaaggagcgatcttgccaccaaacttgttggtcatgttttgcctttgagtcttcagatgtatggctgcc

SEQ ID NO: 6834 - DNA, 642 bp, Sorghum bicolor
  Clone ID: SORBI-28MAY03-CLUS57678_1
cctactgagatccaccaccggcaccgatgccggccctctccacccaccaccttcagctgcgccgtctcggccgacgacgcggcgccgcattcgccctcgcgctgctcgccgccgccctcgtgctcacgctctcccgctacgccacgggccctgcagcctccccgcccgcgtccccgtcctacgggcatcgcctcccggccctcgtcgacatcaccctcgtctacggcgccaccgacaagggcgcagtgtgtttggatggtacgccgcctgcctaccacttccttccaggattcggggacggatcccacaactggctcctccacctggagggcggaagctggtgccgcagtttcgaatcatgtgcccgccgtaagaaaacaaatctcggttcgtctgcccacatggatactcgtgctgaattcgtcggcatcctcagtgatgatcaatctcagaatccagacttttacaactggaacaaagtgaaaataagatactgtgatggtgcatcattctctggacatgtccaagatgaagtcaagaatggcacaggtttcttcttcagaggccagcgtatctgggaagcagtcatggccgaacttctatcaaaggggctagccagagcgaaacaggcttttctgactg

SEQ ID NO: 6835 - DNA, 638 bp, Sorghum bicolor
  Clone ID: SORBI-28MAY03-CLUS57706_1
gcacgaggagcatttaagaatacgttttattttgatttcagcccaacctatattggatgcggtcttatttgtccacatattgttaattgttctacacttcttggtgccatcatatcgtggggttttctttggccatatatatccacaaaagctggggactggtatccagctaaccttggaagcaatgacttcaaaggactctatggatacaaggtttttatatctgtatctgtgatacttggcgccggcctttataacctcatcaagatcatttatgctactatcaaggaaatattgaatgcgagggctaagcaaggaagactgccactagtacaagttcaagatggcgatgaaggctcaaaattatcagctgaggaaaaacatctgaatgagacattcataagggacagtattcctccctggctggcaggatctggttatgttggccttgcagcaatatcgactgcaactgtcccaatgatcttcccacagatcaagtggtaccttgtcctctcagcatatgttgttgctccccttctcgctttctgcaactcatatggcactggcctgacagactggaaccttgcatccacatatggaaagattggcctcttcatttttgcctcatgggttggtca

SEQ ID NO: 6836 - DNA, 637 bp, Sorghum bicolor
  Clone ID: SORBI-28MAY03-CLUS57700_1
ccctcgcctgcctctgcctcagtgagggatggcggcgccggaatcggaatgcggcgggactgacggctaccgcgacctccgcggcgtgcgcgtcgagctggaccctggaacggcccgggtcggcgggggaggaggcttcgccgtctccttctggctctacctgtccagctccgccaggccgtcctcggtgatcctccgccagatcgctgcgggagatgacaataagttgccgtttcttgctttaggtgaaggaaacaaactgctgctcttcccgttgatgaggctgcacagagaagctcctggtcctgctagttcctacccatggactcacacaaccaaactatcatctacgagtcaatgccctcttgagaaatggttccacattgggtgcgaggttactgaaaatgttatgcgtcttcaccttgatggttccctaactgctgaggcctccgtttgttcactatttgatgggccagaaagtcaggatgatgcaaaccaaattagcttagttggaagtgatggcaagcttgaaggctatatctataatattgaggtttcatctgtactaggaaatataaaggaacaatacacaaagaacccaccttttaagttgtctattgactactcatgctccgat

SEQ ID NO: 6837 - DNA, 678 bp, Sorghum bicolor
  Clone ID: SORBI-28MAY03-CLUS57737_1
agcgccccccccttcccttcaacaaaccttgagttgagagagaagagaggagacaacaagagacacagaggtaaccggctcacgcttgtttcggtggccggccaatcatggccaccgtggggcagtccggggccctgaggagggtcaccgtgcactacgccaactcacccacccgcagcacggtggcagaggtgagccttgacgacttcgacgacgagctgctccagtttgtcctcgccgatcttcttcctggccaggaaggtttacaccaatcgatcttggaaggagcatacagcaaccagaaccatatgagaggtgcagggccccatgccccgtatgattattcacaggcacaggaataccatggagagagcagcactgctgcagcagcaactgctaccaggaattcaggcacggagtcaacagatcgcctcagacttcgagtacgccaagcagctgcagcaggagatggaggacctcagcgtcgaagacgacgatggcgacgatatcagctgcgtgccgtctccatctgactccgacgatgaccatgaccatcacgacgaagaggaagaggctgacaggcaggatggcaatggtgatgatgatgatgatgttgatccagacaacatgacttatgagcaaagacaggcacttgtagaatctgtggggactgaggac

SEQ ID NO: 6838 - DNA, 595 bp, Sorghum bicolor
  Clone ID: SORBI-28MAY03-CLUS57726_1
gcacgaggccgccaccctcctcactagcacgaggaatttccaaatctctcgcccggctcgaggatggcggcgcaggtggtggcagcggcgggcaccgcggtggccaggccgctgggcggcggatctgggctcgacgcggcgccccgtggcggcggcgtggcgaggatgccaagggagaggtggggcggcgctgtggccgcgaggggacgccgcgaccgcgagtcgcaggtggtgtccgtcataagctgcgccccgcgctcccaggccgaggtgctgccggtgtcgcccgacgacgacgcggccgtaaaggaagaagcaaacttccagcaccttaaggctatccagcagcttgcaactgcagcaaatggtgtgtggtctaaaccaaatgtaaggcgcaagacaaagatcgtgtgtacaattggtccttcaactaacacaagggagatgatatggaaacttgccgaggctggcatgaatgtggctcggcttaatatgtcacatggagaccatgcgtcacaccagagagttattgatctggtgaaggagtataatgcatcacatgctgacaatgtgattgctatcatgcttgacacaa

SEQ ID NO: 6839 - DNA, 604 bp, Sorghum bicolor
  Clone ID: SORBI-28MAY03-CLUS57151_1
gcacgaggctcaacaagtgtgtcacgccaatgggaaaacgcctcttgagggcatggttcctacgtcctataattgatattgatgtcataaataatcgcctcaacacaataacattctttctttgctgtgaagaagtaatgtctgcattgcgtgagactttaaagtctgtcagagatgttccccacatgctccagaaattcaactctccaagttccttctgtacaagcagtgactggaccacatttcttaagtgcatttgctctctgctacatataaacaagatttttgaagtaggaatatcagagcatctggcgattaagttgcaacatatgaacattgatttgattggaaaggcaaattcttccattacagcagagttggattacgtgtcagacctggtagttggtgtgattgatgttcaacggggtaaggagaaaggctatgaaaccgtggtgaaagaagggttatgtgatgagctggatgagctgaggatggtgtatgaaggtttacctgactttctggagcagataatgaaaacgcttctttacctttctcatttggatgcagaatagctccactagtagtctatgtacaccaaataggg

SEQ ID NO: 6840 - DNA, 897 bp, Sorghum bicolor
  Clone ID: SORBI-28MAY03-CLUS57179_1
gcacgagggcaccttcaacacactgataaaaggatatggcattgtaggcaaacccgaagaatcacagcgtgtcttcgacatgatgggcattgaaggatcaatcaagcctaacctcacaacatacaacattcttgtgaaggcatggtgtgatcggagaaatcttgaggaggcctggggcgttgtggcccgggggcgagcaggtggtgttgagcctgatatcgtcacttacaataccatagccagtgcatatgccaataatgacgagacatggagagcagaagagctcattgtggagattcagactagagtacgcaccagcgagcgaacatggggcataattatacgtggttattgcagggagagcaggttggaggaagcattacgatgcgtccagcaaatgaaggatgcaggaattgttcctaacgtcgtaatcttcaacacactgctgaagggcttccttgatgtaaatgacatggctgcagtcaataatatcctgggtctgatggagcagtttggcatcaagcctgacattgtcacctacagtcaccagttgaacacattcagctcgttaggccacatggctaaatgcatgaaggtgtttgataaaatgatcgaggcaggaatcgagccagatcctcaggtatacagcattcttgccaaaggatttgtccgtgctaagcagcccgagaaagcagaagatcttctgttgcaaatgagccatcttggtgtttgcccaaatgttgtcaccttcaccactgtcattagcggttggtgcagcgtggccgacatggagagtgccatgagagtctatgagaagatgtgcaagtcaggcgtctatcccaatctcaggacatttgaaactctgatctggggctacagtgaacagaagcagccttg

SEQ ID NO: 6841 - DNA, 490 bp, Sorghum bicolor
  unsure (1)..(490): unsure at all n locations
  Clone ID: SORBI-28MAY03-CLUS57253_1
gcacgaggcacatctgtggaaatgatgccttttggcctattgcgttcaaacatggaactaactagctagggtggttctcatctttgacaaagacttcttgacaaaagtttcccttgcagagagccagagaccattcaagacgtatctacacacacgatagctgtccaccattcacgtccctgcaattcaatcaaagggaagggatactgcagatgcttgaaccctaatggcggagattgtcggttctgcggttgttcaggagtcagttagcaaaatcctgtctggtctgcttcaaaaatatgaggagaaacagaacccaattgcgttcagaaaccttgagaggctagagatggcacacatcaggctggaggctgttcttcagacatcagataagtgggacatcactgatacatccttgttgcgttggcgtaggaagctcaagtctgctgctcaagagtgtgatgatacgctgcacagatgcangcagaga

SEQ ID NO: 6842 - DNA, 642 bp, Sorghum bicolor
  Clone ID: SORBI-28MAY03-CLUS57230_1
gcacgagggctagttcgacctcagcaggttctgatttcctctgctttcgcaaaactgatgaacaggaacattctgactcctatatttattgagtggcacgaggtaccgctagttcgacctcagcaggacagtcgagttctacacgttgctttgatcaatcccaatggcagcagagttggtcggttctgtagtggcccaggaggctgttaaccaaatcttatcaagaatcaaggagggttatcaggacaagtcagatgcaaaggagcacatagagaggatggagatggcacacatcaagctggaggccgcccttgagacctccaacaagtggaacgtcaccagcgcgccactgctgcgttggcggagcaagctcaagcgcgcctcacaggactgcgacaacactctgcgcaggtgtaggcagcgcttgcaagaagaggaagaagtacagcaagcggtaaggagctcctcctttccgaagaggatggctcatactgccatgtcatttgtttcgtcaatctttagtggtggtgatgatgatctactgaaaggatccactgtcgcccggcgattcgaacggtttgcagaaggtgcgagcgaattcttgaggtacgtagagcttggtggcacaccatgcagatacat

SEQ ID NO: 6843 - DNA, 619 bp, Sorghum bicolor
  Clone ID: SORBI-28MAY03-CLUS57249_1
gcacgaggcttctgtgcatgacgaataccagctagtcgatctgtgttccgtgtttgacattattattgctgcccaagattgggcggcgaaagtaattaatcaaggggacggaataagcttaagcagttgcgatcgatcggcggccatggccggaggcggcgacgatgcagaggagataacgctggagcacacgcccacgtggatcgtcgcctccgtatgttccatcatcgtcgtcatctccctgctcttcgagcgactgctccacctcctcggcaagaggctaacaaaagggcgccggaagccactgtacgaagccctcctcaaggtcaaagaagagctgatgctgctggggttcatctccctgctgctcaccgtgttccagggcaccacgcagaagatatgcgtccaggagagcgtgatgcgccacctcctgccctgctcgctccccgccgacgacaaggtcaccgcgcacttcatgatcgccggcggcggcacgaggaggctcctcgccggaggaggcgcctccagtgactactgcctcaagggcaaagttccaattctttcggtagaagctattcatcagttacacatatttatcttcgtcttggcagtcacgcat

SEQ ID NO: 6844 - DNA, 769 bp, Sorghum bicolor
  unsure (1)..(769): unsure at all n locations
  Clone ID: SORBI-28MAY03-CLUS5798_1
gccggccgggtccganagaaagaggtcagtctctttctgtgcccgtcgatcccgagatctagagcgagcgagcgagcgagggagatgggcgacgacgctgcggcggctgggtcgtcggtgctcggccgcgcggtggaggaggtgcgctcggctctcaacgaacacgccgacgtggttgccgacctcttcggtcgcgtctcctccgaactgcgcaccggcttcgcccccgccgtcgactctttcatcggcttcttccacgccgtcgactggaaggagccttggctaatcagcatactaactttccatgccattctgctactggttaccatcatctcgaggaggaatgtcaatttccagctcatcttgtcagctctaacattctctggtgtattccttgctgagagattaaatacattcttggggcaaaactggaagagcttctccacccaaaattattttgatccccaaggcctcttcatttcagtcatctggtctggccccctcctattgataacaatccttattttggtgaacactcttgtgacactctgcatgctaattgtaaggtggaaaagggcagagctcaggcatcgtgctcggcaggctcgtaacaagcaggactgatcttgacctgcatctatgtaatttggtggctagtaggaaagtcggctttcttgtggcaattggtctaaccgagaatcatgttcctgggacgcggtgttcatttaggtagcagaatataacaatcagagttggtcagattttgctc

SEQ ID NO: 6845 - DNA, 1012 bp, Sorghum bicolor
  Clone ID: SORBI-28MAY03-CLUS58042_1
ttctgatgtcaatgatgccacactactggaggctttctccagcaggtactcctctgtcaaaggtgccaaagttgtcattgatgctaacactggtagatcgaaaggttatggcttcgtgagatttggagatgacagtgagaagacacatgccatgactgagatgaatggtgtgtattgctcttctaggcccatgagaattggcccagcaactccaagaaaatcatcaggtacttctggatcaaatggttcatctgctcgatcagacggaggagatttgacaaacacaacagtatttgtgggtgggctcgacccaaatgttagtgaagaggaccttaggcaaaccttctcccagtatggagaaatttcttcggtaaagattccagttgggaaacaatgtggcttcgtgcagtttgctcagagaaagaacgcggaggacgcattgcaaggattaaatggcagtactattggcaaacagaccgtgcgtctttcatggggtcgcaacccagcaaacaagcagtttagaggcgacaacggcaaccagtggaacaacgggggaatgtactacgcggcgtccccgttctacaacggctacggttaccctgcggcgccgttccctgatccaggcatgtacgctgctccagcctacggtgcctacccgttctatggcaaccagcagcaagtgagctgacctggactacgaccgcgacgcctcgctcgaagctggagcctggaggcattagacgcttaggtgtagtagctcttggtagaagaagatgaagaaggtagacgacgacggtttcttaggtgagctagatacagtgactagttctcgtatagtgcgttttgttacacgtgctagggtctagcgccgccgagagtccgagtgtccgacacgcctattgactggccacggtatgtcgaattcaacgacagaaagaatttttgatgacctggagctgcatatgctaccttgaagcagaacaataagctaatggaatcctttgcctctgct

SEQ ID NO: 6846 - DNA, 714 bp, Sorghum bicolor
  unsure (1)..(714): unsure at all n locations
  Clone ID: SORBI-28MAY03-CLUS58082_1
gcacgaggcggcgactctctcatctgctctgcttctccactccgctccgccggcagcgcgggccatggcgacgccagcgccggcgccctccctccgcctcctcctgctgctaccgctgctcaccgtcgccggcgccgcggtgtctcacccagcgcacgagttctgcgcagtcgggggtgacgccgccggctgcggcggcggaggggacggcacgaggatcctgatcaagggcgggacggtggtgaacgcgcaccgcgcggaggaggccgacgtatacatccaggacggcgtcgtcgtcgccgtccgctcaaacatcccggttggtgctgataatgtccgagtaatcgacgcaacaggaaaatatgtcatgccaggtggaattgaccctcacacgcacctggagatggagttcatgggcaccgtgaccatagatgacttcttcagcggccatgctgcggcgctggctggtgggacgacgatgcatattgactttgtcattcctgtgaacggcaacttgactgcaggcttggagtcctacaagcacaaggcagcaaaagctgccatggattatggctttcacatggccattacaaagtggaatgatgaggttgcaagggaaatggaagtgatggttaaggaacatggaataaattctttncagtttttcatggcatataaaggctcgttgatggtcaccgatgacctcctcctgca

SEQ ID NO: 6847 - DNA, 646 bp, Sorghum bicolor
  Clone ID: SORBI-28MAY03-CLUS58159_1
atttttttagcgctcggccaacctcgtccggagcggcctcacctcgccagttccctttcctagcagcgccgccgccgccgcaatccccacgggccccaaaaccctacggccacctgaccactcccaacgaaaccccagaccacgagatggcccccggtggcgagggcaagccaaacacgggcggcggcggcgccaagggtggtgggaggaagcgcaagttccttccccacggcaagccggtgcggaagggggcctacccgctgcgccccggcgtgcagggcttcttcatcacctgcgacggcggccgcgagcgccaggccacccgcgaggcgctctccctccttgactccttctacgaagacttagtggatgggaaaggatcggatgacaagcctaaaaacattccagacaagccactgaacaaaaagataaagtttgaggactctgattcctcagatgatgaggatgaagaccactctggcgaggaagctgacaatgggaatgggaatgatgtggagaaagatgaaaccgctccatctgagaagcaacaggaggtacttgatacctctgataccattagcaaggacaataccactccatctgagaagcaacaggaggtacttgagacctctgataccacgagcaa

SEQ ID NO: 6848 - DNA, 741 bp, Sorghum bicolor
  Clone ID: SORBI-28MAY03-CLUS58206_1
atttgtctgttattttactccctccatatgtattaggagtttcatcctatatgtatatattgagctttgcaattctttgatctttgtacttggtactttcctgattgtggtcctggcaagtttttgttgctagtgtacacattacttctgtgacagtgtagttggcccgaggctagacttcgccgtgggtcgacaatggtgaatgcagagggagtagcaggatgggtagaaaagagggtcatattgcctgaaggcgttatatctttcgaagctaatgtgattggttttgctgagggcgttgaggttttcttcataagcactgttgttggtgccttcacgtttgagctgaagtctggaagggtcaggaaggtaagcgaacatacgggttactgtggcatcacccccttcattagcttcttcactccagatcgtggttgcagcaaatggacaaaataattggtggccaaattatgaagggcaagtggacaaattcatgaagctgactctgtcgatgctttaaaatgctaagtgttccgttgggtagtttgatttagggaagtgtaagccaccatgcatgttatgtatggtgcacctgcatggctgcatgctttgtacttgctggttaagaattatgataatgactatatgatgggagtcctgctgcacactttgtctgctgtgatgacgtagcaaaactctaccttgtcaacctctgagtttgcagctatttccttgtggcct

SEQ ID NO: 6849 - DNA, 820 bp, Sorghum bicolor
  Clone ID: SORBI-28MAY03-CLUS57329_1
gcacgaggtaagcgcccacccgcgacggccccaaaacggcaaacctccccaccccgcccgccgccttgcccgcccgcgatgccacccacgccgccggagacggacacggagccggagttcgccgaggtcgaccccaccggccgcgacgggcggtacacggaggttcttggcaagggcgccttcaagacggtatacaaggcttttgatcaacttgaagggctagaagttgcttggaaccagatcaaagtgggagatttacttcggaacaatgatgatttggagaggctgagatcagaagtgcggttgcttaaaaccctcaagcataaaaacataataaagttctacaattcatggcttgacagaagaaacaacaatataaatttcatcacagaggtcttcacatcagggacgttgcgccagtaccggattaagcacaagaaggtagacattagagctttgaagaaatggtcaaggcaaatcttgagtggtcttgtctacttgcacagccacgatccaccagtaatccatagagacttaaaatgtgacaatatatttgtgaatggaaaccagggtgaggtaaagattggagaccttggtttagcaactatcctggataatgcacgttcagctcatagcatcattggtacaccggaattcatggcaccggagctctatgacgaggaatataatgagcttgtagacatctatgcttttgggatgtgtttactggagcttgttacatttgagtacccatattgtgaatgttcgaatgcagcacagatatacaaaaaagtatctgatggtgaaaagccaggttcac

SEQ ID NO: 6850 - DNA, 766 bp, Sorghum bicolor
  Clone ID: SORBI-28MAY03-CLUS57347_1
gcacgagggctacgcgccgatctgcttgggtctagaggatttctacacgcgccgcctctatctccgcatccaggactgctttggccggccgattgccagtgcgccagatgcttggttcgatgtggttgagcgctactcaaatgactgcaacaagacactccatcgtaccacagcaacaaccaaatgccttaacttgggttcctataactatcttggtttcgctgcggctgatgagtactgcacccctcgtgttattgagtcactgaagaaatattcggctagcacgtgcagtgttcgagttgacggaggcaacactaagctgcgcacggggctcgaagagcttgttgcaagatttgttggtaagcctgcagctattctttttggcatgggctatgtgacaaactctgctatcattcctgctctggttgggaagggaggcttgattattagcgattcactgaaccataattctatagtcaatggagctagaggttcaggggccactgttcgggtttttcaacataacaatcctgctcacttggaagaggtattgagagagcagattgcaggaggccagcctcgtacacacaggccatggaagaagatcattgtgattgttgagggaatttatagcatggagggggagctatgcaaactccctgaggttatttctgtctgcaagagatacaaggcctacacatatttagacgaagcacacagtattggagctattggaaaaacagggagaggtgtatgtgagctactg

SEQ ID NO: 6851 - DNA, 767 bp, Sorghum bicolor
  unsure (1)..(767): unsure at all n locations
  Clone ID: SORBI-28MAY03-CLUS5746_1
ctgggaccatgcagagtaccgtgaagctcgcggtgctcgctctactgctagcggcagcagctcaccacggtctgctgccgctgccgacggcgctatgctactggctcaacccagagatctacgacgccggcgggctgagccgccgcgcgttcccggagggcttcgtcttcgggacggccgcgtcggcgtaccaggtcgaggggatggccaagcacgggggccggggccccagcatctgggacgccttcatagaggtacccgggaccatccctaacaatgccaccgctgatgtgacggtcgacgagtatcatcggtacaaggaagatgtgaacataatgaagaacatgggctttgatgcgtaccggttttcaatttcttggtcgaggattttcccaaatggaactggcaaggtgaaccaggaaggagtggattactataacaggctcatagattacatgcttcagcaaggtatcacgccgtatgcaaatctctaccattatgacctcccattggcactccatgaacagtacttgggctggcttagcccaaagattgtggaggcgtttgcagactacgccgagttctgcttccagacgttcggagacagggtgaagaactggtttaccttcaacgagccgaggtgcgtcgctgctcttggctacgacaatggcttacacgcanccgggaaggtgttccgagtgcgctgccggaggcaactccacgacggagccgtacctngctgcacaccatctcatcctttctcatgc

SEQ ID NO: 6852 - DNA, 563 bp, Sorghum bicolor
  Clone ID: SORBI-28MAY03-CLUS57474_1
agaggctgtatttgaacacacactttcagaaaatgaatgaagcccggggccgagctctagtccatttggtgctatggcaagcctttttgcaccaaagctcccaagtggctttgctgcaaacctatctggtgaaaaatcacctgctacagataaaataaagcctatgaaaagggaaagacaagcagttagaccacctgtagagcataagtggtcccttcctggagttgctcaggatgccaaacccccagcaatttttcagcacgagttgattcagagtttctctatcaacatgttctgtaagatacctgttagcaaagttcagacctacaaggacctgcgtagtgtactcatgaaaaggatatttttgtctgccctacattttcgaatcaatacaagatacaagaggctcaaaccctccttttacgtcagttgagctaggaccacagtgactctggaagggaaggttgcacggtcactactcttacagtaactgctgaaccccaaaattggagaagtgcaatcaaagttgctgttcacgaggtgcgaagactgaaagaatttgg

SEQ ID NO: 6853 - DNA, 695 bp, Sorghum bicolor
  Clone ID: SORBI-28MAY03-CLUS57558_1
ccttgccagcatgttgggctctatcccagctccacctgcaatggcctcagaattcccgccatcgacagggaaatctgttgggatgctctcggctgtcagctcaagctcaattcgtgttactgctggcatcatccaacttgatggcctcactttcagcagtggctccggcacgagggcttcctgttggtcttgaggatgcttggatgacacgtcgctctccacggcgaaagacgtgtcatccaagcttcctgttggtcttgaggatgctactcggattagcactgttcccatggtgatgcgaagtggcttttaccttttctttatgtcggccatgattctcctgttgagctacaaagtagggtcgtgtatctacagcaggtgagttgaaggtgatggcgcctctggtccggtctgactctgagggctgtttattttgattttatacgtgggtcatcccctcagtgatgaggggatagtagtcgttcgacactatttgtttatttaccattctgacctgtcaaaacatatagcaataaacttttgaactggtgatggtggccatgccgggaccatgtcctcatcaggcaaagtagtgcactgtgaacttggggctctgcccttattattgtaaccaaaacttaactgcagtatgtttatgttctgtcgtgtggaagaaaagctattttttctggggt

SEQ ID NO: 6854 - DNA, 986 bp, Sorghum bicolor
  Clone ID: SORBI-28MAY03-CLUS58308_1
gcacgagggtacagactttaccaaaaggagttgaggttttggatccattggggcttggtgtcatggataataaatccctgcgattgatcactgatgcttcagtaagttctccagtttcaagggagaagtctcaaggtttagaccccagtatgcgagacaaagttatctattcgtctccaaattttgaccccaaagttttcctttcgtgggtccacaaagacacaagtgctgctgacttagaggctggtgctctcaccttgaaaactgatctcaaagggagaacacagcagaaaaaacagttagtcaaggagaactttgattgttttgtctcgtgcaaaactacaatagatgacattgagtcgaaattgagacagatagaggaagatcctgaaggtgcaggtactgctcacttgtattcagtgacacaaaaaattagtggtgtggcaaatcgtgcatttgagcctctatttgagaggcaggcccaagctgaaaagatcagatctgttcagggaatgcttcaaagattccggacactctttaacctaccaagtgcaatccgtgggaacattaggaaaggagaatatgatcttgctgtcagagagtaccaaaaagcaaagtcaattgttcttccttcccatgtggggatactaaaacgtgtacttgaagaggtcgaaaaggtgatgcaagaattcaggggcatgctttataagtcgatggaggatcctcatcttgaccttgctgagcttgagaacattgttcgtctactgttggagttggaacctgaaacagatccagtgtggcattatctaaatattcagaatagcaggattcatggattgtttgaaaagtgtactcaagatcatgaatcgagaatggaagttttgcaaaataaaattcatgaaaaagtgctctctgattcaaagtggaggcagctgcaacaagattcaaataaatctctggaagttgattctgccattggtgattct

SEQ ID NO: 6855 - DNA, 1081 bp, Sorghum bicolor
  Clone ID: SORBI-28MAY03-CLUS58374_1
taatagacacttacatcagagtatcgcggaatgataactaatctttaggctcaatcttcacagggacggttgactggggtaacatatgcctagcacttcttgtatcctgagaacatccttcatgactccatccttctaatcaactctttctagtggactggagtggtgggagctcgcgggagtgagcacatatcgtactcaacaagtataaccaggggttcatgaggctcaagtggctgacactggtttgactgcatttagcttttaatagtggagagcatgttcataatttagtagcaattgtcaaggtggcagtaataatccattaatcccatgatcaagtgtaagcataattaattcttagcataaacgataatcaaatgaacataacaacttaacaagctcatcgtcgtcgcagcaagaacccccaaggccgctcttaaccgtgagcacggctagtatactagttttaacactctgcagaggttgtacatctttacccatgagtcatgatttaccctttcgcccgaggtgatcagcctcttaacccactcccaaggaaggtcggcagggatcactatgaagcctttcaaaagttcatctaacatgttagggccgcaaggtttcctttgcgagcagatatagataccccccttccgaatggcacaatgacgcgcagcctatacacatagggacaggggctcgcactatacccgtgtcggttcagcccctccgccctttcgggtaacctctaacaagctagaaaaggtctccatactgagctaaagccagagccattatagccctcatggttgcactgttgtcccggtgatcacttacagacaagatctcatatagttatttgtcatcttttaacgttcattgcatagttattaatcatcttacaagatcatggattatatcaagcactagcacatctacaacaaatgcatatcaagtaggtagcaaggaatccaggtaacaatcatctatgattttgctaaggtcgacaaggtgaaagcatgcatatgacatatatgtgtagttataagtgaataggtaacaaggatgatcccaagtt

SEQ ID NO: 6856 - DNA, 916 bp, Sorghum bicolor
  unsure (1)..(916): unsure at all n locations
  Clone ID: SORBI-28MAY03-CLUS58378_1
gctgattgattgatcctccccgcctcactctcctgtgtcctcgcctcgcgctcgctcagtcgctcccggcgaggagggcagcagaaaccctagcggctcgggccgggcgggggttagatgctccgagaaggctcgagaaggtagggtaggttagaggtgcgccctccgcggctgggcgccgcgccgcgccgacaccttcgagaagctcaataagataggatcgggcacgtacagcaacgtgtaccgggcgagggacaccgtctccggccccagcgtcgcccttaaaaaggtccgctttgataacctcgagccagagagcgtcaagtttatggccagggaaatactcatcctaaggacactcgaccaccccaacgtcatcaaattggagggcttggtcacctccaggatgtcgtgcagcctctaccttgtcttcgagtacatggagcatgaccttgctgggcttgccgcaagtcctgatgtcaagttcacattgcctcagataaaatgttacatgcagcagctgttgtcagggcttgagcattgtcatgacaataatgtattgcaccgggatatcaaggggtcaaacttgttgttggataataatgggattcttaagattgcagattttgggctggcgacattctttgatccacggcataaacggccaatgacgagccgagtggtcacgctgtggtaccgtccaccagaattgttacttggtgccactgattatagtgtaggcgttgatttgtggagtgctggatgcattctggcagagctcttgtatggaaagcccataatgcctgngcgcactgaggtggaacagttgcacaagattttcaagctatgtggttccccttctgaggagtactggaagaagtctaaattgccacatgcaacaatattcaaacctcaa

SEQ ID NO: 6857 - DNA, 1256 bp, Sorghum bicolor
  Clone ID: SORBI-28MAY03-CLUS58486_1
gcacgaggccgttgcctctttacaatatgtcttcactcaaacacttcagtttaggcagcaatggccttgttgggcagttaccatctgacattggtaactcactaccaaatctccaggtgcttgacctatcaaataactccttgcatggtcgtgttccgcctcttgggtcgttggcaaaattgcgtcaagtgcttttaggaaggaatcagctagaagcatatgactggcaattcctttcctcactaacaaattgcacacagctgacaaaattgtccctggagggaaatatgatgaatggcagcctacctggatcaatagctaatctttccacaagccttgaatatttattgcttgggtccaaccaaatatcaggctccatacctgttgagataagcaatcttgttaatctcactatgcttagcatggaaaacaatttgctctcaggaagtataccgcccgtggttgggaagctgcaaaacctatttgtcctgaacctatccgagaacaaattatcaggtcagatcccttcctcaattggtaacattaatcaattgggagagcttttcctcgacggcaatgacttgaatggaaacatacctagtagtttaggtcagtgcttagggttgcttcagctgaacctatctgctcgcggacttaatggatccataccagaaaaactattttctggaccttccccttttttgggtctggacctctcccacaacaatctcaccaggaaaaataccggaggctagtgggaaacttgaacatatcgttcttctagatctttccaacaatctgttatctggaggtctccctgcaatattttcgtacttgttctacctccagtatattaatctttctcgaaacgacttatcgggtaatttgccagtattcattgaagacttcattatgttggatctgtcttacaacaactttcaagggcaagttccgacacttggggtctttaaaaatttcagtatcatacatttggagggcaacaaggggctgtgttcaaacttctccatgctagctctgccaccttgtccagataacatcacagacactactcatgtcagtgacatcacagacactaagaaaaagaaacatgtgccacttctgccagtagtggtgccaacggtcacggtagctttcctgctattgttattttgtttattcagtctttggaagaaaatacaagtgcaaacagccgcacggcacagtaaaatatgcagtctgttgcatcttgttactca

SEQ ID NO: 6858 - DNA, 716 bp, Sorghum bicolor
  Clone ID: SORBI-28MAY03-CLUS64258_1
ggtcatcgtgaaagaagaggaagacaagaaaacgattgctcttggtcgtccaccaacaaaacctgatgctcacgacttaggcaaggtgttccggccaccaaatgcccctttctcgacatctcctaaatctgattgtgacaagacagaaactagtgttcgtgggttcaaccttaatgaggtatcatgtgcaatggattctgatagaacagacatcacagtgaagccagcctttggtgatcgattgtcgaatgaatcgaatgtgattcaatctcccaacaggcagcctttaccgtggcagcataagcagggggcgcctgcaactactccatcatattcaaggcttcgcgagcaacagtcgggcctggatcttgtagctgctctgaagaggattgggaaaaggagtgctggggatggtggtgatggccgggatagagaagggaaatgaacagttggtgctttgtagatgtgtctgtagtagagttagtttggccacctctatggcccttgccattctgtatttcctttgcctcgtgccgaggctgtgaaatgtcactgcagacgctttagcttctgtagtaaaatttcactagtgtttccgaattatttacctgactaagttgtttcctgcgatgaaatgtagttcctgtaataatcctattacttgagcactggtatggccgtatggagacaatggtaactactgacttgttcctttt

SEQ ID NO: 6859 - DNA, 647 bp, Sorghum bicolor
  Clone ID: SORBI-28MAY03-CLUS64227_1
ctagtcctgatgaccataggctttaccatgaagttgtgggtaacagaattattccaaggctcaatcttctgttccaggaagccacagatggtaagcttaagtcgtttactcgattcaggcgacccatcctacctgtcccagtgcagcgcaatgccaccgacagtggattctatgccatcaagttcatggagttatggaatggtgaatctttccatcttccaatcctcacggaaaatgcagcaatgtatagagatcagcttctctactacgccatctatcacgaaatcaacactgttgagaagcttcctgctggtctagaagcactcaagccacgacgttgaagaccacgttgggaccagtctccttgggaatgctagaataaatatggaagccttagttactgtgtttttaattgaccgctcctgttggtcatcaacgacccaatttaccaaattcaaatttgaaactaatttgttttcatagtttcacttctcatacgggattgtttgtgcgatgacataattatttgtactctgaacctatactatggtctctttgtttcgaaatctactatttttatttggatattcaactgtcaatattatggtttaacaattgttattccattctcataaatccatttcctc

SEQ ID NO: 6860 - DNA, 972 bp, Sorghum bicolor
  Clone ID: SORBI-28MAY03-CLUS6430_1
gtaccggtggatgggtcctgcacgctatgacttttctggaacaatggtctttctgaagcataggtcatacgaggcaaaggttgcttttctcgagactccatacactcattcacttacagcatcagcagaggatgatgtaactggagcacaaccactacaatctctttggaacaaacctcgcaaaataatctgcagaacaaattgctctgtatgcaaagaggcttcaacatctggacaaaattcagaagatgtttcagacaactccagaacattatgcaagaaccagaagtgggtctggtccgaaggacgtttcctcagcgttggtgcagctatcatttcatgtcgtaatgaaagagcccctgatggcctggtagctgacgcacacctttcggatgggtttcttcatcttctgctcataagagactgtcctcttcccctttacttgtggtctctcacaatttaccaagaagggtttggatcctctgagcttcaagtttgttgagcatcacaagacaccagcatttacctttatctcatcacatgatgaaagtatctggaacttggacggagagatgtttcaggcgagtgaggtatctgtccaagcttgccggggccttgtcaacctgtttgcttcggggccagaggtgtagtaatgctactcgcctaggagagagacatccttatttagacttgtatgttgtacacccttgactcttctttgtattttagtagagacctagaatactttgttgatagatatactgttagctacatggcatggaaacaacaacccatttgtgccatagaatagaggaacaaagaattttgactgaattaatgaagtaaaaggttcttcttctttttctttttccgagaaaaattaataagttgaagcgtatccacatgtttgaacaattaccagtaatccagttagaaataccctgccatggatcatgaatgatttgtgtaaaa

SEQ ID NO: 6861 - DNA, 709 bp, Sorghum bicolor
  Clone ID: SORBI-28MAY03-CLUS64369_1
caaactctacccccaaatcattagcttgaacctgtccatcgcgctccaaattgggatccttaatatatctctaacgacctgcattcctggagtggggtaaatggttgtgggaattgattgtgttgtcgtcgtttaggcgcaggacgaatgggaaacagtcgtcgattacttgcctagattgcaattgtaggtaaactgttaaggttcaagcagccattgtcgacgggacaaaacttctacacggccccagacacaggtaagttgaactaaagaactcttctccagataagctttgttcttttgatgtaatgtgacttgaatgcagcaagatagaatctcctgcccattttggcatcgggaggaaagttacttatatgctttgaagcatagctgaggaaaaggaggacattttagcatagggatgacagaggaagcacgggtggggaattcttagttgtgatactaaaattgagactatggtggttttaggttatgaaataacatggttgttaaaatgccttgttacatgctaggcatagttgttcttgggatgttgttggctatggtggtggagaagaaataaatgttaggtgtaatgcattataaagagtacttctaatgtaaatgtccaactagttgcagatgtaataagagtatgcttattcaagcttagctgaaaaaaaaaaaaaaaaaaaaaaaaaaaaaaaaa

SEQ ID NO: 6862 - DNA, 573 bp, Sorghum bicolor
  Clone ID: SORBI-28MAY03-CLUS64411_1
ggcgctgatgatgatggccaggagggggcggggaaggtgcacctgtggcacggcgccgaggacctcgtggtgccggtcagcctgtccaggtacatcagcgagaagctgccgtgggtcgtctaccatgagctccccaagtcgggacatctcttcctgatcggtgacgggatggctgacaccattgtcaagtccctgctgctcggagacgatcatccgtcgtcggcctcagccctcacagcctcctcctgattctccatgaatccaccagcttgtcatgtagtccgttcgcatttcgatcgcgtggtccatcgctcactgtttttgtaaagagatatatactagtgccgtgctctgatactgcagctttctctagcgtgtgtatgcttatgtgcactgaagactgaacgaataaggtttcatatgtaaagatagtaggtgtctaggtgatgtaccattctcacattcgagatgtgcctttctgggttcgctgcactttccttttaggaggagaagggtagttaaacttatgtgttttggccagctacttattacactacagttatcatggtttgc

SEQ ID NO: 6863 - DNA, 714 bp, Sorghum bicolor
  Clone ID: SORBI-28MAY03-CLUS71553_1
gaaaagaaagaagaggtggggggagcgtggtttggtggccagtactcccctgattttcagcagcagatggcggcgccgctgctcccctcttccgtctccgtgctcctctcgctacacatcgcgctgctgctgatcctctgctccagccaggtaggggattcctgctcctccgggagcgactgcggcacgggcctctactgcggcagttgcccggccgcaggcaggacaaagctctcctgcatcagggacctagccatccagcccacctccattgtgaaggggctgcccttcaacaggtactcatggctcgtcacccacaattccttttccatcctcggggagccgtcgcgcactggggttgagagggtcacgttctacaaccaggaggactccgtcaccaaccaattgaggaatggtgtcaggggattgatgcttgatatgtatgacttcaacgatgatgtatggctctgccactccctgcaagggcaatgctataacttcaccgcttttgtaccagcagttgagacactaaaagaggtggaagcatttctctctgagaatcccacagagatcataacaatatttatcgaggattatgttcaatcaccgatgggtctgagcaaggtctctactgctgctgacttgatgaagtattggtatcccatctcggaaatgccaactggtggcaaggactggccaagtgtcacagatatg

SEQ ID NO: 6864 - DNA, 516 bp, Sorghum bicolor
  Clone ID: SORBI-28MAY03-CLUS58651_1
gcaccacgcgcatttctcgtcctctatctgtggccaccaactgctgtgctatttgagtacacagatacagatgggcagctacgacagcagcagtagtagtagtaatgactcatcagcacggaacgaggaggacgagtcgtgcatgtttgctttgaagctcctcggcgggttcgccgtacctttcaccatcaaggcggtgattgagctgggcgtcatggaccagctcctgactgccgaacgcgcgatgagcgcggaggagctggtggcagcagcagtggcagcacagctgccacggcccgaggtagcctgcaccatggtggaccgcctgctccgtttccttgcctcgcacagcgtagtccggtgcacgaccgagggtggtggtgggcacggacgacgccaccaccaccacctgctgccgccggagctacgccgcgtcacccgtctgcaagtggttcgccaggaacggcgtcgaggattcggtgcttccgcttgggatgatgatcctaaacaagacat

SEQ ID NO: 6865 - DNA, 723 bp, Sorghum bicolor
  Clone ID: SORBI-28MAY03-CLUS58696_1
ctggactccccaccccgctcccgctcatataacccaaggggacgccgcttctgctcctccgtcgtccactcctcttctccccctcccctccttgtcgtccttgcctgcggattggggcggcaggcaggccggaaaggggctctctcacttctcccgcgaggtcttccacggctgcggcctgacgatgccggaggcaaatgccggtgcggtggcgcacgcggagcagaggaagaagaattcaccagagatggaattcttcagcgaatacggcgatgccaacagatacaggattcaggaaatcattggcaaaggaagttatggggttgtttgttcagctattgaccgacataccggtgagaaggtagcgatcaagaagatacagaatatcttcgagcatctgtccgacgctgctaggatcctccgtgagatcaagcttctccggctgctaaggcatcctgatattgttgagatcaaacatgtcatgttacctccatcgaggagggactacagagatatttatgttgtatttgaactgatggatactgaccttcaccaagttattaaggctaacgatgacttgacaaaggaacaccaccagttctttctctatcacatgctgcgtgcgctgaaatatattcatactgctaatgtttatcatcgtgatttagagccaaaaaatatattagcaaatgctaactgcaaactcaagatatgtgattttgg

SEQ ID NO: 6866 - DNA, 755 bp, Sorghum bicolor
  Clone ID: SORBI-28MAY03-CLUS58832_1
gtgcgacgttcgtccatcgggtctttcgtcctgcctcctgcgatgaggaaacccgcccggctctctcttccgcagcacaaaaaaaggaaagcgcccgctatctcctccacgaatcctcctcggcgccgcctcgacgaatcctcctccacgcagagcgcccacctcctcctcgacgaatcctcctcggcgccccctcgacgaatcctcctccacgcagagcgcccgcctcctcctcgacgaatcggcgaccgcctcctcggcgccccgctcccagatttcggtgcccgcgcgaactccggtgcgcatatttcggtggccgcgtcccgctgtccgcgcagcgacccgccgtgggaatctcggcgatctccggtggccgaacaaccggtccgcacccgcgcggactctggtggccacgctgcccgcgcaccgcgcacgccggtggccgcgcccctcgcccccgccgctcactcgctacctgagcggccgcgccggtgcccgctgcccgcgccgcgtacaccggtggccactgctacccgagcgagccgcgccctgggccgtaaccctagccgtcaccggttgacacaaggtcgttgcggggcgcgccggcgttggcaggccatggcagactacagtgttgccatggctggcccatgcggtgacggtgcaccgcctcttcctctccccgccggtggctacgctcacctccgccctacgccaggtttgctggactgacattatccgctagatgtgggcac

SEQ ID NO: 6867 - DNA, 1085 bp, Sorghum bicolor
  Clone ID: SORBI-28MAY03-CLUS58792_1
gcacgaggctcagcttcagcttctcattagtaaaaaaattgtttcccatctctcttcgcttcctcccgacgccaggggcaacgcaagcgcaacggccatgacgctggccatgagcggtgcagtgtgggcgcccttctcctcctcctccttcctcttagggcggcagtgtggcgggcgacagcgacgtttatctctacaagcccgaagctcaccgccacaggggaagctatacacgtcaccccaaaatctcccattggtccacctcagtgccgcctcacctctcctcctcccattggtccacctcaaccagcatgcctttaagctccaagttggtagacaaatgatgagtggtatatttctgaggcttcaaaataaatcatatcttcaatgaaaatataaaaaggatagctttttcattacggtaccaaaaaaaattctaattcatcagctacagtttggagatcactccacgactatagcacgagggttcaatacacaatactgcattgatactgcacttatatgaacaagtttgttgattctgtgctatacactttcattattgtttcccttcaagttctcgagcttatttccatgtatatgttaccaaatcttgctggtttcatgccatcgaatgacatttgctcgatagatttgggaagggagaccttatcaagaacccatattttcgatttcatcggtgtttactttatttcatttttggtagctgcatcagcacttgatctggtagtagattattctaataaagtaataaaagacctagtgagtcagccgtttggttcacagttgtttatgtgttgctgagtgatgcaaactgtcatctacctcttccatcaaattgcccgtagccacattgtactgcagctatctttgtttagaaaataactggaccaaagtatgtgcttgtgttctaaaatataagagcagatgttgattagtctaattaatttaacagtcccactgaggtcttctgcttattttccaaaatagcacgctgtctgcatagtggatccttcaatgttcgatatcctatagattagttactttcatttattcatgcagta

SEQ ID NO: 6868 - DNA, 1086 bp, Sorghum bicolor
  Clone ID: SORBI-28MAY03-CLUS58895_1
gcacgacccttctccctcatcctctctctgctcgctctctcccccgctctcgctctctctctcgatgcctgtgctggcgtgcccttctggccggcttctcctgggcttggtccttcatttttctggcgtgcttgcgcttgcaccgccggggcatgccgtggggccatctcggatcattcgcccggaggtcgcttgttgcggcacccccatccgctggacggcgtgaacgaccattcctccccggccgcctcctggctgctgtgcgccctccatggcgtgcctcccacgaggccgatgctgacgtactaactaaattgctgacgagaccccgtacctattcctgtagctgcctcccgtcaaatggcccttcacccccacaaattacagacgtatgccaacgtcctcatcgacggtactccttccaccgtgcccatcacctggacggtgtgaaagatcaattctggccggttgacacttgacagcgaagcgggatccatgtcgtgcaacctacaagatcgatgcagtcgttgcctgcgattgtccgttgcgtccccgcaccttttgctgcagttgtctcgcctcttgtgcgcgatctcctgccctgcttggggccgccgatcccatgctgccggctcccctgtgctcccataacaggagctgcagcctcgtgggcggccctcctacagtgattggcgaatgtggttgctgcagcgacagctgcagtgctgctgccgcaatcacacccaaaaatttagtcagtcaagtggcttacaactcttgttgttttatgcaatctatgtaaatgagctttgcttgccctcatcatatatgacagttgacatgccattattgatagataaccttgcatgcttggtgacaccaattcaatactaaacgtctgccatgttctctcacataagtgtgatttatgtgcccattttggagtggaggtcggagccaatccactgcatgcaggacatgggcacaactgttgtcacatagcgttaggtataaccgttaatgcatcctgatgctgatgggttcctgctgtgcatgtttgcttacattcctcttgattgtttgcca

SEQ ID NO: 6869 - DNA, 671 bp, Sorghum bicolor
  unsure (1)..(671): unsure at all n locations
  Clone ID: SORBI-28MAY03-CLUS5871_1
canagggaagacccagagctcattgcatgagctcgatgactcaccttccataattcgtgaaagccgctgggcgaatctacctcctgaactcatccgtgatatcatacggaggctggaggctgatgagagcacctggccagcacggaagcatgttgtttgttttgcagctgtttgtaggacatggagggagatgtgtaaagagattgtgttgagcccggagttatgtgggaagctcaccttccctgtgtctctaaaacagcctggccctcgagatggaaatacaatgattcagtgttttataaagaggaataaatcaaaatccacttactatctctacctgtgccttagcaatgttgttacttcagaaagtgggaaattcctcttgtcggctaaaagacaccggaaaaccacatgcacagagtacactatatcaatggattctggcaacatctcaagatcaagcagaacctacattggaaaaataaggtcgaatttccttggcacaagatttttaatttatgatacacaaccaccctataatggggctgtagttcctccttccggaaggaccagcagaaggttcaactccacaaaagtcttttcaaagttgccttctgttagttacaacatcgctcaggtgtcgtatgagctgaatgttcttggcacgagag

SEQ ID NO: 6870 - DNA, 991 bp, Sorghum bicolor
  Clone ID: SORBI-28MAY03-CLUS58200_1
gcacgagggttcaaatgaggatgctgaatcagaatgtggacggcttgtcggtactgttaggcctcgtgggcctattgatacacgtgaacctattggagctattatccatttttatcttggtgatttatttgattctaacagcagtgaggctaatgttctgaggaaactccaacctcggagtacatggtatctaacaggactcggttctcttgcaacaacgcaaagagaatatgttgctttgcacgcgttccgccgtcttagtgggcagatgcaaaatgcaatacttaaaccaagtccagagcatttcccaaagtatcaagagcaaccacctgccatgccagactgtttcaccccaaattttgctgatcatctacatcgtagtttcaatggtcctcaattgtcggcaattcattgggctgcaacacatacagctgctggcacaagcaatggtgttgtaaagaaacaagaaccatggccttttacgctggtacaaggtcctccggggacagggaaaactcatactgtgtgggggatgctaaatgttatccatcttgttcagtatcaacattactatgctgctttgctcaagaaacttgctcctgaaagttacaagcaagtaagtggtagtactagtaccagttcggagacttttgcggcagggtcaattgatgaactattgcagagcatggatcagaatctatttcgcactcttcccaagctttgccctaagcctcggatgcttgtatgtgccccatcaaatgctgcaacagatgagcttcttgctcgtgttcttgaccgtggttttatagatggtgaaatgaaggtataccgccctgatgttgctcgtgttggagttgattcacagtctcgtgctgcacaagccgtttcagttgaaagaaggacagatcagcttttaatgaagggccgtgatgaagtaattgggtggctacatcagctgaaaggccgtgagcagcagctatcacaggagatt

SEQ ID NO: 6871 - DNA, 792 bp, Sorghum bicolor
  Clone ID: SORBI-28MAY03-CLUS58208_1
tggttactgccctatccgatatggtacaatctcttgtgagtatgtatgttgatgtacaggccaagggactcatatcacaacaaggtgtttacaagcactatgttctggggttgctggcatcattagaaggccgcagtgaagcacaatcgaattgcacagattatgaaaagttgcaggctgccctatgcgaagttgaattgaactatgatagttgcagggagtacatccaagctcttccagccacagatatttcatatattgtaggaaggtattgcaccctctgctttccatctaacttagcacgaagccttccacaggaaccttcgtggaggaaacctcttgcaacgctactagcattttggtctaaacttgttgatgacataccgggggattcaattgatgctcgctcatatgaaagaacagactacttaaattcaaataggttatctctgtgcataggagctttcaggcagctgttgataaatgatgagatagcactgcaccaaggttgggatgccatctccatgtatgtaaaagattgccttagaagtggaatgatgatggaaacatcatgtttttgtagagctatgattctatcaggctgtagttttgaatctgtagttgaagtatactatggaggacaaggacaattagggagtgagaatgcagatccaagcaattatttggatctcttagaactttataatgctgctacagaagagtgtttgtcagatttgagtgaggaatcttgcgaatatcgaatattgcttcatcatttgctggcatctttga

SEQ ID NO: 6872 - DNA, 864 bp, Sorghum bicolor
  Clone ID: SORBI-28MAY03-CLUS58218_1
gactgagagagagatgccggagcttccggaagtggaggtggcgcggctggctctcgaggagcattgcgtcgggaaaaggatcgtgcggtgcgccgccgcagacgacaccaaggtcatcgatggggtcgcccccgaacgattggaggcgtcgctggtcgggaggaccatcgccgccgcgcggcgcaagggcaagaacatgtggctcgtgctcgactccccgccgcatcctacttttcagttcggcatggccggggctattcacatcaaaggtgtggagcttagcaaagcacgagggtctgcagtgaacccaactgaggagtggccttcaaagtactctaaactgttcgttgaaatggatgatggcttggagttttccttcactgataagaggcgttttgcaaagatacgactgcttgacaacccagaagctgcacctccaatttctgagcttggacctgatgccttatttgaaccaatcaagcttgatgaatttgtgaaaacattaagtcaaaagaaagggccaataaaagcccttttacttgatcaggcaaggattcatcctgggcaaactgcatcgaagatatcaaaggacaaatgtgagatactccatcagtgcattaaagaggttattgaggagtccataaaagttggtgctgatagcaaccagtttccagaaaactggatttttcattccagggagaagaaacctggcaaggcctttgtggatgggaagaaaattgacttcattacagtaggtggtaggacctcagcatatgtgccagagttacagaagctggatgggacagattcggcagcaagcaggtctaagccaggcaaagacaaggagaatgatgacaatacaaa

SEQ ID NO: 6873 - DNA, 511 bp, Sorghum bicolor
  Clone ID: SORBI-28MAY03-CLUS58224_1
ccccgtccctccccgcccccgccccccccgcccggcgcccgcccccgctcgccacttgcgcgccctaggccgacctcatctcgccgaggactggatcgccgcagggtaagcaagctttgctagacatcgtgggtgttcttcaaacacatgtgcgttaggttaggtgatgcctgagagggaagaagcacctgtacctccaccagattcaccacgtgaggaggaggacgccgccgccgccgccgtcccagttgcttccgttgcctcttcctccttcggctccgatcacaaggaagacagcggctccaggcagaccaaggcctccatcctgtccggcgtcttcacgcccccttttgccttattcgagggcccccgcctcgtcccgcccccgtcggcctcgtccccggcgcgccaccccgtgccggcctcgtcgtcctcggcgcccgcggccggcgccaggtcgccgaggtcgtccgcaggctcctgcgcgtggtcgcggcttctgggctgcgac

SEQ ID NO: 6874 - DNA, 805 bp, Sorghum bicolor
  Clone ID: SORBI-28MAY03-CLUS5824_1
cctcatcaagcagttggagggttcagttgatgaaaataaatcccgcttgatatgtcttgactcccgcttgcaatgcatggagcaagagctgaagctaaaagatgatgtttgtatcagcctgaaaggaaatctagcaagcagcgaaagtgaaaagaacagcttggagcttatgaataagggacacattctggaaattgaaaaactatgccaggacaataaggatcttaatgaattgcttagcagcttcatggttaaagtaactgagctagataaagagcatgcctctgtgtcaagtcatgtatctaggctgatttcttcatttgaaaggttctatgacatggcccaagaggagaaattgctaatggcaagatcttctaaggataaatttgaacatctccaaagccagtatgtagatttgatgtcagaaaacaatgctctgaaaactgaaattgaagaactgaagtccagacttatagagttgcagagaactcaagaaattgttatggttcaacatgttgaggaatgccaagtggctgaagataagatcagaagattagagtctgaagctgaagtttctgcctccaacatcaatcagttagaaaaattagcttctgaactacaagggagaattcaaaagttgctagaagattctacccttgctgaaaatcacaagcaagagttgcttcaaaagattttgaagctagaatcagataatctggagcttcgaggccaagtgcaatccattatggaagagaaatctaataatgctgaatcttttgcaggagagataactaagcgtgaccag

SEQ ID NO: 6875 - DNA, 937 bp, Sorghum bicolor
  Clone ID: SORBI-28MAY03-CLUS58254_1
gcacgaggcccagtgtcactgtaagtgaggaatctagtagtggtgatagcaccacagcaaaagatgagattttgaaggatcctgctgtagaagatgcttcagtcgccaataatgttacaaatcctgcctctgaggaagctaatgaagtaaatttgacaactgaagcaccaaaagaagacaacacatctaagggcaacaaggacacatatggagcagcagaagatgcagcagacaaggcaattgaaaaggttgtggttgattcatcaaacctcggcgactttgttgggaaacctgtgttccaggctgagcgtatatatgagcagacacctgttggagtggtcatgggcttagcttggactgctatggggcgcgcggctttgtacatcgaaacaacaaaagtggaggagggggaagggaaaggtgcacttgtgctgacgggacagcttggagatgtcatgaaagagagtgctcagatagcgcacacagttggcagagctgtattactggagaaagagccagataatcagttctttgcaaactcgaagctgcacttgcatgttcctgcagggtccacccctaaggatggccctagtgctggatgcaccatgataacatctatgctgtccttagctatgggaatgcctgtcaagaaggaccttgcaatgacaggtgaagtaacattaactggaagaatcctcccaatcggcggggtaaaagagaaaacgattgcggcaaggagaagtgcgataaagacactcatatttccagcagcgaataaaagggactttgacgagcttgcttctaatgtgaaggaaggcctcgaagttcattttgttgacacatacggtgaaatatatgatttagcttttcaagagtgacgcggggacagaaacaagattagatgatttagcttaacaggattgagatttttttgttt

SEQ ID NO: 6876 - DNA, 1068 bp, Sorghum bicolor
  Clone ID: SORBI-28MAY03-CLUS59002_1
aaactcgcgaccatccagcaccagcagtgcttctgtgcttggccactccggtgccgcatgagtgcatgactcagcgtgcgccgtgcagcagcagcagcagcactgtagaaggtttgtgtcacgcgggcacgcgctacaggcgtacaggtccatcctctccctcttcccgttccagaatcggccggccagaaggggttcctgctcctcctgggtagcttcgccagggcggcggggttgactgatttgctgctagtaggcagcccagttgccattttcagagagaagagagagagagagagagagagccgagagcgaagatgatgacctcgtggcttctgggccgccggggcgcctccggcttctcctggagctccaccgccgatcaagtcacgcagggcatctccgccgccggcctcaccgccatcgtcaccggggcgtccagcggcatcggcgccgagacggcgcggacactggcgctgcgcggggcccacgtcgtcatgcccgtcgggagcctccccgccgcccaggccgtcagggacgccgtcctcgcccaggcgccggaggccaagctcgacgtcatggagctcgacctctcgtccatggcctccgtccgcgccttcgcgtcccaattcatcgacaggggtctccccctcaacatcctcatcaacaatgcaggagtaatggcaataccttttgagctttcaaaggatggaattgagatgcagtttgcaactaatcatgttgggcatttcctgctgacacaccttctattggataccatgaagaagacctctcgtgaatcaaatgtggaaggaagaattgtcaacgtttcgtcagaggggcacagatttgcatatcaggaaggcatccgttttgacaagatcaacgatgaatcagtgtatagtatctttggagcatatgggcagtcaaagcttgcaaacatcttgcatgctaatgaacttgccaggcgattccaggaagagaatgtcaacataactgcaaattctcttcatcctggctccattatcacgaaccttcttcgtcaccacagtatcatagatgttctcc

SEQ ID NO: 6877 - DNA, 1110 bp, Sorghum bicolor
  Clone ID: SORBI-28MAY03-CLUS59003_1
agtgagctgaactccggcttcgcacccaaactcccctacaactcgctccaccggcggctccggctgcgaaccgcggctgactgctgctgaccccaagcggtaccggcgcgctcgtcccgccatggctatccccaccgccttcgcctcccccctcgcggtccggtcggccgtcggcgcggctctggcggccgtcatcgccgcgcgcgcggtccgccgccgctccctggacgcctcgggcggggccgccggcttcgtcgtcatggcggtccacatcgcctgcggctacaggtacggggcgctgctgctggccttcttcttctcctcatccaaggtaaccaagatcggggaggaccggaagcgccgcgtcgaagaggatttcaaggagggcgggcagcgcaactggatccaagttctagcaaatagcacaattgccactgtactggttgtgatatttgcactattgactggagggcaagatcagtgtttggactcaaatggttcaaagcttataactggtattataggtggtatcattggccactactgttgctgcaatggagatacttggtcatctgaaatcggtgtgcttagtaatgaacaaccaaggcttattacaacccttaagcctgtcaggaagggtacaaatggtggagtgcccttacaaggacttcttgctgccacaggaggaggccttatcattggtctcactttcgtcgttgttggacttttgactgctgaatgttcgtctgatatggccctcttgcagctcctagtactacccatctctgctgcagctggtttgcttgggagtctaattgattcattgctgggagctccacttcaatttagtgggtactgcagtgttcggaagaaggtggtcagcaaaaggggtcccccggttacaaagatttccgggatgactatcctggataacgatgctgttaatgcagtgtctgttctgctaacaactgtgcttacagcttatgggggcatttacatcttttagaaactatatgggaaattttctcacttcattctatttgtgaaactatatggaaatggaacggtctgcaacttctctgtattgatagaatttatattatggtccgg

SEQ ID NO: 6878 - DNA, 644 bp, Sorghum bicolor
  unsure (1)..(644): unsure at all n locations
  Clone ID: SORBI-28MAY03-CLUS5919_1
gcacgaggagggcaacccggccagctgagcgttagtcgcagctcttgcctgcctagcatgcagctctaaacccaagtcgtgctcgtgcagcagacgccaagttgtggcaggtagtagctaggaaggaggcaaggccaggccaggccatggcgctcgaagctgtggtgttccctaaggagcacctcgtgtgcacggtcaaggcgcgctcggcgtcgctgggatgcggcttccacacagaggagctcgaggacaagggcggcgaggttctgcaaggggaggctgccgatgcgctcctgccgccgggtgccgatgccggtgcgggcaccatgtgggagtgggacgcggtgctctgcccgtgctccactgcacctggcgccgtggaggagtgctgggacgtgcagcaccagctctccgtgtccccgccgccgccggccgtgccctccgccgtcgcagcgtcgtcgtccgggcgcggcaaggccgccgccgcgtcggcgcggagacggcggcgacggccgaaggcggtgaagaacacggaggagatggagagccagcggcgcaaccacattgccgtggagcgcaaccggcggcggcagatgaacgagtacctctccgtgctccgttccgccatgccgncctnctacgcg

SEQ ID NO: 6879 - DNA, 1045 bp, Sorghum bicolor
  Clone ID: SORBI-28MAY03-CLUS59297_1
gcacgaggctggaaacgagaatcatgcaagtacttcgcttcaaatatgggcagatctattcagttaatgtagctgtcttcttgggtggaaacaaaccctcaagaactggagatgttcgtggagacataagcgtgaatttctcatgtgatccagacatatcatctaaactggttgattttgttctggaggagatatcatacctacaggtggaaggtccttctgaagaagatgtattgaccatcctcgaaattgaacaaagagctcatgaaaatggattacaggagaattacttctggttggatcgtattctgcggagctatcagtcaaggcttttttctggagatattggatccacctttgcgttccaagaggaggggcgcataaaggttagggatgctttgacaccacagactatgcaatcggccttgcaaagagttatacctttcccttgcagaaatcagtacactgtggttattcttatgccaaagtcatcctgttgggcatcagtgaagtcaatgcttagctggacttctaatggggttagcagagatgctaagattcttgctggcatggctggtgcactggtgttggccgtgagtttgtggagatactctcgtagcgcgctaaaatcatagtgtctgatacaactgaccgttttttgggacttccagtcagatctggaataggatcaggttgggtactgatatacgagctgtcaatagatatttgttctacctgagcacctacccggtgtttggagatttgataacaaaagaggctatactatgacaaaattgttagctaacagattcattgccgcatgtgtgcgtgtagtcctgtaacctcattcgttgtaccgctgcacatgtgcattagtcgtcggtgtataataatggctaccctcccatttgattaggcaggactgaatcactgaagtagtggcaactgtggtagaatggtggaaactggaaacccaacattgtagatcgctttactggtcccatctgtggacagctcaggaaaatgctgatatttctttctgctg

SEQ ID NO: 6880 - DNA, 619 bp, Sorghum bicolor
  Clone ID: SORBI-28MAY03-CLUS58392_1
gcacgaggcgaaggcgtggagggcgcggcccttgtgtctgcgcaggaagagattaaggattgccggatggccctgtcacggtgcgaggaggagctgggacgtgtccaggacaagaagatggagctgcagaaggaggttgataggctgacggagctcgcagagaaggcccagttggacgcgtccaaggccgaagaagatgttgccaatataatggtgttggctgagcaggcggtggctcttgagatggaagctgcacagcgtgtcaacgatgcggaaatgttgctggggaaagcggagaaggccatatcctcagttgacactgtggtggagctaacgtcatctgctgaagagcagaaaagcactgaagaagatagcatttctgaagggtacgagtatagcagtgatgccaccgatgatgtttctgtgagggatgaggtgtcaagtatcgagcgtctaatggttggtgacttgactgttgagggcattgagcagcttgaaccatcccgtgagatatatgatgaagcaagcagtgataagacgtctgttgagcctcagaaagaggctgagcctgattcagataagtcaaagcaagggaagaagcaggaaatggaacgaaagg

SEQ ID NO: 6881 - DNA, 874 bp, Sorghum bicolor
  Clone ID: SORBI-28MAY03-CLUS58526_1
cctactggatctcggattcactgacaactttctatcccttcttttgctccgtcgttgcctcccaccacaaatcatcctcccactcccacctgccactgatgctcccctcgcttcatcctcccctctgacccggccaaatggcctccgtgccctccgtcgccgtccccgtcgccgcatcgggcttcccggctgccggcggggctgactcccggaggccaccaccgagctctgtcgccgccgccgataaggtaaccggatcctttctcttctctttgtcccttttcctcacctcgaggcccccgcaggaccccgccgagctctgtcgccgccgccgataagaacagtccggcgctaggatcgcgggcgaagtatcgattggctcacccatttactccaacttcgcagaacaactggagtggcaggagcgtccacgcagcgcagaacggcggcaccgtggaagcgccgctgcggcctctcgactttggggaagcaatggacatgctcagggaggggaagaaggtgcaatcggcgatgtacgtgccgctgctgcacgggtgcgtcgagaccggcaccctcggcggcgccagggccttgcacgggcacatggtgaagacggggaccagcgcggacatgttcgtcgccacatctctagtaaatgcctacatgcggtgcggggcgtgccaggatgcgcgcagcctgttcgaccaaatgcctgagaagaatgtcgtgacgtggaccgcgctcatcacaggctacaccctgaactctcagctggtagaggcactcgaggtgttcgtagagatgctggaagccgggaggtatccttctcattacacgctgggcgccatgttgaatgcatgctctgcttcccaca

SEQ ID NO: 6882 - DNA, 971 bp, Sorghum bicolor
  Clone ID: SORBI-28MAY03-CLUS58537_1
gcacgagggtcgatgaaaggtgcaggattgcggcctaccacggtatcatacaatgcggtgattgatgcatgtggaaaagggggtgttgatcttaggttcacactcgggtatttccgtcagatgctgcaggatgggctctgtccggatcgtaagacgtttaattcacttcttgctgcatgtagccgggctgggcatttggaagatgctcgcactgtctttgatgaaatgatccatcttggtagtgggcgtgacatttacacttacaacacatttgtcgatgctatttgcaagtgtggcaacatggagctggctacgcaagttgtattggatatggaagcaaacaacatcaagccaaatgttgttacatatagtacgcttatggatggattctccaaactggagaagtatgatgaggcactcaagttgcgtgaaaagatgaagtctttgggaattcaactggaccgagtttgctacaacaccttactggccatatatgtgaagacagggaagtatgatgaaatagctactgtgtgtgaagatatggagaatttgggtattgagaaggatactgttacttacaattccttgattaatggatacggaaagcaaggacgcttggacatggtcgctttccttgttcaagatatgcgggcgcaaggcgtagcgcccggggtgctgacatattcaactttgatagatatttattcaaaggcgggaatgcatggagatgcatttaatgtctatttggattttaaggagtctggtctaaaagcagacgttgttctgttcagctcttttattgatacattggccaagaatggtttggttgagtgtgctttgtctttgcttgatgagatgatcaagatgggtatcaagccaaatgttgtaacctacaacacaattattgatgcatttggcaagtcgaagattcttactgaggaggatcctggtaacatgggtattgttggggt

SEQ ID NO: 6883 - DNA, 600 bp, Sorghum bicolor
  Clone ID: SORBI-28MAY03-CLUS58632_1
ctgacccctatatatggagatgatgaaaccataacacattatatgggcattcagttcttcactgatgcgaatgttgatttgggaccattaccctgttcaatgcacgaggaaccagtgaggtcaacgcggtttgctccagataactcatttcgacccatttctacggggccagagcacagcaatttctgccgggaatattctagcctgttccagttaacggatgaagtgctttgtcaaagtatactgtcaaggttgtcaccaagagatatagcgtctgtgagctctgtgtgcaggcgcttgtatcatttgacaagaaatgaagatctctggagaatggtttgccagaatgcttggggtagtgagactactcgagctcttgagacagtgcctgctgccagaaggctgggctggggtcggctggcaagagaattgacaaccttggaagctgttgcctggaggaaattgacagttgggggtgcagtggagccatctcgatgcaatttcagtgcctgtgctgtggggaaccgtgttgttctctttggcggggaaggtgttaacatgcaaccgatgaatgacacgtttgtattggatttaaatgct

SEQ ID NO: 6884 - DNA, 646 bp, Sorghum bicolor
  Clone ID: SORBI-28MAY03-CLUS58572_1
acccgtgagcgacccccctctctcgtctctcgtcgcatctccgcgcccccccgccgcccccgccgccgccgccgcttcccctccagcggccaggcagaagatggagggaacgggcaaggatggcaatcctttgaggaattaccggattggtaagactctggggattggctctttcggtaaggtgaagattgcggagcatataagcactggacacaaggtggcaatcaagatcctcaaccgtcgtaaaatcagaggcatggaaatggaagagaaagttaaaagagagattaagatattgaggttatttatgcacccacatatcatccgcctctatgaggttatagacacagcagctgatatttatgttgttatggagtatgttaagtctggggaattgtttgattacattgttgaaaaaggtaggctgcaggaggaagaggctcgccgtttcttccagcagattatatccggtgttgaatattgccatagaaacatggtggtgcatcgtgatctaaagccagaaaacctccttttggattcaaaatgcaatgttaagattgcagattttggcttaagtaatgttatgcgggatggccatttcctcaagacaagttgtggtagcccaaattatgctgctcctgaggtg

SEQ ID NO: 6885 - DNA, 1369 bp, Sorghum bicolor
  Clone ID: SORBI-28MAY03-CLUS58608_1
atgatagagaaagcataatttaacaaaataggggctatggcaaagctagggagaacaccgcccaggattctgaatcctggacttgaaatgcaactcacagcagttgctcacaaaatataatggtaaacagaaaagcctggttgtttctgttggtgattagcaaaagtgaaaattaaccgagacaagttactttagaagacaagcaattgagacaattgttgttgggaaacattggcatcgtgtttgctatcttcctttttttttgtttcttattacttctaggttttggttgagaaaatgggtctacctggaggaaataatggtctgtccttggatctgtctgatacattaggcaacaaatacatgctcttcgcaccatggtaagtggtgcttaataaatacgtacatccaaggagtctcacacgagtggactgcaatgttgtttgcgaaaggctgctgcaaatggtggaagaatgttgccaaaaggattgctaccctcgagtttgatcgcacaaggaaatcaattggtgtcattgtgaaagccagttcaggaagcaataccctactcgtgaagggagctgttgaaactttacttgagcatcggagtgtgttgtgggtgctgctgtttggggatctctcttggcggcggcatgtgctatatgtgccatcgccggcctggaccatgtctcccgctccgtgcactgggcaagacgaacgagatgggcaagaggcaacaaaggtctcatgtgaatacattgggctttgctttcaatagctgtatgctgacaagaggcctcttcaggcgtggaattacatctagctgctcgacacggacagatatgggtttcagggagatggaactgaaagatattttatacctcttcagtgaatgcaaaaagtaattatcctgggaaactacatgtggcatttttactacttcgacctgtacttcctctctgttgtatattgttgaagatttttaccctacacaaagcaattattgattcttttccatgcacatatatgtactctgtctgattgaaacaaagcaattattgattcttttccatgcacatatatgtacctgtacaaagtaattatttgtgctctgtctgattgaaacaaaccatgatacatacaagcaacagaagttatagaagactgtagcaggtgaaactcatacggagagcataccaactggttgtttaaaaatagtgaatgttaatttacgtctcgaagataaacatcttgtatatccaaaggggtgtcaaatgacagaagctgtatgtgttgatttctttgagctggaatagaggcatggaactaccgacctgcatgtaaaaacttgatcattttgcaatactttctc

SEQ ID NO: 6886 - DNA, 607 bp, Sorghum bicolor
  unsure (1)..(607): unsure at all n locations
  Clone ID: SORBI-28MAY03-CLUS59450_1
gcacgagggctgcttctcttaagttttcccaaggaaacccgattgatatcaacaagctgggagcactgccgctgaagtcagaggctggccaaaatggcaatgtcaaacaaagctcatcagaaatctctaaaactgaggttaccccagcagtgtacaacagtttggctgaaccaatggctgcttctactggttctttcccaggatcaagaccaacagctccaccagctgtaccacctccagcccctgcacctccgaaggcccctccctcatcaactccacaagcacctgcacctctgaaggctcctccctcatcaactcaagtacctgcacctctgaaggctcctccctcatcaactcctcaagcacccacaccacattcaaaacctactccaattcttcaccctgaatcctcatcaccatctgctccaaaagctgcaccttcaccaatagatgcaccgcagccaaaagctgcacctccacctccaccaccaaaatctaccggcccaccaccaccagcaatgcctggttcatcgaanacgcgtccaccaccacttatgaagaaatcaggcaataagatggatgatggcgcanattctcatgaagctaa

SEQ ID NO: 6887 - DNA, 619 bp, Sorghum bicolor
  Clone ID: SORBI-28MAY03-CLUS59502_1
gcacgaggattgaatctgtggatagattgcaactagcagtgctccaatggcggtggcctcaatctggcggagagcatggaagagattgagatctaggggcagcagcgaggacgacgccgacggcagaggcggtcggctgcggcctaccggtggcgagggcgacgccgacggcggaggaggttggcagcggcctaccggcggctacatcagcagttttggtacaaccaacaccgccagcaccatcaccccattcaattcacacggagaagcgcagcctcgtgatatccatgcatccatggctccgtccacggcgcccatggaagaaaacgcggaggaggagcttgatatagatgtagatcaggagctcgaggaagacagggtggagaagctcgagcatctcaagggcctggcggtgcaattccgtggcgataatcgcagtgccttggagaggtggctcttggagctggacgtcccctgggttatccacctcgcccccggaacacatgaatcttcagggagcgtcgttgccacgcacggcttccaatttcttgtccagagctggatcctggctctacacaagatccgtggatccatccttacaagccttgatggatggtcc

SEQ ID NO: 6888 - DNA, 713 bp, Sorghum bicolor
  Clone ID: SORBI-28MAY03-CLUS59624_1
gacggctgtgttatccagtccagtatcctcgacgccggcgcgagcagcgaatggccaccgcggcggcgaccatgaccatggcgacgcaccacccccgcgcccgcgcacccctccgcgtctgcgccgcctgggacatgaacccgggcgccgccaccgtggccacgcccaagccctccaaggccaaggccaagccgccgccgcccgccaccactacccctgcccgcccgcctcctccgacacacgccgacctcttcgcgcgctccagcgagggccaaggagtggtaaagaagagcacatatatgggctttgagaaatggtggttgccacctccaccagaggtgaagaaacctcgatcgctctacagtgcggcatcactggcttacttgggagactgcatatatgaactttatgctcggaggcacttcttctttccacctctgagcatcaacgagtacaacaagcgtgtgatggatgttgtgaagtgtgagtcacaggaccttttgttaaacaagcttcttggagaggattttctaactgaagaagaaagggacatacttcgttgggggaggaatattgttagcagcaaaactcgcaccagaaagcgtgcaggaattgcagtctacaatcgggcatcttcacttgaaacactgattggatatctttacctcacaaatttcaaacggttagagcaacttatgtttcaattgggcttc

SEQ ID NO: 6889 - DNA, 582 bp, Sorghum bicolor
  Clone ID: SORBI-28MAY03-CLUS59638_1
gcacgaggcgtgcgttcctgcttaggacggaaccaaaccctaaccctagcttcctccaccgcgccttcctcgtgaggccgtatacatggacgcgaaggacatactagggcttccgaagacccccttctcgtcctcccaggagaagaaatcgcggccgcccaaggagccgcagcgcaagcctgatggcgtctcgcgcgaggtctatgccctcactggaggggtgggaatggccccgctcatgccgaccatcgaggcatcgcacctgaagcggcggcctgctgcggagaaagagaaggtagcatggcagtggttacctttcacatcatcggcacgaactgataaccttcaactctatcactgggttagagttgttaatggtattcagccaactggtgattatcagtttgcaaaatataacaagaaggctgatgttgttaaatatacggatgaggagtacgagaagtatttagttgaccctgattggagcaaggaagaaactgatcagctatttgaattatgtgaacgatttgaccttcgcttcatagtaatagcagataggtttccaactgctcgcagtgtgga

SEQ ID NO: 6890 - DNA, 592 bp, Sorghum bicolor
  Clone ID: SORBI-28MAY03-CLUS5892_1
cggacgcgtgggctcggcctgatttcaggttcatattcgatgcgatgcatgcagttactggtgcgtatgcaggacctatttttgttgagaaacttggagctgatccggactgcatattaaatggggtgcctcttgaagattttggaaatggccatccagatccaaatctaacttacgctaaggagcttgtttttaccatgtttggaacccatgcacctgactttggtgcagcaagtgatggcgatggtgatcggaacatgattcttgggaaaaggttctttattaccccatcagactctgttgcaataattgcagcaaatgcacaggcagcaattccttatttccagtttggtacaaaaggactcgcgagatcaatgccaaccagtggtgctcttgatcgtgttgccaagaaattgaatgttccattctttgaggttccaacaggctggaaattttttggcaacctaatggatgcaggaaaattgtctatttgtggagaggaaagttttgggactggatctgatcacattagaaagaaggatggcatctgggctgttctggcttggctttccatacttgcacaccggaacaa

SEQ ID NO: 6891 - DNA, 1053 bp, Sorghum bicolor
  Clone ID: SORBI-28MAY03-CLUS58948_1
gcacgagggccaaatcggaagcaaagcaaggtgaggcgagagcgggatctggtgcgggggcaagcggcagcggcggcggcagcatcaaggtgtatcatgagaggcagaggttgcaattctgtctcctccatgctctcaacaaccttatgccgcgaggggaatgtttcacccgtgttgagttggatgagatcgctgggaatcttgttctcaatgatccaaacaagggccaatggactcctctatcattcatttttaaacctcaccacaatgttataactgggaactacgatgtaaatgttctcatcacagcattagaagctagaaagaagaaggtggtttggcatgatcgtcggaaaggggcatcatcaattgatctgaatgctgaagcattggtaggcctgatgatcaatgtgcctgtcaggaggttcagggggctctggactggcaggcattgggtggcaattcgaagcattgatggcgtctggtttaatctggacagtgatctttctgaacccaagcagtttaaggacaaagaaaatgtgattgggttccttgacagtgtgctcagtcaaggtggagaactcatggtcgtgctgcaagacgaataaccctattgccccgaatctcaaagtctaccaaaataggctcttctatgtgacttgccatacttttgagttgtcatctcaatgaggtcacagacacctacagcagaaatttcctaaaccttgtggtttaattgctgatcataatggacagattggtaaatggaaggttcagtgtgcaacatatacacttcatatgtttctgctgaccctttgatttattgttctgcccgtctctgtcatatattggattgccagccaggtgtctgcagtaggtagaagtagaacattggcttgctaaatgatgaaaatagcgaacttcgattctcagcaagaatatgttactgtggatttgtacagaactaatggggaggttgcttctgttgtagttatatgctttggagaaacaaagttgtcctggcatgttcctagaatttgtcagttcgttcgt

SEQ ID NO: 6892 - DNA, 1071 bp, Sorghum bicolor
  Clone ID: SORBI-28MAY03-CLUS58977_1
gcacgagggctgggcgtcgcgctcgacggcgccggggagcgcgtccggaacgcggacaccgtgcgccgcgtcgtggccgcgttcgtcgagcggccgcagacgcaggagggccggcgggcgtcgctggccggaggaccagcagcaggcgagctcggcgcgctggagaaggtggcgaagacggtggacgaggtggcggcggagatggcgacggaggagtcgctgggcatctccaagttcgtgggcgtggcgggcgcggtgcccaaggacgcgcgggcgtcgcacgactgcctgtaccgcgccgtggacatgtacctgaagacgcacccggggctggacgagatcgagagggagaaggtgtgcagcgtcatggacccgctcaggctctcgtaccaggcgcgcctgcacgcgtcgcagaacaagcgcctgccgctgcaggccgtgctcagcgcgctctactacgaccagctcaagctccgcagcgccgacggcggcggcggcgatggtgcggagggaggagcagggtgggagccgcagtcggccgccgggaaggctcgagcgcaggcgcgggcggacgcgtcgctggcgagggagaacgaggcgctgaggtcggagctggcgaggatgcgggcgtacgtgtcggggatgcagcagcacagcaaggggagcgggtcgaggtcgtcgtcggcgtcgctggtgccggcgtcggcggcggggaagaaggcgagcttcttggggtcggtgtcacggacgttgagccggctgaacccgttcaagggcgggtgggccaaggacacggccagcatcgccgacggacgtgacaggagcgccatgcatgtggtcaagcccaagaggagaaggttctccataggctaatttagtttgtgatatatgaatatggaatgtgatattgtttgtgattatgtttttttattactgtaattagaaaaaggttgtgggtgctttgtagtttcaatgttacctttgtttttttaatttcttactattatagtggtccagtgtgcttaaaatttttgtatttgtttatgtccaatatgtgatgtgtgcttgctt

SEQ ID NO: 6893 - DNA, 841 bp, Sorghum bicolor
  Clone ID: SORBI-28MAY03-CLUS58924_1
gcacgaggctcagccggcggacattgctgaagtatccccaactctatggcccagggcagcgtgaggagaattacaacctgaggctattcatattcatcatgatagactccgtctggcagagccttgcgtgtttcttcatcccctaccttgcatacaggaagagtataattgatggttccagcctcggagatctatggacactatctgttgttattcttgtcaacattcatctggcaatggatgtcatcagatggaattggattacgcatgcagcaatatggggtagcattgctgcaacatggatttgcgtcatgatcatagattccataccaaccatgcctggtttctgggcaatctataaggtgatgggaactgggttgttctgggcactgctgcttgcggtaactgttgttggtatgattcctcattttgccgcaaaggctttcagtgagtacttcatccccagtgacattcagattgcaagagaaatggagaagttgcaagatttccatgatgtaactcatccagaagttcaaatgagtacagtcagtagagcttaggataggatttacacagtgatcttttgttcatgagtaggttagctctacacctttctttggttctttttgttgtgtgtataggcaattctttcagcagtgggcaagctttcttgatgcttgctcccttgccaactatccaaaggataggtccgttgtaccattctgtgtatccaccagccaaattttgttgatttacatgaaaggagatcgtacaggagttaattgtacaaaatagaaactgatcgacatgtcttatgatggtgtcagtacacattcactgg

SEQ ID NO: 6894 - DNA, 995 bp, Sorghum bicolor
  Clone ID: SORBI-28MAY03-CLUS58994_1
gcacgaggcagtggtgggacctagatgtttagcgttgtaagctggcagattaggatgcatatgcttgcatcatgttggtagcaccacctgcgaggttggcatttcaatcatctggtagccaatttcagtgtcatgagatgcaatttttgtgctatgcaggtatgacattgccatgttcttggcacataggacgaacaaggcgggtgaagtagtaagaataactcatatcttattacattttcatatttaaccatatggctcctttgagttttcggaatgcttctatacctgttacctctctaatatagttttcttcgttatgttttctttattgtttgtacaatagcatattcgtatgacattgccatgttcttggcacataggacgaacaaggcgggtgaagtagaagtccgggtgagattcgagggttttggggctgatgaggatgagtgggtgaatgtcaagaagttcatccgccagcgttccattcctctggagtcctcacagtgcaaaagcattgttgaaggagaccttgtcctctgcttcagagagggaaacgacgaggcattgcatttcgatgcgcatgttcttgaggttacgcggaagcagcatgatattagggggtgcagatgtgtattccttattgaatacgatcatgaccaaagccaggagagggtgagcctgagaagattgtcccggcggccaaagtacttctgaaggctcctcctgttagccttatgggcgtatctatctggaactggaactaaccaggacttgaaacttaggtgaagttagggggatgaactttgtggcatccttgatctgatcatgtgtgtagtagcaactggcatgggcttgcatttccaacctctttggcacagggctgcccggactggttgttggcggctgaattttgtagacttgttacggtgagaagaggggagaatacgccttgagcacttactgtgtatagtgcggtctatatgttgctattc

SEQ ID NO: 6895 - DNA, 667 bp, Sorghum bicolor
  Clone ID: SORBI-28MAY03-CLUS59821_1
gcacgaggctaggacaccgtccgtaccacaccccaggtgatcccgcgcgccactcccttctccttccctcccttcccccccacccccagcttttactctcccctcccgcgcccagatcccggcgccccgccgcgaccccgtccctgcacgctccctccctcccaactaggacaccgtccgtaccacaccccaggttttgctttatgctggttcatttgtctacggacaatggactagttgctgcactgtttctgtgattcaccatgggaagcagtggagcagatacaccgtctaagacaaccaaggcatctgcccctcaggagcagcagccacctgctacctcaggtgctgcaacaccggctgtttatcctgattggtccagcttccaggcatatcctccaatcccaccacatgggttcttcccttcacctgtggcatcaagtccacagggtcatccttacatgtggggagctcagcctatgattccaccatatggaacaccaccgccaccatatgtcatgtaccctcctggagtatatgcccacccatctatgcccccgggtgcacatccatttactccttatgccattacttctccaaatggcaatgctgatgctactggaactactgctgcagctggtgatactgatggcaaaccctctgaagg

SEQ ID NO: 6896 - DNA, 811 bp, Sorghum bicolor
  Clone ID: SORBI-28MAY03-CLUS59835_1
gcacgagggcgggcacatctcaagatttttcgatccggctcctccactccatgtcctctgatctggtgacctgcgattccttgcgctaaaccggtgtgcctgccttctgctacgcacaggctacttcgtcggccgtccggccaactacgaggacaaacagcgagatgctgctgcggatgcacagaccaaagagagcgctcctgctgccggtagtggtaggtgatgcaaaacttcaccggcggatccacgccgattcagtttgtctttgcttttcttttctaccttttccatcgctgccgagtttgtgttctatttttttcccctggtttttggtccaatttcgttatcctctcttgatgaaactatttcgctgggggcctctctccagagaaccaagcgccggcgcctggtggccacaagaaaactggcttcctcggcaacctgtactactcctgcactcctcctttcttgttactacaccacacaagaaagctgggttggttggttaacctgctgttactctgatttcttccacaccaggttttcctgcttctccggcggccgagtggagagctagctgaccggcatggccggcagtgcacagcatttactctttcaaagattcgagtaccatttgtaatctgtatggactatggaggttggagggagacgaggcgatctgtacctcaagtgcatcctctgctatccggaaagctgctctgttctcctttcatacgataccacttgttcattatactaccgaaatgtaactattcgttcccacatatgtttcaaatataatttttttccg

SEQ ID NO: 6897 - DNA, 632 bp, Sorghum bicolor
  unsure (1)..(632): unsure at all n locations
  Clone ID: SORBI-28MAY03-CLUS59906_1
atcccatgcacgagggttagcatgagtctccttcgcagcatctattgctcacccctttcgtttttcttgatcgcactggtcatcaccagtagcagccgtagtgctaccagcaccggtagcacttcaggaaccagaagatacaatgccatgttcagcttcggagattcagttgccgaaaccgggaacatctgcatcgtcagcagcaacaactcgacggagctcaatgtcctcacctgcacgcatccgccgtacggcatgacctacttcggcaagccgtcttgccggtggagcaacggtcgcacggtcgttgacttgatcgcacaatcgcttggactcccactacttacaccatcgaaatccaaaggcaaagatttccaaaagggtgcaaatatggccatcaccggtggtactgcgctgaacttctccttctaccaatcaatgggcgttgaaaatccagtgtggaaccatggctcgctagacatgcaagtccagtggttcaaggtgttgactgcttccatatgcgggacaaaagagaagtgcacagggtttctggcagaatcgctgtttcagttcggtggatttggaggaaacgactatnatatcttgcttcttgagcttgggctgaccgttga

SEQ ID NO: 6898 - DNA, 968 bp, Sorghum bicolor
  Clone ID: SORBI-28MAY03-CLUS59898_1
gcacgaggctcacgaattctctcgtggccgcggcgaccgtgaagaagacgacgacgacggatgcggcggcgatggcgtgccgcgcactggccctccgctccctgctcctccccgaaccgctccaccgcctcccggccgcggtgccgcctgttgggagggcgccccgtggcggccgccgtccgcatctccgctgctgctccggcggcggcggcggggaccccgggcagccgccgcaagaagctgtgctcgaggccatatccaagatcgcaaggtctaaaggaagggttgcactcacaacaaatatggtcatgggtggtactgtgacggatgatgcaagtgatgaatggcttgttctggatcagaaggtaaattcctaccccacagatagaggatttacggcaattggctctggaggtgatgattttgtccagtcaatggtagttgctgttgaatctgttcttcaagaatccattcccaaggcccgggtatctcagaaattatcttcaagaggaaaatatgtttctgtaaacattgggccaattcgtgttgtttctagtgagcaggtccaagctgtgtatcgtgccatgagaagagataacaggatgaaatacttcttatgaattgcagttgcatgtcctgcatgttccctagtccattccatcttttaacataaggagtcctccaatgcattttcgccatatttggaatgcaggctggacttctggtgaattccaaaaggaaatgggaagacttctatgtgccattcaagcccaaactgatgcttctcaaataatctgctacaaaacaatttgttgggttcagtttcgttatgtagtgcagcgggcgtatatagctactatgtatgttaaagatgtattttagtattccattttagatgcgttttgctattttataaacaaacagtatgaacagcagtataagtgttcctaaattatcgatgtgtcttc

SEQ ID NO: 6899 - DNA, 1426 bp, Sorghum bicolor
  Clone ID: SORBI-28MAY03-CLUS59905_1
tgatgttgatgccattggattgcagaagtatgggagaagagacaattattgcaaaagacaagtacaaagatgggagaggcaatatcttgcatccactggtgaagggaagcctgcacgttatcagaggatgcttgatctagctcgttggttgaaagaacatgtaccaaaagaagattcctcagcaggatcaggaacaggtcttgttcatggtgattaccgccctgataatctagtttttcatccaacagaggatcgagtaattggcgttattgactgggaactatctactttgggaaatcagatgtgtgatgttgcttatagctgcttgccatatattattgatgcatcactcagtgaaaggacttcttatggaggttttcaagataatggcattccagagcgcgtgcctcaactggaagagtacctttccgtatactgctctttctctgcgagaccctggcctgctgcaaattggaaattctacattgccttttctttgtttcgtggggcctctatctatgcaggagtatatcacagatggactatgggtaatgcttcaggtggtgagcgcgctaaatttgctggcaaggttgctaatgctatggttgactgcgcctgggacttcataaatagagtaaatgtcctgcaagaaccaccttctaagggttttcaagtctcaccagcaccgtggcaagaatttcacagagaggaagaaagttcaacatctgaaaagaatcaaggcaaatttgttcctagtgaaaaggttatgcagcttcgaaagaaactaataaaatttatcgaagatcacatataccctatggagggtgagttctacaaacatgcacaatcaacctcaagatggacaattcatccagaagaagaaaatcttaaagcattggcaaagaaggagggcctatggaacttgtttattccgctagacagtgcagctagagctagaaagctactgttggaagaccattctcaaatttcccttgggagttcgaatgatattttgctaggcgcgggtcttacaaatcttgaatatggatatttgtgtgagattatgggacgttcagtttgtgctccacaaatatttaactgtggtgctcctgatacaggtaacatggaggtcctattgaggtatggcactaaggagcaacagaagcaatggctagttcctttattggaagggacaattcgttctggatttgcaatgacagaaccacaagttgcatcttcagatgcgacaaatatagaatgctcaatatccaggcaaggagatttttatgtgataaatggaaggaagtggtggaccagtggagccatggatcctaggtgcaaaatcctgatattaatgggaaagacagatttttctgcacctaagcataagcaacagtccatgattttagtggacatcaacactcct

SEQ ID NO: 6900 - DNA, 611 bp, Sorghum bicolor
  Clone ID: SORBI-28MAY03-CLUS59358_1
gcacgagggttttgcaacacttggtgatgattcacttgaatatccaattggtgaatactgggattccgatgagtatgatgacgacgatgatgttggctacacccgacagccaattgaggatgaaacctggtttttagcacatgagattgattatcctagcgacaatgagaaggcaactggccacacaagagggactgatcgtcatgatcgccctacaaaggatgaagatgatgaccagtcatttgttgaggaagattcctacatatctggtgagcaatattttcatggaaagaatattgcacaaataggtacatctgagggtccaatgggccatgggattcctgataatgatatgatagctcagtatgatggccaacttttagatcctgaagagcttaatttgatgcattctgaaccagcctggcagggctttgtatcgcagaacagtgaactaggtatgttagggaatgggaaattccttaatgattcggaacgacctcatcctgatgacccttttgtggaggatgatcagcatggctctgttaggtcaattggtgttgggataagcagtgatgctgctgacattggcagtgaggtgcgagaaagtctga

SEQ ID NO: 6901 - DNA, 939 bp, Sorghum bicolor
  Clone ID: SORBI-28MAY03-CLUS59372_1
gcacgaggcgcacaggagggccgccgcccctgctccgacctccgagaaccgaatggctgccgccgctgcatcttcgtcgcctccggctgccatcacctgccgagctgcggtggcctgggggccgggccagccgctggtcatggaggaggtggaggtcgccccgccggggcccatggagatccgcgtcaaggtcgtctccacctccgtctgccgcagcgacgtcactgcctggcaatccaaggcgcaacctgatctgttccctagagtcttcggccacgaagcatccggagtagtagaggctcgcggtgaaggtgtgaccgagttccaagtcggagaccacgttctcactgtcttcattggggaatgcaagagctgtaagcattgcgtctcggggaaaagcaacatgtgccagaagctcggtttggagaggaagggtgtcatgcacagtgatcagaagacccgcttctctgtcaaggggaaacctgcgtaccattactgtgccgtgtcaagcttcagcgagtacacggttgtccattctggatgtgcggtgaaggttggcctgaccgtgccaatggacagggtgtgcctgctgagctgcggtgtgtctgcaggactcggtgcagtctggaacgtagctaatgtatcaaagggctcaagtgtagctatatttggtcttgggaccgtaggactttctgtcgctcaaggtgctaagcttcggggggcgtccaagattataggagttgacactaatgctgagaagcaagaaaaggggaaattatttggtgtcacggattttattaacccagatgaattgagtgaacctgttcaacaggtaatcaaaaggattactgatggaggggtggattactcttttgaatgtgttggtgatactggagtagtatccactgcacttcaatcatgttctgatggctggggagt

SEQ ID NO: 6902 - DNA, 552 bp, Sorghum bicolor
  Clone ID: SORBI-28MAY03-CLUS59388_1
gcacgaggcacgagggagaaaccctgatatttgccaacatgattttctattttgtcaacattccatcatcttataatctcgaatattttcataaactagttgtggaaaatgggggatctttctccatgaatctgaatgactctgttacgcactgcatagctgcggagaagaaaggtatcaaatatcaggcagctttacggcagggaaggatcattcactatgagtggatattagattgttgtaaggaaaaacatcttcttcgtttgcaacctaggtatatactatttcttgctgattttgccaggcacaaatttcctgaagagattgattcatatgctgactattactactgggacattgaaattgctgacctcaagcagattttcagcaacatcgacaaagttgctggtgattcaaacatggttaatcagtacaaaaagaagcattgcatagatgagagattctgtttcttccagggttgctgtgtctacttgcataatgcacccttagtgaatgcggactacaatgtaatatctgatcttgcgctgaaga

SEQ ID NO: 6903 - DNA, 567 bp, Sorghum bicolor
  Clone ID: SORBI-28MAY03-CLUS59435_1
ttcggcacgagggtttgctcatgtggacaagcaacgacgtgttcatggagtattatctgatttcagatgcaacagtggatcaacagatcatctttctttggatatcaaggatttcaagcataagagctcccacagatcgtctgttagatgtcttcctagtgcacagagaaatgaaacagaaatcagtcacatgcaacctgtcgcaaggggagctcaagtagataagaccttcaatgataaaggattgtgtcatgctagcagaactgtctcaggaatgcccattcgacctcaatattatctcagcagtcccaacaacaatttcaagaatcctccgactgtaaagagttgtagtgagatgagtgatttcagttatcaactggtaagatgtgctaaacggtcagcttcaccaaagatgggtttaaccagcacaaactgctccctttctgagaaaatgtctctgctacgtcaaccacggcatggtgataatcatcagaaccaaaaccgtatcagtgctttgaatcgaagacacaaaatcgtgaatcctaggggagcaactgacctgctaaa

SEQ ID NO: 6904 - DNA, 1103 bp, Sorghum bicolor
  Clone ID: SORBI-28MAY03-CLUS59431_1
gcacgaggcccaaaggtccaaatcattctccgtggggctcagcatctcctaccactctaccagcggcgctgcggcgacggcggcagcggcagcgacggcgatgcggctgctctctggcgcctcggcgtcccgccttccctcttctctgttctcacacccccgcgcaaggacaagatgcgtcccagcctcctccttcgcctgtcgggcagcctcttcatcagccgcgggcacaggcgacggcggcgcgcggaagccgtggctcttcgtcgggctgggtaaccccggaaaggtgtaccagggaactcgccacaacgttggattcgagatgatcgatgttatagcagaagctgagggtatatctctgagcagtatgcagttcaaggcaatggttggaaaaggccgcattggtgatgcacctattatgcttgccaagccacaaacctttatgaatgcaagtggtgagtctgtcgggcagctggtttcatatttcaaaataccacttaatcaagtcgttgtgatgtatgatgatctggatttaccctttgcaaaactgcgcctgctgccaaagggtgggcatggaggacataatgggatgagaagcatcgtcaaccatttgaaacaaagccgtgttggtccacccctgtgagctggcactggtcgcccgccggggctgatggttccccctgtggtggcgcgccggcctttcggcatcgatctccttgtgcagcttgatttcgcgttgcataggggcttggaggcagtgagaataatggtgcttggaggattcaacaagagcgcaacttacgtgaacactgcacagtcatccgaaatgctgaacagatgatggcccccatataaactacagtgttcgacttaattcccatgccagagtcgagattggaactgcagcaagtcacactgcagtcagcttcacctgattcatcattcatcatttgcacgttagccatgttccctgcaagaaagttctgacagctgaggtgttcaattggagcatactgtgatatgaacaatctaagtaactgcgaatccatgatcccataacattcttctgtattatacttatatactaccttcttgatttc

SEQ ID NO: 6905 - DNA, 931 bp, Sorghum bicolor
  unsure (1)..(931): unsure at all n locations
  Clone ID: SORBI-28MAY03-CLUS59443_1
gcacgagggctttatgaggaggcagagcaaacgtttgagaaaattgagaaggcgggtcttctgagcgacgagcagacttatgtagcaatggctcaagttcacttgaatgctggagattatgatagagcattggaggtgttagaatctatgatgatgaggaatgtgaagccttcacacttttcttatagtgctattctccgatgttatgttgcaaaggaagacatagttgctgcagaagataccttcagagctctctcccaacatggcctccctgatgtgttttgctgtaatgacctgctcagattgtatatgaggctgggacatctagagaaggccagggcactagttttaaagatgagggaagatgattttcggcttgatgaggacctctctatgacagtgatggaattttattgcaaaagcaatatgattaatgatgcagagaaattattcaaagatattcagagagacaacaaaaccgtgaagattccaacaatgcttttgcttatagagatgtatgctagaaacagatccagtgtgattctgagagaacacagctcatcaaaggcactcgatggaactgacagttcagcagctagtgtggtgttgaaatccttgttggacatgcctgggggcttgtccagtgtgtccctactgatcagcaaattggctagggaagggagcacagatgaggcaaaattcatttatgaccagctgactgaattgggattcaagcctgatcataccgcaattgctactttgattgtccaatatggacaggccaagcagttagagcaagcacaagaactattcgagtcagcatcagcgttctttccagaaggagcaaatgtttacnatgccatggttgatgcattctgtaaatgtggcaaaactgaagatgcatatcatcttttcatgganatggccgatc

SEQ ID NO: 6906 - DNA, 733 bp, Sorghum bicolor
  Clone ID: SORBI-28MAY03-CLUS60159_1
gcacgaggcgcccctctggctccaaccgcaccagcgagagtggaaactccattgacgacgacagctcgagggccgccgccgccggtactagagcgctccccagagtgtcggaggagcttcgcgccgcgctctctgcgttccagcagaccttcgtcgtgtccgatgccactcgccccgactaccccatcctctacgctagtgctggattcttcaacatgactggttactcctcaaatgaggtggtcggaaggaactgccgcttccttcaaggttctgggactgaccccgtagagatttccaagatcaggcaggctctcgcagctgggtcaaattactgtggtcgtattctcaactacaagaaggatggtacaccattctggaacctcctaactgttgcccccatcaaggatgaggatggcagggtcctcaagttcattgggatgcaagtggaagtgagtaagtacacagaaggtagcaaggatacagctcttcgcccaaatggattgccagagtcactcatcaaatatgatgccagacagaaggatcatgcccgtagctcagtctcagagcttctacttgccctcaaggatccacgatcattgtcagaatcaagaaacaataccttaaaaaggaaatcacaggaatcaggagatgtgcttttaggtgaagttcccggcaagagaagctccgaaagtggatcccgtcgtaactcacggagtggaatgcgaaactc

SEQ ID NO: 6907 - DNA, 868 bp, Sorghum bicolor
  Clone ID: SORBI-28MAY03-CLUS60340_1
gcacgagggcgctcgctgcctgtcacggtgtaccatctggcgacgcgaggtgcggacaaggagcggcaggacgcggtggtggagtgcgccgtgtgcctcgccgagctccaggacggcgaggaggcgcggttcctgccccgctgtggccacggcttccacgccgagtgcgtcgacatgtggctcgtctcccacaccacctgcccgctctgccggctcaccgtctccaagcccgacggcgtatctcctcatccggtgtcttccttggctcttccaccggtcccgccggagcccgcgagctacgccaccgccagcctccccgtcagcgtgcttcttggggtgtctggccatgacgtggtcaccgcggtgaccacgaacccatccaccttggtgatcgagatccccgagctggccgtgccgacgccgacgctgacaccgtgcgacgctgccaagtcaccggggtcggcgaggctgagatcgatcaggaggctctggagcttcggaaggcaaggcgccggagcgacttcttcatcctgctcatgtgccggtgcaggtgccagcgaaggagtcgacttggagcagggtatcagctagctttaccattaccatagaagaggcacagcaccggaacggggtatgcggccgaccggccagtcggagagcagcaccaatttctgcgctctctgcaatggtgcagatgtatattcagttaatgtgccatttcttaagtaaattgaaaaatagatttgtgctgttttatatctataaaattttagagcgtaataagaaagtccacttcagagctgaaattgtctgggcctgcaaaacacgtctcattgatatctaatgcaactatttgaattcaataccc

SEQ ID NO: 6908 - DNA, 516 bp, Sorghum bicolor
  Clone ID: SORBI-28MAY03-CLUS6041_1
actcttactaaacctccctctctcgatctcggcctcgcccgcaagccagcgcagccgtccccgctccacgccgggtagagaggagagacctaacccaacagcttccgagcgcgtccggcggcggcgatggcgggcaagtcgcacacgcgcaaggcgttcctcctctgcaactacatcctcctgggggccgcctccagctgcatcttcctcacgctgtcgctgcgcctgctgccgtccccgtgcggcctgctcctgctcttcctccacgcgctcaccgccgtcttctccgcggcgggttgctcgggctccttcacggcgcccgccacgcccgcgcagtggcacaacgcgcacaccgcgggcgccgcgctcaccgccatcttccagggcgccgtcgcgctgctcgccttcacacgcacctcagacttcctcgccgagctccagtcctacgtccgcgacgaggacggcgccgtcatccacaagatggtcggcggccttggcaccgccatctttcgtcct

SEQ ID NO: 6909 - DNA, 647 bp, Sorghum bicolor
  Clone ID: SORBI-28MAY03-CLUS60429_1
gcacgaggggaacggcgagaacacgcggatttcgctgcgggagaaggaaagaaaaaacatgcggtcgacggtgctggtgccgcggagcctgcggaaggcgtccgtcccgccggccctgctctcagacccgacgcccggcagcctccagcccacccgcctcgccgcccatgtcaacggtgccggctcctcatgctctgtctacctcgcctctggctgccgcgtctacaggatcgagataagccttggtggtgcgatgctgtccaaaggaaaggagagccttttgattcctgataatgcacaggtcataagttcgtcagttgtggatcgctgcccacatcgttctgagatccagagtgtatctctcgcagagggcgaagatgactgtttgattcttggaacggttgactcatatggtcaccttattgtatcccgtttggacattgtggctgatgacattgacaggacgtcctattcagtaccacctcgtgattgtggtgttggggaaggcagttgggctgggatatgctttagcccaatgcagcaatccatggtagctgtagctcgtgagttgtgcaagaccattgatatctatgatcaagacattcatgttcgcagtttacgcacgttatggtatccatcttcattta

SEQ ID NO: 6910 - DNA, 1057 bp, Sorghum bicolor
  unsure (1)..(1057): unsure at all n locations
  Clone ID: SORBI-28MAY03-CLUS59646_1
aaccgcgtcggtgctcaccccaccaccgaatccttcctccctcctgccgccccctcttcccctgccctgtccggtgtcccttactcccctgtccctggagaggcgagagcgagggaagcagccaagcaagaagagctagagaatcttcaatcacagggcgacggagtcaacgcagcttccgtctgtctccttcccttccctttcgctggccgtcggcatcggcgtcggcgccaccaccaccaccaccacggccacggcgccgctccgtaccgggtcccggacccgataagcccctgctggctgctgctcggctctcctccctgtctctcgcgtccacctataaacacacagagagacacacgaacagggcaaggggacagccggaatcgcaaggaacagctgccgccgcgccgaatccacccacccccccccgctcgaggtttccgtaaacccgtcgccccttccctttctttcttgcaggtgaatccgccgttcccctcttttcctcatccttcctcctctcctcctccagctctccccggatctcgcttctcgattcggcgccggtggacggaggcgaggcaatcggcgtagaaggtatcggcgagcagcagacggagcagttgcttcattcctactttcgacatccatctgtagtgaatcgatttgggattttggagggagcttggattgtgcaccatctgcatcagttcactttctttgagcatttggtatctggttgggttcactggttctggttcaaggaacccctttctgaggtttccttggactatgggagctttctgttcatgtctgcaacctgattattctgaccaccatggaaattcttcggcgtttaggaactgcatgtgcctcagatgctttacccagcagctgatcaatgcgtacactgttttgttccgagctggagcagtgcattctgtttctccagctattgaagccactcctgttgacacaagtgagagttccttcgatacatatcgttcaccgccnagacctctgccctatgatgatccacgattttcccctcctgctc

SEQ ID NO: 6911 - DNA, 707 bp, Sorghum bicolor
  Clone ID: SORBI-28MAY03-CLUS59690_1
ttaactctcaaatatgttcaaaattcatcaaatgatatagtccacatcagactaaactttcgtcaaaatttcagcagaagggagtactactttgagtctttgacttcttcgcacgaggggaagtacttcgccacgggggagatggatttcgaccctaagctctacgggctcgcgcagtgcgcgccggatctgacgctggcgcagtgccagagctgcctcggagacctcgagtcgagggtgacgacgcagttcctgagcggacggcccctcgggaacaacgctttccatgtgtggtgctccctgaggtatagtgtgtcgccgttctacgccggccgggcgatgctgcagcttccggcgccgccggcacctccaccaacggccacgcccacgccccattcttcagggaggaaaatgaatgcagcaggaatctctgcaggcataacctgtgttgttgtgttgatgttaattctttcggtctttttctttattcgcttcaggctaaggattaaagtgaagaaaaatgatcactcactgaagaagatagggagagctcaatgcacgatctttgatttgctgacgctggaagaggcgactgaacatttctcagagaaaaataagcttggagaaggtggttttggtattgtgtacaaggggatactgtcagacgggcaagagatagcagtcaagagacttttaggaagagccgg

SEQ ID NO: 6912 - DNA, 637 bp, Sorghum bicolor
  Clone ID: SORBI-28MAY03-CLUS5973_1
tggatctcccgctcgcgctcactctcggcgacaaccgggcgacccgccgccgccgccctaccctaggtgcccaggtcttcgccgttcactccgcgaggtcttccccggagacgagcacccaccagaatgaggccagttttttgtggaaaccttgactatgatgttcgcatctctgaggtcgagcgccttttcgggaagtatggaagggtggaacgagtggatctgaagacaggaatatcatggagcatatgtgctcttcctggttgtgcgactggctctacctttactgcctctgcctgagcccccacctcatgccttgtccatctccaggagttcacagtccaccatggcatctgttcacatggaaacgaccacctcgtgaccgatgtcttacttttacgatcaacattgcatccttcttccccggcttttcaccctttcctcgccagtcctcccgtgccggtctcgcgcccggctggagagggcagggttgcggaggttgcacccccaatgctctgtgcctccgcccaggttggggtgctggcgctcgcctcctctgccttcgtggggtccaacggatgccaggtctgggcctgggtcttctcgggtgtgtatgcacttcgtgatgacgatgaaa

SEQ ID NO: 6913 - DNA, 937 bp, Sorghum bicolor
  Clone ID: SORBI-28MAY03-CLUS59743_1
gcacgagggtctataattatcttgccagcaaagcatgaaagatatgaagtgggcacgggggcatttgtctctctattggctctgcaaccctgtaaacaaatcgcgcctatccctatcattgttgaggcttctaactcaaccacatgcgaacttctgaaatcaatcactggcttaaatgtgcaacctgtggagatggttgcgtctaagttgtttgtgcagtgctctaggcaaaagggccttctgaaaatctacaagcacttgcttaatcagcacaaaaatgttttcaaccttttcagccggcctgaactagggggcatgaagtatatggatgtcagacgtaaaatccatgatgcagtcgtttgcggtatcttccggtctggaaaaatttattttcacccaagcgaagaagaactgctgaaagaaacagacaaattgcttcttattgctcctgttcatgggatgagaagaacaaaatatagagtgttaagtgtaccaagagagacacaaacatcgagccattacccagaatcaagagaggatcaaggatcatttaatacagctactaccatggacaatgaaacacggctaaagaacattgtaaagcgcccctcaaaatctctttctaagagtagtgattatatgctgggaccgaaggaacgtgtgcttattattggctggcgaccaaaagttactgaaatgatacgggagtatgatagttaccttggacctggtagtacagtggaaattttgtcaggaacccctattaaagagaggagcagtatcatcaatccccttttgcagagccagcttaaaaatgttgaagttactcatcgggtggggtgtcctttgaactatgatactctgaaggaaacgatacttaacatacagaaatctgcccctgataaagaggttccactttcaatagttgtgatatctg

SEQ ID NO: 6914 - DNA, 819 bp, Sorghum bicolor
  Clone ID: SORBI-28MAY03-CLUS59783_1
ctccccttcctcctccattccttcctcgtggtcaggctcaggcacgccgagcatccgcaccgcacctgctcgcccgatcaccccggcggtttcttctccccttcgccccacccgtgcgggcgctatccttctcgtggcgacgtctgggtgaccgctgccgcggccctactcctggtgccgtgcctaggtattcgccggcgacgagcaccacccaccaggctacctctgcggggatcttctgtcaagcaagggaagttacctagcacacaacgcaaagctcaatagattattgaggatcaacatttcagccatctgtattttagttaacgtatatgatggccaatggtaacatctggttagaaagatagaaactcattattgcgctacagatggttggccataatgactatggtagtgcccttttgacataagaactaagctggaaattgatagatccaagttattaatggagcacgcttcctgtgatgatgtacatgagcatgttataagtgtagcacatggggaaaccgcatcaacatcaaccagtcatcaagatatgtacagtgactcggatgaaccgcatcaggaggataggcaatcaacaagcacacaaaccccgtcatcagagtcttcaccgtcaatatcaccaattgcatatagctccagaaatttatcttttcctagaagagatagtatatatggtcatggaagaagtccttggaattctggtctatggatctcgtttgaagttgtcatgtacattgctcaggttgtagctgctattgtcatcctcgtcttttcaagacatgaacatcccca

SEQ ID NO: 6915 - DNA, 624 bp, Sorghum bicolor
  Clone ID: SORBI-28MAY03-CLUS59767_1
gcacgagggaagggctggtgtatgtgaacagttttgttttatattttcactccatgcatgtgatgttacaattaaatcttatagatggtgaaatggctaatttgaaattcctttgaattactgcttgaaaaaaacaagttttgcagctgattgaaatatgtaatgatggtgaattggcttttgctatattcgaatgagttgccatcggtaatattttacatagatataatgctgtagtttcatatttacgatttgtgttcgtttgtcaagttctatgttggtaatactacttttatcttggtatatcaggtaatgagtgctcttgagaagatgacaaggggagttgcttggggggaccttgatattcttgttgttgatatgcccccaggcactggtgatgctcaactatcgatgtcccaaaggcttcggttatctggtatttatacatctgactatgaagctgcaaatgctgattggatacatattttaaattttagtttttacatattgtttctgcaggtgctttaattgtttcaactcctcaagatattgctcttattgatgctagaagaggagccaacatgttccgcaaagttcaagttcctgtacagtctgtttaacttc

SEQ ID NO: 6916 - DNA, 1036 bp, Sorghum bicolor
  Clone ID: SORBI-28MAY03-CLUS60632_1
tgtatttgagaaacttgaatggagcatctcctccccatagtttggccaatcagaattctcatgtgcatgaggtctcgacaagtcaaacttcagaaaatgcaaatggttctgcaccagatgtttcaaggttatctcttgcaagttcggaagcaagagagtctagtttggaaggaaggcgtggtggtttgattggacaaatgtcagaacattctacggaggaagcatttcaatcttctaatttggatagggatctgcaggacaacttggctagctcttcattgaatgggcgcctgccaaatagtggtcaacttgatggggaatgtgacaatggggttacaagggttccaagggataggacaaattacagtagtgatgcatctggagaggttacagatggtggtggtgcgcctgtggcctcttctgttcctcaaagggaacatttaatccctccaagattgggtcctagaggacaatttatcaggcggcaaccatcagataggggtttccccagaattatatcttcctcaacgatggatgcacggagtgatctatctgccattgagaatcaggttcggaagctgattgatgatttgagaagtgattctatagatgttcagagatcagcagcatcagatcttcgttctctagctaagcacaacatggagaataggattgtcattgcaaactgtggggctgtaaacttgctggttagtcttcttcattcaccagatgccaaaacccaagaacatgctgtgactgctcttttgaatttgtcgatcaatgacaacaacaaaattgctattgcaaatgctgatgctgtcgatcctctcattcatgtccttgagactgggaaccctgaagctaaagagaattcagcagctactcttttcagtctctcggttattgaagaaaataaagtgaggattgggcgatctggtgccatcaagcctctagtagacttgctaggaaatggcaccccacgaggaaagaaagatgcagctactgcattgtttaatctgtctattcttcatgagaa

SEQ ID NO: 6917 - DNA, 661 bp, Sorghum bicolor
  Clone ID: SORBI-28MAY03-CLUS60719_1
gcacgaggcccagatgcattgacaaagttcatggttgtcattcacaatgctataggagggcaggattatgagaagttccctttttcatttttcgacaagaatggaaagtatgtgcaggccttattgaccgccaacacaaggagcaaaatggatggtaaatccattggcgccttttgttttttgcagattgcaagcgctgaaatacagcaagcctttgagattcagagacaacaagaaaagaagtgttatgcaaggatgaaagaattggcctatatttgccaggagataaagaatcctcttagtggcatccgatttaccaactctctgttgcaaatgactgatttaaatgatgatcagaggcagttccttgaaacttgctctgcttgtgagaaacagatgtccaagattgttaaggacgccactctccaaagtattgaggacggctctttggtacttgagaaaagtgagttttcttttggagacgttatgaatgctgttgtcagccaagcaatgttattgttgagggagagggatttacaacttattcgggatatccctgatgaaatcaaggatgcatcagcatatggtgatcaatttagaattcaacaagttttggctgacttcttgctaagcatggtgcgatctgctccgtccgagaatg

SEQ ID NO: 6918 - DNA, 975 bp, Sorghum bicolor
  unsure (1)..(975): unsure at all n locations
  Clone ID: SORBI-28MAY03-CLUS60808_1
gcacgaggcaagtacaaaagccccaaagcggaagcatgcacagttttgtgcagctacaatgccttcttctggaaacaaaagatttagaagagaagacaatgaaagttctgccccaggattattgcaaaaatgtggtacatctttcttcaactggatgtcatcacttacgaatgggttacccatgcttgatggagccactgctgccattccacttgatcagaagttttcagcaagtacaggagagggatctgcagcaccttcccagccacttcaaaacaacagcagcgttcctatgcaatctgttggcttcaattcgctcttccagtccctgtatactcataatgttatgataacttcaagagataattgtcatcaaccagagagcaactatgctgggcatgtgttcaatagactgactctggaattaaatgacagcaattctatgttggacaaacaaattggcatgggtagagaaactcttgacagtggctgtaaaaaaaatcagtgcacagctgcctgctcaaatgatgcaacacaaaataaaggtggtttgagggaaagcttgtgggtaactcggcttttgccaaaagcatccgtggaattgatggaggcaacaccatgcaatgtagaaaatgctgttaatccacaggctgtgggtgacaagttgtgttgtccacctcttcagaattttaacttggagagaggaagcagcgatggtgtaacaagtagtaaatgtccagcaacgcctccagaggaacctaagcaatctgaaacaatggcttctgtttttgcaaagagattggatgcacttagacatgcaaacacatctgcagtaaggctggctatcgcatgtgaccgtggaagtcccaaactgagaaaccacaaaactaactcttttgttgttagttacagcagccatgataaagtagaggcaggacacgaanatcataaatcatctagcagaaacggaagaat

SEQ ID NO: 6919 - DNA, 1394 bp, Sorghum bicolor
  Clone ID: SORBI-28MAY03-CLUS60883_1
gcacgaggcaaggttccttttcttgatatctgcaacacaattttggatcctactttgcctctcactgtcttggactatgaagagtttggtgaccctaatatcccagctgaatttgaggcgatcagcagttattctccttatgataacttagcacatggtgtatgctatcctccagtcctggtgactgcctcgtttaatgatacaagggtaggagtttgggaagctgctaagtgggttgcaaaagtaagagatatcacatgcacatcctgttcccagtcagttattctcaaaactaatatgcaaagtggccattttggtgagggtggacgtttcatgcactgtgatgagacagcctttgagtatgcatttctcatgaaggccttgggtttggatgacatagctatgccgtagtggactcacgcctgaggcttttcacagaacagattttgtgcggctctgaaagcaaaaactgagataattaccttttgtgatatgctcagggataagattgcatcctcataattattgattcgaagggcttgcaatggaaggtgatgtgcccttgaggcgtgttctgtttcgcttttaatagacagctgtggattcctacgtgcagattatctctttagcttcaaaatagcgcacttggatgctgctcatcaacactgcaaaggttcagcacttaaggtcagtaaccaggagtacttgatataattgcattattagtacaaataagtcttgttattacaacagtagtaaacatggtatctagcatactgatcgtctaggaattcttcagtgactgatttgattatgtactatctcttgcatgaaaccagacaatttttttctgtggaaacaaatcatcatgaatcatgatcaaataggtctgactttatcatgtctttcaatgttttgccccctgagtacgctggtggcagataagatccttatggtgttagatagggctattgggcaaaggataaatggttgagcatggatgttgattttgacttctacttcatacggcaggttagtgtatgttgctttcttctctttggctcatctgacagatgatgtgctctttttacactatccttaaattaaattaaaaaaaggttacatgtcacattcttgtgcccgtttttttatgtgtaatccttctcgtcccgttgctatgccacatactccaatgttcagtgcaacactaccatctcaatgatgacttgctaaaactccttgagcacatttctccgagcttatcttagtcaccgtttccttctttcttcttttcgaggatcctagtcaccttttgtgtatacatatacttgtgtccactttgttcagtgcagcaatgcaaagtaaatgatgtctggggatacgtaccgagcaca

SEQ ID NO: 6920 - DNA, 818 bp, Sorghum bicolor
  Clone ID: SORBI-28MAY03-CLUS6085_1
gagaaaaaaaaacagcgaagagggagcgggagatcgaaaccctaggcatcgtcggcggcggcgatggcggcggcggcagctgcagcgccggagtcgtacatcgggagcctgataagcctcatgtccaagagcgagatccggtacgagggagtcctgtacaccatcaacaccgaggagtccagcatcgggctcagaaacgttcgctcatttggaactgaaggtcgtaagaaggatggccaacagattcctgccagcgacaagatatatgagtacatactctttcgaggaagtgatataaaggatttgcaagtcaaatcctctccaccatctcagtcagcaactttacacaatgatcctgctattattcagtcacattatcctcatccagcttcgttgtctacaagcttgccttctgctgcaagcacaacaacagctaatcctacttcacacaatgctccatccatgattcagatgccaccaccatttcaagggaatttgcccccttaccaatctggcaccagcttacagtcatggaactcgtcacctatgccatcatcagcgaatggcactggccttacaatgccaccaatgtactggccaggatattacacaccaccaactgggtttcctcatctgcagccgccaccctttcttaggccaccacacagtttggctgttccacaggccctgcagcttcctatacaatatcctggacttggatctttacccactggatttccaagtatgccagagcttccttcttttcttcaacctggtaatagtaatagtttaagtcaaacttcaggtgtacctacatc

SEQ ID NO: 6921 - DNA, 1061 bp, Sorghum bicolor
  unsure (1)..(1061): unsure at all n locations
  Clone ID: SORBI-28MAY03-CLUS59971_1
aaagcaccacagactggtggtggggaaattttgctgggacgggacgggacacgacctcgccgtcctcatcggtcaaagacggaggcggaggcgcctcctgcaccgggttcacgccgcgccgccgatacggcccgccagaaccgaggttaaggttgcaggcttgcnncttgggattgtgaaagatggggacctcttctggcgcgagctcccggcagcaacctccttcgacccaggggatgttgccaccaaggcatggtcctcgcccctcagggttgcagacctcactctcgctggcctcttcggagcaggttggctcgcctgacatgcaggagcctggttcaaactcggccccagggcatgactctgccactgagagcgccagttccaaagacacatggcctgctgagccgaaccagagcaatggtggggtagctgccagtggtgtcgtgagtaaggcggcggagaaggagaaggaggtggcgaatggtgtatccaagctgcaggttatccgcggaccctcctctcgtgtgggtgggatgcttctgcgggaggttgcacgcgcgagggttgatctggttgctgagaagatgaacgtgatgccggaggagcacctggaggaggtcaagaatgagctcaggtcgattctggagggcactggaggttctcaccacatcgaggagttcttgtacttgcagaagcttgtccaggacagggatgatttgacaccatccatgctttcagtggcgcaccatgtgcagcttgagatccttgttgcaatcaagactgggatacaggcctttctgcaccccagcgttaccattccacacaatcgcttggtggaggttttcttgtacaagcggtgccggaacattgcttgccagagtgctctccctgctgaggagtgcagatgcaatgtgtgtgctagcaggaatggcttttgcaacctgtgcatgtgtgtcatctgtaacaagtttgattttgaggtcaatacatgccgttggattggttgtgatttctgctctcactggacacatacagattgtgcaattcacaatggccag

SEQ ID NO: 6922 - DNA, 731 bp, Sorghum bicolor
  Clone ID: SORBI-28MAY03-CLUS6003_1
tgctctcttgcctctgggctcctctgtcaccctcctcgccggcgtgttcccctctgtctcgcggcttctgctcgcgggcatcaccggccgcgtcctttgccaccgcagccccagcgccgtccatggagaccccgccgctctcctcgttgcaggaggagggggaggaggagcccaccgtcgaggactcgtccgccttctccgccgccgccgtcccgcctcgccccgccacgcacagccactcgctccacaagtacgcgccgctggactggtccgcctacttcgacgaggagcgccgcgtagccatccccgacaccgacgacgttttcaatgtgtacacggccggatcggaggggcccgtcgtgttctgcctgcacggaggtggctactcagggctttcatttgctctagcagcaagtcgaatgaaggacaagactcgtgttgttgccatggatctacggggacatgggaaatcaacaacgaatgatgatctggatttgtccatcgaaactcttaccaatgatgtcatagctgttatacgtacaatgtatggagatctgccaccagcaattatactcgttgggcatagcatgggtggttcagtggctgtacatgtggctgcaagaaaagaaattcgaaatcttcatgggcttgttgtagttgatgttgttgagggaacagcaatggcttcactggttcatatgcagaagatcttagcaaatcgggcacagcat

SEQ ID NO: 6923 - DNA, 514 bp, Sorghum bicolor
  Clone ID: SORBI-28MAY03-CLUS60089_1
gcacgagcccgcgccacaagaacagatgagaaggtgcttttcctaggcccaaaacagtttccacggatcacatacagcccagtaagccgtgcgtcgtcacggttgtcacggagagaggtaatagcttttgccgggcaacaaccttgggacctcggcagatttttcaagacattgtacttcttcaacggccctccaaaccctctcaagattgtagaatctatcatcagcagtttcactggacctgcttctagtgaagcgcccaaaaaaatggaaacatcggatgtggtgctggttacaggagccactggtggtgttgggcgacgggtggtcgacatcctgcggaagaagggcatacctgttcgagtattggctagaaatggagacaaggcaaggagcatgttggggccggatgtaaatctgatcataggagatgttacaaaggaagatacgcttgatcctaagctcttcaaaggcataaaaaaagtagtcaatgcagtctctgtcatagtggggc

SEQ ID NO: 6924 - DNA, 741 bp, Sorghum bicolor
  Clone ID: SORBI-28MAY03-CLUS60078_1
gcacgaggctccaagaggcccttggcgtcgctgcctcctcaattcgctttgcccttgcatccaccagccgtgcggaggcccccatcgccttcgccgtcatcatcctccccgccgccgcctatggctttgcctctacccaattaccgtcgtgggtccccgctccctgctgcagcactcatccagaaggaagctgcggctgcggcggctgctgtgtctgattcagaggactccgatgatgccgatggcaacaacaatcacaattcgccccggtcaccttcgcgctcgctgtcgtcgctctctggcagtaacaagaagcgcagcagagatgaggctagcagcagtgctgaaaaaggtttcagggagctagcaagggcgatcgaagcttttgcggagatgtatgagcgcgtggagagtgctaagcaaaagcatgcggtggagatggagcggcagcgaattgaattcctgaagcaattggaggtgaaacggatggagaattttgtcgatgcccatgtgaagctggctagagcaaagcgtacaaagaagactacaggaggtgctgctgatggtgctggtgcgatggagttggttgccaccgttgctgcgctccctttcgtctccacctcgaccttcctttgatatggaggaagagtttaggtaaagtctgaattttagattagcattgccctaggctactgttccttttttttgttcaatggctatgttaagacattgtaatctacc

SEQ ID NO: 6925 - DNA, 567 bp, Sorghum bicolor
  Clone ID: SORBI-28MAY03-CLUS6006_1
gtacttgctgcagggaaaaagagcccagctttagttgcttttctttggtagatttcatatttcctttccattaaaaaatgttgatccattgatgttttcccagttatttaagaaagcacaaatcagtacttgatcgagttcataggaaaacttgttttgtccactatggactactgcagaattggatgttctagtgagtaacttttgtcgcttatttgctttgattatcttcatctagcattctaaattctctttcaatccaattttatgtgtgcattttttacaagcaacaaccctaatgtggatggatgctttcaattgattaccacaaacatatatcaccccatgtgatttgtctcataaactattggaattctgataatgaaaattacatgtgctataaaagattgatttggaattatttatggattctctacttgtaatcatccactcagtggggactaatctttcatgattcatttactcatgcgcctagatgcctaattatactggtttactgattgttttgattcgggtttttgcaagtcactaaccatggttccagac

SEQ ID NO: 6926 - DNA, 527 bp, Sorghum bicolor
  unsure (1)..(527): unsure at all n locations
  Clone ID: LIB3476-017-P1-K1-G4
cctaaataatgcggcattcatggctgggttagtcttttaatgcattcggctgtagttcaaattctaattatgcagtaacatctggttcagagaatcctagtgtccattccatgggctatttggtggtgcctcccagctttagttgcttttctttggtagatttcatatttccttttcccattaaaaaatgttgatccattgatgttttcccagttatttaagaaagcacaaatcagtacttgatcgagttcataggaaaacttgttttgtccactatggactactgcagaattggatgttctagcaacaaccctaatgtggatggatgctttcaattgattaccacaaacataggtcaccccatggcctacctctaataaactattggaattctgatatcctccattacatgtgctataaaagattgatttggaattatttatggattctctactaataatcatggtttcaaaggggactaggcgtncagacaaggagcttggtgtgcgcctagatgcctaattata

SEQ ID NO: 6927 - DNA, 612 bp, Sorghum bicolor
  Clone ID: SORBI-28MAY03-CLUS601_1
cccacgcgtcctccggtcgatcaagtcgctggaagctctggccttgatggcgctcgccgtgttcgccaaggccgccgtcgctgcaggcgatgcgtcgtcgtcctgccccaagctcaccctccacaacctctgtccatacccggtctggccgctcgtcaccgccaacgctgggtacccctccgtcaccggcaccgacgcccgcctcgacgggaacggcgagggcctggtgaccatggcgctgccgcaaggcgtgtggtcgggccgcgtggtggcgcgcacggggtgcgctgacgacgactgccctccgaagtgcgagaccggcgacgcgccgccggcgacggtggcgcaggtgagcgtgggtgggtacggcgggctggcggcgtacagcgtgagcctggtggacgggttcaacgtgcccatggtggtgacgccgcacgacttcgcggcgggggcgcagtgcccgacgctggggtgcgccgtggacctcacccaggaccaggagtgctgccccggcacgcaagcggcgctgttcaaggccaagtgtcccgtctcgaggacaacctccacggaccttgaggcaacgcctctggactgtatcgcgccccggtgagc

SEQ ID NO: 6928 - DNA, 686 bp, Sorghum bicolor
  Clone ID: SORBI-28MAY03-CLUS61207_1
gcaccacgaggccggccacgcacgcggccagagcagcccatccgtcgcagcggaggaacatctccagaaattcaacccaacaatggcggacgagtcgtggagggtgccgagccttgtgcaggagctcgcggccaccgtgcaggagccgccgagtcggtacctgatccccgagcaggacaggcgcgacggccagctcgccggtgcggagatgccggagcccgtcccgaccatcgacctccaacgcctgttggcgtccgacgacgactatgccgacgaggaagctaccaagctgcgctcggcgctgcagagctgggggttcttcctggtcactgagcatgggatcgagagctctctgatggattctctcgtcgctgcatcacgcgagttcttccgcaagccgctccaagagaagcaagcgtacagcaacctgattgaagggaagcattggcagctagaagggtatggaaatgagcaggtgtatacccaggaccagatccttgactggtgcgaccggctccatctcagggttgagccagaggacgagagaaacatggatcgctggcccggacaccctgaatctttcaggggtcttctgcacgagtacagtcagagctgcaagcgagtcaaggacgggatcctccgggcgacggcgaggcttctggagctcgacgacgacgacggcatca

SEQ ID NO: 6929 - DNA, 1141 bp, Sorghum bicolor
  Clone ID: SORBI-28MAY03-CLUS61212_1
gcacgaggcggaggatgtggtgaccggcttccgagtacaccggacagggtggcgatccatgtattgccgcatagaaccagatgctttccgtggcactgcaccaatcaacctcactgagcgcctgtaccagattctgcgctggtcaggcggttcccttgaaatgttcttctcacactgcccactccttgctggtcgtcggttaaacttcatgcaacggattgcctacaccaacatgacagcctacccaatctcatcagtcttccttgttttctatctcctcttccctgtcatatggatcttccgtggcgagttctacatacagaagccattccccacatatgtgttgtatctcgtcatcgtcatagtaatgacagaactgattggcatggtcgagatcaagtgggctggcctcacgttgttggactggatccgcaacgagcagttctacatcatcggggcaacagccgtttacccattagcaacgctgcacattgtgctgaagctagtccttcgtgggaatggtgtttcgttcaagctgacagcaaagcaggctacaagcaccgtgaacgagaagtatgctgagatgtacgtagtgcagtgggcgccactgctgatccccacaatagtggtgatcgccgtgaacgtcggagcgattggggcggcaattggcaaggcgattgttgggggatggtcgctcctgcagatggccgatgcgtccctcggactggtgttcaacgcatggatcctggtgctgatctacccgtttgcgctcgggatcatagggcggtggagtaagaggccctatatcctgttcatcttgttcatgattggctttgttgtagtagcggcagtggttgttgccatccatgcagcgcgcactggttcttttaggttccatttcagacattcaggcggtgctagtttccctacaagctggggtttttagcttgtgttcatcaacggttcgtggcatcggttgcagtttgttcccttagctgagagtttcttctttgtggagtttctacatgatgtaaatcgtgcattgattgtacaagtttgttcagtgaatggaaagtagccatttgtatgggaaaggaacaaaaaatggtggtaaagtgaaagattttctgccttgattttg

SEQ ID NO: 6930 - DNA, 867 bp, Sorghum bicolor
  Clone ID: SORBI-28MAY03-CLUS6122_1
cgagaacccctacctgatgaagtgcctgatgcgggtgcttgggattgctaatatagctggtcagctcgtgcatgagatcactgctcgacttgtgggtattctcatggaagtgtgcaataaccccaagaaccctgacttcaaccactacttgtttgaggctctggcagcagttattggccggactggtgagcaggacccagcactactccctgcttttgaggccagcctcttcccagtgctccagaggatattggttgaggacatctcagagttctggccatatgcttttcagatatttgcacaactcgtcaatttgagccaaccacctctctcgcagaattacatgcagctatttggtgttcttctcagtaatgccacttgggaccggccaccatgtgttcctgccttggttcgcttgctgcgagcgttccttaggaaaattccaaatgagctaaaccaagagggcaggcttccaaatatcttggcaatatcccgtagtctcctctcacgcagcagcactgaagattctgcattctacatgctgaacacaatagtggaaaatgttggttttgacattctgaacccatatataagtgagatatggagtgctttgtttactcggctgcagggtagacaggcagtgaaatttgtgaactctcttgtggttttcatgtcactagtgctggtcaaatatggatcaagtgttcttgtcagttctgttgatgcaattcagccaaatcttttcacccaaatccttcagcgattttggattcccaacctcaaattgatcaaaggtgctcttgaagttaagttgacagcagttgcttcgacaaagttgctttgtgagtctgcggtgctggtggatgc

SEQ ID NO: 6931 - DNA, 659 bp, Sorghum bicolor
  Clone ID: SORBI-28MAY03-CLUS61349_1
gcccaaagaatgtgtcgccaacagtaatttcaccaaagcagtacaagaagcggtttaggaaagccatgtcggcctactttcttgtggttccagaccagtggtcgcctctagtgatcatccccagcaagcaagctgagagtggtcaggacagggatagcgaccaggttctcttgacagaatcgcgagttatgcatgcataactaaaataggaattattcaggaaataactccttttttgcaacatctatagattttgattttattgaaattttgttcattctcttttgggtaggtatattatctgggtatccgtacctttttttcttttttgggggaggatctatatgtaaaaagttttagcccaagtctttgaaagttgtagatagaaatcaacatgcatatagggttgtacaagctgtcattcgtttccatgaacccttgttcattgaaattttatagcatgtagaaatattagaactagtttcatacttatgcacctgatgtatatcttttgtttccttcatttccatacattctatatgaaggtagactctcaaattcttttctgggagagtccaccaagaaaaatcatgtatgtggtgctttaggcaagtgtatgtaaatactctgaaattgtaaaaagaaagtttttccatttc

SEQ ID NO: 6932 - DNA, 701 bp, Sorghum bicolor
  Clone ID: SORBI-28MAY03-CLUS61229_1
caatggttggcgatggaatcaacgactccccagcacttgtctcggctgacgtggggctggcaatcggcgcaggaacagatgtcgccatcgaagctgccgacattgtcctcatgaagagcaacctggaggatgtgatcaccgccatcgacctgtccagaaaaaccttcttccgcatacgaatgaactacgtctgggcgctcgggtacaacgtcatcggcataccgattgctgcaggggtgctcttcccatccactgggtttcgcttgccgccctgggttgccggtgctgcaatggcagcttcgtccgtcagtgtcgtctgctggtccctgctgttgaggtactacaaggctccaaagattgttggcagttgatgacacagctggaagacgggcatatcatttgccaaaaacaaattactcagtagatatcacatattatatcactggcactgctgctgctggaatgagaaggttggctgctaactgtcgctgaaacaaaactctaaaaaagaatcgctgaaacaagctgtacatatgtgttataagtatatacggcgatgctaagtgaactggtggtgtaactacttgtgatctgcatcgttgtatcgatccgtaccgtttttttccctcctgagaggacttatagcgctgtactgtctttatgatctgaaactgagggaaatggatcctgaatatttttcc

SEQ ID NO: 6933 - DNA, 681 bp, Sorghum bicolor
  Clone ID: SORBI-28MAY03-CLUS6042_1
ccccaccgaaaccgcagtaccgtacccgcgccgacgcgagcacgatggccgccgcgggcccggcctcttcctacttcgccggctcggccatcctgccgtcgcagcgcgccgccgcggcgcccgacaattccgccgtcgtcacctcttctccggccaagcagtcgcgtgacccccgcttctccggatgcgcccccaccaccgtgcgtcacatcgcccgctccttcgccgccgccgatgccactggtggcggggaccctgtcatctacatcgacggcgtcgacgccaccaacgtttggattctggggagggtggtgagcgtggtgaacatggaggctggcgtgtcattcacgctggacgatggcaccgggaggatcccgcttgtgcggtggatcactgacgatattgatgctaaggaagtgtctttcgtccagaatggtttatacctcaaggttcaagttactctcgtagggtttcgagctaagcagcatggttttgctcgctctattaggcctgttaccaatttcaatgaagtggtgctgcacttcattgagtctatgtatgtgcatttggtaaatgtctggccaaagacgcaaggtcaattccctcgcactgttcaagcaaatgcgtctactcacgagatgcaagctcaagtcgctcacacagttcaaacaaatgcacctg

SEQ ID NO: 6934 - DNA, 354 bp, Sorghum bicolor
  Clone ID: LIB3476-014-P1-K1-C8
aaggaatggtttatacctcaaggttcaagttactctcgtagggtttcgagctaagcagcatggttttgctcgctctattaggcctgttaccaatttcaatgaagtggtgctgcacttcattgagtctatgtatgtgcatttggtaaatgtctggccaaaggtgattagagcaaatggcaaatttttgtgtcagttccattttgatgatttatgaaagcacaaactgttatttcatttccattttgaagacgcaaggtcaattccctcgcactgttcaagcaaatgcgtctactcacgagatgcaagctcaagtcgctcacacagttcaaacaaatgcacctgcttatatgccct

SEQ ID NO: 6935 - DNA, 612 bp, Sorghum bicolor
  Clone ID: SORBI-28MAY03-CLUS60433_1
cctcctggtcctgccccgtcgctccgctctcctctgctcgcgcccgtgctcggctcctgcctgcacgtcccgcccccgccctgcacttcgcccgccgccacgtccgctcgcccggccctcccctgcctgcaccagctcattataccatcatcggcgccgcgactactcatcagaaagacgcccctctaggcccgcgaaccctggcgccttctaatgatgacaaccaaagcaaagggtggccaggtggtgttccggacccactccgctccggccttgcggctgctactgcacggcgtccgcccagtctcccataatcaaacctatccccccgaatttatttcacccctcgtattgattcggcaggcaggcattcctttagaagaaaatctctgcacgccattaatggcaccccaaatccatatgagcaagctatctctataatcgggcgaacactgtcaccttttgatgatgataacttaataccatgttttggatttggcgatgcttctacacatgatcactctgtcttcagcttctacccagagaaccgactctgtcgtggctttgaggaggttcttgcaaggtatcggcaaattgtaccacatttgaacc

SEQ ID NO: 6936 - DNA, 1121 bp, Sorghum bicolor
  unsure (1)..(1121): unsure at all n locations
  Clone ID: SORBI-28MAY03-CLUS6051_1
cacgcaccacccccaggtcccagactcccagtccccacccaccactcctcctcctcctcctcccctcgccgccgccgccagttcccgtccgatccgcccggatcgccccgccatggaccagtacgagaagacggagaagatcggggaaggcacgtacggggtggtgtacaagggcaaggaccgccacaccaacgagacgatcgcgctcaagaagatccgcctcgagcaggaggacgaaggcgtcccttccaccgccatccgcgagatctcactcctcaaggagatgcagcaccgcaacatcgtcaggctgcaagacgtggtgcacaacgacaagtgcatctacctcatcttcgagtacctcgacctcgcggccaagaagcacatggactcctccgccgacttcaagaaccaccgcatagtcaaatcctacctctaccagattctgcggggcctcgcctactgccactcccaccgcgtgctccaccgcgatctcaagccacagaacctgctgctcgatcgccgcaacaacatcttgaagctcgccgactttggattggcgagggcatttggcatccctgtccggactttcactcacgaggtggtgacactctggtatagagcaccggaaattcttcttggtgcaaggcattattccacccctgttgatgtgtggtcagttggttgcatttttgctgaaatggtgaaccagaagccactttttcctggtgactctgagattgatgagctgtttaagattttcagaattttgggcactccaactgaaggaacatggccaggtgttgctacattacctgattacaagtcaactttcccaaagtggccatctatggatcttgcaactgtggtcccaacacttgaaccggcaggaatcgatcttctatctaagatggtgcggctagatcccagcaagagaatcaccgcccgtgccgccctcgagcatgagtacttcagggacctcgagcacgcctactagatgatggatgaaccattcattccttcccttcacttgccctgcccctctgtnaataaggtcataatgcttgngcccggcgagtacccattttggncgctgctgcngttatctanntatatangaacga

SEQ ID NO: 6937 - DNA, 617 bp, Sorghum bicolor
  Clone ID: SORBI-28MAY03-CLUS60547_1
gcacgaggggaaattcaggcttggcttgaagattgcctcaggattttgtgagggtgttcgcattcgtgaggcaaaaacagaagcctttatggttaaggaccatagaggagaattgtacaagaagcactatccacctacactgaaagacgaggtttggaggttggaaaaaatagggaaggatgggtcattccataagaggctgaacaaatctggaatatctacagttgaggatttcctcaggctcgtggttcgggacccacagaaattgcgcaatatacttggaagtggtatgtccaacaaaatgtgggaaacccttgtggaacatgcaaagacatgtgtcttaagtggaaaatattacatatactattctgatgagagcagaagtattggtgctattttcaacaacatctatgcattctgtgggttgatttctggcgagcagttctattcatctgagagtcttgatgaaagccaaaagctgtttgctgatggattggtaaagaaatcatatgataactggatgtatgtcattgaatatgatggcaaaggtcttttgaaccctaaaccaaagaaaaaggctgcatccactggtcaagctgagacacatgctcctgtgg

SEQ ID NO: 6938 - DNA, 812 bp, Sorghum bicolor
  Clone ID: SORBI-28MAY03-CLUS6057_1
ctgatgtggcatctctgcatagaaaggaaaggagacgagcttgtcctccacgcgtccggaagcctcatcagtattctgatacagacaaagcttgctctggacatagctctgcatctgattccctggtacaagattgtggtattccagatcaacaggacttcactagctgggctacagactgcctaaaagatgatggagatgtcacacaaaatctaagcttgagcatctcttcgccacccctaactgataccaacctgaaccggagtcagagtcacagacagtttccaggcaccctctttggttggtcaaatgaccctcactattcattttaccctagtggcttgttacatgcacatcataaggctgaaaaccaggatggaactaccagtagttacatggctactgggggacacaatgtgttttcccatgggacagcttcaggcatgaggggtggtatggcaggcccattgctccaacagccaataatgtcaagtcgtgatggatggactgatggaagcagagattctggaacgaactgcccacaggttgacatttcgtaccacatgtacagcctattctagcagcagggtgagaggtctgcttcgcagaccctaacaacagacatgtacaagtcataccttctaacctagatggcaagatgttggatggtgccgaaaatggtgttagggagtgcttcgtgtttgttgctaaagcttgtaaagatcaaacatggagcttcatgtacaaagactgcaggggatggtccttcagtgaacatttggtaaataaccattgctaaactgtactgccaa

SEQ ID NO: 6939 - DNA, 918 bp, Sorghum bicolor
  Clone ID: SORBI-28MAY03-CLUS60627_1
gcacgaggcctcgaagtcactccggcgctcgccggctccgccttctccggttctcccacccatccaagcgcagctccggaagcgccaggggcggacgagcacctcccaaatttagcagccgtggagcgcgtgggcgtggacccgtaaggaggatcgatggggtacctgccgtccctgagcagcaaggcggcgcacttcgtgtccgacctcaccaccgtcatcctcaaccccgtctccgagcgcgagcccgcccacctccccgaggttgacgaagtgcaagaaaatttggaggatgataaagattctgagcacaattctgacagccttgatggacctgacacatcttcctttagagcattcttgatctcatttttgtcatcatcgagctctaataacgattcaatggagataattcctgagcagaatggggacatgggttaccctactttaacacccatggggaagggaagcaagggaagaacaggtctgataagtaggggaaagcattccatcggaaaaatcattaacaaggcgacaaggattggtggtttcaaacaaacaactgcagagcctaaaattgacagggagacaataactcatactgaaccagttgcacctgtattggagcgccaggaaccaaaggaagttgtttcctttagtagtttgccaactatgtcggaaccatctgttcttttgtcagaacggatgcaatcaattctttatgcatctctccctgttcttgcccagggaaggaactgggtcttgctatacagtacatggaggcatggcatatctttatctactttatatagaaggagcatgctttgccctggtttctcactcttggttgttggggataaagaaggtacaatttttggtggtttagttgaggccccattacagccatccagttcaaag

SEQ ID NO: 6940 - DNA, 685 bp, Sorghum bicolor
  Clone ID: SORBI-28MAY03-CLUS61502_1
atcggatattataatgcggattgttaaagattataatgagtatgttatgcggaatctggccaggggctacactagaaaggatcttggtgttagttatgtcaaggaaaaacgattgcgagttaacatgggacttaaaaacctgcgtgacaaagtgaaacagcaccaagaaaaagtaggggagaagtggaacacagttgcaaaactccaggaagagtgggtggaaaatgcagaccgctgggtggctggtttcttagagaagtttgaggaagggtgccactcaatggggacagccatcaaggagaggatccaggagaggctcatcaaggcacaatccagcgactttggcagcctcctacagtatgacagttacgattctgacgaagccaatggagacgacgaggacgaagtctttgaagacgtcaaggaatagcacatctgtacatattacaaggttttagtagttgcaaattgtcttgtcagtccgtcgcccctctctggttggtggtctttatatggtcaaaggtaggtcaggttgccatgcttgtagctgctcttgaatcttgatgtttgttcaggcaacgccgctgttgtaaaagctgtggaaaggcttgcgtcaggataccgatttcgattgttaccattgggttagaacatatacggctataaagttgaagtcgaggtggtt

SEQ ID NO: 6941 - DNA, 661 bp, Sorghum bicolor
  Clone ID: SORBI-28MAY03-CLUS61513_1
gcatgtccatgcaaccattgactggacgaatactgctttaacagcttcagaggttgaggccgcggagaaccagatcagagaacaggtatctcggagccccaacaatacggtactggaattgaacagaagacggcagcggtatattgccaagccatcggaggagttggtgatcactgtcaacagccttcaggagtggggcaaacagatcgaccccagaaagctggtggtggttcatttctcggcggtgtggtgcagatcttcccgcaagatgagtcctgtctttgctgatctagccaagaagttccgaaatgttgttttcttgaaggtcgatgttgatgaaatggagactgttgctaaggaattcagtgttgagggcgtgccaaccttcctgttcatgaaggggggctacgttaaggacagggttgttggcgcagacaaggaagagctgggggaggtgcttgaagagcagttgacctgatgttcacaatccgacctgatgttatagcacctataaatttttttttttgactgtcaacggggggagacgttccccacctgagtaaattttattgcatggcccaaagaggcagataacagattacacctataaattagaagacccttcaaccacaatatacagtgataatttccgtcttctgct

SEQ ID NO: 6942 - DNA, 558 bp, Sorghum bicolor
  Clone ID: SORBI-28MAY03-CLUS61587_1
tgaacatatcaaatgttataccatgagtgttctgaatcctgatggccagacgagcaatgaagatatcatattcctttatcggcttgtacctgggcaagctctcttaagctttggtctgcattgtgcatggcttgctggtatgtacctggacgaacttgtaatcacctggcatgatgttgtgataacacggtgttccaaatgaagttgtccagagagctgacagtgttttaggggacatacattccaagaaacctgcgaggcgcgtgaccagtgagaaattaacagcaacagacaagcagtaccaggatgcagtgactaaactgatggccatcgatacacagaaagatgacctgaacagctttttccaggaactattcccctccgaattgtagctctcgaaatcaagacttgtacaggaaaaaggatgaaagttggaatggttactggaacctacaggaatgagtactggaacctccagcaaaaagggtgaaagttggaatggtatttgttgcatgtaccgccgttcatctgttgcgctgttagcagcttttcatgttt

SEQ ID NO: 6943 - DNA, 659 bp, Sorghum bicolor
  unsure (1)..(659): unsure at all n locations
  Clone ID: SORBI-28MAY03-CLUS61520_1
tcgacngaatagatgttcacaatagattcagacttcgtctctatcgcccatcaactgttaccacggaatacagagaacatgtgaaagatctttcttgcgtgtcaaaagatttcggcaggattgtcattgtcgacaacaatccgttcagtttcattcttcagcctttgaatggaataccttgtgttccattttcagctggacaacattctgatgaccagctcatgacggttatatttccactcctgaagcatctttccctccagaaagatgtcagacctgtattgcatgaaaggtttcatatgccagaatggttccaaaagcatgggatccccccaactaatcaggctgtgtaagttttgctgccgtacaatggaattgttttgatgaaggctgaagtgcctattgtgctataagccccttaagggagagcacttgtacattattatcaatattcatttagggttcctgataaaaccaaatcactgcctatatggagttgtcacatccgaagataagaaaattgttatctagcatgacgtcagatttgtatctgtgtagtggagcattttatatcaattaattgttgtatatcagcttctgttgtaaaatttgattgttgacagttaagatagtctaatgaatagttcagggctcaaaaa

SEQ ID NO: 6944 - DNA, 937 bp, Sorghum bicolor
  Clone ID: SORBI-28MAY03-CLUS6165_1
aatcactgtcttgcaattctacttcacctcctatttcctcagagcaaggggaggaaagttatttacacattgaacctctgtcgcctagtaaagccctccgtatagcaatgctcaagaggcgttttgctggaacaatcgtgaaggcacaacaaaatgcacttctggatcatggtaaggaaatagaccttgcaaagttgcagttggaaaaagagaggctggaaaaaaggcagcaagaagagaaagcaagaattgaggcccaggtaaaggctgctgaagctgctgcacaattaaaactagaggaagagatgaggaggaagcgcgagcaggaaagaaaggctgcacggctggcactgcacatgatgaagaagactgttgatattgacaacagcgactttctgaaggacctggagaacttgtgccaaaagtggcaattgaatcctccaagcaaactgatcgtagactttgtccatgggattgagttgacacagggcctagggagcccactggaggcacttgggctattcatgaagaaagatattgaggaagaggtcgaacatgaaatggaggacagcgtgtcaacctcccagaatgctgatgtcgaggaaggagagatcagctgctgtcagtagtgtacctctcattctatgattatgtgcgtgctatgtaactattccaccactgtgcaacctcataagtgagagtaaaagaagtgtgacttcatgcatgttgtctgctctgtcatctaacctagctgcaccagaatgtctagagtacaataattgggcattggcgcattgctgccggttttgtggttgtcatgtgatgtgctaatgtatgttgtaggtgttccaggtctattgaaactggaccttgtgtaaaaaaatacaaaaaaaaagaatagtgacatatcaatgtatatttgtagttatatatggtt

SEQ ID NO: 6945 - DNA, 675 bp, Sorghum bicolor
  Clone ID: SORBI-28MAY03-CLUS67824_1
tcaagagatgttgaaactgacataatcccgacttgcagggagcttggcattggaatagtggcatatagtccactgggcagagggttcttgtcaagtggtcctaagctggtcgacaccttgtctgatcaagatttccgcaaggacctgcctagattccagccggaaaacatggagaagaacgccgtgatctttgagaaagtgaatgcaatggcggcgaggaaggggtgcacgccgtcgcagctggcgctggcctgggttcaccaccagggacccgacgtctgccccatacccgggacaacgaaggttgagaatttcaacagcaacgtggcggcgctttcggtgaagctgacacctgaagacatggctgagctcgagtcctacgcgtcggcggatgtccagggtgatcgctacaatgagtccttcctcgccgcttggaaggattttgagacacctcccctctcgtcctggaaggctgagtaacgtacacgcatcgtttcacaacatttccaatccttggtgttggcaaataagcacgtaccggcagtgtccgccgtgagtaagatatgtgggcgttgatacttgtgtagttgctcatgtctctgtttctgttgttgcattgtgtcaatattatattcaagaaatgcgaaaagcattcagggtatcaatgaattattt

SEQ ID NO: 6946 - DNA, 663 bp, Sorghum bicolor
  Clone ID: SORBI-28MAY03-CLUS67901_1
aaactccgccagcgcagaggcctcatccgtctccatcccgcccgccacctcactcactcgctcaccgcctccgccggtgcccgcgcgtgcgccatccctactccagctcgctctctccattccgccgggaccacgtcgatcgaagtgccaggagttgtggatttcatgtctgtgatcgtggcaccttaattggactccgatatgggttctgctgctactgagagcaatgacaccttgctgggcaatggagttgttgggattcttgctgagacttgtaacatgtgggaaaggagggcaccattaactccttcccattgtgctcgccttctgctcggaggagggaagaacggagctcgagtaaaccggattactgtgcagccaagcacaaagaggatacatcatgacgctcagtatgaggatgtaggatgtgagatttcagaagacctgtcagaatgcggtcttattataggcatcaaacaaccaaagttgcagatgattcttccagatagagcgtacgctttcttttcacacactcacaaggcccctactccctcttggccactgtcgggcctcatccttgaagaaagggtgtccttgtttgattatgagctaattgttggagatgatgggaaaaggtcgctagcatttgggaagtttgctggt

SEQ ID NO: 6947 - DNA, 734 bp, Sorghum bicolor
  Clone ID: SORBI-28MAY03-CLUS67951_1
gcacgagggccaaagccacgccatgccgctagcttctctgtcgctggaccccgcccccttccctctcatccgccccgccgccggctggagcggacgcgtcctcccggtcccggggcctgcaccgcgcctatgtcggccgctgagggcggctcccgtggcacccgctaccacggatgagccctctgcggccgcgcgcggccggctggagtcgctgagccaggtggccggggtgctgggcacgcagtggggcgacgagggaaagggaaaactcgtcgacatcctcgcccagcgcttcgacgtcgtcgctcggtgccagggtggagctaatgctgggcataccatatacaattctgaagggaagaagtttgcacttcatcttgttccgtcaggcatccttaatgaaaacactcagtgtgtgattggtaatggagtagttgttcatcttcctggattctttaaggaaattgatgggctagagtctaatggaatttcttgcaagggaaggcttttggtatcagatcgtgcccatcttttgtttgatcttcatcaagttgttgatggtcttagagaggtagagcttgggaactcccttatagggacaacaaagagaggaattggaccatgctattcaaacaaggttacaaggaatggactcagaattggtgatctgcgacatatggatacctttggtgcaaaactcaacaacctactaagagatgcagctctacgcttca

SEQ ID NO: 6948 - DNA, 714 bp, Sorghum bicolor
  Clone ID: SORBI-28MAY03-CLUS68083_1
ccatgcagcgagaccagaaccgattcgaagcaagacaagggcttgggcaccagatgacatatttcgaccccaaagcttacccagcatatccaagcaggccagcttcccagcaagcatcggtaaccgctggccggagatgggaatgagcgctgcgcagcagggaattctttcattgccgctgtcgtgccccatttgctgcgatgatcttgacccgacggattcgagcttctgcccctgcccttgtgggtttcacatgtgcctcttctgccacaacaggatcaagttggaagatgggcgctgcccaggttgcaggaagcaatacaacacagtttctgcagcagaaggcgtcggtggtggaggtggtgcaaaagcagcagttgggactggacgagagatggagaagcggctatcccgttcgtgtagcatgggtccaagttactagactgccagggttatactagttctatgttgtagctctaccccattgcatgttactatcagatatgcttgttttttgcgtatcgtctgcttttggtataaagaaatgtgaatatcggaataggtgctgaatccatatagacttgtccagaaactcatctgttttagactgttcccgttgcatgtgatgcatatgttgctggagaggactgtttgttgcttacagtttgtgagataatatatatgccatataaggtgactgttatgtccttatct

SEQ ID NO: 6949 - DNA, 650 bp, Sorghum bicolor
  Clone ID: SORBI-28MAY03-CLUS67997_1
tatgatactccgcttggaaaaatcggtgctctcatttgctgggaaaacagaatgccacttatgaggacggccatgtatgccaaaggtagtcagatatattgtgcccccacagttgattgcatgccaagttggcagtcttctatgacacatattgcccttgaagggggatgctttgtgctatcagcgagccagttctgtcaccgaaagaactatcctccccctcctgagtatacatttggtggcctagaggaagagccatccccggaatctgctgtttgttccggagggagtgtcatcatttcaccatccggaacagtgttggcaggtcccaactacgaaagtgaggcccttctcactgctgacctggaccttggagagattgttcgagccaagtttgatttcgacgtggtgggccactactcgcgacctgaggtgctgagtttggtggtgaagactgatccaaagcctgctgtctccttcacttccgcatcagagaagactaacgctggatagggcaatgacgtcttgaatacctaatgatcacatatcctatatataataacaattgcaagttgtcattgcatgaaagtagtcgcagacttctgttcagaataaactagactgacttccttaataatggccctagtttt

SEQ ID NO: 6950 - DNA, 621 bp, Sorghum bicolor
  Clone ID: SORBI-28MAY03-CLUS61781_1
ttataaatctgaatcagatgatgaaaatgacgacaatgatagctgggacgcccggaaaccgttgtgcagagcttcaaatacgcctgaggaagctccaggtcccatagcgacaaacagcgcttccagccacatttatcagaaagacactactgtcacgtccacagaggacctgaagcccagctcaacatccaagtcaccagaccccagccatgacgcccaagctgctgcagccagcagccaaacggcaggtatcgggatttccatcaagcaagaaccagttattggagtctcaatcaagcaagaggagtcgtccttgacagaaggtgaggttgacggtgacctggaagagtgcgtggagaagctgggtacgatcaaagccagactcaaatacctcatgcagggcacgcggttggaacggcaaagcttccgtgggtactcgtcaggcaaatgaagtggcatcgaagccaggccatcgattgcctgtggttgctgaattttgtgtcctgtgattatagtcctggatgattatgttgtgaatttgattttggggagttgtttgtagttgcaggagagttaatcctgcctagcgttgttaataaaatgctgcaatttgtaggagct

SEQ ID NO: 6951 - DNA, 618 bp, Sorghum bicolor
  Clone ID: SORBI-28MAY03-CLUS61785_1
gttatggtcatcttgtcaaagatgttctttgcaggtgtatcactatttgcagccctcgggtttgttctctatggaggaaggttattcctgatgttgcagcgttttcctgtagaatcgaaaggaaggcgaaagaaattgcaggaggttggctatgtgactaccatctgcttttcttgtttcttgatcagatgcgtcatgatgtgccttaatgcatttgataaagcagcagatcttgatgtcctgaaccatccaatcctgaacttcttgtattacctgctggttgagatagtgccttcggctttggtgctcttcattctacggaaactgcctccaaagcgtgggatcacacaataccacccaatccattagagagcaggccttggtggacaagcaaaggttttctggtggatagtcttacacagcgtggtaaatacagaaggcagagtgaaaagtaccacccgtgctcacgagcttgcccaagctttttatacgaggaaaggctttagaatctcaggttcaaattgtgtgtaaaaatgcaatctctttctctcagatttagaaaatgtaacttatataactttgttattctcagtgcatatcatctgtttacttcgccgc

SEQ ID NO: 6952 - DNA, 675 bp, Sorghum bicolor
  Clone ID: SORBI-28MAY03-CLUS61848_1
catggatgatccagatataaatgacccaatatcaaaagattcacgtgcttctgagccgtctgttgatgaagcaagtgttcaaactctcatttcctttggatttcaggaagatgttgccataaaggccctgaaagcttctggcggtaatattgagaaagcaaccgactggattttcagccaccccgaagcatcgagctcagcatctgctgattcttccactagcaatgcaaatgctgatgacgcatacattccagatggaagtggcagatacaagctgatggcgtttgtgagccatatgggcacctctacccactgcgggcactacgtagctcatgtcctcaaagacgggaggtggacaatcttcaacgacagcaaggtcgcagcatcagttgacctgcccaaggaaatgggctacctctatttctttcagaggattagcaactaggcacatcacacaggcaaataccgtcatgactgaattcatagttcatgcacacagtgaaaaggatggtgggctgttaggatgctgtcatgctgattttaaagcgactgtttgctcacatcctgccatgcttgttaccaactgatcaactgggatatttgctttttctttgagacatcgagtggcaacttactgttaaaaaaaaaaaacccaaactagagggggggcccggt

SEQ ID NO: 6953 - DNA, 651 bp, Sorghum bicolor
  Clone ID: SORBI-28MAY03-CLUS61877_1
gtactgggggataacagaaacaacagctttgattcacataactggggtccacttccagttaagaacatcctcggaagatctgtcctccgatattggcccccatcaagaattacagatacaatatatgagcatgacatggtgcagtacacaggtgccgcatcctgataatacattgtggcaataccacatgttgcaggcccatttttcctttcccggctgagctttgctgacaagtgatatgctgagccgtggggttctttatttattggttgtagcctttcctcaaatgccgattggcaggttggctgacagattagttttttcccctccctacgggcagatgcttgtttgaaggcaacaattcttgtactctgtagctaagaatgaatgtcatataaatgttgcagcagtagatgaacgagcatccaggactataggatgaggatgacagttttcttgttttaggagacgagttggtgctcgaaacttatgtaaaggaaatacaaagcatttatgatttgctcagcttgggttatgtatcttttcattccggatctgggatcaaagattcaaggcaaggtcacccccccgctaaggccttggttgaatccatgtatcctgtatgataaagtttcttgtgatgataaaatt

SEQ ID NO: 6954 - DNA, 665 bp, Sorghum bicolor
  Clone ID: SORBI-28MAY03-CLUS61889_1
tccctcattgcagctcagatatggaaccagggcagtgcttcttcccacaagaagttgcgaaaagcatcaccacgccgatgtttatactcaatccagcatatgatgtttggcaggtagagcatgtgttgtctccagaaggttctgaccctcaaaatctatggcaaaattgcaggacggacattaccaagtgtagctcaaaacagcttgaagttcttcaaggttttaggaaagcactgcttgatgctataaatgaattcaagaagagaagagactggggtatgttcattgactcctgctttatacactgtcaatcaatgaaagctttggcttggcattcaccatcagctgctagaatcaacaacaagacggccgccgaagcggtgggagattggttctttgatcggagggaggtgaaggaaatagattgtgaatatccctgcaacccgacatgctacaatgtggttcttgatcagccctacaaggaagactaactgacttgcagtgttgtggtgattttattcgtaattggctctccgtgagttgatatttgttgagctgaatgcgatcattagctgagttctgactgagacttgtacttgagacctattaaaatatgagaacagtacttgcagagagaattccatacaatatatgggcgttgatag

SEQ ID NO: 6955 - DNA, 602 bp, Sorghum bicolor
  Clone ID: SORBI-28MAY03-CLUS61350_1
gagctggtagaagcagttgaccgtgacctccgaaaaatgcttataaattctacagcagtggaccctttagtccttggtgtccgagtttggccacaagccatacctcagttcctggtaggacatcttgatcttctggaggtcgcaaaatctgccctggaccaaggtggctatgatgggctgttcctaggagggaactatgttgcaggagttgccctgggcagatgcattgagggcgcatatgagagtgccgcacaaatatatgacttcttgaccaagtatgcctacaagtgatggaagaagtggagcgctgcttgttaattgttatgttgcatagatgaggtgagaccaggagtagtaaaaggcattacgagtatttttcattcttattttgtaaattgcacttctgtttttttttcctgtcagtaattagttagattttagttctgtaggagattgttgtgttcactgccctgcaaaagaatttttattttgcattcgtttatgagagctgtgcagacttatgtaacgttttactgtaagtatcaacaaaatcagatactattctgcaagagctaacagaatgtgcaactgagattgcctgg

SEQ ID NO: 6956 - DNA, 625 bp, Sorghum bicolor
  Clone ID: SORBI-28MAY03-CLUS61372_1
aacctatcttagccttaacagggtgtgtagtgcaaacaccctagttctttatgaggggtgcttcccacagctaaaaacgcttgtcttgaagcacatgcctgatgtttgcgagctgaagatcagtgatcgtgcccttccacagattgaaggtttatatgttgtgacacttcaaaaacttaacaaggttccccaaggcatcgaatcccttcgctccctgaagaagctacggctgctgcatctgcaccaggacttcaaagctcagtggcatatgaacggaatgcagcagaaaatgcattatgttccagagctgctcatctagaagtgtgacttaggttccagatgcgctggcattagtttgtggcatatctacttgtaactattatgcaaattgttgagtcctctataagccatcggttattggcattgtcagtaaacctgtgtagcatctataatatgaactagatttgtaatgctccaataaacccttaaatttggaattgttttgacatcaggttgtacaagttgtactgtggttttgatttgtggtatgatccccatgcaagaacctggaccttgtgtactgaattgcataatgtaataaattagttatctggtcactagattc

SEQ ID NO: 6957 - DNA, 547 bp, Sorghum bicolor
  Clone ID: SORBI-28MAY03-CLUS61429_1
cgggtttgtccctgccgcctccaggcgcggtggcacttgggcccttcctttgggtccgtggtgcccctatggctctgaagctgatgagcttttgaaactagctgcagctcggcaacagccgcgccacctctcctccgcctgtgcaccccatccgttgctccgcctctccgcctgtgcgcccccacaactactccacccgcgcgcaaccacgaggtgcaggctcacatagccaagctgagaaggcagttaaccatgatagaaggaatgccccagcaatcaaaagccttttctgtccctggacagcagtttaggcacatctaatgtagcaatgttagcgcacctgattgtaaggaagatgttggaatggaatctttcaacaactgcttgacaaattggatgtgtaactctgtattcacattgaggtggctgccttaggcttgcaaatgatgtactaatatgcagttcactgtgtatattctatgaattgtagtaccattaggctcataagagaacattactaacgtgaccttttgctctatcttttcct

SEQ ID NO: 6958 - DNA, 587 bp, Sorghum bicolor
  Clone ID: SORBI-28MAY03-CLUS61433_1
gtttctcaagggaggataagaatcctcaaagaaattttgtaaagccattggtagatccccaacaatcagaaagtgatgctactggtatcagaggcacaagcaataaacttggtgctaataattcggttggcaaccatcaaatacgacctccgatggcagaaccttcagcaatgccaacagtgggccctctatcgaaagccccccgcttctaagggttatgctgctcttccctattgaagggaaatttcctccttctgcaggtttcgggacattttacatcgaaaacagcccgtaggctctaactcaaggattgctagcaagtggaagcacaataaatccactagcatctgtggcaaactgcagatgcttgtgtcttacaggaaagcagttgctgacttaccaatcgtctccggcagatcctcaacctggggtcgtatgtaactttatttctttttgtgcctgtaaatgcccccatccgttgtacataaatgtttttgcaatggggcattattgtctctagttttgatgttgctgtgtagctgaacaactaccaaagtgcatgatacttatataagttaatgacgtgt

SEQ ID NO: 6959 - DNA, 979 bp, Sorghum bicolor
  Clone ID: SORBI-28MAY03-CLUS61476_1
aagcgaaactgcaaccccgccgtcatgtcgtcccctccgctccctagccaagccaaactccccgccaccggcagctccgccgcgtgcctcccccgcccgcgtgaccgtcacctcctagtccgcggttggtccgccggcgccggcgccggcgctacgcctctcgtggccgcgtcctcctcctcgggccccgcctgctgccatcactactccgtggctaccgccccctccctgcgcgccgcctccacctcctcaaggcgcgggggcggcgctggcctcgacgccctcaccgtcactgcttccgcggttgcagtatctgtgtgcttgatattcttttcggcgattcgctccatgctggcatgtaagagggatgcagagtttctcgagaagtactttgattcagcaagagagaaactaccagaaactatggcttcagtgagactggttgggagggagataggtgatttggctgcagatcttagtgatctaagtcaagaattaacaaagggtgtgaaaaattctatgaacattgttcacacggccgaggcacaacttcgccagtcgccacgttctaccctgccaggacccgcacggagaatgtctaatcagaagaacgtgacagaggagccattgctagctagcactgtacgagatctgcgtcagttgactgcggatatccggacaggatttggagcagcggctggcatcgccggtctttccatgtgggcgttgaaatttggctcaaagggccgcaagaatcgctcatagggtacaagaacgttgaagacgaggaactagttttgacctcgttttgctgttgctccaagcatgcaatttaacacagcattgtactgcgtaattcaaaaaaaaaaaaaaaaacgatccatgtagttctttgagacatgttaggagattgttgtatagtttcaagtaagggcctgtttagatccctttaaaattctaaaagtttacaagatctttt

SEQ ID NO: 6960 - DNA, 715 bp, Sorghum bicolor
  Clone ID: SORBI-28MAY03-CLUS61440_1
ggaaggtggatggttataagatggtatttatgtcatgcagagctgagggttctgtgatgacaataaggaaggatgagtaccccaagttctctcaccagattccctgctttcgtctcacacatgaaaaaggtggcaagcttcgaggctatttggagctcgatcccttatcactaccagaggaatttctctactgattcgatctgagataaaccttatcagcaacgaatctggagccttcttgtgatgaagtttctggagctgaagctcagtgaatgttaaggtccacaattcaacattgttcaagtgacactgatataagatgtctatttcagcattcgtagcactaacgttcttaaggtggactagcaatctgcacaacgaaggcattgactgttggactttttgctggatagctgtactgcagctgcaattcacaagtcgagtaaattgtttgtagctagctttagctgtatctagggtcttagttggtgtaaaaactgccacttttcttctcttgtagtgtactctggtagtactgtgtttgaactgtgggatgccagcctgattaattatcagaagagttcttttggccacccttccctggaactgtaacataaaatcgagataaagccaggtcaggctgatgatcagtgtgttatgcttgtgttgctttgcatgggacaaatatgacatcctcctgcggcttatcatttgt

SEQ ID NO: 6961 - DNA, 556 bp, Sorghum bicolor
  Clone ID: SORBI-28MAY03-CLUS62059_1
cttatggttttgacattctggctacctataaatttggttccttgcaattggcacatgatgcaaacttgttgcgtgtgcctgatatacggtggcttggagtcttcacatctgattttgaagaatattgccttccagactgctgcctacttcatttgtcacctgaagataggaggaaagctgaacgtattcttgctagatgctatttacacagggaagtcccagaatggaggtcagagttggaagcaatgttgcaaaagggtgtcaagtttgagattgaggcactatctgcaaattccatttcctttttatcggatgaatacattccccagaagatcaaacaaggcatgcatttataagattggacatacctgtacccgtccaggacgtgtcttaatatgatcttttgttttactagagttatgtccttatgttgccttcatggctgatcatctgaacaaatgtatcttttaggttgtatatttcatgttattggaagttaaatcgctgtaagagttgagatacaactatttgaatagaagtgcttacgttttctccg

SEQ ID NO: 6962 - DNA, 689 bp, Sorghum bicolor
  Clone ID: SORBI-28MAY03-CLUS62104_1
agccaaattattactaaattggctgggcaggttgttaccatgagccaaaataaatctgcatcaaatgtgatagagaggtgttttcaacatggtgatattgcggagcgggatcttctgatcaggcagattgtggagcagacagagggcaatgacaatttgctggcaatgatgaaggaccagtatgctaattatgtggttcagaagatacttgaaacatgcaatgagaatcagcgggaactcctgctcagccgtgtaaagggtcatatgcaagcattgaggaagtacacatacggcaagcacattgtaagccgagttgagcagctctgtggtgatggaactgccgagtcggattcttgaaaggaaccgcctaattcttcataggccaggggtgtcttgttcttttgctcagtccatcagtgaagaaagcaaaaacagatcaagtccaactctggtgcttctaaacagactaacaaaactgtcgtcgaagattgtataggtgtgactcttcaggatagtcttgaggttctagaacagaagcgtagtggtgtgcatcagtgtatctatgttagggtgtgcctatttacagaataatagtggttgttagctgtgtgcaaaaggagtttagcgttatggtttgtatgcgatacatattaactgtgcctggtaatgtatttgctttcttccatcgc

SEQ ID NO: 6963 - DNA, 541 bp, Sorghum bicolor
  Clone ID: SORBI-28MAY03-CLUS62150_1
agtggagggtaccgtaccctcgctgatcatcagcaggtttatatccacccgagcagcgctctctttcaccagcagccacagttggtgatctaccatgaaattgttatgacaacgaaagagtatatgagggaggtcacggcggtggacccaagatggttagtagagttggcaccgaggttctataggtcagtggacccaatgaagatcagtaagcgaaaacgccaagaaaggatcgagcctttgtacgatagatacaatgagcccaactcatggcgcctgagcaagcgccgctggtgatttttcatcatttcttgcagagctttgatgtaatgctactgtagtgtatatattaaggtgctcttttaatgcatatgctcagatgattgcaatgcatgatacatgtatagttttctcttcttaaagttgtaaggcttgtaaggagtactttgtccccctttgaacaggacgccaaattgatgatgagcttgtcacagtgatttccttgttttcaaaaaaaaaaaaaaaaactcgagcctcgtgc

SEQ ID NO: 6964 - DNA, 733 bp, Sorghum bicolor
  unsure (1)..(733): unsure at all n locations
  Clone ID: SORBI-28MAY03-CLUS62256_1
tggcccatagaagagactgagacaaaatggttgcaatttttggataagcataaggttaccaataaggagtcatggttgtgtcagatgtatgatacgagggaaatctggtgtgcttcgtatcatgctggtaagtgctacttaggactaaggagcaaccaaaggagtgagagcctaaactctaggattcatatgcgtctagatcgtaaaatgacactgcttgacatggtacgtcatgtggaccattgcctttcagggctgcgcgcaaatgaggcaaagttggacaccgatgcattgcaatctgaggtatgcacagatccagatgcttcaattattgagatagaagccgtgaaatcgttcactccaacagttttcgccatggtgcagttcaacataaaagcagccaagaagtgttttttgattgagattgaggatggtgataatatgagtgagtatattgtcggcaggaaggataaaggagacatgatgtacttcgtcaaatgtgaattttgtgatgaaggcaatcttaaggaaatttcttgttcttgtcgtaagttacaatcgattggaaccccctgctcacacatctagaaccttctttatctttttctccgaaatgtttgtctacacaccaagttctcatgtagaggactattagatcaccncatagtgagtgatataagaaccatatgtagtgcccataatgttgtttaaatagcaaagggtaatttcatcg

SEQ ID NO: 6965 - DNA, 1047 bp, Sorghum bicolor
  Clone ID: SORBI-28MAY03-CLUS6159_1
gcacgaggcccagaaaagcccaacgcgatcacacgagcgggactggggagtagtgagagggcgagctcctccctgcgccgccgccaaaaccctcaaaacccgagacgccggcggcgaagaggagagggcggaggcggagatggcgacgcgggtgaaggacgtggcgcggcggtcgaccaagaagtacgtggaggaggcgctgtaccggcgtctgttccggaaggggtccacgccgcaggcggtgcgggaggaggtggacggcttcctcgacagccggaagcgggcgtttaagtgggaggtgggcgtttgcgtccgccggatgcggcggaacgcgctctaccgcccggcgctcaagctttctgaagttatgacaagaagaggcatgaatcctactgttagtgatcaagcaatctgcctggatctcattgccaaatcgagaggcattgctgctgccgagaagtactttttggacctcccagaaacgtccaagactcatcttacatatggcgctcttctcaattcttactgcaaagagttgatgactgagaaggccgagtcccttatggcgaaaatgagtgagctcaactttgcttttactgccatgccctttaacagcctaatgactatgtacaccaaagttaaccaacctgagaaggtccctggtatcattcagtacatgaaggcagatgacgtattgccacatgtctttacttataatgtttggatgagggcgcttgcagctctcaatgacataccaggggttgagagggtgattgaagagatgaaacgggatggccgtgttgctcctgattggacaacatacagcaacctggcttccatatatgttgatgctgggctgtttgagaaggcagaggctgctcttaaggagcttgagaagcggaacaccagcaatgacgtggaagcctaccagtttctcattacattgtatgggcgtacacagaacttagtggaagttcaccgtgtctggcgatcactgaagcggaataaccctagaatggcaaacatgagctaccttaacatgattca

SEQ ID NO: 6966 - DNA, 971 bp, Sorghum bicolor
  Clone ID: SORBI-28MAY03-CLUS61698_1
atggggctttgcattccagagagactcccccctcgctgcagatttatcaaccgccatccttcaactttcagagagtggccaacttcagagaatccacgacgagtggttctcacggtctagttgctcctcagatgacagcgaagtgggagcaaccaggcttggcctcggaagcttttggggcctcttccttgtgtgtgccctgatatgcctcttcgctctgctggtattcttcatacgggtctgctggcagtacaaccagtactccagttctgaatcttctggcgagcccagcgcagccacccctggtcctgtcataagacagcggcgactatcacgccttggcagcttcaaagagctgatccagtttgtcgacaagaaggaggaggagattaagaaaacgatgaaacgaagatcaagcgataaagatagccaagctgcaggattctcatacgctcagtcagtggcttcagcttaggccttgttcagttcgcaaaaattttaaagattctccgtcacatcgaatctttggtcgcatgcatggagcactaaataaagacaaaaataaaaactaattgcacagtttatctgaaatttgtgagatgaatcttttgagcttagttacaccgtgattggacaatctttatcaaataaaaacgaaagtgctacagtagcaaaaaaaccaaaattttgtaaactaaacaaggccttaggacagtctttcagatatctgtccttcagatggataaatatggcaaagcaggggaagtacattaccaaccatattgaattaggctattgtctccaaaagcaaaacaaatcgatgtaaatagtaaatagtgtatttgatctaggagtccattccttatgcccctgatatatgctgtttgtatttgacaaaactgttttcagcaattgaccattgctccaggctgttcaaagtggtttatttcaattgcttttcggcaggcgcc

SEQ ID NO: 6967 - DNA, 520 bp, Sorghum bicolor
  Clone ID: SORBI-28MAY03-CLUS61709_1
ggagaaggcagatgtatatggctttggtatagtactttttgagacaataagtggaaggttgatccattcttatatgaatacggagggcactcgaaggctaccgcccccttcttacgcacacaagtacgaccgaaagaaactgcacaagcttgttgatccattgatgtgcgtgaacaagcatgaatgggatcagattgtcgaatgtgtgagggtggcacagttatgtgttcaccatcttgccaagcatcggcctaccatgtcagaagttgtcaccatgcttggcagcatcaaggtgtcacagagggcacatggtaaataatagggcagtgtattagaaatactaaatctggttgaagctttggggaagagccacaaagggatagttgtaaatgctgaaagtgtcaactgatgagctactcaactaaggccttctttggctgccctaggctttgtatggagatataatatgtacgttattactccctccatcacaaattataagtcattcaaactttcttgg

SEQ ID NO: 6968 - DNA, 628 bp, Sorghum bicolor
  Clone ID: SORBI-28MAY03-CLUS61717_1
tgctggaaagagccgaccagcatgcagagaagtacgtcagaagaggaagattgaactggccagaaggagcagcaacaaaagagagcattagagctgttctcaaactgcctcgccttcagaacctggtgatgcagcatgtggatcactctgctggggacttcattgaccttctgaagcgcctcctagcctatgagccctcggcaaggttgactgctcaagaagcgttgagtcatgtcttctttaccagacacggcaaaaaccaatagccacgacatctcagatgatgctatggcacatttatctgacagagaactgacaaaatccagagacaattggtgagctctgaggatttagaggcaagagatacaggcatacagccttgtgctggtagacgtggtcgctttatatgttgtgactgactgatttgtaactgaacccattgtcctgcctccgcggttgtacctacatagattgtagcagatcacaaggagccggtctggtatatgtgtgtgtgtgtgtgtgtgtgtgtgtgtgaagattgcagttggataccaatgcaagtgtaatttaatcaactggtacaattttttctttgtaaagtgcaagttcgtacaacaccagtttcgtt

SEQ ID NO: 6969 - DNA, 662 bp, Sorghum bicolor
  Clone ID: SORBI-28MAY03-CLUS6177_1
gccccgcgctccctcggcagccccgccggccccgagcccccccccgcccgccccggcgcgcagcccccgcccggcgccgcgcgcagcgcgccgcgccgctccgccgccgccgccccgcgcgcgccggaggcggctcggagcccacccctggtccgcgccgcggcggcttcgcacgccggttcttggtacacgaacaatgccaggaagctggaagaggaactcaatggttggctgggggcagctggtctaaccaagtctcctgatgttagggcagtaattgcaccccacgctggttattcatactcaggccgatgtgcagcttatgcttttggcaacatcgatccaactaacatttctcgggtgtttctgcttggcccttctcatcactactacactccaaaatgtgctttaactagggcttctgtctattgtaccccaattggggatttgccagtggaccaggaagtcatcgaggaactcagcgccactggaaaatttgaatttatggatcttagtgtggatgaagctgaacatagcatggaaatgcatctgccctaccttgctaaagtatttcaaggacatactgtgaaagtcgtccctatccttgttggtgcacttagctcccaaagtgaagccatgtatggacagctgctctccaaata

SEQ ID NO: 6970 - DNA, 536 bp, Sorghum bicolor
  Clone ID: SORBI-28MAY03-CLUS6264_1
gcacgagggcaccctcgcgggccgccttctcttctccagcgtccgatctcccactcgcctccctcaccgcagctctctctgctcggtcgcttcgccccccctccgccctctcccctgcgcgcgcgctcgccacctcgctctcccctccctccacgtcgcccgtgcccgcgcttatataagtgcaggaggagctcatggcggacgctccggcgagccctgggggcggcggcgggagccacgagagcgggagccccaggggcggcggaggtggaggcggtggcagcgtcagggagcaggacaggttcctgcccatcgccaacatcagtcgcatcatgaagaaggccatcccggctaacgggaagatcgccaaggacgccaaggagaccgtgcaggagtgcgtctcagagttcatctccttcatcactagcgaagcgagtgacaagtgccagagggagaagcggaagaccatcaacggcgacgacctgctgtgggccatggccacatttgggtttgaggactacattgaaccactcaag

SEQ ID NO: 6971 - DNA, 677 bp, Sorghum bicolor
  Clone ID: SORBI-28MAY03-CLUS62662_1
tgacaatacaaagtcaggaaaaggtagaaatgctccaaaaccagcaaagggaagagtgaaggcggcaaaaggctcatcaaacaaagctacaaatactagtgatgatggcgacaaggaggattatgaagtggaagaggcaaaaccagcaaagcggggaaggaagcaaccagcaagggtatctaatacctcatctaaaaatgctggcagtattcatggtgatgaagctactgatgaggtagatgcacgtccagcaaagaggacaaagaagcaaatagaaaagaccacaaagcgctcattgaaggaagccaatcatgaggacagtgatgaagaagcacatgataagatagaagccaaacctgggaatgcaccaacagaggaaagcgcaaggaggccgcacatgaaagagcttgccaaagaaagttgatgcaggcccagcaatgagaccgcagaggaaagcgcggcaggcttgagcacgctaggagttaaacaatgtattttgcagttagattctcaactggcttaagttttagttaacttaggtactcgatgtggtgcagaggagcccgtttcttctgctgcaccggcacatgatattgcatcagctggataacggtcattttgttgcttatggccagatcgacagattgaaatatgctaatgcagttgtgtaagctatt

SEQ ID NO: 6972 - DNA, 826 bp, Sorghum bicolor
  unsure (1)..(826): unsure at all n locations
  Clone ID: SORBI-28MAY03-CLUS62682_1
attcagaaccatcacggtagccttccatttgttcaagctcaaaacaattttgctccattcatgtccctagatggggatgacttcccagcaaattgagggtgtcaagagcaacctcaggaacatgtagcccttactagaaggcccattctaccctgtgaagcttaccaagggagcaacaagtgccgtttgtatgacttgtggaactgaaaatagtaaaagcttgtgcctgttgcctgaccttggcatcctccctgaaattgcaaccatgctctcaattgtgacagccttgaaaatatctggttgatgtggttcggctcatttgtggagatgtggtcaatgacataagatacatgcttttcccaaagccgtctgtttaagtttaggcattttttgttgttatcattcttattcattcagtcattaagcacaacctcagattacacagcgaaaaaggaatttctgaatgtcttgatagcttcagatttatacactgtaacattgtggggacaccaatttcattagactaatcattcttttccttgcgacatgcttttttgcctattaaggaggctgctaacttcccagcctctcttctgtaatcatgtatggtgtggagctaaactggtaagcattaggcaaaaacctttacctcgttcaggtaactggatttctgttctatcnagggtacatttttggcttgtattttatctgagcatagtggtctagttgtccagcgcagatgcatttttcacaggtgaatgtttgaaagcttgttccatatcggctcaagtttgccttgtttagttctaaaatttttttggtttgt

SEQ ID NO: 6973 - DNA, 846 bp, Sorghum bicolor
  Clone ID: SORBI-28MAY03-CLUS62701_1
cggtatccgcgaggaactggctcacatcgcatctctcaaggcttccgctgccgcaagcaacgacatggtgttctttgagtcggaggagactaaagacctagtctaccttcaggcagccttgttcgagtccctcaggctgtacccaccaggcccattcgagcgcaaggtggtgcttgccgatgatgttctcccaagcggccaccggttgtgctccggcgaaaccatcctgatctccatctattccatgggcagaatggaagccctgtggggcaaggattgctatgagtacaggcccgagaggtggctctctgaagatggcggtaagctgcggtatgtgccatctcacaagttcatggcttttaactcagggccgaggatgtgccttggcaaagacatagcagtcacgcagatgaagacaattgttgcggccgtcacatggaacttcgatttggaggtgttggaagggcagagcatccagaccaagctgtcgtgtattctacaaatgaagaacgggctcaagatgaacgttaagaagaggtaggaaggaaatgatctacaataagctagttgctgttatcatgagcaaaataagttaggtgcagcacaacctacaaactaaggcatgcggctttatggggtttcaaacgtcaatatctctcaacagtacatattatcacaaagatattatgagccaaaccgcgaaatgcaaacatgtaataacaataaatctatcctcatcatgtactatgaagcatatgttttcctccatttttgcttaccatcatatcgtttgtacgcacctcaattttttgcttattggtttgtatgaaaataatcctttaaact

SEQ ID NO: 6974 - DNA, 671 bp, Sorghum bicolor
  Clone ID: SORBI-28MAY03-CLUS62719_1
aacaagaaggcgatttgaagaggcattgtctgaaagagatggagaaatcagcaagctaaagcaagagcttgctgatgcttctgaaaacttgcaggaagagaagtatgctaatggcttgcagatatctgagctgcaacaatcggttgaatacatcgggtccaaactagagaaagtttctgaagagaaactactggttgagaacaaggttaaggagctggaggcaacaaatgctgaagctgataagtatggtcaggaactaacccaagctgccgagaagctttcagaggagaagttcaggcatgaagctgagattctcacgatgcagcagaacattgaagatctgaaatccggaatcgagagccttgctcgagagaaatccctgcttaaatcatggtttgatgacttggagcaagttgtggggcgaggaaggagcattttggttgagtaaccaagtttatccaaaagcatcagtagctagaatttagcaacttagcaacattttattctattttctcatacgcataccatcttgcgaaattaagatatgtcagtgtactttcctttccttgctgaatctttacttggacgtgaaacgtgatggatggtggtgatgtactggcaatatatgagatactatactgtcccatgatgcatcttgcacgttcagtccg

SEQ ID NO: 6975 - DNA, 614 bp, Sorghum bicolor
  Clone ID: SORBI-28MAY03-CLUS61913_1
ggttgtgtcattgccccactcaccttttggctttactggtcggctttcgacattggtaaccctgacggcgcattcaaagctccatatgctgtaatcttccgtgagatgtcaatccttggtgtcgaagggttctctgcactgcctcagcactgcctagcgatctgctcatttttcttcattgcatctctagtgatcaaccttcttagggacatcactccaaagaacgtctccagattcatcccaatcccgatggctatggccattcccttctacattggtgcatactttgccatcgatatgttcgttgggacagttatccttttcgtctgggagagggtgaaccgcaaggagtgtgatgccttctcaggtgcagttgcctctggcttgatctgtggtgatgggatctggactgttccttctgcgatactttcaatccttaggattgacccacacaatttgcatgtatttcaagccatccgttagcagctaaaattggaacaagtgttatccgttatctggatatcacaagagggcctacctgtgtatatctttactactccatgtaaattgtactaggaagaaaagctgtagcctaatgcaatctgtcgattctt

SEQ ID NO: 6976 - DNA, 693 bp, Sorghum bicolor
  Clone ID: SORBI-28MAY03-CLUS61953_1
cctgtcgcttgtcggtgccagtctttccctctctctggaggcgggccgcggttcggacatgctttttttcccacctttggggtattgtttcttctgccgtgatcggggctcatctgcttctcctttctccgtctttcccctgcagttactttaggtgtaagacttcagatatatgcatagctatcttgttccacctgtgactgttgtgataaattttagatgtaacaatatagggtatgcactactcacaggtgagattgaacacgaaaaaggtgcatcaagtcatgaataaggaagaagtcatcttaatttgtcagttttcagattgagaaccaattgtgctccagaagtgagagaagagatctgactagctgacatccacatcaagagaaatagatgaagcagctcaagcaagagctagaaaaggaagctgaagtagcatcttcttctaaatcttataacttgtgagaatgtttttctgatcccctgatgtggagttaactcattatatttaatgtaccgaaaggagtagtctcagtgtgaagattgaacttgggatggtagctttggtctctataacttatgaagtttggatatttccagtgaatcaaatatgagaatagttttatggaatatttaaaatgttttttcaaatatgagaatagttttatggaatatttaaaatgttttttc

SEQ ID NO: 6977 - DNA, 644 bp, Sorghum bicolor
  Clone ID: SORBI-28MAY03-CLUS61915_1
ttgcctccaacgcctaggaatttatggctgccctcagttacttcagtggtgccaatcaaaggagaatgagatgaagctcgcacacatcaaagaaagagaatatcaaggggagcctctgcccgaggaggtccataaacaacagcgacggcagcgacggctccagaaggcgttggctttgagcaggccacgacgcaggccaggaatggggcgaaggatgaggcccgccatgcagaggcaccaagaaccattttcatcgccgaacgaaggaaggtcccttgtggcaacaaagattccgagtagctgatgggcctccattgggcgcaggattaggcccataaagcaaggtggttaccaaggaagaagacccaaaatgaccttagagggatgtgtttgtatcggcatatttccaaggatatgccttagttgtcgaagcgcaaaaatgtaaaatggtaacctagtgaatagtgccttataaaaggggaaaccaaaccctatgtgaagggaggtagttgagtaacatttatgaaaccataattctgcatgaggccacctggggcaccccaccattactcacttgttgtgcctatatttgcttatttgcacattcatttttactatcataagattgtataccaactgtatgt

SEQ ID NO: 6978 - DNA, 727 bp, Sorghum bicolor
  Clone ID: SORBI-28MAY03-CLUS61954_1
tgtgatgcgacctatgtttggtgcatttggaaaggctggaagttccaattcaattgcatttgtgagcaaggctgctaaagaagctggtgttgcaatggagtacaaattagaaaagagggtggaagctgttggcggtgttcgaggtttgacaaagcttgacatgaagctcaatgacgcgcttccgagaatagaagtcgacccagagacctacacagtgactgctgatggagaggttttgacatgccaaccagcacccacagtaccactgtctcggaattacttcctattctagtagaaagctactgcatcatcaaacttttttttttctggagaggctacacggagaagacgtactcacgcacaccaccacaactcacgccctatgcatgtacatcatatacgacatatcctatacgcatgcttcagcaattgtttcaggacaagaggtgtgactagtcacttccatcgatcagaaatgtaggttcatctaggtttattccaagtcaaacttatatgttgctgacgatccaataacatatataaattacccccaccaagattcactatattatgaaaagaaaattctcaataatgattttaataaaaccaaatcttgtgttgataatccatataaaatttttgacttggacaaacctagacccacttatatttgttatcggtgaaagtatgatttttctatggttaacagatgcaagttccctctttt

SEQ ID NO: 6979 - DNA, 610 bp, Sorghum bicolor
  Clone ID: SORBI-28MAY03-CLUS61992_1
tccctcagttagctgttcaggatatctgggataacaatgggcagcgaagggtgcatctcaaactttcacttggttccttatcagaaatttggacctctgtgctcaatattactgggccactatcaaattggtcctttgctgataacatgctcccagctcctcaaactgtaagtggcgggccaccatcatatatttgtcgactcagtggaaagagtgatatggattggtctttctggttggaggcaaactcttctgatagtctgagaattgatgtcgcggtacttgaccagtatcttgttgacagcacaaagaaactgaagagcctcttcccaagttgggcagacttgacagccttctcaacatttttctcaacgtatcatttatgaggcggccaagtatttgttgtccaacaagtgtaaatcatttgtcttttgtagaggggttttgtagagggggagatatggaactagtcctatacgtttcggggctatatgtggttttcttatcatgatcagctggccctgagccatgaagaagctggtggtggttgtaaaatctttgtaaccgtaccttgatatagccgtgaatcacacaagattgtaagaatctc

SEQ ID NO: 6980 - DNA, 939 bp, Sorghum bicolor
  Clone ID: SORBI-28MAY03-CLUS62022_1
gcacgaggaaatcctgacctaattgaccagtgcgctagagaggattttgttgagagagttaaaactcagcaagatgaaggctgcaacgtccatggctttttagatgtcagtaaagttgctggaaattttcactttgccccaggcaaaggattttatgaatcaaacatagatgtgcctgagctgtcagtacttgaaggtggtttcaatattacccacaaaataaacaaactgtcctttgggacagaattccctggtgttgttaatccacttgatggtgctcagtggatacagccagcttcagatgggacataccagtatttcataaaagttgtccctacaatatacactgatataagaggacacaatattcattcgaaccagttctcggtaacggaacattttagagatggaaatattcttccgaaaccccaacctggagtatttttcttctatgatttctcacctataaaggtgatattcacagaagaaaatagatctctactccactacctgacaaacctttgtgctatagtgggaggtgtgttcacagtctctggtatcattgactcgttcatataccatggacagaaggcgctcaagaagaaaatggagttaggcaaatacagatgatcaacttcaaccttgtactggccccattgtttccaaattttgtggcatgtaaggagggtatatgccagctaaatatgacgagatgccacttacgttgctgaggttgcaaggccatcaaactgatgttattgcacgttagctgatcagataacctgtaaaaagacaatgagtatagcctggtctggggaagtcctttgatgtttatcattgttgactgtcgttgaatggcctgaactggtgcggaggtggatagatcatagatcacagaatgtttctcatgaaagtttgttcaaagaaacagcttcactc

SEQ ID NO: 6981 - DNA, 817 bp, Sorghum bicolor
  Clone ID: SORBI-28MAY03-CLUS63104_1
gcacgaggcattattgatgcaaaacttcctcaaatagagaagcaccagttgtttgcggagcatcaagaaggggcaaggaaaggatgggcagccttcatgaagtctataacacttcctcaaatagagaagcaccagttgtttgcggagcatcaagaaggggcaaggaaagatgtagagcgtgcttttggggtattgcaatcccgttttgccattgttcgtcggcccgcacgtctatggaagagaaagagtattggaaggattatgctcgcttgtgtgattctccacaatatgatagtggaagatgaaaaagaggatgttaatattcatattgacttgaatgagaatccaggggcatcctttgctctacctcctgaagtgaacactagtcgtaatccacgctttgccgatgtcatgcgtagaaaagctgctattcgagatcgtccacaacatacccaacttaaaaatgatctcattgagcacatttggtgtaagttccgaaataggcaacataactagtcatggaccgggcatggcgtgctagaagctgcagatgctacttgcagtgtcatgacttttgatgcaaatgggctggctggtcgactctactgaagtcaagccatcaactatggcttcatgtttctatcagcatcgtctagatgaataaataatggcttatgtgccgatgaactttagtattggttaaaattattgcttttgtataagaccgatctttaagtgtcatgtcttggtgctattccaccgtatcattattgtattgttgtttgagatttgaaatttatctggtattgtttctttt

SEQ ID NO: 6982 - DNA, 696 bp, Sorghum bicolor
  Clone ID: SORBI-28MAY03-CLUS63103_1
tgctggtcgacgtaggcggcggcaacggcaccacgttgcaaatgattagaggtcaatataagaatatgagaggcataaactacgaccttcctcatgtcattgcgcaggctgcaccagttgaaggtgtggaacatgtaggtggcagcatgttcgataatattccacgcggaaatgcagttctgctcaagtggattcttcatgattgggacgacaaggcgtgcatcaagatcctaaagaattgctatacagctctccatgtgagaggcaaggtgatcgttctggagtacgttgttccggatgaaccagaacctactcttgcagctcagggtgccttcgaactggacctcaccatgctggtcacgtttggcagtggtaaagagaggacacagagggagttctccgagctcgccatggaggccggcttctctagagagtttaaggctacgtatatctttgccaacgtctgggcccttgagttcacaaagtaatagctcgcactgtatgtgtaagagcgcgtgtaagtcttcatgatgtttgttctgcgtgtaatttatttgttacctttataagtatgtgccctgtagcctgtaggggtgcatgacacctagaataaagcatggggcgcacacagatattgtgtgtgttgcatcagtgtattgcattgaagttatatatgtatgcaaacttgcaaaggcc

SEQ ID NO: 6983 - DNA, 710 bp, Sorghum bicolor
  Clone ID: SORBI-28MAY03-CLUS6323_1
atggccaggagcccgagaattactggtaccgagtttgcgaagggcgagctgccaaagtcattcaaaggccttggtatgctatttggaagtcgaagaggctgatgaacattgtgactgagattgcaggtaggatggattgggattatgatggcttgcatgttgtccgagggtggaaggcgcagaacaagcaaatgtatccaaacctggattctgacacatcgcctgatgcacttgttgataaggtgaccaagcttgttaagccatggagaaatctatacatcgcaactaatgagccgttctataactacttcgacaagctaaggtcacacttccatatccatttgcttgatgattacaaggagctctggtcaaacactagtgaatggtacaatgagacaacaacgcttagtcagggtaagccagtgccattcgacgcatacatgagggtgattgtggacactgaggtattttacagatcgaaggcacaagttgagacattcaacaacttgacaagggattgcaaagatggaattaatacgtgcaacttgtgacacatgagttcacgttttgtttatttattggtgttcatatgctcttccagtggctggcacatcagaactcagtggaactcatccagggtttgtcttttggcataccatcgcaatgtatttcttgttatggaatgtttaattggtttcatgcttatctga

SEQ ID NO: 6984 - DNA, 914 bp, Sorghum bicolor
  Clone ID: SORBI-28MAY03-CLUS63247_1
gcacgagggaagaattcttataagcaaggctccacctgtattgacgattaacttgaacagattcagccaagattctcatggtcgatataaaaaactgaaaggacatgtgcgctttaaggagatgcttgatatacaaccattcatggacccaagatgtaacgagaacaccaccagcacctatcgtcttgttggtgttgtcgagcacttgggaaccatgacgggaggtcattatattgcgtatgtgagagcttgcaagattggaggtcggcagcagcagagcagtggctcaaagtcttggttttatgcaagcgatggacaagtcagagaagcctctctggaagaagtgctgaactgtgaggcttacattctcttttatgagagggtgggcgactaagataaaatctgtcagcctactcatcagttagtcagttatcagtgcaagatcactgggggtaaacttgggaggtgaagacaacttctttttgtgggcacggcccaatgagtttgcataccaagtccatttgttccttcgattgagtcgctccatggccctaggtggcttcattaccattcatttgcttggtcgaagagattttcacaattggacttggacagaactgttcatactcccctacagccgttactttctcctttattcttctttttggtcttgaagaacatagctggtggtctggagattggtcaaaattggcagggctctgttgaatggttcatggtcaacttgaaatttttctttggtatgtgcatgcccctagattttgagtgatgggggcactgtaacaggtttaggatccatcctgtagttgcaactatcacagctgttttcacaactcatcacccgagatttttttataatatataaatattcagattaaaaaaaaagtataaaaaaa

SEQ ID NO: 6985 - DNA, 658 bp, Sorghum bicolor
  Clone ID: SORBI-28MAY03-CLUS63256_1
gattgttcacttgcaaaacctcctgctgataagaaggatgatactgtatcagcacctactgcaaaaggagctccattactcccaagttatgccccacttggatatggactggtgggagcttataatccacttggaaatggattggcaggtgcttataatccccttggaagtggactagcaggtgcttatggtgtgctttctgctcgtgctgcacagccaatgttgtacgctccaggtgctcctccaggttcaacaatgatcccaatggtcctaccagacggccgtcttgtatatgtaccacagactgcagggcagcagcctgtgcatgtgacttcgcctccgccacagcaaggtggtcgtcgatttggcggtagcggcagtagcagcggtggtggtggatccagctctggcgggaagcgacagaggggagatgaccgcaggggccggcaccgtccatattgatgtttgcgctgattatagcaattagaagttagaaccttagcagttagcattatttgtggcagtaccatgctgcaaactgtacttcagttattcgttttctggtgtgcctcgtaataagaatgatagtacccgcaagtggcagatggtactgtggtagtatagtctatacattcgttaatctcgaagaatgtgttct

SEQ ID NO: 6986 - DNA, 502 bp, Sorghum bicolor
  Clone ID: SORBI-28MAY03-CLUS6233_1
gcacgaggccgactcgtgcacagcagcaccgcctcgactcgggagggagaaggagaggggaggcagggcagcgcggagccctcctcctccgatccatcgccgctctcgacaatctgcgcgtctgctcgtgctcgacgacgatggatagaatggagaaagcagagagatttgtacagttaaagaaattggcaggctctgtgatatcatattggtcaatcatatctgttcctgtggaagagaagctaaacttcgtacctttacttcattatgctaaggccgagtcagtggatgagatacctgaacacattgctgtttcagaggacttcatgaaaactgtggaaaatgaaagtcataggcttgagaagattgtggctgagatgattgtaaggaagaaatctaaattggctcagatttatcaaaggactcgtctcgagtctccctttgctgggcaagaaccctctgttacttctgtggctttttaactagtcaaggagcaaatctc

SEQ ID NO: 6987 - DNA, 718 bp, Sorghum bicolor
  Clone ID: SORBI-28MAY03-CLUS62362_1
catttcactagcatatggcaatattaaaatgcaggttggaattaagaggatggtcacaagtaattccgaatctatcaaccagactatgaagtttacacataacagtggtcgtcgtcttgatctcaggactgatgttgaacaccagaagaaaaatacaaacaatgtcatttctgccaagcaatctgatgcagccaagactgaaggccacagcaatcaaggttatctcaagggcttcaaaagatgttcatcagctgggttcaagtcatacatatttgttgccttttttgtggttggagttgctgctgcagctgcagcgctgcattatcaccgctctggtgccaacctataaatttgaatcatcaaagatcagcacgcttagttgtagctctagtgatcagcggcagcattggcttgagcttagaatcttcccggcttcatccttggagtagttcgtcagcttggggttactggccttctggggatacatttgtgtgaccactgattcccagctatctccacacgttttttttgtggtgctgtacatattaagttttttcttcttttttgatcgtctagttgctaccaacgggtgcctatcaaaaaagaaaaaaaaagggaaaaagggttgggggtgtatgaacaaaaaaagatgtagctttggcttttgtaatctgaaccatgctcataaatgatagtggatgactacattattattaaa

SEQ ID NO: 6988 - DNA, 738 bp, Sorghum bicolor
  unsure (1)..(738): unsure at all n locations
  Clone ID: SORBI-28MAY03-CLUS62488_1
ttctttcctttgaggataccatacatgttttactacgtcctcatattattgcagtattgttctcttactttccttaacgaataaatacatatgcattaactattattccatnggctatgagtttggaagagttgctgccaccaaaccaacaaaagtattctacaataatcatgcttagatcatctctggtgatgtcaaccctcctgattgctctatctgtgcctttctttggacttgtgatgcccctggttggttccttgtttgccatgcttgtgacctatattcttccttgcgcatgttttttggcaatcctcaagacaaaagtggggtggcatcagatagcagcttgctcgttcatcatagctgtcggggtttgctgtgcctgcgtgggaacatactcatccctgtcaaagataatccagaactacacataatacagctgttcctgttatgcagctgcccaacaaaatcatgtgtgtgctatatgggccaagcatatacaagatgaaagtttaccctgcaattcactctatgcataataaattattggtgtcttatcatagggctcaacgatttgtactatggttttaaggtggtatatcatgcgtaagtaacattgttccttatggtgcgcaaaaaacaagttgatttggtattcttgcaattttatgatttgattgtatcaaaagttgaatggagcaagagtccatgaacttaataggatgtgccacttagttc

SEQ ID NO: 6989 - DNA, 718 bp, Sorghum bicolor
  unsure (1)..(718): unsure at all n locations
  Clone ID: SORBI-28MAY03-CLUS62496_1
tggacacatggccccctnttatgtgtttccctgtggacatgccttccatgcaaattgcttgattggacatgtaactcgttgcagtaaccaggtgcaagctgagagaatattggaccttcagaaacggcttagcttgatggacaggaaagcggcaaaagagaatggggcaagtgttaatggtgaatctattacgagcacaaccccagttgataagctgagatcacagttggatgatgctgtagcaagcgagtgccccttctgtggtgatctgatgatcaaggagatttcacagccgtttattctcccccaagagtcggatgaaaaggcatcatgggaaatcaaaccacaaccaacgcctcagaagattctcccgatgaccatgtctatatgatgctacggacagtacagcctaaaatggaatcggttttcaacttttatctgggtttttttcgtggtacatgtatttcatatccttttgctgttgggtgaattttttttatatatttgcccaacttgtgtattagcttgacctaacactgctgtcgagaatagcgtcttcatgctagctgttcgtatatagaaacatcaattcaattgtgtccccgcttgtgggtcttgtataggatgcatcgagctacttggaacatctcggtacactttgggacttgtgaacttttttttttaacctaaagtgtacaacgatgaagtcttgctccgg

SEQ ID NO: 6990 - DNA, 679 bp, Sorghum bicolor
  Clone ID: SORBI-28MAY03-CLUS62546_1
gaaaagacttgcattcgtggagtcaatgatcaatgccatgactgctgaggaaagggagaagccagagttactggctgagtcacgtgagaggaggataagagtagcagaggagtctggaaagactgaacaagaggtgagccaactagttgcccagcttttccagatgcgtgctcagatgcagaagttgatgagtatggtgcaaggacaagatgcaatagcagggatgggagatctcatggactcgcttaaagctgaagagaaggctcctcctggcaccgcgcggcgcaggagaaggaatagcaagcccaaacaaagggagttggacgcagttctgagctagtgatctagtgtatgtgctgcactggtcttggagttgaaagtttttgactggaagtggctcccgcatgcaagagctagactgaggacaagacctacacactcctcatcgactgtgcaaatgtgtttgggttcaggactgggacatgtatattgtgaaaatgcatagttgggcactgtgccactgccactgtgtagtgtaattgtggttaatcagcgacaaatatttgtacataaagtttactctcatgaggaaagatatccttgtttaaacgacggagacaattattgatgctagacaatgggattctagtcagaactgtccattctgatgtaaattata

SEQ ID NO: 6991 - DNA, 621 bp, Sorghum bicolor
  Clone ID: SORBI-28MAY03-CLUS62630_1
tctttgcaagcatcaaagagacaacagggaatcagcgacaagaatgcaggctggggagaggctttcggaagtaacaggagctggcatccatcgtctggtaaccccagtcggggcagccaggggaatcaccaacatgacaggcattttcacagcagtgattcgcggcggggtggctcaaactaccctaggaggtctgacaatcgtcatgaccatggcagtggtggttcgtcaagaccctcgtcaagagggcagtcccagaggggggtatgtaaatactacgagaatggccactgctggaagggctcgaaatgctcgtacgtgcaccggtgattgccattgccgtggaagcggaacgcccaattgcctggtcgccctcacatttttgtatagcagcatatgctttcgtggtagtaagtataggagaacgcttattaaccgtgtcggcaccagtaagctggtagtagtacatatccttcaggggaggagcatggctaaactaggatttcaaagtttatcacaggtactgatggcttttggtgcaggaatgcaccccttttgttcagttaaggcccgggtttacttcttcatctattttgcagaatggacaacatttttcgtcat

SEQ ID NO: 6992 - DNA, 532 bp, Sorghum bicolor
  Clone ID: SORBI-28MAY03-CLUS63428_1
gtcaccacagtatcatagatgttctccatcggacgcttggtaaattggtgctgaaaaatgctgagcagggtgcggcaactacatgctatgtggcactccacccgcaggtgaagggtgtgtccgggaagtacttctgcgacagtaacctgtacgagccaagcgcgaaggccaaggacatggagctggccaagaggctctgggatttcagcgtcgagctcgtcacctagctgatgcctcggttgttatcggtttccttgttgtcagacatggatgcgatcagcaacctgaactctctgtatatcacgtgtatcgcgcactcaacatttggcggctcgcctttacaatacaagggttgcaggtgatcgcattgctgcatgcctgcatgaggatggtgtgtgtttctgtgaaaagaaatgtgcctgctgctgctggtggatgatataatggaagttatgcttcagctccttgtttagttctcaaaaaattttgtaaatttttcagatttccggtcacattgacatatgcatagagc

SEQ ID NO: 6993 - DNA, 564 bp, Sorghum bicolor
  unsure (1)..(564): unsure at all n locations
  Clone ID: SORBI-28MAY03-CLUS63470_1
ggttctcagccctgctgcgttgaacttctttgtgaattatgcagatggggcagtggaatcgttgtggtcaatagaccagtactttgaattcatacttgtgctgatgtttagcacaggtttgtcgtttcaggtccctgttatccagcttttgctgggacaacttggattggtttctagtgaccaaatgctttcaatctggagatatgttgttgttggtgctgttgttgctgctgccgtgcttacaccttcgacggatccgttgacacaaatgctcttggctggtcctttgcttggtttatacttgggtggtgcatggatggtcaagctaattgggcgataactgattcatgcaaggtgatggtgctccagaaagcaagagtccccctgtaactagtcttgtaaaaatgaattcactctgtttgctcatcaaatgatattgttaccgtttcacttcctaaagttcgtgaccagtagaaaatagagcaanacagttaatcagtttcatctaccggtgttgaagtaacaaatgaatgcattcagtggcgcactggcgccctatcgcaa

SEQ ID NO: 6994 - DNA, 722 bp, Sorghum bicolor
  Clone ID: SORBI-28MAY03-CLUS63658_1
gcaaacagtgagcataaaatccaatgaagaccaggaactgtttgatccaaaggtccaggaacgtgatctcaatgtagtttcacccagagaagcttctgaggctgaagaaaactttgtggacgtaagcaagctctggctgattcagagtccagaggctgatgcagaacagagtccaaaggctgatgcagaagagaagatttatgacgagaagataaaggccatagagggaactaagaatttccctgatgaagcggcaatgaaaactgaagccccaggagcagcccagaaggcacttaaaaaacaaagcctattgtctggtgtgggatcaaaggtaaagcaccaacttgcaaaagtgaagaaagccatcgtaggcaaacctgggcgcacaaaaccagaatccccgaaggcataaaactccactcgccttacaacatgtacattattgtattgtctgtagtcttgtgagccatttatttaggtggtagaatgtttgcgatgggctaggtgaaggtcctctttgcaaccatcccattggaattctgtgatgttgcagacgtttgtcccccccccccccccccctcgagagtatgttgaagatgtttgtaaatatgtctagtgtgtaaggtagaatcgaggacatggacttggtcaattgcttgtattctttgttgatatgcacaagcaatttgtggtcatgatgcagcatattcttcactttactc

SEQ ID NO: 6995 - DNA, 631 bp, Sorghum bicolor
  Clone ID: SORBI-28MAY03-CLUS63709_1
ggagcccctacagaacagctgttgggtctgcttcaccaatgcagccaaacaaccaatcaaagccaaagcacaggttgactggaatgcagactccagagaggaggccatcctcagaggggcatggccagcatacacctggaaggagcaggatgaagcagggtggctatgagcctgaagaagaagtggctgtaccaccctttggcgaatgggatgatgcaaatgcagcatcaggtgaaaagtacactggtatcttcaacagggtaagggacgataggttgtcacctacctcttcagctaggcaaccatttaccactcgtagtgaggagaataaggtgcaacagaaatgttcttgttgcatactttgagaaaatgaggacaggatctcaaagagttttggacaacttcctatgctgcttctgtaatgagatccctatcttgtaactcttcctgtgctagttgtgatgtatgttattgctggtgtgattattgatctgtaatttgattgatccatttaagctcttcacttacaaggaacatatatatgataccatttagatttgtaaagtatggagtgagcaatttccttgtgataataaaaggtttatggaatggactctagaattccatagtt

SEQ ID NO: 6996 - DNA, 736 bp, Sorghum bicolor
  Clone ID: SORBI-28MAY03-CLUS63738_1
atatcaacaaatcctcaatgcagtgaaattactaagagattgcggacaccaaatagagatggaaggcactcaaagctggctgatagaggttttttccctttggctgaaaaggtagatgctgtcgattccccatgctttatgctgggcgggaaatacatgcatgctagtcataaagggcatactagaacaactgaagaatttagtgacacagagagtatctcatcttctgttggtagttctagtcctaacagtaccccccatagatcacagtattataatttggtctgccaaagtggagatacctgtagtagaactgatgaagatgaagcttctacatctgaaagagaaacatcagaacataataatgttggattgagggaagaaacccatttactggaattacatgcttatcgtgcaacaatgctagccttgtatgcttgtgggtcaattagctgggagcaagaggctttgttgactaacctaaggttaacactgaacatctcaactgatgaacatctagctgaattgaggagtttggttaccgatgctgttacttccagatagcttttgttgttaatttcctgttgacatttcatatctttcatattattgtaagttgggaaatctcattaagggttgaggtgttggtgtacttcatgtgtagaatttacttgtgaaaagagtcgattgggaaatttttgtactatagatatctcaagattcctgaaattttgcg

SEQ ID NO: 6997 - DNA, 520 bp, Sorghum bicolor
  Clone ID: SORBI-28MAY03-CLUS6282_1
gaagcctgtaggcaatggtagtagacttgcagacctaacccgtgcaaaaaatcttacattgcatagcattgctagatggatggattcagaacttgcacggcatcctaagatgaaagttttcctcaggacaatttcaccaaggcactttgtaaatggtgactggaacacaggtgggacatgtggaaatactatccccttatctaatggaagtgaggtcttgcaggatcattcaattgatatacccgcagaaaatgctgtgaagggaactcaggttaagcttttggatatcactgctatctcgaaactacgagatgaggggcatatatcaaactctactttcaaaaaagcttccactggaattaatgattgcttgcactggtgcttacctggtataccagacatgtggaatgagcttctatttgtacagatttagtatcacactctagttaggcggatctttttcagagccccaaggacctcttctgttcatatcatagcagtacacggtacatttatggag

SEQ ID NO: 6998 - DNA, 778 bp, Sorghum bicolor
  Clone ID: SORBI-28MAY03-CLUS62825_1
aagtacgccctgatggtgacgccgctcgcgacggcggtggaggagaggctgcagctcgccgccggctccggctccgggtctgcccgcggcagcagcagcaagaggtccgtgaacgtgctggtcaggacgctgctggtcgtcagcacggtcgtcgtcgcgctcgccgtgcccttcttcggccacctcatggcgctcgtcggctcgctcctcagcgtcatggccgcgatgctgctcccctgcatcttctacctcaagatcttcggcgtggcgcgctgcagcagggcggaggtcgcgctcatcgccaccattattgttctgggctccgtggttgccgcggccgggacgtacgcttctgtgaagaagattgttctcgactactgaagaacagaggcacgtctgaaaaatgtcggtgacagtgtcacagtcggcgttcttttgcagcgatcaacagttccatatctcaacacagcagattagtttgaagtttgaaccagttagaaggtgatgtttgtagacacgagggaaggagatggaggaaacagtgctgtactgatgataagataatagggtgatctgtttatatatgggcgtgtgcgctactatttcatcttgaagcttgtatgactgagcattagccattgacttctttttgtaatagagtgtgtttggtttagggaatcaacccattttagataagggaatgtatcgtgagtccatctcttaaatttagtggaatgactttgttagtcatgctagtactaattattagcttctaagg

SEQ ID NO: 6999 - DNA, 982 bp, Sorghum bicolor
  Clone ID: SORBI-28MAY03-CLUS6270_1
gcaggggaacattaataatctttcttattaatttgatagtatgttagtatcactaacctgtaccgacccaaaattgcaacatcgtatcactggggtcacataggtaactgacttctaattttacttcttttcgacgtatcaacatcgaatcaggctcgctcaactaaccaaattagccccaactataagctacaacagaatgatgtgaagatcatactcaaacacatcacttttggattattactataagcttacaaacttaatttatcatggtctttttttttgttcctgtgcctgatagtgatagctgttgtggtgatatgatattctacatgggtagcactggtcagattctttggtgaatctggagttgccgtgttgcgcttgcagaaactttaacctgcccccaattcatgaggcctccttcgtaaatccttttactgtagaagcaagggcaagttcagcgcttgtcacccggaaggagctgtaaatatcccctacatgtacaggaccggctcaggagaatgcatcatccatgtttggtatcatgggcctgctgtacaagcttgaagtatcagatttgtcactgcgttataagcctgctggtgcctgctgctttatcagagcaggaggatgatccacatgctcactgtattttaggagggatttagcactataactgtagatttggtggagtaccacgtagcctgactcagtcattttcttatctgccgaaggagctggtggtgagctggtggtgatctggtggcagtcattttcttctctgcctaaccatgatgttgtaataaccatctacccactagcagtgacaatctggtggtaaaataaaactaatcactgtaccaaaatataaaatcagccaaaataggagatgaagtccaattgctaccaattagaactctaccagtttggcttgtaagtgatctgcatagaagaagggtacaatgaacagttggatctt

SEQ ID NO: 7000 - DNA, 883 bp, Sorghum bicolor
  Clone ID: SORBI-28MAY03-CLUS63031_1
gcacgagggaagaagtctatgaggaggataataagttgtggaagaagcatgtcaatacttataagagggtgaacaagctgattggttcttcaaggtacaggaatattatggacatgaatgcaggcctcggaagttttgctgcaactcttcattctcccatgtcctgggtaatgaacgttgtgccctctatatcagaaaggaacactctcggtatcatctatgatcgaggtctgattggtatataccatgattggtgcgaagccttctcaacataccctaggacatatgacctgatacatggcaatggcatcttcagtttatatcagaacaagtgtgatgcagaagacattcttctggagatggataggattttacggccagagggtgcagtcatactgcgggacagtgctgatgtactgaacaaggttagaagtatggtggcaggaatgcggtggaagtccaagttacttgatcatgaggatggcccgcacgttcctgagaagattctgatttcagtgaaagagtattgggttggcagcgaagaacagaacagctgataggtacagaaccatggctatactggaagctagcctctttccctgatgcgatcccctgattctgttttgtcggttaatagattttgttcatacttcataggtacagtactaaaggcccatagacgacagggacatcctcgatttttgctgtgcatatatagtaatcagagcgctaagtgaaatgttggcgatttgccaagaccatattgtaggtaaatgttcattttaaaaaatgtaggtacgagacaattaattatacaaatgcacgcaagaagatttttgcgactttgtctatgaacgttatctgttgataatgcatgagattt

SEQ ID NO: 7001 - DNA, 703 bp, Sorghum bicolor
  Clone ID: SORBI-28MAY03-CLUS63046_1
agacaatgaagaagttgtatggttatcttcataacattgcaggaaaagaaattgaagcaaccttacctcgactgaaagagattgaaatggccccacttagcaaatcaatggatgaggaccttgcagaagcagccaaggaagttgaggaacagagaagagccgcaaatgaagctcctgtggacccaaagattctgcagaaatatgcaattggtgacgacaacgagatcgagaaggccctgcagaacaccaaggtgtctgcaagcggcatcatcagcgtgaagtccaacaaaacaaaggcagacaagaaagagaagcacaaggaatcaggcaaatcgaaaagaaaaggaacagacggtggcagatccgagtcgaaaaagaagaggtcttaagctatcccttgaagttgtatctgtcacacatttgacttcctgtgtcttggagctcgtcagaaatcgcgaggatgcttattatatatatctgacgatgaaaggaaaggaaaccagcagaagtgggttgaacgacgtggccagttgtgggtttggacttctgacgaagttccaatgactggtcgctgtccccaaattttgatgtaacatttctttaatacaatatataatattgaatatactcctagtttttgttgtatcctgcctatcatgcagttcatttttgttggagaaaagaagcccccttactacttcct

SEQ ID NO: 7002 - DNA, 681 bp, Sorghum bicolor
  Clone ID: SORBI-28MAY03-CLUS63077_1
aatcttttgtacatggtgttttagtcgagtcaatgatgctactgttatctacactcatcgccaaccttgctcctacagttgctgtattcttcatgatcttggggtgcgtatgcctgggtcccgccgaccgggattcccggcgtcgtctgggtgctctcatcggtgcttgccccgtcaagtggaaaaacttatggcagcaatctcatttctactggggagagattgaggctggaactctgaagtttgatagagtccagttctgaggtcgctctgctacgagagctcaagaaagaagaattcatcgagttcttcgaccagtacataaaagtgggcgcgcctcaaaggaggacactaagcgtgcaagtcttcggcggcaaccattcggctgagttcaagaaggcgatcgccgaagccgacccgcccaaaacgtacagagttacagacatgtccggctccaaacgatcgaggccgctgtacagctcactcaagggaggtccgggcaggatcaccatggactgacagccatcatgcagctattcctgtacttagtgtaatggcctgtgcatatatacgcatgaattcgattctgaatcctgcatcagattcgattgcacgattgatgctattcttcactgatgtggttttacccaataatccacgacagcgtatcactttctgggc

SEQ ID NO: 7003 - DNA, 1025 bp, Sorghum bicolor
  Clone ID: SORBI-28MAY03-CLUS6407_1
cttaactgggatttaaggtcaagcattgccctagctgcagcccgtggtgttgagtacattcactcaacgagctcaatggcttcccacggtaacatcaagtcatccaatatcctcctgggcaaatcatatcaagcacgtgtatcagacaatggccttaacactcttgttggtccatcatcttcaccgtctcgcaccactggatatcgagcacctgaggttattgattctcggagggtttcccagaaggcagacgtgtacagctttggtgttctgttgcttgagctggtcacaggcaaggctcccagccaggctgctctcaacgacgagggcgtcgacctgcccagatgggtgcagtcagttaatcgctctgagtggggttcagaggtgtttgatatggagctgacgagacatcagactggcgaggaaccgttggctcagctcgtgctgcttgctatggactgcgtagcacaggtcccagatgcccggccatcaatggctcatgttgttatgcggatagaggagatcaagaagtcaagcggggcctcaaacatcgaacaagttgatgatcaatcttccaaggctgaatctgaggtgcagaccaatccgtttgctacctgatctcaattgacctgagagagaatcgtctataactctagtctgcttcaatcgattcaagcatttgatgaatcctatcttcgactgagtcgagtcactgttttcatcttttagcctattggatttaacgggtaacctaattgtcattaagtagctcgggtgctcggtacccagtgctgcggaaggtgattggtggtgtgtttagggaccagttctaaagtgtgattgctaaattgctgtgctcattctagccttgattaggttggttttagcttgtagctgctgctgctgtctttcggctagtcccatgtgtaattactctagcctcttctagtgtttggaattttttttgccggattaatctctcgtttgattttgtcatttttttaatagtttgtttgatttgtcct

SEQ ID NO: 7004 - DNA, 680 bp, Sorghum bicolor
  Clone ID: SORBI-28MAY03-CLUS63980_1
cattcccattgatggccctatgtcattttctacctcaaaggtcactgtacagtggtctcttcggtttgagttcttcacaactccggaaggaacagacccagctaggtacgagcacccactccttgttgagaaaagggagaagggtgaatgggtcctccctgtaactgtttacgcacctccattgcgcagacgagctactcatgggaggaatgatagatctgtcttacctggaaatatcttcaactcttgaagtgcattgttgcctgcaacgcctgactgttgccgaagtacagttactttcagctggaaaggatttgcaaattattctgactggtacagttgcgtcaaaaggatttcctcacagtcgattgtttataggatatgtaatgtgatgcctatttttacagaagcacttcagaaatagagaccaaatggactgagatacttgacttgcactaagtttgtttattggataatttgtttcatcgatttgtatcccatgagagcaggcattagcttttggtgtttaagatgtaccacagaatatagtgagtctgacacaagcggcacacaatgccaggtgcggacgcagtacaggggcatggcccatataattttgataaaaaaaaagatacttgtatgtatattactatatattaatgtatatttgcaatttggcc

SEQ ID NO: 7005 - DNA, 720 bp, Sorghum bicolor
  Clone ID: SORBI-28MAY03-CLUS64089_1
cagagttgttgggacattgtaagctaagctcgtaaacttggctcacggcgccaaggcttataggagaaggccacacccatactcagacagccagagttgttgggacattcggctatatggcgccagagtatgtattgcatggtcgtgtgtcgcccaagatcgacatctttagcttcggcgtgttggtccttgagatcgtgaccaggagaagcaactgcaactctgatgaccacagcactgtgaatctccttagtgatgtctgggatcactggaagaaagggacgatgtcgcaaatgcttcatggatcgctgaatgagtttgctcgaagccaagcgctgcgatgcatccacattggcctgctgtgtgtccagccggaacctgacgataggcctgacatatcagccgtagtgttcatgctaaccagggatagcatagagctcaagccgccggcgcagcctgcattcttctttggtagcgaatcaccttcagcttcacggtcagatggtcaaagcagctatgtatatgcccggtctggtttcatgctggaacagggcgtctctgtgaacgggattacactcagtgaactgtatcctagataggatcaaagtctggatactgagctcatggaatacagctgaaacttaaccactttggttaacatgttgaactctctatgagttcccaaattggcatgcagaaatgggttttcataaaaatttc

SEQ ID NO: 7006 - DNA, 685 bp, Sorghum bicolor
  Clone ID: SORBI-28MAY03-CLUS64202_1
attctggaattactattttcttgccaggttcaggcaaaaatacatagatcagaacgcctgctatcaaaagattcaagcttcctaggcacttgccggtccatgtgatgatcaagaaattattacaaatgaggaaaggtttgtttccatgtgattggttcatgtctaaagcatatttttgccacatggtagttgcaaataatacattgatttatcattttccttatgtatttcatgagtttgtggcattttatacggcgccattgaaaatgtgcacttgcattgaaagttacttgaacaatacattgactgtttaatatatgttacctagatgtcaccgtagcgtcagcacgggcaatatactagttataagtcattttaagaattttgaagagtcaaaacataaattttaactataactataaaaaaatataaaaatttatgacatcatatagatatgctaatgaaaaaatatatttaacatagaatataatgataatttagttggtatcataaatattattatcttatcatataaaagatttctaaaataactcataatttgggacggagcaaatagtattcttcctgaaaggacaggcgtgcatagttcacaggacagtaaatctagaaggtccctaaatcggatctgtaaaatttaagataatattcaagaaagtagaatcag

SEQ ID NO: 7007 - DNA, 718 bp, Sorghum bicolor
  unsure (1)..(718): unsure at all n locations
  Clone ID: SORBI-28MAY03-CLUS6415_1
gtctcccatgacgccgcgccgcgtgggcggtggaagcttccgtcgtcgtctcgtccggagggacctaacggggggccccggcggacccgggcctaggagagtaggagtacttaacacggccgctcaccccgggccgccgggagtcagtcagcttcccttccccgagcacacagcacacccaccgggacgggagtcgggagggggaaggggagggatcgcctgtctatcaaggaaggaagtgcgcttctgcctgcgtgctctggcgatgccgtccgggtggaggggcatcctgggtttcgactacggcatcgtgcaggcgccgctcggccccgacatctccggcccggatctcgtcgccgccgtcgccaacgccggcgccatcggcctcctccgcctccccgactgggttggttgctaccagtttttgcttcctttgctgtccgcgctgagctgatcaaccgcttcgttgtttgtccctgaccgcagccggcgccggatcacgtcagagagctgatccgaaagaccaggagcctcacgtccaagccgttcggggcggccatcgtgctggccttcccgcacgaggacaaccttagggtcgtcctggaggagaagctcgccgtgctgcaggaaatattgggggacttccccaaggagagcgngcaacaggcgcattcgcgccgtagttaaggtcttgcatcaggtcgctcaccttgaggag

SEQ ID NO: 7008 - DNA, 455 bp, Sorghum bicolor
  Clone ID: LIB5048-010-R1-XP1-H5
ccgggtcagtcagtcagcttcccttccccgagcacacagcacacccaccgggacgggagtcgggagggggaaggggagggatcgcctgtctatcaaggaaggaagtgcgcttctgcctgcgtgctctggcgatgccgtccgggtggaggggcatcctgggtttcgactacggcatcgtgcaggcgccgctcggccccgacatctccggcccggatctcgtcgccgccgtcgccaacgccggcgccatcggcctcctccgcctccccgactggccggcgccggatcacgtcagagagctgatccgaaagaccaggagcctcacgtccaagccgttcggggcggccatcgtgctggccttcccgcacgaggacaaccttagggtcgtcctggaggagaagctcgccgtgctgcaggtctattggggggacttcccccaggagagcgtgcaacaggcg

SEQ ID NO: 7009 - DNA, 663 bp, Sorghum bicolor
  Clone ID: SORBI-28MAY03-CLUS63258_1
ccacggatggatcaccagaattcttcaagttctatcgatcctcttattcaggcgaacactggatccaatgcgagttcatcactgtcttttatgagagggatcctgccgaagtatttcagttcagagtggtcatttgctcagttccatttaccagaagtcactcgttatatagtagcctttggtgcccagaatactgtgatgatggttggcctggatggcagcttctacaggtgcagctttgaccaagtgaatggagggcagatgttgcagaaggaatatttccggtttcttaagtccgacaacccacctttcaggaccgcagccgcttgacctgcatgatgatcatcccaccttgtaaataccgaaggttgtgcccggtctattgtacatatcatcttctcgccggctaagttataggcagccggaataatgagagctggctgttggatcgcaacctacaggatttcaacgttcagataagatttctgaagcggttggtgtcccatccaaattgcaagcattatttgcgttactcttgttttcttcaaacgagaacacccattggtacatataacataaaagttcaataacgttgaccatgtggcagggacgtctgcaaggttgtgtaacaaaaaaaggataaaaaaactcgagggggggccc

SEQ ID NO: 7010 - DNA, 601 bp, Sorghum bicolor
  Clone ID: SORBI-28MAY03-CLUS63343_1
ggcaaggtccacagcactgttagacaaagatggcttgatggtgatgagtttataatatcacgtatgaaggaagtagcgcagctagcattcgatggtcacaaggctttgctgcagaaggattatactgagctagcgaggcttatgaataagaattttgatctgcgaagggaaatgtttggggatgatgtacttggttcagtgaacataaagatggtggaggtggcacgcagggtgggcgcggcatccaagttcactggcagtggaggcgcagtggttgccctgtgcccagatggggattcacaggtggagcatctcggtgaggcttgccaggaggccggctttgtaatacagcaggtgaaagttgccccctcggtgctgacggatgcggagctgtcaagtttattagcttcctagttgaacgatgaaaacaaacgatgccttgattgtatgatgttccttcatttgtggtgttttgatatgtctgctggtgtggctgtttagtcgatgccttggatgatagatgacggccaaggcaaggttattgttttcaatcaacaattgaaaaataaatacaagagtactgcacatttttgtcttggtg

SEQ ID NO: 7011 - DNA, 691 bp, Sorghum bicolor
  Clone ID: SORBI-28MAY03-CLUS63320_1
ccgacgtcttccgcgggctcacctcgctggtggacgtcggcggcggccagggctccttcgccaaggccattgcggcggcgttcccgggcatcaagtgcgccgtcatggatctgccccacgtcgttgccgacgcccccgtcgccgctggtggcggtgatgatgtgcagtttgttgccggagacatgttcgagtccattccaccagccgatgctgttttactcaagtatgttttgcattgctgggacgacgacaactgcgttaagattcttaagaattgcaaggaggctatccctgcaagagacgctggaggaaagttggtaatcacagagatggtgctagggtccgggcctcgtcgtgacagaaacgttgctgagacagaagagatgcatagcttgttcctcacgtgcatcaccggcgtggggcgagaggagcacgagtggaagaagattttcgtcgatgctggattcagcgactacaaaatcaccccggtcatgggcccgctttcggttatcgaggtttacccttgatacttgcattggaagaggaaacgaattttgccttaaagacgaattctgctatgtaattgtcggtttccctatatgtttttgtgtcaatctatatctgtacctagctatacctaataataatagagaagcaaaaaaatttctggcaaaaaaaaagtataaaaaaa

SEQ ID NO: 7012 - DNA, 682 bp, Sorghum bicolor
  Clone ID: SORBI-28MAY03-CLUS63358_1
tcgcatttgctttcattatcattccacggcaggttatgccatggacaggtttgctactgatgcttgagtggacctttgtggcattcttcttattgtttgcgagttatctccgttttgtctaccggtggggaagtattagtgcaaaccatgtgggctttagcaattccgatgcatcagagaatcatatgggtccaggccatcagcgaaatatgtctgactgcgacatggatgcaacattttactggatagggatggcaactatagctactattactgtattgttaccaactatcttgggcataactgcactgttcacaaagctaggattaatggtcgctggtggtattgtgctggcatcttttatgacatacgcagcggagcatcttgcaatctcagccttcaacaagggtcagaaagacagaaatgcgtcaagaactcgaagcttttgtttttaacgttcaagtaaaatccatgttgtattgtaggtaggtttgtacaaatgatgattcatttttaacacgtggcttcctgcccatggcccctttttgtagcgctgttgtcacgctaacttgtggtaaatatatttccgacgttgttcgtgtagcccagttggcatggagctttttgccctgcacaatacatcctgtttatatttcgacaaaaaaaaacttcatattgttgt

SEQ ID NO: 7013 - DNA, 579 bp, Sorghum bicolor
  Clone ID: SORBI-28MAY03-CLUS6338_1
gcacgaggggagtcacagggaagaagcgcatgcgcacgccaatcggcatccaccaaagattcccttcgcccagtcgccccgcccagatctccctcactcgcactcgctcaccgcgcccaatggcatccgctggcaccggcgccggcgacggcgcggcggcgcagccgaaggccgcaatctctcacgtaatcttcgatatggatggcctcctcctcgacacggagggcttctacacggaggtccaggagaagatcctggcgaggtacggcaaggtgttcgactggtcgctcaaggccaagatgatgggcaagaaggcgaccgagtccgcccgcatcttcgtcgacgagtgcggcctcaacggcctgctcacccccgaggagttcctcgaggagcgcgagagcatgctccaggcgctcttcccatcctgcaccaagctgccaggagtactacgtttggtccatcatcttcatgccaacggaataccaatggctgttgcgacaggatcccataaacgtcattttgcactaaagacccagaaccaccaagaaatgtttgccctgatgcatcatgttgtcatgg

SEQ ID NO: 7014 - DNA, 664 bp, Sorghum bicolor
  Clone ID: SORBI-28MAY03-CLUS64744_1
tcaaatactgcaaggaagttatctttactgggattacattttcagatgaagagaatcatctaatagagatattttgggatatgcacaaagccagagaggatgataatccaaaagatcatgtaaaatcccagtctcattctattgaagacattccaattactaatggagtgaagaagcgctaccgagatggagcttttgttgaagcaagttccttttctgcatcttcaggtcatgatgcaatgcaaatgctcaggtcagagatgcaagatcatggatttcattatatgccacctaggaaaccaaggaaatcagatggttatcttcgttataggaggaagcggctaagcagtggctttatttatgttgcacatgctgattattacatgttgctacgtgcttttgcaaagcttgcagaaattgatattcgtatcatgcatattagtgtgttaaaagttgagaggagactcgcatgtattgaggagcgaattgagagaagcttgaacaccttacagaacttttctactggaacaggagatgagctaagatctgtatctgactgaagttcctagtgtagtctcatactctgctgtactgctgttttggcatcttgagaaacataattgccctggagcattatgcctccccagtattgctgtttttacgt

SEQ ID NO: 7015 - DNA, 563 bp, Sorghum bicolor
  Clone ID: SORBI-28MAY03-CLUS64768_1
cagattggagaaaagcattgcggcattattcaagagggcgcttcaatagccttagcataaagcttataaaagatgggtctgtaaaactgggtagcgagtgaggttgcagcttgcagccgatgctcttctccacgcattgtagtccgcccctcgggcccactaagcagaagcccttctccatttggtaatgattattttgtctgggatttagatagttggagccgccctgattggtttactcatgtaattattagtagccttttcagtatctctgaggagcatctgctgaaggatgcacgcctgcctgtcggcccatttccggtgtacgtgtacctgacgctcaaagtgttgtgaaatgttttggtgttgacctcaaatgcaatttgctggtaccgtgtaccgtcaccttaggtccatttgcgcctatatggcgataaagagctaactgacaagttacaacagcagaaagaggaaatgatgaagggctagctgatctatcttatgaattctgtttatgccgtgtaatatgttgatgttgaaaagtacaattcaaattcactgat

SEQ ID NO: 7016 - DNA, 1134 bp, Sorghum bicolor
  Clone ID: SORBI-28MAY03-CLUS64833_1
gcacgaggcgcccgagaaggtgagcagggacagggccctgcaggagaagctggtggcgtacctcacggcgcggccggagtggaggaggttcggtggcgccgaccacgtcatcgtcgcgcaccaccccaacagcttgctgcgtgcccgggagacactgtctccggccgtgttcgtgctgtcggacttcgggaggtacccaccgagagtggctagcttggagaaggatgtcattgcgccatacaagcacatggctaagacgttcatcaatgactcggctgagtttgatgaccgacccacgttattgtacttccggggagcaatttacaggaaggagggagggagcattcgacaggagctatattatatgctcaaagatgaaaaggatgtttacttttcctttggaagtgtccaggaccatggggccagcaaagccagccaaggaatgcactcatcaaaattttgcctaaacattgccggggacaccccttcttccaatcgcctgtttgacgcgatagtgagccactgtgtccctgttatcattagtgacaacattgagctaccttatgaggacgtgttggattattcaaagttctccatttttgtccgttcgtctgatgctgttaaaaaaggttacctgatgcaactgctcagtggtgtaagcaagcaacagtggacaaagatgtggaataggctcaaagaggtggataaacattttgagtatcagtatccatcccagaaggatgatgcagttcagatgatctggcaagcattgtctagaaaggtgccaacaattaagctgaaggttcatagatctagtagattttcaagatctgacagaggaaaataaatagaaaaggggtgtgtgtgtatcttgtctctgttggctaatctaatgtaacacatttcactgacacaggctctcaggttttctcagttgcacaaaatagatagattgtaatattcaggttatctttaggaaaggtttctaccgtaggatttgttggtccagttgaagcatatactgtcaagtcaaaggcttgttattttgtaaggtatgttaaatgtgatcatggaagagtgacaatagttttgctgtttctgaacattgtgggattgaaaccggggggggcccgg

SEQ ID NO: 7017 - DNA, 586 bp, Sorghum bicolor
  Clone ID: SORBI-28MAY03-CLUS64839_1
ctcttctccagtcccgtgcgaccttgacacaaccattgagagtggcattggagaagatagaacacatgcaggtacctgttgacattgccccgatattcggcacggcaaacaagctacttgcaaacgtttagttggattcagcaattcagcaaacgttgtgcttaccccccaggcccccaagaataaaggcagcgctaggaattgctcaagaataaggcagcgctccatgtcaagcaaagctgataaaaacaaggcgatgagtgacttttcatcggaaggaaaattgtttagcgctactcttaaagtggtgtttgattagtgagaatgggaatgcccctccattgtttgctcggaactgaatctagctttgcctgagcaattgtaaagtatatttcttttgctgtgaatcactggaactcatgacgtgttttttttaaagtgctcctaggccagtctcaatattttatagaagtttcatgcacattaaatatgctaatgtggcactatattgatgaagagaaagatgatgagagtttcacaggagtaagatagttttacgaggatgaaactcttctacattgttttc

SEQ ID NO: 7018 - DNA, 606 bp, Sorghum bicolor
  Clone ID: SORBI-28MAY03-CLUS64836_1
gaacgaggatgcaatgcttgggaaacttgagggtatgaaggacgtgatcgagcaagtgaacaggcaatttaaagatccagacttgacaacttttgtgtgtgtttgtatcccggaatttctttcattgtatgaaacagagagattggtgcaagaattagcaaagtttgagattgattcacccaatattattattaatcaagttatatttgatgaggaagctgtcgagtcaaaactgctaaaagcacggataaaaatgcaacagaaatacattgatcagttccatatgttatacgatgacttcaacatcaccaagcttcctttgctttcagaagaggtttgtggtgttcaagctttacaaaacttttcccagcacttccttacaccatacaagtttaatcttaaaaggggcaccatcgaggagctcgaacagagaataactttattaaaatctgcactgcaagaagctgaggcagaattagatagggttaggaaaggcaagcagtcagcgtgatcctttttttcacaggtcaaggtgtgtaaaacctgacagaagctatgaagaatacagagtcagagttagagagagacgctcagtttttttgtgtc

SEQ ID NO: 7019 - DNA, 579 bp, Sorghum bicolor
  Clone ID: SORBI-28MAY03-CLUS63814_1
gaggaactgaagcaggctcttgcaaaggatgtcccatggagattaaagggtccacgtgtgttagagatcattgaagcgattgacagtaatacagatgggctagttgattttgaagagtttgttgctgcaacactacacatgcatcagctggtggaacatgatactgagaagtggaaatcattgtctcaagctgcatttgataaatttgatgttgacagagatggctacatcacttctgatgaacttagaatgcatccaggaatgaagggttctattgatcccctcctggaggaagctgccattgacaaagatggcaagataaccctagatgagtttcgtcggctcttgaagactgcaagcatgagcgcccgcaatgtacaaactcctaggggtgttcgcgtgtcatagttttccgtttttgtagttaactgaacaagggagcagcagcccatgtaattggaggaaggcttcttgatgtaaattagattaatcaatactcatgaatggagtcaattggtagttcttgttccttgaaaacgaccattgtattctttctatgcaatactacgtttggtttgt

SEQ ID NO: 7020 - DNA, 757 bp, Sorghum bicolor
  Clone ID: SORBI-28MAY03-CLUS63832_1
actttttttaaatattgtaatttagtcactaaagtttttatgccattccaatttccaacggaataaaaaaaacaagcctattgagcatgcctccagtctttcggcttaacatattttccaaccatattagttggcgtaacacctgggtctccaaaagtcactatctcctttttcaatttaacacggacatgatcccaccggaatggtgcatcttccccagcaccaacaggggagtgactggtatgtccatgatgtatggcctcatcctctggagtaacaggtgactggatcattctcaatccttttaagcggtcatcttcttgaataaagtttaagactttgtccacagcaactggggttccacatatactaccattgattccctctggtgcaaggataatgccacctgaaacatgcagctcctcgcagagctccttaagcggcctccggaatgcagcatggtcggggaaatcagcgaacctgtagaacgacaccaccagcagcgacggggcctcgccatccaggaccccgtcccccactgccaccgcaaagttccgtcccaccggcggtaggagggcgcgctcgaacgtgcactcctgcggcatgtggccgaagcggcggcgcggtacgagagtgctcgaggaagaggggtaggaggatagagagcgtactgggaggaggagccggtgggcggcgccactcgcggcggctgtggcggcgcggcgggcggcggcaagcggtggaactggtagcatct

SEQ ID NO: 7021 - DNA, 592 bp, Sorghum bicolor
  Clone ID: SORBI-28MAY03-CLUS63868_1
ctgatcagagcatacacagaggctaaactatacatggaggcagaagaagccatccggatgatgctgaacagcagcacaaccccttcctgtcctcatttcagccacctgattttcgcctttctgaaggaaggccagattggtgaagcccagaggatctacaaccaaatgaaggaggcaagtgtggctcctgatctggcctgctgtaggaccatgatgagggtgtacatggagcacggtctcatggacgaaggcatcactctctatgagacgacgcgtgggtcgctgaaacctgacagcttcatcttgagcgctgcgtttcatctatatgatcatgcaggcagggagtctgaagcccaggatgtcctggatgccatcagtgtgagtggtacctccttcctgaggaacatgaaaattggatcgaagctttgatgatcctgaaggactacccatgatgtgtacctaatctaaaagaagttaagttagggcacttaaaaatgcattttcccccctttcattccctttgggggagagcacaagtgcaactgcttcagaactcacgaacacatataccacaagtggtacattattttag

SEQ ID NO: 7022 - DNA, 773 bp, Sorghum bicolor
  Clone ID: SORBI-28MAY03-CLUS64005_1
tggtgtcccagaaagtgacccgtgcatcagcaaagaacttctcatgtctgtcactaggaaggctcgactttccacaccagcagatgagaagaggcgatacgatagggagtttggtgaattcgtgtcatccaggaagtctatttcgacgaaggcaagagagtcgaaaggcaaaaaggtcacactagcttgagcctttccttgggcaataaatattgatgtgttgcaaaaattggacagtggcccacaagaaggctggtaacaggtgtacttgtcaggtcatgtggcgtgcgcttcctttcattcgaagagaaacaaaatctacaaagaaacctaaccaagggtcccttgtgtatacttggattggatgggggaaggccattggagggacctgtagttggtggaaggcgcaagggcgctggtgaatcagtgttatagcactcgtcacaaattttgtacggtggtgagtagtaggaaatagaaattctaagagagaacgtgctaatcctgggctgttctgtaattagtgttacgatgaatgatccgcttcttaacgtgcggcagtcattatcatagatgtgctcggtcggggcactaccgctctagccacagggtttgcaaggagaaggtgttgatttgattccgtggggaataagtgtgaatggtggcctggtgccacttagctctgctgaataagccaccatttggtttgtactgctgggctacgagcctctgaaacctgggcgacgtgcccttatatctatcagttttggttt

SEQ ID NO: 7023 - DNA, 640 bp, Sorghum bicolor
  Clone ID: SORBI-28MAY03-CLUS63887_1
gcgttgtgggctcgttaaacaagatccctctttccattgctggaatcgttctcttcaacgttcgtacaagcatacagaattctttgagcattctgtttggtctattagcaggagtgttttttgccagggccaaattgcgagataactcgccgacctagtgatcatcaggcaggctttatagtttgtagcaggcaaggctgatagacatcggtgatgatcatcagctcagaaacactccatagagctagaattacctctgtgggaaatttgtgcagatgcagtggttgtttcccacctgactaggcaaagaccaaagagacaacacaagcacgcagattggcctgggactctacggttctcctttttttcccaacaagttgagctggaccccagtcgttggtctgctggtggtatacgtcttcgttcttgctgtaagatagtacaaaacatggatgcaactgaatttgaggcactttgggatggaaaggatggttaagtcgatgtattgtagtttgtaaagtcacggtggctggattgaagggggatgtaaatttctgcgtgcagcaaattgattgttgtggtttggttccatatgattccacctgagcaaggccagattctggttttattttacaagaaa

SEQ ID NO: 7024 - DNA, 672 bp, Sorghum bicolor
  Clone ID: SORBI-28MAY03-CLUS65379_1
cccaattacctggagatctggaagcttacctcgttctgggagttcccctgcatcttgtatggaggtgcccttgcgcctggcgccttcgttgccctcctcgctcggggcgttcccctgcatcgtccccgctgctgcgcctgcgtctcgcccctgcgtgccccgcccaccgcggtgctttccccgctctgcacccctgtacaactccatgttggaagcgttttaggtgcagttaccatcatcgttgggctgtacgtcgtgctgtggggtaaagcggatgacacgaagggcggagatctccaacccagtgattccaagcagacggttgatgcggattgcatccctgtcagagtagagactcgaaccgatctttcagaaccattgctaccgacgacgacgaatgctaatactcggttatgttaatttctatttgagaacatgataactgcatgttcaaacttgttaatggttcaaacttccaacgtttcagatgtggggatgctatagtaggggaggtaccccccttggagcggggggtcgggtaaagtccagccagagtaaatcccccagccgcaacgaaattatctatcgagtaaaatattatacccgcatttttaccccgcggggcataatacacaagagcatgcacacccacaagttatattataacaagtt

SEQ ID NO: 7025 - DNA, 606 bp, Sorghum bicolor
  Clone ID: SORBI-28MAY03-CLUS65423_1
aacctttgccgaagtcatgagcaatatcgtgcaccttcaggaggaggaagttaacctaaggaggaggtgtgatgaaactcgtagggatctgacccgaaagagggcacactttgaagattggcatcaaaagtacttggagagacgggcagcctttggtgaggatacaaacccagatgcagcagaaactcaaaacatagatcctgtcgaggataggaaacgcaacatcgaggaattagaggttcgtctgagagaggaggaggggcaccatcttaggcatgccaggcaggtgcgggagaaatcacttgcaaacctccggacacacctgccagaacttttcaggaacatggccgattttgcttacttttgccatgacatgtacaataatcttagaaaaactgctgtggtgcccaaagatgaagtgtaaggctgatatttgtgcgtttgtagtcgtactcaacaagcagtacaagggactctggttttaggtgtttgctggtaacttgggatcccgaggccatctagaatttatcggaacttagtcttagctaatagtcggaattaattatgtttataaattggaatggacattcctgagttcccattgtt

SEQ ID NO: 7026 - DNA, 836 bp, Sorghum bicolor
  Clone ID: SORBI-28MAY03-CLUS6557_1
cccgtacactacgtacagggtgggcaagcatccatcgtcggtggcgcaatcaactacgtgagggagctggagcagctgctgcaatcgctggaggtccaaaagagcatcaagagcaggggggcatcagcaggcagcacggacgccggcagcagctcctccccattcgccggcttcttcagcttcccacagtactccaccaccacctcggcccacggcggcggctgctcaggcaacacgagcaacggagggaactgcagcgacgccgtggccgccgcatcagcagcaggatccgcggagaccggctgccgtcggccagcggcggcggcggtcgcggacatcgaggtgacgatggtggaaggccacgccagcctcaaggtgctggcgcgccggcggcccaagcagctcctgaagctcgtcgcggggctgcaccagctgcgcatcccgccgctgcacctaaacatgaccaccgtcgacgccatggtcctctacaccttcagcctcaaggtggaggatgactccaagatgggctctgttgaagatattgccaccgctgtgcatgagattctcggcagcatacagcagcagcagcaggaggaggagaccgccgtcatgtgaaactctgcactgcatgcacatatctgcactgcccctcctggctcctgccaatggaatccattgcctgtacatgtgactgtgattgcacgcaccctaggcatgcatgcagcattactgtccaatccataccatggtcacaagaatatgctaagaaaatttaggctgtaatctaagcacctacctccatttttggagtgagatcacttgtagattattcaaag

SEQ ID NO: 7027 - DNA, 697 bp, Sorghum bicolor
  Clone ID: SORBI-28MAY03-CLUS65673_1
acagccactgcctgtgcccttcacgctttcctttgaaagaacaaggcaacaagatgcaggctgaggctgtcaacaatctacagaattatctgaacgacaagatctacctggaggaaccagaagggcagtacctcgtccagcaactactatccaaggagttgttcatgtaaagatcaaaacaccagattggcatgagccatcatgtttgatcggctaaacggcggtacctcgtccaagctaccactatcgaaagagcaggctcacgtagagatcaaaacaccagatcggcatggagctgttcgtgtttcagaaacacagtcgagacttgcagatcatttttctcccagatcatttttctctctggatgtggcctgcaaggaaatcagcaccaaatctcacgagcattatttatggatagtctcccagatcatttttctccccgtctgtacggaacctgacgctgtatttggttatatatgtggcagtgtttccggaaaagaacatataggatacgttgagaggtttcaccatttgttgtactatgataatgtattcggaaaagaacataggataggttgaggtttcgccatttgttgtactatatgtctgtactctgtaccttatgtcgtggccaactctggtgacctgtatggaggccaattttatgagaaatgggttcagtttttttttttttttg

SEQ ID NO: 7028 - DNA, 925 bp, Sorghum bicolor
  Clone ID: SORBI-28MAY03-CLUS71489_1
agcagcaacagtgcagtttaaggagataggtggagatgcaagaagcaaaggagcagtgggaactggcaagccttcagtacaatcaaatgagaaaaagaaaggttttgattggatgtttacaaaacctgttgatgaagtgaaagaccattgggtcccagatgaggttgccaagaagtgtcactcgtgcgccgttgattttagccctttcaatcgcaggcatcattgtcggaactgtggtggaatcttttgtgacaaatgcagtcagggaagaattgctctgacagctgaggataatgctccacttgtcagagtttgtgatagatgcatggccgatgtcactcaaaggcttagcattgctaaggaagctgccaacagatctgcaactgtgcaaagtcatgaagatcttgcaagaaaactgaaggaggaaatggagaaaaaccgcaagtcttcaggtccagcatctggtggtggttcatctggtaccagaatgagggaagtcgcgtgccctacctgcacagttcatcttcaggttcaggttccaacatctggctcagagacagtggagtgtggagtgtgccagcatgccttccttgtcagcgccaattgatacaccggggagacagtgcatgctatagaaattattctgttgataactattcctttttttcgttatgctgtatacataataagtgtgtgttctgtcagcctgtacatgtttctttgcttgtgttggtgatcacggttaggatgtctctttttcccctgtacatgggtgaattccaattcgggagtattgcaatgctggatgtatgcagagaataccattagattataaccggtggagcctgaagagtgaaggttggccccatgcacgcgtgtgacgtccgcattatgcctgttcgaagttctatcatgctgcttcttt

SEQ ID NO: 7029 - DNA, 691 bp, Sorghum bicolor
  Clone ID: SORBI-28MAY03-CLUS7150_1
cctactggatctcctccgtcctccagctcgctagcccgccggttctccggcgtaggccctcctcctgtcctccatcccccggcctgccgccgctgtagatcggcacccgcgcgcccgcgtccgcctcctctttcgctcgagcgccgccagtcgtgcccccgcctcgtgctcccctccggcggccgtgcccgctgcgtgctcccctccggcggccgtgcgcgcagacctccttccttgacgtggccaaaatccggcgaggggctcctgcggccgagatctggtgagagggcacttcggtggcgacggcacggaggagcgcggctgccttggcgccctcggccccggtctcgtcgtcttccccgtcgaccctgccgctagccaacctgcgggcgagaatcgcactgccaaacgctcggccttagcatcatcctgccgcgaagcgagccatggcgacgaccaccgccgcgccgggtctcgccgtagcagcaaccgatcccatccgctccttcctctcgtccgccgccgcctccgtcgacctggacaccgatctccgggacctcgccgccgacctcacctcggaccccgccgtcccctaccgctctctgcgcgccatctggtgtgccaccacgtcagacacccgcccgccgctccgcgacctcctccagggcgccgactttgtgctgccaagtcc

SEQ ID NO: 7030 - DNA, 795 bp, Sorghum bicolor
  Clone ID: SORBI-28MAY03-CLUS71513_1
cgtctcgaagcaaccccaccttctcttcttttttccgccttcctttccccgtgcaacaaacgcaaacgcgaacgcgacccaacgaatcgaatcaaattcgccgtccacctcgtcggcgtcggcgccaccggcctcgagcccaagcccccgtcgtccgatcaggcagccgagatgcagcacgggagcggcgactacgcgtcctccgccccctccggccactactaccagcaccagtacgcgccccccggctccaacccctatccagccgccaccgacgccccggcgccgggtgcagtggcggggggctacgcctccgcaccgccctactctctcggcggcggctaccccgaccagccgccctccgccccggcctactcgcaaccaccctccgccccggcttactcgcagccgccgccccagccccagcacggcgccgggtacacgccttacaacaccaaccccacgacctacccgccggaggcgtattactcctacacgccgccgcccacccagaccacggccccgccgcctgcggagcccaaccccgtgccgctgccctacgacgccccgtactacgggggcgggtaccagccgccggccgcggggtacgacaacgaggattacctgaacgagggcgcgtacgcgtacagcggcggccgtggctcggagccgtacggggcgcgcggcacggcccctgcgcggtcgggatcggcgctgtttgatgactatgggcggtcgatcagtgccccatctgatgactatgggcgatcgatcagtgccaatctggatgggagg

SEQ ID NO: 7031 - DNA, 614 bp, Sorghum bicolor
  Clone ID: SORBI-28MAY03-CLUS71525_1
aaaaaaaaaaaaaaaaaaaggatgagtagtcatagttttgtcagagcattcccccaaggaatataacgccattgtgtgacgaacaacccttagttcaccaaaacaaagggctgataaactgcaagagacagttcctatcaggattgtggagtctgcaaccagatatcagcacaaaacagaattgaagagatgtatcatcatcaacaacagcttcagagccacagccatttcctgtcttctaggcagacattccctccacaaaggcacatgattctgcaaggagggagcattccagcagagtcagggcttgtgctttcgactgatgctaaacctaggttaaaatggacgcctgaactacatgagcgttttgtggaggcagtaaatcaacttggtgggcctgataaagctacaccaaagacaatcatgagactcatgggtgtccccggactaacactataccaccttaagagtcatcttcagaaatacaggctaagcaaaaacattcatgcccaagctaatggtggaaatgcaaaaaatgtggtgggctcccccttgccaatggtgcagcctaagcaaaaacattcatgcccaagctaatgggggaaatgcaaaaa

SEQ ID NO: 7032 - DNA, 919 bp, Sorghum bicolor
  Clone ID: SORBI-28MAY03-CLUS71530_1
cctactggatcgccaacgcttgtccgcctccgcccgccatcgaaatcgcagctgcaaaaatcgcgtccatctcatcccaatctcatctcactccccatcactactatttcccgggaaaaaatccacgcgaaaatcccctcacccgccacggcgccaccccaccccaccccaccccaccccaccccacggcctctcttctttctcgagagcgaagtgcagtgtacagtgagagaacacttaaaacgggacagtggcgcagccacccggtgtacgagcacttgctccgacttgtgtgtgctcatgccgtgctgcggtggccgtgctgctgctacggacctgcctcataaaagctctcctgcttgcagcttgcacggaggcgggggtagaagacgacttcgcaaggcatctctgctcgagcggagcagtactccgttcaggagacgaggcgttctcctccgggtcctagaaatcctgccgagatggacggcaatgcgaggtcgtcggcggcgaatcagaagaagcccatcgtcgcggacgacgacctcatcgagctgctgtggcacaacgggagcgtcgtcgcgcagccccaggcgcaccacaggccggcgccggcgccggcgccgccgccctccgaccgcgaccgcccggctggcgccagcggcctcaccggcgaggagaccgccgcgtggttcccggacaccctcgacgacgccctcgagaaggacctgtacacgcatctctggtacagcaccatcgccgacgccgccccgcaacacgagggcacgctcctggctaccccgcagccgtcgccgccgccgccgctgccggttgggagcagcggcgtcgagtcgagctgggccggcgacatctgctccaccttctgcggcagcaaccaggtgcccaggacgccggcagggac

SEQ ID NO: 7033 - DNA, 594 bp, Sorghum bicolor
  unsure (1)..(594): unsure at all n locations
  Clone ID: SORBI-28MAY03-CLUS6607_1
gcagaagaggtatgttgagagtgttccattaatcattccacttcttgagaagcaacatcgaaatacaacaagtaaattgcgtgaagtcagtcatgaactcagtgatatgaacgaagccaaactgaaggagaaagctcagctattccatgactcatttttgaccaagttatctttgctattgaaaggcatggtggtggcaccccctgataaatttggagaaactttagttaatgagaggattaatggaggaacatttacaggaagtgagaatttccagctcccgaacaagatgatgccaaatggtggaatgcgtctttatggtggtgcacaataccatcgggcaatggctgaatttcgtctggtagttggtagtatcaggtgccctccaataactagggaggaaattgtcaatgcttgtggtgttgaggatattcatgatgggacaaactactccaggactgcttgtgtaattgctgtggcaaaggcacgtgacacatttgagccattccttcatcagctgggttntaggcttttatacatactgaagaggctgatcccaatctgtgtttatctgctggagaaagatggtgaggg

SEQ ID NO: 7034 - DNA, 852 bp, Sorghum bicolor
  Clone ID: SORBI-28MAY03-CLUS66117_1
gcacgaggccagttcttgctgacaagaatgtgaagtaccatgagcctgagtactggaaatttggggaggaaggaaataaatacttccgtcatgctacggggcagatatatgctgtttcgaaagatcttgcgacttatatttcaatcaatcagcctatcctgcacaaatatgcaaatgaagacgtgtcgcttggatcatggttcattggcttggaagttaatcacattgatgaaaggaacatgtgctgtggaactccaccagattgtgagtggaaagggcaagctggcaatgtctgtgtagcatctttcgattggagctgcagtggcatatgcaagtctgctgagaggatcaaagatggacatgctcgctgtggtgaaggggattcagcagtttggagtgctcttatctagcgcataccctcctttgcccgtaaatatgtagcatacttggtaagctatcgtggtggacacctgcataggcaactcctgaagtaaacttgacaaaacccaaagatgatgccccgtggattatgatctgaaactgcagaaaacaggacgttgccaatggtaacttcgggttggaaaaattctgcaacaacacgtaattttggtctgtcactgttaggaactccaaagtagggttgcaactgatgttactgatcttacaagtagggggagagtttctcagctgatgcgtatggaagcagagatcatgtaatgtagaggacattgttttatgcaaattttgacattcttttgcgagttgcaatcacacattctgtcgctcatgagagtgtaccatgttgtaacatgtgggccgtggacggatgtcggtttagcaaatcttgttcct

SEQ ID NO: 7035 - DNA, 612 bp, Sorghum bicolor
  Clone ID: SORBI-28MAY03-CLUS66084_1
tagcataaacatagtgcattgaaataggaaagtttatagttacaaggcatgacacatatttttgttttgtttggttgtttcaggctatttggtattttggttcatctaccattgtcatcaggaaaccaacatttacacgctgctcacagacgcgtgaatcaattactgaagactaattctaaggtgtcagaaaaaactgttgacagctccttgcaggatactcagttcttgatacggagcaacgtcggtggctccttgtagccgatgacgatgacgcaacctcgtgaccacaaggcagcaatgaagacctcagacagcgacagccatggctggaaaaaataccacagcaacacactctactgaccgttcctaccactacatccagctgtgcaaaaaaggccaatgaagttgttgctaaagctatataatatctgtgcccagtactctcaaatgcatttgcataattactgtagtcctcactaaacgatgctacatctacttgctcctgggcatgtattatatttcagcgcagtgaactgtgatggtttactacacctagcaaaccaaacttttttttatatgtatgtacataaattcaaaacatatactgct

SEQ ID NO: 7036 - DNA, 550 bp, Sorghum bicolor
  Clone ID: SORBI-28MAY03-CLUS66177_1
aacaagcctaggactttgattccaataatttatgcatgtgccctgctcttggcaacaatgccatctatcaccagctacttgaggaggtcattggagtggcagacaccaaaggtggttggcttcgagctcttctcctcacttgttatggctttcatcagctggcagctgttctcggcttgtcagagaccgatgtaacaagacatccatagcactgccaattttacgtgcgatttgatgctcccgaagatgcttcctgatacgtcagaagaattaggatgatcctttgagcctttccactacaactctttggcgttcggttatagaacattttacttagaatcatctgctgtgagctgtagagcagaaaccaatacctcaaatgagttgttctgtaacagatgctcatgtaggcgtttgatccgaaacattttgtttattgtcattatatggtgtgcattttaaatgctctatttggtcgcatcatctagcgtacagatcagataattcagctatcccacagaattcaagaatactaactttggttgcatct

SEQ ID NO: 7037 - DNA, 951 bp, Sorghum bicolor
  Clone ID: SORBI-28MAY03-CLUS6661_1
gcacgaggcagggagaagcttgaggcagcacgtcaagaagagcgggaagctaggattgcccatggagataagaagaatgatttaaatagtgtacgttcggtattagggaaattgcaccaagcaaattcagttgaagaacttgatgagctgattgcaaagaaagagaggactatgcaacatgagaccatttcttctttgaaagaagaaaagcttttaattaaagagattaatgaattaaaagcccaacggaagcagctgtctgccactatgggctcaaaggctgaaatcaatgaggcatttgaccaaaaagatcacattcatgagcggcataaggtgttaaagaaggattctgatgttttatttaccaacctgaaagccctagaggaaaacacaagaaagattcaaaaatctttcgaagatgaaagaacagctctaagaaaattaacagaggaacaccgagcagctaatgaaatacgccaaaaggcctacagtgagtggactgagcttagaaatgagcccagcaagaagaatgaatactttttcgagtacagggatgcccggaatgcagcagaaactttcagagctaatggagatgcaaatggacttaaaacacactgtaatagtcagattgagagaattatggaaatgtggaacacaaacgaggacttccgcaagcagtatgttgaatcaaacaaggttagcacactaaggagattagggacccatgatggacgaagacttggccctgatgaggatcctccagtcattccaagcagaagaccaagcaacatttatccattgtctgcctcaagcccagaagtgcccactttagcttcaatgccagcacctgtattggctgctccagctgcagtccctgccaaagaggactcctttcctgctttggcagccccccagaccagtaagcgcgccaaatcaaaagcatctggtagc

SEQ ID NO: 7038 - DNA, 740 bp, Sorghum bicolor
  unsure (1)..(740): unsure at all n locations
  Clone ID: SORBI-28MAY03-CLUS64853_1
tttttgatctcaatgtgtcagctgaagtggtggataagatctgaaacttcattatctgatgggtgatggcacattcctttgaactgtacagctgacttaagcttcctcaccaacataaaggagaaatactgttcttttttgctgccttgccaccatagagtacctccatgtcaaatttttaccctggtgctaggatcccaagatatagagtagcttttaagttatatgttgcatttcatgacatgatttgaagccaatgttcatagttctgataaagctagttctacccctcaagcaagatgaggatattttggaatagaacctgaccatgcctgtgttgcaaattccagatataaatgtatgcagcatggtgaagggaattatttgttgacaaagatgggggtgcttatttcctggggaatgggcggttatagtgactatgtagacaatgttataaaactgcgactgattcgtcatactaaatgtgcactttgtatgttgcaactgccaaagatcttgctccaaagacgggcaggtttctaggccagcttagtattcgacctttgaaaatctcggatttctgggcatgcatgccagattcttatggataactgtatttaattgtagcagtgagaggagctgagctgcaagatgtcaatcaggtacctgttgatacttgatagtgtgtaactttccttcgtttcttcagattccaanaaggccatccngctatcgtgctt

SEQ ID NO: 7039 - DNA, 626 bp, Sorghum bicolor
  Clone ID: SORBI-28MAY03-CLUS64910_1
atgaccatgcaagggcgaggatcaagagtttgcacagttcgtttcaatatgcctacgatgcgattaagttgcagctgcagtaagtttgagacaatgggtttactttgcccacatgctctgaaagctcttagcatcaagaatatatgcaaaattccagaaagttacatactgaagcggtggaccaaggatgcgaagaaatgggttttcaacccaaaacagtatgaatcatcatatcaggaatgtatgaataatgaagctgcatactgcaactatgttatgaggtatgcttatgatcttgtcacgaagagccaagggcaggaggcattaaggaaagtgctgtgggagaatcttgagagtggtgagaaagaattggagagttacctagaaaacgttacccaacatgcaccttcatacccacttgaaagaatcactaattaacctcctggacttatctgctgaggatgaacaagatacttccttgttctttgggagatgcattcagaatgtctcttaaactgtactcttaagagatgaaaacagatgcttatcaaagatacaagcttgagtaagtttcatgctctcccttcatcatggcgggttacgtcattgagctcagcttctgccca

SEQ ID NO: 7040 - DNA, 698 bp, Sorghum bicolor
  Clone ID: SORBI-28MAY03-CLUS64991_1
cagcacagcgcagaggatgaattctgaagcattagcaagccagcaatgtggatcagtaccacagatttcgataaaccgaggtgaacgtgctgttgagatgaagggcacccctaataatcttcacggacacccgggcatgcagcaaactgtgaatggtttcaatgccgttccaggaccgatgatgttcccacctgccgctcaactggtggtgaatcagatgcagacacatacggctgattgagtaacaagtagaaattgaatctacattgtcaacatgacatttggattgtgcccgcttccagtcagtcagtcgcgggcaccaagcgacgatggtggatggccttagaccgcaccctgccagtggcttggcacccaccaacctcgacattgggggggtttggtcgctgttgatccgttgcgccgtaacccggtgctgcaactgtgagcctgttgtgtaattgcgtaagtagtaattaggatgataacgtgcatagatgtgtcagggttgatgttgtaacagagttgagttgcagtttggagatttagcgatcctgaatgtgtagtagaaaaaaccacagggtaaacgaaacatctgtatagattattcaggagttttttttttagcgttttggtgactggtcgcagacgcagatgcgaccgagcatgaaatcgtgcgaatcagattgtctgttgtttct

SEQ ID NO: 7041 - DNA, 672 bp, Sorghum bicolor
  Clone ID: SORBI-28MAY03-CLUS65107_1
ggtggttaggaaaatgcctaaaaaggacctcgcagaagaggtttggagtctacaggcagcgttgggagaacaatctgaaattaccaagtgtaccaaacaggaatacgaaagacttcaaaatgagaaggttctttgtaggatttgctacgagggagagatatgcatggtgctacttccctgccggcacagaactttatgcaagtcttgcgctgagaaatgcaagaagtgtccaatctgccgtgtgccaattgaagagcgcatgcctgtatatgatgtttaaacctcactaactcagcttaacattacaaatttgtacatgtgggttctgtcatgctgtgcatttagtctcgatcacaactttaagctgattgaggtttgcacttcggaaaaggtctacaatgtatgggggaaatacaagtatatcatgtctaaccaaaagcatggaaaggtggctgatgagcattttgtcatttcagtccagttatctactgtaagtatgtggtcagtgtatttccctcccctcttgtgattggtagatgagtcagatagccttgtttgggtagagcagcattttctcaggaatctcagggatatgcagttgttgggaagaaagtgaaacaaaaacagactgtaaataaaaacattgccttgtttgaatgtagtccttgtttg

SEQ ID NO: 7042 - DNA, 1034 bp, Sorghum bicolor
  Clone ID: SORBI-28MAY03-CLUS6516_1
gcacgagggtccgttgctcctgcccgcgcctccaccagtccgtcgataaagctgcggcattgggacggcgggaggtacaaggagctttccgctcattgcttccccatctcgtgtaggctctccactccgcactcccacgcctgataccattccgccgccgccgccgcctctgaacccacggtgcggcggagatccagccgggcctggatcggcctactccgacactgctttgtgaagataaacaagactgcttgctgtctgctgggaagtggactaagctcacggctgatatcatctgccttgaaggaaccagtgggagaaaagggagtggacagggcccaatcagaagcatggacaaaactgccaatgtggtattggatattgaaggtctgcctcaaccacctgataaatgctgctccggaagtccaaaaatgattagggccttatcacgcaagggttcaaataggatggaaaggaggggcagtgatgagctggagcaagaggatttggcgaaaaaacttatcatcaaagttgtgccgtctcaactggagcagcccctgggccagatcaaggctctggttgctccacattgtactccctgcacacctgttcttattgattctggggaaggaaggagcaaaaggttcagccgattcacgtctatcaaccctcggaaaatcctcctcttattcgcaacgctgtcgagtgtggggacgacaatactgatctacttcacactggcaatcaacagcaaagcggaggcgtagtcgtttgcagacaccaccaccatttgcttcggcggcagcagcagtacattccgagcttgagtttttctcgatttgtttgtggggggaagaagaggaccagatcagatgcagccagtttcaggtgtctccgtgtctgtatccgtgactgagtgagagacactgctaactgcttgagggggtgctcgcgcgttgtacttgtaatttgtattgccttcagttcacccccctcacctcccaaattcccgtcttaccttgcgtgtatgtata

SEQ ID NO: 7043 - DNA, 620 bp, Sorghum bicolor
  Clone ID: SORBI-28MAY03-CLUS65354_1
aaagaaacctgaacacaaatggcgcaaagatttgatgctgatcgggactctcgcagtcactgtcacataccaagctgggctgctcccgccaggtgggttttggcctgatgatcaggtaggccattttgcaggtgacccaatcctccatgatacccatccatcacggtttaaagtgttcttctattgtaatgccacagcattcatggcatcaatggtcatggtcatcctcttgctgaacaacacaataagcaagtacaggagatctcttcttgctatgaagacagcaatggtattggacttgtttggtctccttggagcatatgccgcaggcagctgcagaaagttcaagacatctgcatacgtttttgcacttgtcattgctgtgttcatttaacattgtgattcaatgtgttgctgtcattcgatgaggtggctttattggtcagaaagaagggagaaaagtggattccttgcctgaaaaaaatgtgggcacctatcgaaactgatcctttaagccttcagccatatgctgggcaactgggggagatgcctgtgtaattgtattcttgatgtggcatttattgaattgatgtgcctgatatatacaaagattttatctc

SEQ ID NO: 7044 - DNA, 751 bp, Sorghum bicolor
  Clone ID: SORBI-28MAY03-CLUS6648_1
actaaaatatacagggtactaacgttaaggctggcggcataattctagatgaggccgcgaatagacctagcggaagcggtatgtattactctctctctcatcaatctgcattaacacactaaattattgttatctcatgcttccatgtaagcaacacactagagttcgcatgtaagtgcagcttacactgataaaatcatctcagaatatttcatttggctttgttccactctttcgctttgttcaactaatccatctttgatgctcataccattttaatctatttcttcactatgatccacctgcccagtctttgcatcaatctggcgtggaatgtcaaaccaaagggctttgcctcatgcagatcagcatggctcttggcctcatatagacataattttctactagtctctgatgactccttactagtagtctgtgcctaactgcttgagacataattttctagatacagtcacgtttgtctccttactagtagcttgtgcgtaactgcacgagacataattttcttgatagtcacacttgtctataggccacatggatccttactattagtctttgagtatataagtagtaggtagtctgtgagtatataagtagtatgagctaatgcttggtgaactattgttatctttcagatttttcaggggtgcacacattaagccatgcaaatttgcactgtaactgggcttcttggattttttaaaaaaaacttaggagaatctgaccaagt

SEQ ID NO: 7045 - DNA, 697 bp, Sorghum bicolor
  Clone ID: SORBI-28MAY03-CLUS66522_1
gattttatgtaaagcggattgaagatgatgacgacgacgacgacgatgacgatttggtccctggccaatcgagtagaacaataaagaccaatggatcttctgaacctgtgacaaagccaacagatgttttaagcaaaactaatggatcggagggtgccaataaagaagggagcaagagctggatgcccaaatttattgtaaagccgaagtctgctagcgcagatcctcataagaaacagaagattgaatccatggctgtccaagacaacgggaaaggcctagatgatgaacaaaaaggtgaatctgcgaagcaaaccaatgttctccagtccctgtgccagaactatgatagcgatgatagtgaatgaggacacccctcttgaagccatgacagtcctggttgccaatgctgtatcagtcatcattacaccagaggttgacatgtagttccccaaaccactgtggcattgtgccatcattgtacatcatatctgtcacaaatctctgattgtcaatggctcaacagcaagcattgactaacaaatctgggctatccagataaaactgtgtcattggatatctgaaagggttaagacttcatttgtaaaaatgatagttgcagaaagttcaatctgcagttttcacaagcttttatgcagcaagagtgaggtggtccatcttctcaactcactttttt

SEQ ID NO: 7046 - DNA, 632 bp, Sorghum bicolor
  Clone ID: SORBI-28MAY03-CLUS66542_1
cgcccggggctcgtgtgtcgtcccatctgttcttcgcgaggcgcaacgcaagttcgcaacaaaggcacaaacccctcaccttcctcaaaccctagccctcgcgccccctcccctgcttgcccccgtcgccgccagcatgggctcagatgcggacatggaggattacgggttcgagtactcggacgaagaacctgaggagcaggacgtcgacatcgagaaccagtattacaactccaaaggtttggtcgagacagacccggagggtgcacttgctggttttgatcaagtagtcactatggagcctgaaaaagctgaatggggatttaaagctcttaaacaaactgtcaagctttactataagctggggaaatacaaagaaatgatggatgcctatagagagatgttaacatacataaaatctgctgtcacccggaactacagcgagaaatgtataaacaacataatggattttgtttctggatcagctagtcagaacttttctcttctgcaagagttctaccagacaacactgaaagcgcttgaagaagcaaaaaatgagagattatggttcaagaccaacttgaagctttgcaaaatttggtttgatatgggtgaatacggtcgcatgagca

SEQ ID NO: 7047 - DNA, 828 bp, Sorghum bicolor
  Clone ID: SORBI-28MAY03-CLUS66593_1
agctatcccagattgtgctctgctgccgcggggcgattagataaatccggcggagcaagagggggggaaaattatcctgcgatttttttcttccttcctctccctctcgatttgcccgagaaaatttttcgttgtttcccgcatcactctccactaagccgccgcctcccccgctggtgctgctcgtcgcttcctgcccaattcggcgccattcgcgtcgcccggccccctattaattccctgcctcggtagtcgctggccgattgcctcgtgaaatttcctgtttcgttgcctctcggggtgttaaatacccacgctgctagggttcaatcgtcgtcaggaggcttatcactgcggcctacggcggcggcggcggttcgagagtttgtggatagtttgcgaagagatagttagggttctgcgaattattattattattattttttgtctcccgtgtccgatggaggaatcggacgtaggagttaatcctgggaagcaaatggaagaggataaggctgcgggagtatcgggagatgagggtaagattgagaggagtcactctatcaatctgaatagggcgcccacagttgctgtggaggcgaggagcactcaggggaatgttgagacgcacggcgcagtggtgtcgggaactaaggatgcaggcaccggaaaggcagagcaatccagtggtgatggtcaggagaagttacccaagtgtgagcaagtcgactacgaaagtgagattgaaggctgtgtagatgatgagaaccctgtcaagaaggctgctttagttactttggttggaaatgaatattgtggtggtgatga

SEQ ID NO: 7048 - DNA, 661 bp, Sorghum bicolor
  Clone ID: SORBI-28MAY03-CLUS65677_1
tttggacagggatagggttgaaattaaactaaagttccaatccaacacgcgtggattgagatggatataagtatatcgggcaaggcctgacacatgtttccaatacttgtaccacatatgctgatgcaacttcagtggtgacacgtttgtttatctgcctttgtttttccatgcagacctgacgttgtcccctgttcaccatgcggccattgggcttgtccatccatcgcgcggcatctcggtgaggatgcccaggtacatccgttcagttccagaccggagcccagaggattgcggcactgccaccgatattgctagcatgttcaaagctcagacccggaagatggatgtcagcagcgagggccaggagtagagatgcaatgcaagcgaggttgagcaggtcggcccattgcctcatccttcgtagcttttcttatgtttaccagttttgtgtacagaacgaaccagggtgaaccactgatcccactggtgaaatggtgaaaactgaatagggtaggacagtcaacactgatccaactggcttccagtttttctttgtacataaagaatctgaatgcagttggaacacggaagcaagcgcatgaattgcacgttgtctaaaaaaaatgcataaatacatcagatagcagctttgtactgt

SEQ ID NO: 7049 - DNA, 613 bp, Sorghum bicolor
  Clone ID: SORBI-28MAY03-CLUS65687_1
tctatggccgacaggagccaagatcaaagaaagcaaagacgatgttttcgccatcctccatgagtggcggtggtggcaacggaggggataatgccaagaaccagctccagactttcctgacccgggccgggcacagcaaccccacctacaagacgaagcagatcaagagctatctcttcaggtcgacggttgagttcaacggcatgcagttcgtggggcagccttgtgcaaacaagaaacttgcggagaaggatgctgcgagtgaggcactgaactggctcacaggagatggtggtgcaacgatcactgactctaggggcgcccaggacgcagaccccatgcccttgctgatgcaaccaccacgcaggcgacggcatagccatcgtcggaggagctgattagaacagcatgttttttttatcgttttcttagttgagcatagaagctagcgaggaaaaaaaatattagtagactgcacttgaaacgtactcctataatataatagttctgacggggaatactagagagctgatggcatagaacggtagagagaacactagctttaacgatggaagggtggtccatttttcgttggaggtactgaattcatgtt

SEQ ID NO: 7050 - DNA, 990 bp, Sorghum bicolor
  Clone ID: SORBI-28MAY03-CLUS657_1
ggacaagagcgcaagcctccatccaggtcctaaaaccctagaggagaggagtcgcgtccgcagcatgtgctttctgaacgcgcgaggccgaagtcccaccaatttttgtttgtgaccttatcaaagaccaaaaagaagcctggtttagagcgcaagggcaaagtagtcgccgagatcaaagatgctatcgacaaatacagcagtgcctatgttttcacctatgataacatgaggaatcagaagctcaaggacctcagggagcagctcaaatcttctagcaggatatttcttgctggaaagaaggttatgcagatagcgttggggcgttcacctgctgatgaagctaaaacaggcctccacaaactttccaagttccttcaaggcgactctggtctgttcttcaccaatcttccaagggatgatgttgagaggatgtttcgagaatttgaggagcatgattttgcaaggacaggaagtactgccgcagagacggtggagcttaaagaaggtcctctggaacagttcacacatgagatggagccatttctacggaagcaaggacttccagttcgcttgaacaaaggtgttgtagagttggttgcagaccatgtagtttgtgaggaaggaaagcccctttcaccagaagcagcacagactctgcggttgcttggaatacagatggcaacattccgtctataccttgtgtgccgctggtcatgtgatgacttcgaagtttacaaagaaggcttgatgcacctaggagctgatgattcctcttaagcttgcgtttcctgtatacaagggcacacttttctgtcttgacttggacagtgtttggtagtctgtgtgtggccatgtaccagtgagggttggaaattaggaagatgctatctgcagaaattttgctagtgtatttcctcattctgtcccatctttactcaaccgttgaaaggtgtaagctgattcgtatatcatatttcaacaagatac

SEQ ID NO: 7051 - DNA, 662 bp, Sorghum bicolor
  unsure (1)..(662): unsure at all n locations
  Clone ID: SORBI-28MAY03-CLUS65804_1
gaaagatgggataacaccgcatgtattggagctgcccttgtattatgtggcagcttgactgttcagctatttgggtcagctcntaagaagtccaagaaagttaaaaaacgcagcagcaatgctttagaaacgccagtgaaacaacaagactacttatcgttatctcctataccagttgattcggggaagttcataggaaggcaattagaaaggaggaacaaaacattatagcccaacttcaaggcaagaaaggaaatcccgcgatgataggctcacacaccaaattattgtcctgaggcatcacttcttggctcgtcaaatatggggatggtgctggattgctccgcatgaagattttttttttagttttttctttttagttttttcccgcaatatcttggagctcgtttttggatttctattttgtctcaatgaccgtgctagaatacctcatgcatattaggaaatgaggcattgctagtggcaactcgaggaggtccatggtccacctagacaattgcgttaactgagacattattatgttttgggcactgttaactgtatagatttcatgtaaatgattctagagtactgaactgagcatacctttgtataatactgaaataacaaataccatgcatggtattatttgactcacaatc

SEQ ID NO: 7052 - DNA, 737 bp, Sorghum bicolor
  Clone ID: SORBI-28MAY03-CLUS65902_1
gatctaaatgtaaaattgggagctactgtactgtaggaagaaggttgcaagaggttaatatattgggtggcctcatacttccagtttggggtacaatagaaaaggcgctggccaaccaggtacgcctgattcacaggagaatacgtgttgtccgtttagtcacaacaaatgacaataagcgaatcgttggactgctgattccaaattcagcagtggagtcagtactaacaggcttgcaatgggtccaggacattgatgactgacatggaaaggcttgaattttggttctcatttgcattcattttacaggtttttttcagccctttaacactgttctgatgttagatgcagcagcattagtgcctctgcatatttgattttgtttctagggagatagcaaggtaaacttacccgaagtgatgaaattcttagcttacaggtcaggtaggtatatacagacaacttgtgtatgtaaaatatgcggtgtgataccgctgttgtctcttctttcttttcctctgttctctacctggtgttctggtttatatgttgtatagccatgtaaagctgctaaaaaagctccaggttaaactcaaaggaagtcgcacctcaatctggtgctgccatagtgtttcctgtggagttactgctgatgccgaactgaacagacaagaaaaactggggcgcatttgtattatgatcaaatcatgtacgtgcaaaactttattaccagtgtc

SEQ ID NO: 7053 - DNA, 1157 bp, Sorghum bicolor
  Clone ID: SORBI-28MAY03-CLUS66029_1
gatactgacagaagccaagtagaattaaagggaggagtctcagattttatggcgggtccgccagataacaagcaaatcgtaccttatggcactatgcctaatgatgtctgtgatgaatcaagtgttgtttttggtgccttacataggcttcgtctgtctcgctcagatatcataagatggctgagatcaccgatcatgcacactacgttagatggcttttttgtccgattgcgatttggtaaatgggaggaagcattgggtggcacaggataccatgttgcccgcctgaatggagcactggataggagtcgcctttctgtaaccatcagaaattcaacctgtcaagtagattctcgctttgtatccaaccatgacttccatgaggatgagctgaaggcatggtggtctgctgcaatgaagagtgagtggaagctaccgtcaaaggaagaactgagtgtgaagctaagagaaagagagctacttcgttcgtagaatggaacagttggaaggcttctatccgtcctacactcctactaattaacttaatggaaagttatgagccagttgatgaggcatgtattatttcaccacgataagttgtatagtgttgatttttgcggttagtctgcaaaggcgacgctgctatggctaccacccttggtgtgcccccctccactgtttctgggttgtcagagtttacagtgcaccaacgcgcaacaagcgcgctaggtggtcaacagctggaccgacctagcaaagagttgtgtggaccgatattacataaatgggtcaaccaaaacgtgctcgacatcgagacctacgagtcttcctggaagagctcgcacgcacgcccgttgaacgctgggaacaacgcatctagggcctccacctcgctcgtggacttttcgacaaagtcccggagtgcagggcatcgagtatccccctcggcgcaggcgaaaccggtgcggtcggcggagcgatccccagtcgcttgttcaggagaacctcgccccgcctagcacttgacttcttttttttttgatgggatgagctcctgtgtgatatcctattatctgtaaataggaaggcactgacagatttgtacaattgtacaacttttttggggggggaagaaacttgaaataagattacttatc

SEQ ID NO: 7054 - DNA, 690 bp, Sorghum bicolor
  Clone ID: SORBI-28MAY03-CLUS6525_1
tttgaccaaaagttcacgtatgtgttggccggatgggaggggacaacacatggtgcactagttttacgtgatgctttatcacgtgaaggtggccttcgtgtgccacaaggtaaatattatctagttgatgctggatatggagcgaaaccaggatttttaccccacgcgtcgggtgtacgataccacttgaatgaatgggggagtaatccggtgcaaaatcagaaggaattgttcaaccgtaggcactgctcattgagaataatagttgagcaagcatttggggcactgaaaaggagattcaaagttcttgacgatgcctctacattttttccttatgaaactcaagttgatattgttgttgcttgctgcattattcataattgggtgattgaagatgggagtgatgaattcaatgtcccaagtgacaacgatgaggacacccagcataccacatatgctgggacagcaagtgagaatgcctgccattatgctagcttttagggaaggcttggctgaccaaatgtgggcagatcgtctaagccatggaaactagtgttggtcaatgtaatttgtgttgtatttcatttgtttggaccatgtaatctttgtatttgacggctgaaattgtatttgaggacatatttgttacaaataattgattgctttttgttggcttatatttgaggcagc

SEQ ID NO: 7055 - DNA, 677 bp, Sorghum bicolor
  Clone ID: SORBI-28MAY03-CLUS66870_1
aaaagcagcaccgcactccccaatctcccctcctcccaattgcacccggctgcaattgctctcctttcatctccaaacctcccgtatacctttaatatgttccggaacgcccttcgacagtcgacgcgcgccgtcggcgctgtctctgctgctggcagggtcgccgcggtccgaaatgccgcacccgcctccatcaacgccgctcgattctacgcctccgacgccaaggccactcctactgaggtttcttccatcctcgagcaacgaattcgtggtgttcaggaggagtccggtctcgctgagactggccgtgtcctctccgtcggtgatggtatcgcccgtgttcacggcatggccaacgttcaggccgaggagcttgtcgagttcgcctccggtgtcaagggaatgtgcatgaacctcgaggccggccaggtcggtgttgtgttgttcggttctgatcgtctcgtcaaggagggtgagaccgttaagcgtaccggcgagattgttgatgtcccagtcggccctgagatgctcggccgtgttgtcgacgctctcggtaaccccattgacggcaagggccccatcaacaccaaggagaagcgccgtgctcagctcaaggctcctggcattctgccccgaaagtccgtcaacgagcccgtccagactggtctcaagtc

SEQ ID NO: 7056 - DNA, 563 bp, Sorghum bicolor
  Clone ID: SORBI-28MAY03-CLUS66874_1
agaaacccagaatctagtctagtactagaccagaccaatttggtgctaggaaacatgggtcatgtgaatgtagtataccagctcctgcaagcatctcttgcgcaacgcctactactgctcgtccctctcctcctattgctactgcacttcgcctccagaaaccgtcatggtagcaaagaaaagcagaagcgacccaagcatcatctcccgcctccttcgcctcctggcctgcccatcataggccacctgcacctcgtcggcgacctcccgcacgtctccctccgcagcctagcagcaaagcacggcggcctcatgctcctccgcttcggcaccgtcccaaacctcgtcgtgtcgtcctcgcgcgcggcgcggctggtcatgcagacacatgaccacgccttcgcctcgcggccggcttccaaggtctccaataccctcgtctatgggtcatctgatattgccttctccccctacggcgatcactggcgtcaggttaggaggctcgttaccacacacctcttcactgtcaagaaggtgaactcgtaccggctctcccgccaaga

SEQ ID NO: 7057 - DNA, 629 bp, Sorghum bicolor
  Clone ID: SORBI-28MAY03-CLUS67092_1
ccggaggggttcctggcccggaccaagggcaggggcctcgtcgtcaggtcgtgggcgccgcagcgggacgtgctggggcacgcgtccgtgggcggcttcgtcacgcactgcggctggaactcggtcctggaggcggtgatggcgggcgtgccgatgctggcgtggccgctctacgcggagcagcggctcaaccgggtgttcctggagaaggagatgcggctggccgtggccgtggaagggtacgacaccgacacgggcctcgtggcggccgaggaggttgctgccaaggtgcgatggctcatggactccgagggcgggaggaggctccgggagcgcacgctggaggccatgcgccaggccaaggacgcgctgcgcgagggcggcgagtcggagaccacgctggccgggctggtggacgagtggaaaaaacgcacttgacgtcctggttggttgttgttggaagggacggcggacgttggcgcacacttgtccactgggagaaagtgggccagccgccattggtcattatctatgggtctgcgggactgggtgtcctattttttccccatgtgtgttttggaaattgggtaaaatattgtagcagcattttttttttaagagtactggcc

SEQ ID NO: 7058 - DNA, 543 bp, Sorghum bicolor
  Clone ID: SORBI-28MAY03-CLUS6699_1
tgtagctggggataaaaagcccacaaaaaagaaaataataaaaaaggttgtgaaagttgttcggaaaaaaacaactggaccttcagctgataaatcttctgaggacaagaatgctgtagcagaatctgcaaacaaaactgcagaagggggtcagagtcaacaaaagaatgaggatggtggaaaagaacaagagggagctggcataagtcaacagcctgaagcaaagaaaactggaaaaaagaaaataattcgaaggattgttaaaaggaaagtttctggttcaggttctcagttgactgcccctgctacacctgctgaaactagtaagcaagaaactgttcagccagataaaaatgttgagagctcaaccgatgttggaagtcctcagactaagctgcaagaagggtcaaaaattccatctggagaagatatctcaaatcagaagaaagaagagaagccagaggaaaacgaacacccattgaatgatcgcagttcaaatgaggataagggcaatcacaaggaagctatggaacaaaaagatcc

SEQ ID NO: 7059 - DNA, 611 bp, Sorghum bicolor
  Clone ID: SORBI-28MAY03-CLUS66231_1
tcaatgttttgggtgatgtgtttggtaagaaccctccggtctcaaatccaaatcctgtggaggcgtcagaaattgcagacataattgacttcttgcatcacgcggtgatgtatgaaggccaagggggtcctgttcagagcacgagcaaacccaagttggagatactgacattatgcgggaaagtaatagaaattttgaggccagacgtgcaacatcttctctcccacctgaagattgatcccgcctcttcaatctatgctgcaacgcatccaaagctcgttcaaagctcatcataatgttatagcttacaagtgtattctaatgatgcaagatgcttggaagttggaaccactgcagaagtctcaacgtgtgatgatgtaggaggatcagtagaattacaataactgtaacatgtatcctcatccaaccggaatcttgatcttctcgtcatgactaggggcatattctaagtgattcgctgttgtcagttgtatcctttagctagaatgttgtaaatactaactgcttaagcgtgtattaggacgacatgcataattccattgtgtacccatggaggttatcttgccaggctaagaattttggctgccttg

SEQ ID NO: 7060 - DNA, 945 bp, Sorghum bicolor
  Clone ID: SORBI-28MAY03-CLUS66346_1
cacaaggacagatcaaccaaagaagaagaggaagaaggcagacttaactaagaacgttcaacctaacaatgttggctatggttacaatgctccatttgaacctgcatattgcaatccctttaacaatggatatccttgggcaactgaaccttacatgtatagctcaatggggatgccctacaccggttatccaatggatccatattgtgtgaatacttttactggcatgccaccgcaggttcttgcaatgcaaggctatccagcaagctaccaaaggcctgcaactgtgcccatgcattgtgggggcactgcagctgctagggcactttcaaatcaccctgagaggagtgagagacccaatgacactcgtgttcagccccgatcaccagagcacaagcgacaaatggtctcctctcatggctcagaatcaagaacaaggaacagaacaaggccaagctccgagaggagggaacatgggcattctgacagagcctccgttgaggatcactctagtaggaagcggatgcgcgattcctctccaaagtatgacgataggcagagcggccggagatcgagacatggttccaggggtatgatgactcgtgaggaggatgcaagcgacgatgaacgtaatttcaagaggagatggggtcgcagatcatcaggaggcgtggacacaaggcactgaatggaagaatgtggactatggcggaccaagtgcagtaatgcattgctggttaccagtgctcacctatggattttcttttactcctaattgtatgtttgcccccgaaggcagaggaaaggagagggaaacttccggttccctggcgagatgtattgatattagcaatttgtactaatgatgagagcattgccagctctctgtaatgcaatctctccaaatatatatagaattccaataagtttccaagtttttttttt

SEQ ID NO: 7061 - DNA, 623 bp, Sorghum bicolor
  unsure (1)..(623): unsure at all n locations
  Clone ID: SORBI-28MAY03-CLUS66350_1
actaaaccctgaaaaggtccntgagccttcttccaagaagctgaggctgaaagacaaagaggaacaagttccgccaacgaaaacagcaactgccattgcagtcgaggcggaagatgatgatccggaggaacctccaggatttggtttcagcaatactcagcgtaatgatataggagcaacaaagccaccgatgaatttggaaaatggtaatgaagcgaagccaaatggaggtgagccagctgctatcagcaatccaggggatgaggaggatcctgaagtgccccctggatttggttaatgtcagtgcagctgtttctttcatagcaatgtacaagaagggaaatgtttgatcttctgttgacaggaagaggaatgctttagctcatgcctgagacttcagaggtacagcagttgaaaccagtgtaatggtggctaagtctatgcagccccaggatatcttttaatgcgatgttttgtgcggagtttctttctgtttctgccctgcttgcctcctgagttgctagttgcttgttccctgtaagtgtaaatgttgcaaggcatggtgagatggctttgaagcccatgggttattttgggcatcgccgaagggagagtatatattc

SEQ ID NO: 7062 - DNA, 595 bp, Sorghum bicolor
  Clone ID: SORBI-28MAY03-CLUS66359_1
tggcgcttctcccgggaccccgacctgccgggcaggccctggggcatcccgcccctcctggacgtcgggttatcacaggggatccagagcagcctgataatccttgggggatcactccgttcaagaaggtggtcaatttgccatcaagaatcgatccccaccaaacgtctgctgttgtcacgcttcatggtcagctatttgtgcgtgcaccatttggtcatcctgatatgtagatatggaatcatgtttacttcagttttgttgactgcggtgcttcttcaccagtgatattccttgatattactagggtttatgtctgttctgttgaggaaataggatttcatttgagcagatacatctgtcaagctgacttagcagaaccgttctgtggttgttatcaccttgtttgttattgcagtagtggtcataaaattagctggttcatgcatgtattccagttttatagagaaaggagatgttggtcgtattagggctaatttgacattgtggttacttattattctttattatttttcttctgtattataaatgcctctctgggtcactccagggcgccctaaagttgcattttggc

SEQ ID NO: 7063 - DNA, 676 bp, Sorghum bicolor
  Clone ID: SORBI-28MAY03-CLUS66449_1
gcacgagggccgccagcccgccaccgccggaggcctcccgagagaaccccgaccaagccacaagcgcacgccggccgtcgcagtgactccccctctgctaccgctctgcctccccacctccgtctaagcacttcaagaaccgtgaagcaggcagggagaaggtgggttcccgttccagccgcagttgcgcggattggcgattcccaggacatcagacgaccaaaccctctcatctgacctaagggcaggcacccgcgaggctgacgcttgagtgccagagtgaagcccctcctccggccgcgcagtctccaattcgacgggtgtcccgggcggtgcgtaccgctagcttgcagtggtggtctggtgggtcttgcggtggtggcctgcaaaactagggactgaggcttcgagccggaacttcctgatcccatctcatgtccggcccgggctgccgcaccccgccgcagccgccgtccgcgccgctgctcctggcgccgcccaccgacggcggcggcggcggtggggcggctcaaggatgatggcgacttcgatgctctccgccgcgccatcgttcgcaaggtcaaggacaacgaggtactacggaacaaaatcatatcagaggtaaagcagtcagtggttctacaagaggatggattctagagaatgaaattaaaag

SEQ ID NO: 7064 - DNA, 524 bp, Sorghum bicolor
  Clone ID: SORBI-28MAY03-CLUS6639_1
gcacgagggatagatctgcatatgatttgaaagctccccacgcgtccggtggtgtcccacttgttgctcatgaaaaattctccaaacctagagaggttgagaaacttgtcatagttccctcgaaaaaagacctggggctggcttttaagggcaaccaaaagatggtccttgaagcattggaggctatgagtgagaaggaagcatttgagatgaaagctgaactagaaaccaagggggagacaaattttagagtctgcacacttggaaaagatgtggtgattacaaagaagatggtatcaatcagcatggagaagaagctggaacatcagcgagtcttcaccccttcggtcatcgagccgtcatttggcataggccggatcatctactgcttgtttgagcattcattttacacaaggcctagcaaatcagaagaggaacaactgaatgtcttccggttccctcctcttgtggctcctatcaagtgcaccgtgttccccctcgttaaaaatcaagagtttgatgct

SEQ ID NO: 7065 - DNA, 677 bp, Sorghum bicolor
  Clone ID: SORBI-28MAY03-CLUS6731_1
ggcctcccgtggtgcggttcgtccttgctccgggtgcgcggcgaaggccatggcgaagggcggcgctgccacggtcatcctcgccgtcgtgctgctgtgcctgtgccacccggccaagaacgacgggtcgctgagccttctcgtcgtcggggactggggccgtaagggggcgtgcaaccagtcccgggtcgccgagcagatgggaagggtcggggagaagctcgacatcgacttcgtcgtctccaccggggacaacttctacgacaccgggctgacgggcgttgatgacgacgcgtttgagcaatccttcacgaacatctacacggcaaagagcttacagaagccgtggtacctagttctggggaatcatgactacaagggtgacgcactagctcagtttagtccagtcctgcgtaagatcgacagccggtttatttgcatgagatcattcattgtgaacgcagaaatcgcggatttcttttttatcgacaccaccccgtttcaactgaaatattggactcacccgaaagataatcattatgactggagaggagtagcacctcgagagaaatacattgccaacttgctgaaggatttggataaggcgctgaagaaatcaactgggaagtggaagattgccattggccatcataccatggaggggtgtagtcaccatg

SEQ ID NO: 7066 - DNA, 623 bp, Sorghum bicolor
  Clone ID: SORBI-28MAY03-CLUS67274_1
caagaaggacgtgattgctatgccaagagtcttgtactccagatatagaagcgttttggttgtgaaggaaaagaaggaacatggagaaagattgactgaagaggaggagaccatgaacatggaagctcaagctgaagatttgaaacaaaaaatagaagaaagattggaagactctaacagaatggattgctatctgttttacgtctatggaaaaatctatgaaaagattgatgaagacattgatagagccattgaatggtaccaaaaaggttctgatgttgataccgactcttgcttaaagaaccatttgctttgtaatgaagcttggagaatcaaatgtaacaagagattgctcaagttgcaagctagaaaaggtctccaagtcatcattgtcaacaaaaaccgtgaagactaatgggtctgttgaatagaacttttagattactagtctttactttatattcagagtttttactttttcattggttcttatatatcaatatgtcttctatctataaatactactttttttaactcactttttttttatcagtattacttcaaatatatattcatggactattgtttcaatagttatgattatttcactcaataaaattcat

SEQ ID NO: 7067 - DNA, 638 bp, Sorghum bicolor
  Clone ID: SORBI-28MAY03-CLUS67272_1
actcgcggacggcgtgcgcggcctgtaccgcggcttcggtgtctcgttgctgacctacgcgccctccagcgccgcgtggtggggctcctacgcgacggcgcagcggctcctctggcgcgccgtcggccccgcgcaccacgacagccgcggcgccgcgatggccgtgcaaggcgcgagcgccgccgcggcgggaagcgcggccgcgctggtgacgatgccgctggacaccgtgaagacgcggctgcaggtgatggacggtggggcgcaggcgccgacgctcgcggccgcggcgcgcgcgctggttcgggagggaggctgggctgcttgctaccgcgggctcgggccgcggtgcgcgtccatgtcgctgtcttcggccaccatggtcaccacatacgagttcctgaaacggctctcggccaaggaaggctccctctgactctgaggtctgagcttggattgaaagtgtatccatgggagtgtgaatggatcatccttgtacatgtccaaagtccaaatgcgtacaccttgctctgatctcttgctgggatctaaggatgcaaggtttctgctgggtttgtctgtcgatggcgatgacgacgaaaatttctgtaaaataaagactgtttattatactactg

SEQ ID NO: 7068 - DNA, 606 bp, Sorghum bicolor
  Clone ID: SORBI-28MAY03-CLUS67327_1
attcctctttcgtctctttgtctgtcaactggttcgttctcagctgcctcagcaaagcaatcaagatggctttcggaactctcttcacccgcgagaacaactgccgttctaccgccatccgcgcggtcgctaaggccaacgacatcgagctcaacatcgttgaggccgagaagggcaacgctaccgttgagcacctcaaggccaacggtctcggcaagatccctgccttcattggcgaggatggtttcgctctctctgagtgcattgccattgccatctacatcacctcccagaacgagaagaccactcttctcggcaagaccaagcaggactatgcttctatcctgaagtggatgtccttcttcaactccgagatccttcccagcctcatcgcttggttcggtcccctcaagggcgacgctccctacaacaagaagaacgtcgatgatgcctccaaggcttccctgaaggctttctccgttgtcgaggagcacctcatccgcaacaccttccttgttggcgagcgcatcacccttgccgacctcttcgctgctggcatcgccgtccgtggcttccagtacttcttcgacaagcagtggcgtgagg

SEQ ID NO: 7069 - DNA, 560 bp, Sorghum bicolor
  unsure (1)..(560): unsure at all n locations
  Clone ID: SORBI-28MAY03-CLUS67312_1
aaatgggatctgccgtgccctgactgcgctttttaatggagccaccacccctcctcccccaccgttccttttctccaccattgaagcacactctgatcctcactccgctcactgtcacacgcacgcactacactcacaactcatccgcagtcacaagctcgcctgctgctccctccctcagtcctccggttgaggaggcgttgctgctgctcctgcctgctggctaccctgccctgttcgctcttccgttccgcggcgcatcccacaggaagggaggatcacacagctttgctcttgctcggctgctcctggctcccttgtggccttgtcccgtccaccaaagaaggaaacgcccagccggcaactctagccgtcgtctatctcgtctcgtctcgtctcgtatcatcggagtcgaaggacggaagaggtggatgggatgaagcgacctaccaagaatgagaggctgggctactcctggcacaagtagaggacgaaccccagcagcagccgagccacagggaggaggaggaggaggaggaggaggaacanatgggcaactg

SEQ ID NO: 7070 - DNA, 842 bp, Sorghum bicolor
  Clone ID: SORBI-28MAY03-CLUS66650_1
caggcaggataacaagcagaggaggattagtctgttggagcttcctacactaaatattttgtgtttaggtggcaaagctatagctttcttagccagaaggcttgtaactcgacctgcaattggatgttcatgagaatgcagtgaggcagtgggtagactgaaaagttcattcagcaaacaactatgcagctgcttctgaggagagacttggcagctcattcagaagttgaaaaccgaaagtattaatcccaagcagtggagacttggaaatttccagcgcatgttgtgcccacagagttttacaatggaaaacaatcgttctcgtgcaccattgggagacaagactaacacctccggacaagttgatgataaggaacgtaagagagaaagggatagagctcggtggcatgcaatgtctctagaaaagaagactgcaattaataaaaggcgtcgtgaatcctatcatcaaagaaaacaacatgttactggacctaccgattgtaatgaatctaacatattgagttctctatgcatgtttatttcacatgtatgtgtatttctcatgtatgtgtaatgtgcaactatttttggggggccgcgcatccaaacacggaaaccattggaacaagaaatggagactaaaaggaaggggaaggagagcactactgatgtcaccgatacctctactacttatgttgataaaacttgtgtgaaaagtacatcacgaagtacttactttagtgagaggtacaaaaatatgccacctgaacaaagagaagcaaggcgtgagtatcaaaggttgtataatagtacacccaatcgtaagaaggcatgaaaaaatc

SEQ ID NO: 7071 - DNA, 612 bp, Sorghum bicolor
  unsure (1)..(612): unsure at all n locations
  Clone ID: SORBI-28MAY03-CLUS66652_1
tcctcttcatgtctgcctacccttgcgtctaccgacccagcgacgaccccgntgatgtctgccccttcgctgctccctccgtcgctgcctggcaagctgttgccactgctgtcaccatgcccagcatccccatccccaagtcttccgcctacttctccatcgccatgggtatactatgcgctgtccaggctatcgccaagcacttctggctcgtcggttctcgcgagaagtaccgtgattggctccccaactggatgtccgttggtgtcgcctgggttctcggccccgactccggatatgccaacgccattctctttggctctattacagcgtggtggtggcgcaaatggttcaacaaccattttgaaatgtatgcttttgcgatcgctgctggtttgatcgccggagaaggattcggtggtgtcatcaacgccgccctcgagctcggaaaggtcagcggttctttcaagggaactgagattgctctgcccggtgctgagtggtaattactcaaatagttaatgcgtcgtgagtgtttattgggcgattggcggaggatgttacaccgatcaaatagctggctttgctatatgaatatacccacttatctcc

SEQ ID NO: 7072 - DNA, 678 bp, Sorghum bicolor
  Clone ID: SORBI-28MAY03-CLUS66760_1
atccagtcgtgccagcaagttcatttgactctgcaactgatcgcccatcatggtcgccgaaacagtcgtccccgagcgtttgcccgaggattccctccagcctcgctacgatgagaccgcgcagcctcgctatgatgagaaggagcctcatttcgacacggacctcaagtctgaggccgacagcgaagatgatcgtatcgtcgacctgttctctagctttcctcctgcaaagggtgttgagcatgagcctaaccctctgactgtgcgtgctgtcattgtcggtatcattcttggttcgctcgtcaacgcctccaacgtctatctcggcctcaagactggtttcaccttccccgctaccatgttcggcgccatcttcggttacggcttcatcctcatgctcacaaagtccctccctcacgtccccatcctcggcggcaaattcggtccccaagagaactccatcatccaagccgctgccaccggcgccggtggcatgtccggtgtcttcgtcgccggtctacccgccatgtaccgtctcgacctgctctccgacgaccccaagaaggactttggtcgcatcctcaccatcacctttgtctgcgccttcttcggcctcttcgctgctgttcccctccgacgattcttcatcatcaatgtcgcgagggagctcaacctcgt

SEQ ID NO: 7073 - DNA, 638 bp, Sorghum bicolor
  Clone ID: SORBI-28MAY03-CLUS66802_1
ctgttcagctccagcaccgcagccgaccaaggtcattccagatccagtggtggctgtggctctggctgtggcggtggaggctgcggcagtggcagcatggtcgccgaaggctccaccggcaggcatgccaagtccggaggctgtggctctagctgcggtggtggttgcggtggcggtggcggctgtggcaccatattcaatgtgagcaccaaggccggcggcgagggcaagcactctgtgtccggcggctgtggctctggctgcggcggtggaggctgtggtggcggttgcggcaccgtgttcaacgcatgatcctgggcgctggctggccaattgagccaaggtgctgttgtcctctacaagccttgtacttgctccggcatgtatctattggtgtgccttgggaattgacgttgtggcttgagcatccctctataatcagatatgtaaataatcaagtaagtaaatgaataaacgatggatcgagaaagaaaacccttggtggttttccttgctgctactgcttaggtggaagtcaggacttatgggaattgggaacgctcccaatgatgcgtgcatcctacagtgtgtaaagtttttgctcctccactataagagatttaagtttatttcaagtc

SEQ ID NO: 7074 - DNA, 905 bp, Sorghum bicolor
  Clone ID: SORBI-28MAY03-CLUS6668_1
cggctatcccgaccgaaaccggattcgcggaccgcatctggtcacccctagcagccgaggctagcacgcggcgccctgcggccatggaggacgaggagcacgaggtgtacggccaggagatccccgtcgacggcgaggacgtcgacatggcaggcggcgacgacgccaccaagctgcaggagctcgacgagatgaagcgccggctcaaggagatggaagaggaggccgccgcgctccgcgagatgcaggccaaggtcgccaaggagatgcaaggtgtagatcccaatgcaaccacatctgaaaacaaagaagagatggattctcggtcggtattcgtcggaaatgttgactatgcatgcactccagaagaagtgcagcagcacttcaactcttgtggaactgttaacagagtgacaatcctgactgacaagtttgggcaaccaaaaggttttgcttatgtggaatttgttgaagttgaagctgttcaggaagctgttaagttgaacgaatcagaattgcatggtcgccaactcaaggtggcaccgaagaggaccaacgttcctgggatgaagcaaccccgcggtcgaggtttcaatccataccatggccacccctacatgaggccatatggttatagtccttatggctatgggagattccccagattccgccgcccgagaagaccttatttttgaggctcgggtttctatatggtttgcagaacatggacgataatcggttaagattctggagaaggctggaccttatccccgccttcaattatttcacacatagctttcgggatgttctcagacatgttgtttccgtattgacgatgcttaagctttgtactgtattgtttcagttacagacttacagttatgcaaaacgactatgttttagtt

SEQ ID NO: 7075 - DNA, 667 bp, Sorghum bicolor
  Clone ID: SORBI-28MAY03-CLUS66814_1
ttggtgaatctgcagttttcatatttttagttgctgagagtgaagaggcacttgttaaaaggctaatccaccgtaaaacagaaacatcagatatgcttcttgtcagagttgcaacagccagggaggaggtgaaacgcatgaagaatttcgactatgtggttgtaaacgctgaagggaaacttgaggaggctgttaaacaagtggagtctatcattgatgctgagaaggctaaaattcacaagcggcatgtcaatatctaagctaaagatcatgtgatttatgcctagtgtcttcatctgtttttaaaggaaaattatctgtccaagtttgctgaagcgtgatgaaatgactttcaggtttcagtagccagaaagttcaatggactgctgacttacaagaatatgacatgttctatttaagggatttccctggccacaaccagggcagtgcacactttctgggatatatacaccattctcttgttgttatttgtctctttttttcctttgatttttagttctgacgggaggaatctgaagggctgtaccaaactagttctgggtgagtcttaaaatgatgtactatcattctcaatttcatgttgactagtgttgctgggcatgcacaagaaacaggtgccccaaatagcaaaattgctagttggttc

SEQ ID NO: 7076 - DNA, 654 bp, Sorghum bicolor
  Clone ID: SORBI-28MAY03-CLUS67538_1
cacggacgtggacatcctgtggttccggccgccgttcccgcgcctgccgcggggcgcgcaggtcgtcatgtcgtccgacttcttcgtcggcgacgtcgactcgccccacaactaccccaacggcgggctcctctacgtccggtcgtcgccggccaccgtggggttctaccgccactggcaggcgtcgagggcgaggttcccgggccaccacgagcagtacgtcttcgacaagatcgtcaaggaagggtcgtacgccgccgccgcccccggcgcccgggtgcagttcctcgacacggccgtcttcggcgggttctgccagcacggcgacgacctagggaaggtggccaccatgcacgccaactgctgcgtcgggctggaaaacaagctcttcgacctcaagaacgtgctccaggactggaagacgtacagggcgcgcgccagagccggcaacgcgcagggattctcctggcgggtgcccgggagatgcatacactgactggaggggttgagctcatttctgattgttggccagatgcaacagctgtagctcatttgtttttctagtgagtacatatacatgcgaagctttttttttttgtaatgtatatagaattattatattattagtgacgcaaacaccaccatattccatcc

SEQ ID NO: 7077 - DNA, 667 bp, Sorghum bicolor
  Clone ID: SORBI-28MAY03-CLUS67558_1
tagcagagcagaaattcatcattaattataaaaatctacagtatgtgctgcaatatacataatataattagctttttgataatttgccgtgcaaatgtgatcacattattatgaagaaaaattgcgactaaatggatggttaactcggattcgactcctcacttctacaaccatgcaaatatgtacgctaaatctacacgttgcttgagtgatttttggaatccggtcactcgattcctggtggccgtcggatgacgctgccaatggattggatgctcagttgtggtgtggtcgtgggccaggtgttgcggtcgctcaacgctgcatgcggacgcttggccagggtgcctgctctcctctcaacgcaactgcactgaagacccaaccgcaggcgcatcacgtgcatgttgctccaagccgactacgccgccggtggagtgcatgcagctacagtgctttctattttgcaggtgaagggacaggttgtcccatcaaatcacctagccccataagagtatatgatatttcctttacgagagcagattacacggtattgtaacatattttactacttctattttggtgtaaattctatgtttaactggtgtaaattgattatttgtaaatagaaatagttagaattactcgaactattatatgatctttt

SEQ ID NO: 7078 - DNA, 518 bp, Sorghum bicolor
  Clone ID: SORBI-28MAY03-CLUS6756_1
gcacgacgcttctccctccctctatctctctcgaactagcagcgctgcagcgcatcggcggcctcctccccctctgcctccttcctccctctctctgcctctctctccccatgtgccggcgcagctaggcggattggatgaggcagcgacgcaccaggtggctagcggcgtgggtgggtcggcagcacacggatccagggcctccatcaccggatccagggcctccccatgcccgctccataccgcctccccgcgccagccacggcggatccaaccccggctgtggtggtttgggccccagccatggtggatcctacggatttggccccagccatggcgcctacgacgacttgctgcccgtgcctctaggtactccgcctcgacttcgaccgcatggctccacctttgtctcttccactctgccatagattatttatcccataggatgctgcttgcgtcgattcgattcccatgggctgttcctcgtgatgctctgctgagatttgtgcaggaaggag

SEQ ID NO: 7079 - DNA, 701 bp, Sorghum bicolor
  Clone ID: SORBI-28MAY03-CLUS67579_1
gtgctggatcgcccagaggttgtcgccaaagctcccactgacaacggcgtgcagtacgttgttggtgatatttttcaaagtattccaccggcgaacgctgtgttcctcaagtggattcttcacgactggaatgatgatgagtgtgtcaagatactgaagaactgcaaacaagcaatacctccacgagatgcgggagggaagataataataatagatatggtggttggatctgagccgtcagacctcaaacacttagagacacaggttttgcttgacctcatcatgatgaatgtcaatggggtcgagcgagatgagcatgagtggaagaacatcttcttcgaggctggattcaaggactacaaaatcataccacttctcggtgttcgttctattatcgagctctatccttgaaagcctcggtaaagccatccaaaacaataagagcatcggaacatgcatcagttgttgtcaactgttatttcctatatagataaagtaaaatagaataagtggatctcctatagatatggaggcatccggatcggcccggtcatctggtcagctcttcttggacctaagtcctagagtcttattatagacagaagtttgcacacgtatatatgagtgcggcctccaactgtaaactggcgaatgacaaaatgagtttatattttgttatattgtacttgatagtaatatta

SEQ ID NO: 7080 - DNA, 725 bp, Sorghum bicolor
  Clone ID: SORBI-28MAY03-CLUS67143_1
agtagcgggtcaatctgccaacaatgcggatgaagtcaagagtcgtgtcgctgaggagtgaaacgtggttgacactcacaaaggtgcaaccatttgctttcataagggcaggaaaaaaactaagaaatgtgcactgtacatatctcaactatatgtggcatgctatgcacatcctgcataagaacctccgataatggcattgcctagtgcagtggtggatcttcagaatcacaaccgtgtgccccgtcatcctccgtttatcgcccgtcgagcatttcagctgcagctttcggtcatctacagcccttgaaactgcagcaaagtcggtgtattctttctgtggtgtagcattcctcgtgtgctgtaaacaagcttggttccatggctcaccaggctgtgctttccttcaatatggtgtgtcaaaatccagtttttgttgcgagaatgaaccgtgaccttagtgctttttggtggttgtttggtgcaactaggggttggcataaaatccgatacctggacctgactccgaatactcgaacctgaattaccggctcgctattttcggattgtaagtatacgatcaatctgattttagtttgggtgattcggctattagcccccagtacctgatgtacccattttatatgaaaaaaatgggaagactatatgctatttggttgtgattgactaattatgtggtttcctaatgtcaatttttgaggtaa

SEQ ID NO: 7081 - DNA, 933 bp, Sorghum bicolor
  Clone ID: SORBI-28MAY03-CLUS6715_1
tctgttcctgtgtttggagaatcctgcgtttcaaatgaggcctaaaatgctgacgtcaaatgggattactcaaatcagcctagactatcgtctcaagaaaagaaaagaaaatactccgtaccttttttttctgaaaaaaaaggagcaggagcactgccgctgccagcctgcgactgcgagtatgcgacttctgaggccaagccgcacctaccccggcgccccgctactgcaaacctgctccatgcctccatctgcgactcgcgagctcacatccttccacactacctaccctcctctctccaccacactgacctactcacacacaccaaacacccccaacaccccgtccaccattcacctccaccgccaacaaattcttctcagctttctcacctcgcgtcgccaacaccaatacgcacgtaggagctaaggaacctcaagcttcagtcgaccatggctcagcagcaaacaaatcctgaggaggtggtcctcggacaggaggccgggggcgcgagggtgatcactctcaaccgcccgcgccagctcaatggcatctccgacagagtggtgtacctccttgcgcagttcctggagaaatgggagaaggatgagaacgccaaattagtcatctttaagggcgctggacgtgcattttctgctggtggggacctaaagatgttttatgaagggaaatcaaatgattcctgcctcgaggttgtgtatagaatgtattggctttgctaccacattcatacgtacaagaaaaccacggttgctcttgttaatgggcttgtcatgggtggtggtgctgctatggttgcgccactaaagtttgcagttgtcacagagaaaacaatctttgctactcctgaggctagtgttggattgcacacagattgtagcttttcctacatccattctcggctccctgga

SEQ ID NO: 7082 - DNA, 652 bp, Sorghum bicolor
  Clone ID: SORBI-28MAY03-CLUS67252_1
catgatatcaatgcggcatgcaatgctatttttctagtaaatgcatcgatgatcaagctgaaaatcctgaaacgatggcttctgcttttatctgcgataagagtatcatgcttgtgtgctgcctaaggtaaactgtaggcaattttgttgctgaacgtgcatcaaagactgacaattgttattactgtggaaacggtgtggcaggaccgtgagatcaatggactgaacgagcagttagaggaagactcccgtgtgctggagcttctacagaagcagcttgccgatgagcgcaagaagcgggcagagattgagaaggaaaattctatgcttcatgagcaggtgaacatgctgatgaacatgcttgacgaaaatgagggtttcgatgaggacggagaagctccaccgcccgattcctttgattaagcattacattactatccattttccaacaatatcaagtcatacatctctaggtaccggtttcagagtatccaagggatatatgctgtgtagaatttcatttatcgtattccattacatggcttgtgtttctgtagataaagagtgcatgtctgttgcaccaactcctttctaggcttcaaatgtatgtgagaaactagtaacatattatattgaatcgaagtgtatgtac

SEQ ID NO: 7083 - DNA, 876 bp, Sorghum bicolor
  Clone ID: SORBI-28MAY03-CLUS67194_1
cctactgggcgcaaaaatcgcgcaccttccctccccgtctcctctgcctgccccccagcttgttgccttgcgcggttagctgcgccagcgaggctcgtctcgcggccctccccctccgtcctcgcgccgctattctgccccggtcccataaattcgaatccaaacgcgcgaccgtcgctgctgcggccgtggcaaaggaaacacagaaaaaggccaacgccgtcttctcttcctcgacgacgccagggaaggaggtggagcgcaggcagctgcctccgctagggtttcccatcttctcggtggaggcgccgccgcctccgtgacccggaccctgccagccaggtccacgttgatgccagggaggtgcagccgtcattgatttccctcctgcagctgcatccccatgccgaccatcacgaccatcacgcactacgtgctggatcccttgcttgagacgcggtctcctgcgcaggtccagaaagccacccccaagccgctgccctcgcctccggacaaggccacacccgtgccggtggctcctgtgaggacgcagacgtcgccggcgtcactctatgccacgcctgagagcaccactctgcctgactcgccttcctcgttccccggaacctggtcgccgtacatcatcaaccataagaggcggggggcctcccttgccaagacattctctcagggtgatgatggaaatgagggcagccagccgaagctcccagtggtgatgctgcctgctttgcccaaaggggctcaacccactgcagtgcaggagcctgagtttgcgtttcagcaatcatggaatggtcaagctgaatgtgacattggtgtggaagaagctcccatcaatggaaaaaatgaaatact

SEQ ID NO: 7084 - DNA, 507 bp, Sorghum bicolor
  Clone ID: SORBI-28MAY03-CLUS6726_1
gcacgaggggaggacatgcagatgcagctgggcagttcgccggcggcggcggcggcgacgacgtcgtgcggccagggcgagccgacggtgcggctggtcggtccggaagggaggtgcgtggacgtgccctacggcgtctactacaacggcaagcaggtgcagctatggagctgcaagtccaacggcgacgtgaaccagctctggacgctgaagcgagacggcaccatccggtccaacggcaagtgcctggcggccagcaggagcgacacggcgggcgcgcgcgtggtgatcgacgactgcccgccgcgcgtcccgacggggcgcgtcgtctgggaggtgcgcgtggacggcaccatcgcgctcaaggggtcgtcgtcgtccggcggcggcgggctggtgctggccgtgacgtcgtcgacgctcttcgcggggctgacggtgcgacgggacgaccgcgggacggggcagtcgtggacgccgaccaacgacaccgcgccgatggacgcc

SEQ ID NO: 7085 - DNA, 782 bp, Sorghum bicolor
  Clone ID: SORBI-28MAY03-CLUS6725_1
gaagtaacaatatagtatacttcatttgatgccttgttatagtagtatgcaatatgcaatacatatcgcatactcatagttggagtagcaaaacatcttattgcttaaagtgagaactgtagacagcagaacagcattgtatacaagatgacatgttcttgtagctgtgctcttttttttcggtacctttttagtttgaaatctgatgctattaaatgctaactgatttctcagcagataatttgcattctgttgcgctatttttctgagcacataattgactggttcttcatttctgtctctaggtcctcaatgctttgttcaacctatgcaagattaataaaagaagacaggaacaagcagctgaaaatggaatcatccctcacttgatgaattttgtcatgtcagactcaccgctgaggcaatatgccctgcctttgctgtgtgatatggcccatgcttctcgcaactctagagagcagttgagggttcatggaggattagatgtgtacttaaatctgttggaggatgatgcatgggcatgcacagcattagattctattgctgtttgtttggctcacgataatgatcacagaaaagtagaacaggcactgttgaaaaaagaggccattcagaaattagtgaagttcttccaagactgcccagaacagtattttgtccatacattggacgctttcttgaagataatcacgaaatcttctaggctaaatacagcaatggccattaatggtttgacaacattgctcattgcaagacttgac

SEQ ID NO: 7086 - DNA, 658 bp, Sorghum bicolor
  Clone ID: SORBI-28MAY03-CLUS67669_1
gcccccggggtccccccacaccacaccacgtattttcgttgcctccaatagttgaccgaccagcgcgccggccgctgacatggacaacgtagtatcctcgaaacagaccgtcgttctgtaccccggcggcggcgccgggcacgtcgggccgatgacgcagctcgccaaggtcttcctccaccatggctacgacgtcaccatggtgctcctggagccacccgtcaagtcaaccgcctccggcgccagcttcgtcgagagcctcgccgcctccaacccgtccgtcatcttccacgtcctcccggcgatcccgctccctgacttcgccagctccaccaagcaccctttcctcctcctgcaggagctgctggcccgcgtccccgtctaccccgtctgctccccccgcgccggcccccgggcccgcctgcccccccccgccgccctcctggccggcccccacgccggcctcgtggcccctggggtcgccccccccgtcttccccggcgtcccgccgatccccgcggccctggccgtccgggccctgcccgcggcgctgcttgccggtcggcaaacggggctgaaggagcttggggacacgcccatcgagttcctcggcgtcccgccgatgccggcgtcccatatcatcagggagatgctcgag

SEQ ID NO: 7087 - DNA, 817 bp, Sorghum bicolor
  Clone ID: SORBI-28MAY03-CLUS6768_1
attgaaaggaggttcataaatgtaccttttggagcttcatgggcggaagttactatgcgaacatcagcttttgatactcctagaaggttctttttggatactgttcagatctgtccactgaagcggcctgttaaatgggaggctgttgttactttctcttctccatcttcaaagaatttcagttttcctgtagaaggtggcttaactttggagttgtccatagcccagttctggtctagcggaattgctagccatgagcctacctgtgttgattttgagattgtgttccatggaatatccattgatcagaaagtaactacccttgatggcgagtcacccttgcttatagttgctagatcacttctagcatcagagaagcttgttcctgttgccaccctgaacaagatcaggatgccttatcgacctgtggagtgtaatctttcttcgctgcccactgaccgtgatagattgccctctggcaagcaaattattgccctgaccttaacttacaagttcaaactagaagacagcgctgaaataaagccccatgtgccactgcttaacaacagaatatatgacaacaaatttgagtctcagttttatagaatatcagattcaaacaagcgtatttactctactggagacgtttaccctagttacgtcaaactttcaaaaggcgaatacacgctgcaactgtacataaggcatgagaatgtgcaagtcttggagaaactcaaggaattggttctgtttattgagaggaaactagataagaaggatttcgttccattgagtttctactctgaacctgatggtc

SEQ ID NO: 7088 - DNA, 670 bp, Sorghum bicolor
  Clone ID: SORBI-28MAY03-CLUS67707_1
gagtaaataccctatattgaacagctctttcatcgaggaaactagtgaagttgtgttcaaagggtcccacaatattggggtggcaatggctacatcacatggattagtcgtgccaaacatcaagaaagtgcagtccctatcaatattggagatcacgaaggaattggcgcgattgcatgagatggcatcgcacaacaggctaagcgctgcagatattgaaggtggcactataacacttagcaacataggtgccattggtggcaagtttggctctccccttctgaacctacctgaagttgccatcattgcccttgggcggatccaaaaacttcctcgctttgatgatgacgaaaacgtttacccttcatccacaatcaatgttactgttggagccgatcaccgagttgttgatggggccacggttgcaagattctgtaacgagtggaagagcctcgtggagaagccagagctactcttgctgcatatgcgatgatccagtaagatactagtacctactacgagagatcgcccaaacctttttaagatgatctgaaatggaggcattccggtatcacagtgaaatccatgtattcaaataaatgatcaacgtggcttctctgcctgcaaacagtggaaataaagctgagagttattctcgaaagtccttcct

SEQ ID NO: 7089 - DNA, 736 bp, Sorghum bicolor
  Clone ID: SORBI-28MAY03-CLUS67808_1
tccttgtcagctgctgctcgcacttgttgcagtgtcccgctcccgcactcctcttcctccctccctcctcttctcgtcgtacacagcgcgcgcacgcagctgccaccggccaccgcgccaactaatccaaaactccgccgcgcgcagatcaagactgccaccagccaccagcactccagcagcgcttcagcgggagacgtgacgactgacgagacgaagcttgcgcctctcccccccacgccgcccacatggcctgggctcgccttgcttcccgctcccgtctgcgccccgcggcctccgcctccgccgccgtcggccgaccgccacacgcctcaccgtcggttccgcctcccacaccgcccactgtgcctgcggccacctccgcgccaccgctccggcatctcctcctccttccccggcaccggtttgctgccgccgcgtcctcggcgtcgaccgcgcggctgctcggtgcccggtggccccagggtcacggtaggagatgcttcgcgagcgaggcctccgcggcgcaggcgccgccgggggaggcctctgagctggtggaggtgccactggcgcagactggggaaggcatcgccgagtgcgagctgctgcgctggttcgtcgccgagggtgaccaagtagatgaattccagcccctttgtgaagtacagagtgacaaagcaactatcgagataacaagtcgtttcaagggaaaagtacatcagattaactttgg

SEQ ID NO: 7090 - DNA, 655 bp, Sorghum bicolor
  Clone ID: SORBI-28MAY03-CLUS6764_1
aatttgtcgttagtgtaaacaagtaccttgaagctaaggctcgcgggatgtctgttggtatgaggtttaaaatgagatttgagggtgacgaatctcctgaaagaagattcagtgggacaattattggtctgggaagcatgccagctaactcaacatctccgtgggctaactctgagtggagatctttgaagacctcaagccatgctctcactactgacaggtccaatgggacgagccttctgctattctgcgtccagatagagtttcaccatgggaactagaaccccttgatgcaactaatccacaaccacctcaacctcctttacggaataagcgtgcgcggcctcctgcttcaccttccattgctccagaacttcctccagtttttggtttttggaaatccccagctgagcctgcccaagctttctcattttcaggactgcagcgaactcaggaattataccattcaaaccccaattcaatcttctcgtcatcgttgaatgtaggattcaattcaaagaatgagcgttctactccaaacaacaatcatttgtactggacaatgagagagacaagaactgaatcctactctgctagcattaacaaagctcctactgaaaagaagcaagaatctgctacttctggctgcagattg

SEQ ID NO: 7091 - DNA, 447 bp, Sorghum bicolor
  Clone ID: LIB3476-024-P1-K1-C2
caagtaccttgaagctaagaatcacaagatgtctgttggtatgaggtttaaaatgagatttgagggtgacgaatctcctgaaagaagattcagtgggacaattattggtctgggaagcatgccagctaactcaacatctccgtgggctaactctgagtggagatctttgaaggtccaatgggacgagccttctgctattctgcgtccagatagagtttcaccatgggaactagaaccccttgatgcaactaatccacaaccacctcaacctcctttacggaataagcgtgcgcggcctcctgcttcaccttccattgctccagaacttcctccagtttttggtttttggaaatccccagctgagcctgcccaagctttctcattttcaggactgcagcgaactcaggaattataccattcaaaccccaattcaatcttctcgtcatc

SEQ ID NO: 7092 - DNA, 482 bp, Sorghum bicolor
  Clone ID: SORBI-28MAY03-CLUS67361_1
tcacctcgtcggttcgctcagtccacctccaccgcttcacctgttgtgttcccaatcccaatacagaggaggtggaaggaaaaagccttcccctcgccggagatgctgccgtcggcgactgggtacactgccggcgacgtccactcggcacgcgagatgttccatcccttctacctctgacttcttgcgccggcggcctgcagagagtagttggatacttcatacttggattatattggatcgagctctagatagccttgaagttgaaggtgagctggcgtgggagaggaaacctggaaagcgatgagctttagcgccgcaagagttgccgagcatggcggtgaggtcgaggacgcaagggggatgccggcagaggtgagctgggagatgctcgacaagtcgcggttttttctactcggcgccgcgctcttctccggcgtctccgcggcgctgtacccagccgtcgtcctcaagacgcacct

SEQ ID NO: 7093 - DNA, 668 bp, Sorghum bicolor
  Clone ID: SORBI-28MAY03-CLUS67363_1
taaaaaacttctattttttttcgcttaacacccaacccaacatggatatctctgctcaatgcgaacaatggcttgcttcccaccccagacttaactggagatccacctttaacttcctcctcactcccgaagcctccaaagctatcgaattcaacgattacggtattgcttgcttcgccaaaggtctccagtacgagctcaacgacaagaactaccaagaagccttcaactgctacgaaaacggtgccatgcaattagattccctctgtttattcagactccacgaaatctatgctggcgatgccaactttgacatccaatatgatgaaagacagtctatgtgccacttgctttacagtgctttgatctcccaattcgaaaccttcgacaccaaggtctccttctggcaaaaattagaagctttctggaagaaagacaccagtagaaaggaatacctcatcgatttactcgttaaccctcctactgactacctcgttgccaccggtcccttgtttgccagacttttcaacttctacaacaacaaggaaaccttcactgagatcctccctgaactcaaggcactttctagcgatgtcctcaagaacaaattcttctccatccttaacgccattttcgacttcttggcttacacctataactctgctttc

SEQ ID NO: 7094 - DNA, 760 bp, Sorghum bicolor
  Clone ID: SORBI-28MAY03-CLUS6749_1
cccatagaatactcgatccacccccaacagaagcaaatcgactttttcttttgaaggaaaaaataccggaggcagagcggctacccaccgtcgccccccccgtccccctggttgggcggcggtgcgcccgcggccgcccgtcgcgctcgcgttccgcccccgccgccgccggccgccgagtcttaggtaccagtttgcacaatggatgtggacccaagccccttgctggagtcacctgtgagggattggtctgagctcccactcgaccctctctcctcaatcttcatgaagcttggggccattgaggtcctcatgggtgcaggccttgtgtgccgctcatggctggcagctgcaaaggcaccagaaatttggcgttttgtggacatgactcgccataagttagttttctcgaagagcacaagtatcttgtgtgccatggcaagagtagccatagatcgctcagatggaaggatggagtcattctgggctcaacaatttgttaccgacgaactcttggattacattggaaacagggccaattatttgaagagcattcggcttgtctcatgcgcatacttttggcatatgccattggttatgatggtagataaatgtccgcttctggaggagatagaatgttcatatcaaataatgccagaaggttttttcaggaatctaggcattgtgtgcccccagttgaagcgtctaagaatcaatattgggggagtggatgattctgatgagatctggcgtgagatga

SEQ ID NO: 7095 - DNA, 661 bp, Sorghum bicolor
  Clone ID: SORBI-28MAY03-CLUS67491_1
aacccagaaacagagaactagagaagtccgttgaggcgtcaggcgtgaacaccaggacggggaagaagaagcaaaccagccaagaaaccgactccctaatcgggggtccctcaactcggtcccttgtccttgtccagttgtcccctcccctctcgccggtgctgctcttgcctactccgatggctgatgctgccgccgccgccgcccccacgaagacagcgaacatcccgacgacgatgcgggccgtgcagtacgacgcctatggcgggggcgccacgggtctcaagcatgtggaagttcctgtccctatggccaaaaagaatgagcttctattgaaactggaagcagcaagcatcaatccagtggactggaagatacagaaagggttgttgcagccttttctgcctcgtaaatttccttttatcccagtgactgatgtggcaggagttgtggctgatgttggtccaggaatcaatggattccaagccggagatcaagttgttgctatgctcaactcacttaatggaggtggacttgctgagtatgctgtggcatcagaaaatctgaccgtcaagaggcctcccgaggtatctgctgctgaaggcgctgggctgcccattgccgctggtactgcgctccaggtgcttaggaccatcggcgc

SEQ ID NO: 7096 - DNA, 899 bp, Sorghum bicolor
  Clone ID: SORBI-28MAY03-CLUS6746_1
gaccgggggagttcttttggagatcacgacgtcgtccgcagtccctgtcactcgccgtgtggccgtgcagataagttagatgacatcgatgtaaactgagaggaaaggggggaagcttctggattataggcactaagatcatgaggctttggagatgatcctaataatcggtgcagtgcaacaagctttgaaaggtaacttcagttgacgacaacgtgcagctgacctccaaacaacaacagcaggattcggcggagagcgagaaaagcacaggattcagcggcattggtggcttcgactttcttgatcttggtttaggggttgctggccaaaatcttggaatgcccagtgatgataagtggaggcagcagcaaattctagagcttgcggacgcgtgggcggacgcgtgggttctgcgggaacaggttaccgctgcttgagaagacctcaggtcatcagaagtttgatcactatggaacgtatgcaaaataatgaaggtcgtacaccgtttgaagacttgacaacaccaccaatcgaggtgacaagacaacatcaaattcacaagcgcaagttgatgaacgtgtgcaacgtaaaagggaaagagaaaaagcacggcatgcatcaatgactcaaacagaaagggatgaaaaaaataaaaaaattagggaaaagtatcatcaaaaaaagacagaaactgaaatatctgctggctcaagaggtccaccacaaacaaattttaacaaccaaacatacaataaatatttattcacatatagttactttatctttgattattacgtaaataggtgttggggttgaatctaacaaggaaaacacagatgccatgagtctaaaaagggaaagggtaaaggcgcgatttatggcgatgactcaggaag

SEQ ID NO: 7097 - DNA, 616 bp, Sorghum bicolor
  Clone ID: SORBI-28MAY03-CLUS67506_1
agaatccaaatatagcatcgcagtggcacgccctctgcacctccttcccgtcccgtcctcgagatcgttctccgctcctctgctccccttcttcccccgcgtgctcctccagccactccgcaccccagatctccgaaccctaaccccctcctacatgccattgcactgagcggcagccggtagccacacgccacgccatgtcgcagccccgcagttggggagtcctcctcgccgtcctcgtcgcggcggccgtcgccgtcccgccggcgaccgcggcggtggcgagcatcgacctcggctcagagtggctcaaggtcgcggctgtgcatcttgcccctggccgtgctccgatcgctgttgccatcaacgagatgtccaagcgcaagtccccggcgctcgccgcgctcgccgacggcaaccgcctcgctggggaggaggccgcgggcatcacggcgcggcacccgtccaaggtgttcgcccgcgcgcgggacctcttggccaagcctttctcctacgtgcagtccgtcacggagtccctcttcctcccctacgacctcgtccccgacgcgcgcggcgccgccgcggtccgcgccgatgacgggcaggtatactccct

SEQ ID NO: 7098 - DNA, 551 bp, Sorghum bicolor
  Clone ID: SORBI-28MAY03-CLUS68129_1
tctgggtcccaccctcctccgggcagcctgcctccagccacaacaacaaccaccaccaccgccacagtcccgtcctgtcctcctcctcctcctcctcattcccgttccccccaccatggccgcggccgccgggtactggctcgcggagcacccggccatcgtggggttccggtggagccccacacacctatggttctccacctgggccttcctcctcggctccctcgccgcctacgtcatcctctgcctggctctggacgccgtgctgagcctcgccgccgccgccaccgcccctcgccctcccaagcgccgccgcgcgccgctcgccgtcccactaggtcctctcccggcagcgcacgcgctgctgatggcggccgcatcatccgccatcttcgcggggacgctgctatcagcggtagccgagatacgcgacacgcggtggtcgtggcgcgggcggagccgcaccacaccgctccggtggctcctctgcttccctccgggcacccgctcctccggccgcgtcttcttctggtcctacgcctactacctct

SEQ ID NO: 7099 - DNA, 604 bp, Sorghum bicolor
  Clone ID: SORBI-28MAY03-CLUS68130_1
gattggtgatggcccttgtcacctgcttctgcttctccttcccctccagcagctagaggagtggtgaagacctgtcttggctttctcctgcttgagcacgactcagatcagatcaagaacaggcgctgaatctacctagctaggggccatccacaccgatcgagcttgcagccatggagctggtaacgggggtgatggggagccttcttcccaagctaggcgagctgctcaaggaggagtacggcctccagaagggtgtgaagaagaagatccagtctctgtcacgggagctcacggtggtgcacgccgtcctccgcaagatcggcgatgtgccaccggaccagctcgacgagctggtcaggctgtgggcgagtgaagtcagggaggcatcctacgacatggaagacatcgtcgacacattcctggtgcgcgttcaagaccctgcgcattctactgagccacacatgctccgtcgcctccgaaagaaggtgagcagactgttcaagaagagctgggctcgccacaagatctcttgcctgatagacgacatcaacgagaagcttgaggaagtggcagcaaggcgtggtaggtacacactcgacag

SEQ ID NO: 7100 - DNA, 707 bp, Sorghum bicolor
  Clone ID: SORBI-28MAY03-CLUS68131_1
aatttggctcgtctagagcgcgtgcccccactcgctcgctcgctccccgttgctgaccccgctcccccggtgatctgatgtcggcggcggcgcgcgcgctccccgcgccgtcgagaagagctccgctcggcgccgtgaccttctccgcgccgcgacccggggctagggttcgcgcggcgcggcctcgcgaggagaatttccataataattgcctgttgacatcgtctagtcagaattcaagtcctttgctatgccctccatgcaattgtgctcagatggctttggctgaaacaataattcctcaccagcctgatgttgacaagcatgctggagttctgtcctatgaactggttcaagggaaccttgtgcagtggaattcatttatggacaaatcaatacctgatccaccaacagctgttcttcttcatggaatccttgggagcaggaaaaactggggatctttcgcgaagagattggctcaggaattcccaatgtggcagttcctcttggttgatttgcgctgccatggcgactcagcatcaattaagaagcgtggaccacacactgttgcctcaactgctcttgatgtcctaaagctgatagtgcagctcaggctaacccctcgtggttttggttggtcacagctttggcggaaaagtggccttgagtatggtagaacaagctgcaaaaccacttgctcgtcctgt

SEQ ID NO: 7101 - DNA, 528 bp, Sorghum bicolor
  unsure (1)..(528): unsure at all n locations
  Clone ID: SORBI-28MAY03-CLUS68215_1
gcctactgaacccccaaagcagaggaaagggccgaggaggcgagcgagtcctcggcgacgacgcggagggtcccccctccggccggacccgaaggcggagcgccccaagccacaaaagtcccccgcgagggggtcggtcggttggtcgttcccgaccatgtcctcgtccgcaccctccccgcccgccggcgcgccgccggagccgccgcctccgccctcggagctctactgctacgagtgcgacgccacggtctcactgcccgccgaaccggtcccggccgcgcggcccctctgcccgctctgccacagcgacttcatcgaggagaaccctagcactagcaccccgtctccgcctccaccacctcctccgccgccgcccccgccgctgctcttctccggctcctcctcctcctcgctctccgacgaccccnacgatgacgacgacgacgacgacttcgacttcgtcatggaccccgacgaggcgcgggcttacctcagccgcctcgtccaccgccaccgccaccgcct

SEQ ID NO: 7102 - DNA, 1043 bp, Sorghum bicolor
  Clone ID: SORBI-28MAY03-CLUS6818_1
cccacgcgtccgctcgcaaatgcgcgactatgcactgagtttaacaaaatgcttagcacaaacagcgcaaaagactttcagtgattttgaagaagcggttgaaaaggatgcaacaaagaatattcacactgatggaacagttcatcctttaacgagctatgtgatcaactatgttaaatttttgtttgactaccagtcaactctaaagcagcttttccaggagttcaaaaaggaagatggaacaggttctgagctggcagctgtaacaatgaaaatcatgcaagccttacaaaataatttagaagcaaaagcaaaacaatacaaggatccagccttgatgcacatatttttgatgaacaacattcactatatcgtcaaatctgtccgcagatcagaagccaaggatttgttgggtgatgactggattcaaaggcaccgaaggattgtacagcaaaatgccaatcagtatagaaggattgcttggtcgaaggtgttgcaatgcctctctggtcaaggtttgacttcatcaggtggtagtggtcaagtaggaagtgatggtggcaatagcagtggagcttcaagagcagctgtgaaggagagattcagatctttcaatgtgttattcgaagagatctatcagaagcaatgtggctggtcggttccagacactgagctgcgtgagtcactaagacttgcggttgctgaaatcctgttgcctgcctaccgatctttcataaaacgttttgggcctctcatagagaatagcaaagcacctggaaaatacgtgaagcacactcctgagcaactcgagctgctgctaggcaatttatttgaggggaaacaagaacgcgcttgatagtttggtactgcaacaaggatgatgcggttctatgtaaaaaaaaaaatggagaccctgttagcgttagcattgcttgtgatctccccatgggagtcaaatatacagctgctgtggcaccattccttgtttcggcgcattattatttgtacagaagaatatatatgtcagctatgcctttttgttg

SEQ ID NO: 7103 - DNA, 647 bp, Sorghum bicolor
  Clone ID: SORBI-28MAY03-CLUS67581_1
tgctgggggagcaagggattgctgtccggggagcagcttaaggagatcgccgctggcctagagaagtccgggcaacggttcctgtgggcagtgcgcacgccggcggccagcgacccgaaacgactctgggagacacgcccggagccggaccttgacaccctcctgccggaggggttcttggagcggaccagggaccgtggcctcgtcatcaagtcgtgggtaccgcaggtggatgtgctcaacaacccagctattggcgcgtttgtcacccactgcgggtggaactcgacgctggaggccatcgcagcgggggtgccgatgctgtgctggccactgggcgcagagcagaagatcaacaaggtacttatggtcgaggccatgggcatcgggctggagctggaggggtacaacacaggtttcatcaaggctgaggaggtagagacgaaggtgaggcttgtgttggagtccgaggaggggagggagattaggatgcgagcagaggcacacgaggcgttggaggacgggggatcgtcacaggcggcatttctccaattcttgtctgatgttaagaatattactagtgcgtaaagataactttagaaaaattgtaactttttcatatgttcttggataaatataaattttat

SEQ ID NO: 7104 - DNA, 973 bp, Sorghum bicolor
  Clone ID: SORBI-28MAY03-CLUS6758_1
gcacgaggccaggtccagacatagcaaggattgacagactgagagctctttcttgattctatgggtggtggtgcatggccgttcttagttggtggagcgatttgtctggttaattccgttaacgaacgagacctcagcctgctaactagctatgcggagccatccctccgcagctagcttcttagagggactatggccgtttaggccacgcgctcctgaggccctagctagcctaccagtgcgcgcagctagctgtttggggttttcagccgccgcgccatggcatcgagtaccaagccggccttgctcctcgtggccctcaacctggtcctcttcacggtggccaacgcctgcggcggcggctgcccgacgccaccaacgccaccaactccgacgccgccgtcaccttcaaccggcggcaagtgccccaagcacgcgctcaagctcgcggcgtgcgccaacgtgctgggcttcgtcagcgccgaggtcggccacccgcccgccgagccttgctgcagcatcctcggcggcctcgccgacctggaggccgccgtctgcctctgcaccgccatcaaggccaacgtgctcgggatcaccgtagacatccctgtcaagctcagcctcattgtcaactactgtggcaagaacctccagagtggcttcatatgcgcctgatgatattcttctctgatagcggagcgggatgacgtacttcacatgcatgcagtgctctgcattgcattggctttctcctaccgtttttcttttgtctgcttttgctttgtcatgttggttccaaatgtacaactactctagacaatcaggtgttgtgagtcaaatgtgtgttttactactgccttaattatttgcgtatctgtttttttggttttgattgatcatcagtgcttgtttttttttccttttatttttgaatgaagcgtgcatattaaatatggagattattttccaaggt

SEQ ID NO: 7105 - DNA, 623 bp, Sorghum bicolor
  Clone ID: SORBI-28MAY03-CLUS67585_1
gtcaaggccatgaagcaggtcgctggttccctgaagcttttcttggcccagtaccgtgaggttgctgccttcgcccagttcggttccgatctcgatgccgctactaagcagaccctcaaccgtggtgagcgtcttactgagcttctcaagcagcgtcaatactcgccaatggctgttaacgagatggttcctctcatcttcgctggtgtcaacggcctccttgacaccgtccccgtcaacaagattctccagtgggagtctgacttccttgctcacctcaagaccaacgagtctgagctccttgccactattgacaaggagggtgctatctccaaggacacagaggccaagctccgtgacgtcacccagtccttcgtcaagagcttcctcggttaattataatcaaaagcaacttacgcggagaataacggaggcctttggggatgtcgctgtctataccgaatatttgttgtcgcttttctctcttgaggcggagggaacatgtcgaggggtcgcgccagaatggagcggcgagaatgagatgagggagattctcctgtagcatcgtcacatgtaaaatagagcttaaaactcaatcaatgtcctctatctttttgttctcc

SEQ ID NO: 7106 - DNA, 910 bp, Sorghum bicolor
  Clone ID: SORBI-28MAY03-CLUS67595_1
catatataatgctgtaattatgtttgctgcgccattactgttcagtaattggccatatgcaaatggttttgaggcattgagattttgccaggagaacccagaggtcgcctgggacattttcctgttctgcctatgtggtgccgtggggcagaacttcatctttttaaccatcagccggtttggctctcttactaacacaacaatcactaccacccgtaaattcatgagcattgtggtttcatcagtcatcagtggcaatccattatctttgaagcaatggggtagtgttgtgatggtcttcttaggcctctctatccaaatatatctcaaatggaagaaaaagaagggcagagaccacaaggagtaagcttgattcttgaacctgttccgatttgtaacttcaattggacagatctgttgtgaggttgaccaggataacgttaatgcagtcgaaattaggagacttttacatggactattatgagcgataactagtgtgaggctgtgagctattggtaacagcttgtagtttctgttctacagggagatgcagcaatttgtgttgcattgaggacaaagttgtatgatgaccaatgtatttttgttctactctctcgaaagtaatctgtgtagaattaaaatgccaacatctaggtttttgttctagttcatgtatacctcttatgttgtgtttggaagagcagtagacttaaatttgaactaagccacaagtaatttagatgaggaaatttggtttcagaacctttataataaggatttggaatggttatcttcccaatcctagcgaatagagatgttataagaacattacttatgttgtaccaagatatacgaatacaatgggtgctctatactccattagcgaaatgtaaatgaaaatttgatattg

SEQ ID NO: 7107 - DNA, 741 bp, Sorghum bicolor
  Clone ID: SORBI-28MAY03-CLUS67602_1
tggatggttcacggttgtgtggcagtagaatacaagtcagtagcaatggtctgcgctgcaaggttgttgatcttgtgtatcgccacatctctccttgcagatgcaggagcagatgatcaggtcaactacgttgtcgtggagactagctcgcttaagccaagcgccgtttgcaaagggcacagggtccatccatccgtcaacaactacagcagcagctggacaccgctgagtaatcctcatggtccttgctcgccgtcgtgggaggagggggcggccatggactacagtgcgtcgtccatggtcgacgacatgctgcgatgggatcagcaccgcgccggctacatccaaaggaagctctccggtaatgtttctcatgaagatacagaaatttcagacagcacaacgacgctcgagagcgtaaatggcggcggcgccggagattttagcatgggcgacgatggaaccggcggcatggcaaaggcacagcagcaggacacccatcatcaggtggtggaagagctgagtagtgctgctgatccggcggcgaccggcggcagccgacgcagccgcctgcggcccggtgtgaggcagctgatgcttctggacacggcgagcgacgtgggcgtgggtgcagtgcttcccctgccccgcctcgcagtgttacgcgcagacggacgtcctgtacgacccctcccagtcgcgatcgtcggagtccttcgcgtgcagctccccgacctgcag

SEQ ID NO: 7108 - DNA, 888 bp, Sorghum bicolor
  Clone ID: SORBI-28MAY03-CLUS67628_1
gacctccaaccaacaaccccagaacgatccatctgcgcgcgagctcctccgcctccgcggctccctctcctcctcgatcaatcattcattcgtggcccaccttcccatcgcagcccccctccgccgcgccgcgccaccttccacgctcgcacatgcacacccggccgccagcgcgagccatggcggccgcctagccctccatcgcgcgcacatgcacagatagatatagatgacgacagacacggcgtaggtcgtagagcgattagttcctcttcctcatactatatagacaaggcatatagccgccggccgccggatgatgactagacagcaaccgcagcaccaagcaggcggcctgctgctccgttcgctaggactaggagcaggcggcggagccggaggaggtgcccgccgggcgggggccatgaagtcggccacctcgctcctcctcggcgccgcgctcgccaccgccttcttcctgctctacacctccctctgccgcgacctcgtcggcgccgccgcgcccagcaggtcatcagccaccccggcgccgcggtgggaggagcaggagaccaacacgacagctgcgggggttgctcctcaccagcaggagggcaccaaacatgtggctgcgagtagcggcgacgccgatggtgacgacgacggcgccgccgccacaacagaggagaagaaaggtcagagcgagaagcagcagccgcggtttgtgatgcctgccacgtcagcccagctgcagcagcagaagaagaagaaaagttcaccaccaccgtcccaggatctagcggacctactccggcgagcggcgacggcggacaagacggtgctgatgacggcgatcaacgaggcatgggcagcgccaggttcattcct

SEQ ID NO: 7109 - DNA, 619 bp, Sorghum bicolor
  Clone ID: SORBI-28MAY03-CLUS68636_1
tactgggcactcctccctccccgccccccccccgcggcccgcccccgcccccccgccccacccccggccccccgcccccccccggctcgactctgccccgcccaccccccacgcccccccgcaccggagctcctgtgcgccccatccccgccccactccgcccgtgccccgctcccacccccccaccggagcagacaggccgcctgtcctgtctctcaagggcgcccccgcccgccgtcccccgccctttgagcccggcccgccccggccgcactgtctttcacggccggagacccgggcgcccgttcacatcccagcgccgactggagccgccctccctgagtctcaggacggggtcggggcgggagccccgaaaggcaatgcccgtaaggtgggacgatccgggcagggtcgaaggcccaagcgaaacacaacgaagacggccgtcggttttcggaccggatcacctcggagccggatactctctattcaaggcttgtcacagctaaagaaaaaagacagggcctctcgattcccaggaccaagatggccccgcgctatagctgacgtgaacttcgggccggtgctggtggtgacgaagctggaatttgggctggtg

SEQ ID NO: 7110 - DNA, 688 bp, Sorghum bicolor
  Clone ID: SORBI-28MAY03-CLUS68640_1
aacgaagctacacaggcctacagccagcaagcagcctgaaaccaaactctagctagcagctagctagtaggcaaaccaagccagtcgatgacgacgcccggaagcattgccagccggtggcgcgagctccagggcgcggactcatggtccgggctgctggacccgctggacctcgacctgcgcacgaacatcatcacctacggcgagctgacgcaggccacctacgacgggttcaaccaggagcagcggtcgccgcacgcgggcgcgtgcgtgttcggctactccaacctgctgacgagctcgggcgccgcggcggccgggaactacaccgtcaccaagttcatctacgcgacgtcggcgctccccggcgtgcccgaggcgttcctgctgctgccgctgccggacctgctgccggagtcgtggagcagggagtccaactggatggggtacgtcgccgtcgccaccgacgacggcgtcgccgcgctgggccgccgcgacatcctcgtcgcgtggcgcggcaccatgcgcagcctcgagtgggtcaacgacttcgacttcacgcccgtgtccgccgcgcccgtgctgggttccgccgccgccgccaacccagccgccttggtgcaccgcgggttcctctccgtgtacacgtccagcaacccggactccaagtacaaccaaaccagcgcca

SEQ ID NO: 7111 - DNA, 817 bp, Sorghum bicolor
  unsure (1)..(817): unsure at all n locations
  Clone ID: SORBI-28MAY03-CLUS68642_1
gcacgaggctcctccctccctcgtgccaagccgcgcggccaacatgaagcacggcaacagcatgctgctccagctagcactactcatctctctgtcgctcgccggcggcgtcgccgtcgtcgtcggcggaagcgcaccgacgagcacgcacctcctgttctacatgcacgacctcgtgacggcatatccgggggctccggcgacggcggtacgtgtggccaggggcacgacgccgctgcctacggccggcagcctccggttcggggacacattcgtcgtcgatgacgcgctgacggaagggcccgacgcggcgtcccgcgccatgggccgcgcgcaggggttctacctgttcgcgtcgcagacggagctggcgccgctgctctgcgtcaacgtcgtgttcacggcggggcctcacaacggcagcaccgtcgccgtgctgggcagggacctcatccttgacaaggtcgacgtcagggagctcgccgtcgtcggcggcaccggcacgttgcgccgcgccgccccgccctccctcgtcccgacccgcgccgccaacgcgacccacggcaacgccgtgctcaagattgacatgtacctgagcctgagcgtgtagcaggcctgtttgcgtcgcgacgttgcaccgattgatggtctagatttctaccagtaccagggcactgagcccaacagacccgtactacgtacatccataatactacgttatttatatatttcatgtgtagtaaagtctattgtgatctttcgagaaaaaatgaaataagtcttatatttgtgacacnnaaaaaaaaaaaaaaaaaaa

SEQ ID NO: 7112 - DNA, 653 bp, Sorghum bicolor
  Clone ID: SORBI-28MAY03-CLUS68850_1
aggacggcgtcgtcctggcccggtgccttggcgaggccttcagccacggccacggccacgacgagcaggatgaggggcggcggttcacggcggcgctggagaagtacgcggaggcgaggcggtggcgcagcatccagctgatcacggccgcctacgtcgtcggcttcatccagcagagcaacaacgccgtgatcaggttcctcagggacaagttcctgtctagactgctgtccaagacgctagtcgccatggcggactacgactgtggcacgctatgattctgccccattggagggatgggctgcaataaataaattaaagtaaaaacggtgaagaattacatggccgtcttgtatatcacatggaacacagagacttttgatcgaactacggtgatgtacggtgtgctgctacgtagtactagtacgtacacactcgttttagaggaaataataaatagtgataaatcggcagtgtcaacagttgactttgagttgtgattgtgaccgaatgaaaggagtctgatcacgctgaggcaacagaaactgtcatagtcacatgcacgctgtgcacatgcatcgatgggcggggattaacaaaccgctttaggccttgtttagttccaaaaaatttgcaaaatagatactgtagca

SEQ ID NO: 7113 - DNA, 691 bp, Sorghum bicolor
  Clone ID: SORBI-28MAY03-CLUS68924_1
aaaaaaaaaaaaaaaaaaaaaaaaaaacctggggcgcttggggcaggctgcttgctccgcgtggaccgctgcttgctatcctcagggcgctgtctggtctctctctctctctctctctccccctccctcttctcgaccattccagctcccgccgcgccggtggacggcgcaccccaggcgtcaacgggatggtggtgctggtggctactgccgctcggtggcccgggggaggcacggccgtccgcgcgcgcccgccggctgcgagggcgaggggtccccgtcgcgtcgccgccgcggagcccgagcagaagtcagcggccacggtcaggtttgtaaaatgtaggttgttatcatggatgaaaccaataaggcatgacgtcagggcccaaatgtccaatgtaaatgttggtgctgggagttatggagaaaatgaagcaaatagccgtggagaacgtttggatacctcttctaccggagaccccaacaaactagcaaaacaactttcagggtctcgttacctgcaatccattggtgccgtgctacttctgtgtgccctggcagctagtttttttgttttgtttaaaggactatcgtctgcagttgtagctatgctggcaaaatcaggtttcacggcagcatttacactgatttttggtatctgagattggagataagacgtttttcattgctg

SEQ ID NO: 7114 - DNA, 778 bp, Sorghum bicolor
  Clone ID: SORBI-28MAY03-CLUS75557_1
acctcctcgtcccctccttaactttacctcagctcagcgcagtgccagacatggacgtctcaccatttgttgcactgctgttggttgctctcctctccctgctcctcttcgccacaaggagaaagggctctccgtccagcgagggatggccgccggcggcgattgccgccgtcgccgccagggcttcccctcctcggccaccttccccttcttggctccctgccgcaccgtaacctccgatcaatggccgcgtcgtacggccccgtcatgctcctgcgcctgggccgcgtgcccaccgtggtggcctcgtcggcggccgcggcgcaggaggtgatgaaggcccgggacctggcgttcgcgagccgccccagggtgcgcatggcggagcgcctcctctacggccgcgacaacatggccttcgccccctacggcgagtcctggcgccaggcgcgccgcgtctgcgtgctccacctcctcagccagcgccgcgtgcactccttccgccacgcccgggagcaggaggccgccgcgctggtcggccgcgtccgccgcgccggcgcccgggacggcgccgtcaacctcaccgccctcctcatctcctacaccaacggcatcatctgccgcgccgcgttcggcgacgacggcagctcctggaattacggcggcgagaagctctcgaagctcttcgccgacttcgaggagctgattggcgcggtcaccgtgggcgagttcgtgccgtggctggcgtggatcgacacgctcatggggctggacgcca

SEQ ID NO: 7115 - DNA, 698 bp, Sorghum bicolor
  unsure (1)..(698): unsure at all n locations
  Clone ID: SORBI-28MAY03-CLUS75559_1
tactgggcgcttcttctctcgccgtcgtccgatcgtcantcgccaccgtcgcgtccagacccgtccgttcctccgaggaaatggctgcactgcaaccctcattttcaccagcaatgactttgaagagtagctgcagtgccctgaagttcccgcaaactgcactgttacctggttttggtggcattccacgccctcaagacaggaaagctagcttcgcttgtttgatccccaaagttgcttcagtgactgaccaatcaatagcagagccatcgaaacccaagcaaaacaggcacacggtcgaccctacagctccagaatttctgcctctcccatcttttgaggaatgctttccaaggagtaccaaagaatcaagcgaaatcattcatgaggaatctggtcatgtcctcaaggttccattccggagagtccatttgactggagatcagaagcactttgatacatatgacaccagtggccctcaaaatataagcccaaggattggactcccaaagataaggaaggagtggattgataggagggaaaaacagggtagtcctcggtacacacaaatgtattatgccaaacagggaatcataacagaggagatgttatactgtgccagccgtgagaaccttagtcctgaatttgttcggacagaagttgccccgtggacgagccataattccttccaacaagag

SEQ ID NO: 7116 - DNA, 679 bp, Sorghum bicolor
  Clone ID: SORBI-28MAY03-CLUS75572_1
acagcccagagagcctcctagagctaaggcgcggcgtgcctccgctccgaccggccggagactcctgccgccgccgccgccgccagccgccaccccgccctctcgatccgcgcacggcaaatccagccggacccgcattggggttggggctccttcgatccggctgtggtggggtttggcaaagagctcgaggagtcgaggtcgaggggacggggggaccctgatccttctttccgttcggatttcgctttcccccgtggggtcttctcggttgctggtgcaggtgtcctgacccggagggaggggacgagggcatggatttggcgtcggtcaacgaggagctggccgagatcgacggccagatcggcgacatcctccgcgcattgcaaaatgggttccagaagctggagaagatcaaggatgccaaccgccgcagcaggcagcttgaagagcttactgataagatgcgagactgcaagaggctcatcaaagacttcgagcgagttagcaaagatggcgctcggcgttccgagcctgcaactcctacgttgctccttggcagcaaccggccggtgatcataggagtatcctccttcgtggcgcttaagaaacaacaggcaagtgaaaataagagaatcgatctttttgatgggccaagtgttgaagatggctttggtga

SEQ ID NO: 7117 - DNA, 515 bp, Sorghum bicolor
  Clone ID: SORBI-28MAY03-CLUS75588_1
aaaattccaacgcgcacccactcctaaactgaaactccagagtccaaccgcgacgcgagcacacacagacagccagacaggaagagcgagcgagagaaaacagagtgcgacgaagagggagagagagagagagcaaaacccaaaccctaacaatcatttccaggcccccgcccccggcgtctccagaacgttccagaaccttcaaggaaccatccacaggcgaggcctcgctccccgcccggatttcccatttccaccttgccggcgcggcgggatcctgacactggcgctgtctgctggggtttcgtgtaggagcaggcgcgagcgcgggtgtttggatcgggggaggcaacgctggcggctcgcggcggcagcagctgatggcggatccgcctagcggtgggggatctagggcttgtgtctgcagggagagacaggtcgaggaggcagcggcggggctggggttggggctggggctcgggacaagggagcaggggaggagggagggaggatgc

SEQ ID NO: 7118 - DNA, 508 bp, Sorghum bicolor
  unsure (1)..(508): unsure at all n locations
  Clone ID: SORBI-28MAY03-CLUS75700_1
cgttcccataaaaaaatcccnctcggtctctcctccccgtctctcctcccgacgcgacggcgacaggcgacggcgccacccacgggcgggcttcccctctctctgtccctctcctccggcgttgcggcgtgctaggtgggcaaggactgtggcctcctcttcacgcgatggcggggtgtttgttccctccacgggcgctcgacgaaaccctagggagacagaatgtccaaatgatttggctatccagtcccttttatcagcagtggattcatttggtgctgactacaagcttcttgggatacaggcttccagggagccaacgacatgatataagaaacttttcatgcttccattggcccaattctacaatggcattgtcaggttttatgtgtctcacaaaactcattcgctttcctgcactcaaatcacagtttagtgtacttagagcaactgtgtttttactttccagtcaccctttcacaactggacttaacagatggaaacatgc

SEQ ID NO: 7119 - DNA, 607 bp, Sorghum bicolor
  unsure (1)..(607): unsure at all n locations
  Clone ID: SORBI-28MAY03-CLUS75719_1
tgggtagaatagccccggaccggggcggcggtgcctctctagccgcgcgccagtccgccaccggcgctcgctcgtcgtcgtctcagtcattcgctcacgtccatgcacctgntacgcatcaccngactccngccgcacngtgcgggatgtcgcnctcatcctncttcctccccgtgatccatctatccacatcccttccctgatcagacagacccgtgccgtgcagttccacttccagtcttccaccacacttggagttggagagcagaggtgcagactgcagagtcccgagcgcgcatccaacctctgaacctagtccgcgggcggccggaacccatttggtctagccgtgcttcttccccacccctgcccggaatctgatggggtcgctcacgagggcggcggaggaggacccagcagcggctgcggaagaggagtggtccgacgaggccgtcatctacgtcaacggcgtccgtcgcgtgctccccgacggcctcgctcacctcaccctgctgcagtaccttagagatattggccttcgaggaacaaagcttggatgtggtgaaggtggttgtggagcctgcactgtcatggtctcttgctatga

SEQ ID NO: 7120 - DNA, 688 bp, Sorghum bicolor
  Clone ID: SORBI-28MAY03-CLUS6913_1
cctcatgcccgtcctccttacttagccaaaggaattgaactcttcagaaaagggaagctagagataggcactaagcttgcagagttttgttcacgtgctttgcttgctttggatgtccttgtccaccctcgagccctttctctagaaagaacagttccttcacagggaaatacagtttttggtgctggaacataccagatttcacgattcggggatcagcctcaagcaatggaggttgaagacatgtacgatgattggctgacatccaacaacgatgaaccagcagaggttccagtgaacgatagtgctgcaggagtaagtacagatgtcatcctggtggaggttggaaagcagctcaattccaaagcagaagatcctaaagttgacccacccagaatcacagatgcagcacaagatgcaccaacatccacctagagtgatgtcaagatggttgatgcccctgcagacgtttctgctccgccattctctgtggagcatcctgcgcgcccctgccgtcgggccgctcctgcgtgctctgcagttcctggtgcgccgcagcttctgcaggttagtcctcatgagaacaaaagcccagcagctgtccatctgccatccagcagcatgctgggaacttcaggtgaaccttctgctactccaggtgttggttcgagccaccatccccgttcaa

SEQ ID NO: 7121 - DNA, 662 bp, Sorghum bicolor
  Clone ID: SORBI-28MAY03-CLUS69385_1
atcacaggcacagcccccctgaatcttatcccctcctctccatcctcggcgagcaccacgcagagcggccggcactgcggcggaggtccaagccgagctcggattccccaaccgcgcaaccctctccatggcgcgcgccgtgcggcggcgagcccccgtgcattcccctcgcctgcgcgcggcctgctaagccaccattcctctccgcgcgccctcctccccttctccctcgtaaatccacgccactcctcctcatgagtccgccggcctacaccgcctccccctgcacgggttccgctctcttctccaactcccgagcgccgccgccgcgtcttcttctccagcgtggcccgggggcgccgtcgtccgcggggcggcacggcggccgcgttgccccgtcgcaggagaggcgccgccccgccccggcgcaggagaagcgccgccactcggagtcgtcgtcccggacccagctcccggagcggaagcggcactggaaggcgggagagttcccggggaccgctactgccgatgggggtggcggcggacggctccccgctcaggggaagcggcattcgaaggccggtgaatttcccgggacgcacggcggccgcgccgaccccgccccgtcgcaggggaagcggcattggaaggccggcgagttc

SEQ ID NO: 7122 - DNA, 727 bp, Sorghum bicolor
  Clone ID: SORBI-28MAY03-CLUS69395_1
gggttccccacctaaccccaccccccggaatccaccatggccgccggctccggccccgacacggccgcggaggcgcagcccccgccgccgatccaccacctgccgccggacgcgctccacaacgtgctgctccgcctgcagctgcgcgacgccgtcgtgtgccgccccgtctcgcgcctcttcaacgagaccctctcaccgcagctcctcgcgctgctcccgaccctgcgcctcctcctcctccgccacccgcgccccgacggcggcggatgcctccacgccttcgaccccgcgcgccgcacctggctccgcctccccttcgcccacttcctcccctatcagtccttctcccccgtcgcctcctccacgtcgctcctctacctctgggtcgagacctcctccaccaccacctcgcccctggccctcccgtccacctccacgtcttcctcctccaaagcctcgcccgtgcacccgcccaaatccctcgccgtctgcaaccccttcgccggcacgtaccgcctcttgccccagctcggatccgcctgggcgcgccacggcaccgtcctagccggccccggcggcacggtgctcgtcctcaccgagctcgccgcgctgtcctacaccccctccggatccagcaagtggatgaagcatcccctctcgctgccgtccaagccgcggagccccatactggcctccgccgcggccgccgtcttcgccctctgcg

SEQ ID NO: 7123 - DNA, 679 bp, Sorghum bicolor
  unsure (1)..(679): unsure at all n locations
  Clone ID: SORBI-28MAY03-CLUS69416_1
gcacgaggaccaaacgtccgacgcaatccacaacccagaggcctcttcagatcgagtcatcgcggcgctgcggctcggggatcttgtccgctcctactgccacttcattccccggcgcgtcgtcgtcagtcgtcaggactcaggatccccaaagatgtcttcttcaaatggtgaggctgagcaacaatggatagagagtgttaagttaggaggagcagttccctgtctaacacctgaaaactgtcctaatggctgggctactccttctggtgattcatttatggtcagaggccctgaatatcttacaaacaaggtaaaaataccaggtggagaatatcttctgaagcctcttggatttgattggatcaaaggaccagcaaaaatctgtgagatcctgaaagacaataatcatcgagttagaaaagctattgatgaggaggtttcacgtggtaaccagccttttgtctgggcattcaacttgcaactgcccaaggataactacagtgcaatattctactttgtatcgctggaggctatacctgaaggctcacttatggaccaattcttgaaaggagatgatgctttccgaaactccaggctcaagttaatagcanacattgttaaggggccctggattgttcgcactgctgtgggtgaacaagccatttgtatattgggg

SEQ ID NO: 7124 - DNA, 640 bp, Sorghum bicolor
  Clone ID: SORBI-28MAY03-CLUS69481_1
tcattgctggttaaacctatggtccaagtctctgtcattgccaactcgtttcttttagcctagtgagttaatgatccgcgttcttatctccggtccattattcaacaaagtatccgctggaacaatggtactctgatactctcttttgccaccagattgcagtgtttttttagccacatctcggttttgactcgtactgtttcatgattctcacagaaaaacattaggatatcccagtatccagagtcttgattgacatctcgtgtcataacaccttgtgatgtcttatatcatgttggagcaccgattcctactatgtttgtgatgtaaggccaattccaaccagcgacttgtgtgaatccaatatgcatggttccagttgataatgtattgagtatataaaaaaattgcaatccctttcggcactctgttcagaattcaagactttgatcattcgctttgtaagttagcttttgtaagatatgagttttttctcagggactattcaatctgtatggaatgtttcgcgaaatttttgttttacgagtgggtacatgaacttgtgtccatttggaatatctgtgtacctccattcgatggcctgttttccccagtttaatttaatttaaaaatgcggctt

SEQ ID NO: 7125 - DNA, 696 bp, Sorghum bicolor
  Clone ID: SORBI-28MAY03-CLUS68394_1
gaacaagctccaggagaggttcagaaacttcaacctggacgccactgacctcgtcgccctccaaggagcgcacacatttggcaaagtacagtgccagttcacgcagcagaattgcacggccggccagtccggcggctcactggagaacctggaccaggtcacgcccaaggttttcgacaataagtattacagcaacctcttagagggccacgctcaactccggtccgaccaagttatgctatcggacccttccgcggtggtgaccactgctcccattgttcatcggttcgcaggcaaccaacaggattttttcagaaacttcgcagcatcaatgatcaagatgggaaacattagcccactaacaggaaaggatggggagataaggaacaactgccgaagggttaacaaacgctactaactctgaatacattgattcaatttgattgattccatttctcttaaccaaattgagaggctttatttgtgtaaatgattcttctgtttccatttcacaatctttgtaaccataaggtgtttatcttatatttttctactttctgtaaagcaaatgtaaaagcgttatcacgttggtcgtatgtccatttcatgaacattgaattcataaaattctttttttaccaaactggcccatcgctccagcacgcatataattgtaacttatgtaaatattaaaag

SEQ ID NO: 7126 - DNA, 517 bp, Sorghum bicolor
  Clone ID: SORBI-28MAY03-CLUS6828_1
gcacgaggggctgctcccgctgaccaagcgcagggccaagcccgcggtgccaattggcggcgcgtacaggctgatcgacgtgccgatgagcaactgcataaacagtgggatcaacaaggtgcacatcctcacgcagttcaactcgcaatccctcaaccgccacctctccagggcctacgattgcaccaatggcgtggccttcggagacggattcgtcgaggttctagcagcaacccagaggcctggatcggagggaaagaggtggtttcagggtactgctgatgcagttcggcagttcgactggcttttcgatgatgcaaaatctaaagacattgatgatgtgttgattctttctggtgaccatctctaccgaatggactacatggactttgttcagagtcatcggcaaagaggtgcaggcatcagcatctgttgtttgccaattgatgacagccgggcatctgattttggcctaatgaagatagacgacactgcaagagttatttcattcagtgag

SEQ ID NO: 7127 - DNA, 657 bp, Sorghum bicolor
  Clone ID: SORBI-28MAY03-CLUS68412_1
aacccttctgcctgccctcggcgccgcgcggccgcgcccatgagcctagcggaggcgccgtcgccgtccccgtcgtcgtcgagcgggagcgacgacttcgcggcgctcctcgactccgagctcgagctcgcctccggcgccgactcggccttccctggcgacccctcctccgctttccccgccgccaccgacgacgaggacgaggatgaggatccggaggttgaagccgtagagcaaaacggtaccaaaaggcgtagagtggaggaacagcgccaagatcaaggaacatcagttaggcctgacaaaattcccactggtgcatctaaaaatgttcaggtcgaggcatgtccacatcctggatattttggtggactttgctttagatgtggcaagccacaagacgaggaaaatgtttcaggagttgcttttggttacatccacaagggcttgaggctaggtacctcagaaattgacagactacgtggtgctgatttgaagaatctgttgcgtgaaagaaaattagtactcattttggacttggatcacacactgatcaactcgaccaaactccaagatatttcttctgctgaaaaagatttgggtattcagactgctgcttcaaaagatgatccaaacagaagcatcttttcactagat

SEQ ID NO: 7128 - DNA, 660 bp, Sorghum bicolor
  unsure (1)..(660): unsure at all n locations
  Clone ID: SORBI-28MAY03-CLUS68450_1
aaggcgtcggacgtgttcgcgttcggcgccttcatnctggaggtggcgtgcgggcggaagcccgtggtgcaggacgcgcgcgacaaccgcctggtgctggtggactgggtgctggaccgctggcgcgccggctccgtcacggacaccgtggatccgcgcctgcggggcgacttcgtcgagcgcgaggcgagcctggtgctcaggctcggcctgctctgctcgcacccgctgcccggcgcgcgcccgggcatgcgtcagatcgtccagtacctcgacggcgacgcgccgctgccggagctgtcgccgacgtaccagggtctcaacatgctgtcgctcatgcaggaccagggcttcgacccctacatcatgtcgttcccgatgacgtcgacggggaccagcaccatatctgacctgtccggagggagatgagtgttgatcgcctcgaatcaaggtttagttaccgtacccactacccagtgtcttaactggagttcactcttgttctcgtcgtgaccagggcttcagaacctggtgtgtgtagagcagcagtgtgcagtacacctgaatgtagcgtggatgacttgaatgtaaagatatgctcgggtagcttgatgttcagattataataaattactaatcacacctagagattaaggttgg

SEQ ID NO: 7129 - DNA, 612 bp, Sorghum bicolor
  Clone ID: SORBI-28MAY03-CLUS68404_1
tctgcatccggctctcttctctctgcaactgcatgcaagcaagcatcatcggcactagctagacgtagccacgcctgctgtctgcactgttagtagtagtagtagccatcaactagcttcgatctcctgcactgcaggtgtagcaactcagacctccatggcggccgcttcctctcgcgtctcgtctctcgggttgctgctagccgcgcactgcgcactcttgctcgctttagctggagctgctcacgctcacagttacgctcctagcggcggcgtggcgctgagttccgcgttctacgacgagtcgtgccccagcgcctacgacgtcgcccggcgcgtcatccaggacgcgcgcgtctccgacccgcgcctcccggcaagcctcatccgcctccacttccacgactgcttcgtcaatggttgcgacggctcactcctgctggacgacaatctcccggcgatccagtccgagaaacacgcgcccggcaacgacaaatccgcgcgtggcttcgaggttgtcgatgacatcaagagcgcgctggagaaagcgtgccctggcatcgtctcctgcgccgacatcctcgtcctggcagccgagatctccgtcgaact

SEQ ID NO: 7130 - DNA, 679 bp, Sorghum bicolor
  Clone ID: SORBI-28MAY03-CLUS68621_1
agcttttgtttttcatagctaatccacgcttcaaccttcaataaatcaacatgggtaaggacaagcctcacgttaacctcgtcgtcatcggtcacgtcgactccggtaaatccaccaccaccggccacttgatctacaagttgggaggtatcgacaagcgtaccatcgaaaagtacgagaaggaatccaacgacttgggcaagtcttctttcaagtacgcctgggttttggacaaattgaaggctgagcgtgaacgtggtatcaccatcgacattgctctctggaagttcgagaccaacaagtactacttcaccatcattgatgccccgggccaccgcgacttcatcaagaacatgattactggtacttctcaagccgacgttgccatcttggtcattgcctccggaaagggtgaattcgaagctggtatctccgacaacggtcaaacccgtgagcacgccctcttggcctacactttgggtgtcaagcaaatgatcgtcttgatcaacaagatggacgacaaatccaccaactggtctcaagcccgttacgacgaaatccaaaaggaactttcgtcctacttgaccaaggtcggctacaagcccgagaccatccccttcatccccatctccggttggttgggtgacaacatgttggagcgatccaccaacttgccttg

SEQ ID NO: 7131 - DNA, 650 bp, Sorghum bicolor
  Clone ID: SORBI-28MAY03-CLUS69733_1
tcggcggatgggtgtgcgtcatgacgctcttcgtgtatttcttcctgccggagacgaagcagctgcccatggagcagatggagcaggtctggaggacccactggttttggaaaaggattgcagatgcagatgcagatgcaggggaggaagaagagcaaggccaaaggagacccagacccagaggagaggcagcaggaaccatagctctgtccgccacatagacactatacattgcattggttgccaatcattattaattaagctactatatatataggtgatctgatgatcaaagtatacatacacatgcatacattatatttggtgaaaccgcgcgcgcctgcagaaatcgtatagctaggcgcatgcatggtacaccactttgttgattacacacactagctagtatatatactatactctagtaaataataaatccatgcaaatatatatatatatgtaatgggcttccattgtatagctaactagctgcccacaaattgtttgtatcctagctagctagggagcaaatccatttcaataagctagtttatttgatgcatccattctgtaatgtaaaggggctatcctatccatgaaggaagaattcaaggggcttcccctccagcagaagtgcgaattaattataa

SEQ ID NO: 7132 - DNA, 1144 bp, Sorghum bicolor
  Clone ID: SORBI-28MAY03-CLUS69753_1
gacccagctctctctaatccatctccgtccctgtctcgccatcctcctttcctcctcttcctcctccactcccccaccgagcagagcgaatccttagcgggcaagtctttccgagctcgcggagtggggttcaaaacgcggcccgagaaaaggaggaccgcactcgctgctgctggtcgcttgctttcggtggcgagcgtctcggtaaagcggcgtcggcgtcggaggcggcggcagagactggacttgcttgctgcgcagtgcagtgcagtgctgccttggagacaggatcctgctgcagatatgttaagcgaccttcaagtgatgctttcacacacaggcgagaagagacgcctgaaacgaattgcagtacaggaagcgtcgtgatttctttaacacgcgtaactgcaagaagcgagagttgttgttttcccccctccagatgttggactcataattgaccactgggtccaaagaccagagaggaacgtggctgagtttgccaccaccttcacccactgtggtcgctcgtctgctaatgcccgcgtcggaggattgctcacggatatgcttctggtgatgggcaacccggggcgctcggggcagctgtcagcgctgattgcttccgccgccatcttgttgtcactctctgcgttgccgatttgtcggccctacacctacgagcaagatgtgcccgcaatgaatggcttgtacacggcactcggagcaccacagctgcctagttggacttcaaatggtggtgacccctgcaatgagaactggcagggtgtttcatgtgttgcgtcaaatatcacctccatagtactcagcggtgcaaatttgggtggacagctgggcaacactttggggaatttcacatcattaatcaccttggatctcagcaacaataatattggcgggaccataccagatggtctaccactcacaatgcagagatttttcctttcagctaaccagctaagtggtggccttccaaatacattgtcgtcccttacacttttgacaagcatgtcactcaatagcaatcatttgactggagcgataccagatgtattttcaacactcactggacttgcaaatttagatttttctgacaacaacttgactggtccgatgccgcctt

SEQ ID NO: 7133 - DNA, 642 bp, Sorghum bicolor
  Clone ID: SORBI-28MAY03-CLUS69765_1
caataattggccaccgccgccgcttctccatctccatcctctaaggccagaacctcctccctccacgaaccccccgagagaagatgtacgactacgggctcgggcacccatggctgaaccctgagggcaccttcaaggtcttctgcaaggccgacgaggggctctgcctcgccgtccgcggcggcgccctcgtccttgccgccgccgaccccgccgacgtgcaccagcactggttcaaggacgtccgcttcagccttcgcatcaaggatgaggagggcaagcccgtcttctccctcatcaacaaggccacaggcctcgccatccggcactccctcggcccttaccacccggtgaggctgctggggcccgccccccccgccccccctgggtcgctgctgtgggcggagtgcggccacgtgggctggggcggcggctccatccccggggtgcccgccggcgtccggccccgcggccccccctggccccccgccgtggacggcgtgcggccccgcgcgcgctgcccgctcacggagggggccgagggcgacacacggagctggaagatcctcttctggagcgaggaggccaacaaaacctgcgccgggctttacgctgagcccacatgccgcatctactgcaagg

SEQ ID NO: 7134 - DNA, 689 bp, Sorghum bicolor
  Clone ID: SORBI-28MAY03-CLUS69866_1
cccggccccgcccgccgcggcctggccgacgacctgagcggccgccgccccccgctcggcgacgcggaccccctggacggcgatgcgttccgacgaccgcgactcctccgctgcggccggcccgctcccctggacggcgttcgcgccccagcggccgtccggccggtcgatgccactgacggccacctcgtcagcccgtgccgcttccacgagttgccccttcacggcagcgtttgtgcaggcacccttgctctccgccatcgtcgtcgtccccctgtgtagccccctgcagtcccccgcagccccccatgctttctgaccctcactacctgtcccctctcctcgtcccgttctcccattctgtttttttggttcaggaacgatgttggtgttcaaccgatcaaccggacgatcgatgcggctgatggccacttcggagaatgcttactactagtactatttgctgccttgtgtaatcatttgtgatggcactgtttgtgtgtttgatcgttgtagattctgtatctgtaacgctgcaggcccccctgatcatcagattgtactccactctgaatatttgtactgtatactcgtttggtatttcctactgttggtcaatagtcctatgaatttgaccatgtcggcgatgttcctttatactgtacggttgtgattgttatgcaaaataa

SEQ ID NO: 7135 - DNA, 572 bp, Sorghum bicolor
  Clone ID: SORBI-28MAY03-CLUS68930_1
aggcaggcaggcagccagccagacaagggtcttcatcgcccctgctctgctcctctcctccctccctccccaatcccgatcccagccccgccgccgcccgccgccaaatccagcccaacccgcgccgcgatgagctggtggtggacgggcgcgataggcgcggtcaagaagcggcaggacgagcaggcggcggccgcggagccctcgtaccagagcgtggccctcgtcgtcggatccaccggcatcgtcggcacctccctcctcgacatcctcccgctcgccgacaccccggccggtccatggaaggtctacgccgtctcgcgccgcccgctcccgccctggtccccggcgccctcccccgccgtcacccacctccacctcgacctcgccgacgccgccgccgtccacgacgccctcacacccctcaccgacgtcacccacgtcttcttcgtcgcgtggaccagccgcgccaccgaggcggagaaccgggaggccaacgccgccatgctccgcaacgtgctctccgtcgtcgtcccccactgccccgcgctcgtccacgtctgcctccagac

SEQ ID NO: 7136 - DNA, 664 bp, Sorghum bicolor
  Clone ID: SORBI-28MAY03-CLUS68936_1
ggctctcgctccccatccgtccatggcgatgccgccgagccgtccgtgggcggagctgcagcacgacctcctggtggcgatcgtggcccgcgtgggcgtgccggacctgctctccggcggcgcctcccgcgcctgctcttcgtggcgggccgcggcgcgggacccgctcgcgtggcgccgcgtcgacctccgcgattgggtcgccctcacctcgggccggcgcgccgcgagaccgggacactccagctctcgcgtacccgtacacgccgcgctcttcggcatcttggaggtcgccgccaagttggccaaagggcggatcgaggccgtgctgctccccgagtttgctgatgaggaccatctcttgttcctcgctgagaggtgtccaaacctgcagtatttcagccttcctagcacctgtatgacttacgatcagttctgtaaggcgataggtggacttcattcgcttaaaggcatggcagtggatgagactctgattaactatgatgtcctcctgcatgtgcaccagtgctgcccagactttgtggagctgaaggtgtctgcactgtatgtggatgaagagatggcctcagtcatctgtaactctcttcctcatctgaagaagctggagataccaagcgctgacatgtcttccgccgcaataata

SEQ ID NO: 7137 - DNA, 699 bp, Sorghum bicolor
  Clone ID: SORBI-28MAY03-CLUS68985_1
agcggtccctagctctgccttctccactttcacttaagagctcagcaaaatggttcttggagcgttggcgactgcagtcgcctcgatgcaattgcaatggagcctcctcctcatctacggtctcctgggcggtctgctcctgtggaaggccggccggctgctcgagcggctgtggtgggagccgcggcggctcgagcgggcgctgcgcgcgcagggcctccggggcacctcgtaccgcttcctcaccggtgacctcaaggagtaccgccggttcaacaaggaggccgccgcgtccaagcctttgccgctgcggtgccacgacatcgccggccatgtcgcgccgtttgtccacggcgccgtcctcgaacacggcaagacgtgcttctcgtggttcggcccgatccccagagtgaccgtcaccgacccggacctcgcaagggacgtgatgtccaacaagtttggccacttcgagaagcccaagttcccggcgttgagcaagctgttcgccgatggcgtagccaactacgagggcgagaagtgggtcaagcacaggaggatcctcaaccctgcgttccacctcgagaagctcaagctcatgctgccggcgttttctgcgtgttgtgaagagcttgtaggccgatgggttcagtcacttggttctgacggctcgtgcgagctgaacgtggacccggaacttca

SEQ ID NO: 7138 - DNA, 606 bp, Sorghum bicolor
  Clone ID: SORBI-28MAY03-CLUS6903_1
gagggacattcaagaaggagaaatggtccttgagtatcgcggtgagcaggttagacgaagtgtagctgatttacgggaagaaaaatatcgtgtacaaggcaaagattgctaccttttcaaaatcagtgaggaagtggttgttgatgcgacagacaaaggaaacgtggcacgattgatcaatcattcttgcacaccaaactgctatgcaaggattatgagcgttggacatgatgaaagtcgtattgttctaatagccagaaaaaatgtttgtgctggtgatgagctaacgtatgactacctgtttgatccagatgaggctgatgaacgcaaagtgccatgcctttgccagactgctaactgccggaaattcatgaattagtttacttagatgtcagaggatcactgacatagtttttccctccttgtttatccccccttccccccctcgatgattcatttgtggtatatcttgatctctcccgatttttgtttacattcatcttagaataagtttagttagagctcaaaagtcgagcttccattcctgtaaataccacagttgtattcactagggccagtacatttttcaaataaaaagttttgtgc

SEQ ID NO: 7139 - DNA, 685 bp, Sorghum bicolor
  Clone ID: SORBI-28MAY03-CLUS69042_1
tctggcgcaatccgacttccccaagcatggtgttcggccggagcaaatcatcttcgtcggcgacgccgtccgcgccctcaaaggcggcggccgcgtgctccgagctgcgcaccgcgtaccacgagtgcttcaaccggtggtacgcggagaagttcgccaaggggcagtggcagagggacgactgcgccgaccactggcacaagtaccgcgcctgcctcgaggaacatctggaagacaaacatctgaagcaaatcctactggacgcagaaacttctgcattttataccaggcctgaggctgaccctccctcaggacaaggaactacaaaataacagtctcccgtttaccacatgccatgtctgacttagggaaccttggtagatgaactagaaactcctttaatcttgacacttgtgaggcccctgatcatgtaacacttaaattgagctggtgtttgcgaacaagatttgtgtcagaatgatgtaccctgctacctgaaaacattggaagaattgagaatagaatcagctgcagagctgtacaagttgaagaacgttgtttcatcgatggctggtgttgttagggtaaccaaacaattgatgggggatcttttccacccttctaagtgttcaaaaccttctattttcttttctaggtcttgtatgttctacttaataaaggtaca

SEQ ID NO: 7140 - DNA, 563 bp, Sorghum bicolor
  Clone ID: SORBI-28MAY03-CLUS70139_1
tccatgatggttaagtgcgaccccagacatggtaaatacatggcctgctgtatgatgtacagaggtgatgtcgtccccaaggatgtcaacgcttccactgctaccatcaagaccaagagaaccatccaattcgtcgattggtgccccactggtttcaaggctggtatcaactaccaaccccccactgtcgtccccggtggtgatttggctaaggtcatgagagctgtttgcatgatctccaactctactgctatcgctgaagtcttctccagaatcgatcataagttcgatcttatgtacgccaagagagctttcgtccactggtacgtcggtgaaggtatggaagaaggtgaattctccgaagccagagaagatttggctgccctcgaaaaggattacgaagaagtcggtatcgaaactgctgaaggtgaaggtgaagaagaaggatattagactatctgaggaaaagtatcatacatatatttcacatttcactcgtatgatatattttagcatatgactcttttattgaaagtctagcttaacctaacataaactctctc

SEQ ID NO: 7141 - DNA, 732 bp, Sorghum bicolor
  Clone ID: SORBI-28MAY03-CLUS70104_1
gatccaagttccaagaaaatacctgtgatggaatttgacgttgccaaggttttggaggagcttgaactcaccatggaccagttcattgatttgtgcatcctgtgtggatgtgactactgtgatagcatcaaaggtatcgggggacaaacagctctgaaacttattcgtcaacatgggtccatagaaagcattttagagaatcttaataaagacagatatcaaattcctgaggactggccttaccaagaagctcgacgcttgttcaaggagcctaatgttacattggatgttcctgagctgaaatggactccacctgatgaggagggtctcataagtttcctggtaaaagataatggcttcaacgaagatcgggtgacaaaggccattgagaagatcaaatctgccaagaataaatcatcgcaaggaagacttgagtcctttttcaagccagttgccaccacatcagcaccgctgaaacggaaggagacttcggataaaacaagtaaggcagctgctgcgaacaagaaaacaaaggcaggtgggaagaagaagtaagcttgaatggttaaatgtgcagctacgaaagctgttggttgcgtcatcacttaggttatttgactccttgttgtaactcaaacctgtggtcaaaagctaggtaaattagttgtgtctgaagagagattggtgtaccaagtaacaaaacttatcacggtggttatttttcccgttcat

SEQ ID NO: 7142 - DNA, 826 bp, Sorghum bicolor
  Clone ID: SORBI-28MAY03-CLUS7014_1
gcacgaggtccttttatacctttttttttgcctatgatggcagtgctttgatccgtgtttcctgttgtgcttgatatcaattaaaaaaatctagctcgaggccggctggggccagagggctggttgtgtggtttgctgggcattttctgtggacatcgtgtgtgccccttcctttagtgatgttgctctctgtgactcttccagtttccctgcttgtgggttctataggcccttcttgtttcattgccgctccttctgttgcctagtctagctgtgctgtgctcctgcaggggcctcgcaccggctcctggttccggtgctgtccgccgtggtgtcttccaatgttttcaggtcgtccgattaatcgcgattaatcgtcctggtcggtcaggagtgctcgattaggaggttcgacccgaccaggtcgaccagaaacctggtcgtccgattagtcgtccacttatcgcgattaatcgtccgattaggacatggacgaccagggatggtgaaatgtttcaacttgaatctttgttattgccatttggagcgaaggtcttagactttaaagacaactatctcaggatgttcatgaaggcaccagactgtgaaatttatggacagaaatttaattgtcctattgattcgtttatttcagaccatgagctactgatagaaattgataaaagaaatatggaaccaaagaaagtacagatcattcctgatgacatgtctgtagatatactggttgagaggatgagtcctccagagaggccatttcttgtggaaccttacaatggcttattcagcaatgtcaacaccaggctat

SEQ ID NO: 7143 - DNA, 602 bp, Sorghum bicolor
  unsure (1)..(602): unsure at all n locations
  Clone ID: SORBI-28MAY03-CLUS70169_1
atggaaggggaggctgcaccacccgcaccagcaccagcgccggacaaaccggccgcgcatgtcgtcctgctcgcgagccccggtgcaggccacgttctgcccatggccgagctcgcgcggcgcgtcgtcacgcaccacggcgacggtgccgagttcacggccacgctggtcacttacaccaacttctcggcggcggagcactccttcaccgcgctcccgccgtccgtttccacggccgtgctccccgaggtgccgctcgacgacctccccgccgacgcccgcgtcgagacccgcatcctgaccgtgatcaagcgcgcgctcccgcacatccgcgacctcctccgctcgctgctcgccgccgccccggccggcgtggcggcgttcgttccggacgtcttcagctcgtgggcgctcgaggtctctgcggagctcggcatcccgggctacatgttctgcacgtcaaacctaacggcacgctgtccaacgagcagatggccgagcttgccgcggggctagaggtgagcgggcagaggttcctgtgggtggtgcggacccccagcgacnaggaccgctgcgcgagcttctttggcggcggccatggc

SEQ ID NO: 7144 - DNA, 704 bp, Sorghum bicolor
  Clone ID: SORBI-28MAY03-CLUS70237_1
aattcaaaactcctcaaaagtttttaaagaatactcttatccttctaatcttcatctattcaacatgagagaagttatctctattcacgtcggtcaaggtggtatccaaatcggtaacgcctgttgggaactcttctgcttggaacacggtatccaacctgatggtcaaatgccctctgacaagaccatcggtggtggtgatgatgccttcaacaccttcttctccgaaactggtgccggcaagcacgtccccagatccgtcttcctcgatttggaacctaccgtcgtcgatgaagttagaactggtacttacagacaattgttccaccccgaacaattgatctccggtaaggaagatgccgctaacaacttcgccagaggtcactacaccattggtaaggaaatcgtcgacctttgcttggacagaatcagaaagctcgctgataactgtactggtcttcaaggtttcatggtcttcaacgctgtcggtggtggtaccggttccggtttgggctctctccttttggaaagactctccgtcgattacggcaagaagtccaagctcggcttcaccatctatccctctccccaagtctccactgccgtcgttgaaccttacaactccgtcttgtccactcactccctcttggaacacactgatgtcgctgttatgctcgataacgaagctatctacgatatctgca

SEQ ID NO: 7145 - DNA, 588 bp, Sorghum bicolor
  Clone ID: SORBI-28MAY03-CLUS69510_1
gcacgaggcagctgccgaccggtgctgggctcattcgagcgagcgaccattcgagcaagcaagcaagcagcgcgcggcagctagctcacgcaattaataagccttctcctagctttagccaatagccatggcgctggctagccaggtcgccgctaaccagccgccgctgctgtcctccccggcccggcgcctcccaagaaccagcagcagcaatgcgttgctgctcctccagccggcgtcgtccgcggtcctcggcggccggaagaacctgaggctggcgccgcctgctgccggcgcgcggagggcgctgctggacgccgtcgtcgtcgtgcgggcgtcgtccgaggcgaaggcggcggcggagaccaccaagtcggagggaagcggcggcggcggcggcggcgaggaggaggaggagcggccgtacgaggagtacgaggtgacgatccagaagccgtacgggatcaagttcaccaagggccgcgacgggggcacctacatcgaggccatcctccccggcggcgcggccgacgtgacggggcagttcgaggtcggcgacaaggtgctcgccaccagcgctgtcttcgg

SEQ ID NO: 7146 - DNA, 532 bp, Sorghum bicolor
  Clone ID: SORBI-28MAY03-CLUS69652_1
atcttggccttggactaagctaagagatggctgcccatcccaagcttgcctgccttgtgctgcctcctggccgtcgcctcgctcccgctgctcgccgtcgccgactgcgagtgcgaggcttccaccggcgaagaagatgacaagtcgagggcgctgacgctcaagatcgtcgccatcttctgcatcctcgtcgcgagctccgtcggctgcgcgatcccatctctcggccggaggttcccggcgctccgcccggacaccgacctcttcttcgccgtcaaggccttcgccgcgggggtcatcctggccacggccttcgtgcacatcctcccggacgccttcgaaaagctcggctcgccgtgcctcgtcgacgggccgtggcagaagttccccttcacgggcctcatcgccatgctggccgccatcgccacgctcgtcgtcgacaccatcgccacgggctacttccagcgcgcccaggccgccaagaccgcggcggtcgtcgtcgtcggggacgtggagacttcaggcggccacg

SEQ ID NO: 7147 - DNA, 798 bp, Sorghum bicolor
  Clone ID: SORBI-28MAY03-CLUS69675_1
gcacgaggcaactctctccgtgcccccctcgggccctcgcttctcgcgctcttcttcctctgcctgcctgcctccaacaactcgtgagggcgccgccgtccgtccccgtctccgtctccgtctcggggagcgaggatgatcgcgcgacgcctgctccgatccaatgcccccgcccaggcaagcagcttattgaagcatgtaactggcactgcgagtttgcaagggcatgcggatagtttgttggatgcctcagtcagacattttagttcagctccatctgcacagtctgcctcaactgaagaaaatgggtttaagggccatggcatgttggcaccttttacagctggctggcagagcaatgatttgcatccactgattattgagagatctgagggttcctatgtttatgacattaatgggaacaagtacctggattctcttgcaggattatggtgcacagcgttaggtggtagcgagcctcgattagtcaaagcagcaactgagcaattaaacaagttacccttctaccattccttttggaaccgtactaccaaaccttcgttggatcttgcacaggagatccttagcatattcactgcaaggaaaatgggaaaagttttcttcacaaacagcggttcagaagcaaatgactctcaggtcaaactagtatggtattataacaatgcattggggaggccaaacaagaagagatttattgcacgatcaaaagcataccatggatctacattgatatcagcgagtctaactggtcttcctgccctgcaccagaagtttgat

SEQ ID NO: 7148 - DNA, 606 bp, Sorghum bicolor
  Clone ID: SORBI-28MAY03-CLUS69683_1
cttttgtccgcgcgagcgccgtgatccgcaagggccgccgccaagtgctctttctccccttccccttttccgagcgccgccgccaagcgctcttctcccctcctcctttttcgagcgccgtgatccgcaagcgccgccgctctcggctgtggcgagattccgtacctggacgagagctccgtcgagaccacaatcgcgacgagagtagcgtcggggccgccgccaagcgctgttctcggccgtggtgggatcccctacctggacgagagcgccgtcgggatagggacgagcgtggcagcagttggtcgtcgaagggcgtggccgcctggaggggcgcatgttggctgtccacccgaggatgcgatgggattgcacgcggcccaaccggctccagtagcagcacctggatccattgtgcaggtgagcgattacgatgacaagtgagcgggtgtgcaaaggatggaggaagatgcagctctagcgaactcgcactagatccacggaacgaaggccaaatgctgcagttgcggcgcggtacctctacgcacccacgtcgtgttctttgcctcctccacccgccatgcgtccttcgcctcctggctgccg

SEQ ID NO: 7149 - DNA, 690 bp, Sorghum bicolor
  Clone ID: SORBI-28MAY03-CLUS697_1
cgaggtggtggtgactactatggtggaggcagcagtggtggttacggtggtggctcctcgtccgggctccttggatacggtggtggagctggtgctccgagttcctgggattaatgttatagttgctccctagtagggtctgccaacttgaggtcaccttttactctagtttcatttaggtatacatttttggtaggagctgttttacagcaacagtacaaggtgaatgtggtcatccccttttttcttctggttactactggctgcagtcttatcttgcagatgtccgttacggagagcgttcttgaggacattcaagcacacgagattcctagttaggtgaaattccttggtagggatagtagctaggctgacatgtagtgcttggtgcgaaatttctgcctttgcttttttgttcctttgtcagtgtcggaattttggtggtcggttgtaaagcttgtgttgagggggcttttacggcttgatttttgtcctggattcagagttttgacacccggaggttgaagaagcggtaggatgatgatgatagtccttagatccctgttgtaatgtacatactgcgagttgaggctggatagaataaattatgttggcttgtttagaggaagaagggggaagttgtgtgtgatggtttctttagagaaagattacctgttagtgtgtactgcg

SEQ ID NO: 7150 - DNA, 648 bp, Sorghum bicolor
  Clone ID: SORBI-28MAY03-CLUS69723_1
gagcgcatgcgcaagccaggccacggctccggctccggcgacgagttcgactaccccggctgcgccagggcctaccaggagttcgtccgcgccgtcgtcgcctaccaggagaagacgtcggcggttccccgtggcgtccccgcgccgtcgccgaagctgagcaaggagatggagaggcggcgcaaggtcatctcccggagcttctcgctcgccaaggacatgtacctctccggcggccgcaccaacccggcggagcagcgcgacctcgaagccggcgccgagttcctcgagtcgaacacggcgtcgctgagcgtgcagcaggagaagcggctgaagcagatgggcgccacggtgcggaacgcgtcggggtacctcaacagcctcaaggtgagcggcgtgcgggaggcggcggcgcgggcgctcatggcggagatgacggtgaaccagctctcggacctcgccgccttctacggcaccatgggcaagatctgctccgaggtgctcgacgccaagctgcaggctctgcatggcaacgtgaatctgcacgaatgaaaactgatgagcgtgaacctgccagtagcagcattctgaattcctgatgttataggcgtgctgataaaatcaatatctcgttaacgttaaggcaag

SEQ ID NO: 7151 - DNA, 718 bp, Sorghum bicolor
  Clone ID: SORBI-28MAY03-CLUS70632_1
actgtggcctttttttttttttttttttaagctctttacaaaaaaagtcatactgcacaagatgttgtacggtcgcatatattaaccttgtttgtaaaatcttgcttgcttgatgtagcctataggtgttaaaatcagttctacaggtgaattttaagttgtagtactatttaaattttacaattaattgtcatatgttcccattgcagcaaagataatgcttgaagggcaaatggtctgcacttcttcatgcttctcttgaatatttgtttcaacaacatagtgttgttcttatcagaggaggttttatttctcacaggcaatttgtttaaaaatattcatgcttttttatagttcactagttgcacaaattacaaagatatttgcgatgatatattctgtgtttggaaactaattcgttgtgagatttctatgaatgatgccacttggtacattcctaatattttggttctaatgataggtttcctaacataattagctcaaaatatgttccaagactgccttagcagaagtttgcaccattagctcaatctttttttcttccatatttaggaacctcccacaaagtctagcctctccacatttgaaaaaaggtgtcctgggtcttcatcaaatccccagcaaactgggcatcgagtatcaagtaccactccctttctagcaatattcattatgacttgtagtgagttatgggcca

SEQ ID NO: 7152 - DNA, 639 bp, Sorghum bicolor
  Clone ID: SORBI-28MAY03-CLUS70703_1
gccagccctcatggacaccaccctagcacagctccaggccgccatgaacaccaccacccaccaccggcgccggcgcacttgagcaggtgccctgcttctccagcttcaacaacaacattgccagcaacagcaacggcaatggcaacagcgctgctgctactgcagcagcagtagctcagccatgctacctgcccatggccacaggcggcagccatggcatgatgagctacctggaccatggcctgctgcctgaactgggcagctgctttgatcctctcaacagcgacaagaagctgctcaaggcagtgctgagccagttcggcggtgacgtggtgccaagcctgcagcatgagatggctgccgctgccactgccacttccacttggatgaatcacttctaggaaaatcaattcagcaaacctaagtactatgttgttggtgatatattgcatatatgagagatatatatacatattgtgtggtgaaacatttatgtgtgagtagtagaggatgcaacattttttctgactatcgattcagatgaggcaaggaaaattaggagtaaaactctgtaatggctgttgttgaagtgtgtatattcagatgcagaggtatgtcatgagtgatgaggagattttc

SEQ ID NO: 7153 - DNA, 621 bp, Sorghum bicolor
  Clone ID: SORBI-28MAY03-CLUS70707_1
ccctgtgaagtatgatgtcaaataccaggcaagcgcacagccgttcttcgtgttcggcctactggtgacagccctggcaaccagccattgatgaaagcatccaacttaaacagaacacgcaaccgttctgctaccgaagaggcaaaataagctagctgcttgtgtgcagggtaggaagagaacgtccttttacttctagaacacagatcgattttgtaagggttatgtggtgggaggaaaagttagcaatatcgctggatgttgtagtagggtcagtaggtgcacggtaagattgttgttgtgccatttttagcggctgaactggcaatgctttgaacaagcagttttgcgtgacggccgtattgttgtatgatcaatcctgaaagagtgttgctgattgttccatccacaatggaacgagttcacaacattcaggtttcatgaagagcataaatcggcggtgtgctccatgtattcacccgctagtagtgtagcgaggctttgtttagttcacccaaaaaaccaaaatcttttcaagattttccggcagtcacatcgaatattatgacacagtattaaatatagacgaattgtccagtttatctgtaaatcataagatga

SEQ ID NO: 7154 - DNA, 730 bp, Sorghum bicolor
  Clone ID: SORBI-28MAY03-CLUS70732_1
aaaaggagcccctgccataaaagcgcatccatggtttagaggtgttcagtgggagaagttgtatcagatgaaagctgctttcataccagaagttaatggcgagttggatactcagaattttgagaaatttgaggagacaggaactcaaattcaaagttcatccaagtcaggcccatggagaaagatgcttccgtccaaagatgcaaactttgttgggtatacatacaagaactttgaaattgtaaatgatgatgaagtggcaggaattgccgagttgaagaaaaagagttccaaaccaaagcggccaaccatcaagacattgtttgagagcatggacgaagaggagcctgttcacggaagttttttaggtatgttgcctccgaaggaggggcaaccttcgtcccactccagcattccaccagaaaaataccaacctcgacgtaaataggatatggaggttccaaaagtaaagcataggaaagtaaaaacaagaaaaaaaattcttctgctgccttttgatatgctccctgtctaagttttgtaaatcctaaccaatgcgttctttagtcaaatgcttaaaaaaaatctctccggccaaatagtgtatggcatttgatgtgagcacatcagtgttcgctgtatattgtgttaccgttctaacttcgaattgatgtttctcagccatattggcgactcctagtgtatactagatacaagggaccaggagcaa

SEQ ID NO: 7155 - DNA, 646 bp, Sorghum bicolor
  Clone ID: SORBI-28MAY03-CLUS69947_1
actgccagcggagaaagggaggtcgaccggccccgctgcccctgcccctgcccctgcccccaccgcagcgccaccgaagccgccagacaccaccaccccacatccgccagaagcctctccctccccccacctcatcggcgcgccgccaatggccgcgtggtgaagcgcacctgtgccgacggaagaagcaggctgcaggcaccaacagccaagcccccgcgctctgccctcgccgcggccgccctcccactgccacggaaggttgtggatcccggattcagacaggtgccaaccattcgatttgatttggggcggaggagtactttcctatggccgcctccatcgcggcctcgtccttcgttccagggtcgccggcgccggccccgcccgctcctaagagcggccttggggagcgcccagagagcctggacgtccgcggcgtggcggcgaagccgggagcctcgtcgaatgccgtgagggcgggcaagacgcgcgcccatgctgccgtccccaaggtgaacggtgggggcaagtctgcgctggcggatggggagcacgacaccgtaccttcctcggtgcccaagactttctacaaccagcttcctgactggagcatgctccttgcggccatcacgaccatcttctt

SEQ ID NO: 7156 - DNA, 637 bp, Sorghum bicolor
  Clone ID: SORBI-28MAY03-CLUS6978_1
tcctcctcttttttcccttggaatctgaaacagagactactaaaatgcatagggccttacctgcactagacattagtatgctacattgctacttgctatttacattgcactggtgaacttgatacaaatatgttggcctatccctagtagttcctacatgtaaacctagttcatgatgcacatccactacatctaacttaccagtggtctcagaataccatctatatcaatggtcgatgattcattagtatcactgcatgaggcttgtgctgtcaggctctgactctcacttgggttttgccagaagttcctgcgtacaccacttgagctgaggctatttgctgcaaggctgagatctgacagcaaaggctgcaaaggggtgctgccttcaagcaggcttacaacttttgacatctttggtctgagtgtaggtgctgcagttgtgcatagcagggcaacattcagcatgagccccgcttcttctctgaagtttgtggttccccgggctggttctaccgttgccagccgtgggctcctctctggtagttcgccagccccatcgaggagtgacacaacgtcttccttcggcctgcagtttgtattactttttccactgacaatttccaaaacaacaaca

SEQ ID NO: 7157 - DNA, 382 bp, Sorghum bicolor
  Clone ID: LIB3476-027-P1-K1-G7
atacgatggccagggcaaattccacaagagcacaacaactactctgaagtttgttgttagccaggcaaattatactgttgacaaccttaggaacctatctgatagtttgtcagctgcaaagaggattgacatagcaaattcctttttactgcctcctaatgtccaaagtcagataaatgaaatccaaggaaagctgaacacgtcagctactgatcttgctattaaaacaacagataatgccgcgaggataaaaaagttgctaaacagagtgcgccttgctttaattgtcattgcagcagtgatgcttcttctggcatttattggcttcttgttatccatctttggtctggaattcaatggctctggcttgggtgtattggat

SEQ ID NO: 7158 - DNA, 737 bp, Sorghum bicolor
  Clone ID: SORBI-28MAY03-CLUS70066_1
ctactggactcgatttttttcttcctccagtcctccgtcttatcaccgccaccggtgaggtgagacgagctccgccaccatggcctccgcctgcctctccctttgcttgcacttgcacgcctcctcgccctcgccctcgccctcgtactcgtctcccggatcccgccgatcctccctcgccttctcctcgtcctccaagtccaagagaacgctcaaggtcagggccaaggcgctcagggaggactggaggcagaaatccaagcacatccctcctggcgccgtctaccctgccaaggaccactgcagccgttgtgggctctgcgacacatactatgttgcgcatgtcaagaatgcctgcgccttcctgggagaaggcatgtcccgtgtcgaggatcttgagccacaagtccacgggagaggccggaaggaaggcatggatgaaatgtattttggagtctatgaccaactcttgtatgccaggaagaccgaacctgttcaaggagctcagtggactggaatagtgacaacaatcgcagttgagatgctgaaagcaaatctggttgatgctgtggtttgtgtacaaagtgatcctgacgacaggcttgctccaaggcctgttttggccaggacaccagatgaagtaattgcagccaaaggtgtgaagccaacattatcaccaaatctcaatacgcttgccttagtcgaggcagctggtgtaaagcggcttcttttctgcg

SEQ ID NO: 7159 - DNA, 949 bp, Sorghum bicolor
  Clone ID: SORBI-28MAY03-CLUS7007_1
gctggccgcacagagcctgatgattgtgacgattcaggaagcatcccggagtcgttctacacaaacggggggtttaagctgcgggtggtttggacaatcagctcgctgattgcagccgccgcgaggcattacttgctgcagcccatcattgctgatcacaggatgctcgagagcttggacctgacagatgctgatggccagggagtgctcaccatggacaagtgccaactgcaagagctgagggtgagaccaatatcaacatctaggggctcacaccggacgctcatgccagagcttagcatgtggttgtggtacgcaccatgtattgagctgcctggggggttagtgctgaatggcgcaacactggtggccatcaagccaagtgaggaaggaacaggggacacagtttggaatggggctgatggtgcagctttgggtgttggatgcattcgaggagccgtataggacagcggtgaggatgcttctcaagcggaggacctacagccttgagatgaattcattctaatctatggggagatggcattttggaagcttcagatgtgagaggatgttataactactgatgtggagaagtttctggatgtcttttatgcaccaatctgcgcctactttggatgtttcaagttatgtgctattgtatgccttttcttgttgagcatctgtcagcaagaacatggatgcaatcaaacagaaactgtgttaatttatgatgctggagttgaaaggcaaagccatagttgagttgatggtgtcctctgagatcagatgtggcatagatagtttttttcccttatatgtatgcacatcaaggtactaaccttatgtaatttctacttttggattgtggcattgtgctgcttgtttgcagaatagcatccaatgctctctgtacatcaatgtgtgtcaagagtggactcgtagatttgcc

SEQ ID NO: 7160 - DNA, 489 bp, Sorghum bicolor
  Clone ID: SORBI-28MAY03-CLUS70080_1
ctactggaagatcagatgcggcccccggccaccacccaccacgcgcgtccacgtacgaaggcaaggcaccagcccaaaacagggagagcaagcatagcagagcgccagagccaagaagaactcaagtcagctagctagacactctctgatccttgctggttcgttgatgcatggcttccttgttgcgttggaaggacaggtacgtgaaggagaggctgctaggcctctctggcctgtcctgctcctccgcggcgtccacctccgtcgtcgcctccactggccgcgccatcgaccgccactctccgcgccctcgtgactctcaccggcgtcttccgccatccctgcccaagccaccctgctctcctttcagtagtgccaaagattcctccacctccatgaagcagcagcagctttgccactacgacgacgatggcaaagacagaaggaagaagaagagcacagaagcagacgctggtagtggcaggggtt

SEQ ID NO: 7161 - DNA, 914 bp, Sorghum bicolor
  Clone ID: SORBI-28MAY03-CLUS7009_1
gcacgaggctccacttgtccagggtggtcttgatttcttgcttaacacaatgaatgatgcaaatagcccgcgaggagatactactgcttggactcttgggagggtatttgagctcttgcattctccagctggtgcaaacccaatcataaataattcaaaccttcctcgtatcatgtctgtgctgcttgagagtagtaaagattctccaaatgtggctgagaaagtctgtggagctatttattttcttgcccaaggatatgaagatgcagagtcaatgtcttctgtgctcacaccttatctacctaatatcattgctgctcttctttctgccgcggaccgtgctgataccacccatttcaggcttcgtgcttctgcttatgaagcactgaatgagattgtgagagtcagcaacatacctgaaacttcaggcatcataggccaattgttgcaggagatcatgagaagattaaaccttacatttgatctccatatactttcttctggtgataaggagaagcaaagcgatctgcaggctttgctatgtggtgttctgcaggtcatcatccagaagctgaatagcacagatgcaaagtccataatttctcagactgctgatcagctgatgatgctgtttttgcgtgtctttgcctgccacaattctactgttcatgaagaagcaatgcttgcaattggtgctcttgcatatgctactggtccagattttgttaaatacatgcctaacttcttcacatacctggaggctggcttgcagaattatgaagagtaccaagtgtgttccatctctgttggggtggtcggtgatatttgtcgtgccttggaagataaaatcttgcccttctgtgatcgcattatgactgttcttctaaaggatctatcaagctctatgctcaatc

SEQ ID NO: 7162 - DNA, 588 bp, Sorghum bicolor
  Clone ID: SORBI-28MAY03-CLUS71088_1
gcacgagggaccactttcgagtacccaacttcctcccaccaaatcttcaacatccacgcgagagttctcaacatgtcgtccgatcaagctgatgctgccaaggcggccgagggcgcgtctgggaagagcttgccttctcgccctgcgaagcagcccaaggagaaacagcccaaggataagtctgccaagggtggaaagtctgctggcctcgaacttcctgagacccccgagttcatccagcaccgactcgatctcttcgataagatcaaagcccgacaggacgccgaaatcgctgccaaacctcgtgaggaaatcaccatctcgcttcccaatggcaaagaggagaagggaacttcttgggagaccacccccggcgccatcgccaagggcatctccaagtctcttttcgagcgcactgtcatctccagagttgacggtgagttgtgggatctgacccgaccgctcgagaagagctgtaagctcgagctccttgactttgaacacaccgaaggcaagaaggtcttctggcactcttcagcccatattcttggagaggctgccgagaaacgctttggttgttatctatgc

SEQ ID NO: 7163 - DNA, 732 bp, Sorghum bicolor
  Clone ID: SORBI-28MAY03-CLUS71106_1
agtagtcgagaatttttttttttctatattccccgtgctgctgtctctctgcgccgtgcctcctcctttgctctcgtcctcgaccacggtccccgtcgccgccctgccgccgaccgcctcatctgccgccgggagccaaccctagcccagcgcgcccgcgtctctgcaggtatccactcgccgcccggcccgatctcctctccggacgcgggccggccatggggctgagtccgtgacggatgccagcgcctcgtggttacgcgcgccgaggccgtagagggcggcagcagcggaatccggtagccggaccgcgaaccacgtggtgtctggtgctgtagcagcagcagcagcagtcgcagcgacagcagcgggaggtgggggcggggccaagggatggacgagttcgacagcggcggccggagcggggacaggccgggcgccgccgcggccggaggcgacgacggggctgctccaccgttgccccatacggtacaaattgggaattcaccaacctatagacttgaaaggaagcttggaaagggaggatttggacaagtatatgttggtcgacgtatttcagctcctcgtctcagtgaccgtaaccctggttcaaatgctttagaggttgcactgaaatttgaacatcaaaccagcaaaggttgcaactatggagctccttatgagtggcaagtttacaacactctcagtggaaaccatggtgtcccacgagta

SEQ ID NO: 7164 - DNA, 666 bp, Sorghum bicolor
  Clone ID: SORBI-28MAY03-CLUS71471_1
caatggcgttgatggcagcagggggctgtgccggggcccggggccgtgcccggcccccctcgccggcgcctcccgccccgccgacttctgggccgtggccgcggcgccgcctcctccgccgccgccgctcgccggcatcatctggcgataggacgatccggatcggatcgattcattcatcaagccaagccagcatcgtcgtcgtcgtctcacagcagctgcatgcacacgcgtacctacgtttgggtttttctccacgccatgccgatcgatccatatccatcaagctaattaaagttgcatgcatgcatgccgtaaatatatacataccatgcaccaccattacactgtttcttttgttgcttgcttgcaagggtcgttgcattgggtcgctagctatagcttgttttcgctgatgaggtattcatcatgtacgcctaccaggctgtatacgtacgtatacgtataccaatgtacaccgtagtaatacgtatatgtattatattgagatggagtgatgcacatatcatcaggagccgtcattctgtcggagctgccagcagtgtttaggcagctaggctgattgctcttgatggtatgctgcgtccgtgtatgtatcccaacactactgctattgcatatatattatatatcctcttttttttt

SEQ ID NO: 7165 - DNA, 614 bp, Sorghum bicolor
  Clone ID: SORBI-28MAY03-CLUS70318_1
agccgcgcggccagagcggggggcggccggcaacaacgaacgaaacgggccaacgccaccaccacctcgtcctcggcacctcctccccctgtcgccgtcccgtccaccggtccagccgtccaggtccagcttcccccgcgatccagacgaccccgtccgcctcggcctgcgcctccccgctacaagagtccgcccgccgccagcgctgcggtcccagcgagcctcctccactctctgcggcgcggagatcctgtccctgtccttgtgccccggaccgagaggagccaggccgcggcgtttggaatttgacatggaggctgcggcggtcgtgggtttgggtactggcgcgggcgcgggcctgaccaggtggcaggcggcggcgctggcagcggtggccgggtgggtgtgtgcggcctccttcttcgacctcacgcgccggacgcgcgcgctcgtccagccgtgggtcacgcgccgggtgcacgccgagacggcggccatcctcaggttacagaggttgttggagcacaagttgttggacaatttcttctctgtgctgtcatgcgttgtctccgtgcccttctacacgggattcctccctcttctcttctggagtg

SEQ ID NO: 7166 - DNA, 753 bp, Sorghum bicolor
  Clone ID: SORBI-28MAY03-CLUS70317_1
gcccactcgcgcttcgggccccaacatgccattcctcttcttcttctgctcatgaaccaacccctccagagctacagtaccgttccaatccctattccccgtcccggctaccgttatgccgctaccgccagacccccgccgccgcgccgccgccgcctctgtctgtcgccccccacgtaccctcctcccctccccccccctccgcctcggcccgcgcacccgccgagagctcaccggccggccccgcggagtggtccgcgccgcgcccgaggggcccgaggagaccggcgaccaggtggacgagacagagcggcggagggggccggtgccggacccccgggatggcccggcccccccccccggccccgcctcccgggcgctccagacccggctgccccgaccccccgattacttcatcagagtccacccacaggtcgtggcgggccaacctctcgtcccctgggggcgcgaagtcgactcaaccccacactggggagaggacacctacgatgaattcgccgatccacccgtggcaggtccccccccgctcctgcgcttcgccgacgacaagcgccacgccaaccacccgttcaggctgttccgccttactgtgaagaccttgaaatcagccattgaatcgatcagagggaagcaaaatgtaatggatcaagatcctgagggcaagtacgaagctttggagaagtatggaaaggatctgacagctatggcacgtcaagggaagcttgatccagt

SEQ ID NO: 7167 - DNA, 713 bp, Sorghum bicolor
  Clone ID: SORBI-28MAY03-CLUS70341_1
cctactgggactcttcctcccctttgcttccccagaccgctctgccgcgacaatctcgcgccccgtcccgcttccgctgccgcttgcccgcttcctcgtcgccgccatcttgctctggtccccgtggcagcggccgctgctccaagtaggagccgagtgattctctggccgaagatccaggctgagtcggcgtcgccggcagcagaggcgggagactccgccatcatgtcgttggactcggaggcctcctcgcagggcggggactaccgtagcttccgccagatcactcgagatcgtttattatttgaaatgctcagatcaactaggaagaattcgaaatcaacatggaaggtccttatcatggataagtttacagtcaagattatgtcttatgcatgcaagatggcagatatcacagaagaaggggtttcattggtcgaagacttatataaacgaaggcagccattgccttcactggatgccatatatttcatccaaccaactaaagaaaacattgtcatgttcctatctgacatgtcaggaagaagccctttgtacaagaaggcatatgtgtttttcagttctcccgtgcataaagaattggttgctcaaataaaaaaggattcaagtgtactacctcgtattgctgcacttagtgagatgaatttggagtactttgctattgattcccagggtttcacaactgaccatgt

SEQ ID NO: 7168 - DNA, 711 bp, Sorghum bicolor
  Clone ID: SORBI-28MAY03-CLUS70386_1
cgtcatccggttcgtcgccaacaatccagggatgtggttctttcactgccacctggacccgcacgtgcccatgggcctgggcatggtgttccaggtggagagcgggacgacgcccggctcgacgctccctacgccgccgggggattgggtgggagtatgcgacgcgcagcactacgcggccgcggcggcggtagcggcagcgccggtgccagtccctgccccggcccaagccccaacactagcgccggcaccagcagaatcgccacggacggcgggatcgccgcggcaatctccgcgcgcggtggaccacaaaccgtcgcccaaccttcctcagcacaaggagcacacgggtacctccggctcctccaattccgctgcaggacctggacggagatcaaccgggaacctcgcttgtttcttgtgttatgttcttcttctctttgttcttcatgaacacatggcctagttcatgtgaagcttaggcgtgatagtgatacccactcaaaatatacagttttgttcgttcgtgtaagtaaatgtgataattgtttttcgtttttcattgtttatacatgtgtatatggatttatatcctgatgtgattgtgtgacctttcccctcacctccataggggaagttgtgcatagcaaagttcaggcttcagattgattgactgtgtattcctgacacaagcataaacgtactgaagtt

SEQ ID NO: 7169 - DNA, 600 bp, Sorghum bicolor
  Clone ID: SORBI-28MAY03-CLUS70529_1
gcacgcggtcagcacaagtattccagataagcacggtccgtccgaggagaatggctccaccgatatccgccgatgccttggtggtggaggctgcctcggccatcgccgcgtccccagccatcgcgccgaacggaatggtttcccgcaaggacgtggcggcggcggcggcgccggccatctctgtcgtctcgaagcagacggttcggcctgccgcgggcgcgtcggcgccggtcgtcggaggagacctcaggctctcggtgtccgacatgccgatgctatcgtgccactacatccagaaggggctgttcttcccgcctccgcctcccagcgtgctcacgacgacggcctcgctggtgtcgtcgctcgtgacggcgctctcccgcgcgctcggcgtcttcccggcgctcgccggccgcctcgtcacgctccacgacgacagcatcgtgatacggtgcggcggcggaggcgacgacgcggacgcggccgtcgagttctaccacgccgtcgcgccgtccctgtcgcttggcgacttcctagtgcccggcgccgacgtgccgacgagtctcacgaatgcgctgttccccatggaccggacggtga

SEQ ID NO: 7170 - DNA, 743 bp, Sorghum bicolor
  Clone ID: SORBI-28MAY03-CLUS7069_1
gcacgagggtagtcccccgcaagactctacaatctcacttacgaagtgaaggtgatacagaagaagatgatgatcctgttggtccagttgacagcaatggatcagctgaagatgaagcaaatctaactcaaatgcgtgctagctctaattttcaaaatatccgggataaatgcgcgtgccaaaggggaaatagaaacaaagacacaaaagctaggacagctgatgttgaagataggggtgaacccagtacaaaagactccactgctgcaaccatgaacattcctggagaaggccctttcataaataataaaacaaattggttagcaatacagaggcaattgacacacttggagagacagcaaactagtctcatgaacatgttgcaggatttcatgggaggatctcatgacagtatggttactttagagaacagagtacgcggtcttgagagagttgttgaggaaatggctagggaaatatcactctcgtcaggcaggagaggtggtggtccagcgctgggctttgattcgtctcctggcagatcatctaaatacaatggctttcatgaatattctaattccgaatttggaaggggtggtgatggacggatgggatttgcagaaaggtatttctctgcagatggtatggcttctggcacgaaaaacccatcttggagaccaaattctgaaccatgggactcatatgcttattctggttcaagaagcggtatgaatgcaaggaga

SEQ ID NO: 7171 - DNA, 698 bp, Sorghum bicolor
  Clone ID: SORBI-28MAY03-CLUS71348_1
tactggatgcgattaacgcggcggcagggcagggcaggcgcagccatggagaaggaagagccggcggcggcagagcttgagatccccggcgagtgccagtacgcgggggatcccgtggtggtgcggccgagccagccgacgccgcgccacaccctgcacctctccaacctcgacgaccagcggttcctccgtttctccatcaagtacctctacgtgttcgcgtcccacgccgccgtgtccgccgacgcgctgcgggcggcgctgggaagggtgctcgtcgactactacccgctcgccggccggctccggcccagcgacgaggaggaagggaagctcgtcgtggactgcaatgccgagggggcgctcttcgccgagggacgcctcccggggctcaccgccgccgacttcctccgcggccgcggcggcgccacgccgcacaagtcctggaggaagctgcactacagggtggaggcgcagagcttcgtcgccgtgccacctctcgtcgtccaggtcacttggctcggctgcggcggcatggtcctctgcaccgccatcaaccactgcctctgcgacggcatcggcaccgcgcagttcctccacgcctgggcgcgcgccgtgcgcggcggcccgcgtgcacccgcccccggcgccgccgccgccgcggcatcagcggcgccgtagtcggcaacggcaacggc

SEQ ID NO: 7172 - DNA, 993 bp, Sorghum bicolor
  Clone ID: SORBI-28MAY03-CLUS7141_1
gccaatttcaagtgccgacgattgggtggcattgagaaggcatttcaagaggtaaaggccagaggttacaatcctgacctcgtcatattcaactccatgctttcaatgtatgcaaaaaacgggatgtacagcaaggtcaccgagatcttcgattcaatcaagcagagcgggctaagccccgacctcatcacttacaatagcttgatggacatgtacgcaaagtgtagtgaatcgtgggaggctgagaagatactgaatcagctcaaaagctctcaggtgaagcctgacgttgtgtcctataacacggtcataaacggattctgcaagcaagggctgatcaaagaagctcagaggatcctctccgagatgatcgctgacggcatggctccctgtgttgtaacctatcacacactcgttgggggatacgccagcctggagatgttcagcgaagctagagaggttatcaactacatgattcagcacaacctgaagcccatggagctgacctacaggagagtagtcgatagttactgcaaagcgaagcgatttgaggaggctcgcagcttcctgtctgaggtttcagaaactgacccgaattttgataagaaagtgctgcatacgctcgcagcctatatagaggatgcacagtttggaaggtaggctgcctgtgctaaaaggtggactaggtacagtttggaaggtttctttggttacatacaggcaaggcaactggcagtttgcaatttgcatggtacgtatatgctcaagttttgataggcaaggttactaataatcttgaagagcccgcgcttgtcaaagacggcgataatattgcaccttgcaaatggtgctgtatgttgtcaaaatagtcgcatttttcaaccgttgtatagtatacctatagccacattctgctgtgcatactttagattgcaacaacctgaaagcctgaagggcacctgatatgtatgatgtatcattcgatttcttctg

SEQ ID NO: 7173 - DNA, 648 bp, Sorghum bicolor
  Clone ID: SORBI-28MAY03-CLUS71449_1
tagaatcccgaacttcatagctgtgaatttctacatgcgaagcgatggtggtggtgtttttgatgttcaagacagaatcaatggccgcaccttatgtggttgtgacaccattgctgcttgccaggctggggcaccaatgggtgcatgcaaggacactggggcaccaaatcagactacatcgtcctcttcctctgtaaatggaaatgtctattcaggaactatagaattcaagacacattccactagtgctgccagcaatacctccatccggagaagtcttgtttttctgctaaggctgcagatgacttcactgcttttcttatctttcagggtttagtttttatatttcgacttttttttgttgttgttgttgtgagctttcttctgtattgggatggcggctagtgccttgctagctttataatctatataatatatagttgagaaggggagtagactaaggttggatcaatgttaatgcaagaatgagtagagatgttactctgctctcccgggagtagtagtacgaatacaaagaaactgatgagtggatgttcatgctggtccgtgtcatatgcaaatgttttactcactccatcccaaattgagagggggagtacacttaagaaagaaaaagggtatgatcaa

SEQ ID NO: 7174 - DNA, 603 bp, Sorghum bicolor
  Clone ID: SORBI-28MAY03-CLUS71461_1
agttcaccagtgcggccgcgcccacctcctgcgcacgcgcggccccggcaagcccccgcaccctcctccggccttcccgccggagtacggctcccacttcaggacccaacagctctctgacacctccagccggagcgattacagcgcgttctccacttctgccgccacagcgagaagctcgaacgcgacaaagcactccaggctgtgggatgaaaacgggccagacaagcgtaacacattctgagaaagagctcatggaaactagcacgccatgttcacttagcctgtaagatgtttctcagggaagaggtattgtccaaagtgaagcgagtgaagtacagcaaataaatgagtaaatgacgatgttgccgaaatcattggaacatcgagcggtagacatatatgactgaaagaccggtagtacagcaatgcctactaaagttttgtgagattttctatagcttttgttatctgaatgtaaaagttaatttgtgtgactcaagtattgtaaattctccatcacgtcttacactatgagactagtgtgcagttatcctaatgcaacaccataatgctagtattttccttattaagctgctgaca

SEQ ID NO: 7175 - DNA, 667 bp, Sorghum bicolor
  Clone ID: SORBI-28MAY03-CLUS70801_1
actgacacagcacacaactcgatcagttcctcttggctagctactaggctagctagctagtttctccttcctctccaacccccctttttcatctcatctctctctctctctctcgcatctcctattgatgtttattttctctggtctcacaacttgagagagacttgtgaaaagaaactgaaatagagagagatagagagcaggctgagagagatcatgtcgatgagcttcttgagcatggtggaggcggagctgccaccggggttccggttccacccgagggacgacgagctcatctgcgactacctggcgcccaagctcggcggcaaggtcggcttctccggccgccggccacccatggtcgacgtcgatctcaacaaggtcgagccatgggatctccccgtggcggcatcagtggggccacgggagtggtacttcttcagcctcaaggaccggaagtacgcgacggggcagcggacgaaccgggcgacggtgtcgggctattggaaggcgacggggaaggaccgggtggtggcgcggcgaggggcgctggtggggatgaggaagacactggtgttctaccaggggagggcgcccaagggcaggaagaccgagtgggtgatgcatgagtacaggatggagcctgctcttgacccatcctcatcct

SEQ ID NO: 7176 - DNA, 646 bp, Sorghum bicolor
  Clone ID: SORBI-28MAY03-CLUS70768_1
gagcaacagcgagctgccacgcaccgaccatcacgcagcggcgcgcgatcgaccgagctcatccagcctccagcaaagatggtgaacttcatcgaggcgcagaagccgctgctgtcacggctgatgaagatggccgggctccgccccatcgaggtggagctggagcctggcacgaccatgcacgtgtgggcgcccaagcaccacgtcggcaagaagggcaccaccatcagcccgctcgagcctaccgccgccgccgccgacgccgacgccaagaagaagaagaagacgacgacgaagaagaggagcccggagtcgaggcccaacgtggtgctgatccacggcttcgccgccgagggcaacgtgacgtggcagttcaacttcggcgtgctggtgtcgcgctacaacctgtacatcccggacctgatgttcttcggcaagtccacgacgtcgagcgcggaccggtccccggacttccaggcggcgtgcgtggccggggcgctggcgcggctgggcgtggcgcactgcgacgtcgtcggcttcagctacggcggcatggtggcgttcaagctggccgaggcgcggccggacctggtgaggtcgctgtgcgtgtccgggtccgtggtggccatgacggacgccgtgaaca

SEQ ID NO: 7177 - DNA, 591 bp, Sorghum bicolor
  Clone ID: SORBI-28MAY03-CLUS70838_1
cgattctaagtcccgtatgttggatccccgagttgttggtcaagagcactacgacgtcgccacccgtgtccagcagatcctccaggagtacaagtctcttcaggatattattgccattctgggtatggatgagttgtctgaggccgacaagcttactgtcgagcgtgcccgtaagatccagcgtttcctgagccagcctttcactgtcgcccaggttttcactggtatcgagggtaagctcgttgaccttaaggagaccatcaactccttcaaggccatccttaacggtgaaggtgacaaccttcctgagggtgccttctacatggttggtgacttcgcctccgccaaggccaagggtgagaagattcttgctgagcttgagggtcagtaaggggtttaagtattgaagttaatgccgcgggagacgggaggagagaaataaaggacctgtgtatagagaagaggaacaaaggtcccgggaggtttctcataagctccaccgagtctcttttgtgagctgtgtactaagaaatcaacaaaattcctcttgtagccatatcaagctttcttttttaccaaatgtgaaccatt

SEQ ID NO: 7178 - DNA, 698 bp, Sorghum bicolor
  Clone ID: SORBI-28MAY03-CLUS70845_1
atatttgataaaatattttctgcataccatgatgctcggagctgcatccgcaatgacctggcttctgctggcaatgctgaggatataagagatgacctgaatggtcttgacaaggctgttagtgctgttctaggattgaggactatagaacgtaatcagttacttgttagcattgctaaaagtaaattcacaaagcatcgagatgagaaaaatgagcgaatcacaaagccagaagagcttgttcgactatatgatctgcttattcagaatgcaacagacttgacagatttagttagctctggaagaaacaaaaatgaagaagaaggcatttgccctcttaaattttggtgcactatcctgatcgttcgatttgcttggtgcatgaaccagtgtaaaatgagaatgtcctcatagtaccttcgatgggtgagttttttttcagtttcccgcccaagagattgtttgtcagaaggatcatttagccgttgcaaagtacatctcgctcggtgactgatcagcataactttggtgtcattaaattttgagcaatgcctgagatagctcggattgtggaatgttaagttgtttcgtttccatatccaagtaggcagggaacaataaggaaaatctcttcctggtggttttgccttgctgctcaagtatcttctggatatgctagagagctatgagtcagcgat

SEQ ID NO: 7179 - DNA, 672 bp, Sorghum bicolor
  Clone ID: SORBI-28MAY03-CLUS7108_1
ctccctccagcgcggcggctgcctcgcggctcaaaactgcagggaccaccactccagcgaaagcagggtcaggctcaggcgcaacgcaacaaaaacaacacaaggcgacggcgatgagctctgcggcggcgatgacgggggcggggaaggtggtgtgcgtcaccggcgcatcagggtacatcgcgtcctggatcgtcaggctgctcctcgaccgcggctacaccgtccgcgccaccgtgcgggacaccgctgacccaaagaaaacattgcacctgactgctctggatggagccaaggataggctgcacttatttaaagctagcctgctagaagagggctcttttgacgctgcagttcatggatgtgacaccgtattccatactgcctctcccttttatcacaatgtcaaggatcctaaggctgagttacttgacccagcagttaagggaacactcaatgttcttggttcatgcaagaaagcttctattacaaaagtggttataacatcctctatggctgctgtttcctacaacgagaagccaaggactcctgaggtcacagttgacgagacatggtttactgatccacaaatttgtgaaaagactcagcaatggtatgttttgtccaagacactcgcagagcaggctgcttggaagttttcaagggataatg

SEQ ID NO: 7180 - DNA, 530 bp, Sorghum bicolor
  Clone ID: SORBI-28MAY03-CLUS71031_1
cagcccgcgacaggtcttggttgtgcctgtcatgcctgctgccaacgactacgccaaggaggttcagcagatcttccgagccaaggggctctatagtgatgtggacctgagcagcaacactttccagaagaagatccgcaccggtcagctggagcagtacaactttatctttgttgtcggtgccgaggaggccagttcacgcaccctcaacatccgtaaccgagacgaccaagccacccaggcaaagggtgagctggttcctattgacgaagctcttgagaagatggttcagctcaagtcttcgcgaggacttgtgaacaagctatagagggatgtgataggtttgctatgacactggaaggggcggcgcgtacagagggtgagattaaaagcagagggtatatgaattcacagtcaaccatatgagacatgttagatgatgacaggcacgggaactcgcatggagagatagagtcaagaacagaaacagatatccaagtagcggtcaatggggaaaagaacgcttcttg

SEQ ID NO: 7181 - DNA, 623 bp, Sorghum bicolor
  Clone ID: SORBI-28MAY03-CLUS7094_1
gcggacgggttcgccatggggtccgagggatcctcgggtccggttgtcgttcccagaaactttaggctgctagaagaactagaacgtggtgagaagggcattggtgatggtactgtgagctatgggatggatgatgctgatgacatatatatgcggtcctggacaggaactatcattggtcctcccaacactgttcacgagggacgaatctatcaattaaagctattttgtgatacggattatccagataaaccaccgactgttcgattccagactcggatcaatatgacatgtgtgaaccaagaaactggattggttgatccaagtctatttcctatgcttggaaactgggaaagggaacatacaatggaggacatcctggttagcttaaaaagggaaatgtcaactcctcagaatcgcaggctgtaccaacctcatgaaggtaatgaggatcaaagagtagagcagaaagggctgtctgttagatgtgtcatcatgtaatctatgtgcattgcaatgtacagcattgaattgagtagcgagatgccaaggtgagagagcctctcaggaaatcctgtaattcaccttgatcatgccaccatcacaataaagtgtcgatgact

SEQ ID NO: 7182 - DNA, 587 bp, Sorghum bicolor
  Clone ID: SORBI-28MAY03-CLUS71068_1
aacgagcggatgcacctcatgacgttcctggaggtcacgcagcccaagtggtgggagcgcgcgctcgtgctcgccacgcagggcgtcttcttcaacgcctacttcgtcggctaccttctctctcccaagttcgcgcaccgcgtcgtcggctacctcgaggaggaggccgtgtactcctacaccgagtacctcaaggacctcgaggctggcatcatagagaacacgccggcgcccgccatcgccatcgactactggcgcctccccgccgacgccaagctcaaggacgtcgtcaccgtcgtgcgcgccgacgaggcgcaccaccgtgatgtcaaccacttcgcgtcggacatccattaccaagggatgaagctcagggacacgcctgcgccgctcggttatcactaacaagtcgacgtggcctgctgctcagttcagcatttttacacaattattaccctatcgttaatcttatacgttgtgctagccaaagttgctcagcagatcgatcaggacgggtttgctactcggagtagcttgtatactttgtacatatactattaaagatattttaaataacaatacatgag

SEQ ID NO: 7183 - DNA, 1255 bp, Sorghum bicolor
  Clone ID: SORBI-28MAY03-CLUS71591_1
gtgcgccattggttcgcctccgccgtcccccccccccctccccacccgctgcctctcgccccgcgtccgcgactgcccccccgcctccccccgccgctcgccccgcaatcgccgcaggtcctccgggctggccccccccgcgccgccctgcgcgccccgcgcggtggcccgcgccgcgcccccgtcctccccgccgcgcctccccccccccgtccccccgctagcgcggtggggcccccggccgcccgcctccgccgtcaccctggtggggccggtgcggccccggccccccctccccctcccccccgccccgcccgccccaccccggcctccccccgccatgggcgccgtccgccccccccgcgcccgccggcacccgcatctgctcgacgcgccccggctcgtcccgccccccggcgcctccccccccccggccgcacctgcctccccccgcggcgggctccgtcccccctcctccccctcggcccctcctgcctcttcgcttcgccctctctctgcaacagcctgccgtcccctccctccgtgcgcgccggccccccctccccgtcggcgtgcgccgctgctgctgcgccacctgggctcggcttgcactttggatattgctgctgatgactactcatcacaaccctacttctatcatggcaataagaaaaattttacacatgcagtgcaggccgtcaaagcactttgcattgtcgtctctctacaacagattgtcaatttcaccaactgtaatctgcggagcctgcaactgatcgacgatagccgctagtgcttggttaagtggtcactgttccaatttctttctctttcttcagagcagataagccaattgtgtgtatgtgaattgcaggttacagagaacaacattgtggatatgtttagttcagcaggatttgtctgaatgtgtcagttccgcataagtctaatgaggggaacaacattcattacccaaactgcaagcttgtacatagcagcggcaaggccaccaaaatcagcactctatccatgacatttctggaattgatgacaaagttatcacagtggttttccatgaagggagcactgagtttacagccatcatggctgatgttgggactgctaacaacagtgtgcctgttcagctgccaacagaagtaagccagctcttgtcgtccgtgtatttggggcttcccgagagggaaagccatatgtaatcctgtctgtaaatatagagtgagtccttcctgtgttc

SEQ ID NO: 7184 - DNA, 994 bp, Sorghum bicolor
  Clone ID: SORBI-28MAY03-CLUS71623_1
gcacgaggtcccgacgccgctgctcccgaggcccagcagcagagcgctcgccgtcgcgccctgcagctccgcgtcctccgcctcctcctcctcggcgtcgccgtccacttcctcggctcctcctcgccacgccgccgcgggcaggagagggctgctggcgctgggcgcggggttcctggcctcggccgcgctgctgatcccggcgggggacgccggcgccacgcgcgtcgagtactacgcgacggtcggggacaagctgtgcgacctgagcctcgtcaagtccggcctcgcgtactgcgacgtcgaggttggcaccggtgtccagcccccgcgcggcgagctcatcaatgtgcactacactgcaagatttcctgacggcacactgttcgacagcagctacaagcgcggcaggccactgacaatgcgcataggcgcaggcaagatcctccgagggcttgaacaggggatcagtggcggcggcggtgtgccacccatgcttgttggtggaaagcgcaagctgatgatacctgcgtcactggggtacgggcctgaaccagcaggctgcttctcaggagactgcaacattcccggaaacgccacacttctatatgatctttacctcgttgggatttacaagtgagcactcgatggcaaaggaatattcaggacctagaacaaataagatagcatttctttcctggaacacgtggagagtttcaggggcaagtttatccggcagaagattggtggtcaaagcacctgcggtgccacttgcagaagcttgtgcataggactactgttcattatacatactcgattggcagtgctccaggcctatttctgtattccatggattgcagaaaaacggtacgcgggcgacttgcattgaataaaagaatgatataaaccatcgttatagctcataacatgatagtgccattgtggaactttgtaaagaccaatcatattgttcattatagcagtttgtacagcc

SEQ ID NO: 7185 - DNA, 681 bp, Sorghum bicolor
  Clone ID: SORBI-28MAY03-CLUS71665_1
aacctggtcctctcctctcccattctccctccctcccctccccgccgcccgcctttcagtttttggatgccacggaggcctgccgccagtgccagcagcagcagcagcagcagcagcaggccaccaccgccatacatacgcgcacgaagatgccggtgaagcggtcggcgtccgtggcggcgctgctcccgccggtcgtcggccgccgcgcgcgggcccgcctctgcgtccgcctcgccgcgccgctcaccttcctgctcctcttcgtggcgctgttccgcacccagtcgctcctgggcgtcccgcccgccgctccgccgccctccgcggggcccgccaaggtcgccttcctcttcctcgtccgcgcgggggtgccgctcgacttcctctgggacgccttcttccgcaacggcgaggaggggaggttctcggtgtacgtgcactccgcgccggggttccagctcgaccgcaccaccacgggatcgccatacttctacgggcgtcaacttgcgaggagcgtcaaggtggtgtggggcgaggccaccatggtcgaggcagagaggatgttgtttgccgccgcgcttcaggatcccgcgaaccagcgctttgttttgctctctgatagctgtgttcctctctacaatttcagctccatatatacttacttgatggcctcaccta

SEQ ID NO: 7186 - DNA, 549 bp, Sorghum bicolor
  Clone ID: SORBI-28MAY03-CLUS71632_1
cgtcaagagctgcacgcggtggctcggcgacaccatcaaccacagccgcctcgactacttctactggctgctggccgtgctcggcgttgtcaacctcgtcgcatacctcgtctgcgccatgtgggcaacagcaccggccagcaggcaggcggagcagccgcagtccgccatggccgccgacgagaaatgctagcaattaagtttcactaccgatcgatcgacctctgttgcacttgcacccatcacttgatacgcctaccaatttagaggattttatagttttgagtggtgcagtttccatgtgattttcctacatgttaaaaccatgttcacctatgcctattgaaaaaaataagaaaaccatttaaatttaagaggtagacatagctggccggccgcagtgtggtgtttaggtcgctagtcgaagtttcttgtttcttggctagtcactcatgtaaaagcatgccctaatgggcttgtaggagccttcttcgactcctgtcaacttattatatcatgttcaagaaaataacaggtcttctaattgcg

SEQ ID NO: 7187 - DNA, 739 bp, Sorghum bicolor
  Clone ID: SORBI-28MAY03-CLUS71214_1
ctgttggcctctatagttaattagccaatagccagtggcctgtgacccgcctgcagcagctctgctcatcagtcatcactagctcgtcttcgccttcctatcagggtgtgtagtgtgtgtgtgagagagagccatggcgacgcagcggctcgtggcggcgctggtggcctgcctcctggtgctggcgccgctgccggtgcgcgggcgcaacatcacggccatcctgcaggggtacaaggagtacaagctgtacaaccagtacctatcggagacgaaggtgtgcgacgagatcaactcgcggcagtcgacgtcgatgaccatcctggtgctctccaacgacgccatgacgacgctggccaaggacgccggggactcgctccccgccatcaagaacgcgctgcgcctccactcggtgctcgactactacgaccgcaagaaggtgaagaagtacggcgacgagagcgccgccacgctgtaccaggccacgggcgacgccgcggagaccacgggcaacgtcaaggtggtggaccaggaggacaagaactacggcttctcggcggccaccgcgggcgccaggatctgcaccgtcaccaaggaagtggagacgcacccgttcaagttcgccatcctcgaggtcacggcgcccatcgagttcgacggcctcttcgacgtcccttccaccgccaacctcacccgcctcctggagcgcgccggctgcaaggtgttcgcgtcgctggcc

SEQ ID NO: 7188 - DNA, 656 bp, Sorghum bicolor
  Clone ID: SORBI-28MAY03-CLUS71226_1
cgcgccctccccccgccgcgcgacccccaccacccccgtgcagcgccgcgcggccttcgacgccgcgcccgtgacccaaccagccgcctctccctctccctctctccacccgggtctccacgccgccgccgccgcgcatccgctcctccctgcccctctcggcggccggcagggcgggtgaggtcgcactcacgagatggaaagcaataatccatcacattctcagattgctgaagtgaagatggacatctcagcatcagcttctggagcagcagggtacaaattctgcaaaggtgctgcctgtgatttctctgattccagcaactcctcgaaagatgccaaggagagatccgcgtccatgaggaagcttataattgcagtgatcctttgcatcatattcatgacggtggaagtggttgggggcatcaaagcaaacagtcttgccatcttaactgatgcagcacatcttctttctgatgtggcagcatttgccatatcattattctctctctgggctgctggatgggaagcaacaccgcagcagtcttatgggttctttcgaattgagatccttggtgccttggtctccattcagctcatatggctacttgctggcatcctcgtatatgaggctattgtaaggctcattaatgaga

SEQ ID NO: 7189 - DNA, 648 bp, Sorghum bicolor
  Clone ID: SORBI-28MAY03-CLUS71246_1
ttgaggagtctgacatgcgtgcgaggcatcgcacgcacacacacacgcagcagcgccgcgcagctcctcgcgaacactcgctcgcccgccgccggctgcctgccgcacgccgccgccgcagcttgcccccgcccgtgcgcggatctcggcactcggaccgcgcagcgcggccttcgtcctcccagtcgtgggtccccgcctcccctgctcgcccgcccccacggccgccccaagggagcctggacgtcgcgcctgcgcccccatcaccccctccccggcggcagcgcctgcgcagatctatgcgggtcgtgcagggtctgctgccctcctgtccgcaacggaggcagcacggcaacgattggctccacaagctgaggatctcctttctctcctctttttatttgttcattctaatatttgcttaactcatggagtgaatcacccttaatttcataagactagatctaattcctgactttttcaatagctaccagttcatagttttggagcttcactttattttcacatgctagattggtcttttggagcttcactttattttcacatgctagattggtcttggcctggttgcaatcgatggtatttctctgcaatagtataaggctgcaagcagaatgatatgctgaa

SEQ ID NO: 7190 - DNA, 579 bp, Sorghum bicolor
  Clone ID: SORBI-28MAY03-CLUS71285_1
gtccatgaacagctgtgtgcgatgcttgagaagtctgagagggagcttttgggtcataataatcagtatcttccaaagattgtgtctgtttttgcagagatattatgtgcgggcaaagatctagcaacagaacagactgccagcaggatgattaatctactaaggcaacttcaggcaacattgcctccttcagtattagcctcgacatggtcttctttgcaaccacagcaacagcttgctctacagtccgtgctgtcgtcatagctaaccaaataacctcaacggtgtaaagcatatgatagtcttcacagcttgaccttttgtgttgtatttttgtacttctgagccagggttcctggggtttgcttggcattcatgtgcccttaggttttgcacaaggggcgcttgcatccggtgtgtatatcggctgcagttgcagaactgcacggatgtgtacgagactgggctctctccacatcgtcgatgaagttgtaaagctatataccttgttcacttagtagttttagttgggttgaaagagttgtaaattaaaacaattttgatagttgatttattgtc

SEQ ID NO: 7191 - DNA, 943 bp, Sorghum bicolor
  Clone ID: SORBI-28MAY03-CLUS71300_1
gcacgagggtgggtttagcggttctagagccgtcaatgattggtgaaccggcggatccgtttgcaactcctttggaaatattacccgagtggtacttctttcccgtatttcaaatactccgtacagtacccaataagttattgggcgttctcttaatggtttctgtgccaacgggcttattgacagtaccctttctagagaatgtcaataaattccaaaatccatttcgtcgcccagtagctacgaccgtttttttaatcggtactgtagtagctctttggttaggtattggagcaacattacccattgataaatccttaactttaggtcttttttagtttagggatttttcgagttgattcattccaccgcgaagtcccctgcatgggtatctaggaaatagttacttccaagtgaatcttccctagatacctaaaatctattttattatgatccatttcgcgctcgacacgctctactacgccgagtacaacaacagcgggccgggcgccgacaccagccgccgggtggcgtggccgggcttccacgtgctcggcgacatcaccgacgccggcaacttcaccgtcacaagcatggtgctaggcgaaaactggctgccgcagactggcgtgccattcaccagcggcttaatttcttgaagcaagcgcgtgctataaccaaagcttcacaatattactagtaatagccagtactcctatatatgtgtgtgcttctgcagtaataattttagttcagttaatcgtcataaggggaacgtgaaattaatgtagcagggagacgaaatcgatcagggaagaaatgtacaagtacaacacgccctcgctgtagtaccactgttaccagccccatatatatcaactcgatcatgaacaatgtgcatgtaccaatcgtacgagacctaatcgtactacaattcgtgcgt

SEQ ID NO: 7192 - DNA, 796 bp, Sorghum bicolor
  Clone ID: SORBI-28MAY03-CLUS7133_1
actagttctagatcgcgatctagaactagtacccgctcgccaactacacgttcggcaccaaggagcccaagatggagaaggacacctccgtcgccgaccgcctcgcccgtatgaaggtcaactacatgaaagaaggaatgcgcacaagtgttgaagcaatcctattggtgcaagagcacaaccaccctcacatactgctcctgcaaattggaaatacattttgcaaacttcctggtggacggttgaagcctggagaaaatgaaattgagggtttgaaaagaaagttgtgcagcaaacttgctgtgaactcgccttcctttccacctaactggcagattggagagtgtgttgctgtgtggtggagaccgaactttgagactgtgatgtatccttactgccctccacatatcaccaagcccaaggaatgcaagaaacttttcattgttcacctgtccgaaagagagtattttgctgttccaaggaatttgaaactgcttgctgtcccactgtttgaactctacgacaatgttcagcgatatgggcctgtcatctccaccatcccgcagcagctttctaggtttcagttcaacatggtgagctcttagggtgatgacatgacagcttatgtggccaaggcagctcttctggtgacctctgttgagaacttgagatggatcattgacatgctgagctagctgatgaacgtaccctgactgattttatttaattgtgctggatttttttttaatctagattactactatctagacattggttttctggattggatttttgg

SEQ ID NO: 7193 - DNA, 664 bp, Sorghum bicolor
  Clone ID: SORBI-28MAY03-CLUS72242_1
aggagcgggatggagttcgagccggtggggattatgcccggcggcgagatgcggatcgtgcgggagagccccacctcggcgtacgtccggttcaaggctggcagtgtggagccagcgcaccaccacacctttggccacgacctggtggtcatcaagggcaagaagaaggtctggaacctcaccaagaaggagagctacgacctggtggatggagatttcctcttcacccctgccggggatgtgcacagggtcaagtacttcgaagacacagagttcttcatccgttgggatggccactgggacatctttctcgatgaggatcttgacactgcacacaatgccattgacgcggagcttgcagctgccagcaagtgaggtcatggcatctatgcgtggtgatgggaatgcttctgaaggtgctatatatgctcacatatcatcttttgtgattgatggtcttgcttccataatgtttgttgtcgaacttggtgcgtctttgatccttatcgtcttgtcttgtgattttgtggcattacatggttataatggcaacgatgatagcaaactatacaatttggttactgaatcaaattgcatatacatggaggttgttgctcaatgttcttggaactaattcatgttaatggtacctccattttatccc

SEQ ID NO: 7194 - DNA, 609 bp, Sorghum bicolor
  Clone ID: SORBI-28MAY03-CLUS72250_1
atttacccccatactatcactactttccacaaaagacataccaccatttcccacgagaggtatggattcataatgttggcctaggaagcctcatcatatattcgatcgaggaaatttgtgatgattctggagaagacccgacttgtagcaggtctgtgagtggaaacagcgtgcatgaccatatacactatcttggcatcagcatgcatgccgagtcatggggacattgcagaatcgtcacggacaatagaaccctgccacagcagtataagatggatcctgatggcaatataatcttgtcgaagcagcctggcttatcagtgaatgaactacacagtgcacaatgaaaaactcaagatgacatgaataattttcttgtatgatccttctttgatgaactcaaaggggatatattaggatgaacaaccttggtgattgttctgttgggtcacgtaaaaaatactgacagcaatcttcattctatactatagtgtacttgttagttcttataggatgtatgtacatatttctatatgttagttctcaactttccaaaccttagcatctgctatctgtatatgatgttgcaataaaatcaaacttttgtac

SEQ ID NO: 7195 - DNA, 1227 bp, Sorghum bicolor
  unsure (1)..(1227): unsure at all n locations
  Clone ID: SORBI-28MAY03-CLUS7214_1
cccacgcgtccggatggttcagatgagtttttcttagtctcatgtccttacacagaaaagactaatgctggatttgataggttgttagctgctcctgtatttagtatgagtgagagagctttaggcatagtcctatttgattacaatcctgatagtgctgctgagaagaaggtttgctatttggcaaaaggagtcatggctcagatatccagactccttccatcaccagaactaccagcttacacaaagagaagaggagcagaagaccagaagaagggcaaaaaaagacgcatcatttgaatagtcgtattataataaagttttaatttaagggcactcctagctatgaagcttatgatgaggctgatttagtatctcatgtttctgattcttctatctactctnggcgtttccgaaaacaatgttccacatgtgttggtagaggtatgtgtggtgcaaggtgcggaggctgtcaagatggtggctctctcattccacaagcagaatggacatttgcgctctgacaatgagtaacaactgattccgttcgctggctgagtgccgttttagtgtcacttgtagtttctgtgccttttgggctatatgccttgtttggagcccgtgttgaggcggtgggcgtgtctcgcgggcccgtctctcctttcccctcttggcgttgccggtttctatcctcctcctgtgtccctcggggcccgggagcatggagccatcgtcgggctggttcggctaccttctccccctcggggccctgatgctcgctgtggccgtggcggctgcttgctgcgcggtttggtggtcccgactgtgtgtgttcgtgtcctatgcgccctcctcacactctggccaggtatgtgtggtgcaaggtgcggaggctgtcaagatggtggctctctcattccacaagcagaatggacatttgcgctctgacaatgagtaacaactgattccgttcgctggctgagtgccgttttagtgtcacttgtagtttctgtgccttttgggctatatgccttgtttggaacccgtttaaaattgttgggctagttttgctggcgcttcttactttagcctttttagtaatggtagtttgtatccttgttcatattccctctgtgatcatgagcatgtattcatcgtcatggtggttcggttatcaaaacagcgacttggtagtgaaattcggttttaccgttgtggaaactgaaa

SEQ ID NO: 7196 - DNA, 860 bp, Sorghum bicolor
  Clone ID: SORBI-28MAY03-CLUS79271_1
ccttgtccgaaatggagccaagaggatcaccatttccttgtcgcgtcccatggggaagttgtgctcgtatcacgccctggaacaatggagaatgctttcgaattctttaggctggatatcgaagcgatggagtggtcgcagctggatgaccgagaattggatgacaccagctggtttctttgcaagggccaatccttccgtgtgaaggatgcaggcaggaggagagtctatccctttagtggtccaaaacagtggagcgtcccgatggattcctgcgaacagaccacagatgatggaatggcgatgggcagcaccgcctgcttcactggtacatctgggcatgatgatgtggggttgaagtctattacaaatgtgtatgcttatgacttagatgacgggaccgtcgagatggtcatcccagcatcactcgttacagaagtgcgccactgggtgcagccaagtacgtttgcaacagccaaataatcccatatgttatgtatcaagcatattatatatgatgatgaaggcttgtcctttttcctattctttttcaatgagagagatgtattatgcatgcatagttgtaaacagcatcgacctgattaatgaatgatgatgatgagcagaggcgtgtgcggctgcatgcatttccccgttcatgatgttgctgtttaaccacagccaaataatctcatgttatgtaccaaccaagcatattatgttgatgaaggcttgtccttttcctgttcttgcatctttcgttttccatgacagagatgtattatgtatgcatagcagcataggtgtaaacagcatagaaatgatgatcgatgagtatgcatatgcatttctccctcaaa

SEQ ID NO: 7197 - DNA, 722 bp, Sorghum bicolor
  Clone ID: SORBI-28MAY03-CLUS79162_1
agaggaggaggagcgccagcgctatcctatccatccagtccagcatccactccgtcttccaagctttccggctccctcccatcccaggcaacaagaaatggcggcggcctccgctcccgtgcccccggtcttgtgcaagcggtggcagcagctagtgcttgtccacaccaccaagccccccctgcccctgcgcctcacgcgccacgccgtctccgtccgggccgcgccgccccgtcagcagcagcagcagcaccgcgcccgcccacggccacctcccaggaataagccccccggacccgcgcgccgtcctcccaggatccctctggaccaagatgattatgaatacgacgacggcgaccgggaggaggggagattcgctgggggtacccgggccgccgccatgcccaagccaccggccggcttcgttctggatgaccagggcaggtgcatcgccgcagcatccaagcgcatcgtcaccatcatcgacgacaccagcaaccgccccttggagtgcattatccgaagagtattcaggagctcgcagggccacgactgcttgcttctctgccccgttgacatgtaaagctccacggccacactttcgatcgtaccatcgtccattgcccccactcatactcatggcagactccaagtgacactcttccaggcctgtgcaggtcctcaagagcacaaatttcagtggatgggtagctgtccatgac

SEQ ID NO: 7198 - DNA, 745 bp, Sorghum bicolor
  Clone ID: SORBI-28MAY03-CLUS79279_1
aagcaaataccaatatatcatcattacatcagcccataaatttagataagagtcttgggggcttcgctggccgcattactgactcagaagcccatgtcataaagttcagtagtgatggcaggcggattctgttaaccactaaagctggacgtgttcatgtgctagattcattccatggcaatagcattgcatcgtacaatgtgaagccagtggtaaccaattcaacactggaggcatcgtttagtcctgatggaaaccatatcatatctggctctggtgatggtagtgtttatgcttggaatgttaggagtggaaaggtcgcacgctggggaagcacagataacgacccgccactggtaaggtgggctccaggatccttgatgtttgtgacaggatcatcagaactgtcatgttgggttccggatctgtccaagctgggatcctttaccattagcaagtagatgcaaatgataagaggtggactgcccttgcaagccctgcttgtctctgtatattctgttgcggttgaagggactcgttaagcattcaccaccgatcctttagcaagctgttgtatctctcatttctggatgtctcggctcggagaaatcttgtaattcagaccagatgggtatatagagagagcaaagaaacaaggcggatgggcttgggcaacggttggttagtttgtttcagttggattccttgtactgatgtgctatttcattgtgcatccacctcttca

SEQ ID NO: 7199 - DNA, 527 bp, Sorghum bicolor
  Clone ID: SORBI-28MAY03-CLUS79430_1
gcacgaggcccccgcgtgcgctagctttctctcaatccgcctcgctcgcggcgacggctgggcgtctgcccccgccgccgccgtcgccctactccaggtgcgtaggtcatctccgggcccatcaccggcgacgagcacccgccagcatttcgcctgctagctgcaatcctcttctggcaaaacctatcgggtgaacatgtttacggccatgttgttcactgggtccgtccgtccctgatccccacttcacagacccggagaccccatcccattccactaaaccccactgctgctgctgctggcgccgttgcctgattttttcagttctgtgtttcgcaggggcgtggaagcctggagtcctatctgatcggaaaatggtgatgacgacattctgctcggctccgtctgcatgtctgtgtttctgaactgtgtacgccatgcttaatcgtcgcgtccttggtgaatgcaggttaagatcgaagaccatgccgaggacggcggcatagatgctgatgtcaggggcctcg

SEQ ID NO: 7200 - DNA, 740 bp, Sorghum bicolor
  Clone ID: SORBI-28MAY03-CLUS79530_1
cgtaaggaaatcaatggtggtaacaagtaattttttatctcatctgctaaaattatttgtttccgtcaatcttggggcgggaccagggggccctggttaatgtgaagataaagcaagctttttgccctcccaaaattgttgagggaaatccttgtttggagtacattaaatacattgttttcccttggtttggaaggtttgaggtcgtccgtaaggaaatcaatggtggtaacaagacatttacaagcatgggtgaactaatttctgattatgagacgggtgctttgcatcctgccgatgtcaaacctgcactagcaaaagcaataaatgaaattttgcagcctgttcgtgatcacttcaacaacaacaacgaagccaaagttctacttaacactgtcaagaagtacagagtaaccaattgaggagcggaatgtgtgtctttagggtgaactagaaaatcaagccattgctagagcagcaagctgaccaggacaatgaaatgattaaaattttgaactctcttttgatgtggcttggagattgaactggcctcaaggacataagttcactggactcaaggatataagctcgaatgtttttgacatataggagcggtagtgatgtgctaaaatatacaacagcaattgtgatattttagttttttattcccttttggagtggaatcaccagttcaccttgaagttattattatttatatattcagggtattttcttgttgg

SEQ ID NO: 7201 - DNA, 821 bp, Sorghum bicolor
  Clone ID: SORBI-28MAY03-CLUS79531_1
gcacgaggacgatgcacttaaacttctctgcagcactttcggatgccaaaaggaaaactgaatttacgctggatactcgaacaagtttggcactttttgggtcattcactgcaactgattatgtggcttctcaaagtataaggaggaggataatgcactatcacatggaagctttcaagaaggtcgatgtcatagtaactcctacaactggcattactgcaccaaaaatacctccaagtgctctgaagtcaggagagtcagattacgttgtgtcagcttacctaatgcgattcatcatagcagggaaccttcttggtctcccagcaataactgtgcctgttggtcatgacaagcagggccttcctataggtttgcgactgataggccgtccatggggtgaggcaagcttattgagggtggcttctgcagtggaggagctgtgcctgaagaaacggaagcggccctctgcattttatgacatattgaaggcctgaaacgtcgttgtatataatcccggtgtcttgtgatggcatgggtgcgaggaagggtggctgagaagagtttcatcttctcaagttgtctgtaatacgaatactgtcatcgtcaccatgatggggatggctgcagatcacatctgctataataaggctgatgtagttagctagagctcagtgtgtacttggtatggatatttagagctcaatgcacaagctgacggggggattcaacaaggcgtgagtgtttttctttttacaagttaggcgtgaatgttgttgttgtgactcttcttcctacctgctcccaatctttttttaaaatta

SEQ ID NO: 7202 - DNA, 1050 bp, Sorghum bicolor
  Clone ID: SORBI-28MAY03-CLUS72475_1
tactggaaacgctcggttgctagagtcggctcccgcccgacgccgcgcccctccgccctgccctcccccaccgctggcgcccgctccgccgcagcgaagctcgcggtcgccagcgccgtcccacgggacctcgcctccagcaccaaggtggtgcgcaagtgcctggactacgacggcgacaccatcctccctgctaccgcagcccccacgccgccgctggatgacgtgctggaggacggcctcgcacttccgctggacctgccagaccctgaagtctccggcgactcctcctcctcctcctcctccgtcatcttcgctgctccggatgacgcggtgataacttccgccgactcctctgtcaccgaggtcgccgcgcccgccgactccaccgccgacagcgacgcatctctcccggaacaaatcaagttcgtcatgtccgagctgcatgccgccaccggcctcagcccgcgctccaagcgcctcctcacggcgctcgccgaggccgcgaacgccgagctcacccccacggccaccaccgcccgccgcctccgtcgcgccaccttctggggcaaggtgcgcgtggcggtcctcgccgcgacggtcaccaccgtggccgccatcgacgtcgcgctcgccgcctacctctacgcgcgccgcgtcaacgaccggtaccacgtcatgccccccacctgatcccagcaccgcactccgaccaccgccgccgccgccgcccgtgcgcctcgacctcgatcgtccagacgaaactgtgatcgctccctccgtgttgtccctgctgaagtgctgattgtgcgacgtttgcccagtatacgtaggcacgtagcgatgttgctgttaagagttaatggctgctgcaattgtttagttctaattctggctactgatttatgttgcgagtagcgcatattgcatcattattaagacattagcattggtggtaccctggtataggtcagagattcagagaagtatgttcagaagagagtaactaatcggtgttgtggttcgtttaaggccttgttagatcaaaaa

SEQ ID NO: 7203 - DNA, 755 bp, Sorghum bicolor
  unsure (1)..(755): unsure at all n locations
  Clone ID: SORBI-28MAY03-CLUS72702_1
gccagcccaatacaaggtaccacagggnaggtggggcacacaggggaagggggggttatgatgctgggaggccaagccatggcacgaatgcagagaggcgaaggggtggcagccatcttgaataccagccggtcggatcccaaaataaagctacagacttccaacagagcccgagcatggaagaacgacccgaggggcctcccgcttctggacaagcgttcagggagcgtggccacaacagggggctacgcccagcaggccgcttcgtccggcgaaaccctgcctctacgcctaccagtaattctcaccaaaatgaataatcttccacggctgccacatccgctgagctgcaggaactcgcccttgtggttatgtttcacaacaggtttggatgcacttgggtgggcggcaggtgtctatgcctctatgctggtgagcattaggatcattgtaccggtaaagtggtaatagtcttttgtcccaagggcacctggccccacacgcgccacgtgtgattgtggatttttcctgaagaacatcccctttgttgggatgcgatgttggaacgtgtactaacagagttgtgtttgagaactgggtttgaatgttgttagcttgctgctaatgggaacagaaagtgttcgtttttggcccaactatcaggcctctagttggctaatacgttggcgtcagcacagcatgctctctttgttttttgtttgttagaggtggtgtttacgggaatgctttcggtc

SEQ ID NO: 7204 - DNA, 697 bp, Sorghum bicolor
  Clone ID: SORBI-28MAY03-CLUS72552_1
ctccgacaagccgcaggccgcggaccacgcgctcaagcgtcaggtgaagcactccgtcgcctgtggtgtcgattgggtggtgctcgtctctgacgactcggatttcaccgatactgtgcggaatgctcgcgctgccgacctgaggacggtcgtggtgggtgacggttgccgcgctcttggcaaggttgctgacatttggttgccatgggaccgagttgagaatggggaggttgatgaggagatgctgaggagttgcacatttgcagagtaccgggaagatcaagaagatgagcggggtgagcagttcataggcgattgggatgcaagtgcctttgatgacgttgttgacgatattgttggaatgagaaccagcttgcttggagctacgacaatatctgctttcgctgatgaggacattacagatggcatatttgatagcatgttttggagtagtgatgatgaggaagaggatggttacttgtgaggttcatgtgtgttaacagctaagcagtaaacatttggatggattcatttattttgttttctgtacatgtgacgtgatcaaatgattctgtggaaattagcaaactgttgtagaactagtcacaagtttgtcttcctttgagaagtaactgcaccatggatatgggatcagtttgcatgagtggttcactctctctgtcataggaatgttggc

SEQ ID NO: 7205 - DNA, 1022 bp, Sorghum bicolor
  Clone ID: SORBI-28MAY03-CLUS7276_1
gcacgagggtccgtcgacattccattcgcctctccctccttcccccatctctttctcgccgttccacctctttccgctgataagcacgccgcttcctccatccatccatccacccgccgcttttctgctttggagattggagaggagctgaagcgcacgcagtggttgctgtgcccgtcctcctccaccggtcggtcggcggtggacttgaggtttcttcgtcgacggtttcgagagttgaggaaatgtcgacgacggagtgttccgacctcggggaggagttctggctgcccgaggagttcctggacgacgacttcttctccgaggaggagaaggcggccgtggccgccaggagcgagagtgacgaggaggacagcctggcggggctctcgccccgccgcgcgggcctcctcggtgacgacggcgagcggaagccgcctaccgccgccaagcaggcggagttgacggttgggtcaccgcagtcgacgctgtgcgggcttcccaagtccgggcaggagagccccaacggcgttgcgtccaagggcacgtcgccgccgtcgtcgccgctggagcagaagccggcagacccgtgggacctcttgtacgaggcggccggccaggtcgcgcgcatgcgcgccaccaacagcatcccggtgccggccaacaacgcttacggcttcggccaaagcggtttcgcgccgccggcgcgcaagccctcgccaccgcctatcgctccgccctccgccaaggttcctgctggcggcgggcagggccactaccacccgttcgcgcacttggtctcgcagcgccagatgcaggctgcacagttccatctcctgaagcaacagcaactgctcaagctgcagagggagcgccagcagcttgctgccgccgccgcgtggagcgcgcgccagggcgcctgtgccaaggccgtcggcggaggcgacgcgccgcttggtctgaacccggcggcgtggcccccgcttcagaagccgccgcagcagcagcaccagggcgccggt

SEQ ID NO: 7206 - DNA, 660 bp, Sorghum bicolor
  Clone ID: SORBI-28MAY03-CLUS71736_1
ggacggcagactggagctctctggtgggagttccactccactctacaatgaggataggggctggagcagcggcagcggccaacatggctgcttgctcctccgttccctgctccttccccaccaagccagaccctcaccgccggggccgcagctctcatctccctcggctccctgctgctacccagtttcgtcggtttcgatcactctctgccgccgccgccgcctcgtcgtcggcgagtcgcctccgtccacgagcctccgtgtccgcgtcggccgccccgtccaaggactacgagttcactgatggaaacggagaggtggagctgcgactggacatccaaaagcttggcatagagagtgcaagagatgtttttgttgacgtcgatgatacatccctattgatcagagccaagtctgacgggacactgaggactttgatgaacgtccaaacactgtttgataggattaagtcttctgagaccatatggttcatcgatgaggaccaattggtggtgaatctgaagaaagtagagcaagagttgaaatggcctgatatagatgaatcatgggaatccctcacttctgggatcacccagttgttgacagggatcagtgtccacattgttggtgattccacacacattaatgaggcagttgcta

SEQ ID NO: 7207 - DNA, 1193 bp, Sorghum bicolor
  Clone ID: SORBI-28MAY03-CLUS71761_1
gtgctaccgcgcacccacggcactgagactgacccaggtccaggaatgtggttggtaggtataggtggtgaagattagaggtaccgtatctagcccgccagccatcctgcagtcctgctgctctagtccacctgcatggcggtggtgtccctcttgggattctcgctccctctcttctgcgttcgtctcttcccgacccaccaagccttcctcatttgatgctgttcggtcacggcgattgaattcgcgagattcagctatgccaacgacgatctccacaaggcagtctctgcagtttgctttgccttcaaacaatgcacgtccaatatcgactgcagtaagaatgacatgttttgctaagaagcaacctattgttgccgtgcccttatcatctagtttggaggacaaaaggtatgagcctgtagtcaaaatgtgtggcattacatctgccatcgatgcggagatggctgtgatggctggagctaaattaattgggatgattctttggcccaactccaaacgctctgttccattgtctggagccaaagagatatccagagtggccaaatcttatggggctgaatcagtgggtgtgtttgtggatgatgataatagtactatcttgagagcatctgatacatgcaatctcgatcttatccagcttcatggagatagctcccgagaactacttcctctgctttggaagaacaacaggattgtatatgtgctaaatgctgatgacgacggtatacttatcaatgctcctccaagtgaggaatatgttcttgattggtttttggtggacagtgcaaaaggtggaagtggtaaagggttcaactgggaaaaattccaaatgccaactgttaaaagcaagaacgggtggttattagcaggaggccttcatgcagataatgttcaccaagccgcttctgctctaaagccaaatggcctggatgttagcagtggcatatgttatcctgacggtttacggaaagacccgaagagaatgtgttccttcatgagcagtgtaaaaactttgaatctcctctaaaatactagtacattattggtcatagtttcttggtgcagtatgtggaaactgaataaatggcagtcctaataaaaaataaaggcattattgatctttggaatcaacctgtaacattcagtcaatttctagtttcagcagctat

SEQ ID NO: 7208 - DNA, 524 bp, Sorghum bicolor
  Clone ID: SORBI-28MAY03-CLUS71808_1
gcacgaggggagcgtggtgctggagcaactcttgcctgtggtaccggtgcttgtgcagtggttgttgcagctgttcttgagggtcgagctgagcggaaatgtgtagttgatttgcctggcgggccattggaaattgagtggagggaggatgacaatcatgtttacatgaccggtcctgcagaggccgtcttttatggatctgttgttccctaggtactggggaccaaggtagaagggttggctgccactcagagcttgtgagattggttacaatatccatgaaacagaatgttttggtaccagtacacttgttcagatattcttaattatggttgcttgatttgggtagcagtagaggcttgcttttaaagcattctagtgttgttcaccttttgtactcctttagtctgtcaggtttgaacactacattggtaccatttctttcccaccattttctgtttcttttctttgtaagtgaatgctaatgcagtttcagtatcgttttctatagatttatgcactgc

SEQ ID NO: 7209 - DNA, 872 bp, Sorghum bicolor
  Clone ID: SORBI-28MAY03-CLUS71814_1
ctcatagcagggctagcagagtcagtgtctttttgcttcttgtggccattgcagggctgtcaaatgagcccaaaagactcttgcccttttgcttgttagcaacctgcttctttttccttgcagcctttgactttacaggagcatttttcatgtcaacagacatagcctcaggttgatttgaaccagatcttgacctcacagcccacagcttcaatatcctcttggctaccgttcttgcaattgtgccagcgatgaccatataacccttgcaaatagggcattggtgctgtccatttttcacttgtctgtatagcatctcctaagcagactgaatttttcttttcatttatcttctgcacaaaggcattacctacgatctgaattatagaattagtaaaaacaataatttttatgttggcatattgaacaaccttacgcattgatatgctttatgatttttcactattgtagtaggcataacaaacaagctgaccgtcagagtcacctatggtagctttgctccatctgttttctgtatagacttctgttgatagtatattaacagtgttcatttttattctgttcaagttatagtttctccagttgaaaatacattggatttgtcatcttaataatgggccagtgtactgatttaggagagtaaacatgttctgcaaactatgctcctgcataatgtgacataaatcatcctcttccatgaaagtatcttgtactgatttttttagcaaggtttatctatatatctttatgaaagtatcttgtatgatagtttctccatgttatggaactccagtttaaagctactatgtaaattgtggtttatcaaaggtgtagaagcccctttggtgggt

SEQ ID NO: 7210 - DNA, 693 bp, Sorghum bicolor
  Clone ID: SORBI-28MAY03-CLUS71839_1
atcccccacgcacacggcacgctcgccccctccccgcccgcccccgcccccccccgaaccctaacgcccacggcacacatgcgcccaccctgcacgccgccgccgccgcccgcgcgccgccgccgccgaccaaatctgccgcgcgccgccgacccacactccccgccgccacagctccgctagctcttctatcccaaactcctgcccgcagcgagttcgccggaggatctccgtccgatctcgcctcctgggtcctggccacgcgacgcacgccggagacgagcgagaaattaagaagcggctctagcggctggcaggaatctgagcaacgacgacgacgctccgcaggcagccgctgcatcggatccatcgccggtaaactattgttcattcacacactcctcggtcgactactccgatccatcctacaactacacgcttggagctcagccggccggcagccatgaagaagaaggcgcgggcgaggcggcagcgcatcccggcgtttggggagtggaactacgcctacgtcggcgccgacgactggccggtcacccagtacttcgactccgccatgcaggccggacgactcgtcatggcgataccaccgccgtcgccgcccaagcctgcagccaacaaggtgcatccatgcctgttcattcctgtgtatgaggagttgatagctgatcgtgt

SEQ ID NO: 7211 - DNA, 626 bp, Sorghum bicolor
  Clone ID: SORBI-28MAY03-CLUS71908_1
ccaggttgaaattcattcaggacgacctcaccaaatacggatacaccttgcatacattgggcaccctcttgtagatgatcctctctatggtattggtggccaccccaaatttgttgagccagaatctactggcacagataattcttttgcatttgatggaggttatgagagacctctgcaacctgttcctggagactgcgggtatcacctacatgcacattggctggtcctttgccacccaacaaccaataagatggtaaaaattaccgctcctcttccacaaattctacagacacgggaggaacgccgtgctacagctgagcaagtcgatggttgaactgagcaagcagcaagtcctcacagacgtctgctcctctattttatcacctttctcgaggacatacttgcgtcgtacactatcaactgtacaacggcgagctgcaaaactctggctcgacgcagcgccgtctcatgtgacgtttaggacaggctaacgggataacatcagatatttaaaagtaaacggagtactaactaatgagctctatgatgattcttctatccttgaatcttgttcatctattcgaagttcaaactaagcggagtactagctaatgtgctctatg

SEQ ID NO: 7212 - DNA, 679 bp, Sorghum bicolor
  Clone ID: SORBI-28MAY03-CLUS71840_1
agcaccacgcccacgcacctcctctccctctcctctgaaactctcctacttttccctctttctctcgtcgtcgccatttattacgcctcctcgtcgcaaattttctgtcgtagaataataaaggggtcatccgtgtccaccgtccacgtggtcggcggttgcggccacggcggcggcggcgggcgccggagatgtgagagcccccgtgccgttggagatggctgcggcgggggcgggcccgggccccgggggcggcgaggggaagaagcggggcgcgtcgcggagctggatcctgctcgacgcggccggggaggagcgggtgctggacgcagataagtacgccatcatgcaccgcgtcgacatcaacgcgcgcgacctccgcatcctcgacccgctgctctcctacccctccaccatcctcggacgcgagcgtgccatcgtccttaatctcgagcatataaaggcgatcatcacttccgacgaggttttgcttagggatccttctgatgagaatgtaatccctgtagtagaggagctccggaggcggttaactccatcaaatgccactcagcatgatggaaaagagaacttaaatggacagcatgatgtggaaggggcagaagaagatgaatccccttttgagttccgtgcattggaggttactctggaagcaatctgc

SEQ ID NO: 7213 - DNA, 698 bp, Sorghum bicolor
  Clone ID: SORBI-28MAY03-CLUS73318_1
aaaacgctatcgttctcgtcgggagccgcgacggcgcgcatggcggcgacggcggcggcgcttcggtgctgctttcccggctcctccggtgtcggcagtggcttcgtgaaagccaaatcgtccaggcgaggctggtgcgcagcggccgtggcggcgccgtcgcgggaggcggagccggtttcgtcgctggggcaccgtacccgcgtcgacttccccatccttcaccaggaattcgatggtgctaaattagtttacttcgacaacggtgcaacatcacagaaaccttatagtgtgatgagaacactagatgagtactaccgatcgtacaattcgaatgttcatcgtggtattcatgcactcagcgcgaaggctactcaagcatatgaggatgcaagaagaaaggttgcaaattttgtcaacgcagctgatagcagagagattattttcactcgaaatgctactgaagctatcaatctggtagcctattcatggggactatctaacttgaaagaaggagatgagattgtccttacagttgcggagcatcatagtgctattgttccatggcaatttgtttcccagaagactggtgccaccttgaagtatgttggattgactaaagaaaatgccccagacattgagcagttaaaaaggcttctgtcgaacaagacaaagatagttgttgttcatcatgtcgc

SEQ ID NO: 7214 - DNA, 1174 bp, Sorghum bicolor
  Clone ID: SORBI-28MAY03-CLUS73390_1
gccgacgcctcgccccggcccccgccgccccccccccgcccgcgcccccctgctcccgcccccgcgctgcctccgcggctcgggctcccctgcgcgcttggccccgccggccggccgcccgcccgcccctcgggtcccgtcccccggtccgcggcccgcgcccccctccggctcccctcccccccgcactcccccctccacacccgcgtgcctgcctctgacgccccgcaggccgtcccgacttgccggctccccgcgccgtcgtcgctcctccggcgcgccgcgccatgcctccgctccggctgggctcgccttggcgcctgggcgccccgcctccgtccccccccgcgcgacggctgtccgcgccccgtccgcggccccccgcccgctcccgctgaccgctcgcccccgctgcctcctccacaccatcatgtcattcttaaaagccccgcaggccggccgcacatgcgccctgcccgcgcgccggtggctcccctggcgctcgctgcccggccgcgccgtcgtccctggtgagtctgccccccgggccccccccgtccgccgcgcctgtgccctcgtccgtgccgcctccgacagtgatacctctgattctgacagtgacagattgcaaccgcgtcctttcaacaagcacttcaccaagtacaaggactgggaggattttgaggattttgccgtgatcctgatgagccgctgtaacattgcacaattggattcattccggctgagctctcttccggactgcctcctccacaccatcatgtcattcttaaaagcccggcaggcggtccagacatgcgtgctgtccacacggtggaggcacctctggcgctcggtgccatgcctcgacatcgactttgatgagtttaacagcaaggcgcccgtcatccgtctctccagtagcgacgacagttcgagctccgacagttcagtttgccgctctttggaggatttggagctagacgattgcagatgtgaaattcagtcaatcacctccgactcgttgaagaccctggttctgaaaaattgtgaatgccgcagtctttctgagattatatcacccccactgaagacattggttattgatggtggctcaaatactgatgcctgtatgcttattatcttggcacctgctcttacatatctgcatctggct

SEQ ID NO: 7215 - DNA, 577 bp, Sorghum bicolor
  Clone ID: SORBI-28MAY03-CLUS73487_1
tagaaacaggcgctctgatgacccagaattttttcttgattttgaggagatttatgttatcgactcaaaaacaaggtcaatcacaagagctaaagttgtggttagtgttcctgaaggaaagaaaagagataggcgaaacgacctactactgatacgtgatggaggagagtctttcagaattatcgacaagactaaaaggggcgacgcgacccctgtcatccaaagagaagagtgggcaaagtcaagacaagacgtggagaagcattttaggaagcttagagactttgactactcgaattggttttagaaaatgatatgctgtgattgtgccgtatctactgttgattcttttagagctagccacttgtttgatcaactgagaaatacaattttgaatttagataggttcagtgtaacactagttatagcaagtacgccatttagggagcatgtaagctaaaaaaaattgtgaatctgttgaatgccttttttttttccttttctttttttttcttacgaaatgattgcactacttgttgagtagcgaacgaatttgtggcgcttttgagatttttcc

SEQ ID NO: 7216 - DNA, 662 bp, Sorghum bicolor
  Clone ID: SORBI-28MAY03-CLUS73467_1
atggctgttgctgcatccaataaaagttcatccaaacccagattgagttaccctgacctggaagaacaggcccttcagtttatcttggactgctgtgaacctaatatagcaaaatatacaaagtacttagagggtggcggtggctctccagaagtttcaatgaatgcaaaacaagccaacagaacattactgctaaaacaggtagcaagagatctgtgcatcagtgaacggagaatcctgtatcgtacacaatatatattgcgtagaagattgagggacatgagaggtggcgaacttagagctctgtcattgttcaatgggctaagaaaactctttaaataaatggatcggctatcttatcttggcagatcttactggatccagtaacatggcgctttgaccttactgccgaagcctcatatgtttgtttgccaaatcagactgcagtccaggatctggaccgcaaatttcatcctcggagaaacatctggatgctagaaactagtaattcttcaatgaaggatagctgtgcgttgacattgaacagcccagagcttatatgtaaagagtaatcggtgtaatgttgattcaattcaaccatggtgacctgcaactattaagaaagtcgtgagcggtaaacccacatgttcgcttctgtgtgc

SEQ ID NO: 7217 - DNA, 686 bp, Sorghum bicolor
  Clone ID: SORBI-28MAY03-CLUS72283_1
acccgtaccatggccctgcgcaacatggtccacccttccgatgcatctgaacgtggctatgccatgccacaacatgcaaggcggggaaccaggtgaaggcacaccgttctcgcgccccgtgcaagggcactgccaggtatcggacatcgcccagcccattggtccagcgacgctgcgcgcacccaaaagaaatgccagcaaggccggcacgtccgcccgcctcatggccaagacagggccgtgggcccggctttctcccgtgaacgctcgaagcgctccaagggcatctaaacctgccggttgattgccaagccgccggggacatgccgcgcctcccctcgcggcaaaacccacggcccgctcgcccgtcttcatccgcggatgcatctgcctgttctaccgtcccggcacgggcacagagccagggcaagcggaccgtgacgatgtccaccagttccggggatagggacgggaacttggacccctgacctcatgttaagggggactacgactacgtcaacatcgccgtcgccttctaaagttcagcttcaggcgaaggcaatgcacgctctccctctcacggccccgtttccttgtccttgtaatcctgacgcatgcctctgatggacaggcacgcacaggcgctgtgccctttcacccagagcggacatatttgttgctgcaac

SEQ ID NO: 7218 - DNA, 701 bp, Sorghum bicolor
  Clone ID: SORBI-28MAY03-CLUS72335_1
tactggagcttcttcccctttccgatggtttccgactctgaccccgacgccgccctcctcctctccgctcgctccctctctcgatcgatgcggacggcgacggagtgcacgagcggggcagcgcagctgcgggctccctcctccccctcccccggcgtgctctctcctctccctctctctctctcctttctgctcgatctctctctccctcgatgcggccagggcaacggcagccggggcgcgccaacagggcgacacggctatgaccgtcgtcctcttcccactcggtggtcggtgcgttgtgcgccacatccttcctctgctccacctgtattcttgtgctacaggaaaccctaggtgcttgtggtagaggtcgcgaggattcgcggaagcgctgccctgcgttttttgactccgatcggaatcagaacggcacgtccatggttgcagcggcactccctttcactcgatgttactgctcccatggcgcccctgctcaggctgtgctcgcacacaagcttcgattgaatttttgtgccaccaacatttttgatttcagtgcgttgttttagctgcccaaattgatgtcaacaatatttcattcaattaaatgtggtttaccatatgcctgcctttcaggttagcgtagctgaaatctgtttgagattaaatgtgtaggcacatgtgcatgaccaaagctg

SEQ ID NO: 7219 - DNA, 652 bp, Sorghum bicolor
  Clone ID: SORBI-28MAY03-CLUS72344_1
ctcagtcctcccgcgcttgacctcctctatcgccaccggtcaggtcagatcaacatggccgccgaccgccgcttcaagatcttcacagccgccgatggcttcggccaggcactcaaggacgccgtagcggcgcacctccgcgcccaccccgccgtcgccgaggtcgttgacctcggcgtcgacaagtactacgccgccgccgcagccgtcgcccgacacgtctcttctcccgactcggcgcccgacgacgcccacgagatccgcggcgtcgtcgtctgcggcaccggcgccggcgtctgcatcttcgccaacaagtacccgcgcgtctacgccacccactgcgcctcccccgccgacgccgtcaacacccgctccatcaacgcctgcaacgtcctcgcgctctccggcagcgccacgccgcccgacgccgccgccgccatagtcgacgcctggctcgccacgcccttccgcgccccctgccccgcctccggcgacgcgccctggccagaggacatccagcggttcttcgacaccgcgccggacgagatggccgccatcccggaggcggcggagggcgccccggactcggcctgcgccatctgctgcctcaggagcgggatggagttcgagccgggggggattatgcccggcg

SEQ ID NO: 7220 - DNA, 602 bp, Sorghum bicolor
  Clone ID: SORBI-28MAY03-CLUS72445_1
gcctcgccacgctcatgaaccccagcgccagccacgtcaccaccctcgtcgccggcaccttcggctacctggcgcccgagtacttcgacaccggcagggccaccaccaagggcgacgtctacagctacggcgtcctcctgctggagctgctcacggggaagaggcccaccgacgagtccttcctggagaacggcacaaggctcgtcacctgggtcaaggagaccatggaggagaagcgggaggagcacgccatagacgaggctctgctcaagctgcaccaccaccacttacccaccgaggaagtcaggttggtcttctccgtcgccgacaggtgcctcgacgctgatcccgcaaacagaccaaccatggcgcaagttgtcaagatgctggagcaaggcaaaaacaccacccaccaccactcatcaacgtcaccgccaccaccaccaactgcagaccatcctattcttaatcctatataggagtattgatcttcctcttcctatgtacagtatgtagctctctccatgcatatatgggttaataataattaacgtacgtagaggtactgaggtaggattcaatatatacatacatgcgttttg

SEQ ID NO: 7221 - DNA, 682 bp, Sorghum bicolor
  Clone ID: SORBI-28MAY03-CLUS72353_1
atttatgtataatggctcctaataaatccttcggcgggcgcctaacccccaatcattgatccctggccaggtttgggccaattacttcccgtacaaatttcgccggtcctgtctccggtgagacggattccgttgttttcttgcccaattcgggcaggattttggtcttcctcctcgcagcttgggggcggtttcgctccggttcttgcgcttcggctccaggccatggagcagcggagatggctcgcggcttccgttttgatgtgcctgctggtgctttgctccgggagagacctgaagaccaaacatgcgcccatatatgaccctgggcttgcccggacacttgctgaatatacttctgctgtctatactgctgacctgagccaactgtttacatggacgtgtgaaagatgttgtgacttaacagaggggttcgaggtgatagagttgattgttgatgtgaaaaattgcttacaggcatatgttggatttgctagagacatgaatgcagttatagttgtgttcaggggcactcaagaaaacagcattcagaactggatcgaagatttattctggaaacaacttgatctcgactacccaggcatgcctgaagcaaaggttcacagtggattttattctgcttaccataacacaacaatgcgtgatggagttgtcagaggta

SEQ ID NO: 7222 - DNA, 660 bp, Sorghum bicolor
  Clone ID: SORBI-28MAY03-CLUS72461_1
gcctactgatgacctgcttgaagccgtgaaggcgcaaaccctcgcctgaccgaatccccatccggttgcagcctcccagaacccaaagctccaaactgaggtcgaaaccgctctacaagctacatggattggatgcctggctctggagatcccaacgcttgccggatttgagatctggtgggttttgccgcctggatccggaggagccgccggcagtttgcgaggttggctccgttgcgtcgcggaagccagaaggtcatggagtaccgcgccttcgacagcagcgtgactggtgatgagctccctccagcatatcaaattagaggaccaagagtgcatttcagtgggaatggaaggtcattagcaggcacactttctcagccaagatcgcacatcaagttggatagcgatatacatcagattgagcaacaggcctatactggtgttctcagagcattcaaaatgcaatcggatgccctgacatgggaaaaggaaagtttaatcactgaactaagaagagagttgaaagtctctgatgtggaacacagaatgctattaaacatggtcaatgaagaggaggctgtccatagaataaggcagtcaaggcagggaggtggaatgcaatctagcttgcctcataacagcatagttgatcacaac

SEQ ID NO: 7223 - DNA, 821 bp, Sorghum bicolor
  unsure (1)..(821): unsure at all n locations
  Clone ID: SORBI-28MAY03-CLUS72471_1
gaccacccgccaacacgtaccggtggccgctgcccgtcccttccatccatcttccatcctgagctctgagagctcgatccttcttttcttcttcgtaattgctagctagctctccatcacaattcattcacatactacagtacagcagagcagagcacagcactactcaaagagtgaagagagggatgcataatcctggcttagttgcgctgtacatcaccatctgctccgtcctcttcctcctctccaagatgctcatctccttcctcctctacaagaaatgggcgcggaagaagaggatcatcgacaacagcctagccggcggcggcaagatggtcatcttccgctccgccaccatggccatgccgcagtcgctcacccccaagtccttgctcgccatgctcatgggcctctccaccaaggacgtgatcggcgccggcggctacggcaccgtctaccgcctgcgcctggacgacaagacggccttcgccgtcaagaggctcaaccggggcaccgccgagatggaccggggattcgagcgggagctggacgccatgggcgacatcaagcaccgcaacgtcgtcccgctctgcggctactacgcagaaacgcacttcaacctcctcatctacgagctgatgcccaacggggagcctggaccaggcgctgcatcatcatctgcaactgcaagcgagccgcctcgactggcctgctcgctaccgggatcgccgtgggcgttgctcgcggnctctcgtacctccaccacgactgcatcccgcacgtgatccaccgcgacatcaagtccagcaacatcctcctgg

SEQ ID NO: 7224 - DNA, 1251 bp, Sorghum bicolor
  Clone ID: SORBI-28MAY03-CLUS73955_1
gagagttcgcctccttccctcttcctgttcgtccccggttgcgcctcctcttcctctgactgatgggcgaccatctcgcgttgatcgtggaccggctgctgacagagtcgacgctggaggcggcgatcggcggtgggaagcggatggtcgatctgcatcaggagacggtggccgtcgagtactgccatcgcgccctaggcggtggctcggcaacgaaggtggtggagtgcaggatttgccaggaggaggactgggacacctgcatggaggccccctgcgcctgctgtggcagcctcaagtatgcgcatcggaaatgcattcagcggtggtgcaatgagaaaggtgacaccatgtgtgaaatatgcctgcagcaattcaggccaggttatacttctccacagcagctgtttcactatggtagtataccaatgaacttcagagggaactgggagattacccagcaagatctcaatgattcccagataataacaatgatgcccacagagcgtgactttatggacaattacgatgactactttcctatcaggacaagaagcagcgccttgtgttgccggacaattgccataattttcatggcactcctggtccttcgccacactcttcctctcatgattggtgacaatggggagtactcattggccttattcgcgcttctggtgctgaggactgcgggaatcctattcccaatcctggtgatggtgagagcattggcaagcttccaccgtcgacggcggcagcaggaaagccgggaagcatatatatcttcatcagaaagcgaggaggaagatgaagacgaagcggaagaagaggatacaattacagattcggcacatccaaattactcacaaccacgcttcataccagtctactgacatggccaaaaacaagccttccaagttccaacctcccatctgacgggaaactccagcacctcctgtgtgtagctgacagaagcaaggatgatcccaagggaaaaaacaaaaaaaaaatttacaaaaatgagaatgtggtgacatagtaagatagcctgaagccactcgcttttatgcctatagagaagaatgtagtggccctgctactcgtgtacatatgagaaaatagcagactactgacaaacccggatactttaacttgtgagcctcaactgcagtaacccttgtgtaccttgaagatattatactgtgcaaagtacttgcaattgcaaatcgaagtaacggtgtttcagtttcc

SEQ ID NO: 7225 - DNA, 681 bp, Sorghum bicolor
  Clone ID: SORBI-28MAY03-CLUS73951_1
ggaggaggaggcaccgagagcgtcgggtccagctccagcccgccgccaggtgatccagacgcgaacgccaacgccgcagcagatcaagttgccgcggcgagcgacgcggcctcggatcacgaaggagaggagagcgacggacgagacgcttcacctgcagaagaggaacagcaagagcaatccagctccgcagagccgccgccggaactcttgtgtccgctgccgcgtaacgtgcggcgcgcggcgtccatggacgctgcggcggacgtcgcggagctagaccggctgccggaggaagctcctgaagaggagcagatcggtgggaggcggaagcgctggactgggactggcccgccccgcgcgaaggcttcgggctcgggccaccggagcaacctcagcaccgacaggctggcggctcccagcggcgtcccgaggtcattcttctcgcgccactgccgcgctcggagctcggtgctgccattgtgagtgagtgatggcggtctgatactcgagctgaattttgctcgctgaaataatgttgctgctgttgttgaatcggcagccgcgatctgtacacccttatacttgtgatctcaaagaggttagaagttgaaactcgtatccagtaattggatgtttgcaaatcgagaaaatgcatactgtgcagctatattcttctac

SEQ ID NO: 7226 - DNA, 897 bp, Sorghum bicolor
  Clone ID: SORBI-28MAY03-CLUS73983_1
gcacgaggggtagacgcccagcgcctcgagcggatcctcctggggtatgggagaaatgaggattcgtgcttcaagatcaagattacacatgccccagctctgcgcatgtttggaaaaattgagctggcaaaggacgagctgcaggtcggcaacaccatcatcaaggctgggacaatggtgaacccaagtgtcatgttgtcagctgtcacgatcctggacctccatgtccgttttggggtccgcaatgatcccaagatgctgcccacaatcctcagatgttttcccaacatcgagacgctgcatatccattccaagaaaactactgaatccactggcaggctcagcaacaagttctggaaggagtctggtgccatcaaatgcgtcatgtcgagcattaacatgctgcaagtccatgatttccgaggggagcggagtgagcttgccttcctcaagttctttattgagagtgcacagatgctgaatgtgcttgtggttgtgtatgccaatgggttcttcagttcaaggggtgaggccaattccaaagtgaaggctctgtttgctgggagaaaggccacacaaagctgtaaagtggtggtctgtgagagtaggttttctgaaggtggtagccgttgggacttcgaacaaggctctgatttctcttttgatgatcctttcggaatcatcgggtgtagttcctttggagttagtcagtggtttgtttaagtattcagatgcaggtattgttctgggtcgtttgagtttctttgcctttttccttaagaaccttaagccagtctcttactagcaattcaagaccatgagcctttgtcttgaggttgctagtaatatcatccacgcaaaagactagtgctacatgaataaatgctgctttctgga

SEQ ID NO: 7227 - DNA, 819 bp, Sorghum bicolor
  Clone ID: SORBI-28MAY03-CLUS7281_1
caggaaactgaaccaccatacaaagctgttttagcgaaaagggagaacttcagggatatagtggttactccttccatgtttacagatcacttaccatggaggtgccactttgctatgcagaaaattcttgaagctcaaacgcctatgcataggcgtgcaaattccgattcacccatacaacatttggtctgattaggacaaaactgttggcccatgtacagaatgacgtgaagacagaaataatgaatatcacatttagcagcatggtttattccaggctggaggcatattcagtccttcaggcagccatatcttcgtatacaggattcagaagatatccgtgacagacccaaaatcaggttgagcttattgacagttagaggcaaatgcctagaggcaggcacagaccactgagatctgatatctggcagaatagaaatctggttactgtccaacaatgtctaatcagtctctagtctctactcaccctggcaagtggcaacctgcgcgtgtacattggttcctgacgcagccgccaaccagaaaaccccccccagttgcgtggagaataccccccccagttagctcccgtttattattctctaattcattgattgaatcattgttctgcagctgtgtctgcttgttcataaccattttttattcagggctagttatggggtacataattcaacccagcagaattagctagactgactggctgacaagtgacggtcaagatgtgattgttcccctaagctgaatactgaatggaagttgtgacttaagtcggtacctccccagaaccatactcccttg

SEQ ID NO: 7228 - DNA, 837 bp, Sorghum bicolor
  Clone ID: SORBI-28MAY03-CLUS72912_1
tcccaaccctgataataatcctcgacctcctaatccagatgaagatggttctggagaaaatggaaatttgcctgggcaaaatgaggctgctgttgaaatcgaggaagaggaaaagaaagaagaggtggaagaagatgagaatctttttgctgaaaggaatgaagccgctgctagagtcaatatgagcattgaagaagaaagaaaggaagagaatgatcaagctctcactttcgcattcaactctgatcatcaaattcaatcattccttgaaacaaatcttccaaaagagttgaagagtacgcagtttagcaatctctttggagatactcaagccagtacccaagccagcacccaagccagcacccaagccagcacccaagccagcacccaagtcaacaccagagtcaatacccaagccagcctccaagtcagcactcaagctattgttgagctggactcatcttaggaagatgaagaaaagcaattgtagaagaggtttttgacctcaataaatcttggagtttttatctttaagtaaaacttcaaattaacctttactcgaaatctttatgagatatatactaactaaataataagaatctgatataaaactgcaagtattaagaatttttccctttcgttcccttctcttctggactgagttccaaagaatgagaaaacaaactaatagaaatcatcaatctttgagattggctctaactttttgaaaatgaaattttttgttgttgtcaatatcgaagtttttttgaattcttttaactaatttatttccaactttctttttcatactttattatttctttcaaagaaattttc

SEQ ID NO: 7229 - DNA, 668 bp, Sorghum bicolor
  Clone ID: SORBI-28MAY03-CLUS72934_1
aaagcaataattagaatgcaacaaaatattcttgctggcaacaatatcgataatcctgtcgatacttttgcagtttatgagccactttacgatctcgctgttgagaatccagattacccttcacatctttaccactaccatttccatgaccctaacatccagacaaccaaccctgatgtttacactcttgatgacaacggccaagggcgattcacagccagaacaatcactgatttttggcccagcagaagattgagtaagctgagagtgaaaggtgtgatccttggagtttcacaatatgaccgaggccatcctgataagctccctttttctaatcgcattcgcctgattccctggaatttaatctttggcaacttgagagacgattcggaaggtttgtttatcgttgaggaaacctttaacgatagagagggaaaagccccaattatccatatcacgttactttggggagatcgagtcactattctcagggattatccgagactcgatgaaattcctctgggggctaattcatatctttccattcaacaagaagggggaaggctggtcatgaagtgtccaaaaaataattctgggtggtctggggttgtggttaaaaacatggattcacatttgtcatcttggtgacatcgtgattccatctgata

SEQ ID NO: 7230 - DNA, 772 bp, Sorghum bicolor
  Clone ID: SORBI-28MAY03-CLUS7292_1
ctttctccctcgacgatacacttctccgccgccccggatctacctcgccgcgtcggcgcgcagctcacccaccgaagcgaggaggcaatcgaggcggacaaagcgctgcaccaaattcgacgggggatcgagcaccggaggcgtagtgcaaaatgttcaagttcctcaaggaggtggtcgcgggatccggatcgggcctcaaggacttcccctacaccatcggtgagccctacgcatcagcctggggctcatggacacaccaccgcggtacctccaaggatgatgggtcgcctgtgtcaattttttctctgtcagggcgcgaccctcaggacagacacatggttgctggtcgcaatggtgttaagagattacgaacagtgcgacatccaaatatcttatcctttttacacagtactgaagcagaagttgcggatggacctgccatgaaacacacaatttatattgtaacagagcctgttatgccactttctgaaaagctcaaggaactgaatcttggtggtacacagagagatgagtactttgcatgggggcttcaccagatatccaaagccgtgagctttctcaataatgactgcaaacttgttcatgggaatgtatgcttggccagtgttgttgttacacaaaccctggattggaagcttcatgcttttgacgttctgacagaatttgatgctaacaacgaagcctctggtagccgcatgttgcaatttgaatggttagttggaacacagtacaagccaatggagctgtc

SEQ ID NO: 7231 - DNA, 786 bp, Sorghum bicolor
  Clone ID: SORBI-28MAY03-CLUS73097_1
aaatcttatccgtacacccaaacccaaccttcacccgactctcagcctgatggcttgcagacccatttctccacaaagcacggtgtggatgcgtctcgccgcacgactcgaggatgcggcgccctctgctcgtttgctccctatgttgctccatctcctccgattcgccggcctccgcgagccctgtcaatcgatgctgctgcccgtccccagtctcctacccaagaagacgccgaagcaggagcgccgctgccgccagctgcagcaggagcggatctacatcgtctctacagatttgctgccttcttaattgatttctttgtttcttgatcaattcataggagcgttcttatctagtttctttgttttcggttcgatttgatgggtgatttcttttggttgtagatggattcatgggagacaaacaagataggctgtgaatccatttggttcgctctttgtttttagttcgattgacaggtgatttcttttggttgtgaattcattcctttcccactggcgtcctcggacgtccactcattccttgcgctctcgctcacacacgagctgctccgcctgagttcgggcccggtctcgcctggtctctttgcgctctttttgtccctcgccctgtgcgttattgtggcggacgggctctggcttccaagttgtgttcttgtacttatggaaatactttatgatttcgttaaaatatatgcagtcctatttggatttggacgagaattctatatatacgtatacggactggatttggattgtcctata

SEQ ID NO: 7232 - DNA, 944 bp, Sorghum bicolor
  Clone ID: SORBI-28MAY03-CLUS73201_1
gcacgagggccagatgatgacttggcccaggtgcatcggacgtgaccgcctccttcgatctgcaagtgaatcccgaaggccaggagggcagccaagaggtggaggtccagcaagtcggacccgaggagctagaagaagaagttgagtgtccaagtcacgagccagcttcgttcgtgaaaggccttgatgtggggctggattgactattacaatctcatgattgctgaatttctctttatgccggccttcccgtggctcagtctcgataagcttgcctcctccccgcgacacccaactccgcagatcgtgagaaaaatacgctcctatcacatagatgcagcccagtaagacacgagtatataagtaagctgcaagcatcagagttcggccaaaaggtcctcagtggtgccaaagaaaaaaagtcttacaccatccactctaaatttatgattcttgttcatcaacatttggtccagtcattatgaccggtatttttttgatccggaagctacatcctattcactgcacagtcgccagacagctatgttagctgcaacgacaaaattatagcagacaacggtgagcatgaaggacacacctcatcactccactccacagacctcccaggctacatatcgggatgcagtcaccccaatgaatgtgtgtgtccttgccgagactcagacagaatgctccagcaacgacagcagagcctccatggagacagcccacgagctaaaatagatcttgctgtacttatgaaccccatctgcgcaatgctagaatcagctgtgtaatgtcagaaccatgctccgtcatactaggactctgtctatgttacagttctctattagctttccagtgcatgttgtaactgctccatttacgcatactgcaactactgcatttactttccagtgcttatctcatctaagttcagcttc

SEQ ID NO: 7233 - DNA, 694 bp, Sorghum bicolor
  unsure (1)..(694): unsure at all n locations
  Clone ID: SORBI-28MAY03-CLUS73305_1
aatcatccccaattcgtggggaaacagctgtacctaggcagcgagccactcctgctctccggcaaacgcggagaaagtgggcgggcaaggtgtccgcggcgccggcacctcgtcttgctccgctccgtgcggttccccttctcccagcagcgaggagcggcgcagaccgagaggccaagaaccggatccgtgggtccatgaagcccgacgcgaggaaagatgccggcggtggcgtggccgcattaggcgtctcctgcttcgacatcaagtccttcgtcgcctccctcgcgctgctcacgctcgtcatggcgctctggcagctccacccttaccagccgctcctctccgcctcccgcccgtctaccacctgccccctgctcccccgcccgcccatctcagcttcctcccgcgccgctgccaccgtcgccccatttccttccggcaactccagtgccaacgctgcaagcaccaaggcggcctcttcggctgttcccgccgtcacgacgatgaagccggctgcgtccgtggtgccagccgcccggccgcgggatcccaacaagcgggagttccgttcgtacggcagcgcggcggctctgttcgtccggtggccgntaacccggggcggcccgcgtacgttcgccgtcattgggctagcctccaagccggcacacgtctatggcaccccctacttcaa

SEQ ID NO: 7234 - DNA, 982 bp, Sorghum bicolor
  Clone ID: SORBI-28MAY03-CLUS74152_1
gcacgaggtgagcatttcctctccctctccggggcggggctcatccatgcacgggggcgggatgggtgtcttcttcctctaaccggccggcctcttgccaagagaatcatatcgccgtccatgcatatatgtgatatccgtctcccagggccggtgatgtttacacgagaggaggaattctagcctgcctcttcctctgatcgttgtcagcaagattctccgtccaaccgccagaaccaaaatcccttttaaagcaagggagctcccagctcccgagtttccccaaacacttcatttcagccttcagctatggaggcatcatcggcatcagcggtcgagtcgaccgccaccgtgtccgtcttcgatgtatcatccaacaagcagcgcccagacacggcgaagctcgtgctgaacagccccagcccgccgagcctgcgcgaggagctcgtcggcgtggtcggcaaggcgttccggccacggccccccggcggcggtggccgggcgccgcgctgcccgtggatcctcacggcgctgcagtgcgtgttcccggtgctgcagtgggggaggacctacaccctcaagtccttcaggagtgacgtcatggccggcctcactcttgccagccttggcatccctcagagcattggatacgccaacctagccaaactggaccctcagtacggtctttacacaagtgtcgtgccaccgctgatctacgctgtcatggggacatcgagggagatcgccatcggcccagtcgccgtcgtctcgctgctgctgtcgtcgatgatccagaaggtcgtcgacccggccgccgacccggcaacctacaggtcgctcgtcttcacggtgactttcctcgccggcgtcttccaggtctccttcggcctcttcaggctggggtttctcgtggatttcctgtcgcacgctgccatcgtggggttcatgggcggggcggccatcgtgatcggactgcagcagc

SEQ ID NO: 7235 - DNA, 623 bp, Sorghum bicolor
  Clone ID: SORBI-28MAY03-CLUS74178_1
ctactgggtatgcccccggatccgctccgcccccccgttggcgctgggtttccttctcttctccccaatccgattaactctcgccgccgccgccgccgccgccgccatgtccccgtcgctcctcctgcttccctcctctacaactacttgtaggaggcttctgcctccgccatcccgctgcttcgcctcttcctcgcgcgcctccttcctcctgcggccgcgacgccgcatccgcctcgtgtgcgccgccgagcagcccaacggtgccgcctcccctggctctggctctggctctggaggcgacgccacggcaaacccaaccaacaacggactgcccaagaacaggagggatattctcctggaatacgtcaaaagtgtccagccagagtttatggagctcttcataaaaagagctccagcacaggttgttgaggccatgcgccaaacagtgactaatatgatgggcactttaccaccacaatttttcgctgtaactgtctcaacggtcgctgaaaatctggctcagcttatgtacagtgtcctaatgactggatacatgtttaggaatgcacagtaccgcctggaattgcaacagagtttggagcagattgctcttccggaac

SEQ ID NO: 7236 - DNA, 691 bp, Sorghum bicolor
  unsure (1)..(691): unsure at all n locations
  Clone ID: SORBI-28MAY03-CLUS74201_1
tgcttgtgccttgtgctgtgctgctcccccaaatctcccacctcctccctctaccctctctctctgtctctgagagaaactgggacacaggagaagagctctcggccctgggggggatcaaagattccagcccagagccggcggcggccggggcgggggacggcggtggcgtttctgatcgagaccaaaggatccgttcagcggttcacccagcgcgtgcgcgtcgccatgggcaactgctggggcgccaagatcagctccgacagcccgtcccgcggcgccatctccccatcaggggcaacttccaagttcactagcaggaatggggcagcagccttgagcggctgcagtagccatgcctcatctgcatcgatgctgccaaccccccgcagcgaggatgagattctggagtcggcgaacgtcaaggccttcaccttcaatgagctgaggaccgccaccaggaacttcagaccagacggtgtgctgggcgagggtgggtttggctcggtcttcaagggctggatcgatgagaagacgcttgccccgactagaccgggcacggggatggtcattgccgtcaagaagctcaaccaggaaggctaccagggtcacaaggaatggctgactngagtgaattaccttggaacgctttcgcacccctatcttgtaaagctcgttggctactgccttg

SEQ ID NO: 7237 - DNA, 711 bp, Sorghum bicolor
  Clone ID: SORBI-28MAY03-CLUS74213_1
tgcaggaggcggagaagtacaaggccgaggacgaggaggtgaagcgcaaggtggaggcccgcaacgcgctggagaactacgcgtacaacatgcgcaacacggtgcgggacgagaagatcgcgtccaagctgcccgccgaggacaagaagaagatcgaggacacggtggaggacgccatcaagtggctcgacggcaaccagctcgccgaggccgaggagtttgaggacgagatgaaggagctggagaacgtctgcaaccccatcatctcgaagatgtaccagggcggcgcgggcgcggcgggcatggacgaggacgtgcccagcggtggcgccggcagcggaggtggcagcggcgccgggcccaagattgaggaggtcgactagagcgagtcatgaaaagtgttggttgagctggattggatggttctgcatgcagtgcaggtccagagtgtgtgtgctatatatgtcaaggctttaggcgttttatctgttcgtgtgcgataataatctggggttaacacacctacaaggtgttctttctgtattcactgtcaagtgatagtaggttcagtagggtggaacatatatactatatgcattaggctgagtagatagagtaaataatgtgggaacatccgtaatgctattgtaacagtctctacgagttcaggagtccatatatcaatatactgtttgtttctgtcacttttgc

SEQ ID NO: 7238 - DNA, 618 bp, Sorghum bicolor
  Clone ID: SORBI-28MAY03-CLUS73523_1
ccgtgggcaaggagggggcggttcccggcgcggtctactagcaccaccgccgcctagtgcccaccatcccgacggaaaggatggcgccggtgcggcggcggggacctggcctcctgcaccccgctcgccaagaagatgaaagagcagctgggcgacaactgcttcctgtacggcatccgcaaggccggccacctgctccacgtcgagcggccgtgcgcctacaaccgccagctccagaggtggttcgcctacgtcaactccacggctgccggagaccaggccagctgatggatcgatacaactacacgcaagcgccctgctcctcatgcccgtttcatcagttgataatatatggcgtgaccggtcctttctccatgcacctgtgtattgccgtgttgtgttattcatgtcagttgttgttccgaagaaagaagacgtaggtagccaacacgctgtgtgtagctagtgtgtgctgagctggccatggtgcatggttcgatcagtacgtgtacttcaagtgtagacctcggtctcgtcgtacgtgtggactcattcgtttggattaaattctttgtataagacaacaatacatgcagtatgatgaatgagtgtaatgtc

SEQ ID NO: 7239 - DNA, 747 bp, Sorghum bicolor
  Clone ID: SORBI-28MAY03-CLUS73541_1
attgtcaacagattgcaataagacaaagaaaactctaacgcaatgaaaatcgccgttatcgtgctcgtttgcttcgctgcttacatcgctgcccaagcccccgccactgtcgatcgcttcacttccgactactctttcaccttcgaattcggtggaagttttggtgtcaagcgtgctatggaggtctctggccaagagtctcttctccccattgaagtccaaaaggaactcgtcaagcgtcaagccaccagcttggtcaccactgtctacggtaacatcgaggctgatgtccccaacaacatttggctccaaactgccaagcgatttgttctctccgtcggcggtatggatctcgatttcactctcgatgcctccaacttggtctactacgacttgaacaagaactatacttgggacactactgcctgcgagtgcaatgccatcgagggttctactgagatgcccatcatttctttgcctccttttgctaccgtcaaggctactggtgtttccatcactgtcaatggtgctgctgtcactactaccgaatacaccgcctcatggagcgcaggtttcaactccggatccaagaagcgtaacgttcaacaagacttcactttccaatacactttctacgttgatgccagcaaccaaatgcgccgtaccgtcttcgaagttaacttgagcggatccaccgtcaagaccactttggacttctggaacatcgctgctgtcagcgccaacaag

SEQ ID NO: 7240 - DNA, 925 bp, Sorghum bicolor
  Clone ID: SORBI-28MAY03-CLUS73608_1
tttttttagcaaagagattacactcagcttcaattttacatccaaatagctgcgcaagaacagaatcatggatccatttggtctattatagtaactactaacaattcttgcaagatcttgatctacactcgttgcactagggttcgatcagtgaatggcgacatatgacagcttaaccctcaggtgcattagaccaagagctcgagtgggcaacaaaatcaaacatgaacttcagttgtaccggcaacaaaaatgaaatttaatatcgtaataaacacctcactacctagcacatcatactaatgtgcataattattacattacatatgtcaataatgtcaatgttggttgacactataagccaggggaagttgaatcaccctctaaacagagactgtccgtggcttggcacccatcttcttccatgacacgcttggcatgatctgtgctgtgtcgacccgatccttgtattggatggcaaagttgagaagcgagtcaagcagggagtctgagagcaggtggggcaccaggccgagctcaatgagcttcgtgtgcttggcgttgtaatagtgctcctcagcctcgactcgtgggttgggcaccgatttggtctgcacttctagaccaagcttcgctcctgcggctgtcaccagtttggctagctcattgacagagaattgctcagtgaactggttgaagactctgaactcgccaggtttggctgggttggctattgctagctcaacgcactgtacagtgtctctgatgtccagatatccccgggtctgaccaccttttccataaactgtaagtggatgccctacagcagcctgaacgcagaacctatttagtgctgtcccaaagacgccatcatagtcaaatctgttagatagctcttcatgcagtgcagtttcatctgttctga

SEQ ID NO: 7241 - DNA, 762 bp, Sorghum bicolor
  Clone ID: SORBI-28MAY03-CLUS73717_1
cctactggatgcctcaacaacccgtctccaagaaaccacctcccctcgctccaatcccaatccaaatccttcgccacgaaccaatagaacccaatccgatcagttccccccacgcaatttcccatctgagtttcatctctttctttttcaccgataataaagatccgatcgatcggagtccggcggcagctaattcaccggcgggattggagatgaaggtcgacagggaaatggagattctgctcaacgagatccccctcctccaccacggtggcctcctcggcggcagcggcgaggctggtgcggacgacgacgccgacctctctttcctcatccacgaactcgccgcgatgggcgtcgtggacggcgacgacgagccaccggcgccgggcgctgccaacggcttcggcttctccagcatgatgatttaccccaagaaaggcggcgagaatctggtatccctgcacccgttctccatggccggccactgcgcgcacatgccgtctctgtttgatcccgtcaccttcgctgccgccgacggctgggacatccggtgctccccgccgccttctgtttctgtgtcgccaccgcccgccacgccgagggcccggtgcaagaacgtgaggaggaagaacggcggctgcggcgcggtgacggcgacgagccccaagaagtgcggagccgcggcggcggcggcggcggcggcggccaacaagtcgcacggcgagagcctggccggcctgcgcggggtcatgtcccaca

SEQ ID NO: 7242 - DNA, 1048 bp, Sorghum bicolor
  Clone ID: SORBI-28MAY03-CLUS7386_1
gcacgagggaaggttctgatggcgacgggaagaaggtggatccccgctgccccaacgcgcccaacccgttccatgtctgcaccgaccactgcctcgccaagatagccgacgccggccgctcgtcggagggcgccaagtcgcccatttccctcttctcgcgccactcccgccgttcctcatcgtcctccgaagagggtagcttgaagtccccggggagtaggaaggtggatccaaagtgtccgaatgctggcaatctgttccatgaatgtggtgagcattgtgccaccaagatgcagcagacagagcagcacaaggggttcaatatcaaatccccacgcagaaaagggggaaagaatgctacagtgattccaaattggaaggttgatccaaggtgccctaatgcgtccaatccattccatatgtgtgcccagtattgctttgatcatctcagtgaaacagcgcagacaagtgcaaccaagtcagacaagagtagaggcaaggatattcctaaagatgagcgaagaggagaaatcaactctgattgtgtcaatgcatccaacccctaccacaagtgtggtgcggacgcgtggagaagagctagatcgcgagctagaactagtcggcgagacaagatctcttcagagggacgatcgacgacgacgacgatgaaaaattactaagtaaattccatcgacggaccataggctttgagctgcagcagaggctgttttgtagggtgttgcagctgtttgaatttgaatcctttccttgtgtgttcctcccctgtgtgcttccatatcatcatcattattattatttttttatttcgccatttccagcctatactagtgaaatgcatatatggcatattgtagttccattgtaatgtatatttttttcccctgatgatgaaggctgtacaaatagaagcatcctggagtatctgctgttctttttttccctctttcccttcacttgtgtaagtgtaagatataagaaccctccgaacttatagcaccaaaatgaaagcaaagcaggttttggtgtc

SEQ ID NO: 7243 - DNA, 614 bp, Sorghum bicolor
  Clone ID: SORBI-28MAY03-CLUS74570_1
cctctcgctccctcatccctatccccgacgcagcaccctcccccacaccccgacgagggcacgagggcgcttccacccctggcacgacgccctccctcacccgtggcgaagcgcgcggcgccctctccaccctcggtgcagcgccctcccccacaccaggacgaggtgaggcacagtggtgaaaagcgcggcgtcctcccccacaccggtgtcccctcggctgctttcctccaccatggcgtactctcctaccaggatcccccaacctagcgcgacactctccccacctcggtacagcatcatccccatcctctggtggcactctctcacccccggtgactgagctcctctcacccgacagccatgacgctcccagtgctaggatctcttccccaccctatgttgcaattgtatgtttcagctggtgcaggtgctcttgtggtccgctgccgtcctgcctagctcgagctcgcccgactgcgcgtcgccgcggcggccgtgtgcgccgggttggctcggggcacggcggcaccggcggctttcagcgcgctctggtctaccaccgctatgcttcatgtggttttctggatgcacgttgatgttgtgtttatggg

SEQ ID NO: 7244 - DNA, 960 bp, Sorghum bicolor
  Clone ID: SORBI-28MAY03-CLUS74741_1
ctgggcggtgccgtcccgtcccccgcgccgcgccgcccggcccccccccccgtcccccgccccgccccccccccgccccgcccccgccccgccgggccgcgccccctcccccgccgccccgtccttcgccgccccgccccccccgccccgccccgccccctcccccccccccgccccctgccccgccgcccccccccccccccgccccttcgccgccccgacgggtccggccatccccgccctctgctccccccacccctcgccgggctccccgtgcgcctccagcgggccatgaggcggcacaggcctgccctggtgcgcggcctcctcgccctctcagcggccgaggcgtcggcgctgcgccagcgtgcgtcctgcggtccgcgtgcccacgcggagcatgcatagaggacggactgctcagccaaacagctaacaagatttcagagctactacagctacggatctgcaatcagcatgctcgtgctttatgtggccaacctgccgaaatcctgtttcagcagcatgatgtctcaaatgcaattgatgaactcttgtccaagactcctgctggcctaactgaggctggaattcaacttgtgaaaactagggtgctggagagttctcaggacttcttcgacacgacatttacttccaacaaagtcaaagtatttaaatgccctgagctggtcgcggagcttcatatgcctttggcttgtcgagttcgccaatggatctctagaaataccatctgtgtggcaaccttttgtatcctgcactgctctggatactgtggatcatttacaggaggcgggcattatctaatagagctgaacaaatatatgagcagtaggtttgtgaaatccttgaagataatgccataaacgccaagattgataactccaattgtgagccttgggtggttacctcttggctcagggatcacctgctggttcctcg

SEQ ID NO: 7245 - DNA, 608 bp, Sorghum bicolor
  Clone ID: SORBI-28MAY03-CLUS74569_1
gcacgagggttcgagccaatccaagcgaaacaaacggcgtaacggcacctgggagcggcagagcgcccccccgcggccaccgcaccgcgtcgtcgtcgtccccagccaaccccaacccagcgcacccccaaacgaatccgccccacctcagccgccgtgcggacctccgaatcccagcgccggtgcgcgcacggcaccgcagggcgcggcgcggccatggacatggacagcgtggagtgcctctccctcccagacgctgccatggacgtggacgacgtcgacggccacccgcaccacggccaccacggccatctcggcctcccgctccaccccgcccacctcccatcctcgggcgccggccgcgcgttccccaaggtgaatgccgggggcggcggggcgggaccggcgggagcgggtgcggcgggggcagcgggcgcagcgggagcaggcggggggccaccggcgaccagcgttcacgagctgctcgagtgccccgtctgcaccaactccatgttcccgcccatccaccagtgccaaaatggacatacgttgtgttccacatgcaaggcccgggtgcacaaccggtgccctacatgcagacaagagct

SEQ ID NO: 7246 - DNA, 600 bp, Sorghum bicolor
  Clone ID: SORBI-28MAY03-CLUS74745_1
cctactggacccgcactctcaccaatccatggcgccaccgcgctgaacccccccaaccgccggcccgccctccgctccccgcgctccatggcgctctccgagctcccgctccaccactccttccgcctctcgtcccgccccaacatccaccgcctcctcccgctccgcctcctctcctcctccccggcctcccgccacgtctcctcctcctcctcgtccgccgccgcggcctcctccccttcatccaccggcggcaatcgcacttccccaccctccaccagcacgggggcgccgtggctgcagaagtgggcgccctccgacccctcccgcccggtcccacctccggctcccgtcccgtccccgaccacgtccatcgaccgcatcgtgcaccggctccgcaacctcggcctcgcctccgacgacgacgacccctcctccgtctccgctgccacggccgccgcggcgccccccgacggcaccgagcgcctcggcgacctgctcgaccgcagctgggcgcggcccgaccgccagttcgcggccgccagcttcgacgatgccgtcctcccgtgggagagagacgacgagcccatggggtcggca

SEQ ID NO: 7247 - DNA, 713 bp, Sorghum bicolor
  unsure (1)..(713): unsure at all n locations
  Clone ID: SORBI-28MAY03-CLUS73991_1
aaggacactctccacgccaaccggcccaccgcctctcctcctgctcctcgcgaccacgccgccgccgactatggccgccgccgaggtggagcccagcctcaacccggcgcccaccacggcctccgacctccccaacgtaagcaaaaccaaggcacgggaggccgaccgccgccgccgccgccgcaaggccaagaagaacaagtccgccgccgaggccgatgcccaggacgctgacgggggagcttctggctccgacgccaaggagaacgccgatcccaatcccgagctccaggtggaggtggagatagagtacgtgccggagaaggccgagctggacgaccctctcctcgatgactttaaggccatcttcgaaaagttcaccttcaaggacgctgccgcagcagcggccgaggatggtaagaaagatgagggtgccactgatgccacgaagaagggctcagatgacgacgacgacnaagacgatgagcaggaggcaaacaagaagaaagaaggagggctgtccaataagaagaagaagctggagcgcaggatgaagattgcagaactcaaacagatatgcaacagacctgacgttgtagaggtctgggatgcaactgctgcagatccaaaattgcttgtatatctccaggcatacaggaatacagtacctgtccctaggcactggtctcaaaagcgcaagttcttgcagggta

SEQ ID NO: 7248 - DNA, 592 bp, Sorghum bicolor
  Clone ID: SORBI-28MAY03-CLUS74055_1
ggaccttccccccgcactttcctctccgcctccaccagcagcaagcgcccggccgatgcagatgccgccgtggcggccgatctgacgccatcggtcgccggccatgaggcctcaccgccgggccctcttcccgggcgcaggggactgcgaggacccctggtccgccggctgccagacgccaccgccggttcccagctcccttgattacggccctggcccttccccatcgctgcctcccttcgcggggattccgctgtgccctccacttctccagccgtcgcctgctcccgcgcataacggtaggagggaccagggaggagggatgcagcagggatacggccccccaccaccgggcgtcggcggcgatgcagacgaccacgcccgacggcacttcgtcaagtacgcgctcatcgccgccggggtgatcgctttcgtctcgctcatcctgctcggcgtctcggtcgccgtgcggcgccgccaggtccggcggaggcggcaggcgctcctcgcgccgtccctcaacgcgggcggcgccgcgaacgtcgacgacggcggcggcgggtggggcggcggcggaggaggaggaggcggc

SEQ ID NO: 7249 - DNA, 901 bp, Sorghum bicolor
  Clone ID: SORBI-28MAY03-CLUS73999_1
atgccgcgcggcgcgcgtcagcctgcctcggccgccgcgttcgtcgacccgtcaatcagccccacgccggcactgatcccggcgcggtttttttttttgtcccgtgccgcccgccgccttcgacgacgccaccgcgagaggggatggtgccgtccacggcttgctctcttccccatggcctctcgctcgggttcagccgatcctataacagccgcttactgcgtctctcccgcaccggcctcggcgccgcctgttcttctccgagcggaagcgagagcccgtcaggactgaaatctgccggaaacctgtatctttatccattatcaaggggaagtactgttgtgtgttcagtgatgggtacacccaaaagcaagcaagaaccagaccatctccttgttcttgtccatggtatcatggcaagccccaaagactggacatatggggaagcagttctgaagaggcggttgggtgataattttttcatatatgctagttcatcgaacaactacaccaaaacctttgatgggattgatattgcaggaagaaggttagcaaatgaagtcttggatgtggttaacaagatgcccactttgagaaagatttcctttctagcacattctttgggtggtttgtttgctagatatgctatcgcagtactccactcagtggaaacaaagaacgcaggacaaagtagtgcacttattgttcctacaacaaaagggccaccaaaatcaagatggacttcaggattaggttcaattgctggattacagccaattaattttattaccttagcaaccccacaccttggggttagagggagaaatcaggtctatcaattctagaaaaacttgccgcacctttggctcctttaattgttgggcgtactggtgctcaactg

SEQ ID NO: 7250 - DNA, 698 bp, Sorghum bicolor
  Clone ID: SORBI-28MAY03-CLUS74029_1
cctactggctcacccaaacctcagcaccgccgcgtcgctggcgccccgtccagaactctccgccgccgccgtcgaccagtgacccgccgcgccttgcagcggcgacggaggggccagccaaccagccatgacgacccgcatagcgccgggcgtgggcgcgaacctgctcgggcagcactcggcggagcgcaaccaggacgccaccacctacgtcggcaacctcgaccctcaggtttccgaggagcttctatgggaattgtttgtccaagcaggccctgttgtcaatgtgtatgtcccaaaagacagagttacgaatttacaccagggatatggatttgtagaattcaggagcgaggaagatgcagattatgccattaagattttgaatatgatcaaactatacggtaagcccataagagtaaacaaggcttcccaggataagaagagcttggacgttggagcaaatctgtttattggcaatcttgatccggatgttgatgagaagctcctctatgataccttcagtgcatttggagtcattgtaactaatcctaagataatgcgagatcctgaaactggaaattctagaggctttggttttgtgagctatgactcgtttgaatcatctgatcaagcaatagaggccatgaacaaccaacatctatgcaaccggccaatcactgtctcttatgcttaca

SEQ ID NO: 7251 - DNA, 631 bp, Sorghum bicolor
  Clone ID: SORBI-28MAY03-CLUS7412_1
caacctttcaaataatcagctgaatggttcaattccagagctcggttcgctgttcacattcccgaagatttcatatgagaataactctggtctttgtggcttcccactgttgccatgtggacacaatgcaggctcaagttcttctaatgaccgccgatcccaccggaaccaggcttcactcgcaggtagtgttgcaatgggactcttgttctcgctgttttgtatagttggtattgtcatcatagccattgagtgcaagaagcggaagcagatcaatgaagaggcaaatacctctcgtgacatatacattgatagccggtcacattctgggactatgaattccaacaattggagactctctggtactaatgccctcagcgtcaaccttgctgcattcgagaagccactgcagaaactcacctttaatgatcttattgtggccacgaatggcttccacaatgatagcctaattgggtctggtggttttggggatgtctataaggcccagctcaaggatggaaaggttgttgcaatcaagaagcttatacatgtgagtggccagggtgaccgggagttcactgcagaaatggagacgattgggaggatcaaacatcgcaaccttgttccgctc

SEQ ID NO: 7252 - DNA, 699 bp, Sorghum bicolor
  Clone ID: SORBI-28MAY03-CLUS7413_1
ggaatactcatagagatgatgggtcaacagcatcaacagcagtgttggttggtgaccatctttacgtggcaaatgttggagactcaagggctgttatatcaaaggctggcaaagcgattgcgctctctgaagatcacaagccgaacagaagtgatgagagaaaacgaattgagagtgctggtgggatagttatgtgggctggaacttggagggtaggtggcgtacttgcgatgtctcgggcatttggcaatcgtctcttaaaacaatttgttattgcagaccctgagattcaggaacaagaaataaatgatgagttggagtttctaattatagctagtgatgggctgtgggatgtggttccgaatgaggacgccgttacacttgtgaagatggaggaggaacctgaggcagcagcccggaagctgacagagacggctttctcccgtgggagcggtgataacatcacgtgcatcgtggtgaagttccagcatgacaagccaggtagcagcggcggcggcgatcccccctcttcgcctccaggcgacaagagttgattccatttgttgttggttatacgtgttgttgggtccttttaacctgagccggattttgctggccccatccatggtggcccccgcggctggtacttaagaaaggagttggttcatgttcgttgcctgtctatatatgcccttaatt

SEQ ID NO: 7253 - DNA, 672 bp, Sorghum bicolor
  Clone ID: SORBI-28MAY03-CLUS74130_1
tttcattgaagaaagctccaaagggtccatttcctctgagctcctttgtgcccacagatgagcgtttttgccagaggtgggctgggactagcttggagacataccatacattcagacagaggttgctgctaacaggttttgcagagaagtctggaaggaaaacactagtctcaagacggtagatgcctagggggtgggaatgggtttcttttgagcacgtgctcctaacagaaatgggcttggttgctgacttggtacctgatgctcactgggtttatactacatcactaactatagcttatacttattgttcataccacctctctaaaggtgaagtctcatcgaatgccctcaatcagttgcaaatggatgacaatcagagagaaatgcattatgccagttgccagaatgattggagggacactttgttatctagttctaggagtacctcgccttgattgctagttactatagactacaactacggaacaaaatggctacgttagaaaaatgtagcctaactgtgtaagagtgccattacaagcagccttctgtgctgctgtaattctgtaatgccgtttgaccttgaggtttcctttttgaagtcttgttatcatgaatcatagacggcttgtacatcctaccatttcatggttgttgtgttagaacttt

SEQ ID NO: 7254 - DNA, 818 bp, Sorghum bicolor
  Clone ID: SORBI-28MAY03-CLUS75306_1
cctactgggtctctctcccggccctctcggtctcggccgctccccgcctccctccccctccccccccccctctctctctctctctctctccgcctctccgtctctctctctctctctctctctatgtctccatccctgtaactgtatctccctctctctcctgtacgagtcgtcttctaccttcgtcttctccctcccactccgtctctccgtgactctccatctctctatggaccctctctctctcccccccccccttcctctgtctctccccgtctggaaccgattgaaagtttgatctgtttttcgtctatagatccagctgtagattatttgatgtttttatcaatcttcaagtgtacagtcgcctcaatcatcgatagatctttcatttgcgattactcgattattcctcaatttttttcttcagttctttctatatctcctgcattttgttttttgtcctatagatctaggtttttttgcgatacctacggatccagatttagcttatttgacatttttatcaatctttgaactacttcatccactagattaaatgtgttttattttaaaaaaatccagtgtggcaacactatcacctaaggttaattaattcagtcttccattctgttaattattcttcagttttgttttgtattataagcaatgtgattttgacgtttaggctgcacaagaataaaatgaggacaactaacctgaaagatatatttttctattagttcaaaacatactcctcatattcttgcatttttgtagtgtgcatactcaccatcattacttgtctttcttctcta

SEQ ID NO: 7255 - DNA, 724 bp, Sorghum bicolor
  Clone ID: SORBI-28MAY03-CLUS75354_1
ccgccaggcacctgccgcctttcagctgccccccacctgctccactcccccgccgccgcggcccggcgcggctgccccgacgcggccccgccgccgcgcccccgcccccgcgccgccggccacgcccccccgaacggcgccgccccgccggggctgcgccgccgccgcctcgccgcctccgccactgcacgccgccacgacgacgcgaaggaggccgtgaagtgggagcggatcacgtacgccgggatcgctacgtgcaccgtgctggccatgttcaacctgtccaagggacaccaggaattccccgacccaccgccgaacccgtacctgcacatcaggaacaaggacttcccctggggtcctgacggcctcttcgagaggaagaagaagcactccaacgacattagcggagctttcatgagcttggacaatttttattaagcaaaatatttaaatagaaatttacagagttttattttgatataaaaattttttccttttgaacgtctccgacgagcccgcccggccgcccggggtggccgggcgggggctccgccagtgccaacgaccatcactaggtctagctactatagctagcacgaggctgcaacatgtactggctcaatccttgtgtgctgtctaattttggaggacttgctgtacggcgaagtcacaacgataggcactcgagactatatatatgtgtgtgcagttttgcagagtg

SEQ ID NO: 7256 - DNA, 583 bp, Sorghum bicolor
  Clone ID: SORBI-28MAY03-CLUS75399_1
atgaaagtagtgaatggtattcagaccatcttgattcaccagataatagacttgattccccaagggtgtggccaaatgaagcgctagggtcacctagcatttggtcagatgaaaggcgtaatttggcaaggctgccacagatcaatagagtttcacccaggctttcattaggcagtaggcgaaccttgcattcaggttggcagggggttcgtcggtcaagcacacggagtctgctgcaacggggcttctcaaatcactactctggacaccgccgcagcaactaccgtggacatcgtcacatgcttctggataggtcttatgctggtacccgaaattcaggtactggcaggagcctaaatccgtcggtggtgccaagcaggcggcagcggcttcggtacacgcacagaagtcactactgatggaatcaataccagttccaccgtagaacttcattggttgatccatccatgctatctttgtaaatatatgcaaaggctacgttttttatttagtgtatttaatctgtgtaaacaatctatcccagatgcaaaaggatctatatatttctctccaatgccattta

SEQ ID NO: 7257 - DNA, 822 bp, Sorghum bicolor
  unsure (1)..(822): unsure at all n locations
  Clone ID: SORBI-28MAY03-CLUS7552_1
ccgccgcctacctgctgtacaacgccgaccgagtcgctgagtggcccgatctgctgcagatggccgttgtggatctcatccgcaaggtctgccgatcccagaaccgcgccaacaagggaaggtatatcaccatcattacctcgctgctctccacgcccagcactgcggttgtttatgaatgtgctggcgccctggtgtcactctcttcggcgcccacggccgtgcgagccgctgccaacacctactgccagttgctctcgtcccagagtgacaacaatgtgaagctcattctcctggatcgcctcaacgagctccgcatctcgcaccgggatgtcatggtgggggtggtgatggatgtgcttcgtgcactggccagccccaacttagatgtcaagaggaaggttcttgatttagtgcttgatctgctcaccccgcgtaatgtcgaggaggtggtgctttatctgaagaaggaggtggtcaagacgcaggccggagacctcgagaagggtggcgagtaccgccagatgctggtgcaggccatccatgcctgcgctgttgagtacccagaggtggctgggtctgtagtgcacctcctcatggactttcttggtgacaccaatgttgctgcagctgttgatgttgtgctgtttgtccgtgagatcattgagaccaatccgaagctgcgtgtttccatgatccaaaggctgattgatacattctatcagattcgggcatcccgggtctgctcatgtgctctctggatccttggggagtactccctctctctttcagaggttgaaagcgctattgctaccattanaa

SEQ ID NO: 7258 - DNA, 599 bp, Sorghum bicolor
  Clone ID: SORBI-28MAY03-CLUS7426_1
gtcatttgttgcacctgtgttggtgctggagatcctcgtctttcaaacttccgtttccgacaagttcttattgatgagtccacacaggcaacagaacctgaatgtcttattcctttggtgcttggtgtcaagcaggttgtccttgtcggagatcattgtcaactgggtccagtcatcatgtgcaaaaaagcagcccgtgcagggttagcacaatctctctttgaacgcctcgttatccttggagtgaagccattcaggttacaggtccagtatagaatgcatccttgcctctcagagtttccatccaactgcttctatgaaggcacactgcaaaatggagtgactgttaatgagaggcaatcgtctggaattgattttccttggcctgttccaaatcggcctatgttcttctatgtgcagatgggacaagaagagatcagtgctagtgggacatcgtatctcaatagaactgaagctgcaaatgttgaaaaaattgtaacaacatttttaagaagtggtgttgtacccagccagattggagttatcacaccttatgaaggacaaagggcatacatcgtaaattacatgtcaaggaatgg

SEQ ID NO: 7259 - DNA, 680 bp, Sorghum bicolor
  Clone ID: SORBI-28MAY03-CLUS74317_1
tggatcccaatccaaccagaagcccacacgactcccgatcctatcagttagcggtggcctgaccggcggctagccggattttacttgcggctgccgccgcccgcccgccttcggccgtgctcccccaccgcaacctccgggttcactactaccagggacttccttgaattgtcgatgagcgcccgagcgagcccgtgacggaagcggcccggttgctccgaagctccgttctacgccatgctcgccgccgccgccacggcggtggccatccctccggcggcttctcattgttttccagcaaatacggccaggaaatggaggatttcctggagatgtcgggcggcaagagtcgaggctgggtactcccaattggaggtgagaaaagtcacctatcgacctcctggaactgaacagaacttattgaaggaaattaacctctctcttcgggagaaaagttttggtttgatatttggacggagtgggagtggaaagaccacccttttgcagcttttggctggtctatcagaacctacctctgggtctgtttgcattcagaagtatgatgatactgggaatcctattggcttgcccgaactgctaacttctcaacgagttggaattgtatttcagtttcctgagaggtatttcttagcagatactgtacttgaagaagttacttt

SEQ ID NO: 7260 - DNA, 665 bp, Sorghum bicolor
  Clone ID: SORBI-28MAY03-CLUS74277_1
acctcataccggtggcggccatggccgccctctttgcttcacgtggtggcgtcaagtgcaccatactcaccactcccgtaaacgccaccgtcatccgctcggccgtcgacaaggccaacaactccttccgcgggacctccgccctggcgatccacatctccaccatccccttccctgatgtcggactcccgccgggcgtcgagagcgttgtcggcatctcctcagagtccgacctccacaagttgctggaaggggtccagcgcctccgcgagcccttggatcggttcctggccgatcaccgccacccccgccccgacgccgtcgtggtcgacagcttctacctgtgggccgccgacgtcgccgccgagcacggcatcccacggctgtctttcctcgggagcagcctgttcgcccgggcctgtaacgagtccttgctgcgccacaacccgttcgcgctcgctccggatgaccccgacgccgtcgtgtccctgccggagctgccgcaccgcgtcgcgatgaggcgcagacaggtgatggacccaagaaaggaccagctggagtgggaatacaaccagctcgtgcacgccgcggaccggaggagctacggcgaggtgttcaacagcttcgccgagctggagccggactacgtcgagcactaccgcacg

SEQ ID NO: 7261 - DNA, 905 bp, Sorghum bicolor
  Clone ID: SORBI-28MAY03-CLUS74465_1
cgctgactgactcgctgagtacgattcgcgaaccagtcccgtttccttgcgcggctgcagacgagagagggggagggagggatcatggtggcgccggacgtgaaggcggagacgatgaagctgatggatcagcggggtggcctggaggcggaggtggacgccatcatcgcccgcctcaccgagcccggcgggccgggcattaccggcggtctcgtcgacgccgagggtttccccaggtccgacatcgacatcccgaacgtgctcgcccagcgccggaggctcgctgaattgcgaaatgatcacaaggatgttacgaacaaaattgataaaaatctggagattttacactcagcaaagctatcaaggaatgagcaatcaacctcgaggaggtctgatacaacaagtccttcacacattggatcatctcaaagtgaacctatggaagaggaccatgtgtccaaacttccttttgccatgattgatgaaatcacagatggttctcctgcttctgtggatggtttgcaacttggagatgagatagtaaagtttgggaatgtggaagctggtgatcaattgcaggaaaggctcgtctctgaagctctttccaatgaggatagtcatgtatctttagtcatcattcgccaggggtcagcaatgaatttaacaattacaccaagaaagtggcatggaagaggactgctggggtgccattttcgaatgctatgaagtgtcaacgttcttctgcaggatgcgtttgtctatcatgtttgcacttgtggagaaggctctagcaatgtcatttcagccgcaaaatgaactgatttaactgaatgtgtggcatcttccaaaatactgatggcatatacttaacctgtggagcgcttgaaacatactgtaccggtgta

SEQ ID NO: 7262 - DNA, 573 bp, Sorghum bicolor
  Clone ID: SORBI-28MAY03-CLUS74546_1
ggcgttccagcttgggatggcacctgtatacatggccttcctccgtttcatgggggacgagaacgaggcgaagaactacagctacagccttgaggttggtgccaatgggaggaagatggtctgggagggcacccctaggagcgtccgcgacagccaccggaaggtgcgggacagccacgacggcctcatcatccagaggaacatggcgctgttcttctctggtggtgaccggaaggagctgaagctcaggatcactggtcgcatctggaaagagcagcagaccccagacggcgcctgtattcccaatctgtgtagctaagcgattgcaaaggaaatggcgctgaattggctggatatggtgcatacaatcctgctgccataccttgctattcttctaatcgtgattggggggcaaatctctcagtgttgtgtcttggctaaaaaggatattaggaggataggatgctcctgtaaatgaaattgtgtatatggcatcccttaattatctcacagtacagatgggctgatcaagctctctgctgcctgacaaagttgtgttttcatcggaaaaaa

SEQ ID NO: 7263 - DNA, 697 bp, Sorghum bicolor
  Clone ID: SORBI-28MAY03-CLUS74564_1
ctgttggcctaccggaacttctctttctttccccttcctctcacgcaccctgctgctcctgccggctggctgccgccgctgatccctctccctctcttaccacaagccgcaattgccggctgctcctctttctctcacccccattgttgcctgctggaggaagtgggaaaagaaagatggcttcttgggagtgagtaaggatcacatgatgcaattacctccatctttctctcttctctttttgtgggcggcatattcttctcctccgcctgtctagatccttgtttcctcggcccggcttagcttccaatctcaccaacggtccaagttgctgaccacggagcatttcttcaaacgggtcattctctgcgccggttccatcgggttttgatgcaagagtaggggacttggcaggctgttgcgactggtggttggagagcaggaaccaatttcatggcgtgtgcccccctcccttttagccagattgaggacaatttcagccaattttgtaggaacccgttaaacccatccggagaatttttcttgcgcctcctatgattacgagctgtgtctggacagtgcctacgctctggagttttagtgcgaattgttaccggtttcagtcaattttgatcaagcccagggaaagtaccaatttgggagttccagctggtgctgctgtctgcattcttccaag

SEQ ID NO: 7264 - DNA, 747 bp, Sorghum bicolor
  Clone ID: SORBI-28MAY03-CLUS73925_1
caaatgaagcagatgatagcagtctagccattgcagatatatgtccgagtattgatggctcattggttgctgtagctattcaaagtttcagtggtgtaatgcttttagcatgtgatttagtaggaaagaagttatctttcctaaaggtgattacgatggaaaagagttatattcctactagcttagcatccagcctgtcctcagaactcctatggactgtcatgggcgcatcaaacatgcccaaccaggcttcctcccatttattaacccgtttaaggatcataccatgtttccaaaaggacagattatcttcttctgatgccggtcctgcgacccttgaagacggtgaggtaccacacggtgagaagctccttttggcactgcaaggaagcctcgacgtcacaaagcaagaggaggtgttagcttcagtgctggctgcgctgaaggtttcaatgcataagatgctggtgaagaagcactactcggaagagaggagggagcagaggaaaagaggtaggaacgacaagaagatcaagaactagtggctcagcatgcggtttcaagtttccacactaccgtagaacggttctctgttgccttgctgtaccattagtttgagaaaaaaaaaaccccagaatactactgtagtatcaccagccgtaagagtaataatttgagatattgtaacagtaattcatgttggttactccaagtaaaattttgcgcagctttgcgtttccttgtccc

SEQ ID NO: 7265 - DNA, 704 bp, Sorghum bicolor
  Clone ID: SORBI-28MAY03-CLUS75811_1
gcgctgtggctcactaccttccccaacataaactagtgaagagcctcccaaacccccgagcaaatactcccaaccaaccaaaattcggatgaagagaaaagctgcataattctcataaacacacagacaaaataaaaaggagacaaagatggcttaaaactccaaaaaccaccatgaaaaagagcttctctggcccccgagctgctggcatttggtgtctcctttttcgtaacctcctggtgttgttctcttatcccaaatcccaaggcgtcgagggaataggaagctagaaagttcatctgcagctttgctcatggcctagctagctcaggccgtagctgagcgcccatgggtcagggagtctgaaccttgcccgctcctcctttcacttctctctcctcgctcgtgttcccggcgtcttactggtctctgggggactggagagtgaaggtctccttcgcagctgctctagtagttcttcaatggtgggcgtaggtgctggcttgggcttgggcatggaaggtcccagctgtggtgctctgctcagggagcttcagcaaatctgggcagaggtaggagaaagtgaggccgagaagaacaaggcgttgctggacatcgaaagagaatgcttggaagtctaccgcaggaaggtggacgatgccaatcggactagggtccagttgcaccagtcagtggctgccaaa

SEQ ID NO: 7266 - DNA, 581 bp, Sorghum bicolor
  Clone ID: SORBI-28MAY03-CLUS75822_1
ctactggtaatcgccgccgcccacccctccgacgctgggcgtctgctgccgaatttgcagaccccggctaccttcccgagctcgccgcgctcctctggtcctcccccacccgcacgcgcagcagcagcgccgtcaccgcatggcgctgccccaggtcttcgtcggcggccgctacctcagcggcgccgaggaggtccggcgcctccatgagtccggcgagctccgccgcatcgtcgcccccgccctcaccaaccccgcgttccccggcaactgcgcccgctgcggcggcgagcgctacgtgctgtgcagcgcctgcgacggcagccacaagcggtacagcctcaagggcggcggcgggttccacgcctgcaccgagtgcaacgagaacgggctcgtccgctgccccgcctgctgctgcatccccgtccccgccgcctgatccagatccaccatccaactggtcctggttttctctctagttattactactcgaactctctaggactacctgtactctgtactactcagcttgccatcaaacttgattaggacgaagctagttattagtagtactagtgatt

SEQ ID NO: 7267 - DNA, 723 bp, Sorghum bicolor
  Clone ID: SORBI-28MAY03-CLUS75888_1
atgaatgctttagtttcatagatgaagctataagctctggaggcaattgtttagtccattgctttgctgggcggtcaaggagtgtgacaatcgttgtcgcatatctcatgaagaagtatcaaatgagcctcgaaagtgccttgtcgctagttagaagtaaacgacctcaagtggctcctaatgaggggtttatttcccagctggagaagtttcagaaatcctttcaagtggagcaggaacggagaatgcaatctgtgcagaattaactcattatattataataggtgtagaggccttatatgttgtgaatgcatatgcgttgtcaagagcgtcctgactgcgtattatgtcatctggataacaagcaaggccttggcaaactggtggtggtgggactccactgctttatgttgtaaacagcaagtgacgttgttcctccattgggatgcagtttctcttctaatgggtagtatcatatatagagctgcaattagcacttcatgaactacaacatcaagacactcaaagaaaaagcctgctcatgtcaccaagctaaacagacactaggatgatggtgcttgatccggtgtctcgtagatttgtgctatgtaatcatgcttgatttttcatgtcacttgtttttgtaaacctgggttccaaatattgtgaaacatcctacaatctcaaagtcttcttttttccaatgatgtcacctatcagatc

SEQ ID NO: 7268 - DNA, 756 bp, Sorghum bicolor
  Clone ID: SORBI-28MAY03-CLUS75899_1
cgccttcgtatatcattgaagaggatatcaagcacttccattctgttcagaaacaagtgtgtgatagctatgatcctagcttttaccctagattcaaaaagtggtgtgatgactatttttatatcaagcatcgtggtgagcgacgtggggtgggaggaatattttttgacgatcttaatgactatgatcaagaaacacttcttcgctttgccacagattgcgcagactcagttcttcctgcatatatacccatcatagaacgtcgcaaagacactctgtttactgaggagcacaaagcatggcaacagctacgtagaggtcgctatgtggaatttaaccttgtttatgatcgaggaaccacatttgggctgaagactggggggcggattgagagtatccttgtttctcttcctcttaccgcacggtgggagtatgatcataaaccagaagtagggagtgaagagtggaaacttcttgacacgtgcataaatccaagggaatggatctgacctgttcagaagtgcttgccctttcttcaccttaatgttaatagaccactttgatcttgtatgcggatttttcttttacagctagtgtgattcccttgagcgaccttagcaaatattttacatacaacatatatgccatcctactgcttttgacatagattgatagagttaggaatctgaatcaaaaaatttgaggtgaaacagtacaaatcttttgtacaagacataattgaggtaattttttttc

SEQ ID NO: 7269 - DNA, 626 bp, Sorghum bicolor
  Clone ID: SORBI-28MAY03-CLUS75845_1
cacggcgtcccctgtaaaaatgtcccccgaaaacccccacctccgcttcctcctattcctcgccgtcgcggccgtcgccgccggcggggctgcagcgggcaccaccctcaccgcgtccctctccggcgaccagatcaagatccgctggacgggcctcccggccccggacggcctcgactacgtcggcatctactcgccgccgtcctcccgcgaccgcgacttcctcggctacctcttcctcaacggctcggcctcctggcgcagcggctctggggagctgtccctcccgcgcctcccgacgctccgcgcgccctaccagttccgcctcttccgctggcctgccaacgagtactcctaccaccacgtcgaccatgaccagaacccgctcccccacggcaagcatcgcgtcgccgtctccgccgacgtctccgtcggcgaccccgcccgcccggaacaggtgcacctcgcgttcgcagatgggatcgacgagatgcgggtcatgttcctgtgcggcgaccgcgggaagagggtcgtcaggtacgggctgcagaaggaggacgagaaggagtggaaggaggtggacacggatgtgagcacgtacgagcagaagcacatgtgcgattggc

SEQ ID NO: 7270 - DNA, 860 bp, Sorghum bicolor
  Clone ID: SORBI-28MAY03-CLUS74811_1
tcctgcggccggggcacgcgtcgctgacccatatcgcgccgctgggggtgtccccgatcgcgcaggaggacttcggtgtcccctccgcccggatggggtctggagtacgagcagtacgaggtgcgcgccggcgagagctcgctggcgcgcctctacgcggcggacgacgcggtgctggccgacccggagaaggcgatgcgggaacaggggtgggacctcgtggcgcgcgtctaccccggcggccagaacgtcacccttgacctcgctaggttccgccggacgctggcgaggatgcacgcgcacgcgttgcagcagcggcggcgccggcgggagagacggtgatggccggccgcgacaggtatggccggctagtgacaggtacgtactacggacggcagcgcaccgcggccggccggctgtggcagggcatctcgggagcttgacaagtgttgtgctctggtcaccatatgaatgcatcgtcacggtaccgtgtagtagtgcattttggatggatgggacagaagaggcgttcgtgttattgtgtcctttttgtcgtgtgccgtgtgcgtgacggggtcggaaatacgtggaatattgccgacgaccgctaacgtgacggtagcatacccgatcgaatgtccgcacacatatggtgtgacgatgcaccgttgacacatactgtatctgcaacattataaataacatatcttgattatatctgcatcctgcatgcatgtatgcatactcacttttttgggagtattatgtttaggaattcttttcatgaacctgtacatgtgggtgtgattccctatgctacactgacctcagaagttatatagagttgctttgtttttttt

SEQ ID NO: 7271 - DNA, 650 bp, Sorghum bicolor
  Clone ID: SORBI-28MAY03-CLUS74857_1
agcttgagcagaaaccctagccctagatcccccaccatggatctgctccagtcctcttacgcgccggacggcgcctcgtctccggaggactcggcggccgcgtcctcgccggattcctcgccgctccgccttccgtccaagtcggcggcccccgccgtcgacgacacggcgctcgcgctctcctccgccgcgtccgccgcccgcccgctcgacccttcgctccacctcgtcgccttcaaccccaccgccgaccagctctgggctcccatcctcgggccccagcacccccacgccccaatctcctccgcctccggcaaccgcaaccacaagcttggccacgttgaggacgccgcggtcctgccattcctattcgacgagcagtacaacaccttccaccggttcggctacgccgccgacccctctggtctccacatcgtcggcgacgcccagacccaggcgcccgagcccgacacagtctacaacctcgccccctccgagcacaagcgccgccgcctcctggccaaggcggacaaccaggaggagcccgcacccccgggggctaagaaccccgcctccgaggaatggatccttcacaacaagcagagtccctgggctgggaagaaggaagcgcctcctgcggagctcaccga

SEQ ID NO: 7272 - DNA, 633 bp, Sorghum bicolor
  Clone ID: SORBI-28MAY03-CLUS74975_1
cttttcttgttggtggccgaaagatggaaggagatttcaaggtccttgaggatttggacattccagaagagctgagagacatgttcatctccattccggaggaaatgtttcgcatagatatttcatctactgaaataagaaagagccatgggctctgatgtatcaaatatggtcatatactacagcagatttgggatgattctccacaaccatagaaggaaattggaatcgatcctcttgtagaacctcttgatgtcttcactaccccttgcggctaggtggtcaacctctatctcatatctttggtacaatgctggcaaagtgtgggcgcagagaaatcctgtggaagaaatataagacttgttaaatgtatagtcacaactggttttgtatggtgtcttgtatgtttatcttgctataaaaaaacactattttctgcgctactcaccaagatatagtagacttgtgaagctgtaagaacttcctatctcggacaatattagcagtgacacgaccaccttagaattagaaacagaacattgttagtgcaagactacagtgttgtaaatttcccaaaattctattagattgtcgaatagcattggcaaagtaatggcattgctttccacgctt

SEQ ID NO: 7273 - DNA, 874 bp, Sorghum bicolor
  Clone ID: SORBI-28MAY03-CLUS7522_1
gcacgagggtctgatatagcagaacaaagtggagaagtagtctcccgttctgtgacgggatcaatgatctcaagggactttggatatgcggatgctcatatggatagacacatggtacctaggcagattccagcagcaactggtcctgcggattggcgtgaagctctcgagatagttgcattgggtttgcctgagcagtccgttgaaggtatgaaagttatatgccatgagctaacgcaggcagctgaccctgaaagcacggtgcttgaagatcttattaaggaagctgacagattagtgtcatgcttggctgttatggttccaaaaaccttcaattttagcttatctggggcttcttcaaggtcttgcaaatatgttttaaatacactcatgcagacatttcagatcaaacgtcttgctcatgctgtgaaggagggtactcttgacaaccttattacggagttactcctttggcttttagatgaaagggttcctcttatggatgatggcagccaattactcaaagcacttaatgttttaatgcttaaaatcctggataatgctgagagaacatcctcgtttgttgtgctaattaatttgctgaggccttggattccttcaagatggccatcgcctacaccagcagagtctcttgctgtaaaaaatcagaagttttcggacttagttgtcaaatgcttaattaagttgacaaaggttcttcagagtacaatatttgaagttgaccttgatcgaattcttcagagcatccatatttatttacaagaactaggaatggaagaaatacggagaagagctggtgctgatgataagccattaagaatggtcaaaaccgtattgcatgaacttgtgaagc

SEQ ID NO: 7274 - DNA, 666 bp, Sorghum bicolor
  Clone ID: SORBI-28MAY03-CLUS74994_1
atcagcgctcgtatccgcagcgcccggaatggcggcaccctcccacgtcctccccttcctctcccccgccggcgggtgcgccgcctcctccgcccgcgcccgctcccactcccactctggccgccgcgctggaatcctgcgctgctcggccgcggccggccaggcgggcttcttcacccgccttggtcgcctcatcaaggagaaggccaagagcgacgtcgagaagctcttctccggcttctccaagacccgcgagaacctctccgtcgtcgacgaactcctaacctactggaacctcgccgacaccgaccgcgtcctcgacgaccttgaggaggcgctgctggtctcggacttcgggcccaaaatctcgttccggatcgtcgacacgctccgcgaggagatccgcgacggcaagctcaagtccggcgccgagataaaggcggcgctgaaaaggtgcatcctggaactgctgacgagcaagggcggcaactcggagctcaatctcggcttcaggaagccggctgtcatcatgatcgtgggagtgaatggcggtggaaagacaacctcactagggaagcttgcttacaggtttaagaacgaaggagtgaaggtattgatggcagcaggtgacaccttcagagcagcagctcgtgaccagctagaagt

SEQ ID NO: 7275 - DNA, 613 bp, Sorghum bicolor
  Clone ID: SORBI-28MAY03-CLUS75278_1
ggcggaggagtattacggcgaaaagagtctcgaggacgccgtcatgccgcccgccgcattcatcaaccagatcgcggccggccttcgccgcgcgctgggcctgcaactcttcaacttcgacatgatccgggacgtccgcgccggcgaccgctatctcgtcattgatatcaactacttcccgggctatgccaagatgccagggtacgagactgtcctcacggatttcttctgggagatggtccagaaggacggcgtggacaaccaacaggaggagaaaggggccaaccatgttaccgtgaaataagatgatggcactggatatctggcgaatgctgctggttctggatgcataattcgatagaggggattttagttggatttcaaccggcagcatgcggaggaccctgcgccttgctgtgtaaatcctttctcctaactctttccataccagttatttaggtatctttctgttttcctgggtaagtcgcttcatctagtttagactgtctggaacaaaagagagggacataactcaaactggaattcgaatgaaaaatgagctctctatctgcaatccttttgttcttgagcaatgaatgaatggcaaatgccg

SEQ ID NO: 7276 - DNA, 557 bp, Sorghum bicolor
  Clone ID: SORBI-28MAY03-CLUS76244_1
acgggcacgagggcagctcggctcttcatcagagcttagctatagcctagcagcagcagcctcctcctccctctctctccagcatctctctctgcctcttcattcggccatctctcagtacacagagagataagtgagagagatatatggaagagaggggggttgcagcaatggggagagcccaagccttcttgttcctgtcgctgctgtgggtcgccatgctgagtgctgctcctcgcgtggtgcaatctcttccttacgactactcgtccagctctgagtgcttgccggagccgctggagcctcagtacggcggcggcatcctccggaacgccaacttcagcgctggcctccagggctggtcgtcgttcgggtacggcgccgtcgaggaaggcttgtcagagagcggcaacagctacggcgtggcgcggaaccggacccggccgtaccagagcgtcagccagaaggtgttcctgcagaacgacacgcactacactctgtcagcttggttgcaggtcagcaatggtagcgccgatatcagagccgtggtgaagacc

SEQ ID NO: 7277 - DNA, 780 bp, Sorghum bicolor
  Clone ID: SORBI-28MAY03-CLUS7626_1
gtggaggagttatttgaagaaggctctgcaatgttagaagaaaggttgggtaggaatttgtccttgaaagcagcttcaccaccttttcgctgtgcaatctgccaagtggaccaagagccattcgaagatttgatgacagataatggaggtggttactgctcttccccatacgctccatggggtggtccacatctctgtttggactgtcggaagaagaaagatgcaatggaaggtaagagatctagccgctctacagcatgcaggtgaaacaatcaagactctgtttaagtcaagcctgcggcctgcctgcttcacagagaaaagaagcaatgagaggacaataagttgctggatccaagtataattgtttgctgaaactaactgtattgccagcccggtacaaaacatatttggttggtgagcgctaactagtctgttacctgcgtacaacccatatggaaaagtttgatgttgcggaaatagctccaatgacgaggttgtagtttgacggtaccctgtagtgtgcctcttgtgcagggaaacattgacctgcctattgctgcctgtgttcccccccccccccctcccccttctatataatagctactgagggttctctttgtattattcgtggaacatatttttggtgggattgaagtaagtacgaagcaatgtacttatgtgtaaaatattccttgagtaatgacctgttattgatgaattggcttccagaatatgcctttcttgcatttgagttttgaactattcaattcaatgtcg

SEQ ID NO: 7278 - DNA, 736 bp, Sorghum bicolor
  Clone ID: SORBI-28MAY03-CLUS76319_1
aaagcaaagaaattactatgagtcacttctactagaagtcaaagaggaaactgagagagaaatttctgctgctactgagaaggccatgagcataaaactccaaaagttggaagcaaagtttgaaaagttcagggaagagaaaagatttcttgatgaagttaatggcaatcttgtcaagaatcaggagatgtggattgaaacgatacgaaaagcacaagcaagggagcaagctgcccttagattaaaagatgagaagattgagaaacttcaagaagagctaagaggtttgatagcccatttcgagtgccaaagtgccattgcacaagctcaagattcgttctcaagtgatataccaggggacatgattcttccggtagcatcagaatcatcctcgagcggcggtgaccctgttggtggcactagaaacgggaagcagaattgagttttgacaccacaatctgcacccgttataaagcacgtttgactgttatagggacctaggtatattcttgcttccaaacccccaccctttgtatgttcagttagggtaacacacatttgtcagttgtcacctcactgcccctcaagtctattgtcattagccgctagtagtgtgtaccatagtggtatagtatcagagattccacggcaggaattgcaaagttttttttaatactttgggtgaagcagtgatatcaggaagtgcaaattaacacttcagttcatggtttcggat

SEQ ID NO: 7279 - DNA, 994 bp, Sorghum bicolor
  Clone ID: SORBI-28MAY03-CLUS7630_1
gggccaacaggggcaggttttacacctcatcttatttttgtaaaagccggagaggacgtatcggcaaagatcatgtccttctctcagcacgggacacgcgcggtttgcatcctttcagcaaatggcgccatatcaaatgtgacccttcggcaatctgctacttcaggtggaacggtgacatacgagggtcgtttcgagatactgtctctgtccgggtcgtttcttctgtcagagaatggcggccatcgcagtcgaactggtgggctcagcgtttcgctagcaggcccagatggccgtgtcctgggcggtagtgttgccggacttctgacagctgcttcaccggtacagatcgtagtggggagcttcgacgccgatggaaagaaggagccgaagcggaagaagcttgctccgtcaccgtcagacccatcgccggcgccactaaagctcgcgccggcgacgacgggcgtggcggcagggccgagcagcccgccgtcgagagggacactgagcctgagcgagtcatccagcggcgccccgagcccgccgcacgcaggggccagcggcggcggcggcggccatgggcagcagcagcagccaggggtcttctccggcctgtcctggaaatgaccagatcccggataccgtctgaatctgaccgtggtagaactggcagaaagaagagtgtttcagcggctgaaggatgaacgaaagctcactcagggagggagaagcagcagcagtacagtagcttgtaggtggtgtcaagactctgtagctcttgctgtactgtactaggtgttaatcgtgcattgttaggtggttgcttactgtcgtctggaatggaatggaatggatgccgtgtactgaatctatgaccctatgcagcacgttggaagttctttggtttctactgagtactgtgtagcgcacacgcgattttctccgccttgttgaaggatgaagcaaataatatgtatcacctatttttcacgtc

SEQ ID NO: 7280 - DNA, 534 bp, Sorghum bicolor
  Clone ID: SORBI-28MAY03-CLUS83892_1
agtacccgaagaaaggcgcccatgctgtcgctggaatcgccctgcagtgcatccgcaacgacggcaagaataggcctgcaatgtccgaggtcgtggagaagctggagcagctgcaggaccccaagtacaacatcgcggcgcctcaagtcaacacacggcagatgtcgtcgtcatcctcaggctcagtcccaaggtcacccatgaaggcgcagccttctccaaggcgcctgtcaggttcggcctccccgaagccagcagcagcagcagcaggctccccgctcccagggtcttgtaggaccgcgcaggttcactagacctgctgagagaagttcgaaaatggagcgcatatgtgtgttgttgtagggcctgtagctgtgttacatgtagctgtatatttttgctgtattgctcccaatcaaagtgtttttttgttcgtgcgggtgaatgtatcatggaatccgctctgtgagtgagacagtgaacccttgtttcgccattatgagatgagatggattgctgcttcttgggacagcc

SEQ ID NO: 7281 - DNA, 690 bp, Sorghum bicolor
  Clone ID: SORBI-28MAY03-CLUS8357_1
aaaagagaaaaacatcaaacgaccgaggcccgcccggggaggcgccccccccgcctccttcctcgccctcccgccggccctcgctccctgcccccccccgccccccccccgccccccccggccgcgccctgcccgccccccgccggggccctccctggttgggtcttcagggaggctgtgtttgagcctgctggcttggtcccctccgccttctccctgccctatggtccccccttcctgcagccggactagctgaggttgtctgcctggtcacctcgctccccgtgggacaggaatccctgcgtccgcttgctttcggcccagctttcccctgctggttcctgtttgtttgcaagtgtccaatcggccagcccgcctccggccaatccgccggttcatctcactgtggtcgccctgtcccccggttgcgcctatgtttactgggctggtctaggggtatttcattctggcattgaagttcatggtgtggagtatgcatttggagcacatgactattcgattagtggagtttttgaggtggaacctcggcagtgtcctggtttcaaatttaggagatcaatatgcatgggaactacctgcctggatcctctccaaatcagagagttcatggagattcagtcagtaaattacaatggggatacctaccatttgataagtaaaaactgcaac

SEQ ID NO: 7282 - DNA, 342 bp, Sorghum bicolor
  Clone ID: LIB3476-047-P1-K1-H7
gtaattccttagggtccagcccagacctctcgaagcacatgtcttgagggtcttctgaaaatttatttaggaagtgtataattgatcaaaaagacttggtccaatcctacttttcaaatcactatggtcaccctttcctacagttgtactagcatagaatgtcagtcatgataccaggctcaaagaaggaaaggaatctcagcatgcgctttcaatcaggccagaaatcttctggtaaattttgtttgttttcaaaagtccaatctgccagcccaccaccagggaatacgctggtttatctgaatgtgtatgatttgacaccagtaaacggctatgtttact

SEQ ID NO: 7283 - DNA, 677 bp, Sorghum bicolor
  Clone ID: SORBI-28MAY03-CLUS8393_1
gcacaggcatcaaacaaatcaagtggtcgtaaaggaattcgaggtggaagcccaaacattggcagaagagctccggttggtaatgacccaagtcctccttcggcttctgctctgcgggcagcattgtggttacgcctccaattcatcattagattgcttccagtaatcatggcagacaggcgcgtgggacaaacacttgcttctgcaattctaggcctgcttgcaacgcggatgatttatgaagatgcagatttgccccttcctcctaccaatgcaaatgctttaaggagggagatggattccttgctggaacctcccctggatgtcctgcttgatcggcctggtgaaagtctttttgagaggcttttatgcgttctccatgcgctgcttggcagctataaaccaagttggctgaagtcgaggtcagcctctaggtcgacaaatagaactcaacgagatttctccgcatttgataatgaagcagccgaaggcttacagtctgcgctggatcacatggaattgcctgaaacaatcaggcggaggatccaagcagccatgcctcttcttccaccatcccggcacccttctatgcaatgtcaacctcctcagttgtcgttggctgcattaacaccactccagagcaggacatctggtgcaggtcctcaacagaaaagttc

SEQ ID NO: 7284 - DNA, 654 bp, Sorghum bicolor
  Clone ID: SORBI-28MAY03-CLUS84011_1
gacgcggacctgcaggcggacctggactacgcgtgctcgcagctgggcgtcgactgcggcgccatccagccaggcggcgcgtgcttcgagccctacacggtgcgcgcgcacgccgcgtacgccatgaaccagctgtaccaggcggccggccggcacccgtggaactgcgacttccgggcgtccgccacgctcacctccgagaacccaagctacggcgcctgtgtgtacaccggtggcgcccaataatacaccgcgcacggcggtgctaatcccgtggcacatgattaattttgcgagtaccttgcatgatggattgccgagtgaaaaaggttgggcctatacaggctacagcaagggctctctgtggacgaaccgaataaagctacacgaataattgtggttgttgccgtggtgtactgtagtgcatggatgcgaatgcgatccatggaatggaagagcgaagcatcctcatgtttcgtagcaccagaagtttccttggacaggctgggcagtgaatctgtgattgtgacttcgtgtaaaagaaaactgttagaagttgccagtgtcgccgtgagcttcgtgtacgtagtacgtacgtgtctaaatgtacgagtagcatgagattatatgtttctgtatttttttaaaaaaata

SEQ ID NO: 7285 - DNA, 467 bp, Sorghum bicolor
  Clone ID: SORBI-28MAY03-CLUS8403_1
cccttgtcgtcgtactcccctccgcctcctctgccaccccgtgtcctattcctcctagcacccaccacccagctcccccctgtaatctctccctctcagtcagtagtaggagcaagtactacgaggctacaagtagtaggccttggtaccgacgaatcccagctcccgcggtcgtccgtccgtcctagtagaggctaagctggcgaggagggtggcggcagctgcattgccggcaggggagattcccggcctgcgccgtttcctccccactggttggtcggctggcggctccgccttctgaaaaaagaagtcccaatcttggcgcgcgcgcctcgtggcgggcgggcgggtggccggccggccggctgattcggccttgcgccgtggctatttcggcctgagattcgaggatccccggtgaaagcctcgccgcgggtcttgagtggatcctggatttgaggcttcct

SEQ ID NO: 7286 - DNA, 973 bp, Sorghum bicolor
  Clone ID: SORBI-28MAY03-CLUS84041_1
tggtatgggcaggttcaactatgtcgggaaaaatccactggtaacatttatgccatgaaaaaactgaagaagactgatatgcttgtgaggggtcaggtggagcatgttagagctgaaagaaacttgctggcggaagttggtagccactgcattgtgaaactatattattctttccaagacgttgagtacctctatcttatcatggagtatcttcctggaggtgacatgatgaccctcctgatgagagaggatactctgactgaaaatgtggctcgattctatatagctgagactgttcttgccattgaatccattcataaacataactacattcacagagatattaagcctgacaacctacttctagacaagaatggtcatatgaaattgtcagattttggattgtgcaagccaattgattgttcgaagttgtcaacattgaatgaagatgaaccaatgactgatgaaaaccttagggagtctatggacattgatcgttctctctctgatactgcaaatggtaggaggtggagaagtccaaatgaacagcttcagcattggcagaacaacaggagaaaattggcattttcaacagttgggacacctgattatattgctccagaggttctactgaagaagggatacggactagagtgtgactggtggtctcttggtgcaatcatgtatgaaatgcttgttggttatccaccattttattcagatgatccactagttacatgccaaaaggtttaagtcttgaccgctgaacagttcatcttttcatcgtgcagattgtcacattgtaatagtatgtttagattattttaattgctattgcagctaagttcagatcttataattactttgaggttttttttgggacttactgaactttttcatgcgatttgttagagtaaataggaatagtaccacattgtgtacccatataaggtgttagtcctatgtaccctat

SEQ ID NO: 7287 - DNA, 496 bp, Sorghum bicolor
  Clone ID: SORBI-28MAY03-CLUS76631_1
caaccggaagctcggcgtggccgcggacgccgtgaagcgccggcactcggacctcaagctcgtcgtcttcgacatctaccagccgctcctcgacctcgtccaaaaccccaccaacgccgggttcttcgagtcccggcgggcgtgctgcggcacgggcacgatcgagacgtctgtgctgtgccaccagggcgcgccggggacgtgcaccaacgccacgggctacgtcttctgggacggcttccaccccacggacgccgccaacagggtgctcgccgacgcgctcctcctgcagggcctccagctcatcgcgtgagccacgcaaccgctgctgcttctgtccttctgtcctgctactgtgtgcttgtccgtctgtgtttgctttctgcccatgatctcctgtagttttgtgatgcttggaaaaagttggactgctgtaagagggtgccgctctgtataattacattccacgacttccaaatctcctagctgaactttg

SEQ ID NO: 7288 - DNA, 1227 bp, Sorghum bicolor
  Clone ID: SORBI-28MAY03-CLUS76647_1
agcccagctctagcgtttcccttcctccacggcccgtggcagcggctcttgctggcttgcgctgctccctgttctcggggttccagcggatcctgatctgagcatcattcagagtggaagaaatatgtttaggagaaagcatgaccctggtttcaactcaaatgatgctgagcaaagagaagcaaagataagtgaactgaaagctgcacttgggactttgtctgcccgtggcgagaagtactgcagtgaagcttgcttgaaaagatatctggaagcccgtaactggaatgttgctaaggcgagaaaaatgttggaagaaagtctcaagtggagggcagcttataggccagaggatattcgttggcctgatgtttctgttgaagcggaaactggtaaaatgtacagggcaagtttccgagacagggagggcagaactgttgttgtcatgaaacctacaaaacagaatacttcgtcccatgaagggcagatacggttcctagtatatactttggagaatgcaatcttcagcctacctgaaggccaagaaaaaatggtatggctgatagatttcactggatggacagtggcccatgcttcgcccttaaagacttctagagaaactgcaaatatcctgcaaaatcattttcctgaaaggctggccattgcatttctatttaatcccccaaaagtatttgaagctttttataaggttatcaaaattttccttgatccaaaatcgattgagaaggtgaacttcgtgtcccagaaggatgaggagagcatgaaggtcatgtataaatacattgatccggaagtacttcctgtagagtttgggggcaagaacaatgtggtgtacaaccacgaggagtactctgagttaatgatacaagatgacatcaaaacagcaaacttttgggcggttgatgcgaaaactgaccacactaaccctgccatcaatgggaacttggttcctgaggttgcaccacagccatcgttgctcgctgctaaagctagttgaaggtaatagaatcttgagagaaataaataaaataagaaacatggtagactcgttcgtcctcaatagttgttccaatactggaagtttattcagcatacaaggtatcgcccagttgttgtacttaaatcattactgaataagtactcctatgtgtcagtgattatcacttggaataataactaacacaagcttaaccatttttttctctt

SEQ ID NO: 7289 - DNA, 636 bp, Sorghum bicolor
  Clone ID: SORBI-28MAY03-CLUS767_1
cgggggcggcggcttgggaaggggagccgctggggttcgaggtgtcgacggagcccatgccacagctgccggacccggagacgcccgacttctgggagggacctcagtgggaggccctcggcttcttcgtgcagtacatgtgggcgttcggcgtcgtcttcggcctcattgcttgtggtgtcgctgtggctacctacaacgatggagcaacagatttcagagacacgcctgcttacaaggaatcccaatcacacgagttcccttgggaggcagaatgggcaagcgccgatgtgtttgaaggcaatccaactgaggtagcaccagctcttgagtaggaggcacgggggagaaaacttgtgtctctattcaagctatagcctatagggctttgcgtttgcaataggcaataagacatgtaaaagccttggttgaaatcttgatgccaagaaaattggctggttaatattgtgtactgaattttcccttagaatcgaatatagatggctagtggtgataggattcaactgtactttattaccaaaagttgggggaaacgaaagagagcaagcattgctgtcttccctgtattttgattcatcctgcctctacaatggcttttctggcacatataagccc

SEQ ID NO: 7290 - DNA, 639 bp, Sorghum bicolor
  Clone ID: SORBI-28MAY03-CLUS76859_1
aacaaatgacgatccgcaattggcttttcttcgtacttttggcgagctttacgtactccgcttttggctggaacaacacagacactaataatgatgtgttgctccagttccgagtaaacaagactcaaactgtgtcttgtcctaatttcaccgtatgcgccaatccatccactattgcttggaatatctcattgggtggcgttcccgttcaattctgtcacgagagatgccgccttttgttctttgtaaactttggtactcatactcccggagtatcacctggatctatcttcagtgctgccagctacacttccacgagagatctttaccgcttcatggatatgctgaataattggttcccttatatactaggctacgaattcgattgggcgtacggaggattttccgagtcaggaggctttcctgatgtagatctgagcaacgcaacgatacatgatattacacttactatcaacgcactcacggcaaccgtggcgaataccagtggctcatccgtgcttaacttatactacgatctgatttttaccgtattaggaaattggcaccctaatcttactaacattactgcattacctgtcggtgatgcatttgttcgtaatggcactagttttagtacta

SEQ ID NO: 7291 - DNA, 1049 bp, Sorghum bicolor
  Clone ID: SORBI-28MAY03-CLUS7592_1
gcacgagggtcggaggcatatgcagagctccccagcactcagtcaggtcaatccagcaatccaacaacaccaatacagcgcccaagtcatgctcgtcgtgaaaagcaactggtgaacgatgggcgatgtggtagtgaaaagaggaagtttaaaggacgtgggcccatcaaaggtttaaatgtatctaacaaaagagctaggcagggcactatgaaactggatgttcaaatctctagactgggaggacctgttggtggtaaccaatgatcttttgttgatgaagtggtagtgtatacaaggaaaagtgctccacttattggagtgagaaagtggaaagacatcgattttgaagtgaaaaagaggatagcaactctggtaatggaaaagtgggaccttgatgatactttgcaaaacaaaaaaatgatatgggccatcgctaatgagcgctacaaaggatgacgatcaacattttgtgcaacgtatagggcttacgacacttatgatgagagaatgcgacataagcccgaagacctacacattgttgaatggcactatctagtattgtatttcggcacagaggaattccagaaacttagcaatatgaattctcaaaaccgttcacttgcacaaacaaagcatatgatgggatcaaagcctttcgctcagtgcagctatgaactgagagacccacaaactggtgaagaaccaaatgatgtggatctttgggtgaaaacacacagtaagggagggaaatggacaaatgatgcatctaaggctgtctatgaatctgcttgcagcaaaattgcagagaaggaaaaagagtcaccaaatagctttattcctttggtagagagaaaccttatttttcaggaagcatacaagcaaactactagagctaaatcatccaaggttcatggtaatgggtatttggcaaggtacccaagtagaaggcagctaatgactgaacgttttgaggaccaagcctgttctgaaatggcatcccatatggaaaatgaagagctgaaggctacactcgagacaagaacaac

SEQ ID NO: 7292 - DNA, 849 bp, Sorghum bicolor
  Clone ID: SORBI-28MAY03-CLUS76025_1
gcgcgaggccgcgtcgtctttcaagggtccgatttggcatggcccgccgttgggttctcccactgaggttggtggcgcgaggttcttgctcgaagcgagcaggggtgcggcccctgtgcgctcacctgggcgtagctcttggtacctgtgcgcttttgactgccttacggagagactcaataggtaattttctgtgctgtgcgtcttggcaactgtctacatggtccagctggtagttctagtcaagtgaaaatgtgttgcttgtgaaggcttctaaggcttactttgcaggtgaatactcggtcaatgatgcttggaacttcgatgaacttgagcaacaaatcaccaagggatatatatgaatcatttaattaaatctgccttctggactttgggggatgcgagctaggttacatgcggcttgcaagttgcaaccagtggccttgtgcccatgtcatttgtcaccaattatatagaaaattaagtcaacagtagagtggtaccttgagtagacatccagaaatgggcattcatgcatatcagtccctcagcccccaagccgtcttggcgtgctggtccgcttctcctcttcacttcatcccctcttccgcagtggtgcacggggcctcgctgcttgtcttgttctcgtcatcgtggcagtgttgttgtgctctttcagttgtgtgcttacagaagtgggttgctcagggcgttagtcgtttggcttatcatgcatggttaagtcatggcagagagtgctgttagctgatttattgtgaaagaaaaacattgttgaatggctgacagattcagctgataaggtcaagcgaatatggtgtgcctataaga

SEQ ID NO: 7293 - DNA, 568 bp, Sorghum bicolor
  Clone ID: SORBI-28MAY03-CLUS75985_1
gcacgagggataactctcctcggtaccgctttcatggaggggggaacgtcggagcctgcggcgccggcaaccttcctccggggtgaggagggggcgtcccctgagtcagcgcgcgctaggttcgagcgcatgatccggcgcgtgcaggcggatgtctgcgcggagctcgaggcggtcgagggcagcggcacaagcaacggcggcggcggaggcgcgctatttcgggaggacgcttggacacgtcctggcggcggcggcggtattagccgtgtcctccagggcggccgtgtgttcgagaaagctgcagtgaatgtctctgtggtctatggagttatgcctccagaggcataccgcgcggcgagacctgaagccgccgcggcggcggcggctggaggggacaaggcggggccagtgcccttctttgcggctggtatcagctcggtcatccatccagtaaacccgtttgctccaacaatgcatttcaactaccggtatttcgaaacagaggcacctaaagatgctcctggtgcacctaggcagtggtggtttggaagtggtactgacctga

SEQ ID NO: 7294 - DNA, 727 bp, Sorghum bicolor
  Clone ID: SORBI-28MAY03-CLUS76048_1
aagccaaagcttcaatttgttggtagttgccggaataaagaggatctggacagactacaaaaacttaaggacagatccactgaactgcaaatagatgagcttgtggagttccacagggatatttcttacagcgacctggtacgacttcttgggggtgccatttctgggctccattcgatgacagatgaacattttggaataagtgttgttgagtatatggcagctggtgctattccaattgcgcataaatcagcaggcccaatgatggacattgtgctagatgaggatgggcatcaaacgggatttctagcctccgagaaggaagaatacactgaagcaattatcaaggtcttgaggatgcgagagtcagagaggcaagaaatggcagctgtggctaggaaacgtgcacaaagattttcagatcagagattccatgaagatttcactgaggctgttcgccatattttgtcagcaagggaagcctgagtcctgacaagctgccgtttcctcctaacaatctgaattgtctaacaagtttcacatgatacacggaaagactgcaaggtgcattgaattggcatggttttgttttgagctgctcccttttcctagactgtctgtgtatgtgcatcgtgtaacactactgtacagaaatagaccacagaaaattatatgtcaacagcgcttggtgctatatcactaaatttgatcagcgatgtagaatttc

SEQ ID NO: 7295 - DNA, 520 bp, Sorghum bicolor
  Clone ID: SORBI-28MAY03-CLUS7606_1
gactgatgttcaatgtttgcataggtggcagaaggttttgaaccctgaacttgttaaagggccatggtccaaagaagaagatgagatcattgagcagatggtaaacaaacatgggccaaagaaatggtcgaccatagcccaagctcttcctggacgtattggaaagcaatgtcgggaaagatggcacaaccatcttaatcctgggatcaataaggacgcatggacacaagacgaggaaatcaggctcatccatgctcatcaaacttatggaaacaaatgggctgagttgacaaagtttttaccaggaaggacagacaatgcaattaaaaatcattggcacagctcggtgaagaagaaagttgattcatacagatcatctggtttactggctcaattccagggtctgacacctgttgaatacactcctggtggtttaaatgttgattcttcatctgccatgaccaatcaaattagcgaagacagtggttttaatgtttttcgggaggctgaagattcaatg

SEQ ID NO: 7296 - DNA, 698 bp, Sorghum bicolor
  Clone ID: SORBI-28MAY03-CLUS76218_1
gcggcgctggacaccatgtccaaggccaacgcgcccatctggctgaccgagatcgacgtcgcgccggggcccaaccaggcgcactacctggagcagatactcagggaggtgtacgcgcacccggccgtgcacggcatcatcctctggacggcgcgccacccgcagggatgctacgtcatgtgcctcaccgacagcaacttcaggaacctacccacgggcgacgtcgtcgacaagctcatcgcggagtggaagacgcactcgcacgccggcgtggcggacgccgacggatactacgaggccgagctgttccacggggactacaaggtcaccgtcagccacccggtggccaactccaccgtggtgcagagcctgagcgtcgacagggagaccgacaccgatagcgagtacaccatacacgtctagctgctgccttagctagctcctacatatatacctacgtagcctccttccaagtactcctactagctaggactaggataggaggggattgatatacatacgcatgcacgtgtgcatgtgcatgattgtgggtctagattctagggtattgtggtttgtgatgtcgtcagtcagtcagtcagtcagtcatatacacatacatatatagggcgcccgagagatagaattcctggtgaggcgatgccatgtgatgttcatataaaacaaaaggaggaatt

SEQ ID NO: 7297 - DNA, 964 bp, Sorghum bicolor
  Clone ID: SORBI-28MAY03-CLUS77280_1
ccttttcttcgtttgattccctcccgccgccgccgccgccgccggagacgccgaaccacgacagcgccccagcgtttctcctcccgctggagtagtaaggagccggagaaaagcagcgcaagagagatgtggtacctatgcgtcttctaccacaggctcctggactaccggcggccggaggtggagtccctcgccgagctcttcgccggccctgggggcggcgaatccgtcgagtggcgtatgccggagaaccaccacgtagactcccctttccacctcgttcgcctccccggagacgagcgcctcgccgcccaggtcgccaaccgcagcttgttggtcaaggggatctacgagctctggggccatggcaccacctacgaggagctggagaagtcggtcacggagtaccccgacgagaggaagctgccgttcctaaccccggaaagcaccttcaagatcgttatcgacagctttggcaaggtgatcagctcccaagagcagaacgagatcatagagagcctcacttacataccatttaagggacgtgttaatctgaagaagcctgatcacaagttctttgtcatggagacagatgactatggctcgaacaatggtctcccaccggttgtgaagaggtcaatattctttggccgggaggttggagcagctgataggcatctcctgccaacataccagctcaagagtaggaagtacattggcccgactgcaatggatgctgaaatggcttttctcatggccaatcagggtctggcccggcctgggaagcttgtctatgacccttttgttgggaccggtagcattttggtcgcagctgcgcattttggagctatgacaatgatatcgatataagggttgtgcgggatggccgaggccccgattgcaatgtttggagcaactttgagcagtacaagttaccagagcctttgtgtttgctaagggcaga

SEQ ID NO: 7298 - DNA, 635 bp, Sorghum bicolor
  Clone ID: SORBI-28MAY03-CLUS77139_1
gcacgaggctcgagtacccatctacctccttccccgcccgcgcagcgccagcgagtgacgtctctacccatcccccgcggcagcacccctcccccgcccccccgcgcagcgcgagcggagttttgcagtacgccgcggctcgcttcgccacgcgcgacgaattcctggtgcaggtgcggaatttcgcggcgaattggaagggtttgctcacccaaaataagatggcctcaatcgcgcctccgtcctcagcgtcgtgcgctcggacttctaggttgtgttatgatgcttcgcttttaccaagtgctacatcaaacactttgaggacaatcggatcaatttgcttggaaaatacccgtcgactcagaaagttccatatatctcatgccgtgggtggttcatcagagaatgttattataaatgggaaggccaacccatctaatgcagttcaagcagatgctgttgcacttgggaccattgcagctgatatggctcctgttgttgatggtttttctgttgatgatgatgagcttgacctagacttccctacagagggtttctcatctatacctgaagctatcgaggacatccgtcaaggaaaatatgtcattgttgtggatgatgaggatagagagaat

SEQ ID NO: 7299 - DNA, 674 bp, Sorghum bicolor
  Clone ID: SORBI-28MAY03-CLUS7733_1
tcagaaatatgttcgggtatgatcctagtagatatgcaggcagagatgaggatgtcagtgacatggaagccgattttgctactatagaaatggaagagaagagaagcgcgaggattgctaggcaggaggatgaggaggaacttcgcttgattgaggaagaagagagacgcgagcaggagaggaagaggcgaaagatggcacgaggccgatagtccaatactcaacatatttggatgttacaacttcacaggcctgattgcccgaggacaaggccatggtcgatcagacagctcttctcttgcattcctggttacccttgagcgttgcagacaacatcaaaccttagcacgttgattatctggaggcaaatcaaggaaaacagcaggtgagcaacgctgggcacacaacagaagcagaatgttagtcgtagtggtttagttctcgaagctgacatggaccgtatttaagctcttgtcagattgtttggataacacaaggctcccaacgttgcagcgcctcgtcggattgtttcttctaaattctaattatagtactgattctttcagttaagcctatataaggaggcctaatccaagtggccctcttgtctacttttgtttggtgtagcagtagtgttgtaataaacgatgtgttcgaattttcggatataattt

SEQ ID NO: 7300 - DNA, 938 bp, Sorghum bicolor
  Clone ID: SORBI-28MAY03-CLUS77275_1
acgaaatccccaattccatccgccgctccggtcctagggttccttctccagttctccgccgccatcttcttcgcagttcttcctcgacccgaccgtagctttccatcaattctcttctttgcgccatggcccctgcttgcatcctgctcgaccgcaccgttgctttccgcagccatccccaagaaacagaacccttcgatttaggagaaagagcagagcgcgtggtcggcgcggaaagagcgaaggacctggtcggcgccaccaccgcggaattgccaaagctttcaagccgtgaggacatcgaagcatcaattgccgagtacctgctggccatgacgccagatctggagatcgtcaaacccccggagataagctacctcaccatgcagcgaccactctcatcagagccgatcccaaatcacggatggtccttgcgcgacggcgctgccgccgccgccgccgacaagaacttggtcgtcctcttccccggctcctaccgcccagcctactcgtacaaccgatggtacttgatcttggacctcgacgccgacgcatcttcatcttcctccctctccgcgatccccggtatccgcttcgagtactctgattgctacatgaccgccggctacggggtcgtcatcatgacacgcgaaggtggcgccttcgtcttggctgagctgctcttcgacttctaccaccgccgcagaggtccttggctgggcatgctctgcctctggcagtcgtcgttatgctcgtgggtctacaagcacggcgagctccccgccgaggtgtcccgcacgtggaagactcacatgtccttccctgtccaaagcaggaacatgaacctcttctgctgggtcgatcttcgctgcggattgctactctgggatctgggacgacattgtgaggtcgactcgtcggatgacttgttggacttg

SEQ ID NO: 7301 - DNA, 682 bp, Sorghum bicolor
  Clone ID: SORBI-28MAY03-CLUS76339_1
gctcatacagattatggttagtacgtctctccaaaaaaaatttgttgtgctgctggttccccatgtcatctgatgtagtggtcgttcatgactgctgatccgtggcttcgccttgcccgtgggcggggcgccgggggcgtgtggccgcgtaacggctccacatcctttctgggtgttaaggttgattggttatccagtagatattccaaaagagcagcgcactgatactggctgtggagctcatacagattatggacttctaacactggttaaccaggatgatgacatatgtgcccttgaggtgcaaaaccgctccggtgagtggatatatgcaacgccgattcccggaacctttgtttgtaacattggtgacatgctgaaggtttggacaaatggaatatatcagcccacacttcacagagttgtcaacaattcgcctcgttaccgtgtatctgttgcgttcttctatgagtcaaactttgatgctgcaatagagcctgttgagttctgccgggagaaaaccggcggtgctgccaagtacgaaaaggttgtctacggagagcatttggttcagaaagtactgacgaactttgtcatgtaaatttgctgggtgcagatgtggaggaataaatctgtattgtaaacggcacattatatttcatctataaacatgttttttttt

SEQ ID NO: 7302 - DNA, 822 bp, Sorghum bicolor
  Clone ID: SORBI-28MAY03-CLUS76349_1
cctgaacgaacactccggtgtcattggcgccttcaactgccaaggcgccggctggtgccaggtagggaagaagaacctcatccacgacgagcagcccggaacagtgaccggcgtcatccgggcacaggatgtgggctaccttgcaaaggttgctgatcacagctggaacggtgacgtgatcgtgtattcccacgtaggaggggaggtggtgtacctgccgaagaacgcctcgctgcctgtgacgctgagatcacgcgagtacgaggtgttcaccgtggtccctctgaagcacctgccaaacggcgtctccttcgcgccgatcggcctggtcggcatgttcaactccggtggcgcggtgagggaggtgaggttcagtgaggatgccgacgtcgagctcaaagtgcggggctcgggcacggtcggcgcttattcctcgacgaggccgaggagtgtccccatcgattcgaaggcggttggtttttgctacgatgacgcctgtggccagctcacctttgagcttggcctctccgaacaagaactatacttttggacagtttcagtgggctactgataacttagaacaagtctggtatacgtacttcgatttattcagggtcatacttcgatttattcagggtgttgtaccttgtactgttagctagctattctgtatacagagaaggtagctaaatgcctgaacccgcttgggaattgggagatgtatttcaggttgaatcgtagtgtgccaagaatccaggagactgtgcaagtgtagtacatttacatagatgaaaaatgaaactatgaaatagaaaagaattc

SEQ ID NO: 7303 - DNA, 764 bp, Sorghum bicolor
  Clone ID: SORBI-28MAY03-CLUS76366_1
tggaatgggcaatgacggagttgcttcaaaatccagtctcaatgtctaaagtttgcaatgagcttgcaggaattattggctcaggaagaaatcttgaagaatcacaaattgtccagttaccatatcttcgagcggttataaaagaaacttttcgactccatcctcctgctccgttattgttgccacgtcaacctgagacagcaacaaaagtaatcggttacacaatacctaaagatgctcaagtactgataaatgtatgggcaatgggtcgagatgcaaatatatggtctgaaccagagaagttcatgcccgaaagatttttggcaaagaccgtcgatttcaaaggtggagactttgacctcatcccgtttggtgcaggacgtcggatttgccctggcatgccattggctattaggatggtgcatctggtgcttggatcactgttaaatcaattcaaatggaagcttccagctgatgttgaaagaaatggagttgagatggcagaaaaatttggggtgacactaatcaaggctgtgccactctacgctgtagcaacaccaatttgagttaaccaataggtcagcacaactgtattttgatccttcttattgtgcaataatgtattaagcacatcaaacaataacgagacacacacgcaccaaccgccagctgcatgtatttatcctaaacataaacagggtttatcaatggtttaacttggtatttagatatatttgtatatctaagagcatagcaagctacat

SEQ ID NO: 7304 - DNA, 697 bp, Sorghum bicolor
  Clone ID: SORBI-28MAY03-CLUS76391_1
ctactggaatttcaatcaataacacgaaacacgaagatgcgtagtttcatttacgttctacccctatttgctgtcgcagcgatagcacaaatgacttataccggtgtaaacttgtccggcggcgagtttggccaagttcccggtcaactcggtacgacctaccaataccccaccaccgcagatgtcgactactttatcggcaaaggcatgaacaccattcgcttgccattcagatgggagcgtatgcaaaaaactttgaacggaagatatcgatcaacaagaatggagctacattcagaaccttgttaattacgttactagtaagggcgcctatgccatcttggatccacacaaccaaggacaatacaatggcaatcagatcggttctgctgctgttcccgccaccgcttttgctgatttctgggccaagatcgcagtcatgtacaaggacaaccaaaaagtgatctttggcttgatgaacgatcccaattctatggactccgctgtttggaagggcatttgcaataccgtcattgacgctatccgcaagaccggtgctcaaaacttgatcctcgtgcctcctgttgaatggagcagagtgcaaaattggagcactaaccctggcactcctcaatccgtcggcatgcttggcgtcgtcgatcctgcgaacaactttgcctacgaagtgcatcaattc

SEQ ID NO: 7305 - DNA, 715 bp, Sorghum bicolor
  Clone ID: SORBI-28MAY03-CLUS76427_1
atcttatcccatcaacctgctgccacagtggcgagaatggaatcgttcgaaggcaacaaactctagtggttaggatacagctcctggatggagcgcggcggtaccgcaatgtcgctgctgctgctgctcgtgctcgtgctcactgtgtcgccatggcaggccgccggggcggcgggaggcggcaggccgcgggtgccggccatcctggtgttcggcgactccatcgtcgacacgggcaacaacaacgccgtcctcacgctcaccaagtccaacttcaggccatacggcaaggacctcaacggcggcgtccccaccggccgcttctccaacggccggattccgacggacttcgtagcttcacggctcggcttgaaagacctggttccggcgtatcttggcactgaccttaccgacgacgacctctgcactggcgtcagcttcgcttctgggggcaccggctacgaccccctcacctccactctcgtggcggtcctgccgatgcaggaggagctcaacatgttcgccgagtacaaggagaagctcgcaggggtcgtcggagatgcggccgccgcggggatcgtcgccgacagcctgttccttgtctgcgccggcaccgacgacatcgccaacaactactacctcgcccctgtcagacctctgcagtacgacatctcagcatacgtggatttcctcgttgagcaggcttgcgacttca

SEQ ID NO: 7306 - DNA, 969 bp, Sorghum bicolor
  Clone ID: SORBI-28MAY03-CLUS76585_1
tactggtaaaaatccaaggccgcgccgtacgcgcaatcccccctcgctcgctccatggcgctgcagctccagctgccgcggccgctcgccgccgcccggccctccgccctcctcccttcccgggaccatggcgcctccgcttccgcgaccgcccttcacgctcgcgccggcggcgtcgcgttctcgctccagaccaacgtgcgcctcctcaagcccaaccgccgcgtccgccgctcccgggacccctactacgacctagacgaggacgatgaggaggaggcggagttcgacgaagaggatgacgacgaaggttacgagagcgatgatgacatgtcgggtttggaatatcctggtgtactttattcaaacagcccccgggcttcaagcaagagacaagaattggaacctccactggtaaaagaaaactgggaaggaagacaacccaaaactcgtgataactacggcagtccaggaaaaagtaagtccctgtatcctaggagtaaagtgggacgatcatcaatggatcttaagaacatggatagtgaagttgagttgaaaaatgcaagtatctctcgaagtctgttccagaaactacaagaagattatgactttgatgacaaatggttaccgctgattgattacttgtgcacatttggactaaaggagtctcattttacttacatctatgagagacacatggcctgctttcaaatcagtcaggcttcagcagaagaaaggttggattccctgctaagtgctggggttaagagcaaggatatgaagaggatactggtcaggcagccacagattctggaatacacccttggcaatctgaaatcccatgttgattttctcgtaagcattggagttccgaatacacgaataggacaaattatttctgctgctccttcgatgttctcttacagtgtggagcactctctgaagccaacagtaaggtatctgattgag

SEQ ID NO: 7307 - DNA, 683 bp, Sorghum bicolor
  Clone ID: SORBI-28MAY03-CLUS7659_1
gcacgagggttgaccacagttattcatgtgcacttgagaggtcatttttgtatcatggacgcatgtatgtctcttcatggcatatttgctttcattcaaatgtcttttcaaagcaaatcagccatctgtttcttttattacaaacactgcagataaggagaagtcagcatgcagttattaatccagctattacaatatttcttcgaatgggagctggaggatttggtgttcctccattaggatgtccagatggaagagtcaggtacaaatttgcatcgttttggaacagaaaccatacatttagatcattgcagcgagctgtgaagaacttccaaatgatgatagaggctgagaaacaggaacgtgctcagtctgcattacgtgcacacagtagttcaagaaaaactagcaagcaggagataaatgtcccagaagattgtgctgcattaacagggcagttacaaccttttgttaaagaagaagttttggtccctgtattcaatggaacatttccatgtacagcagaacagttctttagtattcttttgagtgatgattcaaattacataacagagtatcgaacagatcggaaggataaagatataaatctgggccaatggcacattgcagatgagtatgatggccaggtgagggaacttaattgtaaatcaatatgccatagt

SEQ ID NO: 7308 - DNA, 611 bp, Sorghum bicolor
  Clone ID: SORBI-28MAY03-CLUS77524_1
tcctcaacgtcaccggcgcggccgtcggtggtaccgccctcgcggcgcaggggctcggcgccagcaacgtgctcatcgactccggcacggtgatcacgcgcctggcgccgtccgtctatcgcggcgtgcgcgccgagttcacgcgccagttcgccgcggccggctacccgacagccccggggttctcgatcctggacacgtgctacgacctgacggggcacgacgaggtgaaagtgccgctgctgacgctgcggctggagggcggagcagaggtgaccgtggacgcagccgggatgctgttcgtggtgaggaaggacggctcacaggtgtgcctggccatggcgagcctgtcgtacgaggaccagacgcccatcatcggcaactaccagcaaaagaacaagagggtggtgtatgacacggtggggtctaggctaggcttcgccgacgaggactgcaactatgtatagagagggaggactggaggaggatgtggagaggggatgagtgaaatatcggatgatgcctagttatctgttgtataagctatgtccacctaactactgagtgtagtttgatgaaatttcatagtttttaataagacttacaaatcc

SEQ ID NO: 7309 - DNA, 732 bp, Sorghum bicolor
  Clone ID: SORBI-28MAY03-CLUS77548_1
gtcacccatcacaggtgacccgaagccctacgcggtgctggcctcggtgcacgcccggttcgggtgcgtgccgctggcgcacgtccaggacgcgtgcgacgcgcacgtcttgctcatggaggcgccgcgcgccgaggggcggtacctgtgcgccgccggcgggtactcggcggcgcacctcgcgcggctcctcgcctcgcgctaccctccgttcaggcctggcgacaggctgagcagagacttcgacgacgacgcctcgtgctcgccgccggtggtttcgtcgaggaggctgctggatcttgggttcaggttccggtacggcgtcgaggacgtggtgaaggatagtgtcgcgcagtgccttgcccatggattcctggagcagcctgaaggacagagcaccttcaggctttcagcagtgtaggatagcactggaggaggcaggcaggcagggccgggattggatggttgggcttgggctcaagcatggcaagctacctgggcctaatggcccttatgcttttgtgctattgtcaaatttaagaacacgaatatgtttgaagtgaggaaactttcacaggaaatcgttcgtatatatatttttttcaaaccatgggaacttcccatattttaaactgttagaaaaatatttaaaaggtaaagaaaaagatgtatttgtttgtgtctcgaattcatgaaattggtgggaaacaaatcaaaccattcatttgatgt

SEQ ID NO: 7310 - DNA, 615 bp, Sorghum bicolor
  Clone ID: SORBI-28MAY03-CLUS77552_1
tagtgagaagctagacaagttcattgaagtaagcatggtggctaggaaggatcgtgcgaggatggcagagacgcagaaaattttggcaaatagtaagattgaagctgctaggttgaatgatgaggcagcagaaaagcagctgaagtgtaaaatgttggacacttacagagagctgttgctagcaacgacaactgatatgaattctcatgctttgactgagagggagaaagcactagagagtatgaggttggccttatttgctactgataattaagataatgctgtggtttgtggaggatttttgcaacctgatggcttcaggtggacttgtgaactatttgagatgatgttgtgcaatgctggactatttgagatttttgcaccctgttcttatatcatgaactttagttttatatctgagatgatacttttgaactgttttgttgcatgcgcaacctggtgatgaaaccagatgttgcaccctatttatcttttaagtttctggattggtatgattatgaatatatgattctggaaactatatgtgcagcacaagcagagtactgtattcctgtaattttgttgtgacttacgagatatttgatctgttggggt

SEQ ID NO: 7311 - DNA, 636 bp, Sorghum bicolor
  Clone ID: SORBI-28MAY03-CLUS76991_1
atccccccgcaccaaccagtggtcaccgccgcaccggtcagcttcacttcacctcagccaccaccaccacgcctcggccgttgcccgccaccgctacctacgccaagggaataagcagcagcagcagcgccgccatggccgcgccgctcacggccgtccgtgcccggctgctcccggtgacctgctgcacggccgccggtaccggcgggcctccaccgccgtccaagaacagcagcaacaggccgccgcatctactaccactaccaaccaccggcaccaccgctcctcccctgctacgcctggaggcgcctgcgccggcgccgtccgccgccgccgcggcggtggcagcgatgatgctggcgctgtcgccggacgaggcgctggcggtgggcggcgagttcgggatcctggaggggcggagcttcgcgttgctgcacccgctcgtcatgggcgggctcttcgcctacacgctctgggccgggtacctcggctggcagtggcgccgcgtgcgcaccatccaggacgaggtcaacgagctcaagaagcagctcaagcccgccgccacgcccgccgcggtcggcgccggcgcggactcctcctcctcctcctcaccgccggcggctagtcccaagtcgc

SEQ ID NO: 7312 - DNA, 645 bp, Sorghum bicolor
  Clone ID: SORBI-28MAY03-CLUS76996_1
ctactggaaccttaatctcactttcacactgactcgcgttccagctctccccttccctttgttcctccagcctagtagaattaagtagcttcttgctctgcagtttgccagttttgtgttcctgatcgatcgaatcctcgaatcgtgcgtgtttgcgctgggtgccctgggtttcgtcctggcgcaggcgctctttatagcccgaccgaccacatggatcggcggagatggatcggcaaagcggcggcggcggctgctgttgctgttgcgctcttgctgctgtcgacccctcctcctggaggagcaaggagagaaccccacgtcaacaacaatgggcggagttttgtttttaactatactctggccaaggctgttgtggaatatgctgcagctgtatatatgacagatctgacggctctatatacatggacatgctcaagatgcaatgacttgactcgaggctttgagatgacttgtataattgttgatgtccagaattgcttgcaggcattcatcggtgttgatcacaatctcaatgctatcattgtttcaatcacgggaactcaagagaacagtgtacagaattggattaaggacataatatggaagcaggttaatcttaatgatcccaacatgcccaatgct

SEQ ID NO: 7313 - DNA, 1092 bp, Sorghum bicolor
  Clone ID: SORBI-28MAY03-CLUS77003_1
agcacagcccagacggctaagcccaggcaacactgcggcacgtacgcgcgcagagatacacagagcagctagtagctcgctcgcaacaccagcaaaagcttgagagtcatggggagtgtgccagaggagacggcggccctggacaacatcggcgacctggtgagcgacctgagggaggtgtacgagagcggcaggacccaggacatggagtggcggcagtcgcagctcagaggcctcgtcaggctcctggaggagaaagaggaggagatcttcgacgcactccatgaggacctgggcaagcaccgcgtcgaggccttcagagacgaggttggggttctgaagaagtccgtcgtcgacaagctgcaaaacctcaagaaatgggcggctccggagaaggctcacacgccgctcgtcgccttcccggcgacggcgctggtggtgccggagccgctcggggttgtgctcatcttctcatgctggaacctcccaataggcctagctctggaacctctctcgggagccctggcggccgggaacgctgcggtggtgaagccatcggagctggcgccgtccacgtcggcgttcctggcggccaacatacccaagtacctggactccaaggccgtgaaggtcgtcgagggcgggcctgaggtcggggacaagctcatggactacccatgggacaaggtcctcttcactggcagcagccgtgttgggcgcctgatcatgaccaaggccgccaggcacctcaccccggtggcgctagagctcggctccaaatgcccctgcatcgtcgactggcttgacagcaacagggacagccagatagctgttaatcgcattattggagcgaaatggtccacctgctccggccaagcctgcatcgccatcgactacctgctggtggaggaggaattcgctccgattctgatcgagatgctcaaatcaacgctcgagaggttcttcaccaggccagagtacatggcgcgcattctgaacgagaagcatttccagaggctcagtggcttcctggccgaccgcagggtggcgtcctccgtcgtccatggcgggcacttcaaccccaagacactg

SEQ ID NO: 7314 - DNA, 623 bp, Sorghum bicolor
  Clone ID: SORBI-28MAY03-CLUS77008_1
gcctactgtataatcatactacaacaaaatatctttccaacaataacaatgtcaaatcctactgctattggtattgatctcggaaccacatattcttgtgttggtgtctggatgaatgatcgtgttgaaattattgctaatgaccaaggcaacagaacaactccctcttatgttgcctttactgaaaatgagcgtcttattggtgatgctgccaagaatcaagttgccagaaatcccacaaacacaattttcgacgctaagagacttattggaagaaaatttaatgaagacgtcgtccaaaaggatatcaaattgtggccttttaaggtcgaagctggctcagatggcaagcctttgatggttgtgaagcacaaaggagaagtgaagaaattccacgctgaacaaatttcttctatggttttgaccaagatgaaggaaactgctgaagcatttttaaataaacccatcaaggacgccgtcgttaccgttcccgcttacttcaatgattcccagagacaagcaaccaaggatgctggagcaattgctgggctgaacgttctcagaatcatcaacgagcctactgccgcagctatcgcttatggacttgacaagaaaggaaaggg

SEQ ID NO: 7315 - DNA, 852 bp, Sorghum bicolor
  Clone ID: SORBI-28MAY03-CLUS77030_1
cctactggctctctctctccattccctccctctctctctcattggcgaaacgatggagagagtgatgagccagctgcactactcgcctgcagctctcgcggggattcttcccaagagggtgcaacagctgctgatccagggaggcttcctcgatgacccatcagattctactatattgcaccatgtgcaagaatggcaagagctatactcaccttgcttctggatgggcacttttgcaccgatacaattgatattcaacattatattggctcattttctgttcaagaaattcagatggtggagacagagactaaaggctgcagctcctacacggacatggctgctcacagcaagtgataaggacggggatgctttgggacccattgcctcgcagtcagcaggccaccgccgcaccgcataagttgcagccccacgccatcgcactgcagaccgctgcatgcaccatagccctatgctgacccatccgcaggctgcggccccgccatcacaccaccatctgggccgctctaatccatgcgccaccaggatatctgagtgaggagggagattgggagaggggatttgagctgctgctgtggagatttgggggacagaagcagctaggacggggaagggagcctggggcgcccgcgagctccctgcgcagccgggggagaggggaggcggggccccggcggcgagcctcctcggtgcagggaggggcggccggcgttggccagcgcggcgaggcgcaaggagcgggggcgagcgcagcgccgagtgagggaaggcggcccgcgctgcagcgagcacggggagggcggctggcggcgacgggcgcggacccagtag

SEQ ID NO: 7316 - DNA, 626 bp, Sorghum bicolor
  Clone ID: SORBI-28MAY03-CLUS77051_1
atgctcggtctgcgcgccacgcacactcccactcccctgtttcgtttcgagagcagagcagagcagagtagagcgccatgccgcgtgccccggcgagcctccgcctccaggcagcagcctccaccgccaccgcgacaccgagccagcagcaggcggcggcgtcgtctcctccccagcagcagcagcagcaggcggcggtgtcggtggactccgacatggtggtcatcctggcgtccttcctgtgcgcgctcgtctgcgtgctcggcctcgccctcgtctcccgctgcgcctgccgcctctgcggccgcgggcctgccgccgcctcgtcttccgcgcagcaggagcaggctcctccacccaaaggtctcaagaagaaggccatcgacgcgctgcccaccgtgcccttcaccgccgccgcctcctcctcctcggactgcgccatctgcctcgccgagttcgccgagggcgacgcgctgcgcgtgctcccgcgctgcgaccacgccttccacgtggcctgcgtcgacgcctggctccgcacgcgtgccacctgcccctcctgccgcgccggcatcgtcgccgccccggcccagcaactgccgcagccgcccgtcgtgtcgcccggcggc

SEQ ID NO: 7317 - DNA, 863 bp, Sorghum bicolor
  Clone ID: SORBI-28MAY03-CLUS77067_1
gatgatgttcttaggcgagttggaggaggtgctggagctgacagaaatggcagatttccagaagtgtgtggttcctttgttccgcaggatcgcgcagtgcctgaatagctcccattttcaggttgctgaaagggccttattcctgtggaataatgaacatttgttcgacctgatctcccaaaatcgtcaagtgatcctgccgatcatctatccagctctggagaggaatgcccgttggcactggaaccagtcagttctaaatgttacaatgaatgtcaggaaaatgttcttagacatggatgagagattgctgttggcttgtcaaaccaatttccaagaggaggaaaagaagcgagctgcatctgaggagcgaagaaggcttgtatgggagcaccttgagaggaatgctgcatttcatccagtaaccggagacattgggtttgcagttcctcctacatctgctcctctggtagctcccactatgacatgattaatcatggtctcagatgtaattcatactgcttgattgttagctaggtatgggtgtttggtgttgcgcaaggaattttgttgcctttgtaagccccttgtgccaagtctgtaattaatagttgctggtttgacaatgaatgcttgattctttggtgtactctcaagttatggtcatatctttatgtcccaacataatgcccagttatacttggcaggagggggtgaaaaagtgtttccttggaaaatttccactggagctgaatagctgatatcatacacatattgaggtgtgttttttttaatctttggggttctgatttatctacaaaaatgtcaggattgatggctgaacataccacttttcacgattg

SEQ ID NO: 7318 - DNA, 821 bp, Sorghum bicolor
  Clone ID: SORBI-28MAY03-CLUS7774_1
acccaaaggcagagcaaaccaaccaccactgtcccatcccaccaccctccgcctccgctgccgattcgaaagcgcccctccccccggcctgtcccctcgcaaaaaccctagctccagccaccaccaccatgaagggcaaggccgacacctccaagaaggatgagggcaggctccgggccggcggcggcgccggaaagcgcaagaaggccgctgcgagcggcaagcccaagcgcccgccctccgccttcttcgtcttcatgtctgaattcaggcaggagtaccaggcacagcaccctggcaacaagagcgttgcggccgtgagcaaggcagcaggggaaaagtggcgtgctatgtcagagcaagagaagcaaccatatgtggaccaagctgggcagaagaagcaggactatgagaagactaaggcgaactttgagaagaaggagagcacaagctcaaagaaggctaagactgatgatgacgatggctcaaagtctgaggttgacgatgaggatgacgaggacgatgagtaaatactgtctccgcagtcatgagatagcaaatcgagtgttaggtccccaactagcttaccggcttgttatctttaatgttaagttgtttggaacaggtgtttatgaaggggatctattagtttcgtgaggttgttagtttagtgcattagcaaagaaaaagctgaatgctgctagctgttctgttgcttttcttttgttgctgctagctgttctgttgcttttcttttgctaaccacttgtcacaactttctgtacctgtttcattgactaatctagtgactagtcagttat

SEQ ID NO: 7319 - DNA, 590 bp, Sorghum bicolor
  Clone ID: SORBI-28MAY03-CLUS77758_1
aaactcgcaaagcgcccgacggcgagcacgaggccgccgtcctttgtcatcctctcgtttcagctggatcctccgccgccgcatcctcagctcgctgctgccgtcaccacagcgctggctcctccgtcacgggcgtggatttgttccccttttctggtacaagcatcccctgaatggattttttcactgagtatggtgagggaagcaggtacaagatagaagaggtcataggaaaaggaagttacggtgtggtttgctctgctttggacactcacactggtgaaaaggttgcaataaagaagataaatgaaatatttgaacatgtgtctgatgcaacacgtatacttcgtgagatcaagctgcttcggctcctgcgacatccggatattgtagaaataaaacatattttacttcctccatcaaggagggaattcaaggatatatatgttgtgtttgaactcatggagtctgatttacaccaagttataaaggctaatgatgacttaactccagaacactatcaatttttcctgtatcaattacttcgaggattgaagtacatacatacagcaaatgtgtttcaccgagac

SEQ ID NO: 7320 - DNA, 730 bp, Sorghum bicolor
  Clone ID: SORBI-28MAY03-CLUS77766_1
attctactcgccgtcgttccctcaattcatcatccatccccatccaccccaccgactctcagatctctctccccctctcgctctcctccctctcccgcgcgcgctgcggcggatgtcgtcgtcggcgcgcttcgatctccgggcctcgtcgcagcagctgcagccgccgccgtcgcacgccagcatgagcgacgggggcgcgttcgcaaacgcggggaacctggagcactgcgcccggtacctcaaccagacgctcgtcaccttcggattcccggcatctctcgacctcttcgccaccgatccggtctcgattgcaagaacatgtaactgcatctatgcactgctgcagcagcggcagagggatattgagttcagggagtccacaaatgaccagcggcagcggatgcaatctgacatatcacgactggaagccaagattgagagaatggatgcccaattagcagcgaaagatcgagagctagccactcttactcgaacggaggccaaaaacactgctgctctgaagtctcagattgataagctgcaacaagaacgtgatgaatttcagaaaatggttataggaaatcagcaagtacgcacccagcaaattcatgaaatgaagaagaaagagaaggaatacataaagttgcaggagaagctaaaccaggtattgatggagaagaaaaaggaatcatcccgttctggaatggagataatgaacttattgcag

SEQ ID NO: 7321 - DNA, 672 bp, Sorghum bicolor
  Clone ID: SORBI-28MAY03-CLUS77789_1
aattcttaggcttggagcaaagcaaacaagctttgatttgtactcttatctttcccatcttttggttctgtccccactcggcacctccttgccaccttgtgtgctgtgtgactagaaagtcacagctgccgagttggaactgcaagaacacatcagatcgatcgagggtgtcacatctgttgcttagttaacaagttcatgctcttgttgacgaactatatatgctgtgcagacttgatcgatatttcttttgacatttttgcagcgacaaatccaaacattcgtcgcggaggccaagccacgagcaactggaagattcagtgtggcttgcatccttgaagtcaagtgatgccagtgctcagacaataacgtcatggtggtcggcgtccattgtgctgcggtctgccttggcaatcgcagtgaccttgcttgttgcacaacttgcaccgggtcatcctatggtcagcttgctatgattcggcaagttgcacggttcttgatccataggttcagaccggaagaggattagagcagtagtagtgatcagcaatgggttgagaatattctgtaggctttttgtttgtggataggcgctagaaaaggaatgatgtgttacaagttggcaatcggaattaccagaatgcattgcataagctcattcattgccttcac

SEQ ID NO: 7322 - DNA, 649 bp, Sorghum bicolor
  Clone ID: SORBI-28MAY03-CLUS7884_1
gcacgagggtcatcagtgtgaggaaactgctgccagactaatcgaggcattgctgaacaatgtaagaataagggaggcaaaggctgctaaaaatgctattgcaccattgtccatgtaccttctggatccacagacacaatctcaacagggaagattgcttgctgctcttgctcttggagatcttttccaaaatgaaggtctggctcgttctactgatgctgttgcagcatgccgtgctctagtcaatcttcttgaagaccaaccaactgaagagatgaaagtggtagcaatttgtgccttacagaatctagtcatgtacagccgagcaaataagagagcagttgcagaatccggtggtgtccaggtcctgctggatcttatcagttcaagcaatcctgacacttctgttcaggcagcaatgtttgtcaaacttctgttcaataatcacactatccaggagtatgcgaccagtgaaacagtcagagttataactgcttctattgaaaaggatatatgggcttctggaagtgctaatgaagagtatctcaaagcacttaatgctttgcttagtaacttccctcgtctgagggtcactgaacctgccacattgtgcattcctcatcttgtaacatcccttaaaactggttct

SEQ ID NO: 7323 - DNA, 1162 bp, Sorghum bicolor
  Clone ID: SORBI-28MAY03-CLUS77388_1
cagaccagacccctctcctcaccttccttccttccttccttcccatcgcaatcgcaaggccccggctccggcttcgtcgcggcgaggagggagggggttccgccgtggaccgcgcggcacttggatgagaagggcgggcggcggcggcggcggcggaggaggaggaggaggatgcggaaggcgtacagggactccatcaaggtgctcgaagctgacatccagcacgccaacaccctggcctccgagtttccccgggactatgacggtgcgtgtctgcagatgcggctgtcgtacagtcccgcagctcatatattcctcttcctggtgcagtggacagactgcagcctcgccggggcgcttggtctgctgagaatcctcatatacaaggtttatgtggatggcacgacaaccatgtcgactcatgagaggaaagcaagtatcaaagaattctatgctgtgatatttccttctttgctgcaactgcaaagggggatcactgatgtggaggacaagaagcagaagcccgtgtgcatggagaggtacacaaagaaagatgaggacgaacggggctccttatctgatattgatgtcgagagggaagaggagtgtgggatttgcatggagatgaacagcaaagttgtgctgcccaactgcacccatgctatgtgcctcagatgttaccaagactggagttcaagatcgcagtcctgcccattctgccgcgacaacctgaagaagacctgtcctggtgacttgtggatctatgtcgaggaccaagatgtggttgacatggagacagtgtcaagcgagaacctcagacggctgttcatgtacataagcaagctgcctctgattgtcccagacgtcattttcagtgtttatgattcccacataaaatgaccgcgatgccttctctctgaggaccttcagccagtgctcagtgcccagtttcagttaatcttatgcccccatcatgttctccattttcatgctttactcaagctttagtgcctgaactgatttggaaccgcaagccttccgttggtgctttagaaacttatttagtgcctgcatgcatccttgatcatatgcagccactctgtacatatctgacttggctcagttaatagagaactctgtgcttgccccaaatggaggcagg

SEQ ID NO: 7324 - DNA, 647 bp, Sorghum bicolor
  Clone ID: SORBI-28MAY03-CLUS77385_1
cttactatggtttcccggccaaccatccaagagggtttggtacagggctgcataacgaaggtgccagtgagagtgataccagcaaaagcccatcagttgaatctagttcagattgcgtgggcaatgctcatacaaccaccccctaccaactgcaaagttgtcaaggagtcacttgggccagttgagtcaggtccaagtgttgagctgaaacccagcgtgaattcggccttcgtaagagtgaagccgagcagcggcagcagagaccaaccgataaggggattcatgccatacaaaagatgtaaagtcgaataacccaaccagatatttgtctacagctaatttgactgaagattgattgatcttgaacagtagagactcaagtggcacacagcccctgttccagtgtgcctgccattttttgcctgcaaaagaggtaccgagattggcaagtgtatgtgtaacattatttttcatgcttgcagcgcaatgtaagattctgcaagcttgttgctgttacctagtgtagactggacagatattattgtgcagggatgccgatctctggcctgttatgttgttgtataaggaaaccagattttgttgaactctcctgttcaaagttattaattcctaatggaaactgattt

SEQ ID NO: 7325 - DNA, 748 bp, Sorghum bicolor
  Clone ID: SORBI-28MAY03-CLUS77364_1
aactcaaaggaagagaaggctgacgccgagaaggataggaataggagatccagtgaaggtcgtcctagtgatgagcgaagagaaaagcttcatgatcgcgagaaggataagcccaagtcagagaacaagaagattctggatgcaaagcaattaattgatatgatcccaaggacgaaggaagagctttttgcctatgatataaactggacgatatatgacaagcatgagttgcacgagagaatgaggccctggatttcaaaaaagattattgagtttcttggcgaggaggaatcaactttagtggactatattgtttcctgcaccaaagaccacgttcacgcagaaaagatgctagacctcctacagtcgattttggatgttgaggccgagatgtttgtcctcaagatgtggagaatgctgatatttgagatcaagaaagtcgaatctggactatcaggaagagcaaagtcatgaagcttgtatgacctctgatttacatcagtcatcaaactgtgatcacgcttgtaaggtcatactgcactacaaacatcaaaaaccatttttagtgacgctgagttgatggttttgatttgactcttcccttgtagaaatgtatacgagaatcaatgagatactgtgcgtaatttttttgatagattgcataaatgtgttggcgcattttactcttgttccctggtgaatgacgaagaatgtcaatgctggcagtagccaccacaagtaatccctg

SEQ ID NO: 7326 - DNA, 823 bp, Sorghum bicolor
  Clone ID: SORBI-28MAY03-CLUS77401_1
tttctctttagaaggaatctgctccgtcagttggtatcacaactagcgaataatcatgacagattccttaagcaattaaacggaacacataaggcccatgttcacacaaagcgtgaggcccatatacttgcaagatacaagcccaggctcaacacgacatcactaatatggcaactgaaacaagctgatgaatacactcgcgatgctattcaaaacctaaataacacccgccacatcactgtctactacgaggatatcgttcgcaacagaacaaagctttttgatgtcctggatttcctcaaagtgccaaggaggaatctggtgagccggcatgtgaagatacacacaaggccactgtcggagcaaattgagaactgggacgaagtctacagtgctctcaacggtacccagtacgagggcttcctgaatgctgctgactacgtagtataacatcacgtctccacatctctcgatgtggatgtagatgtagatatagtcccttatagcatccccttgtgtgcgtgtgattgtttcgttcttttttttttctttccatgtagctggccttggacgtgcctggcagaaattttgatgcggggaaggcgctttgccatggttgcattactctgagttcctggttagcctcactattaattgtacacctgctttcctgatgtccctgttacctaccctcgagcttctctgatgtcaggccgtccgctttgtaatgcttgctgtgccagttcacatatgcttgcgtgctgtcctcggtgatctttactctcttgccatcgagaaatacagctgtgcacctgtttctctc

SEQ ID NO: 7327 - DNA, 813 bp, Sorghum bicolor
  Clone ID: SORBI-28MAY03-CLUS77404_1
agtcccgtcccccttcccctccgcctcccccgcggcccagcctcccccggcccctcgccgccgcgtctccccccctgcgccggccctcttctcctttgcccccccctttcctgcggtctgtggctcccggctcgccacgtggcggcttggtgtgcccccgcggcgcttccacctgttgtacgccacgcactcctcctcccggtctcgtttcccccgtccgaagcactccgctctgcacgtgaccccacgctgccgccgcacgcggccccggctccttgggcgccgggcccgactcatcgcgtccagggggccgctgcaggaaagaggtggtttgccaattgacaaaaggctgccgccggatgctgtccaatctcccctggtggatgatgcaatgcaacccaaggaggggacggatgggtaccctgtcaaggctcggaagccttacacgatcacgaaacagcgagagaagtggacagaagaagagcatgggaagttcctggaggcactgaagctttatggtcggtcttggcgccagatacaagaacacattggcacaaagactgctgtccagattcggagccatgctcagaagtttttctccaaggtggtgcgtgaacctggggcaagtaatgcaattgagatcccaccccctaggccaaagagaaaaccactgcacccataccctcgcaagtgtgctgactccaccattgcaaatcgtccaattggcgaaccgaagaatgctcctatttcatcatcatctggttctgatcaagagaatggttcgcctgtgtcggtgttatctgcaatgcaatc

SEQ ID NO: 7328 - DNA, 742 bp, Sorghum bicolor
  Clone ID: SORBI-28MAY03-CLUS77436_1
cctactggattttcctttcgtattatcctcttgctctgttcgtccggctcttcgccctcgccggcgcgcgggactaccaatccaaattggcgacgaccctctgccgcccgccccactgcagattcggggagcgcaccgcccgctccaatggcgattagagtcccgtccatggagctccaccgctcctcgccgctgctctccggtggccgagggaggaatacatgcccacagaagaagcccttccttgtccaagcaaagagactaggggggttggagaaagcgagtacgaggttaggaacacaagagtctggacaaccaaagaaaagagcacccctggttcgtggaactgttagcccacctcttccagtaccaggaaacatacctcggcctccttatgttggcacaaaatatgtaccagagatagcaaaagaggtacaaatgcacgacaacgagagcattgtccatatgagagctgcttgcgagcttgccgcccgtgttcttgactatgcaggaacattagtgaaaccctctgtaacaacagacgaaattgataaagcagtgcacaagatgatcatcgatgctggagcctatccatccccacttggatatggtgggtttccaaaaagtgtatgcacctcagtaaatgagtgcatgtgccatggaattcctgattcacgcgagctacaggatggagacataattaacattgatgtcactgtctacttgaatggttatcatgggg

SEQ ID NO: 7329 - DNA, 877 bp, Sorghum bicolor
  Clone ID: SORBI-28MAY03-CLUS7850_1
gattgggttgtatgatgtccaaggtccgattccactcgtaaaaaatgtttttattcctccggacttagaagaagatggcctgcctgttgcccttgaagatgccatgcccctacattcttttttggctccagttgacacatgcaaggatcgaattgctgctgctctggagacactgcgacctacatcttcatgggagagaggtgctgcttctgggcaggaagaggatactgttttgctcggaggacgaggttttgggacagccatgtctgctttaattgagtacctaagttcagaatatggttctacttttgctttagctcgggtttttgcttttctgtctggtgctcctgattatggagctggtctgctagataccaggagatatggggagcaatatgctagtaaaggggtagatgctgaccttgcattactccctgaacagatacctttctacagagacctagcagctgttgctgttcaatcaggagtatgcgtagacatatttgctgtaactgatgaatacactgatttggcttcactgaagtttttaagtattgaaagtggtggatctttatttctttatgcaaatacagacgattcaacgcttccccaagacatataccgcttgctaagtcgaccctatgcatttggttgtgttctaaggctcagaacatcttcagattttgaaccaggcaattcttatgggcatttcttccctgaccctcaatatgaaaatgtgcaacacatcatctgctgtgattcatttgccacttatgcttatgactttgagtttgcccataacaacggtttctccaggcacacagatcctgctgttgtccagatcgcttttcagtacagcgtgattgaacctgtcaag

SEQ ID NO: 7330 - DNA, 539 bp, Sorghum bicolor
  Clone ID: SORBI-28MAY03-CLUS78526_1
acgccaggatgcagcccgagaggaagcggcgacctgagcaactggcccctgggcaactaccgcggcttcgtcatgtccgccgcggtccagggcgagggccggtgcagcaaaccgactgtcgaggtcggggtggcgcacatcgggtgccccgaggacgcggcggcatttgtggccctcgcggcggccgtggacctgagcatggacgcgtgcaggctcttctccccccggccgaggaaggaactctcgcccctgcgggctgacctactccggtgacccatcggccatcggaccggcggcaacaacgaatcgcgagcaaattgtacagaaagtagttgaggcagatttgtgctttagagtgcgctagtttgttggagtagttcgattcgagctggtgatcgtctagttgatcgtggtcccctactttttttttcgtgagcgctgagtgtggtgcggtgtgattttttggttggttgctaagctttagccatgtagggtgtcctcttttttggatcgctccataatttagagcaatttggctc

SEQ ID NO: 7331 - DNA, 532 bp, Sorghum bicolor
  unsure (1)..(532): unsure at all n locations
  Clone ID: SORBI-28MAY03-CLUS7877_1
ggaaggctttccttcctgtggtctacaatatatttaatcttcatggtgcaacactaatggcaagggagaatgaccgcttcttgaagcaaattgcttttcatcttctgcggcttgctgttttccgaaatgattcgattagaaaaagagctgttgttgggttgcagattcttgttaggaactcattcaactatttcaagaacactacaaggttgagggtcatgttgacaattactttgtcagagttgatgtccgatgtgcaagtaactcaaatgaaatccgatggttctcttgaagaaagcggtgaagctcgtcgccttaggaaatcactggaggaaatggctgatgtgagaagcaaggatctgttaaaagattgtggcctccctgttactgcattggaggcggtccctgaaggttcctctgatattagngtggtcttgggtagaggtgaaacatctgtctaaatgtctagtccaggcccttgatgctggtctggaacatgccctcttgggttctgcagtgactgtagacaggt

SEQ ID NO: 7332 - DNA, 531 bp, Sorghum bicolor
  Clone ID: SORBI-28MAY03-CLUS77572_1
agtacccagcctgcaaggagctagtgtcccgtcgagaattgaagctagcatgagtcgggcggcggcaatggccgccgtggcggcggcggtgctggtgtgcgccacggcgttgggagtagtaggagcggaggtggtggacgagttcggtggcggtgcgtccttcatcttcggggactcactcgtagacgccggcaacaacaactacatcccgactctatcccgggccaacatgacgcccaacggcatcgacttcgcggcgacgggcggggcaccgacggggcggttcaccaacgggcggacgatcgcggacatcatcggcgagatgctgggtcaggcggactactcgccgccgttcctggctcccaacacgagcggcggcgcgatcctgaacggcgtcaactacgcctccggcgggggcgggatcctgaacggcacggggaaggtgttcgtgaaccggatcgggatggacctgcaggtggactacttcaacgtcacgcggcggcagctggacgcgctgctggggaaggagaa

SEQ ID NO: 7333 - DNA, 627 bp, Sorghum bicolor
  Clone ID: SORBI-28MAY03-CLUS77575_1
aactactcgaggctatctggtatccgctgcatcgccaccgccgctgcacgcgcagcgcgctcccgcctccagttcccgcgattccagcgtgctcccaccatcttcctcgctcccgcctcagctttcccgcgattcgtcaccacgcgagcgcgctcacgttcttcttcccgcgcgccgcagccaactccccgcttcataggccgctaaatctccatctccagtgaggtgtgtcgctcaatctcaaggcctagcatcgtccgtccccaatccatcccaaatttgagcgaacatgaatcagctgaagaggaatccgagttcaagttccaggcgaggcactggtactctcgctgctgtcgctgccagttctgctagggttgcccgttctcctgccgcccctgctgacggaagtgctcctggcgcccatggatccaactctactgacggtaatcacgctgccttggctgctgcatctccatcacttctaagttttcaagctgccggctttcctgcgtggtggttaagttcttctccgatgggctccagtgaagggatgcacccaccaggtggatttaccaacattctccagtcaaacatcagtcctgaaaattttcatttagttggcaatac

SEQ ID NO: 7334 - DNA, 675 bp, Sorghum bicolor
  Clone ID: SORBI-28MAY03-CLUS77599_1
ggcggctcggcccctccctccccttctcaggctcaggcccgcaggcctccgcggcgcagcccccgacgcctccctccgtggctccgcctccgcctccgccaagcgcccctctctgtcgcccttcgccgatcccctccgctgaatccaatagaagaaccaatcgccgctgccggcgagggggctcggcgcacagcgcaggatggcgagcggcagcagcaacggggagccaagcacagcgccgcaggcgaaccggtggtacgacctccgcctgggctcctcctgccgtgacccctcccccaccgccaagttctgcactctccgctatgaatttaagccagcatcaattgacaagactcaagctggttctctgcagagtaccaaagataaccgggttactgtggaattccataataatcagcctggcaagccaaaggtgacatttgagggaagccaagaagagtacaaggataatgatggcgttttattttttgatggtgagacctttcgcctagagaggttgcatagggctgtgaagaggttaaggcatgtacgagttccaggagagtctgcagcagttaatttggcagctacaactactggaatgggtgcagaatcacagtctcctccattacctaaagtcagcaagtcacagaccatgagcaaacctgctgttca

SEQ ID NO: 7335 - DNA, 758 bp, Sorghum bicolor
  unsure (1)..(758): unsure at all n locations
  Clone ID: SORBI-28MAY03-CLUS77624_1
tctggatgcatgcacactactcacattcccttgtctcttgcattgtcagatcctccgtgccagctagctagcttgcattgtcagatctatctatccaccgtaccacacggtccacagcagcgcgctaacttaacaatggcggccgccgctcgccttcttcttggcgtccttgcgcttctcgccgccgtgcaagcggtctacggaaagagcgccgtgctgtctctgcgcgagttggatggacgacggggtgccgctacggagacctggagccgccgctacggcgacgcaaagcttgctgaaatgctaggagagcacaagaaagcaggggcagcaagaacagcgaccaccgtgctagagctcaagcgccactccctcgttgccatccctgacgacgatcccgccgcccacgaccgctacctccgccgtctcctcgcagccgacgaatcgcgtgccaactcattccagctccgcatccgcaacgacagggcagcggcagcgtccacgcagtccggctcggcagaggtcccgctaacctccggcatccggttccagacgctcaactacgtcaccaccatcgcgctcggcggcggcagctccggctcccccgccgcgaacctcaccgtcatcgtggacacgggaagcgacctcacctgngtgcagtgcaagccctgctccgcgtgctacgcgcagcgcgacccgctcttcgaccctgcgggctccgccacctacgccgcggtccggtgcaacgcctccgcgtg

SEQ ID NO: 7336 - DNA, 684 bp, Sorghum bicolor
  Clone ID: SORBI-28MAY03-CLUS77671_1
actgttactgctaatggaagacaggagtcagggtctcctcagtctccacttggtggcaagacggatgtctttgacctgccctttcatatggctagagatcagatagaagagagtttgcgcacaaaaatgacttcaatcaaggcacgaatgactcaacttcaagatgctcagaaaggtgcagaagtgacttctgaggcaactgaccgggagcttgagcttgaagctcagctggttgaagcaagaagcatcatccaagagcaggcttccatcatgtcgaagcacttcaccaagtctgataagacaagtggcaggaggcatagcggtctggatggtgagcgcgaggcacctgccgaggtgtaaaaacatgtctgtagcaaggatatctgttctgcaaggcctcctgtttttagtaagtactgaggtagtatgttgcaggataacatcgttctgtgctgttgtattatgtatgttgcaggataacatcgtcttgtgctgttgtagttgtagcccgagtctaagtgctgtctatgcagtatgatgtgcaggagcatctcctccgcacatggctaaccagatcatatctaatagtcacatgtagcgtaactgtaatcatattcatactgtatgaagaatgtcagtgtagcaacctttacacccctggaaaaaatggacctttcgtgcctt

SEQ ID NO: 7337 - DNA, 1126 bp, Sorghum bicolor
  Clone ID: SORBI-28MAY03-CLUS77623_1
aaaaagaatgccgtgccgagattaaaaaaaatcgtgtctctctcatgccccgacgctggacgcctctctctctccctgtgcggtgctccctcccccgatggctgccggcggctccggtgctctctctcctccaggcgatcccaaccccggctgtgctcctccctcgccaacatggtgccgctcccccagcggtctccttgtcgcgctctatgttgggctagagctcatcctcttcctcgaagatggcgcatcgcctagatccacaagacctgatggtgtctgatctggtcggcaagcaggaggagctcgagcgggatgaggagcaccagatgaaaagcaagcagatcgagcaggatgaagagcaagtagattgacaagtagtggatgggggcggttcatcttctcctagcccaggtaacaagctccgatggcacatcttgggcagcacgcgacctccaatgaactacttgaggtgatgccgtgatggattttttctttttatgcatggatgaaggggatttctttaattctttttattcatctattgttcctcttgcaaacactcagtgtccatggcaggagcttcgctaggcagctacagagggtgctcaacattttcctttcgactgtattgttccagctgatgcaactctattggatactgtaggatcggacatttatatttcaagttgattcaaattctattggataatgtgtaggatcgagcatttataccgtgggagcagctatatgtgcacttcgtctagacaattctatacattgttggagcatgcttttatgcattgttacaatattgtgatatacgctgttggaacaattattcgtatagtggttccagcagtggatatatttgaattccagcagtggatacaaagatccacgtttatggttcgtgcataattcatcttcattgttttgtttgtagattttgagttattatgcttgagtgcataagtttctatgcatggttaaactatagcttggtatgtattccatatatttttacaacaaattagcctatatttttggagcagttaactatacacttctatacagctatatacatagttggagcaccttttttatgcaatgttgatgcttctat

SEQ ID NO: 7338 - DNA, 827 bp, Sorghum bicolor
  Clone ID: SORBI-28MAY03-CLUS77461_1
tgaggaaagaagagagcacaagagaaggcaaaagaaacagaagatgtaagcggtgatggaactacagctgttgctgaaaatgaatcatcaaaacctgttcctgatgaatcagataaggagacaggagatgctggagataaggacaatgaagagagcactaagaaatttgggattgttactgatgaagactctcaagctgataaagacatcgcagaaaaaataagcaatatgattgaggagtggttaaagactagaccgccacccccacctccacctccaccagttcaaccatctgctgatagctctggcgtagataaggcaaaaaatgattctgatgataagaatgacgctgacactgataaaagggcagttaatgaaactgaaagatctgaaactgcctctcctgataggaggaaggacagagagcatgataaacgggacagagatcttgaaaggcatgatcgtgaacgggagcgtgaaagagtacggagggatagagagaaggatcataagcatagagaagctgataggctatacagggatcgccttaaggagtgggaatctagggagagagagaaagaatatcagagatatagtgaaaaggagaaagaaagagaccgggaacataaccgcagaagggagatcctgaagcaagaagatgatagtgatgaagaggataataggaaaaggaagcgaaggagtagtagctcacttgaagataggaaaaggaggaggcaacgtgaaaaggaggaagatttagcagataaaataagggaggaagaggaaattgcagaagcaaggaggagggctgtagagttgcaacggca

SEQ ID NO: 7339 - DNA, 593 bp, Sorghum bicolor
  Clone ID: SORBI-28MAY03-CLUS79128_1
tggcgcatgtgaaggcgtcagttgagaagcctccgccggctgccattccgccagcggatgctaaggccccaggtgacctccctccagccgccgggtgccctggcgggtgcgcctcagttgtgacacatgagaattcaacagttgagaagactctgcaggatgccattgcgccagcagatacaaataccacactaggggaggccccaacggtggagaagactatagaggatacctcggtcgaggcaccagatgcacaagcaggtgcaagtgagtaaaccagcttaacaaaccttgcgttcctgtcagtttctgttgatatcgacatagtctggtcaactgattctcttgtctagatgatgcagtctgtatagaaaaacggaaatcactttagcatcataaggttattaggtattagtaaccagggcatctacatctctatcccttttttcctatataaacttcatctagttgtattggacgcgcacgtgatggtttgtcataaacacagtttcctcctacgtcagttcagtgctcaggcgatcagtgactgagtgaaggccttaaatatatcagatagagggaaagcatgttca

SEQ ID NO: 7340 - DNA, 898 bp, Sorghum bicolor
  Clone ID: SORBI-28MAY03-CLUS79138_1
cgacccgcactacatccgcacgggcgtggtcaccaagaagagcgacgtgtacagcttcggcgtcctgctcctggagctcctcacggggatggaggccttctgcgcggaggaaggccggctcctcaccgccgtcctcgcgccgcggctcagggccggcggcgacgcgcgcgggatggtcgacgagaggctcggctccgcctacgacgccgccgaggccgccgcggtggcggcgctcgcagcggcctgcgtcggcgagaaccccagcctccggccgtccatggccgacgtggtgcgcaccctggagcagagcgcgcagggatccatctccgccgtggggaggagatcggacggccacgggaaggtgtgagtcaccaagggccaagggggaagtcgtcgcgtccaccgaggcgctcagatctggcttgccgagttgttaacgtgcgtgcgtcgcacacgtggcgcccggccattggttggtaggagaacaaagcgttattagtgggcgagcatatcaaaaagacgaatccaaaaaaaaggggaagaaaagcgtggtgaaaaaaagcgttgattagggggaaagatttggatggaggagataaagaaaaaggcagggctaatttgtgcgctgatggttggggatttcgatgatatattatgccaaagcggcatctgcttgggagaggccaaaaaaaaatattggatcgtacagcacacgattctaagattttgtttattcttattatcagtagtagtttcttttgttctttttttaaagtatttcgagtgtttcttccatgccgttgtttgtacgtatagtttagctagatttcgatttgtattgatttgttgagagcttggtttgtgagtgctgtctgctggtgaaaaatgaaatcgcttc

SEQ ID NO: 7341 - DNA, 855 bp, Sorghum bicolor
  Clone ID: SORBI-28MAY03-CLUS79145_1
cctactggatatttttggaagaatcttctctggtacactattgtttttggaacaatagcagctataagtcggaaagtagtggctgatgagcttcaagttattgacccagaaggggccatgtgcctcgctgttcaccaaacacattacatgccaaagcggtggcgtggtaaagagaacagcgaacttgtccgaagagaatttgagacattatttcagtacactataattatgctacttgaagagatggcctccattttcatcaccccttacttgcttatttttgaggtaccaaagcgtgttgatgacattctggcacgaggctcagacttcacaatttatgtagacggagtgggagatgtatgcagtctaagcatgtttgacttcaaaagacatggaaatagaaactatgggtcgccgttcaatggtcttaaaggtctcaggagctcccaagggaagatggagaaatcattcttaagttttcagagtgtctatccatcatgggagccaaatgctgatggcaaacagttcttatctaacctccaaaagttcaaagaaaagcaaatacgtcaacaagcgcttgcacaataccaagcaatggaagcttcaggctttgtggcaggcactagaggtcaaagggatgataccttccaacaactcaatagtgatattcatggccatgctgagaccactttgcctcctgtttataacttgagccccttgggattgctcgacacggaccaaagaactcatccatatatcctggactggtattacgtgtgtcatccaccacaccaagatagagctgaggccccccaatttgaacaagcattccctgagactggtgtgatcacaagt

SEQ ID NO: 7342 - DNA, 578 bp, Sorghum bicolor
  Clone ID: SORBI-28MAY03-CLUS79150_1
caagttgacagtcttgagaaagctggaaatattgcccctgggctaattgaccatgctaatcaaattgggaaaggtacagaagctgcatctgtgcctgaagcgtcatctcagcaagttggtaatgttgaggaagcttacactcaaaaggaagtgtcaatcagtgatctacccacagagacagaaaccttacattctgatgctataataaaagagttgcctcagaatgatgctccagataatatgcaaacagatgcagtcgaagctccaaaacagagtcacatttcaggagacaataccgtatttgaggcagacactgaagcaccaagtactgcacaagatcatactgaggatgatactgggaatgaagttctagaagagcacatggtatctccagagttattacaaagtcaaacctctggtgagaaactagtgggaaagacagcaactgaacaaaaagtgggacctgaggacccagagtcacaatctgaaaattttgctgctgaacctgaacctttcgtacaaggtgcagttgagcaagtagaagtggaagtggaatccaaaactactgttgaagtatc

SEQ ID NO: 7343 - DNA, 609 bp, Sorghum bicolor
  Clone ID: SORBI-28MAY03-CLUS78038_1
aaaaaaagcaaaaaccgttggaaatctgttttccaatccacgccctgtcgtctccgctggacctcctcgtcgaccactggaactggagttccgacttccagccttcccgcgatgtgttcctgcgcgcgcctcctccccccgctcttcagccccgctccaagcccaaagcccagacccgccttcccgcacggcccaacgccagcccggagccgcgccctcgtcgcgctcgcgggcgcagcctcccgggacgacgcgcctgcgccgctgtccggcttcgacttcctcgcgctgaagcgggagcttgaggaggaggaggaggaggaggaggcagtggtggctgtggattcgaaggaaggtggggctgtcaatgtggacgatggagggagtggggcagagagaagtgcgggtggtacgaggaggcggcggcggcggcagatggcgaggcgatcggctctgctcgcgaagcaggtgatcagtgtgagctcggcgcggagcctcgggttcgtgtcgcagctctggatcgacgccgcctcgattacagacagctccagaggccaggtcaacacatctctgttaattgcagagcttgatggtcaggctcagtacgtc

SEQ ID NO: 7344 - DNA, 668 bp, Sorghum bicolor
  Clone ID: SORBI-28MAY03-CLUS78057_1
gcctgtacctggactcgctgcggaagaaggtgcccgccaggctcgcgtcgggcgcgcacgtcctgggcaacgtgctggtgcacgagacggccgtcatcggggaaggatgcctcatcgggcccgacgttgctgtcggccccgggtgcgtagtggaggccggggtgcggctgtcccgctgcaccgtcatgcgcggcgcgcgcgtgaagcagcacgcctgcgtctccagcagcatcatcggatggcactccaccgttggaaagtgggcacgcgtggagaacatgaccatccttggggaggacgtgcacgtctgcgacgagatctacagcaacggcggcgtcgtgctcccgcacaaggagatcaagtccagcatcctcaagcccgagatcgtcatgtgatggatccaggaggaaatctgggtgggggcgccaaatccaaattacaagggccccttgcaacccatcgcaatgtgcttcatacttttgttgtttgattttttgctcggttgtctcttgtctgcaactgtaaccaacttgtctagtgtttgccagctatatggttaaggcaaatttcaggtttcgcgcccgtgcgtgtagatagggatcagatgaatggaaataacaaaagttttcgtcgtgttattataagttgatgagcaattgctttttctc

SEQ ID NO: 7345 - DNA, 860 bp, Sorghum bicolor
  Clone ID: SORBI-28MAY03-CLUS78078_1
ccgagaaccagctgacgggcgcgatcccggaggggctgggccgcggctccgggaatggcgggaacgtgctgacgtcgctgtacctcggcgggaaccggctgtcgggcggcgtcccggcgagcctgctggcgaacagcgggctcggcatgctgaacctgagccggaacgcgctgggcggcggcatccccgacgcgttcacgccgcggtcctacttcatgctgctggacctgtcgcggaaccggctcaccggcggcgtgccgcggtcgctgtccttggcggcgtacgtgggccacctggacctcagccacaaccggctgtgcggaagcatccccgccggcccgccgttcgaccacctcgacgcccagtcgttcgccagcaacagctgcctctgcggcggcccgctcggcaagtgcacgtgacgacgcccgccgcccatacggtcgctgcagctttgttaccgtgatacgtacagcaagtagtgtctgatgacgtggtgtaccgtatgtgcgtgcatgcacgacgaggcacgacgcgtaacaaactttccagtacgtccgtgtgcgtgggcgcatgtatacgtacgtgcgtgttgcttggagcttggttaatataagctgttaatcttataggttgggtggtggtaaactggtaatggatagatgatgacaacttgcgtcgttgtggtgtgcgtgatgagtgaggaagttaaatgcgtgaggaaaagaagaatgctcgtctttcctctgatcccttccactttttttctttttctttttctttttttaaaaaagaagagtttggtttgtactagtgtctgaatgaagcaaaaagatagctagcttagtagcttgtgctatcag

SEQ ID NO: 7346 - DNA, 874 bp, Sorghum bicolor
  Clone ID: SORBI-28MAY03-CLUS7826_1
tacaatgggctagactaattcatacgatgttcctagttcaggttgtgtagttaaagactacaaaattgttggcaaggatgccaaaaaagacatatcagacatggatgaaagatctaagattgggcttagagctacttctctagttatatatccaggaaacgatggggactcgccgtctagctcttactatcagagtgaggaccagcaagattcttccaagagagttgaaagagtacaaatccataatgatgaaccacaaggaaatctgctaggcaagcaatgcactaacaagcgaactagaaagccaacaaaaagatacatagaggagctatcagacattgagactcatgactccactgtaaaaatctcttcaccagcaaaaaggcctgcacatgatgaagtgttaatgaaaccgcgggtcgcacctttcaatgaggctgattctctgggcacaatctatcctactagaaaggatacccttggaggatttagtgtacatgttccttacgtttcaaggatgagaagggggcgccctaggaaggacttcatttcatttgcggataaggaaccctcggttgaacctaaagggattcagacagcagttgaggtgatattggagaaagatggtgacaagggaaaccacctgaggaaagcacctgaagttccagtaaaggtaagttctgagaaagggcatatagaagcagttgattgtgaaggggttcggaacctacaagcaaagctttacagtgctgttgccaaacctaaaattaaccggggtttaacgcggaagcatcatcgagcattgacattgtgtgaggtcgtgaaactggttgatggtgtggctcggtttggagctgggaagtggtctgagatc

SEQ ID NO: 7347 - DNA, 786 bp, Sorghum bicolor
  Clone ID: SORBI-28MAY03-CLUS7819_1
gcacgagggttacgatggtgaaagttctcattgggcatcatcagctttccacataaatgatgccacccgctataaatctggttcaaagtccataggaaagcacaaagcagcatcggaatctggtagacctcccaaatccaaagtccagaagattactgaatctcatcaggaagggccaattgtcatgagtaattttctccgtatgcctgctcaaatattgccaagtacagctgacttccacattagtgactccctatctgaatttggtatcagcgattctgaattcaactactctgaggatctctttcaagaggttgacgattttgagttcttcccagatcagggtgactctggtctccttcctggtattgaagagttagaacctctttcggatttcacagatatcggatgaacatagatgagcaaattattcttgatgggatgccctcctacaccaagaggagacaagattgcctctggcaggagcccaaggatataggttgagttgcccagccgtgctcaaatgtgttgcaagcttgatcatggttggctggagcgaagctgctggcttggtgaggtcacattgatctgacaagcttggaggatggatttgcactaatggcggcattgggtaatttccatacatgtatgtatattggtagtctagaatcgtaggatgtagaaatgcctccctcatttgtgtttgggggtagcccttgtaactcgcccacaggaaattttgttgagcaggtaccaacagagaagggaaaagaggaggccttcagc

SEQ ID NO: 7348 - DNA, 752 bp, Sorghum bicolor
  Clone ID: SORBI-28MAY03-CLUS7836_1
gcacgaggattttctttgcattgcattgtcagaaatgcttcgaatattgacaaacaatgctaccatagcaaaaggtccatctgcagccaaagtagtacaacctcttttctctttgctttctaaggcggacatgggtcctgaagggcagtatagcacattgcaggttcttgtgaatattttggagcatcctgaatgccgtgctgattataacttgacaccacgccaaactattgagccagtgataaccttactgaattcatctccaccagctgtgcagcaattagcagcagaactcctatcacatcttcttctagaagaccacctccaaaaggatacaacaacagagcaggcgattactcctcttattcaagttctttcttcaggtttgccaaatttacagcagagagctataaaagctcttgctaaccttgcaatagcttggccaaatacaattgcaaaggagggtggtgtttttgagttgtccaaagtgttgttgcaatctgacccgcctttgcctcatgttgtgtgggaatctgcagcatctgtattgtctagcattctacagtacagtacagagtttttccttgaggtacctgttgcagtactagtgcaattgctcaggtcaggaactgaaagcactgttgtcggtgctttgaatgcccttcttgtattggagagtgatgactcaacaagtgcagaagcaatggctgaaagtggtgctgtggaagcattgcttgatctcttgaggagtc

SEQ ID NO: 7349 - DNA, 649 bp, Sorghum bicolor
  Clone ID: SORBI-28MAY03-CLUS78416_1
tcgccttgcgagtgcccgtgccagaaccgtcctctgctcgcgtcgcctcgccgccgctgccgctgccgccgacgcggctatatacggcggaaaccctaccctgctcggcgcccgcggccgtggagagatagatcggtgacgagcgggaaactcgtagtcggagcagaggaggggtaggggatggtgttcggtcaggtggtgatcggcccgccgggctccggcaagaccacctactgcaacggcatgtcgcagttcctctccctcctcggcaggaaagttgcggttgtcaatttggatcctgcaaatgacgcattgccgtatgagtgcgccataaacattgaggacctcataaaactcagtgatgtcatggctgagcattcgcttggcccaaatggagggcttgtgtattgcatggattacttggagaagaatattgactggcttgaagaaaaactgaagcctcttatcaaagatcactatctgttatttgattttccggggcaagtggaacttttcttccttcactcaaatgcaagaagtgttgttaataaactcatcaaaaagatggacttaaggctgactgctgtgcaccttatcgatgcccatttatgctgtgatcctggaaagtatgtgagtgctttgcttcttt

SEQ ID NO: 7350 - DNA, 859 bp, Sorghum bicolor
  Clone ID: SORBI-28MAY03-CLUS79545_1
aaattcagtttagttttccataagtagcgttcactgcaatatgtactaaacttgagacaatcttgcaatatacttgcttgacaaaattcaaagtcagctcgagggtaccctactatgatttttatgaatatttgcctacgatggtttagatcacatgatgcattttttttgaagggataaggtaggtattttttttggcaatagctttctttgttcattgttccattcatctattagatcaatactcttcctcaatctactatatcagtgctcttgcccaatctactagatggttctggatgcttcatctcaggttaggatgcgatttgttgttttttctgtctctcttaaattgttgcttcgtttcctacaagtaagcatctgctgcctttttctgtaactttttgcaactattgaattgttgcttctgtttcaaattgcagctttagagctacacattggattggatagaggagcagaactgcgggtggacgggtgaaaaaccaggaagctgccaagcagactgcccactggactgccaatgatccctcagttctcatgtcaccgagtggactgttcagttcatgtacccttcgttctctgcattgctcccttgatggagtctgcacatttagccatggtgatgtactgcttgagctgctctgtactagcaacatttttcttttcaaagttgtgttgatggatcatgtatttgaggcaataggaactagctagattttttactggcattgtttagatgcaaaattttgtgaaattttgacactatagcatttttgtttttatttgacaaacattgtctaatcatagagtaactaggcttaaaagattcgtttcatga

SEQ ID NO: 7351 - DNA, 495 bp, Sorghum bicolor
  Clone ID: SORBI-28MAY03-CLUS79733_1
gcacgagggaagcatccccttgctattgtgaacattaagaacagagcggatggaactccaattcagcagctgatatcagaactagaggaggcgacaggatcggttctagtgtcacgagaaacaaacaaagtgattttgtacagaggttggggtgcagaagtggcccaggaaagctcaaaggagagcagcgcagatgaaggcgaaaaggaggtcatatcacctcagctccttgaagctatcaggttagagtgtggattgctccctggcgactcagagtagctgatccggatagcctcccagcacatcctgtgtttcaaaaggatcgtacaatcattgcccgcggataaatggaccatactcataattctgggcatgtatatgcagtgaggcactgaagctgcatagacgcaaggtgtggaaccctgctcactgggatagttgtaacttgtaagaaagcagaaatgagcttgctttagcaaaaaaaaaaaaaaaaaa

SEQ ID NO: 7352 - DNA, 677 bp, Sorghum bicolor
  Clone ID: SORBI-28MAY03-CLUS79690_1
gcacgagggaagttaggcggccaaagtgtttgtgaccaacccaaccccctcttcttccttgtccactgaaaggttcagactcccgttttagcagggtcaccgagacaaaggggagcttgggttggcctggccacgatgaagtttatgaaactcggcacccggccggacaccttcttcaccgccgactccgtgaggtctgtctgcacggaggtggccacggacctgcagatcctcgtcgataactgcatctatcatctacacaagttccctctgctctcgaaatgcatgctcctgcaagcgctgtgcgccgacgccggcgacgtcgtcgagctcccgggattcccgggcggcgcggaggcgttcgaggcgtgcgccaagtactgctacgggatcaccatcacggtgagcgcgcgcaacctcgtcccgctccggtgcgcggcggcgcacctcgggatgtccgaggccgccgacaggggcaacctggccgccaagctggacgcgttcctcgcgtcgtgcctcctccgccggtggaaggacgcgctgggcgtgctccactccacgcgccactacgcgccgctctgcgaggacctgggcctcacgtcccgctgcgtcgacgccgtggccgcgctcatcgtcagcccggacacgggcttgccggctaagtcgtcgacgtcggc

SEQ ID NO: 7353 - DNA, 733 bp, Sorghum bicolor
  Clone ID: SORBI-28MAY03-CLUS79764_1
tcgccgcggctgtcgccggcggccggagcctgcgctccctcgcccctgacagcgcggccccgcacggcgctgcgcgggcccgcccgcccgcccgcaccgcccgccgcgccgccccctcgtgcttcctcccgcatttcagggtccagggcgtcgcgtccccccggggcctccccggtgccgcgtgcgacggcctcctcattggcccctgcctcgcgcactgccagtcggagcagctgggcacctggaacaccaaaccaggtggctcccccaccattcaaaacaaggggattgcaaaatccgttggtgactggtactttgatcgagctgaagtgaaggcgatcgactgccgctatccctgcgacaacacttgccaccatatcatatgagaagatccacatttttattttgcacagtgaagagcatacgttttatcaacaaagtgtacatcatattgatttgggaatgcattcgaatacagccattaaaggaacactaacacaagaaataaatggtaatgacatgtttcagtagatcaagagtgattctatgtttagcatgtgatccattcgatggaatagctatctatcattctagtcagttagcagttggcactaccagcaaatattttctactactacattcagaattctgcatacctgctcatgccaatcctccaaaaactgaagaatggggctttcagtaatcagtgtcgataagaatgaattacattatt

SEQ ID NO: 7354 - DNA, 1105 bp, Sorghum bicolor
  Clone ID: SORBI-28MAY03-CLUS78908_1
caaactgacccgtgcttgtgcgcgtagcaaatctctttcttgcttgctctctccctttctttatttgcttcgcctttattaatttccatttcccgtaatttcctcctccttttcccaccttgcttcctctcctcgctttgctctctctctctctctcacatgcacctaggcagggctaggctcgaggctcccatctcatctctcatcccaatcccattgcatgcgaaacaagcaagcaagaggtcaagaggagcagtgtgtgagtgagtggcgtttggtgtgaagtgaggacttggaggaggaaggaggacgacgacgaaccgccgcgccttgccccggggttccgcctggccgctccccctccccccccttccttgccccccccccgcagtgctgggactgggaggagaaggacaaggtctctgatcagctgagcttgtctggtcaaagctgaggagcccggttgtgctgcgagtccaagctcgacaggaccactgccactgccactgtgaaagcacacagcggcagcggcgacaagagacgaggaggcggaagctgccaagcggatagatctacgcaaatggagaccaaagacgtgtcgccgctccccgccaccgccgccgccgcggcgcctgtgcctgcaccggcctctcagccgccgccggcccctccttctatggcgccgccgccgcagcagcaccagcatcagcaccagcaccagcaccagccgccgccgccgttcgcgcagcaggcggccccggcttcgtcgcctgccgggtccatgcctggcggcatgcggctctccttcgaccagatgtccgggaaggcggccggggagcagcaccaccactccgcgcccatgctgtacgcggcgtcaccgcagtccgcaccgggcgccggcgcgccaggcgcaccgggggccaatgtgctgggcatgggcgaactgatgcgcaagaagcgcgggcggccgcgcaagtacgcgcccgacgggagcatggctctggcgctggcccccatctcctccgcctcagccggcggcgccgcggcccccgggcagcagcagcagcacggcgggttctccatcagcagccccccgtccgacccc

SEQ ID NO: 7355 - DNA, 657 bp, Sorghum bicolor
  Clone ID: SORBI-28MAY03-CLUS78987_1
tcttctaccggatgggtttatctgacaaggacattgtggcactctccggcggtcatactctgggaagagcacatccagagaggacaggatttgatggcccatggaccaaggaacctctgaaatttgacaactcttattttgttgagcttctgaaaggcgattctgaagggctcttgaaactccctactgacaaggttcttgtggaagatcctgaattccgtcagtacgtcgaactatatgccaaggatgaagaagctttctttagggactacgcggagtcacacaagaaactctcagagctaggcttcacaccgcctcgctcttctttcacatgcaaatccggaaataaacaaaagtccctgctggtgcaagctgcagctggggtcgcagttgctgctgcagttgtcgcattggcgtacctgtgcgaatccaacaagaagttcatctaacttatgctcaccattagtacagcaacagtggtggagggttgaaactggaggagtcgaaatatttcagtgctgtccacttgtatttgcaccatgtggctacttattgataataccaagcgtgttatgtgttgtgaagaggtcaaagaatgaaataaagacaaatctaaaaataagagcaaaaaaaaaaagctctgacttggtgcccaaa

SEQ ID NO: 7356 - DNA, 753 bp, Sorghum bicolor
  Clone ID: SORBI-28MAY03-CLUS7903_1
caccaagaacggtgtgcgcgtacggaccaccaggagtggcggtggcggcttcgcccgcaaggtgaagttcgagagcatcgtgatgaggaacgtcaccaaccccatcatcgtcgatcaggggaactccgaccatctgccagcttcatctgaagcagtagcaccggctgcagcgacagcagtgcaggtagagaagatcaactacattgacatcacgggcacgtcggcgtcgaagcacgcggtgacgttctcgtgcagcgacgccaagccgtgtaggcacctgtcgctcgtcaacgtgaacctgacccaggtggacgggaccaaggcgttgtcctactgccgcaaggcgtttgggaggagcatcggcaccgtcatcccggagtcctgcctctccaaggaggacttcgtccagcatgtcccgcaacgttctcaagatggagaagaagattcagattcgtgaatctgtggcagcttcctgcttggctggccggatgattttgtgacgggatccctgatactagtttgtcatgcataagaagaccctaaagacagactgatgacgggggttactgttcaccatcaggtgttgtcggttgccctgtctcgcatggcgggtgccgacctgttcggtagcggctgggtggtgaacggttagctgggcccgggtcgtgctccgctgtagtcagttgccttgtcatgtataaaatgtgtcgaccagtactgaagggggtataaatgaaaggatatctgaaccct

SEQ ID NO: 7357 - DNA, 716 bp, Sorghum bicolor
  unsure (1)..(716): unsure at all n locations
  Clone ID: SORBI-28MAY03-CLUS79075_1
gtgagctgtcccgttgcccctccatccgcaggtgaggagcacccgctcgtcgcggccccccgctcccccccgcctctcctccgatggccgccgcgcccgtcgccccgccgccggcgtccgcggacgacgagatcgtgtacgagtccatgccctgcatccgcgtctacaagaaccgcgtggagcgctacttcggcaccgagttcgtcgccgcgtccacggacgccgccacgggcgtcgcctccagggacgtcgtcatctcccccaacgtctccgcgcgcctctacctcccgccgcgcctcggcgacggcaacggcgccgccaagctccccatcctcgtctactaccacggcggcggcttctgcctcggctccgccttcaaccccaccttccacgcctacttcaacgccttcgccggcctcgccaccgccctcgtcgtctccgtcgagtaccgcctcgcccccgagcaccccgtccccgccgcctacgccgactcctgggacgccctcgcctgggtcgtctcccaccccccccccgccgcctccgccgaccgggacccgtggatcgcgggccacgccgacttctcccgcctctacctgngcggcgagagcgcggggtccaacatcgcgcaccacatggcgatgcgcgtcngccacggagggcgggctggcgcacggcgcccggatccggggcctcgtcatgatccacccttacttcct

SEQ ID NO: 7358 - DNA, 752 bp, Sorghum bicolor
  Clone ID: SORBI-28MAY03-CLUS79082_1
aagggcgcgccgctgctggtgaacgtgtacccgtacttcgcctactcgggcagcggcgggcaggtggcgctcgggtacgcgctgttgtcgtcggacgccagcgcggcgtcgtcgtcgtcggtgacggacggcggggtggtgtacaccaacatgttcgacgcgatcgtggacgcgacgcacgcggcggtggagaaggccggggtgcagggactggagctggtggtgtcggagaccgggtggccgtcgggcggcggcggcgacggcgccaccgtggagaacgcggcggcgtacaacaacaacgtggtgcggcacgtcggcggaggcaccccgcggcggccagggaaggccgtggagacgtacctgttcgccatgttcaacgagaacggcaaggccgagggcgtggagcagcacttcggcctcttccagccggacatgagcgaggtctaccacgtcgacttcacggcggcttcttcctaggctagctcttctcgagtagcagcactagtctgtccgtgtgtacagtgcatgccagtgcacggcgttaccccatcccatggatttgtttagcacattattactgtcgtcattattactcattagtgatgcatttgctcagtagatacagatacagacatacagtagtacactccttcagtatgccatgcgtctctacttgaccacttcgactgtgttctgctacgtttttttgtgatctgtgttcatggagcagcatgtgaatctgttcgcttcaa

SEQ ID NO: 7359 - DNA, 609 bp, Sorghum bicolor
  Clone ID: SORBI-28MAY03-CLUS79083_1
tgtacaacaccctgttccggtgcaccaggcggaagctggccgagtaccccagcctccacgcctacacgcgcgacatctaccagatgcccaaggttgccgagacatgcgacacggaggccatcatggcaggatacttcaagacactcttcccgctcaaccccggcgggatccagccactcccgccggcgacgtgcgatagggagtcgctcttgaggccacacggcagggaggccttgtcctctgctgctgacacgccgcttgaagcagctgctgtttcataactcaggctatgaacaaagctagaaactgcagaaagagtttatagttataccagatactgatggttcagcttcacaggatcaaatcacatcagcagtaactggcatttgcaaactattggctatatgagtcactggttaaatatgttgtcaagatctgtgctgccagtgatgattatgatagtcttttggatgaagacagaattggttctgctcagtgtacccaaactgtgaatttccatgtacttattagaatccttagtgtaataaaccgctcctctttggacatgtaaattttgtaaagcagctgatgagttgtataaaagatgaa

SEQ ID NO: 7360 - DNA, 704 bp, Sorghum bicolor
  Clone ID: SORBI-28MAY03-CLUS84077_1
agtggctgagctcagctcacacttggccggcctcgttctgctgcagtgcaggtgcagctcgtcccttgcccccccaatcttcttctccaatcccgttcttctgggctctctgtcggacaggtgacaggatccccatgggcatgggcgccgcggcgaggaggaagcccgccgccgccgccgcggctctgctgccaatctggctcatctgcctcgtctgcgcctcgagagcagcagcggagccgtacatcggcgtcaactacggcgaggtggcggacaacctgccgtcgccggacgagacggcgaagctgctcaagtcgacgtccatctccaaggtgcgtctctacggcgtggacgcggggctgatccgggcgctggcggggtccggcatctcggtcgtcgtcggcgtggcgaacggcgacatcccctcgctggccgccgacccggcggcggcgtcgcggtggctggcggccaacgtgctgccgttcgtcccggccaccaccatctcggccgtggccgtcggcaacgaggtgctggagtccggcgacgccacgctggccgcggcgctgctcccggccatgcagaacctccgcgccgcggccctggccgccggggacggcgcggcggggatccggttctccaccgtcaacaccatgggcgtgatggcgcagtcggacccgccctccacgggcgcgttccacccggac

SEQ ID NO: 7361 - DNA, 714 bp, Sorghum bicolor
  Clone ID: SORBI-28MAY03-CLUS80169_1
gcacatcgcccaaacaaaccctcgctttcaccgcgccgcaatcccacctaactcccaacaggcgcaaatggcggcggtcggaacacttcccggcgccgccgcagtcgctggcgcttctgtgcgccaacgccaatgccgcggcgccgccccttctttcgtagccgcctacgtccgcgagggcacccgcctcgtctacgggaggcagctccgtccggctccggtcctcgcctgtccagcgaggcggcggttcctcggcgctgctgctgcagcagcctcctcaggttcagctggagatgcagagccccagggatttgcagagagatacccaacccttgtcacaggtttcttcttcttcttgtggtattttctgaatgtaatatttaacatcctcaacaagaagatcttcgactacttcccctatccatattttgtatcagtgagccatctttttattggagtactatactgcctcattggctggagcttcggtatcccaaagcgcgcgccaatcaactcaacacttctgaagcagcttcttccagttgcggtttgccatgccattggccatgtaacaagcactgtgtcatttgctgctgtagctgtgtcatttgcccacactattaaagctctcgagccattcttcaatgcggctgcttctcagtttatccttggacaaccagttccattgacactctggctatctcttgttccagt

SEQ ID NO: 7362 - DNA, 626 bp, Sorghum bicolor
  Clone ID: SORBI-28MAY03-CLUS80145_1
tctgggtgcccctctccacgacaccagcagcgcgatcccccagtgtgtccgagatcctccctcgacatctagctagctagctaccatgcgtgtcctcttgctcctcctcctcctcctcctctccgtggcctcttctccggcgacggcgtcgggcgacggcggcgtggccgttccagtggggactaccgtcttgtcctccttctgcagccccagcagcgtggacgcgaccatgtactacgaccagtgccagctccggttctccgaccaggacttcctcgccggagcgggcaacatgccggagagcgccgcctccaacatgaacaaggtgtccgccgggaacgccgccgcgttcgacgccctggtcacgcggctcgtcgccgcggtgtccgacgccgccagcaacaggagcggccggtacgccacgggccaggccgggttcccgccggaggacatgaacgtgtacgcgctcgtgcagtgcacgcaggatctgacgacggcgcagtgccgggagtgtctggccgacctcaggggccagatcccccgcctgctcgcccggggtgtccgccgggaacgccgccgcgttcgacgccctggtcacgcggctcgtcgccgcggtgtccgacgcc

SEQ ID NO: 7363 - DNA, 647 bp, Sorghum bicolor
  Clone ID: SORBI-28MAY03-CLUS80214_1
agatcagggcggccgtcgccgccgccggcgccggcgacgacgacgtcacggaggacgacctcgagctgctgccctaccacaagcaggtgatcaaggagatgctccggctgtgcacgccagtgccactcctccttccccgtgagacgatggaggacacggagcacctcggctaccatgttccggcgcgcacccacatcttcttcaacgcctgggccatctcacgggaccccgcggtgtggcgcagcgcggacgagttcatgccggagcggttcgccgacgacgacatgaagacgacgacgacggagtacctgctggggcaggactttgacgagttcgtgccgtttggagcatcatggaggagaggatgctctggtgttgggtttgccgcgccggccatggagctggagctggcactggcaagcctactgtaccactttggctgggagctgccggccggcaggccaccagcagcaccaaaggacgagctttcggtgcggctcaagacgaccttgcatttggtggctaagccatggtcttctcagtgagatcacatatgagagtaacctcacagtggattttgggtaacctcgtcatgtacatctttcgtacgtttttttaaatcgtaataagctgagttcctcggttct

SEQ ID NO: 7364 - DNA, 1002 bp, Sorghum bicolor
  Clone ID: SORBI-28MAY03-CLUS80228_1
ggaatctgcagctagctgatgcaaaggaggtcctcaaaggtatccagcaggagccaggcgtacggtatccggtgttaacccctaacctcagaggatttgaggctgctattgcagctggtgcaaaagaaattgcggtttttgcatcggcctctgaatccttctctaagtcgaacattaactgtaccattgaggaaagccttgttcggtaccgtggtgttacagcggctgccaagaaacatggactaactatccgggggtatgtttcatgcgtgattggttgccctgttgaaggcacaattaatccgccgaaggtcgcatatgtagctaaggagctttataacatgggctgctcggagatctcacttggcgacacaactggtgttgggacaccgggtagcgtggttgctatgcttcaagctgtcatggcgtttgttccagtagacaagattgctgttcattttcatgatacatatgggcaagcccttgccaacatcctagtctcccttcaaatggggatcaacgtagtggactcatcagtgtcaggccttggaggttgtccatatgcaaagggcgccactggcaatgttgccacagaggatgttgtgtacatgctccatggcctaggtatagagaccaacgtcgccctcaacaagctcatggaggctggtgattacatttccaaggaattgggaaggccactgggttccaagactgcgactgctctgcgcaagctaactacctgagtccctgaaaaccttctcaagcactccgaagacaacgatgagaaatgtatcaacgaagagaaatgtatcagttgtgttatcacacgtttttttttttacttacttatatatacagacgagtcatatgaacgtcctaaggttgtactttagtttgcaatttcgtggacatactctgaaaacatttgattcacacagttgtccctcccgttggatgattctgaataatctgggttttcctggacgcaaattgtgtttgctc

SEQ ID NO: 7365 - DNA, 778 bp, Sorghum bicolor
  Clone ID: SORBI-28MAY03-CLUS89662_1
ttgtgagggaatggctgggaggaacattggagtcgcagtggacttctcgtcatgcagcaaagcagctctgcgatgggcatcaacaaaccttgccaggaacggtgataagctcatactaatccatgtgaacaattcctatcagaatgagcagggcgctgttcatctctgggagcagagtggttccccactcatccctctggccgagttctcagatgtcaccaggacatatggtgtatcaccggacaaggagacaattgagatcctcactcaagtggcaaatcaaagagggattgaagtctttgcaaagatattctacggtgacccggcaaagaagctctatgaagcagttgacctggtttcccttagctacatggttatcgggagcagaggactaagcacgctcaagagggctctgatggggagcgtgagcacctatattgtgaactacgcggcatgccctgtgacggttgtgaaggagcacatgtaggggcagtcagcccgatgaacactgctgtttacaagcttcactccaaaagaacaatacgtatatgtgtggtagccagattaaataagtgtacttgacatgcactgatcaggtggatcttgctacatagaaaataataaaatctgaagatacggaatcttgtgcttgaaattcactcagctaggactggacagaacatgacttggcactgtcatctgaagatatgtcctaggcctgatgtaatcttcgaataattttgcttgtaaaatcagttaaagaaatatacggctctga

SEQ ID NO: 7366 - DNA, 796 bp, Sorghum bicolor
  Clone ID: SORBI-28MAY03-CLUS89692_1
ctgcaaaagacatactacaaaacggcatcattgatatcaaatagttgcaaggctgttgctattcttgcagggcacacagctgaggtctcggtgcttgcatacgaatatggtcgaaacctgggtctagccttccagttaattgatgatgttcttgatttcaccggcacctctgcatcccttgggaagggttcattgtctgatattcgccatggagtcattactgcccccatgctgtatgcgatggaggaattcccgcaactacaagaagttgttgaccggggttttgataatcctgcaaacattgaaattgcccttgactatctcaggaagagccgtgggattgaaaggacaaaggagctcgcacgagaacatgctgatcgtgcagtcaaggctatagaatccctcccagacagtgatgacgaggatgtcctgacttcaaggcgtgctcttattgatatcacagagagagtcatcacaaggacaaaatagcaaggtgtttgtcgttcgcaaggtgaatggaaagctgaacctcgcctcaaggcctagtgttccacttggaaaattttgtatactttggttcattgcattcttttcacagccaaaccccaagttttgtgtaacattgctgaaatttaggattaagaaatggccctgcatttctgggagctctagtggttttggctgcatgtggcaacaaaatatatatgccactgactgcaatgatcgccagatattgtgtagccatatataattgtgggagcattgcaccccatatacgagaaggattgttgactcc

SEQ ID NO: 7367 - DNA, 1191 bp, Sorghum bicolor
  Clone ID: SORBI-28MAY03-CLUS8945_1
acggcactagcaggtagcagcggttggccaccagcacccgacgccggaggcccggaggaggaggaggcggcggcgatggcggggaagcacgggcgcaacggctacgacgacgacaacgtcaaccccttcgcgggaggaagtgttccacctgccaccaattctcgtctctcacctctatcacatgaaccggctgatttctacaatgtggacattcctctcgactcatcaaaggatctgaagaaaaaggagaaagaactccaggctatggaggctgagctaaacaaaagagaacgggaattgaaaaggaaggaagaggcagcatcccgagctggcattgtgatagaagagaaaaattggcctcccttttttcccctcatccaccacgacatttccgatgagatacctatccatctacaaaggatgcagtaccttgcattctcgtcattcttgggattggtagcgtgtctcttttggaatatcatagcaactacaacagcatggattaaaggggaaggtgttatgatctggctgcttgccattatctacttcatatctggtgcacctggggcttatgtgttatggtatcgacctctttataatgccttcaggtcggtgagcgccttccagcccgggtggcttttccttttttccccgtttcatataatcttctgtggtgggcagctgtggctcctccattccctttcaaaggaaaatctttggctgggattttacctgcaattgatgtcataagcaagaatgctattgtggggatattttactttgttggatttggcttgttctcccttgaatcacttttgagcatcggtgtcattcagcaagtatacatgtatttccgtggaagtggaaaagctgcagagatgaaacgtgaggcagcacgtagtgctctaagttcacccttctgatgaacagagggcggtgtgatcacagccagttgatggatggaaggaaatgagatgtgccaaatgagccacgtggatttggatctctgaaatcgtacagctgatcatctttttgctcttctgtaaaatatgaacaatcctcatatggatgcgtcagggttcacttattgccatggtttaggtgtcgttgatagggaaaacagtgaagttttttgtagtagtgaatataatgtatcttcatcatacgtttgcatgtgagtgtaatagcttg

SEQ ID NO: 7368 - DNA, 473 bp, Sorghum bicolor
  Clone ID: LIB3476-055-P1-K1-H9
ccaccacgacatttccaatgagatacctatccatctacaaaggatgcagtaccttgcattctcgtcattcttgggattggtagcgtgtctcttttggaatatcatagcaactacaacagcatggattaaaggggaaggtgttatgatctggctgcttgccattatctacttcatatctggtgcacctggggcttatgtgttatggtatcgacctctttataatgcaatgagaactgagagcgctttgaagtttgggtggttttttctattttacatgattcatataatcttctgtgtgtgggcagctgtggctcctccattccctttcaaaggaatatctttggctgggattttacctgcaattgatgtcataagcaagaatgctattgtggggatattttactttgttggatttggcttgttctgccttgaatcacttctgagccatcgtgtcattcagcaagtatacatgt

SEQ ID NO: 7369 - DNA, 1031 bp, Sorghum bicolor
  Clone ID: SORBI-28MAY03-CLUS8973_1
cttgtgcaggcactaaaagaactcaggagaacccctgagatgtttgttcagcttaagaggatgtttggttcagtggcatcagtacctgctagggttttccttacaggagctacaattcaaatggcagcaggatcggtatctgacctcaaaccaaactttgaggagtaccttgctaattggagatatacaaatgatgaggtttttgttttggatggagggcatggcagtgcttcaaatggttttgttgttacatctgttatgtcaactgggcagtattttcaggtggcagaattgtatacagtaacattcctctgtattgtctctcaagatagtgaaactgctatctcatgggctgaaaaagctgatctgactgagcaaagccgacaggatctacttaaaaagcttcatgcagtacgattagctgcaaataaaaagctgtcggctgttgaaggggtaaaacaaacagcagagaggaacctttctacttctacaaatggctcaacaccattgccacatgaggatcctccaaagaagatagctcctgtgtgcgacgggctcaaaaaggtcctagtgaagtccgctcaaccatcccagcacgttgcaaatcaatttgatccgttgttctggtggtttcattcgattcgcctgaagtttggaaaaatacatattgttctaccaagcggtaagctaatgtttctgttctcactgctgttctcaaccatgtacgtgctccgaaggaaaactgctggattgaagaggactgtgttccagcaagcttcttctctgcgacgagcattccttgatgcacttcagcttgcgttctctgtccagatgaaccctctagctgctgtccaacaagtgccacaagcccctcgaggaagctggttatgatgtaattctttatgccacgatctatgtaacaatataactcaactgaaattcgacagatgaccagattctgtgtcacagaaaatgtaaatacacctgtgcttaatgcagcatgatcatatgatctgggttttttttggtcc

SEQ ID NO: 7370 - DNA, 727 bp, Sorghum bicolor
  Clone ID: SORBI-28MAY03-CLUS8979_1
ctccgtgcaatgatcaccaagggattgattgaaccaatctccagtgtttttgtcaatctggtaaatgctgacttcaccgcaaagcagaggggagttcgcatcaccgaggagaggatcctgttggacggctcacctgagacacctattgattacattcaagttcagattgccaatgtcgagtccaaatttcccagtgcgatatctgagagtggagagatcactgtggaggggagagtgaaggatggtgttcctcatctaacaaaggttggagcattccaggtggatgtgagcttggaaggaagcctgatcctttgcaggcaggttgatcaacctggtatgattgggtcagttggaagtgtcttgggtgaagagaacgtcaatgtcagtttcatgagtgttggaagaattgctcctcgcaagcatgctgtcatggctatcggtgttgatgaggaaccaagcaaggccacgctgacaaagatcggggagattccagcgattgaggagtttgttttcctcaaactctaggcgcaaagcgcaaatgtatgtttgaagttgcaagcatggtgtgcaattttgatgtagctagcaatctagaggacttatggttctccttgaaataagcttttaggagtatttttgtagtggtgctcttgaatttggtgcagtattgctccctccttttgaacgggggtgtttattaataaaaacttgtctccatatttggctc

SEQ ID NO: 7371 - DNA, 720 bp, Sorghum bicolor
  Clone ID: SORBI-28MAY03-CLUS8983_1
ttgagggagcagaagcgcatagcagctgagaaagtgtgtgatatttgcggccgaccaatgctccctggaaaggatgttgccaccttgctgaactgcaatacaggaaacctagcttgcagcagtagaaattcaagtggggcttatcatctattccacacttcctgccttttgcactggactatattgtgccaatatgagatgctgaatgaccaaatagctagcaaggggaagagcaatcgaggaaggaaggcaaagaatgcacctaagaaaagcaaaataacatccatagtgtgcccagaatgtcagggtactggaattcacgtcaacggagaagaacttgagaagccaagcatttctttatccgagatgtttcgctttaagatgaaagccattgaagctcacaaagcatggctgaagagtcctgaagtgcttgaaaactgttccactgggcttcatttcccctcagaacatgtggagaactctgaggagaaggtgatgccactgaagtcgcttgctttctatgcctctgatgggtagggagatgggtaagctcattgccagcagctaccagaggatgctgcaggtgttgatgtaaataaggtcgcttgacagttctggaaacagtgatgatgttagatgcttacctgtttgtctgtaatataaacgtgtcttgatctcagttaacctgtgtccgccagatgatagacattcattaaactg

SEQ ID NO: 7372 - DNA, 914 bp, Sorghum bicolor
  Clone ID: SORBI-28MAY03-CLUS8054_1
gcacgagggacgcgacaagcgcgaggagagagaggaacctgagcgaggcgcaccagtttcaattcaagcaatccctagcccgtggcgacgtggtgggaagcaattcgaatctgcggtgaagcctaggtgacggcgctgttactcgcctctcggggcgggccggcttgtccgatcggtttggctcggccatggcgactaaaaaggttctttgcaagttcttcatgcatggagcttgcttgaaaggagaatactgtgaattctcccacgactggagtgatcaagcaaataatgtttgcacattctaccagaaaggtgcatgctcgtatggtagccgttgcagatatgaccgcgccagggtttctcgtaaccccacagtgccaccaccaccctcaacgtcaagtgctgcaagacgtgtcacatctaattctcttcaacttttaagttacagtcatgcacctcacacgggacaccaaactgattcaagcaaccaaagacatcagatatctgtggatgtgctggcacattctgccagtaagcctgcatggagaaatgattttcaacatgacattgtttctgatgatggaattgactggtcctctaatcgaaatttgctaaacgaaacatcattgaaacctgcggatctgcctatttgttcttttgctgctgctggtaattgtccttatggggaagggtgccctcaaatgcatggagatctgtgtgcaacctgtggaaaaatgtgcttgcatcctcatcgtcctgatgagagggaggagcatatcaaggtatgtgagaaaaatcacaaacgccttgaagctctgaaacgcagccaagaaatagaatgcagtgtatgtttggatcgtgtgctttcaaagcctactgctgctgaaaggaagttcggactgttatccgaatgt

SEQ ID NO: 7373 - DNA, 760 bp, Sorghum bicolor
  Clone ID: SORBI-28MAY03-CLUS80535_1
ggaggcactggcattcagaatacccaattctattgggaaactgctaatcctagcagcagcagcagtagaggaagcagcggaagcaacagcttgggatttgagcggcaaagcacaagctcacttctggaaagtagtgttttcccatggacagatttaacaccagataaaaatagccaagttcaccttgaggaagaactcaagtggcctgacttgctccatggaacattcacggacacacctgcaacgatgcagaatcttagccagtcactgtacgaagatgttatcaaagccgagagccaattcaacatagagggcctctgtgcagcctggtctcaaaatctgcagccacagcaacatctgcaggtagtatcagatttgtatgacaaggatttgcagagaatgtccttgtcttttgagaatatctaggcaacatgttgcatgcagggaacagagaaatagcagaaagctgagttaatgaagcctagaaaacacaattatttcttcacagatttatttgaaggctatgtggaggtgttttccgtaggtacattcttatgatgaaacagagatcaatactgataactgttcatcagtaaaagatactgcagtccatgaaaaagaaaaaaaatgaatttatattccagcttaatgtatagactagagaaagtacatcctaggagtttacctcgtttcatttaaaagttgctgtctttatctgtacatgcatgtagctcgacctttttgtatatgtgagtcatgg

SEQ ID NO: 7374 - DNA, 614 bp, Sorghum bicolor
  Clone ID: SORBI-28MAY03-CLUS80632_1
gaagtctcaacgaccatggccgcctccgcctgaccgggcgcccactaccccagacgccgtcgcctagatccatgagacttcccgatcttcctgcggcccgaggatgtcccagcgcgacgtcgactacaggctctgacaacaattacatttgtattgacagttgtggatcttgtggataccctctaaacctttcatcttctaaccgaagcacatctgaagtaggatcctcatataagaagtctctgaagaaaggactgatttcattcatatctgttgatctcagccgatttactcaggtggacgaggtatcttgctttccccttgcctggcgtagttacaggccaaaaactaagcttctctgcagaaaatgtggagcatctattggctacggatacggtgagccagctgttttgtgtagttttgatccagcaagttcatcttcctccagtacatcccagaagtatttaataaagatccaagcactccaaccttcagacgggactcagtaagtgaaatatggaaagagagacaatagatgtcagcttagagaactccatcagttacctatctgatgattgcttgctttctatatttaacaagctagaaagcgagtc

SEQ ID NO: 7375 - DNA, 776 bp, Sorghum bicolor
  unsure (1)..(776): unsure at all n locations
  Clone ID: SORBI-28MAY03-CLUS80634_1
aatactggctgcaaagaatagaagagtgcccttaagcttgccggtgccttcctccaaatcctgatatcagtagccactagttgctgccgttctcccacaagctccactatcacacaccactgtaggagctcatatagctcctccacaatcatcgcaccctagagccataaatcgttgagagggattcttagaaccagaggattacctgtgaagaattccgtgctgctcctcaagctgtgagctgtgcagattgcagagctcagcttcagtttcagcattgctttcaatggggaggcactcctgctgttacaagcagaagctgaggaaggggctctggtctcctgaggaagatgagaagctcatgaaccacataaccaagcacgggcatggctgctggagcactgtcccgaagcttgcagggcttcagaggtgtggcaagagctgcaggctgaggtggataaattacctgaggcctgaccttaaaagaggtgcattctctcaggaggaagaagaccttatcattgaacttcatgctgtactgggaaacaggtggtctcagattgcaacaaggttgcctggaagaactgataacgagattaagaatctctggaactcaagcatcaagaagaagctccggcagaaaggcatcgaccccaacacccacaagccccttgccgaggttgaacacagcanagcagcgcccacaatcagtactgagagaacctctgagtccagtgatgttgacccttcaagtggtggtgcacttggcaacttga

SEQ ID NO: 7376 - DNA, 663 bp, Sorghum bicolor
  Clone ID: SORBI-28MAY03-CLUS79871_1
atgctttggcggcactgcaggtgcggccgcgcagcctgcctgtcttttgatcgatcgatcaagcctcaaggggtaccgagatgacggatcggccgtcgtttccggctctcattgctctcgccgttcttgtggtgggcagctactgctgcgtggcgacctcggccgcctcgccggcggtggaagatgatgagctgcgtggtcggacgatgcggcggcgccgcgcggcgtcggtgatggtgcccatcaccatcctcaagtccgcagtcagcgacggagctgtgtgcatggatggaacgccacctgcttacaacttggatcctggctccggaacgggtagcagaagctggattgtgaacttagagggaggtgcatggtgcaacagcgccaagacatgccggcttaccaagagctccgggcgcggctcgtcggaccacatggataaagagatccccttcaccggcatcatgagcagcagcagcgccgtcaatcctgatttctacaattggaaccgggtaaagattcgctactgcgacggtggatcttttgccggcgaggcctttgataagaacactgggatttatttccgagggcagcgcatctggaacgcggtcatccggcacctcctctccattgggatggcctctgctgatcgtgtgctgctca

SEQ ID NO: 7377 - DNA, 662 bp, Sorghum bicolor
  Clone ID: SORBI-28MAY03-CLUS79864_1
agcttctcctaaacccaaccattcccgattcacaccagaggcacgagctgacaggggagcggacgagggatgccaggagcgaggtccagcgagctcaccgctccggcctccggcagactagcagtaatcgctagtgacaagttcgttgttggcggagctagccatggcgtcggaggtgtcgtcggagatcaaccagaaccagggcggcgaggaggagacgcggctggacctcccgccgggcttccgtttccaccccaccgacgaggaggtagtgtcgcactacctcacccacaaggcgctcaacagcagcttctcctgcctcgtcatcgccgacgtcgacctcaacaagatcgagccgtgggatctaccgagcaaggcgaagatgggcgagaaggagtggtacttcttctgccacaaggaccgcaagtacccgacggggatgcgtaccaaccgcgccaccgccagcgggtactggaaggcgacgggcaaggacaaggagatcttccgcggccaccgcgtgctcgtcggcatgaagaagacgctcgtcttctacacgggccgcgcgccgcacggcggcaagacgccatgggtgatgcatgagtaccgcctcgagggaagcctgccgtccaacctccgccgcggggccaaggacgaatgggctg

SEQ ID NO: 7378 - DNA, 571 bp, Sorghum bicolor
  Clone ID: SORBI-28MAY03-CLUS7994_1
ctgctcgctaaaaaaagcttctcgagcttataaatacgctcccctccctcccggtgccaagttcctccccccgatccccttcccccccctccacccgccgatcgccctccgctcgctccaccgcggcgggcgatcgctcatctccctctaccctccctccggcgcgcgattcccgagcgaggcgccacccaccgaagatttccgccgacggacggacggctcgctccgtcccctgccttgccgatcggatcgcgtgctccccgaggtagaggtgatgataaggcatagttttttgacttagcctgccttagctatttcttgaagctaagggaaataataattggcgttatggcatttagaaatatggtttgcactccccaagtcattgatcttacgtcagagagagggcaagctcacggaggcaatggtagtgagatacctgagcaaggtgcacaacatgctgtcagagttgtaggaaatggaacaaatgttggtctctctggtgtgcgaagttactatgatgtgagcataaatcatcaccatcagcctgttcataacccacccccaaatt

SEQ ID NO: 7379 - DNA, 708 bp, Sorghum bicolor
  unsure (1)..(708): unsure at all n locations
  Clone ID: SORBI-28MAY03-CLUS79888_1
gcacgaggatgaagtacaagtcagtgccgaataccttatatgaagatgcagaaaaatgtctaagattggctctttattcaaatccgccggtgatggctgcgttattgccactaatacagctcacccttgagctttgatggaaatcatataactgcagaccttacctgatcgttgactcgatgtgcagacgcaggtgaacccccatcctgaagcatgaaagaaagcgactgatctagaggcggctcctgaattcttgcatgcatcaatatggctcacggggaatatctcctaattctcgattctcctccttggtgataaactgaaagatgcactaaatgagcttgaaaaggcctgcctcagttcaacaacagccctacctttcaggttgagaggtaggctgctggaagagtatgaccaaaaccaggtatcaaccatttcctcttgctatgaggaggctttgagaagagatcctacatgtagctactctatggagaggctaaaaggatattataatgtcatccaactactcgaggcaatagctttacatttagattccgtcaatggaaaaccctgcatctgggaagagcttgtatcatgtttccttcggcttttttctgacaatactgctgactatgaggattgcatatcatgtactaatacccatggagatgaagcattggangtttccagtaaattgtcttcagtatt

SEQ ID NO: 7380 - DNA, 847 bp, Sorghum bicolor
  Clone ID: SORBI-28MAY03-CLUS7997_1
cggacgcgtgggttgcaaaagagctacaataaaaacttgtctcagaaggacctacaattaatagcatcttcggtcttacttgctgcactatctgtggcaccttatgaccaaaagtatggtgcatctcatcttgagacagagaatgagaaggaacgtaacatgcggatgggcaaccttgttaacttctcgcttgattccaagcgtgaaaatagggaaatgccttcaagagcatctcttctatctgagttggtgtccaaaggagtcctttcatgtgcttcccaagaagtgcgagatttatacaaccttttggaacatgagtttctccctctggaccttgcatcaaaagtgcagccacttctttcaaagatttcaaagattggagggaagctttcatcagcttcttctgttccagaggttaagttatctcagtacatatcagcattggagaagctgacaacattgagagtgctgcaacaggcctcttttattttccagtccatgaagattgatatgctctcaagaaggatccctttcttggacttctctgttgtggagaagatttctgttgatgctgtgaaacgcaattttgttgctataaaagttaaccatttatcgggagctgttcatttgggtactgtggacatagaatctgatggcttaagtgatccccttagtgttctggctgattcattagacaaagggaggatccatattcgtcccccagtgaaaaagccgtctaaactcagtgaaagtctcgttagttgggctggaatagtggagaatgagcataagaggcttcttgcaagaaagtccatcattgaaaaacgcaaagaagagcttgagcgtc

SEQ ID NO: 7381 - DNA, 784 bp, Sorghum bicolor
  Clone ID: SORBI-28MAY03-CLUS80062_1
gactggcttcattaatgccatgatctcaaatatttctttcacctaccgaagcatctattcgaagaaggctatgactgacatggatagtaccaacttgtatgcatacatatcaataattgctctctttgtctgcattccccctgcacttattattgaaggacctcaattaatgcagcatggatttaaagatgcaattggcaaagttggattaacaaaattgatttctaacttttttgtggtgggcttattctatcacctttataaccaggttgctacaaacacattggagcgggtagcccctctatcacacgccatcggcaatgtgttgaaacgtgtatttgtcattggcttttccatcatcgtctttggcaacaagatcaccacacagactggaattggcacttccattgctatttctggtgttgctctctactcatttataaaggctaagattgaggaggagaaaaagcaaataaagagtgcataaggtgttggactgttggctgatgtgaatgcggttggtttgttgctttgatggacctgtattctctcggtgaatgaacagacttgcaagatggataaaatcttgctatctcctactacattctcagttttgtattgaggtgtgtggtggctggtgttggctaatttgtttatttgaagcaaatttgagcaatgctcagagacatggaattttcatttagttttcctttgctcatttattatgatttgacatggtgctcttgtaatcttaagtactagtgttatgaccggtatggtcttc

SEQ ID NO: 7382 - DNA, 592 bp, Sorghum bicolor
  Clone ID: SORBI-28MAY03-CLUS80119_1
gtcttgctcctcgagatcataagcgggaagaggaccgccggcttctaccagtacggcaaattcttcaacctcacaggatatgcgtaccagctgtggcaggacgggaaatggcacgagctggtggacccggcgctgggcgacgacctgccggtgggcgaggtgatcaagtgcgtgcaggtggcgctgctgtgcgtgcaggacagcgccgacgaccggcccaacatgtcggaggtggtggccatgctggggagcgaggggatcaccatgccggagccccgccagccggcatactacaacgtccggatcaccggcctcgccgtgtcgtccgactccttcggcgagtcctcctgcaggatcagcagcatcaccatcacggatcacgaggaaggcaggtagtagtggctgctgtagctcgatcggtaattaatggtaactgtacaggacggtcgtttattatgatcagaatacagagacacggaaagaaacaacacagaaacgatcaggataggttaacatagctggccggtgtaagatactccacaaacgtgttaacgaacgcttttagtttctgcttgactagctccagcaataa

SEQ ID NO: 7383 - DNA, 830 bp, Sorghum bicolor
  Clone ID: SORBI-28MAY03-CLUS81172_1
caagccgagccggcgctggtctccggcgaccccaccatccagaccatcgggaactacgagaaggcgtacgtgtacaagtcgagcagcggcgcgtgcgcggcgttcctgtccaactaccacaccaacgcggcggcgcgggtggtgttcaacgggcggcgctacgacctcccggcgtggtccatcagcgtgctgccggactgcaggacggccgtgttcaacacggcgacggtgagctcgccgtcggcgccggcgaggatgacccccgcgggcggcttctcgtggcagtcgtacagcgaggccaccaactcgctggacgaccgcgccttcaccaaggacggcacgagggagcagctcagcatgacgtgggacaagtccgactacctgtggtacaccacctacgtgaacatcaactcgaacgagcagttcttgaagtccggacagtggccgcagctgaccatctactccgccggccacgccctgcaggtgttcgtcaacgggcagtcctacggcgccgcgtatggcggctacgacagcccgaagctgacatacagcgggtacgtgaagatgtggcagggcagcaacaagatctccatcctcagcgcagcagtcggcctccctaaccagggcacccactacgaggcgtggaacgtcggcgtgctcggtccggtgacgctgtccggcctcaacgagggcaagagggacctcagcaaccagaaatggacctaccagatcggcctgcacggcgagtcgctgggcgtgcactccgtcgccgggagctcgtccgtcgagtggggcagcgccgccgggaagcaacccttgacatggcacaa

SEQ ID NO: 7384 - DNA, 1207 bp, Sorghum bicolor
  Clone ID: SORBI-28MAY03-CLUS81357_1
aaacgtgcggtgtctctggatcttgcatctctgcacctccccggacaatcgacttcgccggcagccccgccggcgacgacaggaccaacttgagacatggtgttcgcttgatcttggcacagtgtaggccgtaggaatgattgattcctatcagcgctcatgcttcaattcacgatatagagaaaggaaaaaacgcctattggatggatgaattggtcatttggttgtgcccgtaaccgagctccgagcattacatcagtttgcgttaccgaatttggtgatatatctgtaacatatggcggggctcccagattcactgcctcgagaatagatgaaaaaaactagattctaagatgagcacccttgctgattctgaagcacccggctcgtgctctggcttctcccctccgcccccgacgctcggctgcgccggcggccccgccggcgtcgtcaggcacagtggagcacggaggaggaagtaccctgctgtgaatgggtaattccacgagcggagacaaagttcatgacaaggaaactcacggaacaagtagcaatataactgaggagacgtctgtggaaaaggtgaaggctccagatctgcttgagcgagcaaaggaagagatcgaggctcttgccggagctgttcatactaagatggagcaccattccagtccccatgagaagaagggagaatcacataaggaagacaaggaggggagcctgcacaatataaaaacacacacgaatgaaactcacggaacaagtgatgacataaatgagaacacaccagtcgacaaagtcaaaggcccgaatgtgtttgagcgtgccaaggaagagattgaagctattgtcgaagctatccatccgaagagtggatcagacagtaagtgaagactgagacccctggggctgttctgccttaaactggctgcagaagccttaacatgaggtcatgagctaccagatagacacatgctttcaatgacgtccacccaggtggtgttttgtatacgcgttctggagctgtaaaagctaagagctgacttgttttgtatgctacactgttctccgttgtgccattgtggtttgtttgagcagaggtgtgtaggttcaacgtggaattgtgatgcttcaggcctcgtttgtttggcctggattgaggctgggaactattctagctaatcaatgttaatacaaataagtctta

SEQ ID NO: 7385 - DNA, 670 bp, Sorghum bicolor
  Clone ID: SORBI-28MAY03-CLUS81342_1
acatcagcacccgctcacaggtcacagccccttgctcattggatgaatggatggggggccggcggacggaaatcgcgagaggatgcgaagacattggcgtattgcatatggtggcaccaagcatgaggcaggaactgcattacttgcaagaaagtcacaaaatcaattgcagaccatacttgtggctttcttgcaagttgtgcagttgttgcctcaagcttgctgcctccctttgccagagctattagtaaaacaggaagtaccgtcagtttatgagctacaaaatataagcatagaaaaataatttagaaatgtaagcataatatactagtacattgctaaagataaatcaatactcaataacttccacatgctttggatttaaatacaagtacattgctaaagataaatcaataactcaataacttccacatgctttgaattttgggtaacatactagcacattgctaaagaagtaaagataaatcaatactcattccacatgctttggattctggttaacatactagtacattgctaaaagataaatcaatactcaataacttccacatgtcaatgatatcttttgcagattaacaagattcaatcatttgctggggtagtctacagcaaatgcattggttctctttattgatagctaacacgtctt

SEQ ID NO: 7386 - DNA, 856 bp, Sorghum bicolor
  Clone ID: SORBI-28MAY03-CLUS81368_1
gcacgaggcaagcagccaagagcagactgacctctgacctctgaggttctgacagcgcacacacgctagttgctaacagcctccatccatggccgcggctcctcctcctcctcctcctcctccccggcctcgtctcatggtgctgcccttccctgcccagggtcatatcatgccgctcatggagctgtcccaccgcctcgtcgaccatggcttcgaggtcgacttcgtgaacaccgacttcaaccacgcccgcatcctcacggccttggcgacaggaggagacaccggagcagctgtccatgccgggatccacttggtctctttcccggacggcatgggccccgacggcgaccgcgcagacatcgttcggctggctcagggcttgccggcggcgatgctcggccaagttgaagagctgatcagagctcataagattcggtgggtggtggctgatgtctccatgagctgggtgctggacctggccggcacggcaggcgtgcgcgtcgccttgttctcgaccttctcggccgccaccttcgccgtaaggatgcgtattcccaagatggtagaggatggcatcattgacgaaaatgcgaatgtgaagaggaatgagaggatcaagctgagccccaacacgccagccttcgacgccgccgacatcccctgggtcaggcttcgaagccccatgataaagggcatgatcaagaccaaccaaatgttcgcgctcgctgacaccattgtctgcaacccgttccatgccatcgagtccgaggcgctggcgctcctccccaaggcggcactggccatcggccccctcgaggcgccggcatcgaactcagccagccatctctggccc

SEQ ID NO: 7387 - DNA, 731 bp, Sorghum bicolor
  unsure (1)..(731): unsure at all n locations
  Clone ID: SORBI-28MAY03-CLUS80332_1
gaacagtcccacgcggcccccggtcggtcggttgcttcttcctccctcgctttccgttccttctcgtggcagacgcggacggacggacggacggaggcgcggccgcctgcgggacgaagcaaagcaaagcaataagcaagcagctgcgccccccccggctccgccccgcctcatccaccacaccaaaccagagagagcgagagcagttcggccgccggtcgcgtccgattccagcaaaaccccagcgcccccctgattgattttttcttctttttttcattaccttcctcgggttcggtgcctccctgcctgcctgcctgcctgactccgcacgtcttgccccttttccccccctcccgaccgtccaccggatccagggagcgagcgaggttcgtgctcatcgaccggagtcaccggacgaccctcgaggaaggatgtcgagcctcgaggagccactcggtctcggagacctgcccaagttgagtattaacagactcgggaggttcttgtcgccgacagctcgcaggtcatcaccgtccgatgaccacagcactggaaaatacagcaactcctgcaatggtagccccttccatggcaattcctatccctggcatccgcaatgccgtcaggccgattcgtcatgtgatgcggtggagcttagagatcttcctcggaaggttatgtgggaactngccaagtttgtgaagatagttgaggttggaccacgggat

SEQ ID NO: 7388 - DNA, 686 bp, Sorghum bicolor
  Clone ID: SORBI-28MAY03-CLUS80393_1
cagtggcggaggcagcggcgagtctatctggacgttcccgcagatgggcagcgccgccgccgcggctgccgtgtaccggggcagcgtgccgagcgggctacatttcatgaacttccctgcaccggtggcgctgcttccagggcagcaactggggctcggccccaccgtgggaggcagcggcggcggaggaggcggcgccgaggggcacatggggatcctcgccgccctcaatgcgtaccggacacaggcggcaacggatcccgcggccagccagggcggaggaggaggtgcaggaggcgggtctggccagcagcagcagcagcacggtggcggccgcggcgaccggcatgagagcatgagcaccagcgactcgtagccgacgggaggccggtctccgaggatcgcatgcatcgcgcgctctggaggaatctgctgctgctgcttgcaatgcaaaggcaggagaggaggactcgatatagctaggacctcctcccctctttatcactttatatggctggaatgaagcagtcttcgtcctcaccctcaaaacaccagcagcttttgtgcgatcagattttgagcatagtgtagtgtctgtgtgatagatgcacattacttgctttttcggctcgccagtgcatgcttataatcttttgctcccctccccgctgcagcagagagagaga

SEQ ID NO: 7389 - DNA, 749 bp, Sorghum bicolor
  Clone ID: SORBI-28MAY03-CLUS80346_1
agtgcagcctggtgcagacgaccaacgaccatgcggcgccaccaagccagcaacggttgtgttggtaccgtcacacttgcgatgtcgacgacgatatccatatccatccagctggcgctcgccgccgccggcgacctatggccaccgaccacgggcatgccggcggtgtacgtgttcggggactccctcctggacgtgggcaacaacaactacctgccgggggcggacgtcccccgggccaacatgccctactacggcgtcgatttccccggcggcgccagacccaccggaaggttcagcgacggctacaacgtcgccgacttggtcgcgaaggctatggggttcaagaggagcccgccggcgtacctgtcgctctcgcggcgctccggccgacggcatcgtctcgtcgccaggggcatcggcggagtgaactacgcttctggaggagctgggattctcgactctactttcgccggaaagaacatcccgttgtccaagcaagtgcgcaacttcgatgcaaccaaggctcagatggtactaaaactgggtgccaccacggtgaagcacctgctctccaaatcgctcttcctcatcgccgtcggcaccaacgacatgatggccgcgttcgccacatcgtcatcaaacaacaacgggcacgtcgccgtcgccgccttctactccgacctcatctccgactactcagccaccatcacaacaataatttgtttataaattcacgcaggggttgt

SEQ ID NO: 7390 - DNA, 1115 bp, Sorghum bicolor
  Clone ID: SORBI-28MAY03-CLUS80455_1
atcaacaactgaaccttgctaggtccgctggaccacctgagttacgagattggacagatatggctgagtcgtatgataacctcaagaactctgttaaagttgctttggttgggaagtatactaatctgacagattcttacctatcagtggtgaaggctctcctacatgccagtgttgcctgttcgttaaagccatctatccagtggattgcagcttcggatcttgaagatgcaactgcaatatctgcaccagatgcccatgctgaagcctgggaaactcttaaaggttcatcatgcattttgatacctggaggattcggggatcgtggaatctcagggatgatattggctgcaaaatatgctcgtgagaataaagttccatatcttggtatttgcttgggcatgcagatatcagtgattgagatgtccagacatgtcctgggcctgggagatgcagacagtgaagagtttaacaaggatacaccaaatcatattgttatgtacatgcctgaggtttcaaaaacacatatgggaaacacaatgaggttgggctgcaggagaacattcttcaggaaacctgattgccttacatcaaaactgtatggaagtcctccacatgtagatgagcgtcatcgtcatagatacgaggtcaatccctcttttgttcccatgcttgaaagtgctggtcttcattttgttggttgtgacgaaagtcgaaagcggatggagattgtggagctacaagatcatccattctatgtaggtgttcagttccatccagagttcaaatcaaggccccgaagaccttcacctccttttacaggtctaataatggcagccactaaacaactgggaacaatttcgaatagctcgaatggctatgttggagcttctggctaatgtaatgtcagatagggattcctctgggtgagaagcattttgctcgttgctgcagaaacccaagttgtttcttgtacacattattagatgtaccgggaataaatctgagccagaagaagagtttttttattctctctagagaccacctgagtggcgtcgctaatgatcttacagtgtatggggtcgaacgtcatgattttagtgattgttgtgcgc

SEQ ID NO: 7391 - DNA, 613 bp, Sorghum bicolor
  Clone ID: SORBI-28MAY03-CLUS80458_1
gcacgccactaaacccgcttcttcctcctctccacatcccccattcccctcgaagcctacgggctcggggggctcctcccatcgaatcggaatcggataggaagcatggagatctcgctggaggcgtcgtgggtgggcgtgcagcggcacgggcaggacctggcggaccgcctcgcgcagggcttctcggggctgctcctccacgcgcacccgccgcagctgcccccgtggtcgccgccggcgctgttgccgcccaagatcgtcatccccttcgacatcgacctccccgttgtccccttcgtcggcggggtgcgccgcgcggccggggccgtggacctccccgccgtcgccgtctcgtcgctcgtcgagatcggcggcaggctcgggcaggccgggtccgagctcggtgcggcggttcagcagctcgcgcgcctggtgccggtgcctgtgcctgtgcctgtgccggttcctgaaatgggaagccgcacagccgccgaccgtggtggcagtggacgagggggaggttgctctcgctgtgaggacggttgcgtccaccaacgtccctttggaaagggctggacacatagggtccctcgaagtggcagcggccggt

SEQ ID NO: 7392 - DNA, 493 bp, Sorghum bicolor
  Clone ID: SORBI-28MAY03-CLUS80533_1
catggggtccatttacctggatggtctgcaatcgggttgtactgcaataagctaagagtgctgcatgtgaaccgctgccgacacatctgtgaccagagcttgctggccctcggcaatggctgtccgcgcctcgaagttctgcatataaatggctgtgccaagatcaccaataacggcctggctttatttaccatttccaggccccatgtgaacctaagggtggatgaagttttgtccattggcccttccattgagaatttgttccagatgcattgagaagaaattgtagttagattttgagtttggggttaaaagtttgatagcccatcccattacagggtgattggttcttcagccattatgtggattgtgtttgctctggtgcatatttattgtaagataacaatagtgaaccataaatatacagatgggttgaacttatgtaggtttacttttgttagtaatatgctctggctctggtttactggtgccc

SEQ ID NO: 7393 - DNA, 646 bp, Sorghum bicolor
  Clone ID: SORBI-28MAY03-CLUS81589_1
gacctcgtgtcccagttcggcctcctccactccgaccaggagctcttcggcgccggcgtcgtcgactccgtcacggcgaggtacgcgcgcaacggcgccgccttctcgtcggacttcgtcaccgccatcgtcaagatgggtaacatcagcccgctcaccggctcctccggcgagatccgcgccaactgccggaaacccaactagaccaccagtcagccagtcagttttcgagattcgtgctgagggagggagggacggacggtctggatcgggcgacatggccagctaagaggagagtggcttttttgcgtggaaagtgtggagtgcgttggaagggagcggcggagcggagacgatgatgatgatgatgatgatttcagggatttggtgggtggagcgccgctgtcaggacgcaggataggatggatgagggagggaggtggggcccagcgtgccgtgacacaacgatcactgcatggccattgctgcttttcgttaatttttattttttttatttggccgcgcgcattattcttttctcttctttgtaccccgattttaacctgtaagtttgtacgtacgtacatgggtcgattcatgattatttttttcagggaggcgacgaataattaagaacagacgacat

SEQ ID NO: 7394 - DNA, 1240 bp, Sorghum bicolor
  Clone ID: SORBI-28MAY03-CLUS81614_1
ctactggatccccatccccccacttccatcctcggaggcataccccaccatccatcctcgccgggagagagagagagagagaggagggcgtcgcacccatggcggcgccgctgccgctcgtcgacggggtcgggccccaggtggacgcaccggcaccgctgccgctcgtcgacggggtcgggccccaggtggacgcaccggcaccgctcgtcgacggggtcgggccccaggtggacggtctccccaatacgctgaacctcctcctcaggacggcgacgtcttctcccaatcacccggaccaagagcagcggaatctgcttcgggcctcactcctcccggtgatcgtgtgcaagatcaaggtccgcgacgcagggccgttcatgcagttggtgcgtctgccactcgccgcagccaacccacatggcaaccgcaccatccccaaccgcctggcgatcgagagggtcgctgctgctgccaacgtcctcttcctcctcatcgatccgctactgccttgcctccgccgccaccccagccgaccccacccacctccgtggggtgaaggcctgcgcggagagactccagcatctcgccgctgaggccggtggccccttcaagacatcctgcagtcagttcgcgcagcgcatcatcctgtacgtcacccaagcccacgcccacccgatgttctcaccgtacgctcctctccgctcgtctatcgatgacatcattcgccgtgccacggttctcctcgacctcacggtcaccgtgaagcatccggagccgggtgagttggctgctgctgcggtggaggtggctgcatatgcagcgcagtacggcggcgcggtggcgggactgggggccgaggccgaggctgatcctgaggaagccgaaggcaactaaggcaaggcgtgaagattcaccgaagtggtgcaaatcgtagttgatagtttctactagagccccgcccatcttactttcttctagtcggagcagttctatggatagggtgacggtgaacgtaaatgtgattctctggtagtactatggtagtagtagagtcaagagttccatcccatggaaatatctgtttagggtgatggtgaaagtagatgtgactctctggtagtactatggtagtagtagagtcaagagttccatcccatggaaatatctgtttctgtaattctgttagtctctcaaatcaaagatggtgctacagtgctgctataataagcaattctgc

SEQ ID NO: 7395 - DNA, 648 bp, Sorghum bicolor
  Clone ID: SORBI-28MAY03-CLUS81585_1
agtatagtcctgaagcacaagaaagtagaaagcaggagatggagaagttactgcaagatcaggaagctatgaggacttcgcttctgcaatggtgctatgccagctacagcgaggtattcagttcctggatgcacttctgtgctgtgcgtatctttgtagagagcattcttagatatggtctgccaccatcattcctgtctgccgttcttgctccatctacaaagggcgagaagaaagtaaggagcatcttagaggagctttgtggcaatgtccatagtatttattggaaagccgaagatgatgtggctgttgctggtctgggaggtgaatcagaggtccatccttacgtctcattcactgtaaactttgtctgagcctagtctgtggcttgccaatattttggagcaactattacctcgagtaatcgaaacaatcgaatggctctgtatattattagtgatacgccaattctttctttatctgtcacttttatcttatcatgtaatttatattgggtagataagccgatcaataatgtagcttttgagagaactgaaatagatcgatcaccatgtaataacgtgttctcgtaacattgttactgtaataaagccatgccaaataattcagattgctggtcaccgagat

SEQ ID NO: 7396 - DNA, 710 bp, Sorghum bicolor
  Clone ID: SORBI-28MAY03-CLUS81684_1
aatctgcactgccaaggccacaagagcacaccactagcgctcgcgcgcgcgggcgggccgtctggctggcaattagttcgccttggcagcttcttggcttcccagttcccagttcccaccaccgcgccgcgcgcgcgcacctgctgccgatcgcctgatcgatctatttcccggcgggagacggccggacagcgcggcgaggagcagaggacgcgtggaggaggaggaggaggaggaggaggaggaggacagaggtccaaggaagggaggagagggctagtaatcaatggcgccgccggacgagggtgcgggtgcggcggcaggcggcgcgcggcgccggtgggtgcggcgggagacgctgctgggcctcgcgctggggcagttcgtctcgctactcatcacggccaccggcttcgcctcctccgagctcgcccgccgagggatcaacgcgccgacatcgcagtcgctcctgaactacatcctcctagctgtggcctacggcggcgttctcctctaccggcggcagcccctcacgataaaatggtactactacttaattcttggaattatcgatgtggaagctaattatattgttgtgaagtcataccagtacacatctttgacaagcgtgatgctgttggattgctggtcaattccgtgcgtcattgttcttacttgggtatttctgaagacaaagtatgggttgagga

SEQ ID NO: 7397 - DNA, 641 bp, Sorghum bicolor
  Clone ID: SORBI-28MAY03-CLUS8166_1
cgagtactccattggatgggtgatttggaggggtgaatctttattaattgaggcaatccggtaagataacattgatgtgggaccgtgagtatactgttctcgcgggcacgaggacctagcttgcctgatctcggtgacaggatggcaggtccatcatctcctgctattatcttgtttttataaatgtgcagatcatgtgcacactcaatgatagtctttcttgtacattgatgactaattggttcattcatgttgtctgctgaggtttgggggttgtgcaatggtgaaatttttgtagactgaaacaatgaaattgtgcaatgatgattatataattactttgtagaaattggattgttgtttctccaccaagaggcgtaccatcacaaggtacacacaatatacagctactatcctaacaagtgaagctgcagctgtcattctcaaaagtaagatgttcgtcaaaatgggactgtttaggtcatgggagaattctaagtgtgttttccccttttccttttatagcatgttcagttgagcattaattgttatcaccacatttatttaatatatatggctcatagtttcacaaatttaatatatcataataggtgctccctttgaaagaagggttggggtag

SEQ ID NO: 7398 - DNA, 1342 bp, Sorghum bicolor
  Clone ID: SORBI-28MAY03-CLUS80733_1
tttcagtatctttttcatcagggtcggcgtcggcccgatttgttgccgtcgtcctcgtcgccgccccgcccaccactccacttcttggaggactcggtcctgtcctgtcctgtcctgtcctgtcctgactccgctccacctgtcctcctcgcttccatcgccattgccgccctccttgctctgctccctccaagccacctgcttttttggacccgatttctgtggcgttcgatggtgtccgggcggtgccggcaggcggcgcggtggcgaggtgtgttgtgttcgatttggatggcgtgccgcagttccgggacctggagggaaccaatgtgtgcacgacgtatcggcaagggcacatctcgattgtggtgaattctagtgagattgctccagctcctgctcctgctgccccgcctcccccccccttccccaccgggggcggcgctgccgcggcctgcgccgccgcccggggccctcctcgcggcgctgctgggcgtcccgctccgtgcgggctctgcgcgcccccgctccggcgctggctgcggcgccacggggccgggcagcctcaccgcctgcgccgcgtccccgcggcgccggcgacattgaggatggcacaggttgggcggacgcaggcgcctgtggcattggggacgcggacacaaccggtgattgagaacgattatgctgcatagtagatttttcaatttgcttgatacttctgctaacaagaagacttgatagtgctggctagagacaggattgtccattggttgcttgatgtcggtaaattttctatatcagcgagggcaatgctagccactaatttcagagcccaggttctgctcagtgagggttcagcacattctttcggtggtgttcaggagcttaagttttgtactgcagcgaatgggaggctattgttcatgttcatagttgccatgttcatatgtggggagtccctttcatctccaagcaagcaatggaggggaaatgtttgccatatcggatttggaatcccctgttaatattttttcttgggtttctgtattcaagaggaaatgggtttagcaagaaagctgaggtaacatccattgcacatcacgttatgctgtgctggagaaattcattcatccggttgcaatttcatttcatttctttttcttctccatttgatgattagatgactgcgaagatgatgtagtgatataaatgttcacttgtctagtgctgtggtaattagtcttattgtgatgatcgttgatttcatggacaattctgtttacatccgctgtgtatgttttcaggcagcattcatttctttattagtgttgggaaacaactt

SEQ ID NO: 7399 - DNA, 704 bp, Sorghum bicolor
  Clone ID: SORBI-28MAY03-CLUS80835_1
gccccgcccggtgacggtccgcggctacgtcctcctgatgccgttcttcggcggcgtccggcgcacgccgtcggaggccgagtgccccgcggaggcgctcccgaacccggacctggtcgaccggttctggcggctgtcgctgccggccggcgccaccagggaccacccggcggcgaacccgttcgggccggacagccccgagctgggctcggtcgacttccgggcgccggtcctggtggtggtcggtggcctcgacatgatgcgcgaccgcgccgtcgactacgccgagcggctggcggcgatgggcaagcccgtggagctcgtcgagttcgcgggcaagccccacgggttctacctgcacgagccggggtccgaggccaccggcgagctgatcggcctcgtcagccgattcctgcacagttgcgcttgcgatcgaggcgcggttgcttgattattagcgagaaataaagtcaaatgcatgggacgcagagcaaactgtaagatcgcatcaaggttcgtgcatgtgcattggcgtgagctgcgcgccctgtgttcctcgcgcctgccgcgcgctcgtgtcctgctgtgcgtcgtcggggtcgtggtggcgtgcttggtctcgcacctcccgccagctctcgggtcccttggccccacgtgtcagtcatgttttgatgtttagtgatggtctcatacactcgtgc

SEQ ID NO: 7400 - DNA, 708 bp, Sorghum bicolor
  Clone ID: SORBI-28MAY03-CLUS808_1
aagggggaatttgtgggttgccttggatctttgctttggattttctacgcaatccattcagtatctttgctctgaattttggagtttggccggtctcagtactagttactaaattcatgatgtcacggtaagccaccacaatgaatattcatagtttaactacgtttttgtatgcatataaaaaatgtttattcctacaaagtgctaagtagagtcagttctacatgatcaatcggtataaataatatttattcttgcaatgttttatccttgcactggtattgataactaattagtgttcagtataccagatgaaggttcactctgatgattcacattcatcggtaacattttggttttgttacaatactttgctatctaattggtttgccttttattttttgtagggttctcttcgaacaagacaatagattattgttcagctgacatgtctgtgagttcagatatctggaaactgaagttgtgcttcagtttgtttcctggtgtcttagaatttaggatttacaccaggcatccattttttctctttgcacatatgccttattggccttcacaaattagctagatacattcattatctatttcgattccaactttcactattaatttatatgttcaactttttttagtatctgcagtcaatacagttattcttgatcggtaaatatgttcgttcaagttattttc

SEQ ID NO: 7401 - DNA, 1040 bp, Sorghum bicolor
  unsure (1)..(1040): unsure at all n locations
  Clone ID: SORBI-28MAY03-CLUS80856_1
tctctacgagctgaatgtcctgggaactcgaggtccaaggcggatgaactgcgtaatgcactccatcccagcttcatgcctcgaggctggtggcagtgtcccttgccagccggacagcattgttgcccactctgttggcgaaatgttcagcagcatccccttgtcaaagtcatctactatggaccactctatgcacttcagcagttcccggttctctgacgccataacagcggatgccattgttagcggaggccaggcattgagcaacgctgatgacgaagagagcacggacacacctttggtcctccgcaacaaggctccgagatggcatgagcagctgcagtgctggtgcctcaacttccggggtcgggtgaccgtcgcctcggtcaagaacttccagctagtcgctgctgtgatgacgcagcctgccgtcggagccccgaccccgtcgcaggcagccccgctgccactgccagctccagctccaggtccgcctctgccagaccaggagaaggtcttactgcagttcgggaaggtcggcaaggacattttccccatggactactgctacccgctgtccgccttccaggccttcgccatctgcctcagcagcttcgacaccaagctggcttgcgaataaattcgatgactctagttcttatcgaataatcatcaaagcccctgattgtcagtgtgttcgtttaagaattgaagctgactctgtcctcaagttctagccatgaccccattccccccctggtgacggtcccttgttaactctgaaacacccccccctaaacgtgtgtgtgtgtgtgggntggggtttggggggggggggggctgaatctgtttcagcagcttacttgtgataatcggtggctgctgtgttgctgtttgactggtgttgtatcgtatgctcatttctttccagttctgtagcttcccctgtaacattaacctggatgtttttcacccatttcgttggattgtttcccggggatgccatgtatgaacagagatagttacagctgtaatgaatt

SEQ ID NO: 7402 - DNA, 670 bp, Sorghum bicolor
  Clone ID: SORBI-28MAY03-CLUS8094_1
ctccaaccacatcgtcggccgctacccctacggcatgacctacttccaccgccccaccggccgctgctccgacggccgcctcgtcgtcgacttcctagcgcaagcgttcggcctgccgctgctgcagccgtacctgcagtcccgcggcaaggacctccgccggggcgtcaacttcgccgtcggcggcgccaccgccatggatccgcctttcttccaggagatcggcgcgtccgacaagctctggaccaacctctccctcagcgtccagctcggctggttcgagcagctcaagccgtcactctgcagctccccaaaaaagtgcaaggagtacttcagcaagtccctgttcctcgtcggagagattgggggaaacgactacaactacgccttcttcaagggcaagaccctggacgacgccaaaacctacgtccccacggtcgccgccgcggtcaccgatgccaccgagaggctgatcaaggccggcgccacgcacctggtggtgccggggaacctgcccattgggtgctcgtcggcgtacctgaccctgcacccgggccggaacagcagcgactacgacgccgacggctgcctcaagacgtacaatgacttcgcgcagcaccacaacgcggtgctccagcagaacctgcgggcgctccgggtcaagtacccg

SEQ ID NO: 7403 - DNA, 1002 bp, Sorghum bicolor
  Clone ID: SORBI-28MAY03-CLUS80963_1
gcacgaggctgatgggtattgagttgagtcctctgtatgaagagttccttagggagaagaagacagttgttcgtggcatggctcatccatttctgtttggaaacaaatttgactcatcgcgccaggagatatctcggatcgatactgtttctatgtatggtggattaccggtcaccccaatcaatatgtacaggttattcaagaggaatgactttgttctgctttatcctggcggagttcgggaagctctgcataggaagggtgaagaatacaagttgttttggccagatcaaccagaattcgtaagaatggccgcgcgctttgatgttactatcataccctttgggtgtgtaggagaggatgacgttctagagttggttctcgattacaatgatcagaagaacattcccggacttcgggagtggatagagtcaatcaacaaagaagccgagagagtgagggacagcgtaaaaggggaggatggaaatcaagacatgtacttgccagctcttctcccaaaagtacctggtcgattctactatctattcggccaaccgattgaaatgaaagggatgaacaaccttgtcagagatcgccgggggacccacggggtgtttgtacccgtctatccccccccggcggtgagtgtgtcctagctcacgtgggagggggagcacgacccgttcccccgtgcaccgcgccctgcccggttcctgcccccgtggggcgcctctgctctgcgcccgccttctgggcctcctggttttggtcctgtcttgtttgtgtggttggatatttagaagttcacacaaacgacgacaggagaacagcgactaccatttctgtgtgaaagtagggaagggcatctacgagctgcaattctttgaccggatgtaatgcattctcatttctgaggaaatctccctcatgctgtacagaagtagattacgtatagtatacagaaaaaatgtatatttttagaaaaactgaaataataatttt

SEQ ID NO: 7404 - DNA, 677 bp, Sorghum bicolor
  Clone ID: SORBI-28MAY03-CLUS811_1
ctagccttgcactggaaatatcacaagcaaatttggattcggagaatcaacctcataatgatgatcagaacattgagcaacatacagtgttgagtagcacactgtcgccaaaccacgataaggggcaaaagggagctcaaaggacaaacaagaccaaaaaactgaatcaaagaaaaatccttggagatgctggccttgcacagccgtctggagtgagaagaagcacaagaacacgctcaaggcctttggagcattggctcggtgaaagattactatatgggcctataaatgacactttgcctgcagttattggcatcaaatcatactctcctggccaagacggcaagaaaacattgaaagtgaaatctttcgtgcctgaccagtattcagatcttgtcgctaaatccgcgaagtactaaacaagccaacattttcctaagaagatcacgccttgtgacctgttgctttgtcacctgactttatgtgatgttgacatgtatccgtggaactggagtgagtgctgcacaacgaaatgcatgtgaacttgtaaggcagacgtcctatcgaatggttgtcagtattttttagtgtggatgcgatatttctaattcggccgagtctaggctcgaaatggcattcgcaaaaaagaaaccttctgatgctctgccatctaacag

SEQ ID NO: 7405 - DNA, 483 bp, Sorghum bicolor
  unsure (1)..(483): unsure at all n locations
  Clone ID: SORBI-28MAY03-CLUS81889_1
ggcacgctgccggatacaatcggcaacatgcgcgcgctggagcagctcgacgtcgcgcacaaccggctcgccggcgagataccagagagcatctgcgagctgccgcacctcaagaacttcacctactcgtacaacttcttctgcggcgagccgcatcggtgcctcgaggtgccgcgcatcgacgaccggcagaactgcattgctgggcgccccgaccagcggccaggcgaggagtgcatctcattcctacaccaaccacgggttcactgcgacggccatgggtgcatcgcgccaccattgccgccgccgccaccacctccaccagtgcatgctcctcctccgcctgtatactgatctgtggtaacatgtaattgcttcctgccttgtcgtgtgaaaattgaagggtaaatgcatacacatggtatatactgtaatttttatttctcaacaaaagagtaataatggattcatagattttcattn

SEQ ID NO: 7406 - DNA, 725 bp, Sorghum bicolor
  Clone ID: SORBI-28MAY03-CLUS8179_1
atttcatagtcagaggtgaaattcttggatttatgaaagacgaacaactgcgaaagcatttgccaaggatgttttcattaatcaagaacgaaagttgggggctcgaagacgatcagataccgtcctagtctcttccgtggacgtgcccggcctggctgcggcgcaggtggctcactcgactccgccggctcctgctggctctccatggtcggtgggtgcccgggcgtgcatggtcgcgggcccgcatcggcgacgcaccctcggacgggctcccccccgccgcgagcctgcggcgttagttcccccgacgcgggctaacttgtacatcgacccccgggaaaaggtcactgctcggtatcagctcatctgtccatcaaagagagaggtcatgatatttggaagcctgaagcaggctgggacgctgctaccaaaagccccgaagggctggggttggcgtactgctatactgtttgatgagcttgcagatcttctccagggtggtgccctgcgaattgctgcagtggtccagctcgtgtaaactacagttgcagaaaacaactgctttgcaaggatggtgataccacagcagtttatgtagttgatagtttgatacctgcaagaactcagtccgtcatgtattcgtgctctgaaattgtgtatactgtatagtggttcgctgtttgaatatactataaaataatatataggtggatcttcagctctgg

SEQ ID NO: 7407 - DNA, 504 bp, Sorghum bicolor
  Clone ID: LIB3476-045-P1-K1-A9
ccttagccaagaaaacagtgctgctcatctgcaggctgaaagtctatttgagacagggatgcagacaagatatcgcagtgttgcatctgtttccactccaggtggttcttctgtccagatgcaggagtcaaaggagcatgaacttggatcagattgggaaactgcagaggatgcaactatatcgttagacatgaaaacacctcttagccattttcctcctttccgctttggggttgaattcgaggatgtgcacaggcttgctgatggtcaggtgaaacactcgactgaagtgttttatgcaggctctctatggaaggttagtgtccaggcattcaatgatgaggatcctcatgggcgacgcacccttggactttttctccaccgacgcaaggctgagttgttagatcccttgaggaaggctaacttgtacatcgacccccgggaaaaggtcactgctcggtatcagctcatctgtccatcaaagagagaggtcatgatatttgg

SEQ ID NO: 7408 - DNA, 740 bp, Sorghum bicolor
  Clone ID: SORBI-28MAY03-CLUS8198_1
ggtctctctagatgcagcggcaggtgcggcgatggcgccccccatgggcggcgcaccggaggccgcccccgcccctgctcctggatctcctttctccctccttccccgacgtgttccgcgctcctccgaggcagctgcggcaacagcagcacactggacggtcagtggcgaggcctcgtcgcggacgtccctctccctctccatctaccgatgtggcgcttgcggtggggacatggcggccctctgtgtagggcaccggcgcgagcgcccccggcttgtcggtggccctcgccacggtgtggtcgcggctggtcgccgccgttggctgcacctaccccttctccagcgtcgcctggtgcaggtgctccggtagatccgctattccttgtgctgtccgctcgcagagtgtccaatggtttttggcgacatatttctgcttcggtgctccacgacatggtcgaagcgatacaagattctagatttgaagcacaattttttttcattagtctgctgcctctcagcctaaagctttcctccagaattatcgatgtcaggccttgcaaaaacgtcaaattcccaatttgctttgaccatggcaatcaagaaacttgcagagtcagcttcagaaatagcaagtggcaattgataaatttcctcggttcattgaaacgagagggttatttgaagatcaagaagctcgctgctcagcactagatgttaaactgttggtactgtttttt

SEQ ID NO: 7409 - DNA, 715 bp, Sorghum bicolor
  Clone ID: SORBI-28MAY03-CLUS82161_1
ggctgcacgggctatggtagcaagcccctccgcgagcacattcgacaggaccaccctggcgtggtacgcacgatcatctcaccacattgcctcacgccgctgaggatgcacgcgcatgagcaggctcgcatggtgagactcggcgacagtgacggcagcccggagttcctggtcatcgttggccagtacaagcagctggggcgcatgctgtcggtggtgcgcctcgtggatgagtccgtcgtcgagcaggatttcaagcacaggatcgaggtggtcggcaacgccggtgtgctgtcgctgtccggtgagactctggacgctgagcggctgaaggagccgtacaaagcgagcccgttcctgttcgtccccaacgagacctgggactctcctgagggcatccgtgtgttcatcgagctgaaatgaagtccccatttggaaagtcgtgatttattttatcctatttttcacaagaacctagactctgcatccaacttttgcattccagatagacttgaaatggtgccccgagcacccgtactccttttctttcaaatggtaagtcattccatttcataggtagtttttgttattcagctaagataaggttacaaaagcgggcggcccctggggtattcagtacttggtgtttgtttcgctggtgactgattatgttacttgtgtttgtttcaattggcatgggcggccctgtggtatt

SEQ ID NO: 7410 - DNA, 713 bp, Sorghum bicolor
  Clone ID: SORBI-28MAY03-CLUS82075_1
cgcggctgcggcgttcgcgccaggcacggacggcgtcggcaagcgccgacggccgtggcgggcgcgggacaacaacggcctcgcggacgcgctggactgcagcgaccagcagcaggagcggatcgtcctcgcggcgacgtcgtcctcgtcctcgctggtcaggtcgtgctccctggaccgccgcgtcgagttcggcgtcaagaacaagagctcgtggctgcccctccacgcctgcagcggcagcgaggccacgtcgccggcgccggccgacccgcgggatataatagagccgtcgtcggaggactacacgtgcgtcatctcccgcgggcccaacccaaggacagtgcacatcttcggcgaccgcgtcgtggaaggcggcgccggcgctgcggctgagagggaggagagctcgccgcggccgatcaatctgccggcgcgcggcgaccggggcttcttcagcctctgaatgatccatccattcgcgcgtagcctgatgatgcctagtaggtaaagaaactgagtttgctgagtgctattattaagatcagccatattgttgctgtattgtattggttgttccatttccatctgatcagatagatgatcatagatgtttttcttgatcagatgatgtactagacgttttgtccaggttgagctgaagctgtgatataaatttcattatgtggttattactagaaaaaaaactgcaa

SEQ ID NO: 7411 - DNA, 604 bp, Sorghum bicolor
  Clone ID: SORBI-28MAY03-CLUS81476_1
aagccagcaaccccagcaagcaagcaagcgcgcgcgcacaccagcacgaggagcaagcaagagcgcgtcagaaaccaccaaggagccggtcagttctgttcccaagaagcaaaaggacctccacaaccccgactgctgctgctgtcgtccgtgaccatggacaagatcctggccttctccatcctgagctcatcgccggcggacatctccgcggccgggttcttctccacgcggctatcgtggcggacctccgccgccgggaagcctcagacgcctcaggtggacccggcaccgcaaaatcagaaggccgccgagcagcagcggggctcgccgcgggtcccggcggcggagcgcgagcgagaggcgcggccgcggttcgcgccggagttcgacgggctcaactgcttcgagtccatcgtctccttctgaattcccggggggggctccgcgtgacatggttcccctccccgcttgaattcgttcgttcctctcttctaattaattttgggatgtttgctgactgaagcgacgagtaatctgtacagagctgctgtataccgcgtcctattgaatggatcatcatacgttcggttgagttttttat

SEQ ID NO: 7412 - DNA, 667 bp, Sorghum bicolor
  Clone ID: SORBI-28MAY03-CLUS81494_1
aaaaacgaaagagaaacactagaggcgaccaagaaatccgccttgccatctccgtttcgtatatgccctgagaattcggaatttccacacgaatttcacgaggttttccctcgccgcgacctgcgatctcgcttgaaagagacgccccagatcacgggaccggtgtgaggactgagtcgccgacctccgacctcaccgggggcattcgattcgtcccgatcctcacccctcatctctcgcgtgttcaggtttgtcgggctgccggccggagaaggaatgcttgtgtcgacatgctaggccgcggagccgtgcggtcgctgttggatcgtctccgggctccgcctccgggttggaattggaatcccagctccgccgccatgcctccgccgccgccaccgccaccgccctcgccggccgccgcgaaccgcgcctgcctctgcaggttcgcccactcgaccgcgcgctgcggcggcgagagcggcaggacgctgccgggtaatagggcggtgttccttgatctgggagccgggaccgggaggaggttcgcgccgagcggcgcgctcagcttgaaggggtgcttgggttggcaggatggcggcggcggcgagttcaggaggagggtggacggggaggcggcggggatgaaggcccaggtgcttaccacgca

SEQ ID NO: 7413 - DNA, 582 bp, Sorghum bicolor
  Clone ID: SORBI-28MAY03-CLUS81527_1
gatgctccgttgagccgagcgcgcacgcccgccgtccagagcgcagacggcaatgcaggcccccgcgcgctcctccgctccatcctcgccgctcgtctcctccgcgccaccgctacctccacggccacaacgcgtcgccgccccctccctccgccgccgtgatctcctccttctcccggcggcgctgaccctcccgatggcggcgcccgcctccttgcctgcgtcggcgcgcgggctgttccggatgcccccgccgcggctggcgaaccgctactttctggtgcgcgcgggcgagtccgtgtacgaaggtcagggcctcctccgtaccaacccggtcgccaagacctccgtcgacagcggcctctcccccgtggggctccgccagacggcgcgcgccgcgctcgagctccagcgcctcggcgcgtgcgaggacgactgctggatatggccgtccatcacgcagcgcgcgtaccaggcggccgagatcattgccgcggccaacgggatcaaccgcaggcgcatcgtgccggagtacagcttcttggatgcacgcggattgggtgcgtttgagtggaagagctt

SEQ ID NO: 7414 - DNA, 674 bp, Sorghum bicolor
  Clone ID: SORBI-28MAY03-CLUS81580_1
aaaagattaattataattgtaatatatgtcatgcggaattaatttactcgcaggttattcttactgatggtgacccatgtacactcagaaacatgaaggaaaatatggaactgaataacttatgcattgagcaggaagattctagtgtgctaaaagaaagcaagaataaggtagagtgcaaatatctttcttgggaagaagtgtgtgaaagcgatttatggggctaccagccagacatagttcttggcgcagatattatttacgatccggtttgtgtgccacaccttgttcgagtactctcagtgctgttaagacgagaccgtagacaagggaaagccaacgcaacatctggcgatgaatttgaaacggaggctccggtcgcctatattgccacggtggttcgaaatccagagactttcaattgctttgccacagcagctgccgacacaaagttgtctgttttgaatataaccagtactgcggctccttcaaaatttctcccttacatgctatcttatgatagatccagtgtgcagcttcttaaagttacatcgttattctagaacatcgacaacagttgctgtgcttcacgtatttgtcattacgaatgtcattgtaaggacatcaagcatatcatttgcatttcgtatgcttacagttatttgtttacttgt

SEQ ID NO: 7415 - DNA, 877 bp, Sorghum bicolor
  Clone ID: SORBI-28MAY03-CLUS81547_1
aacgcgccggcggctcgacggcgtcggacaattcgggcaatcgcgcgatcccaacctccaagcagccgccgcggccacgcgagtctacttcctcgtccgttcatccccaccgaacctgccagtgaactgcaaacctacctacccccggtcgccggtcacgggtctccgcccagactacaaatggagctccgcacctgcgcggcccccagttctgcgtccctctcttccggccgtggcgcggtgccatcctcgcgcctcctttcccgtcaaatttggagccgatcggcatactgcactgtctcctccacctcatcaagccctgttgctagaaggagccggttctccactctgatggcgactgcatacaacacagggaccccggacctagctgacttcaattgggatgctcttgggtttcaactgatcccaacggacttcatgtatttaatgagctgttcttcagaaggggtgttcacaaatggtaaattggtgccgtatgggccaattgagctgaatccagcagccgctgtgctgaattatggtcagggattgcttgaaggtctacgagcacatagaaaagaggatggatcaattcttctttttcgtccacatgaaaatgcactgcggatgaaaactggtgcagatcggttatgcatgcctgcaccaagtgtagagcaattcctagaagctgtgaagctaactgttctggcaaacaagcattgggtgcctccttttggtaaaggttctttgtatatcagaccacagctaattggaagtggggctatccttggtgtggcacctgccccacagtacacattcattgtgtttgtttgcccagttgggcattatttcaaggatggtttatctccaatcagct

SEQ ID NO: 7416 - DNA, 594 bp, Sorghum bicolor
  Clone ID: SORBI-28MAY03-CLUS81581_1
cggcatctcgttcgagttcaacgccgtcgccttcgacccctcggacccgttgcccccaacggagttgtccgtcgcgcccggcgaggccgtcgccgttcacctccccatcggctccggtactccgttgccgacgactctccgcgtcgtgaagcagctccggcccgccatcgtggtgtgcgtcgacgaccacggatgccaccgcggcgacctgccgctgtcgcatcacgcgctcaacgtcgtgcgctccaccgcggcgttcctcgagtcgccggattcgcgccggtgcagctcagcaacgccgccgaggcacaggccgagtgccttgtcagccgcacgcccacgccgggcttccatgtggagaagcggcaggcggcgcttgcactgcggtggcaggaatcggagctggtgatggtgtcggcgtggcggtgctgaagatgaactactgattccggcattgggactacagttcttgtaaagattgaatccttttattttctcatgcagtaaaattagctaacttgctgttgtcaacacgcatgcagtctgttcattttatatatttaattattaatctgtgatgatatagcaattgct

SEQ ID NO: 7417 - DNA, 645 bp, Sorghum bicolor
  Clone ID: SORBI-28MAY03-CLUS8252_1
gcacgcccatcgccatggccaccaccacgctcttcctcctcctctgcgccgccgcggcactcgcatcagcggcagccgccgccgacgacaccgggttcacgaccttcaagctctacttccacgacatcgtggcggggacgtcgtccccaaccgcggtgcggatcgcgcaggcggcgtcgtccaacacctcctccacctccttcggcgccgtggtggccatcgacgaccctctcaccacggggcccacgcggtcgtccggcaccgagatcggccgcgcccagggcacctacacgttcgcggaccagaccacgttcggcctcctcatggtgatgaacttcgtgttcaccgccggcgaccacaacggcagcacgctctccatcctcggccggaacgaggtgctcaccgacgtccgcgagatgagcatcgtcggcggcagcggaaagttccgcatggccaagggctatgtccaggcgcacaccattgattccggcgccaccaccggggagaccgtcgtccagtacaccgtcaacgtcaagacgccctagctagcttagttggtttcttgctccggccggccgggggcctgctggtgctgccatggcttgttgtattgtgtgcgtctccggcagctttgtacacactgct

SEQ ID NO: 7418 - DNA, 675 bp, Sorghum bicolor
  Clone ID: SORBI-28MAY03-CLUS82739_1
ctactgggacttcgtcggcttcatcgaaaaccctacctctctccgccgcctgccatggccatggagcacctccggtggcgccccacggtgaacgagcgcgacttcatcgagcgcgcgctccagtccgacctccgcgtcgacggccgccactccttcgacttccgcaagctcaaggtcaccttcggcagggaggacggctcgtcggaggtgcagctcggagagacgcacgtgatgggatacgtgaccgcgcagctggtgcagccgtaccgtgacaggccgaacgaggggacgctggccatattcaccgagttctcacccatggctgaccccgccttcgagcctggccgtcctggggaatcagcaatagagcttggccgagtcatcgaccgtggcctcagggagagtcgagctgttgacatggagtccttgtgtgttgttgctgggaagcatgtctggtccgtgcgtgtcgaccttcacatcttggataatggagggaatctcattgatgcagctaacatcgctgcattggcagctctatctactttccggagacctgaatgcacggttggtggggacggtggtcagcaagttacagttcatgatcctgaggttagggatccgcttcctcttacaatacatcatatgcccatagctgtaacatttgcatattttggt

SEQ ID NO: 7419 - DNA, 760 bp, Sorghum bicolor
  Clone ID: SORBI-28MAY03-CLUS8276_1
cccacgcgtccgctcaagtcgctgcgcctcaggatcgggctggtgcagcaggagcccgtgctgttcgccaccagcatcctggagaacatcgcgtacggcagggacggcgcgactgaggaggaggtggtggaggcagcgaagacggcgaacgtgcacggcttcgtgagcgcgctcccggacgggtaccggacgcccgtgggcgagcgcggcgtgcagctgtccggcgggcagaagcagcgcatcgcgatcgcgcgcgcggtgctcaaggaccccgccgtgctgctgctggacgaggcgaccagcgcgctggacgccgagtccgagtgcgtgctgcaggaggcgctggagcgcctcatgaagggccgctccgccgtgctggtggcgcaccggctgtccgccatccgcggcgtggaccccatcgcggtcgtgcaggacggccgcgtcgtggagcacggcagccacggcgacctcctggcccgccccgacggcgcctactcgcggctgctgcagctgcagctccaccgtgtctgacgccgccgccgtgcatgcatcctctgatgatatattaatttaacgatgacatcttcattttggaggtctggtgtggcggcttcttttttcggtttcttgggttggccggtggtcgtgcggatgtagatactagggcaaaccgtgtgtgttcttctgaatgaacttggaaaatgtgatctgtatcttctccctgggatggaatgtaccatgcaatgcactcttttcgtcc

SEQ ID NO: 7420 - DNA, 1513 bp, Sorghum bicolor
  Clone ID: SORBI-28MAY03-CLUS82753_1
atccgcagagcgccgcctgaacccgtctcgttcgcggcccatctcctccctccgctcgccgcgccgcaacccggagaagagaccgcgctctgtcaagcactacctggggcccagcatcctcgcgacccgctccggcgcggcgcccgccctctgcagccccggtgtcccggctccggcgcggccggcacacagctccacagtcaattaccgggtccaaccctggtggtcagctggactcatcgcacatggagcacgctaagtcaggccccagcagttggccggaactggccgatgtggtgccggtgccgcaggacgacgggcctagccccgtggtgcccatcgcctaccgagatgacttccgtgaggtcatggattacttccgtgccctttacttcaccggtgagcgaagcccccgtgctcttcgcctcaccgccgaggccatcgagctcaaccctggcaactacaccgtttggcatttccggcgccttattctggaggcactagattttgatttactggaggagatgaaatttgtcggaaaaattgctgaatgtaatccaaaaaattaccaaatctgggtccaattttattaccaggcatcataagaggtggcttgctgagaaattgggacctgatattgcaaacaaagagcatgaattcacaaagaagatacttgctattgatgcaaaaaattaccatgcttggtctcatagacagtgggttcttcaagcgttggggggatgggagactgaaatggagtactgcaaccagctgcttaaggaagatgtcttcaacaattcagcttggaatcagagatactttgttataacaagatcaccgcttcttggtggccttacagtggtgcgtgattcagaagtagactacacaattgaagctattctagcaaaccctcggaatgaaagcccctggagatacctcaaaggtctatacaagggtgagaataacttgctagtagacgatgagcgcatctctggtgtttgtttcaaggtcctgaagaatgattggacttgtatatttgctttgggtttgctgctcgatcttctctgcactggtttgcagccttcagatgaacttaaatccacccttgaaccgataaggagctcccatcctgaaaccgcagatgctgatcctgcaaccgttgtttgctgtatcctgcagaaatgtgatcccctgcgggtagaatattggtcttggttcaaggccactctttctcagatgtcctgacttcacatgggttcacccaaccgttgtttgctgtaaacctgcagaaatgtgatcccctgcgggtaaattattggtcttggttcaaggccactctttctcagatgtcttgacttcacatgggttcacccctttttgtcctcgttgggacggactctgagatagacatagatagtttcattgtatctgcatgatgcaaacccaaccttcagtgtgactgaaagcaatacttgtaacgaatttgttagtaaaatttatcaggttacttccc

SEQ ID NO: 7421 - DNA, 842 bp, Sorghum bicolor
  Clone ID: SORBI-28MAY03-CLUS81687_1
accgagtcgccgatggctgacgcggcggcgcaggacaccaccgacaccgagcaggggctgctccacctgaagctcgcgttcctcgccggggagcctcccgcctgcgtcctagcactcgccagagcagctgggggaggttctatcacaccacatgtccaaaaatttattttggagacttgcactagctcaaacgtaaatgatttattttcttgttgtcttgcaaagggcggcagacgcagaacagaagtcccaccgagtcgccgatggctgacgcggcggcgcaggacaccaccgacaccgagcaggggctgctccacctgaagctcgcgttcctcgccggggagcctcccgcctgcgtcctagcactcgccaggtagagagatgccaagactatacttatacaacaattatctttaaaaagattatatctgaggttgaactatcttcaaatgttgtgattgatgaactttatgaggaatttgcccaacaaggattcattattaaacaagacagatcatatttataaagaaatatcttttctctcttctacagctagtaacatttcttcaaagctagtaagtgtcgttgctcgactatcatgttcttctaatatgcttgaaggtgatacagggtgtgctctttggccatcaagtctattcttgtctgaatttattctttcatatcctaaaattttctcctcgaagtgttgctttgaggtaagtgattaattttattattagtgtgagatacattaccagtatgacctcatgtaagaaagtttatgtaaatatgtttagctcatgctccgataattaagttctatcagatattcaaataataat

SEQ ID NO: 7422 - DNA, 608 bp, Sorghum bicolor
  Clone ID: SORBI-28MAY03-CLUS81688_1
aattcaatttgcaagttgttgcagtaccaacagcaacaccatccatcacctccgactccgactactctcagtccgatcctccctcccccacgcacaccacccagcactcctcttctgatcacgtacgataagcgcgctgccgcccatgtccgagctccaggacgacggcgccggcggaaatggccaagacgaaaccgcccccgccgccgccttcgcgtcgccggccaagcgcctccgcagcaggtcgccggcgtcggagcccacctccgtgctctacaaccgcagccccagcccgcccacgtcctcctccctggcctcttcctccgcgcccgagccgccccccatcagcgccgaggactgggagtgggaggccgtcctcgacatggccgcgccaccagccgccgcacggtctcaggacaccacctccttcctccgctggatcatggacgccgacgcccaagttgacgcctttgatcccttcctgcctccgccgccttgccaggagaccgccgccgtcgagcccttcttgcacccgcagctccagctcccgctcccgctccccgtggcgcaggaggaccttgaccttgagccaggggtggcggtggacg

SEQ ID NO: 7423 - DNA, 617 bp, Sorghum bicolor
  Clone ID: SORBI-28MAY03-CLUS81702_1
cctactggactgcagatcgcaggtgcggcgacggggaaaaacagaacagagattctagctgtcttgggtcatggcggtggcgacgacgactgctcggtcgtggctcctgctgctgctgctgctcctggccgtcatcgtctcggcggccgcggcggcgtccgggaagaagcagcacgagagatggagggtgagcggcggcgcggtgggcgggcaggtggtggagaaggagaggcggcgtgcggtggcggacagcgaggccggctcggtcacggccgtggacgtcgccgacgcggcgggcacggcgtaccggctgcacttcatcaccatggaccctggagcgctgttcctgcccgtgcagctgcatgccgacatggtgttctacgttcacagcggtcggggtaaggtgactttcatagaagaagagagcagcgaacagagttccatggaggtgcagcgaggagacgtctacaacttcgagcagggcagcatcttgtacatccagagctaccccaacgccaggagacagcgtcttcgcatctatgccatcttcaccagcgaaggcatcaacgccgatgatccctcgaagcccaaggtggaagcttattccagcgtcagta

SEQ ID NO: 7424 - DNA, 1068 bp, Sorghum bicolor
  Clone ID: SORBI-28MAY03-CLUS81750_1
gtaacgaaccgaaccggaacgtaacctccctctcgtcaacgacctcgtccatcgcgcccgaggcgagaacgcccccagtttcgcgctatggcggcgacgtcgtcgaggcgcgtgtcggtgccggccctggcggcggcggccgccgtgctcctgctcgcttccgtagccgcgggcgacgaccacaacggcgtctacgacccgtgcgcggacgcgtcggtgcagcgcggcgacgggttcaccttcggggtggtcttctccgggcgcgactccttcttctccggcggcgtgcagctctccccctgcgacagccgcctcgggctcgccaaccgcgcgcagctcgcgctctaccgcccccaggtcgacgagatttcgctcctcaccgtcaactcctcttccttcgacccgtcttcttctggtgggtacatggtggctttcgccgggaagaaatacgcagctaggtcaaccccggtgttcgtcgccaacacctcgtacacagcgacaggctttaccctggtcctggagttccagaagggcacgctccagaacctgttctggaagcccagcgggtgctcgtcatgctcggggcgctccgacttcgcgtgcgtggacagcagctgcgcgatcaagacgacgagctgcaagggcaagggcgggcaggtggactgcaaccctggcatccagctcgcgttctcgggaacggacaagcacgaggccgtgctcaacccgtggtacgaggtgtccaagctccggcagtactccctgttcgggctcttctccaacctcaaggactcgctcaccagccagttcagcagcttcttctagctagagcctgccccgtccagtgcgagctgccacgtcgtcgctctgtactgtacgcttgcttttgctctgtctgttctatggactatggttatcgtgtagagtatgcttagtgaatactccttctgtcgtagttttgtttctgatgacagaagaactacgtatgtgtataacggctatcatcagatgagtcctatgtatgtcagtatgtgcagtttataatgcaaatgagatggtgtaagttttgcg

SEQ ID NO: 7425 - DNA, 622 bp, Sorghum bicolor
  Clone ID: SORBI-28MAY03-CLUS81775_1
agaacgtggccgtggagggcttctgcagcagccggtgcggcaagcacggctctgccgccccgggcgccgaggtcgggtccacctacatctgggtgggcaacgccgtgaagcagtgcccggggcagtgcgcgtggccgttcgcgcagccgctgtacgggccgcagggcgcgcccctggtggcgcccaacggcgacgccgggatggacgggctggtgatggtcctcgcctccatggtggccggcaccgtgaccaacccgtatcgggacgggttctaccagggctcaagggacgcgccgctggaggcgggcaccgcgtgcccgggcgtttacggcagcggcgcgtatccgggatttcccgggagcctgctggtggaccaaaccaccggaggcagctacaatgccaacggcgtgaacgggaggaagtacctgctcccggccttgtacaacccggcgacgtccacctgcaacaccctggtgtagtcgattggagtatgtagtgatgtagtgcgtaccgaacaccgtccccgttaatatgtactgtactgtactgtactgtacgcctgattaaagctgtacatatacgagtttggacttggagaaatgaaattacttttttttttgag

SEQ ID NO: 7426 - DNA, 639 bp, Sorghum bicolor
  Clone ID: SORBI-28MAY03-CLUS8337_1
aggagtagcgcggcgcggcgcggggaaggagagaactcgctctagctagctagctagcgcggcgagcggtgcagggcgagccgagctgctgcagaggcccggagaccggaggagggagggagagacgtcgcctgcctgcgatgtcaccggcagcatccgccgccgaaatcgccgtcgtcgtcgttgcaagcgtcccgagcgagcagagcagccaccgcgccgcggcagcggcgccgtccgtcccgtcgtcctacgccgtctgggagaaggagcggtaagactgagaggtcgatcgagctctacgtcgtctgcactgaaagtgaaagcctggaacctgctgccgcaagggagagtgaaggaaaacgcagggcagggccatggaggttgagaaggccaagtgcgagtgctgcgggttcacggaggagtgcacgccggcgtacatcgcggcggtgcgcgccgagtacctgggccgctgggtctgcgggctctgcgccgaggcggtgggcgacgagatccggcgcgagggcagcgccatcaccacggccgaggcgctcgaccgccacgtcgcgttcgcgcgcgccgcgccgtcgtacaggacggcgtccgccgccgaggacgacctcgtggcggccgtcgcgc

SEQ ID NO: 7427 - DNA, 849 bp, Sorghum bicolor
  Clone ID: SORBI-28MAY03-CLUS83540_1
gcacgaggctggactgctcaattttgttgatgggctgtggtcaacaagtggggaggaaaggatcatcgtcttcacaaccaattacaaggagcggctcgacccggcactgctgcggcctggaaggatggacatgcacatccacatggggtattgcaccccagagtctttccgaatccttgccaacaactaccactccgtcgagtaccatgacacatatccagagattgagaaactgatcaaggaggtgatggtgacacccgcagaggttgctgaggttctgatgaggaatgacgacgctgatgttgtgctccatgatcttgttgatttcctgaagtcaaaaatgaaggatgctaatgagatcaaggctgaacacaaggaagcaaataaccagctggatgagaagaaagacgacaaggataatgagaaaaaataaaacccagtgcaattccttccagaaaagaagacgaaagcaaatagcggtttgagatcaagactgaacacaaggaatcaaataaccagctggatgaggagaaaggcgacgagatattgaaaaaaaataaaacccagtgcaattccttcaagaagaggaaagaatatgaaagccccccatatcgtatttcatatagatcaatcctacaggggatccataggcgcatgtgagtgtttgcatattgtcaacattgtgtttttggattaatgaggtgtactggtacttccagtgtgtgttagtacttgtttagtagcttgtatgcagaattacagatatgcaaaatccatgtgacaatttacatgaaactgcaaacatgccattgccttgcaaatgccaacctgttaagtgtaaagcagtac

SEQ ID NO: 7428 - DNA, 696 bp, Sorghum bicolor
  Clone ID: SORBI-28MAY03-CLUS837_1
tggggcgagcacgtgcttccactggtgctcgtccttggctgttttcgaggctccccggacaaaagcggcagcgataaaggtgaaaacctctgctgactgggacaacgcatgggctacgtttaagaagaaagggaagctcttttctgatttctcaccagacaagtatgtgacctggaacccacggcgcagcgagtatccattgtcagaagaggttgatccaatcaagagaactgaaagatctaacttgatgctgtggacaagtccccagtttaccttggtgggggcaattatcatcgtcttgacattactaatctatacactagttgttcctcccaagtaactgcagaggtgacagctaggaggtgagctgtaaactaatatttctactgggaagtatgtattgtttcattttagtacttctactacaccaactatagcagtattgcttcaagtgcaatcaagtagtatataacaccacatccattccattccgggaggttttcttcacttgtatacggcgtctgcgtgcctcctcgcggccgtgggggtgttcggcgcgcggctagtgggctcgggcggcccccagccggcccccgcccccggctctgccgtcctgctcctccacgccgaccccgccgccctctcccttgccgtcgcctccatctccgcctccctacgccgtctcgccgccaaggg

SEQ ID NO: 7429 - DNA, 773 bp, Sorghum bicolor
  Clone ID: SORBI-28MAY03-CLUS83739_1
gcacgaggttttcttctctatccttgggaaattcggggctatctttgcttcaatcccactgccgatattcgctgccctgtactgcattttctttgcatacattggtgcttgtggcctgagcttccttcagttctgcaacctgaacagcttcaggaccaagttcatcatggggttctccttgttcatgggcctgtcagtcccccaatacttcaacgagtacacgtccgtggctggctacggcccggtgcacaccggcgcccgatggttcaacgacatgatcaacgtgcccttctcgtcgaagccgttcgtggcggtgctggtggccttcttgctggacaacacgatccaggtgcgggacagcggcgtgaggagggacaggggctaccactggtgggacaagttccggagcttcaagacggacagccgcagcgaggagttctactcgctgcccttcaacctcaacaagttcttcccttccgtctgatccatccagcaggggctgcacactcttccctcgcggtggcagtagctcggactcgaagtggcggagtcagagaagaaatgatcctatgaaggtgatgctggagctggactgatggcgttttgtacattcaggggtgaactctgaactgggcaggttgcagatttgcagtccaggggggagctctgggatttgacacacgcattttctcctaatgtggttgcatcttggtctattgtgttgagtgcatacatacatagatcctttttgccttttgcgagaagaatgttgt

SEQ ID NO: 7430 - DNA, 701 bp, Sorghum bicolor
  Clone ID: SORBI-28MAY03-CLUS82190_1
cgcaactgacggcacctgtgatgccaacaaggcgaacgatgaaaaggtcgccgccatagatgggttcgtggaggtggcgagcaacaacgagacggcgctgcaggaggcggtggcgatccagcccgtcagcgtcgccatcgacgccggcggacgtgcgttccaacactacagctcgggcatcttcaacgggccgtgcgggacgaacctggaccacggcgtcacggtggtgggctacggcagcgagaacggcaaggcctactggatcgtgaagaactcgtggagcgacagctggggcgaggccggctacatccgcatcaggcgcaacgtgtttttgcccgtgggaaagtgtggcatcgccatggacgcgtcgtacccggtgaaggacacctacggccccgccgccaccgccatggatgtgctcaagatggtccttgcttagccggcagagcaggcagcggactcgactacagttgcttcgatcactcttatatagaataaggaacaactgaagtcgttgcttggtttttattactagcgttgcgctgagtttgtgtgatgctcgaggatcttgtgcaacttgtatagtgttggtgtggtaagttaactaataataagtagtatgttattgcgtacctatctttcttgagtcgtaatgtaatgaagttaattacaaatgaataaataaataatgataaagatgt

SEQ ID NO: 7431 - DNA, 680 bp, Sorghum bicolor
  Clone ID: SORBI-28MAY03-CLUS8220_1
gaagataatggcattggtgagacacaaccctttagaggtcaaggtgacgccaccgaccaacagactgatagataccagacctcagcagggacattggatgctcttagggagaggatgaaaagcattcaagctgcagctataggtcattttgatggagctcaggctcggccgttggcaagtatgaacggaagtaatgtgctgcatgggggagcacggttggacggtgaaccccaacaacaaagcaatattccacccatggatgagcgagctctatctgggctgcaagcacgaatggagaggctaaagagtgggtctatggaatcactatagatacgaagagaaataccaaccattgtaattcattgtaaatttgaggcatagtgatgctgttgtttgtagataggtatttgaatgtcggaagaactacatggcacggggccgacatttcgtaacccctgtgcctggttaagccattcttgcagagcctttgggtgcagttttagataagagctagccagatgttttccttgtagctactccatgaaggactaattagtgttgacacattttgccgtactgtattggttttcttgtggtgtacagcaatagaatttttcattctcaaatacagatgttacttgtgaaacatacggttttcagaatgcatattcgtttggttt

SEQ ID NO: 7432 - DNA, 979 bp, Sorghum bicolor
  Clone ID: SORBI-28MAY03-CLUS82248_1
tactgggacttcttctccccaagaccccaacgcttcctttccccgcgccgttatcacacaaggcgaagcggctcggggacgagcagcggcgaaaatcccatcgagggcctctcccccgccccgtccctctcctgcgtgcagccgtcgagcctcttctctccgcaactcgccatccttgtcgatctgggagacggcctccacagggccatctctctctctcgctctttcccctccgatccgaccggtgtgggctgcggccggcgcgatacggccccctcccgcccccctatgccgtaagcgagcaatcagaaccccgatcacccgcacgccggcgcgccggtgtcttcttcgccaccatgaactccatcgagcccttcaaccggctggtgaggctggcggcccgcgccttctacgatgacgtctccatgaagggcgacaaccagcccaagacttcccgcggggacaaccgtggcatggccgtcgtcgtcctggacgcgctcaccagacggcagtgggtccgggaggaagatttggctaaagcattgaagctccactcgaaacagctgcgtcgcattctccgtttctttgaagaggagaaactagtcacaagggatcatcggaaggagtcagcaaaaaatgcaaaagcacataatgctgcagctgcagctgctaatgatggtcaaccagttgccaaggagggagaagagaaagtaaagatgcacacacattcatactgttgcttggattatgctcagatctgtgatgttgtaaggtaccggatccaccgcatgaagaaaaaattgaaggatgaattggacagcagaaatacaattcaacactatatatgtcctagctgtaataaaagatactccgcctttgatgcactacaactggtaagctacacggatgagtacttccattgtgaaacttgcaatggtgaactggttgcagagagtgacaagcttgcttctgaggaaat

SEQ ID NO: 7433 - DNA, 667 bp, Sorghum bicolor
  Clone ID: SORBI-28MAY03-CLUS82256_1
cctaaaaccatcgatccagatcagagtcgcaaatcaccggctcgatcggtggcggcgtccctagaccctagacgtcgccgcgcccaaccggttcctcgtcctcaacgccgccaagctcgacgacttcgcgctgcagggctccgaccagacgaccaagtgcttccccgcttgccttgctccccctgcacggatgggtgggaaggggccaaggcaggtgctccaagccagcgccgcgacgaaaggccctaggcggctgactgaggtcccagctgagacgagccaacaccaagcgatggagaagatcaccgccaccatcaacgccaacctgctgcagtgttgtgtatgctctggtccattgacgcctccccttttccagtgcacgaaaggccatgtctcatgctcacggtgctgccccgccgatgggtatctggacgacgaggttgaatgcctcatgtgcgatgagccagagacggccacccgcttccgcgccatggagcacatcctcgtcggcatgcgcatgccatgcccgttccggcagcacgggtgtgccaagatgataccctacgcgtcggtgcaagcccacaaggcgtcgtgcgtccatgccccgtgccattgccccatctctggctgcacgggctatggtagcaagcccctccgcgagcacatt

SEQ ID NO: 7434 - DNA, 840 bp, Sorghum bicolor
  Clone ID: SORBI-28MAY03-CLUS82289_1
gtccggccgcgccgccgccgggtcgcccccggggcggctgccgccgcgacccccccccgccgcgaccccccccggcgcccccgcggcccggcccccgccgccggccttggggcgcgttcctcctccgggctcgctctccgcccgtcccccgctatccccactgctcgcgccccctcgggggggggcgccgccccccgccccccgcgggggagagagcgcgggggggcgcggacacggggggcgccgcgctgcgcgcgcggagggcgcgggggacgcgcgcgccccgctcggggtggagacacgagctccgccgcggggccccgcgggtctcgtcgcttgcgcagggagttgtttactggcaacctcctgagtcagctctggataagatcgaaaaaatcgtcagggaaccaacagtcagtaagtatggttctgatgatggacttcctgagcttcgagaagcacttctcgaaaagctacgcagagagaataagcttaccaagtcatcagtcatggtcactgctggtgcaaatcaggcttttgtgaacttggtcctcactctttgtgatgctggtgattctgttgtcatgtttgcaccatattatttcaatgcctacatgtcattccagatgacaggtgttactgacatattactggggggttgccggcccacccctctgcagcctgtggtccctggcctgggcttggttctgaaagaaaatgaccctatccctaaacttgttactgttgtgaatccggggaacccctctggagcttttgttcccaggcctatgcttgagagaatttcagatctgtgcaaaaatgctggtgcatggcttgtgg

SEQ ID NO: 7435 - DNA, 727 bp, Sorghum bicolor
  Clone ID: SORBI-28MAY03-CLUS82410_1
gacacactgtcatcacccacccggagcaaacgccggtggagtcgagtcgagtcgagtcgagtcgagcgagaggccccgtcccgttccccccccttctcttcctcttccaactccattcaagatcactgttgcgctgcacaatctgactgaccaccaggggcagccactcattcattcatccattcatctgtctgttaagaagagagcgagagagcgagaggggaggaggccggtggtggagatgaggaggcaaacagcggcttccgggggacggtggcgaggaggcgacggcagcgttgctgcggcgtggtgggtgggcgtggtggtcctgggtggccatttactgagctgcgcgcaggcggggctgctggagtccaacccggggctggcctacaacttctaccagaagagctgccccagcgtggactccatcgtccgcagcgtcacctgggcgcaggtcgccgccaaccccgccctcccggctcgcctcctccgcctccacttccatgactgcttcgtcaagggctgcgacgcgtcgatcctgctggacaacgcgcagagcgagaagacggcggcgccgaacctatccgtgggcgggtacgaggtgatcgacgccatcaaggcgcagctcgagaaggcgtgcccgggcgtggtctcgtgcgccgacatcctcgcgctggcggcgcgcgacgccgtctcgtaccagttcaggtcctcgctgtggcag

SEQ ID NO: 7436 - DNA, 674 bp, Sorghum bicolor
  Clone ID: SORBI-28MAY03-CLUS84163_1
gtcaagcatgtacgatcgcgaagacatggatcactaccacagctttgatcacctccgcacgcccttcttcaccccgctcacgagcatcatggacggcgatcatggggtcgtcggtaaccccttcaagtgggcagcagcctctgaagtctgctgcgacctcctgaaagcatgactagcggggttgccggacagccaaatgctaggagctggtgactgctggcagttcccagctccagggtccgggattgcccctcccatcgtttggctcccggtaggcaaatcattcttggctgaaggcattgttgagcgttccactcatgccgcctagttctcctagaaactctgaaacctagtttctgggatcctgtggtgagtggaacattcctttgcctcaaaaaacaaaacaaaaaaaaagttggttgtactatcgaccaacttctaaatggtttcaccttattagctttcagaataataaagcctgatacttcggactcgtctgaagtttcagaggtactggaattgtgctatgtgtgagtctgttaaagcgtcaagaactacggatttgttggtgatgaattgtagtgtgcttgaagcttatgtggacttgattcgtacttttgtggtgtgctgaaaacttaaactcggtaatgtaatgaaactcgggcttggtttgt

SEQ ID NO: 7437 - DNA, 656 bp, Sorghum bicolor
  Clone ID: SORBI-28MAY03-CLUS84201_1
aggttgtcaatccaaagaagacgtatggacctgcagctgacatatggagtcttggttgcaccgtcccagagatgttgacacgccgaataccctatcctgacctcgaatggacacaagctctatacaggattggtaagggggaatcaccagcaattccaaatgctctttcaaaggatgctcgtgattttataagccagtgcgtaagatccaatccagaagacagaccatcagcatccaaactgttggagcatccatttgtaagcaagtcaataagatcagtacggtctatgaggccgatatcttcacgatcaaattcatctacacgtggcatcaattaatgggtcgttgattatctattggacagtggcagaatgatattggtccgcgcaaatcatgcggagctagccgaaagggagtgttgttttgcctggagctagtattgtcaacgctcaacagcattgtcgtgtcgtcaacctcttagtgtttcattagttgattctttggcatacgttcgcgaggaagatgtcctcgtttgagccgccggctaatattcttctgcctggatagagaatagtgaatgtgcatttgagcgcatgagttgtagagtgagaacggggtgtgtaaatagattgtcttgatgccaatgatatgttgtc

SEQ ID NO: 7438 - DNA, 570 bp, Sorghum bicolor
  Clone ID: SORBI-28MAY03-CLUS84343_1
gcgcccggcgaccagccgttgagtgacgacggcgaggtcaccgactgggacgatgaggacgccgccgacggttccgatattgagatgacacccgtgtcgtcagaaaggtcggtccgtggcgacgacttcgccgcttgtgacgacgatcataacgacggcgacggcgacgacacgtccgtggatgaagagcttctgaagctggcggcgaaggcggagccggacggggaggaggaagtggacaggaaggccgacgagttcatcgccaagttcagagagcagatcaggctgcagaggcactagccggccatgcatggcgtgcatacatgcatggatccatgcatgctctgctgagtgctgagcgtgcaccgatacggcgacacacatataaataccactgatgatccaccacgaatggagaacgcagcagttgtttgttcatccatggcaccatgtttcctgtatcattttattgttttttttgttgctccactgcccaacaaggagccggaaacatggtgtgtatatgaatgcagaatgcatattgagcactgcttttttcagtgcatttct

SEQ ID NO: 7439 - DNA, 737 bp, Sorghum bicolor
  Clone ID: SORBI-28MAY03-CLUS84400_1
gcacgagggcgctgcaaaaaaaaaaaacatcgtggccaacggccttgatctcttcgtcttcgccactcctcttcccgcactggcaaagctcatgttcctccgccgccgcctcctctccaccgctgccgcggcggcctccgcccgcggcccaccgccgatccgcgtgtccctaacggagtccgcgggccgcggcgttttcgccacccgcccagtctcctctggcgagctcctccactcggcgcagcccctcgtctcccacccatcccactcactgctccacgaggtttgctacaattgcctcaggaggaagcccggggaagggcgcgcttcaagcggaggttactacttctgcagcgacacttgcagcgaccacgccaaggggttccatgacattgacaaggacgtagattggtctttattcgattaccactgcagttcacgtggtctgaagtacccatacatggccaagcgccttgcttgcatggttatatcaggatctgctaatgcagattgtcttaacatacttcagccagctcggttgcaccaagggacgctgattgagatgaaggaggaatttgagttgttggagtccactcttagaaaagctgggtttcaggaagaagccacagcctgtatccttcaatttgtttcctctcattgcgactattcttagtttcttacaactgaatgttgagaaaattgggtctgtcatagagttcttgtttcagttctcttca

SEQ ID NO: 7440 - DNA, 816 bp, Sorghum bicolor
  Clone ID: SORBI-28MAY03-CLUS8287_1
gatgaatggagacattgatcttgaggaccgagcagaggagttgttggtgtcgcttgatccatccaaggcaaaccccaagaagctcccaaccccacctccaaagaggcgcctgggaattaacatgcttgatgggaggaacaagctagtagagtacaggctgccaccaaagattgaaaagaaggtggtcaatgaacagaggtacgtcccagacacaagatatgtgctccatgacattgatcaggaggccaaggaacaggcattgctgtaccacagtgagaggctggcaatcgcttatggtctgattagcaccccagcaaggactccacttcgcatcattaaaaacctgaggatatgtggggactgccacaatgccatcaagatcatgtcaaggatcgttgggagagagctcattgtgagggacaataagaggttccaccatttcaaggatggaaaatgctcctgtggagattattggtgataatggattaaagtcgttcatctcatcagtattgctgccatcctttatatggatatatatgctggcagctgtggtttcaattgataataagcaatatgaaggtatccaatggtggtgttagtggttctcatccttaaatatgcttaagatccttagctgaaagcacttgtatcatgcaagattataacttcttgatgcactaatcaattctactctcctctgtatcagtatcatgtttctcatgggaaacatgtgctagtttggaatatataactatatggttgtaagagctgattcttccttgctttaatttggatgaatgaactaaaatgaatctt

SEQ ID NO: 7441 - DNA, 642 bp, Sorghum bicolor
  Clone ID: SORBI-28MAY03-CLUS82934_1
tcggggagattttaggcaataacatgcaggttaatcatcaactaactgattattactacttcaagaaggacccaaatgttcacttggagacatcgctctccatggcctccggcctggaaacagcctcatcatccaccaacagtctgaacctcagcatcatcgccgtcgacagtctggagctcagcatcgcgccccctgctcggtgcggctgcggtggcctggcaggggccatcaaagtcctgtgactttggggacgccgccgagctactcgcatcggctcccagactcctgcgagccctgcgttcagtatcacctcgatcgatcgtcaggctgccgcagccagcagttcccgtcttgttggtctttgtcatgctaattttgtgtgttgttcgtcgatggcgtacgtgctggttttctgtagttccgtgtgatactatgctcctactagcagctgtagcagcagtggtggtgcagaaggaatgtttgtgaaattgcatgcatgcttaagttttggctggttcgttttcgtttggtgcaaagctgtatgttgcgcaagaaatcggattgacagactactagccgatgctagtttgcactgtactgctatgtactgccagtagcacgtcctgaattgcaatgcat

SEQ ID NO: 7442 - DNA, 561 bp, Sorghum bicolor
  Clone ID: SORBI-28MAY03-CLUS8289_1
gcacgaggcattacccaagatttccgcaagaacctttatcatagctggaaatccaatgatttgtggtaataaatctggaggtaactgctcttctgtgtcacttgacccactctcttacccaccagatgatctgaaaactcagccacaacaaggcattggaaagagtcatcatattgctacaatatgtggagcaactgttggttcagtagcttttgccgctgttgtagttggtatgcttctttggtggcgtcataggcgaaatcagcagatcttttttgatgttaatgatcaatatgatccagaagtttgtttgggtcatctgaagcgatatgctttcaaggagctccgcgcatctactaataattttaactcaaagaacatcttaggtgaaggtggatatggcatagtatacaagggttatttgcgtgatggctctgtcgttgctgtgaaaaggctgaaggattataatgccgttggtgggggaagttcaattccaaactgaagttgaagtcataagcttggctgttcatcggaatctcctccgtcttattggattctgca

SEQ ID NO: 7443 - DNA, 778 bp, Sorghum bicolor
  Clone ID: SORBI-28MAY03-CLUS82952_1
gtattatagtgccaggaggtgtgcaggaaatacttcatatggatcatgattcagaggttgcttttcttaaatcaagaaaaggttttgttaagatagctattgagatgggttgccctgtagtccccgtttttgctttcggacagagctatgtatacaaatggtggaggccaggtggcaagttaattgtcaagattgctagagcaatcaaattttctccaatcatcttctggggaaaattggggactccgatcccttttgcaacaccaatgcatgtggttgttgggaggccaattgaggttgtaaagaatcctcagccttccattgatgagataaatgaagtccacagacagttcgttgttgcgatgcaagatatgttcgagaaatacaagaccagaactggataccctgatcttcggttaagagttctctgatggcgtgctcttccaaccaaaagctcttaccatctggggtttaagggataagatggctgtgcaggcccatcgattgaattgctcgtagcatttgagctataatgttttttttagcacagatccaccattggaatttcgtagcatcgaaagtataagctagtagcagcatcttcactaggatgtttgtgtgatgtgctcctatcatattttcatcttttggtgctcttgtagaattcctcgaggttcggatgcaatgatatgcattggcctgcatttgtttatactaacaaaaactgcagtggtaggtttatcagacattcaaacctctgactcaggaacttagtata

SEQ ID NO: 7444 - DNA, 646 bp, Sorghum bicolor
  Clone ID: SORBI-28MAY03-CLUS83095_1
taggagagcagcagcagcatgacgacgacgacatggcggctgtgggcgagctggtgatcccgccggtgttcgagcggtgcagccgggtgctggaccccggggagcagaaggcggcgagggacctctactgggaggccatcaccagcagcaccaaggacgacaagaggaaggatccggaggcgctgctgcgggagagcatcgcgaagaaccccttggtgggggagccgcacctggtgctggcgcaggtgctcctgaacggcggcaggtacgcggaggcggcggcggcggcggcgcgcggggtgcggctgctgctgcagtgggggagcagctgggacaagcgcatgtcgtgggaagggtgggtgtcgtgggggcggctcatgggggacaaggcccgccgcggcaccggcacctggccgcgcaccgcatggggcatcatcaacctcggactcgtccaaggcgtcgccaaccgcaactgatccagtctgcatggggagatgcatgcatgcatggcgcatcgtcatcgtccatcccgattcgattccatgcgcattcgtatgtggtgcgtatgtactggagtatttataatggctaaaaataatgtacgtacgtacgtacgtacgtacagcatatgtatgtgtactgtatt

SEQ ID NO: 7445 - DNA, 1371 bp, Sorghum bicolor
  Clone ID: SORBI-28MAY03-CLUS83244_1
tggacgacaccgacggcgaagagaggaagaacgcagcgccgagccgaaccccgcaaccgcaacccaccacttccccgtcgcgatttgcattgccctccgcctcgggcaggccccgatcccgccgcgccctaccccaagccccccgcgccgccgccgggccggagagatcgcgcccccccattcccacaatcccatccctccgtccctcgaggagccggccgccgagccctccgcgcggccgtgggatggggcggtgacagcaccagtgagtggcgtggggggcggcgggtgcgggagccggtggcggcgagcgcatatcatggtgcagtgcctggacggggtgaggcagctgctcgcggtcctgctcaagtgctgcgacgtcgacctcaagcagccgcgggggctcgaggatccccaggtcctcgcgagggagaccgtcttcagcgtcagcgaggtcgaggcgctctatgagctgttcaagaagatcagcagcgccgtcatcgatgatgggctgattaacaaggaggagtttcagttggcgctatttaagaccagcaagaaggagagcctgttcgcggatcgtgtatttgatttgtttgacacaaaacaccaatggaattttaggatttgaagaatttgctcgtgctctctcagtatttcatcctaatgctcccgttgatgaaaaaattgacttttcattccggctgcatgatctcaagcagcaaggctacattgagagacaagaggttaagcagatggttgttgcgacacttgctgagtcagggatgaatctttcagatgaaattgtagagagtataattgacaagacatttgaggaggcagacacaaagcatgacggaagaattgacaaggaagagtggcgcagtctagtcattcggcatccatctctgctcaagaacatgactcttcagtacctcaaggacattaccactacatttccaagctttgtctttcactctcaagtcgatgataactgagattcatgggattattttgacaagaaacatcagaagatatgctcgtgggtttctgatatggttttcattttttaatattgggttgttggattggccgagattgtagtgctccgaagtatgttgcatactggattcgagaactcgaatctttttttcaaccttttttctttcatttgcatgtctggatgcgcttggaaaagatatgtagtatatgcccaatgttcccctttttggatcttttggctggcccgcaatcggatccagttcttagaatcttctgtcttctgtacaggaatggaaacagcggtttaaggatttgtattgtgcttggacttcttttaagtagtggctcgagcagaaatatttttggttg

SEQ ID NO: 7446 - DNA, 1051 bp, Sorghum bicolor
  Clone ID: SORBI-28MAY03-CLUS89855_1
gcacgaggcaactacaccagcatgttcgacgcgcagatggacgccatctacacggcgatgaagaagctcgggtttggagatggagtggagatcgccgtcggggaggccgggtggccgaccaaggcggaggcggcgcaggtcggggtgggggtcgaggagggcgaaagattttaatgccgggatgatccgggtgtgtagcggagggaaggggacgccgttgatgcccgggaggaagttcgagacgtacgtgttctcgctgtttgatgagaatcagaagcctgggccggtggcggagaggaattttggcatctttaacacggatttcacgcccaagtatgatctcggactgcttcgccaaggatcctccggatctccaaacccatctccgaagccaagcccaaacccgtcgccgtcaggaggaggcaagtggtgtgtggccaagtccggcgcgagcgcaaccgacctgcagaacaacatcaactacgcctgtggctacatcgactgtaagccgatccagagtggcggcgcgtgctttgaccccaacaacgtgcagtcgcatgcttcgtacgtgatgaacgcgtactaccaggccaatggcctgcacgactacgactgcaacttcaagggcaccggcgtggtcacctccagtgaccccagttacgggagttgcaaatacgtctcctgacggggcgcagcaagtccaggcagtgcgagggcagaggcaccagcctcgagtccacatcttcctccaggctccagccacggcgatgccgggaggatgatactgccgggcttgcgccaaatacttgtatactcatgtctgacacccatgcttcttgctctcaatcactactagtcgtccttcttaggagagccgccattgtattgttatcatccgtccctctccctcagcacgagcgtgatatggtgtagcctatcccagctgttctacctttgtgttttgatgatttggttggtggcgcgcgcctgttgcgattcgttgtcgtgtgtggtagtggtgaataataaaggcttcgttacttatcattct

SEQ ID NO: 7447 - DNA, 586 bp, Sorghum bicolor
  Clone ID: SORBI-28MAY03-CLUS8479_1
ttatgtctatttttttttacaaaacaattatatcttttgtttattgaacttgtggttcaaattctagtagatgattcaaaacgagaagcaaaaaaattgaagccagagggtggtgaacaaatttctaaagttgaaactgatgttaaccaacttcctcttacggtttctgatgttcttgctatcttttttggtacgggagaaagagaaatggtccattctgaggctgttaagcgtgtttgggagcacattaaaagtaataatttagaggtttggatgattactatcaaaattgttatgtgttattgtgcctttttgaaatgttgggtctaatgttaaagttttaaactcttagtgggctttgtaagtaattttgtccaaccttgggaaattacataaggtcaaaggaaatgtctatatctgttttacagtatcagaatatttttgtataaaaaaaggggcataatgtttgattttagaacattggattattatttcttttgctatgaaaatgtaaatgcatcaatattggtaacttgtaactgcattcgctgtgctttaaactgatgtcatacatgaaaacttgtct

SEQ ID NO: 7448 - DNA, 245 bp, Sorghum bicolor
  unsure (1)..(245): unsure at all n locations
  Clone ID: LIB3476-050-P1-K1-A1
aaagattatatgcaatgatgagctccgattagtttttgagactgatagcacagacatgttccagatgaataagcttctgtctaagcatatacgtcctctggagagtaaaaatgattcaaaacgagaagcaaaaaaattgaagccagagggtggtgaacaaattcctaaagttgaaactgatgttaaccaacttccncttacggtttctgatgctnctngctacctttttgggtacggggagaaag

SEQ ID NO: 7449 - DNA, 649 bp, Sorghum bicolor
  Clone ID: SORBI-28MAY03-CLUS85191_1
accacactccatcctcacaaggcagcagtctgagtgttgagaggggaagaggaagaggaagaggaacagagtgagcaatggggaacaggcacctctgctgcctgtccttgctccttctcctgggactggcatccggccaggtcctgttccaggcgttcaactgggagtcgtggaagcagagcggcggttggtacaacctcctgatggggaaggtcgacgacatcgccgccgccggcgtcacgcacgtctggctcccgccgccgtcgcactccgtctccacccaaggttacatgcctggtcgtctgtacgacctggacgcgtccaagtacgggacggcagcggagctcaagtccctgatcgccgccttccacggcaagggcgtgcaggtggtggcggacatcgtcatcaaccaccggtgcgccgactacaaggacgcccggggcatctactgcatcttcgagggcggcacccccgacggccgcctggactggggcccccacatgatctgccgcgacgacaccatctactccgacggcacggccaacctcgacaccggcgccgacttcgccgcggcgcccgacatcgaccacctcaacgaccgcgtccagcgggagctcaccgactggctgctctggctcaagtccgacct

SEQ ID NO: 7450 - DNA, 631 bp, Sorghum bicolor
  Clone ID: SORBI-28MAY03-CLUS85222_1
tgggaaagctcaaaaaaaggcgtcgcggctccccggggtccacacgcaggcggtggggtggtgcccatggcttcgtggctgttgctccctctcccctccttcccgtggcctcccccgcccccgcccggctcctcctccggccgaggcggcggtggcggcggagacggcggcgattggaggccgaacgtcgtcgcggccttcgccggcgcgcaactcggccgctccctccgtcgccgcttcgccggcctcctccgctcaccggaggtgcgacatctcgatgccttgccgaaaatgggtgacttctggttcgaaggatcagaaccgtttgcaacattcccaattcttggtgcgatagggaatgtgctctctgcaccctatgtttgcagctctgctctgttcagtgggaacgggtcagggggtagatacatcagtaacgggaagttgttgtccagacggcctcgtggaatcgattcgaagaagaggctctggactaatgtccttcttgctcttaatgtcctggcttatgtcgctcaggtagcatcacaaggaaagcttcttttgtgggggagccaagatcaacagtctgattgatagagggcaattttggcgtttggcaacatcatctctactt

SEQ ID NO: 7451 - DNA, 676 bp, Sorghum bicolor
  Clone ID: SORBI-28MAY03-CLUS96202_1
aaacaagaagggaatgaaatcagcgatgggtttcgaggtgcaggtgatagagtcgtcgtttgtaacgcccagcgagccggcaccgaggaaggggctctggctgtcctccttggacctctggctggccaaccaaggccacactccgacgatctatctgtatagcagctccaacgatgctgctgcggctgatcatttcttcgacgtggctaggctcaaggaggctatggccagagccttggtggccttctaccccctcgccggccgtctcggcgtcaacgacgccgacggcaggatggagatcagctgtaatggcgaaggtgcactctttgttgtcgctcgagctgatgatttcactgccaatgacgtaaagaaattcaagccgtcgccagagcttaggaggctgtttgttccactcattgagccattgtccatcattttggccgtacaggtgacattcttgaagtgtggtggggtggtgttagggacagctctccaccatgccgctgttgacgccttaagtgcgtttcacttctttcagacatggtcggccttctccaagcatggccaccgcgctactgtggagctcccatgccatgaccgtgacctactccgtgcacggtcccctcccacagtccatcccgatgcactattgacgttctaccctaagcacaccttc

SEQ ID NO: 7452 - DNA, 703 bp, Sorghum bicolor
  Clone ID: SORBI-28MAY03-CLUS96313_1
aaggatgattgaggcagaaaaggctggattcgagatcctgaaatctaccatggtagagaagctccccaatgatctggaaggaatggagtcctcaatggagaagctttacattcttattgatgagatctacaaattatgtcgatgatgttgtggaaggacgcgtggcacctgataacagaattggaaggttcatctctgattctgttgcttcaatgccaaagttgtccccagctgctttcgataagcttttcaatgacaagattcaggataaccttgcgctggtatacctgtcaagcatcacaaggacacaaatcaccatcgcggagaagttgaacactgctgctcaagtgctgtaattttggtggttgtggcatttggttggacgtcgatgagttgggtgcaatctgtgatgtttggcatacgtgtccaatttggtggcaggaatgcatttttgtacttgttattattattactaaatgatagacctgatgaaacgggttagtcaacaatgagatcccataatcatgttgccagtagagtggtggagggcgagatgtttctgtttggatagtattctgtgcttcaggttcaatatttgtaatgctcgtttgttttgtgtaatgacacagttaatgacattgccgagctaacgccaatgtggaacaatgaagagatttgctccacattaacgccatttggaggt

SEQ ID NO: 7453 - DNA, 622 bp, Sorghum bicolor
  Clone ID: SORBI-28MAY03-CLUS96358_1
agcacgagctcccaacccagaggccgccgtcctcacactccctccctccccgaccccaccacttggtcgcagtcgcagtgagcgaacaagcaagcaacaatggcggcggctcgagcccggccgccgccggttgccgcgctcctcctcctcgtcctcctcctaaccggcgcggcgggatcgtcgacgacgacatcaacgacgagccccatcaagacggtggtggtgctggtgatggagaaccggtcgttcgaccacatgcttggttggatgaagcggctgaaccccgagatcgacggcgtgacgggccgggagtggaacccggccaacacgtcggacccgtcgtcggggcgcgtctacttcggcgacggcgcggcgtacgtggacccggacccgggccactcgttccaggagatccggcagcagatcttcggctccgacgacgcgtccggcccggcccggatggacggcttcgtgcagcaggcggcgtccatcggcggcggcaacacgaccgacgccgtcatgcacggcttcgcccccgacagcgtcgccgtgtaccgcgagctggtgtcgcagttcgccgtctgcgaccggtggttcgcgtccgtgccgtcgtccacgcagc

SEQ ID NO: 7454 - DNA, 584 bp, Sorghum bicolor
  Clone ID: SORBI-28MAY03-CLUS96396_1
gcacgaggcctcgtgccgaattcggcacgagggcgggaaggcgctcacggagaacctctccccgacgttcatctcctcgggcgacccctgcctcgacttcttcttccacgtggtgcccggcacgccggcagcctccgtggagtcgctcctgggcgcggcctgggcggccgacccgaccaccgcgctctgcctcgtcgccaacctccgcggcgtgcgcgggagcggcaagtccgaccgcgaggggttctacgccgccgcgctctggctccacgcgcgccacccgcgcacgctcgcactcaacgccgcccccatcgcccaccgcgccggccccagcggccgccccgggccccgccgccgcggcgcccacggcgggccgccccccggcgctcctcgcctcgggccgcccctcccccccctgcgtcgtccacgcggcgcccgccgcgcccgcgggcccggccgccgcggcttcggcgcccccgcgccccgcccccgcgcgcgccgcccgcgctccccccccctcggcgccgcccccatcgccgacttcggctacctcaaagacctccccgagctgctccaccgcatcg

SEQ ID NO: 7455 - DNA, 644 bp, Sorghum bicolor
  Clone ID: SORBI-28MAY03-CLUS96436_1
ctatcaagtccttgacagcagaaagccaaaatacaggaactaacttggtgattgtgtataagttgtaagatactttatgaagttttgcgattttgactaattcactctggttggtgatcctaggcaacgtctgtgatctccaagctaactgaggagaaaatgtctgctattcagcagaaccagaagttacgacaagagctggaacttctacggaaagagagcagcaaaaccagcggcggcggtttctccatcaccttcttgtttgtcgttggccttctgggcatcatcgtcggctacatcctcaagagaacatagtggaatggtggtgtctccagcaaggctatactcccatgagaggatacccacacgtggtatgcctccccatgtgtttgtgctcctaatcggagcgccctgttctaacgtgtaacaacagcagcactcctagaagccttcggtttgtgtacattgtggtggttcataccttttctgttcagaattcttctcagagttggtagacttgttttaaacctaactgccgcaacgttgttacccttcacataacctttattctttctgattctgatggatctcaaatttgctggtatgtttctacccaactgaaaatgtttgaactgttgcaagtc

SEQ ID NO: 7456 - DNA, 640 bp, Sorghum bicolor
  Clone ID: SORBI-28MAY03-CLUS96444_1
cgttactttcaaaagagagttgagactggactgaaaggagatccaagtgaggagttctctttctcaagcttcttccctgaatttgtaagaccaattctcgacccagtagcatctgtattccataggctactttgtggaagatccgaaagatctgatgccaggggacaaacattagatacctcaccactgcctggttcagattcgattgaggcaaacaggaggagagagaggggtcaacgggcactggagcaaagattagccgagaagctggctgcagtcagaagttcagagggcacatcactggatgctgctgacaaagtttgagtcttctatgcaatgaacaacgagctgtgcagtttgtgaattcctggcgattcgtttctatgtgatttcctgaaggattgatcgaatgcgaatgtgtcatgtatgttcagcagccccagccccactgccgagtgcttcattttttgatggttttttgtagttatatcatcaggaaccaacaaatgaagcgttgcactccatttttcccatggtttctctgtaatcaactagtgaagttatcaagtactaagtagtgtacaacgcgatgctcacatagacaagaactcatctatgtttagttttctgttgtttcatc

SEQ ID NO: 7457 - DNA, 648 bp, Sorghum bicolor
  Clone ID: SORBI-28MAY03-CLUS85598_1
aacgggagctccacgcacagccattccaagcacatattcccggctcggcagctcaccaactaccttgtactgcaattcatcttatcacagttatcacggcacatacatacagatatatagatagatccatctaattagtacctggctagatgctcgtttagctgcaggcgtcatgattggggtgagcattgtcagttattataagtctctgatcatggtgctactggcgctcctcctctgcgtcagcctggctgcggcctcgccggcgacggccgcggccggccgggcagaggaggtgcacctggtgcccgcggtgtacgtgttcggcgactcgaccgtggacgtgggcaacaaccagtacctgccggggaactccgcgctgcagctcccctacggcatcgacttcccgcactctcggcccactggacgcttcagcaacggctacaacgtcgccgacttcgtcgcgaagctgttgggtttcaagaggagcccgccggcttacctgtccctgacgccaagaacgagccgtcagatcttgagaggcctccgcggcgtcaactatgcgtccggagggtccggcatcctcgataccacggggaacaccatcacgttgacgaagcaaatcgagtacttcgcggccaccaagtc

SEQ ID NO: 7458 - DNA, 623 bp, Sorghum bicolor
  Clone ID: SORBI-28MAY03-CLUS8589_1
cccacgcgtccgcttgtcacagagactgtgttgacggcgccatggctttcggtgcgtattgcctgttggacggcgtgtgcaatttgtaagatacagtcaagattcattagcctccttgcagaaggtttgtggaccctaccctgatcctgccattgaacttggaggctccccccccccccccccccaaataattaatcatacctaggttaaccaaaatgtaaatagccagcgaagattcgggttgtactttgtcagcattattcctttttcaagtgtaaaaaggtctgaagatgcttgatatgataaacagggctttgtaggggttgctgcctgggcaagtgggggttgtgcatatgggcccaggtagaatatggttgcacatgtctgctcacagatgatgttgaaatagatagatgcatttgtccagctaatatagcgctagatgggggtagtattggcctgcatgaatgaaggaatgttgtcgagtgacttgcattgtaaccctttgatagattctgtttgtatatatgaatcgtgtctgtacagatgtaacccgtggaaatggtgtgttttatgtcggtgcattttaatagagatgagatgaggtgatggaacagtagaag

SEQ ID NO: 7459 - DNA, 630 bp, Sorghum bicolor
  Clone ID: SORBI-28MAY03-CLUS85924_1
gcaccacgggcgtcaccacccaaatcccaccacctggatccgccgatccgccgccgccatgtcccaccgctcggagcgacgcctcgcctccgccgtggtgcgcctccccggccgctccagggtctccgcctcgccatccccgcgccgccgctcccagtccccatccccgcgccgtgaccgccgccgccgcgaccgctccccgatcccttaccgcgatcgctccccaagcccttatcgaaaccgccgccgcgaccgctccccgagcccttaccaggaccgccgcggacgctctccgagcccttaccgcgaccgccgcggccgctccccgagcccttaccgcgaccgccgccgccagtggtcgccctaccacaacgaccgcggccgggaccgtgaccgggtcccgcccgtccgtagcggcgggggtgcctggtctgacgacgatgacgacgacaaggaactccagggcctcagctacttcgactaccgccgcctgaagcgccagaagctccgcaagagcaagaagcggtgcatctggaacatcacgcccagcccgccccgtgttgagggcgacgaggagaactacggctacagcgacgtggaagaggagaaggcatctccgaagggctcgcc

SEQ ID NO: 7460 - DNA, 608 bp, Sorghum bicolor
  Clone ID: SORBI-28MAY03-CLUS84541_1
tggaagaagttactcaagatccccatcccctcgtcgtgaaaggagccctgttaggagttacagcaggagccgcagtaggggctatagccgttcacgatctccaaggcagaacagccgtgatgaaaggagccctcgtgacagccgcagcccaaggaggagccctcgcgatagccgcagcccaaggaggagcccctcactgtccaagggaagagaccgcagccccagccctaatggtagcaggagccctgcaccaagggaacgcaatggctcagattacagcatgagccctaggagggatgacagccgtagtccagcagaccacctgcgccgtgagatcagtccagcagccaatggtcgtagccctagcccaggggtcaatgataatggcaatcaccgctcatctccctgaatatgtttctgggatcggttttaccccccaaatgtttattaaccatcccaaacatctttatggttaggactggttttttgtgtttattatgcaattgtggataaaccataccatctgttacttgtaactttaaagtgcacaaacggatcatttttgcttgctcttattattctatgaaaaagggaattctttatgcggc

SEQ ID NO: 7461 - DNA, 634 bp, Sorghum bicolor
  Clone ID: SORBI-28MAY03-CLUS84641_1
cagggtgggcatgttaaaatcatggatgaactattggagcgtggtgccaatattgatgctcgaaccaaaggggcctgtggctggactcctctacacattgctgccaaggaaaggaacaagaaggctgtgagattcctgattgagaatggagcattccttcctcctgagatgaatgaccataggttcaatccccccctccattactgctttgggttagaatgggcatatgagatgaagcgcgtgcaagacgaaagcgattcgcctggcgagacttcattgagttcggataactagagtgaaagcagcaggtgccccgagatatgatgcggtttgagaaagatggagaagttatgtcaggtcgtatggttatattcttgagttgtgtgtgcataaccattgagtacatttggttgatgcctggatgatggttgtgatctatggagctgaataattgtcgaatggtacctgtattattgtactacgagtgagtgttggatgatacacgtgtttcattaagagggtggttccttgtgctcttcttttttttttttttttgcacttcacctgtaatctgctacttcgaatgattgttggatggtaccattggtcttcatcagattttaacgcctgagtg

SEQ ID NO: 7462 - DNA, 649 bp, Sorghum bicolor
  Clone ID: SORBI-28MAY03-CLUS84555_1
aagacgcacacaacacaggtctacaacatctgtagttcatcacattcccttgcacggttgcactgcaccttctatcataggcacattcactgcaggtcaacaaggccgcagcagatcgatctccatggacatggacatgagctcagcttatccccaccactggctctccttctccctctccaacaactaccaccatggccttcttgaggccttctccaactcctcctccgctgctccactcggagacgagcagggtacagtggaggagtccccgaagatggtggaggacttcctcggcggcgtcggtggcgcgggcgccccaccggcggcggcgacggctgcagaggatcaccagcttgtctgcggcgagctgggcagcatcacggccgggttcttgcgccactacccggcgcctgggacgacggtggagaaccccggcgcggtgaccgtggcggcgatgtcgacggacgtggcggagtccgaccaggcgaggcgccccgccgagacgttcgggcagcgcacatcaatctaccgtggtgtcaccaggcaccggtggacagggagatacgaggcgcacctgtgggacaacagctgccgccgggaaggccaaagccgcaaaggtcgccaagtctacttaggaggctatgat

SEQ ID NO: 7463 - DNA, 894 bp, Sorghum bicolor
  Clone ID: SORBI-28MAY03-CLUS84674_1
gcacgagggatgcacgagggcgcacacgacctcaacctggctttccctcaccacaacggccgcgctctgcagccaccggagttcccggcgttcccgagcctggagagcagcagcgtgtgcaaccccggagcggcgggcatggtgggcaacggcgccgctggcaggggcatgggcgcgctctcggcgatggagctgctgaggagcaccggctgctacgtccccctgcaacacgttcagctcgggatgcccgccgagtacgcggccgcggggttcgcgctgggcgagttccgcatgcccccgccgccgcagtctcatagcgtgctcgggttctcgctggacacgcacggcacgggcggagttggcggcgccgggggttacagcgccgggttgcaggacagcgcggctggcaggttgctcttccccttcgaggacttgaagccggcggtgagcgccgcagctggtggtggcggtgcaagcaacggagccgatcatcatcagtacgagcacagcaaagatcaagctgcaggcgacggcggcagcgggcccagtggcgtcaccggtggccacgagactccagggttctggagcaatagcctgatcgggaatggcagcagcaatggcggcggaggcccttggtaaggcggcgcgccattgcatggctcatgcacgccccgttgtcagcatgtggagataggggatagagacaaggatccgagttaataagagggtcgaggaggtgattggggctcacatatggcgtttgatctctctctggttgtttggcttttttttttcttttttttttcggttcttggtgttcgtgtgtgtcaatcgacttgggggctaacccagcaggatatacagattgttaaggtggtgaaccgatgttttccc

SEQ ID NO: 7464 - DNA, 780 bp, Sorghum bicolor
  unsure (1)..(780): unsure at all n locations
  Clone ID: SORBI-28MAY03-CLUS8468_1
acgccaagacggcaaccccgaggtctgagaacgcccaggaagactccaacagagcagaggagccatggcggtatccttggccgctccaccgctcttgactctccccttcctcttccttctcttcgccaccgtcgcctgccgcggggcgtatggggcaagcggcggctacgggctcggcgtcaactacggccgggtcggtcaagatctacgacgccaacccgggcgtgctccgcgcgctggcggggacgcgctggcctgtctccatcatggtgcccaacgagatcatcccggacctcgccccacgcgtccgcccacgcgtccggtgggtcgccaagaacctggtcccctactacccggcgacgcgggtcaagttccttctcgtggggaacgagatcctctccgaccactccatcgccaactccacctggccgcgcctggtcccggcgatggagaacatccaccggagcctccgcaagaggggcatcagcagcgttaagattggcaccacgctcgccatggacgcgctcgccgacggcgccttcccgcgcccaccgtcggccgccacgttccgcgccgacatcgccgaggcagtcgtgcgcccgctgctgcacttcctgaacgggacaaactcgtactacttcgtcgacgcgtacccctacttcgtctgggccgacaacaacctcaccgtctcgctcgactacgcgctcttccagggcggacgcctncgctacgtcgacccgggcaccagactcacatacaccaacctgctcgacgaaatgc

SEQ ID NO: 7465 - DNA, 595 bp, Sorghum bicolor
  Clone ID: SORBI-28MAY03-CLUS84812_1
acaaccagtccggatccggccgcccggacccccacatggacgccgcctaccgccgcgcgctcgaggcgctctgcccgaagggcggcaacgaggaggtcacgggaggcctggacgccaccccgcgcgtcttcgacaaccagtacttcaaggacctcgtcgcgctccgcggcttcctcaactccgaccagacgctcttctctgacaacgccaggactcgccgcgtcgtcaagcagttcagcaagaaccaggacgccttcttcagagcattcatcgaggggatgatcaagatgggggagctgcagaacccccggaaaggggagatacggcgcaactgccgcgttgctaactgctcgccggtggcgccccgagtcgtcgacatctgagctccggtgagcgaggttggtgtttcagaagagatcgagccctgatattatatggtactaatatgttgacatgcgttgtttttttggtcgtgtgtaacagtgtaagttttgcgcctacctatggtcgtggtgcctgagctgcggtcattgctgatgtgggaaataattgagacattgtgcctataaaatgatgacggtagcttgcccaaaaa

SEQ ID NO: 7466 - DNA, 658 bp, Sorghum bicolor
  unsure (1)..(658): unsure at all n locations
  Clone ID: SORBI-28MAY03-CLUS84930_1
atgcgcacgcacacgcacaaacctgcctgagctcgagctccctcgctctctccctccctctccctccccgcgcgcacgcaatggccagcagcgtagccccaagccccacgcaaaccagcagcaatgtctcacggccgacgatccccacaggcctcgtgcccgtggccgtgcttctcgccgccgccgccgtcctcctcgcgctgctgccgtcgctggcccaggcnggtgtgggaggtgccgcacctcttcctcctaggcgccgtcatctccttcggcgtcttcacgcagaggaacaacgacgccgatggcaacggcaatgccgccggcgccaagcgcagctcgctggcgtggaacgcgcggtaccaccccgacgaccccctcgtcgtgatcgctgatcatcacgcggtgccgagcgacgaggacgacgacggcggtctggaaggcgcacgacgggagaggccgctttccttgccggtgcggaggctgaagcctgcgtctgcgtctgcggctgcggctgcggcgcccgaaaccggcggcgacgccagctgtggtggtttcggcgaagagacggatagctgcgcgtcgtcgtcagggttttgggccggcgcgcgcgccgtcccttcgccgccctctgttctcgacgccgacctggacttct

SEQ ID NO: 7467 - DNA, 865 bp, Sorghum bicolor
  Clone ID: SORBI-28MAY03-CLUS863_1
gtcgaccagcgtccgtcaggtatagtgatttcatcaacaaagagctgatactcttctcaatggcggacctgcagcgatccataccttcaatggttgatggccttaaaccaggtcagaggaagattctgttttgttcattcaagaggaattttgttaaggaagccaaggtggctcagttctctggttatgtgtcagaacactcagcataccaccatggcgagcagagtttagcaagtacaattattggaatggctcagaattttgttggcagcaataacatcaaccttatgttccctggtcgtcagtctggcaccggagctcagggaggcaaggatgctgcgagtcctaggtacatcttcaccaagctgtcccatatcacacgttcaattttcccgaaggatgatgatattctacttaattatctgaatgaggatggacagtcaattgaacccacctggtatatgccaattcttcccatggtcttggtcaatggaagtgaaggaattggaactggatggagcacgtttattccaaactacaatccaagagacattgttgctaacctcaggcggttactgaatgaagagtctactgtaccaatgcatccatggtacaggggattcaaggggtctatagagaaggcagtcaatacaaaggtagctggttccacgtataccgtcactggaatcattgaggttgttgacaacagtagactcaggatcactgaactgccaatccgccgttggacgggggattacaaagaatttcttgaatctttaggtccagataagaacaaggacaaagtaccattcatagaggacgtcacagcgcaaggtgataatgaagacatttacattgagatcca

SEQ ID NO: 7468 - DNA, 637 bp, Sorghum bicolor
  Clone ID: SORBI-28MAY03-CLUS86353_1
cgcgccaccggttgaagctgagagcaagaaagatgagccatctgagaactcgccggaggagaagaagaatggccagcagaacgggaagaaggaagagataaatgaggagaacaaggcaggaggaggagaagaagaggaggaccatgtggatgagagcccagaaacggcgaagccgggcgacgccgccggcgaggggcatggtgcccatgccggcgaagctccaaaccataacaatggcggcgatgggctcgtggtggagaaccataccaaggacggccgcctgttcaccgttccgatgccggccggagttgtgacggtggcgcctgagatggccctcagcaaccgcagctactactacccgccgccggcgtatccgtacgcacaatactattacccctacaaccagtactaccagtatccacagccgtacccggcgtatgctgcttgcagccctgctgccatgtatgggcatggctatccaccggaagctttctgtgaggagaacccaaatgcatgcaccatcgtgtgacgtgtagtatgtaataatataaaagaagtgagtacttctgtatataataatcgatcaatggatcaatgtaatatatatatggaactgtataaatttcatggtttctcc

SEQ ID NO: 7469 - DNA, 1067 bp, Sorghum bicolor
  Clone ID: SORBI-28MAY03-CLUS86470_1
ttaaagcctgcaactatgaggcccattccccactctggaaaacaacaaatgcatccttttatgggtttacctgaaacttcccttcatgaaactagtattgtgaagccaagcttgccagttgcgccaactgttaagcacaattcagttttttttgccccaaccacgcacagaaaatcaacatcagggccatcacatactccttcagtcattcaattgaatcctctgccaatgaagaaacatggatgtgataggttgcctatccaagtatgctctgaggaggacttcttgaaggatgtcatgcagtttttaatccagaggggccacaatcgacttgtacctcatggaggactagctgaatttcctgatgcaatccttaacgccaagcgccttgatctttataacttgtacaaggaggtggtgtctagaggtggattttatgtgggtaatggcataaactggaagggtcaagtcttctcaaagatgcgtaaccatactgcaacaaacagaatgactggtggtgggtactcgtcggttcgccgctacgtgacttccgtgccggcctttgagcttgcgcctgatgatctggatggcctatgctgctgccttggtctcagtcgcgcacctggagattgggtgaactgtggtttatgtggtgaatgggctcactttggttgcgacagacgacaaggactaggcactttcaaggatcacgctaagacagatggtttggaatacatctgcccccattgtagcttagcaaactacaagaagaagccaccaccaccaaaagcagctaacggtttttcaaatacagcatctgtaccacgaaatgtttaattttcttgtttttttccttttcctttggtcccatgtttgtgggaggaagagtcattagagtagagaataggctgatggaaagatgggcaagcccttcagggtatgtagtgttcgaatgtatcatctcgttaatttagtggttatgaggttatatagcatgtaccaactgataacagagacaagttcctccagtagttggttagatgcggggtgtatgcgtcatgtttata

SEQ ID NO: 7470 - DNA, 512 bp, Sorghum bicolor
  Clone ID: SORBI-28MAY03-CLUS8658_1
ccacgaccatcacactgacaccacagtccactgccaactcctccgatgaagatgagctcatcatccgtgcccgcggcggcggcggtggcggcggtgctgctgctctcggcggtgtggacgacgacgactgtgacggggcaggcgctggtgccgggcgtgatgatcttcggcgactcggtggtggacgccggcaacaacaaccggctggccacgctggtgcgcgccgacttcccgccctacggccgcgacttcccggcgacgcacgcgcccacgggacgcttctgcaacggcaagctcgccacggactacaccgtggagagcctggggctgagctcgtacccgccggcgtacctgagcgaggaggcgcagagcaacaacaagagcctcctccacggcgccaacttcgcgtccggcgccgccggctacctcgacgccaccgccggcctctacggcgccatctcgctgaggcgtcaggcggagtacttccgggagtaccagtcgcgggtggcggc

SEQ ID NO: 7471 - DNA, 1183 bp, Sorghum bicolor
  Clone ID: SORBI-28MAY03-CLUS8525_1
cggacgcgtgggcggacgcgtgggtaacatccccgagttcggtcagattagcgatttcggtaaatgggaggataaatccattggaagagactgatgtaaccgttgacttccttgcccctgcaaggcctggtaggtacatatcttactggagattggcactaccccggccgcagagatttggtcagcgaatttgggttcatattaaggtggagcagcctattcaatctactggtggcaaacaggctgctgcgatgaacctgaatcagctcccagaagccaacagcagaaaactgaagcctttcacagttgatcttgaaacaaatagtgtttcctcagaacctttctatggatgccatggaatcccagaagccaacagcacaaaactgaagcctttgacacttgatcttgagacaaacagtgtgtcctcagaacctctctctagatgccctggaagctttctcagaaccatgaaactcaaggaatctaagcctgctccttgtgatgtgtcctctgtcccaacaacagtcgaactggtgcaaattcctgccactgatgtttctgctgagtctttattggcttcaatacctggtggtgtgcctgcatttgaagcctctcccctgcccaaccctgtgcctatgcttcctgttagctcttcggcgcctgttgttggtcatgttagcatgcctgcgccggcagctactattgctcctgttccagcagcacccttgcctgaacagatcatcaaccacctggaggagaagctgatgactgagctggagggtctgggcttcatgcaggctgacctgaacaagcagatactccggcagaacaactacaacctggagcagtctgttgcccatctctgtgactatgatgagtgggatgctcttgagttctctgagctgggctttgatgacgcagagatgaacaaggaagtggttgacaacagcgatgaagaagggttcatcgtggcggatcttgtgaccaaggcggcgaatgatcattaatggatgacgtcactcttagctgtctcctgtctgctattcctagtataatatagatgtaaataagtagttttatgcttgaataagttgatggaagcgaggcatgttgcctgaaccttggggggcatgcgatgtggtttaatgatcacagatgcactatggagtatggatatcccttt

SEQ ID NO: 7472 - DNA, 784 bp, Sorghum bicolor
  Clone ID: SORBI-28MAY03-CLUS85316_1
aaatgaaacaaccatccagacgctggaatggaccatggcagagctcatcgccaacccacgggtcacggccaaactcaagaacgagatcacgcgagtcgtcaccgctgatcagccgaccatctcggagtcggatctgaacagaatggaatacctgaaagcagttttcaaagaggtgctccggctccacgcgccgttgccgctcctcgtgccgcacgaatcgacggcacccgcggtcgtgcagggctacgagatccccgccaagaccgggctctacatcaacgtgtgggcgatcgggagggacccggcggcgtgggacgcgccggaggagttccgaccggagcggttcgtgggcagcagctccccggtggactttagagggaacgactaccagttcatcccgttcggtgccggtaggaggatctgccccggtatcaacttcgcgcttccggtcttagagctcgcagtcgccagcctcatgcgccattttgactgggagctccccgctggcatgcaattgacggacctcgacatgagcgagacgccggggctgatgacgccgcggcgggttccccttgtcgtggtccccaggacggtgcctcagccagcactgccgtaggatcacggtcgacctcggccagtgggccttgtttggaaaagccagttctgtagctacctaaaatccttgtaaacagttgctcaaaaaaaaatccttgtaaatacgcacccccccccccttttttttacaaggctaagtactctctctatcccattaaaaatattattt

SEQ ID NO: 7473 - DNA, 888 bp, Sorghum bicolor
  unsure (1)..(888): unsure at all n locations
  Clone ID: SORBI-28MAY03-CLUS8532_1
ctgtgcggcgctcaggcggcgggtgcgactcacctctcgtcctcctccgagtctccgaccacccgcagcagcaacaggccagcacccaacgagcaaagcttgctttcctagcctagtcacagaaacaacagccacacccacggctactacacgcgcgccagccatggcctccgccttcttcttcgacgccgagccggtgtgcgaggtctccagcctgctgctgcccgcgctggacgcctgcgcgctctgcgccaagccgctgggacgcgacgacgacatcttcatgtacagaggcgacacgcccttctgcagcgaggagtgccgcgacgagcagatgcagctcgacgccatccgcgccaggcaggccgccggacggaggcagcagcagcagcagtactcctccagaacggagtccaggcaccaggagtccaggaaggtgtctgttgcgacctgaacggccggggcctaagtgacggcacggtcctgaagaccagaagacatgcatcccctactccccttgtgtgtcaacaagagatttctgcacctggagaaacgtcgatgggtgccggcgggacataggacttcgatttctaggtcgctgttgtcctgcctgagcactgcgccgatgcaatcggcgcgacggcgctcgagggcggactgaccacttcgcctggggaagaaagttcagtcaccgatctgtgatctgcttgcttgtggctgtggcgagtcgcccaactatgcacacgcaccccgttggacgctctgatctttggctcgtacagggtgcgaagagtgtgttttagcgttgattgtacaccggtttgntctttgtaaagcaggcatgcatttggggatttttgtttccctgtgagattcacacgatctctg

SEQ ID NO: 7474 - DNA, 638 bp, Sorghum bicolor
  Clone ID: SORBI-28MAY03-CLUS85503_1
aaaagacgaagcagagaaggtgatcaggagcctggaagcagccatctccagaagagtatccgagggcttcacgctggaggtgcgcggcagggacagggtgggcttgctgtcggacgtgacgagggtgctccgggagcacgggctcacggtgagccgcgccgacgtgacgacggagggagggcaggccaccaacgtcttctacgtccgggacccctcgggccagccggtggacatgaagaccgtcgaggggctccggggtcagtttggccagaccgccatgctcaacgtcaagaaggtgagtgtgcctgctgcggcggtggccagagcgcccgagccgagatccagcggcggcattgtcaggaacagcttcttctccttcggcagccttttcgcgaaactccgggcctgacatgctgggtggtcaggcgattcaactcccattgtgtgtagctggtgtagaagtaatgacctggagaactagggtagtgggctagtggggtgggacttggaagggggagatagagagagacagccagtgtatctctatgtggcagctgtggtggttgtacagttcataaggagcctcaaccagaatggtggttttctgtggatgcagactgctgttaagggttcatccc

SEQ ID NO: 7475 - DNA, 678 bp, Sorghum bicolor
  Clone ID: SORBI-28MAY03-CLUS85474_1
cgggctcggccacgacagcccgatgtgggcggcgctcaaccacggcgggcggacggtgttcctggaggaggacgcgtcgtggatcgccagcgtccgcgccacgcacccgtccctcgagtcctaccacgtggcctacgacacggtgctcaccgacgccgacgcgctcctccagctccgcgaccacccggcctgcgtcgcgcagccggacctcgcgtccgccgccgacgcctcctgccgcctcgcgctgagggggctgccgccggtgttccacgagctggagtgggacctcatcatggtggacgcgcccacggggtggacgccggaggcgcccggacggatgggcgccatctacaccgccggcatggcggcgcgcgcgcgcaggcccggggatggacccaccgacgtgttcgtgcacgacgtcgaccgccccgtcgaggacgccttctccaaggccttcctgtgtgaggggtacctcgccgagcaggtcggccggatcaggcacttcgtcatcccgtcacaccgcgagaaggacggcacgccattctgcccttgatagagaactttgtttcttgcattcagagccatccatctatccatctatccatcctttttgctttgctttggtcagttgctgtgctttgccttgcctttacatacacatatatatatatacaagag

SEQ ID NO: 7476 - DNA, 910 bp, Sorghum bicolor
  Clone ID: SORBI-28MAY03-CLUS8553_1
tttgtcacaccatgtctctttgggctatcatgccactcctgattttgttttatgcagcttacctctattaccaggcaacatctcgcgaggtgaagcgtctggattccattaccaggtctcctgtgtatgctcagttttcagaggctttgaatggtctgtccacaatccgtgcctataaagcctatgatagaatggcaaacatcaacgggagatcaatggacaacaacattaggttcacacttgtgaacatgagtgcaaataggtggctagctattcgtctggaaacattgggtggcatcatgatatggtttacagcaacttttgctgttatgcaaaatcaacgagcagagaaccagaaagcctttgcttctacaatgggtcttcttcttacttacactctcaatattaccaatttactcacagctgttcttcgtcttgctagtcttgccgaaaatagtttaaatgctgttgaacgggttggaacatacattgagttaccttcagaagctcctcctgtcattgaggatcataggccacccccgggttggccatcatcaggtgtcatcaagtttgaagacgttgtgcttcgatatcgaccagaacttccccctgttcttcatggcatttcttttcttattaatggaagtgagaaggtaggaatagttggcagaacaggtgctggtaaatctagcatgcttaatgctttgttccgtattgtggagcttgaacgagggagaatattaattgatgattgtgacacttctaagtttggaatttgggacctgcgcaaggttctaggaataataccacaggcaccagttctattttcaggttctgttcggtttaatctggatccctttaacgagcacaatgatgcggatctctgggaggctctggaaagggctcatct

SEQ ID NO: 7477 - DNA, 916 bp, Sorghum bicolor
  Clone ID: SORBI-28MAY03-CLUS85873_1
acgcgcacgctgcggtaccggctcgcggagctcccccctccctcccggcgctccgcccgctccttgtccgctccggcgatgggaactcgccgcggcagcggcgtgctccaccgcctcctcgccctctcgtcgctgctgctcctcgcttccggtgagatcgtcttcgaggggcgcttcgaagatggttgggagagtcggtgggtagaatccgattggaaaaggagtgaagggaaagctggaaggttcaaacacacagcggggagatactctgcagatcctgatgacaaaggaatacaaacaacaatggatgctagacattttgctatctcagccaagttcccacaattcagtaacaagaaccggacacttgtggtccagtactccattaagtttgagcaggatattgaatgtggtggtggctatattaagcttatgtctggttatgtcaaccaaaaaaaatttagtggggacactccatacagcttgatgtttgggccagatatatgtggtactcaaacaaagaagctccatcttatagtctcttaccaggggcagaactatcccatcaagaaagatctagaatgtgagacggacaagttaacacatttctacactttcattcttaggcctgatgcgtcttatagcctacttgttgacaaccgcgaaagagaaactgggagcatgtacaccgattgggatatcctccctcctcgtaaaattaaggatcttcacgccaaaaggcctaaggactgggatgacagagaatatattgaagatcctgatgaagtaaagccagagggctatgattctatcccaaaacagattcctgatccgaaggccaaaaagcctgacacgtgggatgaggacgaggatggaatatggaagcccaggatgggtatcgaatccagcatacaag

SEQ ID NO: 7478 - DNA, 717 bp, Sorghum bicolor
  Clone ID: SORBI-28MAY03-CLUS8687_1
acctatattcattaatgcagtttgatgagtcaggatacattggttttgttgagctgctgcccttaggcttcctggcgaaggtgattcgcgtctgctgttgtgggcccttgccgtgctatggtcttctccgctgccgtgcatagttttctcttttgcgcctgcggcttcgctgggctgctgttaccctttcttcgcgggttcttgcgccggtcccgttcatctaacgcctcttgctgcgtacagtgggaaacttctacaaagcttggctgtagcaactagccatgggtccttcttgtcgttggatcagattatctacaatggaatcggctttacaattgctgcagcttccactgctgcgatcactatttatgcaaagaaagcacttcaaaagctccaagcggaggacgagatattttgagcgcatgaggtccaagccaaggatcaaacccataacgctagtttcctttcaggtgtattatatatgaacagttgctactaatttggtttcctgtgtcaactacctgactactacaaccatctgaggaggggggagggtgctgcagcaattgtaaagaaaatagacccagaaaacacttacgttttccgttcttcttgttttgttttctgtagagagaactgtcaacttcatcagtgtattgcattgcgcgatgtaaattcccaagtcgaaagttgtttccttgtcttgagaagtataac

SEQ ID NO: 7479 - DNA, 579 bp, Sorghum bicolor
  Clone ID: SORBI-28MAY03-CLUS87076_1
gcattgtttaaccatgctctgagcctgaggcccccgcagtgtatcacaaagtgctaccaaaacgatccagctttgcatcattggaatttgaagcataccagaggatatctttgatgaatttgggaaaacccttgccatcatcatcggcttggtggcggcggtcgccattgttatcgtcttcctctccttcctccgtagggctggcggtgtcggcgggaaaagctaagagcatgcaatgcaggatggtcccctcttggttcagattggatcggtcggtggctttggcttgaaaaccgctttactccatctgcctcctttttaatcttttagggtctcttttgtcatgtctttatctctcgaaacaaagggaagccattatgaaatggtgcaagctgaaaggcgttccctgtgcagacatgcatgtgaagtatgaagattccatccggtaccccctactcagctagtgctaggtagccccgatgcaagacatattttccgcaaaaataacaaattatgtcgtcgatctctgcccgttatatatatacttatatccagtgtacttattatggagcatgattc

SEQ ID NO: 7480 - DNA, 964 bp, Sorghum bicolor
  Clone ID: SORBI-28MAY03-CLUS8708_1
cttttgtttggacggaatatcaccaggctctatgatctaaagggatcttcaaggtcaagatataacgcagattcaaatggtagcaacaaggttcttcttgaccagaacttaattgaagcaatgccaacttcaccgatttttgttgggaacaaggcaaaacggctactggaaagagctgtttggaatgatacttctttcctagctggaattgatgtgatggattattccttgcttgtgggagttgatgaggagaaacatgaactggtcttaggaattattgattttatgagacagtatacatgggacaagcaccttgaaacatgggtaaaatcttctggcattctaggtgggccgaagaactcatctccaactgtcatttcacctatgcaatataagaagcggttccggaaagccatgtctgcttattttattgtcattcctgaacaatggatgcctgcgataatcaatccaagcaaatcatcatcaaacatttgccaagaagattctcaaaatgggtctcaagagtgataggatgtttgaccgataagtccagtttttgtcatgtcctgtcgtgaaaagtgctgaactggtagtctggcactctgccttggctactcctggtgcatccaagtgaccttccggctgaccgcattctctcgtgctaattggcacaggtccgattgcatcatcgagtccctctcaagcatcggatatgtatattctcaaaactgtagttatgtcctagtcttaggtttttttccacttttccgtctataataaatcagttcatagtgtcgtcacttctctgttgtcgtcgcttaaattttgttggatgtatagaacgagcagggcggagaattcttttatttttgtaaacggtccttgtatattgagtcttccatctgtcatttttttggggggctattgccgtctgtcatatcaaaataaaagccctgtattatgc

SEQ ID NO: 7481 - DNA, 765 bp, Sorghum bicolor
  Clone ID: SORBI-28MAY03-CLUS85985_1
accaaagcatattattagatgggtctcatatgcatgcacatctgggtttatgtttggatggcatgtacatgagaaggcatcacttcatttcactatcccgcttgccctaattgccatggatagcttgaacgattccaggcattactttttgttgtccatagtttcatgctactctctattcccgctgttgtttgagaaccaagagtacctgataaaggtgatgctgctgctgacctacgccgccctcatgtgggtaggttttacatcccattttgctgcaaattctgacctagaaggaaagaaagtaaatcggtcaggcagcacagtgaagaagaatggcatcattggatggattgggttaagctatcttctgggaattgcaggtatagaattatggtctcgagtgtttcaccatcatgtatttggcgagaggctccccttcctacctctcataatggtgtcattctattgtggccttggaatgatgtactcctgggtgtggcagcttgtacatatagtcagacacacatgatttgattaccggtcatcaatgcttcaatagaagcattctcttgcctttcttatgttgagattgagactaattgcgatgacataccgcctgtaccgatgcggctaacacagccatgactcatgactgggacggcattttgttttagctgtcgacgtcattgtttgtgtgcaagaaattttagagatgtctgacgatgttatgatgtaatatcagtttaagtaacagaagctgct

SEQ ID NO: 7482 - DNA, 605 bp, Sorghum bicolor
  Clone ID: SORBI-28MAY03-CLUS8608_1
aaaaaaaaagaagcctcctccttcccttcttctatctccaatcttcttgcggcggaagcaaagcgagggcggcgagatggacggcggcggagaggacgggaagcagcagccgcacctggtactggcgcacaagctgttccttctgtcgcgctccgacgtcgacgacctcgccaaggtcgacctacgcgctgacgtgctcgcggcagtcaaatccgatgacatggcggctctgtacgagtcgctggcggcggacggcgtactggagatggacgcggcgctgctggccgagatgcgcgccaggatcgacgaggagatccggaagctcgacgagaagattgccgatgctgaggagaatttgggtgagagtgaagtgcgtgaggcccatcttgccaaatccttatacttcataagggttggggagaaggagaaagcactggagcagcttagagttactgaaggaaaaactgtagctgttgggcaaaagatggaccttgttttctacacactacaaattggacttttctatatggactttgatctcatctcaaagtccattgacaaagcgaaaaacttatttgaggaaagtggtgactggagaggaagaa

SEQ ID NO: 7483 - DNA, 724 bp, Sorghum bicolor
  Clone ID: SORBI-28MAY03-CLUS86188_1
ggtcgttattagtattaactgatttaaggaattatggtagtgtatttatggaattttaaaagccatcctttttagcaaacaacagctcaatcagtttcatgttttagtggcaaagtaagatgttcaaaacttcaaaatcattattttttgttccttctcggtaattattctttcggtccaatttgtgagatagtgtcttctatgtttcagaatgcacgagggcgcactcgtctcaatcggaaacagggcgagctcctggttgttggtgttgctgaggaaggggccaaaaagcacccaaggggtgataagatccagctgaaggtttgcagtcagcaaccaagatctcacaaagggggttgctggttcttctcagagattttctcaaggcgctgcaatatcatctcatggacgctaggtggtgatagcttgttggaagaaagggtggaagggtgctgggagtaaacttgaatgcttttgaactaggtgctttcttatggtgaattagatgctgtctttgaatgcttctggactacaatctgtgttttagtttgtggacttgaatcacttttggttgatgatgacttagctagattatgtattcagctaatctatgcatgcttgtatatggccttgatggcacatgattatatatgtactcatttgatatggatgtatgagtaatgtgcccatttgtgtgaaaaaaaaaaaaaaaaaaaaaaaactg

SEQ ID NO: 7484 - DNA, 705 bp, Sorghum bicolor
  Clone ID: SORBI-28MAY03-CLUS86199_1
gctctcctataatttccaaactccagtctcgatctaatctaaagagcatctcaaaaggaagatagcatcgtcatgagaccggaaggcgcagcgcggctggcgtggctgctcctgctcgccgccgcggccgcggggcatggcggcgtgcagccgctgtcgcgcatcgccatccaccgcgcacgcgtcgcgctggacgcgtccgccgcggtgcgggcctcgccggagctgctgggaaccaagggcgaagatactgcctgggtgaacgttgattttattactccccatccaagtgatgatgattggatcggcgtattttctccttcaaacttcaacgcgtccacatgccctggttctcacggatctggcccaggtcctgtgatatgctcagcaccaataaagtatcagtttgcaaattactcatcagattttggaaagtctgggaaaggggcactgaagttccagctgatcaaccagcgtcaagacttttcatttgcactgttcaccggtggactctcgaatccgaaacttattgcagtgtcgaatgccattgcttttgcaaacccaaagtctccagtttatccacgcctagcacaaggaaaatcctggaatgagatgactgtatcatggacaagtggctatgatataaatgaggcatatccctttgtcgaatggggaataaaatggagccccgcggtacgcactgca

SEQ ID NO: 7485 - DNA, 609 bp, Sorghum bicolor
  Clone ID: SORBI-28MAY03-CLUS86206_1
aaagcaaacaccacaggcctcgcctccgggacacttcttgctcaggcagctagtcaggcaccgcccacaaccaacatggctccggctgtgacaatcaccgacgtcgcctacgtcgctgcgccggatggcgcgctgccgccggagcctgtcatcaagctcaacgccatggaggcgcagtgggtcgtgattcccctgctacagcacctcctgctcttcgacggcgaccatctgccgccattcgacgccatcctccagtccctccgctcctccctcgcggcgaccctggccacccacgccccgctcgccggcaagctccactacctcgcggacaccggcgacgtcgccatctgccgctccaccggcggcgccgacgacgacgacgacgaccgcggggtcaggttcgtcgccgcggagtgcgacgccgacgcccgccgcctcgcgggcgacgaggaccacgacgtgcacacgttcgagcgcctcgttccggagctcgacatgagcctgctgccggcgccggtgctcgccgtccaggcaacgcgtctcgcgggaggcggggtggccctcggggtcagcgtgcaccacggcgtcgccgacgggcaatcgctgtgg

SEQ ID NO: 7486 - DNA, 663 bp, Sorghum bicolor
  Clone ID: SORBI-28MAY03-CLUS86219_1
ctcacgcacaaagcagagcaggcaacggcacagcaccgcgcggcacaggtagagagagaaagaggagcgcagagccaaagaagcagagcaacagcagcaggtcgaggaagaagagaagggaagaggaagaggagagaaggccaggaggcagcagcaaccaagaagggggaagagagcaagatgctgcgcgggggcacgagcgtgctggggatcatcaacttcatcaccttcctgatctcgatcccgatcctaggcggcggcatctggctagcctcgcgtgccaactccaccgactgcatccgcttcctgcagtggcccatcatcgtcgtgggtctcgtcctcatggtcatctccctcatgggcttcgccggcgcctgctaccgccagacctggctcctccgcctctacctcttcgccatgttcttcgtcgtcctcgccctcctcttcttcatcgtcttcgccttcgccgtcaccgaccgcggcgacggacaggtcgtcatgaaccgccggttccccgagtaccagctctccgactacagcggctggctccgcgaccgcgtcgctgacccggagtactgggccaccatcagcgcttgcctccgcgacggccacgcctgcgccggcatgaggcgcctcgcaagggaccccaacaccggcatgctc

SEQ ID NO: 7487 - DNA, 556 bp, Sorghum bicolor
  Clone ID: SORBI-28MAY03-CLUS86344_1
cgcccgcgactgccccacgtaaggtgggtcccggtccgggccccgtcccgccagatcagatcggatcgctccaccacctgctggtctgatggcgccgcctccccccttctagatctcgcctaagaaacctctcactgtgtctctctcagagtatcgctttagttttgccgatccgggcgcccatgagcgcccgccgccgcctcctccttccaccctgctgcagaggagtgcgtcagtccgtccatccgtccgtcgttttcagattttgtttccccatcttgggttcgtttggttcgtagaagaactcaagttaagttatcatcatcgagtgtgcttggtctcgttgtcagtcgttgttaaggttttaagaagaattgagaagtgagatggattggtcttgtgttgccgaggagatgtcaaatctgcctctctctctttttttttgtggttttgttcttccagactgaggaagggagatcagatgattattatcccagattaatcgtgcttgcttgttatttcctgtgcttgatctgattacgataatgcttcattg

SEQ ID NO: 7488 - DNA, 679 bp, Sorghum bicolor
  Clone ID: SORBI-28MAY03-CLUS87630_1
cgactccgccgcccccgctgaaatggcagcgaaatgattttccctccccctggcagcaccagctcagtcacagcacagccagaccagacgccgccctcctcctgctctgctccctccgtcctccgtcttcctccttgcccctctggaggcgagccgccagcccagaaaaccaatcgaacagcgcgagcgaggccgcccgcctccactgctcgcccgcgtgcgtgcgtcccgatcccggcagcaggaacagaaaaggaaggaaaagaagaaccaagagcagagttgaataggccattatgcgccggtggctttgctgcagtcattttgacacgccatatctcgaaaacgaaaatggatttacaagcagtcctgataaaacaagtggaaacgatttgaattcaaatagtgatcctgcaaaaccgccttccatcgaagtacctgcattgtcatttgatgaattgaaagaaaagacagatgattttgggtccaaggctttggttggtgaggggtcatatggaagagtatattatgctgttctggaaaccgaacaacacgtggctgtaaagaagcttgatacttcagcagatcctgagcctgataatgaatttctagcacaggtgtccactgtttcaagattaaaacatgaaaattttgtggacttgcttggttattgtattga

SEQ ID NO: 7489 - DNA, 615 bp, Sorghum bicolor
  Clone ID: SORBI-28MAY03-CLUS87652_1
atatacgcacgagggttcccgattccaacccgtcttcgtccgctccggccacttgcttccccgccgccggtcgccacccgcaaggtttggaggataagattcgggagggatggcttccggtgggcagccgcagttccggtacacgcagccgccgtcgaaggtgctccacctgcggaatttgccatgggactgcactcccgaggagctggtcgagctggggacccccttcggcaaggtcgtcaacaccaagtgcggcgtcggcgccaaccgcaatcaagcattcatcgaattcgctgaccaaaatcaagcgattgccatgatatcatattacgcatcgtcagcagagccagcacaggtaagagggaaaaatgtgtaccttcagtactccgatagacaggagattatcaacaacaagacaactggggaaggttcaggcaatgttttgcttgtgggaatggagggtgttgcaccagattctgtcagcattgatgttctacacgtggtattttctgcttttggatctgtccataagatagctacctttgagaaagcatctggttatcaggcattaattcagttttctgatgctgaaaccgcaacatctgcaaaagctgc

SEQ ID NO: 7490 - DNA, 623 bp, Sorghum bicolor
  Clone ID: SORBI-28MAY03-CLUS8770_1
gagagaaaccccggctgccccccggcgaggtagagagagaaaccaaggccaaggagcaccgcccccctgttcgtccccagcaggagagggagatagagagagagagagagaaggctgtgggaaggaaagaagaggcggtgggaaaggagtgcgacatggagaggccggcgccggtgaggaagtcccacacgtcgacggcggacctgctgatctggccggagggggcgccgcaggaggctcctgccggggccacgccgccgtccaaccgccggccgcaccagccgtcggaggcgctcaagaaggtggtgttcggcgggcaagtgacggagaggaggccgagagcctcaacaagaggaaaccatgctctgctcccaagtggaaggagatgacaggaagcggcatatttgcagctgggggcgaggctgaagaagatgaatctgccaatgcctctgcaactcccatccgaacagctccaaagaattatcaggcaattagtactataagccacatctcatttgctgaggaagaaaacatttctccaaagaagccgacttcgatagcagaggtggcaaagcagcgtgaactaagcggcacacttctgagcgaggatgacagcaagatga

SEQ ID NO: 7491 - DNA, 1040 bp, Sorghum bicolor
  Clone ID: SORBI-28MAY03-CLUS87723_1
tcaacgcgctcgtcggcccgctgccgcagcaggtgcccgggatgcgcaaggtggagcagctggacgtcgcgcacaaccgcctgtcgggcgccgtcccggaggccatctgcgcgctcccgcgcctcaagaacctcaccatctcctacaacttcttcaccggcgagccgccgtcctgcgcgcgcgtcgtgcctacgcccgacggcgacaggaggaactgcctgcccaaccgccccgcgcagcgcacgccgcagcagtgcgccgcgttctactcgcagccgcccgtcgactgcgccgcgttccagtgcaagccgttcgtccctgttccgccgccaccaccatcatatcccggcccgcgcccgccgggtggccccggccctggcgcgccgccgccgcctcctgcgcattaccgatgatctggttcgctgatggggtggagaaagaagcactatcactttcaccttaattctctgccgccgccgcccgccgctgcgctggatggagacagacagcaaagttcactaccgtgtcacaattgtacgtggtcagtcattgttgtgcttagattagcagtgttcttgattgatgatagctaccggcatatagaagattattatcattattattataaggtgcatatatcgctctggaattgcttttgcattggtcgggtcggtctctgtttttcgcgtcgatcggggggtttgcgtcatggcgatggtgaaaaggattgattgaaggtggtggtggtgctggagagggaacaatttgtttgagcttggattgattgctaattgggttgtgaataataaactgctgcttgagagagacaggttatgacgaggatgaggaggattggttggtgacttgccgcgcgcacctgggactgggactgggatgtatagagggaatttgagcttgagttcttcagttaagctgctgctttcagatgagagtccagagataagttttcagaccaaggaatgtaccctacttaactattctttttttttgtcacagctacttactgttaatcgattgtt

SEQ ID NO: 7492 - DNA, 568 bp, Sorghum bicolor
  Clone ID: SORBI-28MAY03-CLUS86610_1
gcacgagggggacccggaggtgagcacggacgtggggcggttcgcgcggctggtgaactcggcggacgtgatggtgggcgtgcacggcgacgggctcaccaacatggtgttcctccccgccggcgccgtgctggtgcaggtggtgccgtacggcgggctggagtggctggcgcgcggcacgttccgggagcccgcggaagggatggaggtgcactacctcgagtacgtggtgcagaaggacgagacgacgctgagcgaggagtacggcgaggacgatccggtgatcagagaccccgccgccatccataagcaggggtgggacgcgctcaaggccgtgtacctcgacaagcagaacgtccggccgcacctcggcaggctcaagaacaccttcgtgcaggcgctcaagctgctgccccatggacggcaggtcgccgacgactgagtagtttggacaggtctctgtcgtcgttcgcgtacaccgtgttcatgttgtttagtaccttggtttaactaccttcatcatcagctggaaaatggatgggtttaatttataccctaggtaggtaga

SEQ ID NO: 7493 - DNA, 613 bp, Sorghum bicolor
  Clone ID: SORBI-28MAY03-CLUS86637_1
taatgaagatctatatactggtaatgaaatgagcccaagtgaccaaaggcaaaaccatgtttcagcttcgagaaaaagacctatttccctcccaccaagtgaagaagcaaaacctggaaagaaacagagagagaatgccgaagatatgatcccaacatcagagaactatagccctgaagatgctctagaacatgtccaagatagcaagggaactgatctaccagaatcatttccagtgaagaagttaagggagggtgactacgttgatgttggaaccattgtctcttcaaccaatatttttgcggataggtacaagggtgacgatgaggaagttgatgttgattagtgagtggatgctgtcagtggttgataatgatttgagctttaggaagcaatttcaccagacgacatctatgccagcttctaaaactactcgtatgccttttgcatcgtaggggctggtatatttggtagctatttatgtgcttagactgagttgtgatgctgtcaaacgtgagtacattatttttcttttgtgtttcgtgaggctcgaagaggatactaatctgtactcgctttatgtattattcctagccagtttgaatagtgactt

SEQ ID NO: 7494 - DNA, 682 bp, Sorghum bicolor
  Clone ID: SORBI-28MAY03-CLUS86759_1
caagacggcatggaaggagcatatcagctcagtggcttacctcctcatcgccgcaccttcggtcaaggagctgcgcgtcgagacttacagcgacctaccagggccaccaccggataacctgatgatccaatggccagagcgctgctcaatggaaaagctccagagcatcatcatcggtggattcagcggggagccggagctgatggaactaacatttttcctcctgcagagatcgccggcactccagacgctggccatcgacacacacaggcggcatctccaaaccggcagcgacagtggctgcaacagagaggaagcggaagaccatgtgaggtgctactacgcaaggggtgtggcgtggacaaatttggtgcccaagatcccatcaactgtcaagttcaccatcctctgaatcatttaatgtatcaattgtttatgccattgcccctttcccgtttatgctgtgaaacgttggagtttgcacctttggattccgaacctactagcataaatctttttgtgccaggattttaatagataccttgtgaagaacaatgttatccttttgtgccaggattaatagatacctggtgaagaacaatgttatccttctgtgccaggattaatagatacctggttaagaacaatgttatccatttgtgcctggattaatggatacttg

SEQ ID NO: 7495 - DNA, 917 bp, Sorghum bicolor
  Clone ID: SORBI-28MAY03-CLUS8680_1
gcacgaggcttaaggaaggagctgtcccttgttaaagacgtgcctgtattgttcgctattgatcagtacaatagttggtttacattcagtgacttccaggaacctgtaactgtccgatcctgtcgatcgatccatgcaaaagagcttacaacggtcaatacttatagaccaatggtgcacaatgatatgatggtgggggccttttcacactcaacagcagtcggcaaactacggcaggagctgccagatgttccttctgatgctcgtttgatctttccacgttacaccttagatgaagctgagactgtgtgtcactattacatgaggcaaaagatcattcggcgcgagaatttttcagaagagaaatggaaaaagatattttacttatcaaatggaaatggtgcagagatgagatggcttgctgcctttgtttgagtctctgatacttggattatactcggttttgatggtggtctagaaaggttgccacttctgtttcagcatgctgttcgacaccacagttaattgttgtatacttgtagtttgtctcatgacatttctagcataaaatttggcgtcaacatcatttttgctgagtagaatttgaggagataaaacataagtttgtggctccgttacatgattatatcatgggggccctttcagttctgctcagatgctagatacaaaataataatcaactgatgtgtaacattgttcgtggagaagttttcacatgttttggcttctgtgtttctcatgtagctgagctgcctgcgagctcactgtgcttatggatatgatatatgagttgatgccaatctactcagcatgctacattgttgctgaattgagccattgatttttttttttgattttgttgtacgaatggaacaagtattggagtttggaactca

SEQ ID NO: 7496 - DNA, 739 bp, Sorghum bicolor
  Clone ID: SORBI-28MAY03-CLUS86803_1
aaaaggtaaattgattcttgggcttcgctccgctaactaacgaacggaccaaggtagttttgtcgtcggctgccttcccctttttttggtgtttgtgcccgcctcttgcagtgcccctggctacgttcaggcttcgcgtgcatccagcccgcggttccaggtctactctgatctctccgtcctccacatggcagggttttgggcctcctgccccctgattcctgctgcggtcctcccctcccctattatccctctcaagtagcgaccttcccccgccagcccgtcgcctcggtgtaagtgccccaagcgacctctccgatccccttccccgtcccgtgctcaccctgcagcttgttatggaattgggtcacttctagatcggaatttaatttttttggaggcctcaactacatgctcggcctgcggctatctcaccagggtgcagtactaagatggcaggcaaagcaacttccccaattctccaggatatgcacaaaaggtagcctcccaaagtcccagttaggtagttaggcacaacacaatacataccgcgcatttggtttatagattttatcggacatgctttgttggtagttacatcagagttttcactttataagacatgtccaaatattaactgaaatttataaggtcgagttgtccacaaaatggtcaaacccatgtggatttgtaatttcccgctatatgaatatcacattcaattgaatcttgttattcc

SEQ ID NO: 7497 - DNA, 700 bp, Sorghum bicolor
  Clone ID: SORBI-28MAY03-CLUS8682_1
tgagcactattgaggaagctgacaaagccattgagatgttcaaccgctatgacattagcgggaggcttctgaatgtaaacagggcatctcctaggggcactcgcatggaaagacctccgagacaatttgcacctgctttcagagcttatgttggcaacttgccatggcaagttgatgactctaggctggtgcaattgttcagcgagcatggagaagttgttaatgctactgttgtctatgatagagaatctgggcgttcacgaggatttggttttgtaacaatggtgtcaaaggaggaactcgatgatgctatttctgcgctggatggacaggaattggacgggcgccctcttcgagtaaatgttgcagcagagcgaccacagaggggcttttgatgcggtggtacgagagagatggctgcttgtttgtaatgagaacggagacaacggaggagcaatggtacaaattagcggaagctgatgctgtcacaagttgctagatccctcccttagcttcctgatgtttggttcttgccacatagctttttgatgcttctcttggcagctggacttgatgttttactattcttgtcgacatcatgagttgaattatccaagtaggcttctatgttctatcgatatgccttgatcagattctcatcgtggataataaatgtgggaatttattataataatatatt

SEQ ID NO: 7498 - DNA, 670 bp, Sorghum bicolor
  Clone ID: SORBI-28MAY03-CLUS86859_1
gcacgaggccctctcgtcatttctctcggcgcgggcgcgcattgccggcccgagctccccgccgctgccgccctacccggttccggcggtggttccgccatccagggcaggccgaagctaacctcttcggtgctcgacgcccccgcccaaccaccgtgagattctcacgacccgcccccggcgggcgggcggcgcccccgctgcccgccgtcctgcccacagtccgccacaaccgctgggacggagactctcccggcgatccgtctaaccccggcagtgtcgcagcttcaggacggcacgaggcacgcatcggagaggctggttctgcccgtaggatcatccctggtccctaagctaagctcgctacaatggcaagatgcccacaatttgagcacagcgggggaccattgaaggcgctgcgtgcagaggctcacggccacatcagtttgctgccagacgacatcctgataggaataatctcctggctgccgatccgcgacgctgtggtcacaggcgctgtctcgaagaggtggaggaacttgtggaagtatgtccccagcctcaggctcactcggcaatgcatcaaactgaaagacgagggccctaggagtgagcaggcggcccggtttgcgggcgtggtgagatctgtcctgtgccaccacggcggtgt

SEQ ID NO: 7499 - DNA, 694 bp, Sorghum bicolor
  Clone ID: SORBI-28MAY03-CLUS88404_1
gcacgaggctccggcccgccgcgcattcctctccctctctcgtggcaacgacgagcgacaagtcgctggctcgctgccgccctacgccaggtgctccaggtcttcttcggtcccttcgccggcgacgagcactgccaggaatttgatcttatatatacagacttcaagatgttctcggctccaggcaacaattctttggctcttgtagccccacgaccagggatggagctggctaatgttcaacatcccaatcaggctccagggcctggaggcaaacagcgcacatccagcctggaggcaccgataatgctacttacaggtcaccagagtgctatctactgcatgaagttcaatcctgcaggaactgtgatagcatcaggttcccatgacaaggatatcttcttatggtatgtccatggtgaatgtaagaacttcatggtactgagagggcacaagaatgctattcttgaccttcagtggactactgatgggacccagatcatctctgcaagtcctgacaagactgtgagggtctgggatgttgagactggcaaacaagttaagaagatggccgagcactcatcatttgtcaactcatgttgcccagcacggaagtggccacctcttgtggttagtggttcagatgatggtacagcaaagttgtgggatttgcgccagagaggggcgatacaga

SEQ ID NO: 7500 - DNA, 510 bp, Sorghum bicolor
  Clone ID: SORBI-28MAY03-CLUS885_1
ggtccgcattccgggtcgcccagcgtccagaatactgacatatcatggacactgattacggctgccctctcttctgttgcgaggacttccatggtaaccatgcaggacattcttggcctcgacagttctgctcgaatgaatacgccagctacccagaaaggaaattggaggtggaggatgccaggctcagttggcttcgacagtctcagccctgaagcggcaaagctgaaggagctgcttgcgctgtacaatcggcagtgaagtccccgaagtccctttaataaaataggcaaccaaatgtgagcggtttggctgccaagttctatgggaccatggtactcggtcccgcacaaacgttttgtgttctggttggctagaaacttgcgtgcttgaatatgaaggtcttgcactgcaggttgaggcctgaacacgaagtattgtactgtgtattcccattttttaacaatttcctttatgtgcgggcctatacaagtttccccccactttcgc

SEQ ID NO: 7501 - DNA, 709 bp, Sorghum bicolor
  Clone ID: SORBI-28MAY03-CLUS88519_1
cgtacaccaacatgttcgacgcgcaggtcgacgccgtgcgcgccgcgctggacgccaaggggtacaaggacgtggagatcgtggtggccgagaccgggtggccgcacaagggcgacaccgacgaggccggcgccacggcagagaacgcgcgcgcgttcgtgtcgggcctcgtgtcccacctcagctcgctggccggcacgccgcgggcgcccggcaagtcggtggagacgtacatctttgccctgtacgacgaggacctcaagcccggcaaggcgtcggagcgctacttcgggctgttccagactagcctcaccgagacgtacccgacggggttgctcaggaacggcacggccggactgataccggcgccggcgccggcgccgacgacgacgtccgccccggcgctaaagccaacgccagggcaacagccacaggtgactccagggcagcagggctcgacggcggcagctgggccttccggcctctgcacgccggcggggccagggacggctacgtcgaaagggaccaccaccaccactgcctgcgctcatcctaatgctgctgaatcgtctcgcacttcctcgatgctccctattattgctggtttttggttcatagctttgcagatgtttatatgaccttttctttatgctttttccagctaatgtatcgtgccaccttttgtaatcgtagtacggtttcacgatcc

SEQ ID NO: 7502 - DNA, 1226 bp, Sorghum bicolor
  Clone ID: SORBI-28MAY03-CLUS87151_1
tctatgggatatcgaaactccagagaacatggtcttcccttctccattgaattcaaagcggcaatgtcttcctagttatgcagttcctggcctacaaattggatctgtaaatatgtcatcaattccaagggcacaaggaagtccttttggtaacttgcagcaaatgccagggagtggctcagacttagctttgctgcttctcaatcaatctggccagaaccttggtagtccaattgcctgtcaacaatcatcattttccagcattattcaaaatgctaagcacagctatttccctccatcgacatttggtgcttccactggttcaatgaagcaagaaaccatgccttcgaatgaagctccgcagcagttgaatgctcttggtattcagaaaggtgatcaagtaagctgtgaagtccagccaggtattgattcaatttctgcacgggagatgagtgttaaaccaagaggaccaagaagcacagattcatactcaagtcaaagcatttcggatcaaaacggcaagggcgagcctagaacaaaatctccaaggagcaagaagagctcgtctcacaaaaccatttcagataaatctgagctttcttcactaccttctcagatttgtgacaagcagaggcatggttcagaaccaacattggttgactgtggagccgaacaagctacctgtgggaatattgaagattcatctggtgcacctacacgaggtgattttgtaggagaactgcaagttctggaggttgaacagcatgaactactttcaccaccaaagttagaatcatcaaagtcacctgatggagggaagtccgtcagctcgttcccaaaccaagggtgtttctcacagttccttgagggcctggattggatgattccgccttcctactaccaagactcctatggcattcaatcagctaccgcatcggataacatttttaatccgtctgaaggtataccttccgcaatgaatacggatggcatggaggcgtttcaaacctcttgcctttctgagtgctttcctaattcaattcaagagttcatcaacagtccagatataaatacactgacatttatgtcgcctgagatgcaacatttggatgcccaacacgacggcagcaacttgccgagcacatccaactcctatgtgcagatgagtttctcagaggagagtcagagtgcatccttaagtggcctgcacatggaagctatccata

SEQ ID NO: 7503 - DNA, 669 bp, Sorghum bicolor
  Clone ID: SORBI-28MAY03-CLUS87191_1
gtcgagcaagagctagtagcattcgcaccgccaattgctgcacgacaaagtactccgagctgccacgccgacgccaccaaccccgaccagagcagcatcccgatcgggcgctccgaattccgatgccgcgcatggtggccgtggtcggcgcgggcccggcggggctagtggccgcgcgccagctgctccgcgagggcctccacgtcgcggtcttcgagaagtcgggccgcgcggggggcacctgggcgtacgacccgcgcgcggacgccgacgacccgctgagccgcgacccgggcgcccccggcgccgtgcacggaagcctctacgcgtcgctgcgcacgaacctgccgcgcgacctcatgggcttctcggacttcccgatggccggccgggtcttcgcgggcgacgcgcgcgcgttcccgggccaccgggaggtgctcgcgttcctcgacgccttcgccgaggagtccggcgtcgccgcgcgcgtcaggctccgctccgaggtggtgcgtgtggctcccgccctcgggcacggggagcggtgggtggtcgcgtggcgccgggaggacggcgaggtggtggaggaggtgttcgacgccgtcgtcgtctgcaacggtcactggacggtgcccatggtgcccaagattcgaggaattgacaattggagcg

SEQ ID NO: 7504 - DNA, 765 bp, Sorghum bicolor
  unsure (1)..(765): unsure at all n locations
  Clone ID: SORBI-28MAY03-CLUS8731_1
cccacgcgtccgctcgagggctcctctcccattccgatcgccaattcgccatccacaccgcctgcgactgcgaggctgcgacccttcttccccctctgcaccactgtcacggcgtcacgcgcgtgcgctctccttctcccacgagttcgtcagcctgctaagtgttaagatggcttcaagcactagtcagacagaagctccagccccatctgtccccaaaaatcctgcaatggcatcatgccggaagaagaaaacagatgatgctaccttccttgaagatctgaaagaccacatcgatgagttcattcatgcctccatggatgagcacaagacctgctttacgaagacgatccaaaagatgtttgggatgtcaaaggctgttgcagagagatctgcggcagaagcaaaggaagctgaagttgaaagtgctttgccacttcagaccagcgtctctcagtagaatttcatgttggtagtttcttgctcgatgccaaacttttatacaagggttttgttgctctgtgttgtctgaaacgcataagcttgtcagtagcatgttttcgtaattggattgtagtgcttgattctctacagttttttgtctgtgtgtatcatagaccaatgtaacagcttagcttgcttcattctccgaaatcttgtatggctgtactgtacacccaggtatctgggcatcctgaacccaactgattgtgtggtttctgatttgactgattggctaaaaaaaaaaaaaaaaaaggcccctan

SEQ ID NO: 7505 - DNA, 1420 bp, Sorghum bicolor
  Clone ID: SORBI-28MAY03-CLUS87529_1
gcacgaggcttggtcttggcagttggcacatggggatcgtgttggttcgccgaaaaaaatcaaagggcgcatcactatagaacgagttgtgtgaaccagtagtggtgtgtggactgtggagttcgcgcatctacggcaggtcttcgattgggccagagatcatatcaaaagtgtagtgcgtgcacgagaggagcgcgtgattcgtccgccgcccgccggtccgagaccgcggccagtgtggacgcgtgacagcgaaaaattatttagacctcctccctcctcggctgctgccttccgcacactgacctcgccgtgccgttgagaggtcaactagagcctgccgagccggtagggcggtagcaggcgcgaggagaatggggacggaggccgacgccgctgccgtggacctgctccggtcgcagatcccgttccagaccgacggggagttcgtcctcccgccgcgcggcgtggggctcgtcctcgtcgacctctgcaatggcttctgcaccgtcggcgccgggaacctcgctcctgttgcgccaaacaagcagatcagtaagatggtggaagaggccaataggctctctaagctgttctgtgatagaaacctgccgatctttgcgttcctggatacccattatccagataagccggaaccgccatatccccctcattgtatcattggtactggggaggagaactttgtcccagatctggagtggttggaaaaggagccaaatgtgactataaagaggaaaagctgtattgatgggtgcatcagctgcatagagaaggacgggtctagtgtttttgttgactgggttggaaaatatcagatcaaaactgtcttggtgctcgggatatgcacggacatctgtgttttggattttgcaagttcaactctggctgctcgaaatattgaccgagtaccaccattacaggatgtcgtgatttattcagaggggtgtgctacatatgaccttcctgttgagattgctatgaatatcaaaggagctcttgcccatccacagtaaaacattactggacataaactggatgctctctaggagatgctgaaggaagaaccttacaatcaacttaccatttgatattgaaggatctgatgcatcatattggactctatatggccaaaggaaggggtgcaaaggtagttgacagggtggttattgaaccttgaatcaaaaaacttgtcctcatcgtagtgatgttgctagagtttcctcagtcctcttatccttccattgtaacaatcagatagatatgcatcttagcaagttgttgacatactatataatgctagcgacaactatgttgaatatgtaaaaatgggctcattttgtggttagcttgtacatagttcctaagattactctatcctgccaaacatgcgcccagttta

SEQ ID NO: 7506 - DNA, 784 bp, Sorghum bicolor
  Clone ID: SORBI-28MAY03-CLUS87536_1
tgaggcccttaatttttcatcacccttctagtctagacaccgatgagccggtctcattgcggtcactgatgctttgccggtcgttttcatcccctttcttcctttcttaaaccttccgtacccatatcgacctgccgccccctgcttccagtcttctctgtagagggtttcgctccagagatttcgcctgaagggcacacgcacacccacccacgggggatccgcagatgaagatcattccggtcccctgcctggaggataactatgcctacctaatcgtggatgagagcaccaagaaggcggcggccgttgaccctgtggaaccggagaaggttatcaaggcggccggcgaggtcggcgcctacgtcgactgcgttctcaccacccatcaccactgggatcatgctggtggcaatgagaagatgagactgcaggtgccagggataaaggtctttggaggatcactggacaatgtggaaggatgcactgatcaggtggagaatggaacgaagttgtcacttgggaaggacattgagatactatgcctacacacgccttgccacactaaaggtcatattagctactatgttactagtaaggagggggaagatccagcggtcttcactggagataccttgttcattgctggctgtgggaagttttttgagggtactgcagagcaaatgtatcagtctcttattgttacactgggttctctgccaaagtcaactcgagtttactgtgggcatgagtacactgtgaagaacctaaaattcatactgac

SEQ ID NO: 7507 - DNA, 536 bp, Sorghum bicolor
  Clone ID: SORBI-28MAY03-CLUS87608_1
cggataccatgctccagagtatgctatgactggccagctgactcaaaaaagtgatgtatatagttttggggttgtccttttagagcttctaactggaaggaaacctgtagatcatacaatgccaaggggccagcagagtcttgttacatgggcaacaccaaggcttggtgaggacaaggtgaaacaatgtgttgatccaagattgaatggagaataccctccaaagggagttgcaaagctagcggcagtggcggctctctgtgtgcaatacgaatctgagttcagaccaagcatgagcatagtagtgaaagcattatctcctcttcttgtaaatgcaccatatcagccggctggtgctcctgatatatcttcagatgcctgacaacatgcacaactcaaaacccatgtaaagaaacaccatttattttcggtatgccatttttatgagttacttatctttcgtaaaatctgaattgtgtgtatttattggagaggaagggaaggaaaaggagtaatgcgtttattttgaaccccat

SEQ ID NO: 7508 - DNA, 1113 bp, Sorghum bicolor
  unsure (1)..(1113): unsure at all n locations
  Clone ID: SORBI-28MAY03-CLUS8733_1
gtacagacatatacccttgctacacggcttcctgataacactagcagttcaggttcaggccggggttacgtacaacccattatacatttcagtccttcagacacaatgttgctttggaatggagtgctgtgggatacgaggcaaccaactcctgttcatcagtttgaccagttcacagattactgtggtggtggattccatccagcaggaaatgaggtgatcttaaattcggaggtgtgggatcntgagaagtttaagcttttgaggagtgttccttccctggaccagacagtaataaagttcaatggaactggtgatgttatctatgccatcctgaggcgtaatcttgaggacgtgacagcatccatcaatgctcgtagggtcaggcaacctcttttccctgcattccgcacgattgatgcggtgacttactcagatattgcaaccgtccaaatcgaccgctgtgtacttgatcttgccactgagcccaatgattctcttattggcgggggtggtatggacgatcaccgggagccgttctcttctgctcgtgtctgcgtccttcgctgctcgcggggtccggctgccgcttctccccccgtgccccccggtggatccgatgatgaggacgatgatgacaatgatgactctgatgatgatgttcttcttgcgccagtgctggaaggggatacagattctgaagagttaagcagcagtggcgatgatggtgatgaagatggtggcgacgatatccccagttcggatgacattgaagatgacccagagttcattgatgatggcggtgactttgaagggggaggggacttgatggatcttttgggtgacgatgaaggggaggacgacgagagtgatacgatggaatcctttagcagtggcgacgaggagggttggatcatgtaggagtgttggataatgtaggttttgttctgctgccctgctgaagaacatggagcatggccatgtacaattgaatatttatacgctcacattatgcttgtaattatttccttcctctaggggtagcgcagctcctgctggggaacttggaacataatgaagtgttgaggccttagatgnagtaagtaaagatgg

SEQ ID NO: 7509 - DNA, 1199 bp, Sorghum bicolor
  Clone ID: SORBI-28MAY03-CLUS8937_1
cctccctccttcgaaacctagggcaccaccgcagcacctcaacacgcagtccacgccgccgccgccgtagcgccgcagtccatgcagctcctccacacggctgcatccgatgcatccacccatcccactgccacacctccactccgccgcatccacgaatccgcactggttcaatgtggtaaactgattatccgcatccacggatccgccgcatccaccgccacacctccccctctcctcacctcccctgctgcccgcggccccgcgccggagcaggtggtggcagcggcggcggggctgcgaccatcttcgctgtgactcatccgggctacgacccacttcaaggtgttgctagttacatccgttggagttgcggcttccgccgaatcccccaatccacacccgccatggcgttcttggggggtggaagtgaagcctaggaagccctatacccacacccaccaggctgaccatggtcgcctccgcatttgccaggttggggtttttgtccaaccagttgcagagcttgcatgtaaatttagcaggggctcaacaatgaactacagtggagtttgcaagaactgaggggggccgtggcccctcgtggcctcactgaagcactgcccctatgtacaattaacatgtgccttctgccctttgtcatttcctactcctaatatgccccatctgttaacatgtcacctgaaatactttggttttgttgacatgggtatatgttctcttttatttgtatctatcatttttgataacagagaaggtcttgaaatcaggatgggatattcagtgagtgtaattgcttttgattgccttccgacacagaaatgttttccagtgagcctcctatttggttgcatgatgtgaccttgatgacttgaccattaagatcaataaaaaactacgtttacagtttacactgcattaagcgaagcttgttcaaactgaacattaagatcaatatagaatttatatttgcactgaattaaacagagctgaatgccttgttagttcctttttacttggttaatagtccatgatactgcaattagctatttctgtcctactgctggatttgaatgtactagagattgagtttgaggaggtcgatgatgttgtcttttcagtgattggtcaaagttcgattcatctctctggatactatgtccgtgcaagcagcaggt

SEQ ID NO: 7510 - DNA, 633 bp, Sorghum bicolor
  Clone ID: SORBI-28MAY03-CLUS8941_1
attttctttacaggcaatcacttctatgcattggttcttcatgtatgatttatcatacttcttaaactctaacagattatattttttctctcacatctcacataggtagtgttattagcaagctttgattgttattagcagagaagggagggagacggtgaaagcagggagtatcttgcagccaacagcatgagtgaggtgccatgcaggtgcggcagataacaaataatggtgctgtgaagatcagtttcaattgtttataatgccattcagaaagttccatcgcctatcaatgtgttcaccctctatgactcaggcaatttgatagagcacatgcaggcaggcgatgcatacttgctgggcctgtgatcatcagtataattatgcgggttgttcttgtctttatccatctcaagatttgatatatgttggaggtagtacaattttgtgattatttgacaaattctgttccatttgtattgtagtcatgtcagcaaaatgatagcacatttagatatattcttgggtagcatcattgtgtgtttatgcatctggtcgatcagatggtttgggtccgactacaaaataaattattttgtagctagcgaaaaaaaaaaaaaaaaaaggccccta

SEQ ID NO: 7511 - DNA, 621 bp, Sorghum bicolor
  Clone ID: SORBI-28MAY03-CLUS8952_1
ataacaactcccctctctcctccgggaattcttgccctactcctcgtaccgccgccgccgccactgcccccagcgcccatccaccgccgccgccgcagccaccgtaggagactcccctctgacagggctccggtgccccttgcgtggccctgctccaccggcgagctccctgccatggatcctcaccgtggatctcgccatcctcatcgtcctcgtcatggatctcgccgctcccgtcgtcctcaccatggatctcgctactctgctcccgccctttggtagcacaggctcagtgcctccctccggtcacgtgggcctgcctcagctccatcgtgtgggctcgatccccgctgctccaccggcacgctactccgccgagcgcttgtctccctgtgtgttgctctccctcgcccaacgttggccacatcttcttcctccatgaggccgaccaggctgcgcggacctacagctctagcgaagcgggctcccttgctcctctcccggtagccatggcgcacttcctcgggcagcggcgcgatcccctgctggcacattcatcacgcgagcttgggctggcagatctccctcctagcgcctagggggcgagctcgggccaccaaa

SEQ ID NO: 7512 - DNA, 648 bp, Sorghum bicolor
  Clone ID: SORBI-28MAY03-CLUS89623_1
ctgaattccctcgtctccgcacggaggccgtcctccccctgacccctctgcgtccgccgccgccgccgctcaccggccgcccgcacgcacgcgcgctccattaccccggggtccccggcgggcgatggccagcctatccaacgccggctccaccaatcaggcctaacacgagcagccacagcctccgggcgcctgatctctcctcgtcgggcgggattcgggtcgacaggagatggaggccagcgtgggcgtccgtgcgccggcgcgcggccgtgcctgggccggcatcgagaagccgcacggcgcttactccgtcagagtcccgccggtaaggctcacggcggacaggctgcggctgcctccgccgcggaggctggtgctgggcgccgatccgtggaggaccgcgggtcctgccctccgtcccgcaaagctgagagtttcgtgctccgcgaaatcggcaggaacaggaaaagtccactattctactgacgaggctctcatactacagcaaaaggcccaggatgttctcccttacttggatggccgatgcgtttatcttgttggaatgatgggttcaggcaaaactacagttgggaagatattagccgaagtattaggttattcgttctttgacagtgataagctggt

SEQ ID NO: 7513 - DNA, 774 bp, Sorghum bicolor
  Clone ID: SORBI-28MAY03-CLUS87784_1
gcacgaggcacaggtccgtcgaggagcgatcggcgcagaagcggtcgtcgccggacaaggggcacaagtccgcgtccgccatggacgccgtcctgcacatggaatccaagaactatcaccaccaccaccacctcgccgccccgtcgccccgcttcgccgcccccccctcccctcccctgttcccgggcgtgctgcggttcgtcctgccggttcctcggcatcttatttctcgtgtctactgagacgtagaccaagaacgaggtgagtaattggcgagcggttggagaacgaagacgagacggctgcggcggccggcggaggcccatttttgatgcgtggcgccgtcgaggtccacgcgattggcagagacgtcgcgtcgccgagccccctgagactcagagacgctccggcattggacatgatgaggtaccaaaggctgagcccggactgcctccccctcggcaacggcggcggtggcggaggcggaagcgccgtgccccggaagcaggcgtccagatcctccttcatcagagacgacgacgccccggccgtggccacggatggctcccgcctcgcttcgtacctcgcggcctccccgcccgagtccaagccgctgcgcgcccgcgcgccgcagccggcgcctctttcttcggcgacggccggccggagcccagcgcgcgagcaggcgcaccaccacacctccgactcctccgacaccgcctccccgagctccaccggcggcggcggtgccgtcgtcggcgacgtgctgctgca

SEQ ID NO: 7514 - DNA, 669 bp, Sorghum bicolor
  Clone ID: SORBI-28MAY03-CLUS87823_1
gatgcagcagtccccctttccttccccttccgtcgccctccgcactcctccaaaacacaacgagaaaaacagagagacgaccaccgctccgcgccggccggccattccatccggcaatgacctccgccgcgggcgccgcatctgccgccatcgccctcctcatcctcctacccctcgccgccgcctccgactccgaccacaagtaccaagcagaggagcctgtgacgctctgggtgaacaaggttggtccgtacaacaatccccaggagacatacaactactacagcctcccattttgccatgcgtcagaaaaccatgtgcataagtggggaggacttggcgaggtccttggtgggaatgaactcattgacagccagatcgacataaagttcagaaagaatgtcgataaggccacaatttgttcgcttgacctggatcttgtcaaggctaagcaattgtcagatgcgattgagaactcgtattggtttgaatttttcattgatgatttgcctttgtggggttttgttggagaggcagacagaaacaatgataaccaatatttcctattcacccataagaatatcgtcatcagatacaatggcaatcagattatccatgttaatcttactcaagaattcgatccctgaggtttattagagttcgctacta

SEQ ID NO: 7515 - DNA, 1373 bp, Sorghum bicolor
  Clone ID: SORBI-28MAY03-CLUS87884_1
gcacgaggcttgagctggggtagctacgacacatacctatccctcccagtccgcagcaccaccacacccactggtgcgccgcggtttgtggtcttgtggacacactggcctccacccatctctctcaccacgtctcgccatcggcagcaaaggccacagtacagattcggcccatcgatttatagccacaccatggccaggaagtgctcccactgtggcaactacggccacaactccaggacctgcggcttaggacacagcagagaagtcatgctctgcgaagccggcgacaatggcggcggccacggcggcagcggcctaaggctcttcggagtgcaggtccgtataggtggcggtggtgcaggctcgtcggcgtccatgaagaagagctacagcatggactgcctgcagctcgcggcggctcaagctggctgctccctcgtctcgccgtcgtcgtcgtcctcgtcgtcgctgctgctgtcgattgaagagggcctggagaggggggcggccgccaatgggtacctgtctgatggacctcatggcagagttgtgcaggagaggaagaaaggagttccatggagcgaggaggagcacaggcagttccttgccggcctggagaagctgggcaagggcgactggcgaggcatctcgaggaactacgtgacgacgaggacgcccacgcaggtcgccagccatgcgcagaaattcttcctcaggcagagcagcatggggaagaagaagcgccgctccagcctctttgacatggtgccgatttgcgagaacagcgcgagcatttccgatccggtgagcagcgaagaaggggcaggctcgacctctctgtcgctgaacgtggcatgccattgccatggcgccgcctccgactccgagagggcagccttggacctgaattcgacggaggaaggcggcgacagcagggcggcaccaggtgcagggacgaccaggccgttcccggcaccggtggcggtagctcagacggagctgctgctgcatcagccttagtagtcgtcgcatggccatgggcgcggccaccactgctctccgttggacctggagctgggcatgtccctgcctgccccatccatcggaacatgacgcgtcgtcgtcctagtcatcgccatggagtgactcccacgcaggtcgcgccaaaattcgtcagctcaagttgccaaggtcgaggccggccgccggccgcgcgtgcctgctgtctcgctcagctgtgtctgccagatggaggggcaatacagtattgttggtgaaaacgttgtgcaaatagcactgaactaactgtggatatcgtaccacgtgtactatgctgctatatatatatatatatatgggtctgtttagtt

SEQ ID NO: 7516 - DNA, 721 bp, Sorghum bicolor
  Clone ID: SORBI-28MAY03-CLUS87920_1
gtcaaggtgcagcggcgaatgcaggagaagcgggtgcagaagtgcgtggagacgctggacgccatccgcgcgaagaacgcggcggcggcggcgcccaaggcgaacggcaacatgaacggccacgccaagccccgcgcgccgcacctcccgccgcgcccgccgcccgtgtcgcagcggcggaacttccagcagcagccctccccggcgccgcccacgcagagctgggagtcgttcgacctgctgtcgtcggtgccgtccacgtcctcggccgccgtgaccacaaccatggcggccgcgaccaccacctcgccggccggcgcctccccgtccccgatcccgcggttcgactgggagctcttctgaagccactcctcagcgcgtgccggttgatcgatcagacggtacctccctttgtccatggatcattagtgccattgtttcttctgtggattctttccatttctattttttctcttcttttcttccatttcctttcgatttgtatatctactatatatctacaaaaagaacagagaccgaccccggtgcgccgagtgtgttcagtgagttgagtgagtcaaagtccgtcagttcacaactcctcctcatgtcatgaggatccatccatgcgtgttgttcagtgacagcaaataagtggtggtcttcttaccatgacgatgaagaaatttccatgaaaatatacacacatataaatagcatg

SEQ ID NO: 7517 - DNA, 695 bp, Sorghum bicolor
  Clone ID: SORBI-28MAY03-CLUS88215_1
attaaatgcgagtgtgttgatatatatactcggaaatgtacttcatatatttaacaacctgacttgactacaaaagatcatgagtccatgttgaattagcactaagaatctgaacattgttagaagtgcaatccttttctagaaattatttcacttgagaaggatgcatttacttgcaccatttacttggacctgtcaacatatgtaggatatcgaacgtcataatgttcaagtgcacattatgttcaacaaggatgaatgacccggttcaggcaggtcttcaccaactacaactggaagacagatgctcaatcatatacattgtggacatagcattgatgaaatacagaggcacgagggtttgctaagacagcctgaatcctatgatgcagattcattttcttagtagattgttccccttttatgggaaagctgatgatttcaatgttgctatgggcatcagatgccaaccattgtactatagggcataggcatattatttgaaccacttaatagttttatcaggcttcaaaagcctcagcttggaatggtagtatatatccatatacctggctcaatgggcttgcagtaccatataaatgggaattacagccgtacatggactgagtgtgttgtgtaataaaaaagtactccgcatgttatgcgttggagtctctaaaaaaaaaaaaaaaaaa

SEQ ID NO: 7518 - DNA, 853 bp, Sorghum bicolor
  unsure (1)..(853): unsure at all n locations
  Clone ID: SORBI-28MAY03-CLUS8831_1
acacagactcgttgcgtttctcgagtcagagagccggcccagcccaaactcctcgccgctacgacctccgtgctccggcgatgcagcggatttcgctgcgacttctgcgctcctccgccgccgccgccgcctccaccacctcctcgtccctccgcggcctggcagtactccgcggcggttggcccgcccgaccggcgctgcagcctccggcgcgaaccgcggcgccggccgacctcacccggtggccgccgcggaggggttactcccagttcgccagcgggttcaccccgctgaagccgaagccgctgggatccatcctcgacatcgaacgcgccaagggcctctcccccgagcacctcgtcgccgcctgggatgactatcattggaaggggtcatataggtgcatctatgaaagcgaagctttaccatctcttggaacaaagatcagattcatgccgacactttgttattcctttgtggaagggaagtggatacaccactatgttcatgcaagtccagatgccatacattatcttcacaggacttgaagactataaagcacgaggcactcaagcaagtccttactacacagtcactcattacacagagtttgcagagaccaaggacacggtacttattcgaggagatgttgttttcaccagcaaactaactgattcagaggcaaagactcttctagagacagctcactcgttctacctgaatgatgtgaggtacagactcgtggagcgattcaacaaagagacccatgattntgagttccgagatgtcccttaagtgcttgatatgccaaccatgtgacctagtttaattctcaatcaacaagccaatattt

SEQ ID NO: 7519 - DNA, 511 bp, Sorghum bicolor
  Clone ID: SORBI-28MAY03-CLUS88334_1
acgagcccgtcgtcgtcgccaccctcgggcagcgctgctcccgtgccggctcccgcggccaccccgacctcgccgccgtccccagcagcttcggctccggcgcccgctcccacgtccaccgccccgagctcgccgccggcgccagccgcccagaccccgtcgccgtctacgacaccgacaccaggaggcgggtcgtcgtcctcgccgccgtcaggttcggccagcgcgccggggggcgatggcggcagcggctccaccaccacgccgcctccgccttccgcagctgcccccgtggtcgcgggcttcgtcggctcgctcggcgctttgatcggttacgccatgcttgctgcctgagatgagagagaccgacgtgttcgttttcttttgccagtgtgactcgagtgagatgactcgcactgtgaagaggcatcattatttgtatttgcatttgcatttgttcaaatatttgtcggataataataataaatacatgcacgattgcttttggtgt

SEQ ID NO: 7520 - DNA, 575 bp, Sorghum bicolor
  Clone ID: SORBI-28MAY03-CLUS89900_1
atcgccttcccccccttcttgcgttggctctcctgctggtctcttggctgttgttcttgctttcaagctgcacacaaaccaagcaaagtcaagagaaggtgcctttcctaggtaaattaaagaagcatgcatccgagctgctctccactggcagtgcctccgggcttccggttccacccgacagacgaggagctcctctactactacctgaggaagaaggttgcttatgagcccatagatcttgatgtcataagggaggtggatctcaacaagcttgaaccatgggacctcaaagatcggtgcaggattgggacggagtctcaggatgagtggtatttcttcagccacaaggacaagaagtatcctacggggacacgaacgaaccgggcaacaacggctgggttttggaaggccaccgggcgggacaaggccatcttcctcggcaacgctgggaggaggatcggcctgaggaagacgctggtgttttacaccggcagggcaccccatggcaagaagaccgactggatcatgcacgagtaccgcctcgacgatgacagcgtcgaggtgccggttgc

SEQ ID NO: 7521 - DNA, 875 bp, Sorghum bicolor
  Clone ID: SORBI-28MAY03-CLUS9_1
catcaacaacaatggccatcaagcagaaaggagcgacgacgacgacgttcctgctcttcctggtgctggcagtcgtcgtcgcagccgaggccgcccagctgcaagacgacgagcctgctacggccgccggcggcagccatgcccggcatcagcggcgcgcgaataaggcatccgccggcaccggggacgcgccaacgcacctgcacttctacttccacgacacggtgagcggcaagtcgccgacggcggtgcgggtggtgagcgcgccggcgacgtcgccgtcgccgctgttcgggatggtgaacgtgatggacgacccgctgacggacgggccggagcagagctccagcgccgtcgtcggccgcgcccagggcctgtacatggggtccgaccaggccaagctcggcttcctccaggccatgaacctggtgttcacggcgggggactacaacggcagcacgctggcgctgctgggacgcaactgcccgctcgacgccgtccgcgagctccccgtcgtcggcggcacgggggcgttccgcttcgcccgtgggtacgcgctgctccgcacccactggctcgacttcaccaccggcgacgccaccgtcgagtacgacgtctacgtcatgcactagcttaccaagacaacatcacaacaacaatggtgtcaataatggcttcgaagcaagcatgcatgcatgcttcgtcgcagagtgctgcttgccttttctttttcagcttatagcatgcgtgatctgctgtatccaatagaagcttcagaacccttccttttttttcagaaaaaaggtcgtccaaaaatctgatccagattatgttgctgttttaaaattgaggcaatatatatagcttttactttt

SEQ ID NO: 7522 - DNA, 749 bp, Sorghum bicolor
  Clone ID: SORBI-28MAY03-CLUS89955_1
gcgcctcctctcttcaggagcctcctcttctagagagagagagagggagggaccatagccgtggccgcaccgccaaccacgccgcccgaatcccccgatcgagacccgacccgacgtggcctagggtttccgagccagtcgggcgctatggtgggctgctccaggggctccctccccacctggatgaccgccgccgccgcgcgggtcgacctctcgggcggcgtaacaccttcgcaccaggggtcgtcctctccgtccccctcctcctcgggtcccgctccgtccgcgggggcggaccaggagctcgggatgttcgagcgcgcgctctccgccgccggcgccgccttcgtctcggctatcatcgtcaaccctctcgatgtcgccaagacgaggttgcaggcccaggcggcaggggtgctgtaccaccagcctgcccagatggcggcgcttggcccggatgcgatcctatctgaattcagatgctctccttcatgcacacgtggtcttgtattaggaagtgagccggtttgtcctcctgattgctttcagtacaagggaacacttgatgtatttttgaaagtggttagacaggaggggttcgttagactatggagaggaacaaatgcaggcttagcattagctgtacccactgttgggatatacttgccttgttatgatatattccgcaactggattgaggatttcacaagaagcaatgctcctggcttgacaccatatgccccgctagt

SEQ ID NO: 7523 - DNA, 1130 bp, Sorghum bicolor
  Clone ID: SORBI-28MAY03-CLUS88536_1
aaagattggcgacgaagcaaggaaggcagccgaatcccaactcctgtgtgtgcgccgtcgcctcgtcggccgctgttgctgctgtgcccctccccagccgctcccgcccggagcacgccgccgccgccggcgcgggcgcgcaccgacgccgtcgcgtcgcatggatatggcccccgcgcccgtctcctccaacccgcgctcggtcgaggatatctttaaagacttctccggccgccgcgcggggctcgtccgcgccctcacctccgatgtggacgatttctgcagcttctgcgacccagataaggagaatttgtgtctctacggccttcccaacgggacctgggaggtgtcgccgccggcggacgaggttccgccggagttgcccgagccggcgctcggcatcaactttgcgcgcgacggcatgcagcgccgcgactggctctcactcgtcgcggtccactctgactcgtggctcatctccgtcgctttcttctacggtgctcgcctcaacgccaacgaccggaagcgcttattcagcttgatcagtgatcatccttctgtctttgaagcattcgcggacaggaaacacggcagagataggtctggggttgatagcagtggcaagtccagacactcatcaaagagagcaaacgatggccatgcgaagaattccagggcagcagctcctgctgccaaagactatgacgccgacgatgacgaggaagatgaggaacacacggaaaccttttgtggaagctgcggcggcctttacaacgcgaatgagttctggatcggctgcgacatatgtgagcggtggttccacggcaagtgcgtgaggatcacccctgccaaagcggagcacataaagcactacaagtgcccggactgcagctcaaagaaaatgaggcagtaggtccccgcctgcactggccgtcgctgacctgtttgatctgatccaaaccatactccgttgtttgccccaaggtcgctgttagcagaggtgaattccttcattttaggacatttgtggggttgttatgtggtggtagcctggtaggaagaggcaaaggactgatagatacatgctcgtcgcttgttttattttatatataaatggctcgttcgtggtc

SEQ ID NO: 7524 - DNA, 832 bp, Sorghum bicolor
  unsure (1)..(832): unsure at all n locations
  Clone ID: SORBI-28MAY03-CLUS8848_1
gccggccggccgccgcggcacccccacgccgccgccgcggcacccagcggcgcatcctccctgtccgtgccggcgctgctccatccccgtgcgctccctgctctgcacctcacctctccagtccccgcgcatcatctcctccgtcatagcctcactcactcatcaccgccgccgccttccggcctgttcacctcctccgttcgtgtctgtgccgccaaaccttgtcgcgcccactgccggcggcgccccctcgcatcccgacctggtcgcgccctaggctaggatggttggatctgcgaccccgccgacatattctccacagggcgaacctagaggcggatccaggcgagcgccgtccccatctgtgtgggactggggattttccgatttgaggcgatgcaacaacgacctggaggcacgacgagatagggttttggcagggctgggcctcttgcacatccggcatctcagggtactgggtcatcccatgctggaaataatgccgcttctggtctcccgagcaatgatttcaaagagacttgttgctgttgaaggaaattaacctcttttgtgtaattagaaacctagtatatatatatgttaagagtgaaaatgcctctgttatgtagttgtgatgcagctttgaacctgtgtaggagctagaattgctatgtaaactcttgaattagcatgaacttttatatattgtacagtttgcacttgtgaaccattctgaaatctacgagtaatcatgctcgaataatttattanatgtatttttggaacaanaggatggttctaacacccgaaaaaaaaaaaaaaaaaggcccct

SEQ ID NO: 7525 - DNA, 314 bp, Sorghum bicolor
  Clone ID: SORBI-28MAY03-CLUS887_1
gtcgaccacgcgtccgcttcaccttgaagccatgagtatttttgacatgggaaacaaattactggagaaggttagaaatgtgaacttcactggggtgtctggacaagtgcaatttaatgctcagtttgaactcattcatcctgcctatgatgtcataagcataattgggaatggcatgcggaccattggtttttggtcaaactatacaagattgctatcgactgtacttccagaggacctgtattcgaagcctcctaatacttctcttgccaatcaacaactctatgatgtcatttggcctggagagactgcac

SEQ ID NO: 7526 - DNA, 936 bp, Sorghum bicolor
  Clone ID: SORBI-28MAY03-CLUS8899_1
gtggggtacaggtacaggttcgacaacattaacagagaatatacacacccttgaaacaaccaaaatgggcagcaggagggctttgcagcttggggcagctgtgttagtcatcttctccttctttggtaaaatcggagctctcctagcctctatacctcttgccttggccgcctctgttctgtgtttcacctgggcgctaagtattgcactgggcttgtccacattgcgttacacccaagcagcaagctccaggaacatgataatagttggatttacactattcatttccttgtcaatccctgcatactttcagcagtatgaacccagctccaaccttatcttgccaagctatcttcttccatatgcagctgcgtcaagtggaccagttcgcacagccagcagtgggctgaattatgcagtgaatgcgctcctatccatcaacgttgtggtggctctctttgtcgcgttgatccttgacaacacggtgccaggcagcagacaggagcgtggtgtgtacatttggacagatcccaaatcccttgaggtggatcctgcgacattggaaccctaccgattgccggaaaagatttcatgctggttcaagtgggcaaagtgtattggcatataaaggctctgaggagtggctgtgaagattctatttattccattggtacctgctactgtaggatttactatatgagaatatatatatatatatatatatatatatatatatatacatacagatgctacatagttaggggcctctcttgctgctgttagcttcgaggccctgttttcgtggttaggttaggataagcctgtgtaaagttatggtcatgttagaggatacgttctacgagctatgctatgtaaagtttgtggaaatgctacgttgaaatgaccagtcactgtgttgacgcttttaagagtttc

SEQ ID NO: 7527 - DNA, 955 bp, Sorghum bicolor
  Clone ID: SORBI-28MAY03-CLUS89066_1
cagcgcgagcgcccctctaagcacgcacaggctcactgcttgacgatggcgaggctcactgcttgctttgctctgtcagccgtcctagtgcttgccaccgggatttcttccggaaatgggcagctcctggacctgattccaacagatgctacgaccgggtgtttgcagtttcctagtggtcagctttttccctctcctgatcttctgcctcttgcatacaagtttcttggaagcttgccgccgatgaggataatcagcaggggaaacactagcctgagtgtagccgctggtgacaacggcaacgttgttcttgccaaaaccaactgctgggacgcccgacagctgtgggttcagcactatcccattctttttgacaagactcggttctcgcttgtgaacctcggcaacaagggtccgctgctggcaatgccgatccctgaagacagtagtatttacccggtgaagctagcgccatacagttacagcccctggttgttcttcatgcccgtgccaacgtcgatgctgtggacgcaggaaaccccgctcgccgatggcttttacaagatacggtcctacaaagttccacgtttgctcctggacggactatatgggaacgtacacgagggcacggttgtaggggcctatcctgctggtcatgatgatgataacatcctctggaagatcgaaggcttcttgtccaatccctgatccagtcgatctctgctgatgaagagcaataaacaaagcccgatccgtcctggccacctacatgtttggatcagcctggagttccattcaaattgtgtcctgtttcctagagtttgtttcaaaatatcatctgcttggataagcttacatgttttaaattcccacgtagaataaacacacgcctgtgtgcacacagaatcatatgatatatgtgtacccatattgtattacaacgttcattggagac

SEQ ID NO: 7528 - DNA, 633 bp, Sorghum bicolor
  Clone ID: SORBI-28MAY03-CLUS89084_1
gcacgaggcagccattgatcgaaaccttcttgtgccaaatggaagctatgtcctcaccgccaacaactgtgtcatgtgtggctgcagctctagcacctggcagttggactgccagccaacacagggattgagctcgtcgttctgccctgctgccaagtgtggagacatgttcctcggcaacacatcctccacctcatcctgcgagagcacgacatgctcctacgctgggtacaccaacaccacatcgttcgccatcctcgccaatgtcaccaccagcaatgtgtgcaacgctgggatgtctccagtggcgcagccggtccactcctcggcgtttcggttggagcgggcgtggttgagatggacggagctcgttttctctcttcacgtcgtcttggtttgtctaggctatctgcggcaagactgaacgctgttgccttgcgaatgtcgtagttctggtcctctgattcctagtttgatgctgtgagtagtatcttttcagtgtttgcgcgactttgatctgtagctggttggatttgtaagtgcataccctagggtaaaacacttctgtgttagaaggtagatcaggaaacatttgtacttcgtcaaacttttgcaaagatacttttttctgtt

SEQ ID NO: 7529 - DNA, 633 bp, Sorghum bicolor
  Clone ID: SORBI-28MAY03-CLUS8934_1
tgctgccattgtggccaaaatggaattcattcagcatgcggatagagagactgactggtataaagaatcaaagaagtccggtgtcatcattcaagatgaaagaagtataaaagtaaaaattctgcaaaaagggcttccgaaaatattgaggagtcttaaggctgaacttggcaagcgggcagaaccatttatatatgatgagggtgatgctctcaacatcgtgaagcacattgaggatatggcccgtggaggagaagacctcggataaggcagggacttcggattcatcccaagagctccgcgcacacttcgcgagcctgcaccacggagcccgcctgcgccacctagcccgctcagtccaccagattcaaacaagtccgatccagattacgaccctacacaggatctgtctgactccaacgatgcagattatgaccctaccctggacccatagatttaggtctcagtttcagttccattgcacttatgtttcagttcctatgagataggcactcatgacatgtaggtaggccttgtttacttccaaattattttgcaaaatatgaatagtgacgctttcgtttgtatttgacaaatattgtccaattatagactaactagggtcgtctcgtc

SEQ ID NO: 7530 - DNA, 1344 bp, Sorghum bicolor
  Clone ID: SORBI-28MAY03-CLUS91148_1
gccgcgggtaaggcgcggcggttcgacctcgcgtgggcggtcgtgcggcggatgcggaaccgcggtgtgctcactggccgcgccatggttatcctgatggagaggtatgcagctgccaatgaagtaaataaagcagtgaaaacatttgatgtcatggagaagtttaaagttgaatcagatcaaagtgtattctactcccttcttcgtgctctttgcaaaagcaaaaacatagaggatgctgaggagttgcttcttctgagaaagaaattcttcccacttagtgcagaaggtttcgacataattctagatggttggtgtaatgtaatcactgatttggctgaagcaaagagagtttggagagaaatgtcaaatcactgcattactcctgatggcatgtcctatactctcatgatcagttgtttctcaaaagtaggaagcctttttgatactctaagggtttatgatgagatgaaaaagaggggatggattcctggtattggtgtttacaattcacttgtctatgttctgacaagagaaaattgtgtgaaggatgcgcataatatattcagcaaacttacagatgaaggcctccagccagatgttgaaacatataacagtatgatagttccactctgtgaaagttgtaagcttgatgaagcgcgagtggtgatggaaagcatgatacttaagggcattgttcctaccatttcgacttaccatgcatttttgaagcaagaaggcattgacgaatcactgaagctcctgcagaaaatgaaggaggatggttgtggtccaaagagtgatacatttctcatgctttttgataaatttttcttgctgaatgagtctgggaatgctctaagagtgtggaatgaaatgagaaaatacaagatcagccctgtccgttcacactatatgacagtggtcgaaggtttagtaaagcatggatgtataccaagagctttagagtactatgacgaaatgaaggaaaaaggttttgcctttgatacacaacttgataaggaatttaaaacctttttgttgaacaacagagaccactggagaggagcaggcaaatacaatatcattccccagcgtggcaaacattttgcgaagcggtcaagaatgtaataacaaatgtggttaaaaatctgcttctagtgcctttgtgatatgaggactatttcaacaaagttgaatatggaccacaatgtgaggtacatttagttaacctgtttgtgaaccctgaccaacggcaaaagaagaaaatctgtgtgaatctaattgtaaaaggataataaacatggctgtagcctgttttttctgaaatagttgaactcagtt

SEQ ID NO: 7531 - DNA, 673 bp, Sorghum bicolor
  Clone ID: SORBI-28MAY03-CLUS912_1
cctactgggacaatccatctaccacgcgttcttccacctgctcctgcctcctgcgccccaaacccacctcgccgtcgccgtcgccgtcgccgcaggccgcagcctgttcccggttcccgcctcgccgtctaccgcgtcccgcagcaacggagccgcggcacctcggattcgcctcagcttccgcaatcctcgccgtcctcctgctccgccgcccctcccgtgtactggcgctggagctgcagatccaccgcgacctggcgaccgattcctcctcgcgctgaagaattggcgaccttggaggcttggactccgcccccggcggcgcggagggggtcaactgtggtagcaaccaccgcggaggctgcaagcctccggtaagggagggaaattgacttcttggaagccggaagccggtcccgggccgcgatggcgtcgatcggcggcggcgcgtcgtcggctgccgcgaagaacgagtcctacgtgcgcgccgacaagatcgacctcgagagcctggacatccagctggagaagcagctggccaagacctgggggaagcacaaggggtcgtacaaccaggggcccagggaggactgggagatcgacctcgccaagctcgagattcgctacgtcatcgcgcagggcacctacggcacggtgtaccgcggcacgtatg

SEQ ID NO: 7532 - DNA, 643 bp, Sorghum bicolor
  Clone ID: SORBI-28MAY03-CLUS91309_1
actcgtccaggagtagagtggaaatcaacggccatggcagcagaaacggcgaaacttccaccccaccttcccctcctgctgcgtatatatactcgccccggctcccacctcgctccagtctagacggcggtttgactttctgaccggggaatcggagctgcgtttgatttgatttgaggagaggagacgcagacgagacgggagggatcttcgctggggaattcggaggagcgtttgcccgattcgtcgcggttctcggaggaagggagggtgcacatcgggctccgatcgaagagctttgttaacatcggaggttaaaaggtagcactgtagcgcaatgaaggcaccatcactgctggttcagtgtttccctggcttgcttcccagcaaggccactagttgcgtgccaattatatctgagaaggatctgcagctaccatcaccagctgttgaaataatcccctcaaagagtgctcatccatacaaatatgctggagagaaggttgatgtgcaaggtcttgatattttcaagggtaaagtcagtgtagcggatatgatagccttctcaccgtctgaagtagcatcatcaaaatatgatggaactctgaaatactgggagagttccattactcttgtcaacatt

SEQ ID NO: 7533 - DNA, 628 bp, Sorghum bicolor
  Clone ID: SORBI-28MAY03-CLUS9143_1
gcacgaggccaagatgaccctggtaatgacatgtggtcaatgccttcaccaacgcccgggctccagacttcatcaggtcttggagctgatggaaaagacacttcatgcatcgtagaggaggcgagagcggaccaaggagatggtgcttttgtcgaaacattaccaacacaaggggataaaaagatggaacatgcaaactcaagtgcctcaggttctttagtgccagaacaggtaaaaccaaaagcaagcactgcatcaggtctatctctagatgggagcacaaaagctttgggttggcaaccgccaggctcatctctagaggggagtgcaaaagcttctggttggaaaccaccagccttatcacttgcagggattggtaatgctgcaggttcacaagcatcgtgcccctctacacaagggagcacaaaatcttcaggttggcagcgaagttcatccccggatgggagcagaaaagcctctgcttggcaacggtcaagtacatcgccagaggggagtggaaaagctcatggctggcaacgatcaagttcttttacccagggggggacaaaatctgcaggttggcaaccctctggttcttctacagatcggggtgcaaaagttgatggct

SEQ ID NO: 7534 - DNA, 655 bp, Sorghum bicolor
  unsure (1)..(655): unsure at all n locations
  Clone ID: SORBI-28MAY03-CLUS1016_1
gccggccgggccggcattcgcaatcgctcgcagtctcccacacgcccccaagcaagttgcgcatccatccatggctggaggcaagtccggcggcaacgccgcgcgcagcaggaagcgcgtcgaggccaccgtcctcaagcgctccagggacggcagcgcattcaccagatgcgaggcctgcaacaaggatgtccccgtcgtcctcatcgacatgcacagctgcagcctcgacaagcacatcaggatgatgctcgaggcgcaggtcgtcgagaagaccgtcgaggtcgccgccaagcccgccgaacgcaacaagtcctccgccaagggacacggaggcggcggcaacaaggatgccaagcgcaagcgctcgcccacagccttcttcctcttcatggacgacttcaggaaggagttcaaggccgcccatcctgacaacaagagtgtcgccaccgttgcaaaggaaggaggggagaagtggaagtccatgacagacgaggagaagaagccttacgttgaaaaggccgcggagctcaaggctcaagccgagaatggcgagggcagtggtgagaacatgttgccaagaagaaagccaagcagatgacaaggatgnnggagcagaggtggatcagcctgcaaagagcgcatcaggcgcaag

SEQ ID NO: 7535 - DNA, 843 bp, Sorghum bicolor
  Clone ID: SORBI-28MAY03-CLUS10171_1
gcacgagggcaccgcctcctcggcttggtcgcgtcgcctcgcgtccactccccaccacctccgaactccttccccctctttcccaaatcgagcaggcggcggggagcccggcggctcggtttcttgggtcccagattcaatccctctccgaatctcgccgccggcgtcgctaccacggatcgccgtggaacaccgaggttgtcgcgggtttcggcatgctatagtcgccagcctgcagcggcgatcgtctccgagccgggctagccatgtcgtgggggcggttcagattcacccctcacagcgggctcagccggacgcggtggacgcgggtcttccccgcgcagaagtccgcgccttgcaccgtggtgcttagcgatgaggacgatgatggtgacgatacctccgactcggatgttctcataatcgacgacgcagctgcgggagaatcagcttctgcggcgggacgtggatctcaagccaggaaagggaaccactcctccagtaacgtgatcaacatagatgatgatgaagacgaggaagatggtaccagaggggataaagcaggtcccagcatgtcccgtgcttctgggtctccagcagctatgacaccgggtcggggttctccacggaacagatatgggattgggatgaatgggatggattccatgtccgacagctctgagagcgatcttactgaaggatgggactcttacactgatgatggcagctctgattgtgagattctcgatgacacttacactgatgatggcagctctgattgtgagattctcgatgacactggtacaacacgtaagatgtgggagacagctgcttccagaaaaa

SEQ ID NO: 7536 - DNA, 614 bp, Sorghum bicolor
  Clone ID: SORBI-28MAY03-CLUS92305_1
ctcgatatggttggatgacaattgggtgccaaagattgctgattttggactctcgagactctttggcaaagagcagacccggatgtatacagtcaatgttaagggacataagtaagcagaaacaaactgtgaaatactcgtataggattacatattcattctatttactataagtaaacgccatttgattctttgataaactattgcagtgggtacatagctccggaatatctatacagaggtgaaatctccaccatgtctgacatatactgttggcgcgtgtttgggctcgtctgttcggccagcgtgccctgctttccgccttcccctgaccgctctgcatgacaccccgccccgtagatacatcaaatctggaagacagatgagcaaataatgtacaagtacccatcactggatccaaatggccttcagcaagtaaaagcatgcgttgtaattggactgaagtgtgtcgaagctgatcggaacaagagaccttccattgaagatattgttaataagctcaatgggagacgtgtaccaatttttgaccaggtgtgaacaattgaaacatcgttacagtttcattgtgtcgtgttatgtattaaggaaaaaat

SEQ ID NO: 7537 - DNA, 437 bp, Sorghum bicolor
  Clone ID: SORBI-28MAY03-CLUS9232_1
cccacgcgcacgaggccgccacaaccaaacgcacccgcacccgcgccgctcgtcctcgtctccaaatccctcctgcacgggcggcggctgcacagccgtagccgtcttcgaatcctcggcgaatctactcctcagtcggtacgaaccgctctctacctcggggcagagtgaacgcgcggcccgctgctcgtcgtcagcagcgaggcaccaccgcagcagcacctccgccacccgccccggcgagcactgtccgctgccgcgcgccggcttccgcccacgggtgcattcgatccgtaccggccgcctacactacacgatgtccaagtcgggagcgctggatcttgcttctggcctcggagggaagatcgacaaggagggagtgaagtcggccgtcgatgagtatgagaaatatcatggttactatggagggaaggagg

SEQ ID NO: 7538 - DNA, 778 bp, Sorghum bicolor
  Clone ID: SORBI-28MAY03-CLUS90361_1
cgccttgtccagcggcagctcgggcctgatgaagcctgggaggcagcggcagcgtcagtctgatgccttgtccaggtggatcacatactcgatgcagtcctccacgttgtaggcgaggtcacggacctgtctcacccaggtcctcaccacgttgttcctggcgcgttcctcgtctgcgacattgagaaaggattgcatcatctggaactcaccagtgatgaatgccaggtcattctgcgtgctcttcctcagggttgcctcctcctcaattgccgccagtgccttggtcacagccccctccaccgacttggccaagctcactgcatggtctgcaattgcttctcccctgcctgtctctcctagatactccagcttgtttgtctgtggtagcaggctagtgattggtgatgctaatgctggaaggaattgtgcaacctcatgggaacagatggggatatcagctaggcatgaacagagtttgggacattggaaagcaagtcttgcctggccagatccgtgagctgagttggatctcacacatcaacttagccgttgactagcaaaacacagtcgccccttgagccctaactttcagttttcacatatgtgcagtggtgtttctgcaactatgtcataccttaatgatgtggacctgtaacctgtttggaaaagagaatatttcttgtcaagtggagacagattgatcggtaattcggtatgtgttatgtgtgcttcatggaaaagaacattttcataataacaattaaaagaacgccac

SEQ ID NO: 7539 - DNA, 667 bp, Sorghum bicolor
  Clone ID: SORBI-28MAY03-CLUS90408_1
tactgggactctagctgccgccatggcggagtcgtcgagctcgaggggcaagaggataaggttagaggaggaatcccaccgattcggaggagatcgtggggaagaaagtatctatgccgatgagatcgggcgcctccccgacgacgtgctcacaaatatcatcaccctcctctccaccagagacggcgcccgcacgcaggccatctcccggcgatggcggcccctctggcgcgccgcgcctctcaacctgcaggtggatcgcagcctctccggccaggatcgcaagcgtatcatctttgtccctaagatccttgccgaccaccccggcccagcccgccgcttggcactccccatgatccgccttcgcaaccgctacgcccagatcgacggctggttgcgctcgcaagctctcacaggcctccaggagatcaagttctgctacgaggtcgaggacccggaggtgccgtaccctctgccgccttctgcgttacgcttcgcgcccaccctctgcgtagccgagttttgctgctgcgacttccccaatgagatggcgctgtcgctgaactttccctgcctcaagaaccttactctgaacagagcctccatgtcggaggccgcccttcactgcctgctgtctagttgccctgttctggagagcctctggttg

SEQ ID NO: 7540 - DNA, 1084 bp, Sorghum bicolor
  Clone ID: SORBI-28MAY03-CLUS90499_1
gcacgaggctcagaagaaccctcagtttgtcagcaagctcattaagatggcagaggcatccccaatcttcgcggatgcatttcacaagaagcgaaggctacctgggtttgaatacatcaccgaggccactgaaactgccactagcttttttgatgaccatagcagctcttccaggcaagaaatgggcaaccttctgaatcagcacttctctgacaagctgaagcttggactctgtcctgcaatgacggaaagcaacctcatcaccctgagcacccaaagctcacatgaagataacggaagccctcatggaaagcatccagactacgagagaacagccatggagtgccttccactggtgccgcagatgatggagctctctgacactgggacatccatctgtcccgcaaagagtttgagcttcgcagcagctgcaaatgatgatgggttcttgccatgccacctcaacctcagtcttgcatcatgctcaatggatgtgggcagaagccaaatccccgttgcaaacgggaacattgtggatgagaaggacggcccagcggagatgaccacacccaccatggagaaggtcggcagcattcctgacagatgccatgatgccgatacccagaacgaggcttcaggtgacgctggggccgcagcagatgcaacgggtaggccgcatcagggcagtcaagctccccctgaagaacatgcagctccccaggtggtggcgaacgacaagttctgggagcagttccttaccgagaggccgggctgctccgaggccgaggaagcaagttccaccctgaggagggatccagaccacacgcagcaggcggaccagggaactacaagtgacaggagagatatggggcagctgaaactctgaccttcagtttttttagcatgacctcttcctgaaggcgacacagtcgtacagcgttaagtgttggaaattggaagaatggcacgatggtctgtctgtctatgattgattgtaactaaacagcatcacaagaatgtcctgtacatattatcccaggatacataccggagattgagagcaatgcgattttgtgctgttctg

SEQ ID NO: 7541 - DNA, 532 bp, Sorghum bicolor
  Clone ID: SORBI-28MAY03-CLUS9066_1
ctcaccagtcaccaccgcacggcgcccccctggaggcctggaccacccaccgtgacactccccaccaccaccacccacgccggcgctgaggcagcccataaccgccgtcaccgcctgcccggcccctcgctatccgcgccgcatggccgcctcgtacttcaaccactcctcatcctcctacccgccgccgcctcccccgccgggcacctccccgtacggcgcgtaccgccacgcctacccgccggcgccggcgccggcacccccggccttttacggcgcctactacgaccgcgcggagcaggctctccccgcgcgggacgagctccgcaccctcttcatcgctggcctccccgccgacgccaagcggcgcgaagtctacaacctcttccgcgatttccccggatacgtctcctcccacctccgcacgggcaaatcctcccaggcgtatgcgtttgctgtgtttgcagatcaacagtctgcactaactgccttgagtggcacaaatggaatggtgtttgatcttgagaagaat

SEQ ID NO: 7542 - DNA, 659 bp, Sorghum bicolor
  Clone ID: SORBI-28MAY03-CLUS90795_1
tgccccgtctgtcgccaagagcttccggccgcagccaccccagatgcggaggcggatgctgggctcaccatatggcgacttccacgcggtggatttgccgtaggcaggttcgccggtgggcctagagagcagctcccggtcgtctacacggagctggatggcggcttcagtaacggggttgggccgaggcgggtgacatggccagagggagaaggacaagtggatggtggtgaaggtcggattcgccgcctacttaggaatctatttggctgttttggtcagccagcgagttcgtcgcagtcccgtagtggctgagcacagttttccttggtaacaagttttcaattgatagcactgaagaactagggctagtgtaagaatggaacccagattataatttcttggggcttttgatgtaaatgaaggcctagcattcccccttcctttgtctcatttaagaattattaagagatggctatgagcaaacatcttggagtaagctttgcaaccaaattaggtcaaacgcacaagtgcaaaccttcaagaaaggaatagcaatgaatgttttggggaaatcaatctttgtcaatattgtaggtagagagaacaattgttgtatttgcatcctggtgtttgtgtacatactggattggttgaac

SEQ ID NO: 7543 - DNA, 690 bp, Sorghum bicolor
  Clone ID: SORBI-28MAY03-CLUS9081_1
gaagaggaagttaagtgattatattggagagctaaatgcagctgatgcaagccttcgagctctgaagaggttagcaactgccaagaaggctgaagtttcatctgatgaaactggtaaaattttatccgatgaagattttaaacgcatcaaagaactcaaggcaaagaaagaggcaaagctggctttggctcaacatggactaatcaagggtggtgacacgagatctgtaacctttaagatgccatcttctgatcaactcagtaggaagcgtgttgatccacttgagcttgaggctcacgtcaggagaaagatgtcgaaggaagaaaggttagcgttagtgaaagctgggagagaggatagaggtgcatacatggcgagaacggctgtgaaacagaaaaagaccggtggcctgagcaataaacagaagcagcacaagaagaggatgcccctggcagcgactagagccaaggcagcacgttcccggcaggagaagaagcaacagcgcaagcgctctgggaatcagtttaggggccgcaaggcgtggaaatgagcatgagctgctactttgcaattcatctagccaaatggccaaaattttgactcttgtactactcagataatgtttccaggcagttttcccagggcatgtggggctgggcttttctttggatgtccagccagttatcccag

SEQ ID NO: 7544 - DNA, 725 bp, Sorghum bicolor
  Clone ID: SORBI-28MAY03-CLUS9275_1
cccacgcgtccgcaccattacagcaaagcagagcaggtgcaaaagctctcaagaactagctagcaaaaggcaagaagctccgagctgaggaccggagaaacgtacaagaaagaacagcagaaacaatgaggccaggagcagggttcaatgcgacggcggctgcggcggcgaaggtcgccgcggtcgcaccagcggtcgccggcagcgccgcggcgcattccgcctggcactcgccggtgccgtacctcttcggcgggctggccgcgatgctggggctcatagccttcgcgctcctcatcctcgcgtgctcctactggaagctctccgggtacctggagggcggcgctggccgaggcgacggcgacggcgacggctccggcgccgacggcgccaagccggcggcctcggacctgccgccgccgatatgggaggagaagatactggtgatcatggccggggatgtgaagccgacgtacctggccacgcccatgtcgagcagggcgtcctccttcggagaccgcagcagcaagggtgacgaggaggagaccaagaaggtgcaagaagtcgccatggccagcatcgtcaaggatgccgagcagaatggtgagcacagtgagagcaggagagaaggagaggagcaccgcattcctgaggtgtgatcttcactttttgaagaattttagtttaggtttgttttgggttttcgatcggtggagtggaatgat

SEQ ID NO: 7545 - DNA, 666 bp, Sorghum bicolor
  Clone ID: SORBI-28MAY03-CLUS92927_1
agagcctggggtccctgtggcgcgtcatgtgcccgaccaccacgggggaggacgacccgctcatcaacccgttcgtggacggcgcgccgccgctggcgtccctggcgtgcagccgcgtgctcgtgtgcgtcggcgagggcgacgtgctccgcgaccgcggccgcaactacttacgaccggctcacggccagcgggtggcccggcgaggcggagatctggcaggcgccaggcaagggacacacgttccacctcctggagccaagctgcgacgaggccgtcgcgcaggacaaggtcatcagcgacttcctcaaccgctgactcgcctcgccggcggtggctggtggcgttgttggatcaaatttagcttcgttcattgtatactcggagatcggaataactgcagcttcgtcgtcgcagatgaagattgctggcgctacactacattactttacttctatagtagtacatttcaggttcagaagttgtgtttgtattctttgaaattgggtgtaaggatggatgaagggggatttgccattgttagtaggcaatggtgctcatgtattgcacctggtaatttggggatgacgatacagtcatagtgtcatacagatgaaattatacttgttggacacacagaatttgttgaaacatgtatttatccaa

SEQ ID NO: 7546 - DNA, 713 bp, Sorghum bicolor
  Clone ID: SORBI-28MAY03-CLUS9281_1
tgggctcgcagccttcctcccttcccttcccttcttggtggaagtggattggttgattgatcgcacagaacacagaccgagctgctgcacgcccgcctctcttctcctcgcggagcaggcaggcaggcaggcaggcaggcaggctgggattcccgtccgcggcgccggcgttgaagcagcgcaggagttaggagctttgcctgcgaccaaggggggggaggtggtacaccgccgctagggcagcaagaggggaggaagaggaaggctggcgtccggcatggcgagcgaggaagtgctccataaggtccagaatcttatagagcgttgccttcagatgtacatgaaccagaaagaagtggttgatgccctctctcagcactctaagatagagccttgcattactgaacttgtttggcgacaacttgagcaacaaaatcctttgtttttcaaggcatactatatgaggctaatgcttaagaatcaaataatggtcttcaacaagcttcttcaggatcagtttgagattatgaataaagatttttcttcagggatcccttctatgtctcttcctaatggatctaattccaacctattgaagcaaaatccatgctttttgccagagactgctcctggatctgcaatgccagatggtataatgcacaatggaagttcaagtggtataataaatggcacaccatctggcaatcaattgc

SEQ ID NO: 7547 - DNA, 466 bp, Sorghum bicolor
  Clone ID: LIB3476-060-P1-K1-F11
cttcccttcccttcttggtggaagtggattggttgattgatcgcacagaacacagaccgagctgctgcacgcccgcctctcttctcctcgcggagcaggcaggcaggcaggcaggcaggctgggattcccgtccgcggcgccggcgttgaagcagcgcaggtccagaatcttatagagcgttgccttcagatgtacatgaaccagaaagaagtggttgatgccctctctcagcactctaagatagagccttgcattactgaacttgtttggcgacaacttgagcaacaaaatcctttgtttttcaaggcatactatatgaggctaatgcttaagaatcaaataatggtcttcaacaagcttcttcaggatcagtttgagattatgaataaagatttttcttcaaggatcccttctatgtctcttcctaatggatctaattccaactctatgaagcaaaatccatgc

SEQ ID NO: 7548 - DNA, 907 bp, Sorghum bicolor
  Clone ID: SORBI-28MAY03-CLUS93047_1
tcggtggtggtggtgacgtcgctgtcgctggccgtggcggtggtgtgcgccgtcgtcgtgctctgcatccgcgaccagctcagctacttcttcacgggcggcgaggcggtggcgcgcgcggtgtccgacctctgcccgctgctcgccgtcacgctcgtcctcaacggcgtgcagcccgtgctctccggcgtcgccgtgggctgcggttggcaggcgttcgtggcgtacgtcaacgtgggctgttactacatcatcggtgtgccgcttggtgtcttcctcggcttctacctcgacctcggcgccaagggcatttggagcggcatggtgatcgggggaaccatgatgcagaccctcatcttgctctgggtgaccagcaggaccgactggaacaaggaggtggagaaagccagggcaaggcttgacaagtgggatgataagaagcagcctctcctagaaggctgaagagattgatacctactcagatccggtgataaaaatctgccatcatcatttagaacaagactcgagaaagagcgcacgctagctcagtgatttttgttggaatcgtgagatcatgagacgagaggagtaagatgtcgcagccaaataattaaagaggaggttcttcgtatttatatatcagcagctgttttgcatgatttttggggtctgtaatatatgccttcgagagaaacatcttttgttcaatgatgaaccaagaggcaaggagaaatgatgaagtacaacgatttttgctaccacgaaataaaaaaaattgtgatacacattgactatcccagatgtgtgttttaagatgtatgattgtacacttctcaaagcgaatctaatgggtgaaagaataagggtatgtgcccttaagggcaaaaaagaaccgccctccacagaa

SEQ ID NO: 7549 - DNA, 698 bp, Sorghum bicolor
  Clone ID: SORBI-28MAY03-CLUS9152_1
gccggccgggcttccatctcacctttgactcccacaccagacgccactccaccaaggcgccgccgccgccagccttcacggcttccatctcaccctctccccttcaccttccacttcctgcacgcatcacccacctgcatctgcatggtccacgcagtcatgcggtgagtgcggagtgcctgagcctgcacagcgtgctgcgttccaaggagagaagagaacattgtcatctcaaatccggccagaaacgattgagcaacggagccaataatagggtcgggatttcatctgtggaggtgcggctcaaatctattcgagcttgctcctgctgtctgatgattccagcgttctcctgctgtctacatcagagtactactagatcgatctacaagtgcaacgtgtatgtaaacatgcttcagtgcttgtacattggagcttgctcttgcttttgccctctagatctgtgtgctactagatcttctgtgagcgcaacgatgtatgttcaatgtattacaattttgtgcaatggtgctttttgttttggaaaaaattattggaatctcctggtgttcaatttctctcgatcttgcactcttcaaaaattgtaattttctatgtctgtcactggaacggggacggggatctccacggggatggattccccgctcggggacggggacgggggaaactcaagcccc

SEQ ID NO: 7550 - DNA, 569 bp, Sorghum bicolor
  Clone ID: SORBI-28MAY03-CLUS9189_1
gcacgagggagagagaggggttttcttccttcagtgcccaaaggagatgagttcttccagtaccaagtagtcctactagttctactttttagcagtaggaggctggtgtttgctgcgatttcgattggattgagatgggaatcgtctgcgtcgatgcatcctccacgctgctctgcgaggaggacaggagcaacgcactcggcctcgtcggctgctgcgacgagctgctagaggtggggagcggccttgatggcttggactccgccgacggcgccgtgttgcccgtgcacaccgatgaggccgtgtcggcgttggtggagaaggagatggaccaccaacctcaagagggctatgcggagaggctggagcgcggcggattggagtcctcctggaggagagacgccatggattggatttgcaaggttcattcacactacagctttgcaccactcagtctttaccttgctgtgaattacctggatagattcctctccttgtatgagctcccacacgataagccttggatgcaacagttgttgtcagttgcttgcctatctcttgctgtcaag

SEQ ID NO: 7551 - DNA, 768 bp, Sorghum bicolor
  Clone ID: SORBI-28MAY03-CLUS91950_1
gcacgagggtcataattgttgtgcatcaaacaagtgtatctgcaggccatgtgaaaactttcttaaggtcacataacactatagagttattgtcagacaagtgtaaagtcaacacagcaaatcggttgatctcagagtttttgttctcctcggttagcccaagactgataaagcttgagaagatcttgaagacttggtttagcaaaagaaaccaccataatagctcaatgcacttcattgaagctaaagtggcatcaataccgttggtgaaattccgtttggagtttgaaagggacgtcactgaagaggatcccatctgggatgatgttccagagtggaaaacgagacccatggtccggcgagtcccagttgacattatagccgaagtggaagatgacgataggttgaaggctatttcagtgaagaaggttagaaggcagtttccagtagtggacaccactacttggggcagcctggcttcaaatatttctttcacaaagtttctgtcattcattttgccaccagaaccgctgtcgctggatgtgaagtggtagtagattttgctctgatatactagtagggttgataggaaattgcacatacacatcgatttcatgtatacttaggctggaagtgtgcctgaaagtgaaatgggctgtaacataatgttcaaattttgtattgcttctggcaattgtgtgggtacaatcttacattattcatactgccttctgccaatggctgtctttagcacccttgcatgttttg

SEQ ID NO: 7552 - DNA, 736 bp, Sorghum bicolor
  Clone ID: SORBI-28MAY03-CLUS9196_1
ccgtcgcctgcctcccgtgccttgccttctagggtttcccccgtcgtcgactccttcctctccccagatttggcgcgtgggcgccgccgccgccgacccaggttgtcttgatggcgcccgctgtggaagccgtgaaggagacaggctcgttccaaaaggttcctgccttgaacgaaaggatactgtcaaccatgtccaggagatctgttgctgcccacccttggcatgatctggagataggccctggcgctccaaccatattcaactgtgtcattgagattcccaggggcagcaaggttaagtatgaacttgacaagaaaactggattgatcaaggtggaccgtgtgctgtattcatcagttgtttaccctcacaactatggattcattccacgcacactttgtgaagacagtgatcctttggatgtactggttataatgcaagagccagttatcccaggctgtttcctacgtgcaaaggccatcggcgttatgcccatgattgatcaaggagaggcagacgacaagatcattgcagtgtgtgctgatgatcctgagtacaagcactacaatgatatcaaggaccttccacctcaccgcttggctgaaatcaggcgcttctttgaagactacaagaagaatgagaacaaggaggttgctgtgaacgactttctgcctgcaactgaagcttatgaagtcatacagcactctatggatctgtatgctacctacatcgt

SEQ ID NO: 7553 - DNA, 750 bp, Sorghum bicolor
  Clone ID: SORBI-28MAY03-CLUS9200_1
caaaaggcaaaagagaaagaagagaaaaaacttaaggcaaaacaaaaggaggtggctaggctccaggcacaagcaaactcagatggagcaaagaagaccgagaaaaaacaaaggaagaaagctgtcgaggatgaaaatccacaggatttcatagacccagacactcctaatgggcagaagaaattgctcgcatctcagatggccaagcaatacagcccaagtgcagttgagagatcatggtatgcctggtgggaatcatcaggatattttggggcagatcctgcaagcacaaaaccaccatttgttatagttctgccacctccaaatgtgactggagctcttcatatcggccatgcacttacagtggctatagaggatgctatgatacgctggcgtaggatgtcaggctacaatgctctgtgggtccctggagtggaccatgctggcattgctacacaggttgttgtagaaaagaagcttatgcgtgaaaggaagctgacaaggcatgacatagggcgtgaaaattttatttctgaagtactcaaatggaaagatcaatatggtggtaccatattgaatcaattgcgccggcttggggcttcacttgattggtcccgtgaggctcctgccttggacgagcgatgagcaaaggccgtaactgaagcttttgtcaggttgcacaaggagggcctgatatatagagattatcgccttgttaattgggattgcacacttcgaactgcaatttct

SEQ ID NO: 7554 - DNA, 658 bp, Sorghum bicolor
  Clone ID: SORBI-28MAY03-CLUS92208_1
tccctcctgccccgtcaagaagaaggtgcagaggagcgcggaggacagctccttgctggtggcgacgtacgagggcgagcacaaccacccgagcccgacgcgcgccggcgagctccccagcgccgcctccgcgacggccagcggccccgtgccgtgctccatctccatcaactcctccggcccgaccatcacgctggacctcaccaagaacggagggggcggcggcgtgcgggtgctcgacgccgccgaggcgcccgacctcaagaagctgtgccaggagatcgcgtcgccggatttccggacggcgctcgtggagcagatggcgcgctcgctgaccagcgattccaagttcacccacgcgctggctgccgcgatcctgcagcagctgccggagtactagtgcctagcgtccccccttgtttttagtactctagagtgttcgtcttcaaagagcggttctttcatcatcaggaaaggaaaaccttggtaggaacagttttacgtttactgagattagagccaaatctccctcaaatttatagtcgtaatttgaagtttctttgttctggttaggatctgaactgtactagcactgtacatctggcatgtccatagaccatagttccatcacgaatataaataaggaccactgccaaat

SEQ ID NO: 7555 - DNA, 657 bp, Sorghum bicolor
  Clone ID: SORBI-28MAY03-CLUS923_1
agtcttgtccggagcgtcccatctcctccgcgagcttgcgcctaaaccctagctcgcttcccgatggcgccgaagaagcgcaaggccgatcccgccgagtccgccgccgccgcggaggcagccgcaggcaaccaccgccaggagccggcgtcctcggagcccaagccccgcggcaccatctacttccccatcaccgacgacccgcccgagtccactgcccccgacgaggacgaggacgacggcgccggcgacgatgaggacgacgccgaggacatcgccaagctgctcgagccgctgtcgcgggagcagctcgtcgcgctgctccgcacggcggcggaggcgagccccgccacgatggcggccgtgcgccgcgccgcggaggccgaccccgccagcaggaagctcttcgtccacggcctcggctggggcgccggcgccgaggacttgcgctccgcattctcgcgcttcggcgagctcgaggactgccgcgtcatctccgacaagcagtccggcagatccaagggctacgggttcgtcctcttccgctctcgccgctctgcgctccgcgccctcagccgcccccagctccaaatcggaggccgtcttgctttctgccacctcgccgcctcaggccccgcgcccccagcttctcagtct

SEQ ID NO: 7556 - DNA, 672 bp, Sorghum bicolor
  Clone ID: SORBI-28MAY03-CLUS92091_1
gatcatcaatttcctctgtgccacaaagccccattggtgtactggatgctgcatcctgtctgagtcaacaaagcgatgatgctactggtggttctcctgcagtatgttaccatagttcttcgacaagcaagaggagaaggattactaggcgtctgctctaattgtgatatgcttcaggtgtgctcctcaccgctttaggagtttttgattggtccaatcatcttaaatttagtttggccgcctgaggattatggtttagtcaagtagttgctcaatggaacaacaaaacatgcacactacttggttcataaagaagaaaaaaaataacaagcagcgtcctgtgagccagtgctgcaagccagttcatgcaattggcatccgtaaggggaattcaagaccctagggtccagggatgctggtgtaggtagagagggaacaaggaacttacatacgctgtagagatgagagctctctcgtaccattttgtacttttgctccttcaatttgcaatgaactttaggcaaggattgccttgggcattgaacatttgtcgagtgagaagaatccaaagatggatgcggcagaggaatagaacaatttgatatatttcatgaactacagatatatattttcttttcttaatgacgagctatcattttgttgatgataata

SEQ ID NO: 7557 - DNA, 822 bp, Sorghum bicolor
  Clone ID: SORBI-28MAY03-CLUS9333_1
ctcggtcagtgctgcgagctgccggtcgggtacgtgcaggtgcccgtgggcatcgcgggcccgctcctgctcgacggccagaggttctacgtgcccatggccaccaccgagggctgcctcgtcgccagcaccaaccgaggctgcaaggccatcgccgagtcaggcggcgccaccagcgtcgtgctgcgggacgggatgacgcgcgcccccgtcgctcggctccccaccgcgcgccgcgcagccgagctcaaggcattccttgaggaccctgctaattttgacacgctctccttggtcttcaacaggtcgagcaggtttgcgagactgcagggtgtgcagtgcgctatggccgggaggaacctgtacatgagattcagctgcagcacaggggacgccatgggcatgaacatggtctcaaagggcgtgcagaatgtgctggatttccttcaggacgacttccctgacatggatgtcattagcatatcaggtaacttctgttctgacaagaagccagctgctgtgaattggattgaagggcgcggaaagtctgtggtttgtgaggctgtaatcaaggaggacgtggtgaaaaaggttctaaaaacaaatgtgcagtcactggtcgagctgaacacaatcaagaatcttgctggctcggctatcgctggagctcttggggtttcaatgctcatgcgagcaatattgtaacggccatcttcatcgccactggccaggatcctgcacagaacgtcgaaagctcccactgcatcacaatgctggaacccataaatgacggaaaagatcttcacatatctgtcacgatgc

SEQ ID NO: 7558 - DNA, 695 bp, Sorghum bicolor
  Clone ID: SORBI-28MAY03-CLUS9342_1
atatccgactcgaattcaatcgaaatccctacctatatcttctactgtttcgttgtgagggtgatggaaggcctgaattgggaggcggcggagacggaaggagagcaaggccaccaagccatggatttggagatgacgacctcgggtaaacaatccagaggcatcggctgcgttctcgatttcatcgaggagaatcctataggggtgacaatcttcccggcttccctcttaccaccgctccatgctgacgacggtggtgcgagaagcggcggcggcggcggctgtgttctactcgatctcaaagcctacatcgccgacttcaccaacgagacgaccgccaaggatttcacaagcgccggccacgagatgcaggccacccttcgcgtcgcctgtccgccacgcgtttcccacctctgcatccactgccccaccctcaagccggctgatttcgggacggagcccgtcatcctcgccgcgtgcgacggcttcctcctcttcagagcggccatctgcaactcctaccactgcgatgagccaacattgcaggactacttcgtctaccgggcaccgctctccaggatgcatggccggccgtcgctcacgcgcctcccacgacctgacctctcctcttgcttcgtcagatgcaatgttggcctcctgcgctacgatggtggcgacagcggcagcaacaacga

SEQ ID NO: 7559 - DNA, 749 bp, Sorghum bicolor
  Clone ID: SORBI-28MAY03-CLUS93464_1
ccgcgtcccgcgcccgcgggccctccggcacccccggctccgcgcccgccgccgccgcggccccccggggccccccggcgcggcggcccgcctcccgccgccgctccgccggcccggtccgctgcggctcgcgctccggcaccgccgcggggtccggctccacggccccccccggcggggcgcgcaccgccccgcccgggaccgcgtgcctctgccggcccccgccgcccgggccccccgccaccgcggccggcgggggggcggcggcctgctccgcctcggcctcctcggcctcctccgagtccagctactggatccagaacttcttgaagagatagatgtggtgtcgatcggcctcatccatctcactcgctggccatgagagggtccatctcgtccgtttccactggttggctcgtgccatgtcgttgttgccaaggggctgaccgagtgaccggccgggtacggtgaattatttgtttgcagagagtgattgttggtttgtatggttgtagtctatggggtcgccattggtgtccgttcttgagtttgagtgtgagtactcctgctagaggggaaataaagctcttactgccgagctatgtcagtcgaacgtacatgtaatgtacagttcggtccctttcaaccaaaataaaccaaggcccgtgtgaaaaaaatttggatttcactgttgtagcacattcgtttgtttgtggtaaatattgtccaatcatagactaattaaggtt

SEQ ID NO: 7560 - DNA, 584 bp, Sorghum bicolor
  Clone ID: SORBI-28MAY03-CLUS92330_1
gtgctataaaaagaaaggatcaaacacgtgcactggatatgataaggagcgacccagagttgatgggtttgaacattatccaagcacctcttgtggacatggagattagagcacgaggggctctcaagtttttgggtgatatagtttggaagtaacttcagttgtgggaaacagtatcagttataagggtgcttaattgccaatatcactgttagcctgctgcacaattgcactgctctgaactaacaatctgtgggcgcttctggtataagcttgagaagttgtttgcagctcctacaatacaggaacatacccccgtacattaaatctgagtagaaagcaccgaattggagggttttgctgcacgcctgcaccttcctttgatgacctgttactcttggcagtgatgtactgatgtcagattggatttagccccaaaaaggctaattgaactgaaatgctgtaatgtttatccgtttagacattatccccaagatagatagcaacacttatggcctttggttcctcgactctggtgctctcttcgtttttccatatgtgcaatgtgaatttgtacaagaaag

SEQ ID NO: 7561 - DNA, 562 bp, Sorghum bicolor
  Clone ID: SORBI-28MAY03-CLUS92323_1
tgaagtccaatcttcagaagcagtttgagatggcggcagtagaagctggtatggccttcgggggcgcctgctcgcgcccttggccagtgtctccccctggtgggagagtggcgtcgtagggggggcgcgctctcgctgctgattagttgtctgtggcttccgctcggccctttgccaccgcagtgtttgaggctgccaccttcggctactccaaggggaagcgcactaaaaaagggcgttctgccagggcccataacaccgacaccattgaagaaggttaagccaaaggcaaaatctgcaaagaaggtcttgaagaagcagccttcatctgctgtgaagcgcttgcgcaaattgcagagtttctcagcatgagttttttggtatatgacgccatgatggtcatatctttgtatcttttttgttttggtttatcattactttattcttatcctttttgtaggttagttttatactgtgttaacttcgctgtcagtcatattcgatggattgcctaatgatttgcgttgtcactgtgcttttatgataatcatgtggtgattgc

SEQ ID NO: 7562 - DNA, 691 bp, Sorghum bicolor
  Clone ID: SORBI-28MAY03-CLUS92331_1
gttctgcttgctgctgttctctgcgattgggaggttcagccacggcctgcccgtcctcgacgcggagacgttcaagacggccgatcccttcattgctgggtggctgctgagcgcctacctccttggtggatttggtgatgatgccaaagggcgcaatggcgttgcaaatgctgttatcgctgcagctaaatcatgggctgttgggataccgttgggacttgctatccgagcagtgacgtctggtcatattccaccaactccttttatcttggtaactatgggaagcacaggggtcttgttaactgcatggcgtgccttggtatcccaacttctttccaaccagcaaaagcagcaggatgatgtctaccggcgtggaagtccttttgagctttttgagttactcacatcactggtgcggaggtggtgacgtctgaagtcagaagctataaaagggcattgttcctatctggtatccgcatcaccaggttcagccacctgtgtgtaagtacaattttgaaggtgaagaagagcatactaaaaccgtttggagcatttgccgaaccaaaaaatgtttggcaataacatgcccgcgatgctggcttagtatcttattcgtaagatgtactcatattcctgatccaccacttgtaaaattgtatctgtagcttaactcatccaaatccattaaacc

SEQ ID NO: 7563 - DNA, 522 bp, Sorghum bicolor
  Clone ID: SORBI-28MAY03-CLUS9239_1
ggagtcctgatttacgccggccggaccaggatccgtgtagctaccgcctactgcagctttggccttcggaggaccatccggctctctctcgtgcggcaactcggcgaccgccgacgccgacgccgacgccctacgccgaggttcccggatttttgtcggtcccttcgccggccttcgtcgcgtccttgccggcgacgagcacccaccaccaccagtgtttgtacacccatgtgctttactaggtccgcccctggagaagactgggatattttgcatacacaaaggatcatctaatcttgcctcctggaggtgtagaggacattcagtttccttcagttcttggatagcaatggcaagtgaatttcctgatgaagttcttaagtctgttttcccattattggatgggaaagatctagtattctgcatgcttgtatgtcgtcaatggcgtgaagttgcaaaggatgattacttctggaaatgcatttgctcgcggaagtggccgtccatttgcaaactgccccc

SEQ ID NO: 7564 - DNA, 1156 bp, Sorghum bicolor
  Clone ID: SORBI-28MAY03-CLUS92418_1
gcctttttttttttttttttagatcataaccgtcgctatgtataattgtatatgagtctatctgtacaagggcaggcaacaccgcaacgctattgccagtgactgccagagggcagaggcagcacagcgtcactggtctctcctgctcttcagtcagatctgacagtgtacatgtacgtatatcctgtgtagtctctgctgcatcggtacatgcttgtctcggctcttgaagacatcacgatcggcacctgatgagctgccattctgcaactgaacctgcggcggagacaaccgcggcgacctggaactattgttgcgagtgcaggttcagccgctcaccgtcgtcagtgacagtgctgcggtcaggaggcacgtcgtcgccagcgacacggcggccgtcgtcgtcctccggccgggctgcagtgccctcacggcggcgctgatgttgtcgccatagttcggcggcgacatgttcccgtacagcggaggggagttgccgtatccggccggtggagagctcccgtacccgggcggagatccgtacgttggtgtcagcggagtcgacgtgtttaggaccgatccaccggtgctcgttgctggatactgacacgtagaagtacttgggttggtggtggtgaggacggcggtgccggcgaagtcgcagctggtctgcacggggttcttctggtagtagctgttgaaggcgtaggacgcgtggtcgcggacggtgtccgggctgaagcagctcccgccctgctggatgggcgagcagtccgcgccgccctgcccgcacgcgtagtccagcgccacctggagcgccgtcgcgctcgcgctggggctcgccacgcaccagctaccgccgccgccggtggccagagacggcgtcggcgtcgcggtgggcatcgccacgggcgtcgccgtcgggttcaccaccgggaccgtggccaggggcgacgtcacgtcgtgctccagcctcggcacctctgcaccctgctcgcttcttccaccatgacagtggcaggagaggaggacaagaagagacgccaagccatggactggcctcagagccatgccaagcttcctgagctcagagtgtgtgtaaagcgagctggccagctgctgctatcactcgccttctactcactgagcctcgtgc

SEQ ID NO: 7565 - DNA, 556 bp, Sorghum bicolor
  Clone ID: SORBI-28MAY03-CLUS9269_1
gcacgaggccgatctccgcaccctgaccggtgaccgcctctattctcccgtcccaatccaccgaccgaattccaaacctgcctagcctaggacctcggcgccgctcgccgcacgtcggccacgtccgcctccgcctgcccttgcaaatgctgtcaagtttttccccttgtgcaataaatatctttgcgctatgaatggatggaatgaagtgggccatgttgtaatgtcttcttcgttttcaatagccaatccgatggggtacgaagagagcaaaaatcatctcctcagtctcagttaccctgagctgcaatgtttgtgcaaaaagtataaccttcctgctaagaagacccactctcagttagcaagtttgctcgcttcgctgcttgaggcatctccatctcctactgcccctcctgtccaattagcaaatatgaaagaagcatccacatgcaaccttgttaacaacaaaagaggcccatacagtggcagggatgatgacataccacttgtgcacacaaagcatcaaaaaggatatcaaacaactgttgatgaaaca

SEQ ID NO: 7566 - DNA, 643 bp, Sorghum bicolor
  Clone ID: SORBI-28MAY03-CLUS92459_1
gtgtcgccgacgagcgagctgttcgggaccaagaacttcggcgtcaaccacaacgtggtggtgagcaacatccccgtcggctccctcatgcttcggatacttcgccgcctacctctaccagcgcggggcgcggggcggcggcacgcaccagtgcatcggcgacgcctgctaccgggagacgttcgtcgtgtggggcgccacctgcgccgtcggcacgctgctctgcgccgtcctctacgcccggtcgcgcagcttcgcggggaaactagcatcagtaaggacaccatgcctcgcccggttagctaattgcctcaccaagtcgtcgtcgtcgtcatcgtaggtggtagcaggcaggctctccagaagtttctgatctgagggcctgattaatcatacacccatcgatcgatcaagcatctctgcctgtaggcgatgatgcaacttttgatccttccttctttttctttttttacttcgagtttctcttgactgatcccggtggaagggggtacataaaaaaaatggccttgggggaggctgatcatgagtagatattgtgcagcaggttggccacctttttcacttgttattagtgcatatagtatatatatgcaaatataaatatgagtggtacacttaaaag

SEQ ID NO: 7567 - DNA, 753 bp, Sorghum bicolor
  Clone ID: SORBI-28MAY03-CLUS93996_1
ctactgggtgctgcccgtggagctccgtccgcctccacctcgagaaggagacgaagaaagatcccaaccaccagatcaattcgcacacgaaaccaatcacagtcaagtatcgtctcaaggtccaaagattttggtatccctagccctgggagctccagctccggctccaagcgctttagctcgattcaattccttcttcaatcgctgtgtgggcgtctctctctctctccctgctcgagatgctgtctctgagctgcccaggggtgtcgtccatgagcaagacggcgctcgatttggggcagctggtggccccctgccgcagccgctgtaccggcgcgtgggcgtcgcccagacggcggcgcacgccatgtgtttgcttcgttgcctcactggccaccgcccagcctggaactgcggctgttgatgtgccggcacggacgattcctgctgtgacaacagcaagcgcccctgcccctgaacgcacttctgtttcttcgctgctcgaggttgtctcggacgacttgctcaacctcaacaacaatctcaaatcgcttgttggtgcagaaaatccagttttagtttctgcagcagaacaaattttcggtgctggtggaaagagattaagaccagcattagtttttctggtgtccagagcaactgctgaattagctgctttgtcggagctaactactgaacatcagcgcttggctgagatcatagagatgattcatactgcaagtctaatacatgatg

SEQ ID NO: 7568 - DNA, 567 bp, Sorghum bicolor
  Clone ID: SORBI-28MAY03-CLUS94060_1
ccgtagatggtgtgaatgcagctaaagttgcagctatgaaagctgctgaattagtgaataggaacattgcagcatttggtcctggaactggacgcctatccactgatcagaagaaaaagcttctttggggtaacaaaaagagtaatccttcggaagagacaagtaaacgttgggagttgttctctgatcgggagcgccaagagaaatttaacaaactcatgggtgtgaagagcagtgccccagttcaggaaagcatggtcgagaacaaggccgggagctcggcggacgaagccaagaaactggaggagctcgacaccaacctggagaagcattacatagcaggcctccgcaggagagatggcaggacggtcggccttggcctctagaaactttgcttgcagatgctgcggcattgaaaaattcagagagcttgctctgtacaatctacagtgtcttgtttatttctgcacttataaattttcctggctggtttacgttaattgtgttgccgggttatcttgaagccctagaacatctctgtctgattgcacttataaatttacattc

SEQ ID NO: 7569 - DNA, 782 bp, Sorghum bicolor
  unsure (1)..(782): unsure at all n locations
  Clone ID: SORBI-28MAY03-CLUS94285_1
ctccagcacgacgcatgcagcagacacaataaaatcttcccttttgttagcgtattatcaaactaggttactataaaagaagtccaaaactangactgcagtgggccactggggctggaagagggaaactaagaggagttccttgcagacccaacatgcagcgagtggagatgcatccatttgatcaaagcagagctcagttctctgctatttttatattagtcttgccaccatgatgctgtgagacttgttacctccaagagcagtctttatgtttgtttttcttcctgttgagcttacaaaagtgcagccatttctttgagtgatgtcagtttcagagagtacagcgattccttcatcgttgtcatcttcacttgagttggatccattgctgaaggatcttgttgagaagaaactgaccctgaagaggaatgtgactgcaatggctaccgagctcaaggatgccaggaacaggcttgcttcacaggaactgttgctggctcaggaattagaagccagaaaggttgctgagctaaaggcgagaaatttggaggatgaggtgagcaaactgcagaaatgcttagaggacaaagatgagcagctgcgtgcatcgctatatagcactggaccagtttcgcaatgagttggatggtctcagatcacaactttcagtgatccaagctactgcagagtccactgctgtgtcagccaagacaacgatgctgcactgctcatatttgttaggaaagctgaatgataagaacagcttgatgactggaggt

SEQ ID NO: 7570 - DNA, 595 bp, Sorghum bicolor
  Clone ID: SORBI-28MAY03-CLUS94317_1
catacccccctcggccagcaagcactcccgagcaaaggcctaccgagggcacgacgacgcgcctgctcccctcccgccacggtacaagccagccgacttacaccgggctcccagcgccgttcacgcgccggcgacccgccgcagccaggccgcgaccccgccacggccgcgctcacgcccagcggacggcccgggggcgccgccgggcgccgccgcgcccgccccgggtgccctgccctgctcccagaccggccacggtggcccccccacccggccccgccctggggggtcacgaagaggtcggggcccctccaggacgccaggcacacgatctctcccccctgcttcctgcccttcgggcccccgcccccccccctctcacccacgagaggcgtccggctgcgcgatcctcgttgatgcagggtgctccccggtgggctgtgacctgctgtttcggctccgctgccacctctgatgcccggcggcatttgaccctaaggcccgtctcgtgtggctggcttgtctgtccgtagacttttccctccgttcgcggtacaatgtaatgcaatgctcgtgtgtataaaattgaaacagg

SEQ ID NO: 7571 - DNA, 1689 bp, Sorghum bicolor
  unsure (1)..(1689): unsure at all n locations
  Clone ID: SORBI-28MAY03-CLUS93_1
cggctcatctcagcggtgatccttgctgtgtgctcactaattagccgccgcaaaccttcaccaggttccaagaagaagcggccaccaggcccatggcgtctccccttgatcggaaacctcctccacctcgccacctcccagccgcacgtcgcgctacgggacctggcgatgaagcacgggcccgtcatgtacctgcgtctgggccaggtcgacgccgtcgtgatctcctcgccggcggcggcgcaggaggtgctccgggacaaggacaccaccttcgcgtcgcggccgagcctgctcgtggcggacatcatcctgtacggaagcatggacatgtcgttcgcgccgtacggcggtaactggaggatgctccgcaagctctgcatgtcggagctgctcaacacccacaaggtgcggcagctcgccgccgtccgggacagcgagaccctttcgttggttaggaaggtggtctacgcagccggcgccggcggcggcggccgcggccagcgcggcgaggcgccggtcgtcaatctgggcagactggttctgtcgtgctcgatggcgatcaccggcagggcgacgctcgggaagctctgcggcgacgagatcatgtcggtcgtcgacgtggccgtgctgtacggtagcgggttctgcgccggggacctcttcccgtcgctctggttcgtggacgtcgtcactgggctgacacgccggctgtggacggcgcgccggcgcctcgacgccatttttgacaggatcctcgccgagtgtgaggctcggcaacgacaggaggagaagatgaccggagatgatggctttctcggcgtcttgcttcggatcagggacgacgacggggagccagagaccggcggcatcagcacgacaagtatcaaagcaatcttatttgacatgctcgccggagggacggagacgacgtcgtccgcggcagaatggatcatgtcggagctgatgaggaagccggaggcgatggccaaggcgcaggccgaggtccgtggagccctcgacggcaagagcccggaagaccacgaggggcaaatggacaagctcagctacacaaggatggtggtgaaggagggcttgaggctgcacccagtgctccctctccttctccctcgttcttgccaggagacctgcgacgtcggtggcttcgaggtgaccaagggcaccaaggtcatcgtcaacgcgtgggcgttggcgaggagtcccgagcggtggcacgacccggaggagttcaggccggagcggttcgccgacgacgatggtagcagcgcagcggtggcggtggactacagagggtctcagtttgagtacattccgtttgggagcggcaggaggatgtgccctggaaacacctttgggctcgccgcgctggagctcatggttgcacggctgctctactactttgattggagcctcccggatggaatgcggccggaggagctggacatggacacggtcgttggttcgactatgaggagaagaaaccacctgcatctggtgccatcaccgtacaaggagaccgagctcaccgtaggaatttaattaatggctgcaaattaatataacctcatgcatgattgtgattcttctaatagaggttggacaaataaacgatgttgttctcatttgtaaaaaaaaaaaaagtcacngttgacaaaaaaaaaaaaaaaa

SEQ ID NO: 7572 - DNA, 621 bp, Sorghum bicolor
  Clone ID: SORBI-28MAY03-CLUS93216_1
tggaggagaggttgaacatgggtgtcaacttccttctatctgctgagattgaccattgtaagaagaactacaagtttggttttggaatgaccgtaggagagtaattctgctaaaacaattgctgtgagcgcacatgagatacttgtgcagtcggctttgcatgtatgttaagatacttcaggcctcagttttgattgaccaggttctgccctttgcaccgtggaaaaaatacaaggctgttgctgctttacagggttttgtctttcagtgtgtcggtggttgtgtattttcagctacttgagcatgggggccatgattctttgttcatcttggatgtaactagctgattggtgttccaataatgtattggcggaacaatttttaccttttaaatcaccaccaacccaccacacgagccacaagattttatggttcaaagcttctcaccgtttggcacttgacatgtttgatgttgtctggtgcttttgttcatccatggcaagtcagaaatctttcagctcaactagaaaagacatgcggccttgcttcacagggctagtgtgggaccattttattgtaatagattttgtttattggtgatttattggagtacaacttagg

SEQ ID NO: 7573 - DNA, 632 bp, Sorghum bicolor
  Clone ID: SORBI-28MAY03-CLUS9310_1
gcacgaggcagaagcaacgacgaggcggcgcgaggagaccatggagtagcacggggcgaccacggagcagcgtgaggcaactgcagggcgacgcccttctccttcctcgtccttctcgccgaagcaacagactcagctaatcgatttgcatgcccatcaaatatttcctctctccctctcaccctgagatttctccaccaccatttagagttggcgaaggtgaacctccgccttcgtgggatccggtaccaactccagaaggtactctagaatatttagcttttatatgaactagatcaggaagcaactttgatttggctcaagaatgcgatggtctaacagggaggaggcaatgatcaagaaacattggattggacaaagtgcctggacacatgagtaggcttagatgagttatcaactggttaaattatgctttggatttgaaaagattgtaatttcatgagtggatcatgacagtcttttggtgcaccttttgccaattttgacagtagctagcatgtctttatatgtggttgcacattatctgtgcccattatctctatatgcatgatgagagacttgcagataaagaactccaaaacattgaagatttatttattttattttgttgc

SEQ ID NO: 7574 - DNA, 515 bp, Sorghum bicolor
  unsure (1)..(515): unsure at all n locations
  Clone ID: LIB3476-061-P1-K1-A12
caagaactgaaatagatggactgcacacaattagtttgtctgttctttattttgttcctaaaactgatacttttgtggtgataactataaccatcttgctcatatgtgcatatgtatgcaagttatttcaaattccttttatttctaatttcattcgattgctacacccatgtttgcattgtgatgttgagttgtttattcatgtgctatccaaaagtttttggtgtatccttgcgttcctgttctctgagcatgtcagcaccattcgtcttttgatgtggttttttgcttaacaaatactttttcttgttaattgtagatttctccaccaccatttagagttggcgaaggtgaacctccgccttcgtgggatccggtaccaactccagaaggtactctagaatatttagcttctatatgaactagatcaggaagcaactttgatttggctcaagaatgcgatggtctaacaggttagtatactgaactgctgaaaatntgatgtttttcttcta

SEQ ID NO: 7575 - DNA, 1183 bp, Sorghum bicolor
  Clone ID: SORBI-28MAY03-CLUS93226_1
cccgtatccccgccgatggcgttcacgccgccgcgcctcctcccgctaccccttccgccggcggcggcaccggcatccacgcgggccgtctcggcgcgccaccacggagggcgcacggcgccggagctctcgggcccgaccccgcgcgtggtggtcgtcacctccgggaaaggcggcgtcggcaagaccaccactaccgccaacctcgccgcctcgctcgcgcgcctcggactccccgccgtcgccgtcgacgccgacgccggcctccgcaacctcgacctcctgctcggcctcgagaaccgcgtccacctcaccgccgccgacgtcctcgctggggactgcaggctcgaccaggcgctcgtccgacaccgcgcgctccaggacctccacctcctctgcctctccaagccacgctccaagctgcccctcgcgttcggatccaagaccctcacctgggtcgccgacgcgcttcggcgctcgcctaacacgcccgccttcatcctcatcgactgccccgcaggtgttgatgccgggtttgtcactgccattgcacctgcagaagaggcagtgctcgttaccacccctgacattacggctctccgtgatgctgaccgtgtcgcaggactgttggagtgcgatggcatcaaagatatcaagattattgtcacccgagtgcgcccagacctggtgaagggggaggacatgatgtcagcgcttgatgtccaagaaatgcttggcttgcccttgcttggtgtggtccctgaggacgcggaggtgatccggagtacaaataggggtgtgccattggtgctcaacgacccgcccacgcctgcggcccttgctctggaccaggccacttggcgattggtggaaagagatgcgatgacagcagtcatggtcgaggagcaggagaggcccaagaagaaaggcggcttcttttcgttcttcgggtaggtgagtctggagttcagctgtggagtttaggctgtagatggtgtacaggactcgcgacccggagtttctgaatgctttacgtccctttgggcttgctttgttctaggttagagcgattcatttgttgtgatggtgtagaagaaatatgtaactctggattgatgcttctaatattagaggccctagttcgacataatgtgtccccccccaagatatttaattttgaaat

SEQ ID NO: 7576 - DNA, 798 bp, Sorghum bicolor
  Clone ID: SORBI-28MAY03-CLUS93241_1
gcacgagggaatcatggatactgatcctggtacgagccatggcaaagggttgaagtttgaggtgggtgctgcagaagaagaacttgacatgctcctcaattcatttagcggaactcacctttccagcgccaatttggacgaaccatttgaacacgcttcaactttgcaggaggtcagtttgtcgaatgagaaggttgaacctagcttgtcttccaaaccgcctttgcttgcacctctcgacgatgctctagatgacttgctttcagagagttcccttgatgtacagagtgaaggtttcgctatgcgaagtacaacttctcagcctactgctaattatggtcagaacattggcttcagatatgctaagaaaatggatgtgacgccatcaattgatgattcagtggatgatttgcttgaagacacttcatcatccttaaatgagccaaagcaaattacaactgcacaagtatcgaacagcaccccacttgatagtgcaccccttcatcctggtcccttaaatacatctgcgtcggatgattttgattcatggtttgattctctataggacagaaaaggttggttaggcgagaaagtgatggctgtcttcagggaatcttgggcctttatgtactccattactgaattaaactttgtaacattacgagaacaatctctctctctttttatcaagagatgacaagagctctgtcgttcaacttctccccccaattccttctcgatgtaccccattgtataagtcattatacagtcttttttgaatgttttttttatcgatct

SEQ ID NO: 7577 - DNA, 673 bp, Sorghum bicolor
  Clone ID: SORBI-28MAY03-CLUS9320_1
tgagagagaagagagagagagagagagggagagaggcgaccaccacctccctccgctccctctctctgactcgactcgacccgctcctgttcgccgctccgccatcgccggcggcgaccactccgggtctccggcgacgccgctgcgtcttcggcggccccaccgacgccgggccccgcgacgccattcctccgatcgccgactcacgccttgcgctccgccccccccggcgagggtccgagctcctgcccagatccgccctgcgcctgctcgcggcccccgtccgcgagcgccgatcggcaggcggcgtaggcgctgctgcgcgagtgagcgagcgagcgggcgacggatccgtcgatccgcgcgcccgccatggacgacttccagggcctgctggcccgcgacttcggcctccgcccgcaggggaaggccgcgcccatgtcggctgcgcgctcttcggggccctccggatccgcctggaccaataccagatccgccgcgggggtccgcctccgccgccgccgcgccctcctacgacgacctcttcgggtccgccccgccgccgcccaaggccacgccgtcgccgtcgctcgacaacatcttcgactcgttcaaggaccccgccgcttccaccaccgcgccgccgcctcccaagcctaagcactcgtccatg

SEQ ID NO: 7578 - DNA, 459 bp, Sorghum bicolor
  Clone ID: LIB3476-061-P1-K1-B12
gagagagagagagagagagggagagagacgaccaccacctccctccgctccctctctctgactcgactcgccccggggcggtgcgccgctccgccatcgccggcggcgaccactccgggtcttcggcggccccaccgacgccgggccccgcgacgccattcctccgatcgccgactcacgccttgcgctccgccccccccggcgagggtccgagctcctgcccagatccgccctgcgcctgctcgcggcccccgtccgcgagcgccgatcggcaggcggcgtaggcgctgctgcgcgagtgagcgagcgagcgggcgacggatccgtcgatccgcgcgcccgccatggacgacttccagggcctgctggcccgcgacttcggcctccgcccgcaggggaaggccgcgcccatgtcggctgcgcgctcttcggggcccttcggatccgtctggaccaata

SEQ ID NO: 7579 - DNA, 1109 bp, Sorghum bicolor
  Clone ID: SORBI-28MAY03-CLUS9329_1
gcacgagggagattgactgctcatgaggttctatgtcatccatggattgttgatgattctgttgcacctgataagcctattgattctgctgttttgtcaaggctgaaaaacttttctgcaatgaacaagctcaagaagatggcattgagggtgattgctgaaagtctatctgaggaggagattgggggtttaaaggagttgttcaaaatgattgatactgacaatagtgggacgataacttatgatgaactgaaggatggtctgaaaagggtgggctcggatctgatggaacctgaaatccaggctttgatggatgcagctgatattgataacagtggaaccattgattatggagagttcttagcggctacattgcacatgaataaactggagagggaggaaagcttggtgtcagcatttgcattcttcgataaggacgggagtggcttcataacaatcgatgagctgtcacaagcatgtgagcagtttggtctttctgatgttcatcttgaggatatgatcaaagatgtggaccagaacaatgatggccaaattgattacagtgagtttgctgcgatgatgagaaagggcaatgctggtggaacaggaaggcgaaccatgaggagcagcttgcatgtgaatcttggtgaactcttgaagccttctgagacctagtttttatcagaggattctgctttccagatgctcccatctgaagtctaccgtgcctcatcagctttgacagattgattagttgatctagtaccagtgccacaaaaatagctgttaaaattctcagtggtactagtagttagtggaaagaacattctgtggtaccagtgacaaattttaggtgctgaagatgaacatgttatgctactccggagtcctgttgtctttttcatgactgttgttggtaatttcaggtttgtaccattactgatctttgttgtcagtgtaaaatgcgctgtggtccataaggtaggcacctaggtctcctccatttgaagtatcaacggatttgtaaacatgttctcatgaacctatctattattgatgatttgtcaaaacttgtttttgttatcatcacagtgttattaggaatggtt

SEQ ID NO: 7580 - DNA, 668 bp, Sorghum bicolor
  Clone ID: SORBI-28MAY03-CLUS9491_1
gtgctctcttatccgcgccgcattctcccttccactcagaaacccccgcaccctctaaaccctcaccaccggccaccatggcgatggccggcgccgccgccgccggtcgctgcctcctgctctcccgcccgtcccctttccggctccgcctcctccgcgccgccctctccacctctgcccccaccatcggccccacctccactcccgctccccctccgcggcacgagctcctcctcgagcgcctccgcctccgccacctcaaggacgcctcctcctcccccggcgccccgaggcccgcctcgaggggcgcggagcggagctcgcagcaggggaaggggaagagggtcgaggccgcggagagcttcgaggagctcggcctcggggaggaggtgatggccgctctcggggagatgggcatctccaagcccacggagatccagtgcgttggtgtgccggcggtgctggccggcaccagcgtcgtgctcggctcccacactggctctgggaagacgctggcctacttgctccctcttgttcagctacttcggcgtgatgaagcaatgctggggatatcaatgaagccaaggcggccaagagcagtagtactctgccccactagggagctcactgagcagggttatcgagttgcaaagtctatcagccatcat

SEQ ID NO: 7581 - DNA, 1183 bp, Sorghum bicolor
  Clone ID: SORBI-28MAY03-CLUS94912_1
gaagagcacgtcgcagcagagcaaagccccccattaaccccaccggcccccttcagctctgctcttgcatatcagttccagtgtcgcccgagcatattactagcgcgctagccatctggtggtgctgtggcgacgagccaaggggctcatcgatcaatcgaagaagtgaagtgagtagcgccggaaatcgtcgtcagaaatcggcgtcggcatggcagaccagaacaaggtggaggtcaaagagaccaaggtggaggtcaagacggccacttacaaggtgttcgtccactgcggccagtgcgcacgcgacatccacacggagttcaccgagttcccaggggttgaagaggtgaaggtggatgctggggcagggaacgtgacagtgaagggcttcgcgttcgacgtggagaagctcaggaagaaagttgagaagggatgccggaagaaggtcgagctgattccaccggcgcctcccaaggacgacatggttgttgacgtcaagaccaaaaaggaggagctgaaggtcatcactgtaaagcttccattgcattgccccgactgtgcagtcagggtcaaggagatgttgcttgagaacaaaagtatctacgaggccaagacggacttcggcaagaacacgtgcaccgtcgagggcgtccttgaggaggacaagctcgtcaagtacatcttcgagaggacgcgcaagaagggcgtcgtcgacaaggtcgagaagaaggtgatcgtcaaagaggaaaaggtcctagtgaagaaggcggacaaggagaaggagaagaaggagaaagagaaggagaaagagaaggagaaggctaaggaggtcgtcgcgaaggtcgtcaaggatgtcatcgccccctacttcatcccctgcacgcacccgcacttcgtcgactactcgcacccgggccaccgccacggctgcggcggctgcagctattgctcgccgtacgacggcggttacggttactggggcggcggcgggtacccaccgtacggcggtgtcagctacacacacactgagctcaaaggctaccaggggacggcgttcttgcactgcactcaccccagtgaattcatcagcatggagaacccctatgcatgcgctgtgatgtagacctttttttgcagttggattattcatgtggaataattgaacaccaagaacaacgcc

SEQ ID NO: 7582 - DNA, 666 bp, Sorghum bicolor
  Clone ID: SORBI-28MAY03-CLUS94972_1
atgagttgtgtgacacactacaccggacaccgagacagtgagtggatctattaggaccacaggatggacgcggcggcagccacccccgcccttcgaaggcggccgctctcggtgcacaaggagagcaatggcacggccgccaccggggcggctggggccagggtcgccgccaccggggcggctgaggagctcggggagcccgtggacgactccgcccggctcgtagaggacttctacatcgtcgtcgtcatcgggacctccacccccgtgaacctcgccgccgcacgcgccggcatcgaggcccagctcgcgcgctacccgcacttccgaagcatccaagtgaaggacgacgcgtccagtgaagaagacggccgccggcggtgggtgccgacggcggtgaacctggacgaccacatcatctacccgaagctggacgcggcggcggtggcgcgcgacccggacagggccgtggaggactacgtggcgacgctgtccacgctgcccatggactggtcccgcccgctctgggagttccacgtcctcgacttccccacctccgaggccgccgccaccacggcgatccgcgtgcaccactcgctcggcgacggcatgtcgctgctcacgctcctcatggcgtgcacccggagcgccgccgacccgaccagg

SEQ ID NO: 7583 - DNA, 754 bp, Sorghum bicolor
  Clone ID: SORBI-28MAY03-CLUS9348_1
cctccccatcctttttttttacccgcccgcccgccagccgccgtttcggttgctcggctgggggagcaccagcgctcgagggctatggcggcgtcggcgagggcgtgcttggttgcgctggcgctggtggccgcgctcatcctcgacggaccagcggcagcggcggcggaggaggggaatgccggaggccgcgggtcgctgacgctgaggcagcgccgccggcagctgctacggcagcggcaggtgcgcagccacctcaagcgcctcaacaaggcgccgctcgctaccattcagagtccagatggagacatcatagactgcgtgcatatctccaagcagcctgccttggatcaccccttccttaagaaccacaccatccagatgcggcctgcataccacccggaaggtctgtatgatgagtccaaggttgcatcgcagcagaacgcccaaacaatcacccaaatgtggcatcagaatggcaggtgccccgagaacacgataccgatcaggaggaccaaggaggaggacgtcctgagggccagctccgtcaggaggtatggcaagaagaagggcaagactaccgcgaaccccatgtcggttgaccctgacatgctcaacgagagcggccaccagcatgccatagcatatgtggagggcgataagtactatggcgccaaggctaccatcaatgtgtggcaaccgaagatcgagcaggctaatgagttcagcctgtcccagctttggatctttgggg

SEQ ID NO: 7584 - DNA, 611 bp, Sorghum bicolor
  Clone ID: SORBI-28MAY03-CLUS9352_1
gatgagagcaaaaattcgaaaccagagaagccgtcttcagcagctggtgcaggcctccccaatccttttgatttttcttctatgagcagtttgctcaatgacccatcaataagagagatggcggagcaaattgcaagtgaccctgtgttcaaccagatggctgaacaacttcagaaaagtgctcagggtgctggagaacagggtatccctgcattggatcctcgccggtacctggcttcgatgcccccactcgtgcccaggcctctccccgggtcgtgggctccccgtcgtgcgctccctctgtggcaggatcctgctatgtccagtatgctcgagaactttaccagtccagctcataaagagcagcttgaggagaggatggcccgtatcaaggaagatccatccttgaagccaattcttgatgagatagagaatgggggtccatctgcaatggtgaagtaggggtttttactcatgtttactattactatccatgagatatggtagttttaaattgctgagatattttttcttctaaatttaggtattggaatgcccctgaggttcttcaaaagattggccaggcaatgggagttgcccttcccggagat

SEQ ID NO: 7585 - DNA, 805 bp, Sorghum bicolor
  Clone ID: SORBI-28MAY03-CLUS93553_1
accaatccagctccaggactagactggggccattccggttaccaccagctccagtgatcttgtccagtctacgatgggtgtcgggaacggaatggcgaagctgcttcttccagctctgcttctggcagcaaccgcttgcatcggcgttcacgccaagttcagcaggtacagcttccccaaggacttcgtcttcggcacaggctccgcggcgtatcagtatgagggtgcctacaacgaaggaggcaaggggcctaccatatgggacaagttcactcacatcccaggtaagatcttgaacaacgataccggcgacgtagcagatgacatgtaccatcgatacaaggaggatgtgcaactcctcaaggacatgaacttggacgccttccggttctccattgcctggaccaggatcctgccaaacggttccctgagtggaggaatcaacaaagaaggcgtggccttctataacaacctcatcaacgaggtcatagccaaagggctgaagccatttgtcaccatcttccactgggacacgcccctggccctggaggacaagtatggaggattcctcagcgagaacatcatcaaggactacgtggacttcgccgaggtttgcttcaaagagttcggcgaccgcgtcaaggcctggaccacgttcaacgagccgtggacgtactcgtaccagggctacgccgtcggcaagtcggcgccgggccggtgctcgtcgtacgtcaacaagaactgcttccccggcgactcggcgcgcgagccctacaccgtgacgcacaacatcatcctcgcccac

SEQ ID NO: 7586 - DNA, 603 bp, Sorghum bicolor
  Clone ID: SORBI-28MAY03-CLUS93763_1
cccgattggatgcatcccaatgtatctgttggcattccagagtgacgagaatgaagattacgagccagggacaggttgcattaaatggctgaacgagtttgcacggtatcataacaagcttctcattcaggaattggagaagttgcgaaagctgcatcctcgtgtgaccatcatctatgctgattactatggggccgctacagaggtttttgcttcgccgcaacaatacggaatcgaatatcccttgatggcttgctgtggtggaggaggacgctatggtgtgtcctcaggtgtaagatgtggacgtggagaatacaaattatgtgaaaacccagagatgcatggatcatgggatggcatgcatccttcagaaactgtatacaaggcgattgcgatgagccttctacgaggctctcgtacacagccaccgattgctaccaccgccagttcatgcatacaactaagtgagactggaatatctgttgaagacaagtccctttgagacgtaattgtttgactacattgtattcttataaaagcaaaagtcacgttattattagctgatgttggtataaagtggaatcaataaacaatgcttcaact

SEQ ID NO: 7587 - DNA, 570 bp, Sorghum bicolor
  Clone ID: SORBI-28MAY03-CLUS93791_1
gatcttgcacattgcttgctgcaatattcatttcatagttttgagaactgttgcaggcccacacatcgcgaaggttttccccatgtagctaactggcagggtataggtgagggcacacatagtcatagtcacagttgcatctctgtcattgactcattgctggtctcctgcttgctggggaagtcctgcctctggatcctagaagatattctgtctatgaaatagcactgctaacagttcagtttagaagatattctagtagatactgttccagttctgatacggaaaaaataataataatgcgtgctacctatttagaagcacagttggcaatgcttggtcccaatgattttctttcgcccgaacctgtgcttgtagggtttgttttagtctggtaacacaagttgtgttgcacaccacacgaaatggccacagggcattggaacatgatttgatcagaggtcaccgttgcattgtcatggtttatagcttgctgaaccaggccagtctattctgagctgaaatgtatgtattgcaggctgaactttagttgaaagggctgcctcagag

SEQ ID NO: 7588 - DNA, 629 bp, Sorghum bicolor
  Clone ID: SORBI-28MAY03-CLUS93852_1
cctactggagcgccgctgatcgacgaagccaacaagaaaccatgacttcctatctttacgggggaggaggaagacggcttttgctgttcccgatggcggcggcggtggctgcgctagttggggcagcgccgtcgccggcgtcagcgtgctacacgcgcgtgttcagcttcggcgactcgttggcggacacgggcaactaccacttcgtctacagcgacgacgactccgaccccgtgctccggctcccctacggcgagaccttcttccaccgcgcctccggccgcttcaccgacggccgcatcgtcctcgacttcatcgctgatgctctggggcttccgttcgtgccgccctacctgagcgggcgccgcgccgaggacttcttgcacggtgccaacttcgcggtgggtcgcgccacggcgctcgccccggacttcttccgggacaggggttttgacatcggcgacgtggtgcacctcgacatggagctggagtggttccgggacatgctcagcctcctctgccccgccgatggcctctcactctcaggttgctcggacgtgatgaaccaatctcttttcatagttggagaaattggaggcaatgactacacccttccccttctggaaaga

SEQ ID NO: 7589 - DNA, 652 bp, Sorghum bicolor
  Clone ID: SORBI-28MAY03-CLUS93897_1
tggcagattcagcacaagctggcggcgctgtacgcggagggctgcagagcggaggagggcggcggcggccaagttcccgccggagacgtgagcctgtggtcgctgaggctgcactcccacacgtactaccgctacgtcgggtccttcaccacgccgccctgcaccgaggacgtcatctggagcgtcatggcccaggtgagggagatgacggtggagcaggccgccgcgctgatggcgccgctggagaaagcttacaggcacaacaacaggccgacgcagccgatgaacggccgcgtcgtccaggtctgccacaggttcgtcatgagcaagaagacggcgccgtagccgtacgtgcgtgccccgtgccccggccgtatgcccggccgccccctgctcgttgccgtagacgacgcctcatcaatactgaagttggtcagtaggtctgtgggtttaattagctaggttcattcataggagatgtataagctgtttggtttcctgcaaagtggatccttcttatctgtaagaataaggtctctgtttggttatgagcggtaaagtttaccgtccgtcacgtcgacatcgaatgttggcccacatgcatgaaacactaaatacagactatttagaaattaaagacatgataaaaagt

SEQ ID NO: 7590 - DNA, 707 bp, Sorghum bicolor
  Clone ID: SORBI-28MAY03-CLUS95995_1
agccttcgactgcccggtgagctactaccagcgcacggagcaggcgtcggtgtacccaaactacacctactacccgtcggtggtggagctggcgtccaacagcgacgtgctggtggtggcgtgcccgctgaacgcgtcgacccggcacatcgtgagccgcgaggtgatggaggcgctgggcccgaagggcgtgctgatcaacatcgggcgcggcccccacgtcgacgagccggagatggtggcggcgctggcggacggccggctcggcggcgccgggctggacgtgttcgaggacgagccgaacgtgcccgaggcgctgctggcgatggacaacgtcgtgctcgtgccgcacgtcgggagcggcacctacgagacgcgcaaggccatggcggacctggtgctcgggaacctcgaggcccacgtgctcagcaagccgctgctgacgccggtggtctgactgcgcgtggtggtggactggtggtggtgttttacacgtacgtgtgtgtaggagaggggaatggatggtatgtttccgttcgttccgatccaggggaagaagtcggggtggggaggaagaagcagatgggtgcgttgcggtttccttgttttatgatgatgatttacgaataacagcaggtagcgaggcgcagcagcgcgccagcgcctgatgatgaactctctctctctctctcccagcggcgggcgat

SEQ ID NO: 7591 - DNA, 663 bp, Sorghum bicolor
  Clone ID: SORBI-28MAY03-CLUS96015_1
gcacgaggccggcgtctggatcacttgcgagttgtgacttgtgagcaccaacaaaaggcacatctccgcagatcacagccacaggggtcacacggagccaatccatcctcgtcacgcccccagccacaccacaccacaccacgacctcacctgccgccgccgccgcctcctccagtcctcctccagcgcccgccgcgccgatggagtccctgggcgtgctgctgctccaccccgtgaacgcgtacctggagcaggagctggaccgccgctgccgcctgtaccgcttctgggagtcgccccgggaggagttcctccgcgcgcacgcgggcgccgttcgcgccgtcgtcggcaacgccaactacggcgccgacgccgcgctcatcgacgcgctcccggcgctcgagatcgtcgcatccttctccgtcggcatcgaccgcgtcgacctcgccaagtgccgcgagcgcgggatccgggtcaccaacacccccgacgtccttaccgacgacgtcgccgacctcgccgttggactcgccatcgccgtcctccgcaagatcccgcaggccgaccgctacgtccgcgccgggctatggaagtccaggggcgactacaccctcaccacgcggttcagcgggaaacgagtgggcatcatcgggctgggcagga

SEQ ID NO: 7592 - DNA, 654 bp, Sorghum bicolor
  Clone ID: SORBI-28MAY03-CLUS96093_1
gcacgaggccgttcgccgccgcctggctcacaccgccgacagtgcctcagtccagaaatcctccctctttcctacagtagatcctatcctggttgcggcacctgccgccgccgctgcatccgtcagcttcacccctgcgcgcgcgctctatctcttgtctctgcgacgactgggtgggctaccgccgccgccgccggcgaagagcgcccatcagatccgccccccgggttcaaccggtcgaaccccgatggctgacgccgagtccaaccctggcgcgggcgggaagccgccgccgtacaaggaccccgacaatgggagtcagcggttcctactcgagttggagttcgtgcagtgcctcgccaaccctacctacatccactatctagcgcagaatagatattttgaggatgaggcatttatcgggtacctcaagtacctaaaatactggcagcgaccagagtatatcaaacacataatgtatccacactgccttttctttcttgagctcctccaaaatgccaatttccgaaatgcaatggcacatccaacaaacaaggagcttgctcataggcagcagtatttcttctgggaaaactacaggaataacagactgaagcacatcctaccacgccctcctcctgaaccaactcctgg

SEQ ID NO: 7593 - DNA, 781 bp, Sorghum bicolor
  Clone ID: SORBI-28MAY03-CLUS9441_1
gagatgcatgtacgggtggatgccggtaccaaacacggctgcgctatgcgcctatgcccacctccggttcctacgggagatgtgagcctaacatttcaattcaacgcacactagcagccactagggcattcagccacatcagtcaagccacacacgacaccccgcaccgccacgcgccgcgcggccgcgcggggatcgggacttcgtcgcagtcgctcccggctcccggctcccggcttccggccgcaccgcggtaccgccccacgccgtatgctgtcgcccgcagcacgagtccccggccggcactcccctcctagaccccccaccggcggcgactctccctcaccaatccggcgtccacacgtcctcctccttcagtccactccagggtcacgtatattggtttggtggacaatatgtcaagctctaaccagatgtgttctgatggcaagtttgggagaggtcctcgggagcttagtggtgctgtggacttaattagtcgctacaagctgctgaatcatcatagtttcttttgcaagaaacctttgccattggcaatttcagatacaaattatcttaacaatgttgtgggcgacacagaaattcgtaagggggaagggatggagttggaccaactctttcagaactcatattcaagtgagaagactgcttatattcagccatttgacatggaaacactgggacaagcatttcagctgcgagaaactgcaccagtagatttgccttctgctgaaaaaggtacaccaaccatatctgggaa

SEQ ID NO: 7594 - DNA, 585 bp, Sorghum bicolor
  Clone ID: SORBI-28MAY03-CLUS9439_1
gcgggagtggatcaacctttttctccaaaaacaaaaaaaaaaaggttagaactcgcacaagttttgcaactatctaccaaattctcggacgcgtgggtttttttgctagccccaaggtgagattctgaaattaaaatggtgggtatcttggtgcagactgcagcagacgcaccacagtttatgacctgctttgcaacaaccaaagagatttggtggaaaaaaaaacattggctcaagtaaaagtgttaagccaagccgggtgatctcacatgacctatacatccttctgttataactagatgagatcaccactgcggaaacaagggtgctttcaagtttatttcagctaacaaaggaatctatggtgaacgaaaccaactgtacacttgaatgtacaatgaaccagtgaaatgggaggtgagcctaaaggggatcagtaactcttccaagaggccgcctcagccagcactagacctgggcttgacgatcctacgctgtgtagaacgctgagtcttatagctgttctgactgatgagcgtgacacgacatatcttgctgacacgtggttgtgttaacacacttggt

SEQ ID NO: 7595 - DNA, 391 bp, Sorghum bicolor
  unsure (1)..(391): unsure at all n locations
  Clone ID: LIB3480-001-P1-K1-H7
agacaacatacccaaccgctggttcaggccagagactgatgctccgtcgtccatccgctctatccagatcgaggaacaggctattaaagacttcaagcgcttctacagcagcgtgaggatcgtcaagccgcaggtctagtgctggctgaggcggcctcttggaagagttactgatcccctttaggctcacctcccatttcactggttcattgtacattcaagtgtacagttggtttcgctcaccatagattcctttgttagctgaaataaactngaaagcacccttgtttccgcagtggtgatctcatctagttataacagaaggatgtataggtcatgtgagatcacccggcttggcttaacacttttacttgagccaatgttttttttt

SEQ ID NO: 7596 - DNA, 582 bp, Sorghum bicolor
  Clone ID: SORBI-28MAY03-CLUS9459_1
gcacgaggcacgcagcaccagtaccagcgacagcaccagcaacagctgtgggttcagcacaagaggggcgaggaagacgcgccgctgcatttcttggacgacgagcgcggctactccggcggacatggcgaccaacagcggcagctccctgacgaagctggcgccgctggaagccatcctgttcgacatcgacggcacgctctgcgactccgaccccatccacttctgcgccttccgagagctcctgcagcagatcggtttcaacgacggtgttcccatcaccgaggagttctacagtgccaccattagtgggggacacaacgacgacctcgctagggcgctgttcccggacatggatcaccagaaggcgatgcagttcatggatgacaaagaagctctattcagaaagttggcaccaggacagctgaaggccctggatggactgcacgagctgtgccgatggatcgagggccgcaacctgaagcgcgcggcggtgaccaacgctccgagggcgaacgccgagctgatgctgtcgctgctggggctcaccgacttcttcccggtgctcgtcatcgggagcga

SEQ ID NO: 7597 - DNA, 1058 bp, Sorghum bicolor
  Clone ID: SORBI-28MAY03-CLUS94488_1
gcacgaggctggtgcagtcaaaaccatcttagatgagggggttagcttgttcaggatgcatcagagcaggcatggaagagccatcgaaaggttcatacgctaaagaatgggcacagtgggaacaaaggttgcgtgtgaccttgtttgggaatgctgattatcttaactcaattcaggttccttttgactatgctgtgaaagaagtactggaacagttaaaaactgttgccaaaggtgatctcaaaacacctgatactgggaagcggaagtttggcaatatcatgtttgctgctgttcgattaagcccacccgatatattgggccttctccacaaggtggcagagaaggacacagctgtcaacagtttcctcaacaagataagactggaggacaacctaaagaaggctcacgtcacccttgcccacaaacgaggccatggtgtggctgctgtcgcaagctatggcatctaccagcaccaggaagtccctgtctcattcagcgcattgtactacactgacaagatggccgctcttgaggcacagctcggagcagtacccgatgagcagatcaattcccggaacgagtggtcacatgctaccctgtggacagctccaggtgtcgcggcaaaggaggcaaacatgctgccgcagctggcttcggaaggaaaagcagaacgggtgccgattgatcctcccatccccatatctggggtggtggacttctactgatttgttactaccttggttttaggatacgaatgtgcagaagtgaagatagaataaatagtagtttgctgctgggggacttaacgttaacagctcatcctggccaagccaagacagctaatcatcgagcctcaggccactttattttgacacgatagggctggcctagactactgcatttctacttcgacgtgttccaaaaagtgcaagatgccatcgagtttaagtcagcactagagagagagttgtctgtagagcacatcattctacttctagtgtattttgaattttcagaggccgtttgacacggcagttgaccagaggtaaaattca

SEQ ID NO: 7598 - DNA, 670 bp, Sorghum bicolor
  Clone ID: SORBI-28MAY03-CLUS94688_1
tactgggtgccatctcttcgacttgggagtccagcgccgccgcgccgcctcccatcccatggcgtcgctgctccgcctccaggccctcgctccagccatgacagttccccgccaccatttcctcatctcccctctccgcctcgcctctgcagccacggctccgctcgctcgacgcctctccaccgccgtctccagcaacaagccggagccacgcgtctcggaaccggatctggaatcaggtttgtatcttgtggcaacgccaattgggaaccttgaagatatcaccttaagggcactgcgtgtccttaaatgtgctaatgtgatactatctgaagacacaaggcattcaggaaagctacttcaacattacaacatcaagacacctcttcttagcttccataagttcaacgagcgtgagagagagcccagtatcttaaggaggcttcatgaaggcgaagcagttgcactgataagtgatgctggcacgccaggtattagtgaccctggcatggaactggctagactatgtgcaactgagaaaattcctgtcattcccattcctgggccttcggctgcaattgctgctctttctgcatcgggtctgccatcaaatgaattcacatttgttgggtttttaccaaagcatgctcggtcatcaggttatttttca

SEQ ID NO: 7599 - DNA, 519 bp, Sorghum bicolor
  Clone ID: SORBI-28MAY03-CLUS9470_1
gcacgaggcctctgcgtccgaagcgaagctaaccaacccaaaaaatattaactgcccacgcgtccgcccacgcgtccgccctcccttgcgttgcgcgttcctcttcttccttccttgatactacgatcgattccaacttctttattagccttatattattactatcagtcaatcctgagaaattggattggggatcgcatcgcatccaaatccgatacacaacaagccaagcgagaggccgcctgcccaccttccggcgcggcgacatgaagaagatcttcggcgccaagaagaacaaggacccgccgcccaccatccaggacgcaaccgacagaatcaccaagcgcggcgacaccgtcgatgaaaagatcaagaagctcgacgctgagctcgcgcgctacaaggagcagatcaagaagacgcgcccaggccccgcgcaggaagccgtcaaggcacgagccatgagggtcctcaagcagcgcaggatgtacgaggggcagcgtgatatgctctacaacc

SEQ ID NO: 7600 - DNA, 1288 bp, Sorghum bicolor
  Clone ID: SORBI-28MAY03-CLUS94792_1
aaaagtaagctactcgatcaaaccctctaccaccaccacagatttatagttaacaaatattgcctcctgctaatctatcacattaaaattctctcatgttaacatctcctctctactgctacccagcgtagcctcataggcgttccaaatagctcttttatcatcccttcctgagatctcaccaagaacaaacagaagctagctagcatggaccatcagctgttcgacgaccccttcgggagcagcatctcgtcgctggaggcggacatcttctccgccggcggcggcggacagctgccgtcgccgccgtggccggacctcgacctcgacgacgactacgacatacacgacctctccgcgccggccgccaacgccgccacctcctcgggcggcggctatggctccggcggctccggcaggaagctcagccacaacgcatacgagcgcgaccgccggaagcagctcaacgagctctactcctcgctccgatccctcctcccggacgctgatcacactaagaagctgagcatcccccccaccgtgtcccgagttctcaagtacatcccggagctgcagaagcaggtggataacctggagaggaggaagaaggagctgaccaacgccaactgcaagccgggagttctcaacaccaaagagatcgtaactcccattgtttctgctacttgccttaacgacacggagatcatgggtcaggtcagcctgcacagcaatgtggccgccacagctctccctctctccaagtgcataaaggtgctagaaaacgaaggccttctcctcgtcagctcatcaacctactccaccttcgagaacaagacattctatagcctccatcttcagagaagtcaaagaacgatgaaggagcagtgcccaggattctgcgacgaactggagaagatcgtcaggaagaaagcaggggcgtagctatctgcagcagccagagcctccaccaccggccggtacacacagtgctggcgcatgcattcgatcagcattcctgcagatccaacggcgtgctactccataagcatgcatgcagctagctaataaggtattctagtttagtctgtaaatgatggactgtttacctgggaaaactatgtagtagcagtactgatgcacgcatgcatccgcgtgctgatggtgtgtccatgtgtgtgtgcgcgctgttgacacagaagaatatatatatatatatatatgataactgtgaaagtcactgcaaaataccaatggatgcatagtatatggttttctttaaccagagtcc

SEQ ID NO: 7601 - DNA, 674 bp, Sorghum bicolor
  unsure (1)..(674): unsure at all n locations
  Clone ID: SORBI-28MAY03-CLUS96467_1
tactggaagtcgcaatgacgaatgacttgctgtcctcgccgtcctcttggtgtccacgcgcggtggcagcagcatcctcccactcccatccccacccgctggacccactctccgccgcagagctcacggctgtccgcgcagccgtgcttgcctctccgttcgtccccgcccgcccgctccacttccactacgtcggcctcgacgagcccgagaagccggaggtcctctcctactcctacgcctccgccacagccctcctcccgcggcgcgcgctcgtcatcgctcgagccgatggccagtcccacgagctcctcgtcgacgtcaccgacgcctccgcgccgtccgtcctctcgcacgccgtccaccgcggcgcgggcttcccgatgatgacgacggaggaccatgtcgcggcaatggcgctgccgcccacgtaccctcccttcgtggactccgtgcggcggcgcgggctcaacgtcagcggcatccttgagatgaaggcgacgtcgtatacacacctcgagcagatcaagtccgacgcgcacggcacgctggtggccgagaacacggtgggcgtctaccacgaccatttcatcacgtaccacctggacctcgacgtggacggnaccaacaactcgttcgtcaagaacaccatggtccccgagcgcaataccggg

SEQ ID NO: 7602 - DNA, 643 bp, Sorghum bicolor
  Clone ID: SORBI-28MAY03-CLUS96516_1
cagctgctctctccaaaccctgactccccgaccccccactcccggctttgcttgctctgcactccgctaattccttcggcggcgatcccgaccaagaaatccaagtgcaagcggcggccgcggatctcgtcgggcggcggccgccactatgatgagcggcagctcgcctccggcgccatcgcttcccgccgggagtggaggcttcttcagggggtacacgaagctgtgcaagggcctcgccgtcatattgctccttgtgcaccttgtagtccagctgttcccgtccgccgtcacctatctcgcacttatccctggaaggacgatcccttttgcttggaacctgataactgctggctatgtcgagcaaacaattccaggggtggttgtcagcatcattggtcttcttttatttgggaagttgttagaacctctatggggttcaaaagagttatcaaaattcatctttattgtcaacttttcaacttctgcttgtgtcttcatgactgccattgtgctgtactatataactcagcaagagatctacctctatactcctctttctggattttatggggttctatcaggattgttggtgggcattaaacagcttttacctgatcaagaacttaatctttttctgcta

SEQ ID NO: 7603 - DNA, 819 bp, Sorghum bicolor
  Clone ID: SORBI-28MAY03-CLUS9648_1
gcctactccactgtccactccgctccatcctcccttcctccggcccgatgcctccgactacgatgccttccacttccctcgccctccccaccgccgcccgcgccggcgctcgccgccatgccttcttcagcaaccgatcaccctcaagcgtccccatcgcgcggcggaggcgcgcgccccggttcgtcatggtctccgcctcggcgtctctggaggcactcatctttgattgcgacggcgtcatactggagtcagagaacctccatcgccaggcctacaacgacgcgttcgcgaactttggggtgcgctgcccgccggcctccgccgacccgctgtactgggacgaggctttctacgacgaactacagaaccgcatcggcggagggaagcccaagatgcggtggtactttggagaaaatgggtggccttcttcagagctctttgagacaccaccttcgactgacaccgacaaggagaagttggttgacataattcaggattggaaaacagagagatacaaagaaataataaaatctggaactgtgaagcctagacctggtgtgttgcggttgatggatgaagtaaagaatgcgggtatcaagcttgctgtttgctctgcagcaactaaaagttcagtcataatgtgccttgaaaaccttattgggcttgagcgatttaatggtctggattgcttccttgctggtgatgatgttaaactaaagaagcctgatccaacaatatatataacagcatcagagaaattaggtgtcggaagcaagaactggtctgtgggtgacgatagtgttattggattactag

SEQ ID NO: 7604 - DNA, 569 bp, Sorghum bicolor
  Clone ID: SORBI-28MAY03-CLUS96584_1
tcagcatttacaatcacattcaagtgtttctccggcgcatagcacgaggctcacctggtgcacggtataccgcttaccgtgatgggactcggaagtatagcagccagaatcatcatagaaggaaagccaagacaagataacagtgcagttggcaggttactgagcaattaacaagctaactcagcgcaaatccagctcaaatggcaagaaacaaaacaatgtaagccgaacaaaatatggagattgaacaatcaataacaagagttgattgggggccttcggaaaacataaaaaccaaggaagagtctagtggagttgtacattgacgctgaaagttccgttacatagctctaaccagtaaccagcagtttccttgtgtaccaagtacctggcaagcagtgaagcaaaacctgcaactgtacatacgcggatcttctagctgctgtttttttttttgtaaaataatagttagcttgtatagtaggcctgtgcatatccgcatgtaatgttccctctggacagcagttttgcaatgcatgttctcgagtattcagtgttcaaaaaaaaaa

SEQ ID NO: 7605 - DNA, 660 bp, Sorghum bicolor
  Clone ID: SORBI-28MAY03-CLUS94983_1
ctttttttttttttttttggaccggaaaaaaaaaacgtactacaagtccacaacagtgatcaccgtttgacagcgcgttccacgagagaataataaagacaaggaagtgcacagcacgaggtctcgatcgtctcatcagctcggtgccgtgctgacgatctccctgagctgccggacgaactcgtcggcgaacttcccctgcacggcgtcgtccgtgaagaagtcggtccacttcttcctcgcgtcgtctcctccgcctccgtcgttcgccaccgccgcggcgaccgcgtcgcacacgtcgtggcgcccgaaccacccgtcctcgtcgcggcgcgccacctcgacgcccacgcggagctcgcgcgcgaacagcgccgcgttcaggtactggtcgcccttcatgggcagcagcacgaggcggcagccggcgacgagcccctcgacgacggagctgaacccggcgtgggtcacgtagcaacccacgctgcggtggcgcaggatgtgctgctgctgcacccacccgctgtgcacgattcctctcccagacaccctctccttaaaccccggcggcgggacgactgccgccgcgccgtccggggagttgagcacggcgaggaacgggcggccggtggcctcgagccccaggaggagctccgtcgc

SEQ ID NO: 7606 - DNA, 614 bp, Sorghum bicolor
  Clone ID: SORBI-28MAY03-CLUS94987_1
cagctctcctctggacgtcagctacggcccaccacctcacttgacttcgtttactagcaacaacctgagtggggcttgctggcactggcgagcggcgcggcgcggcaccacaccagagcacgcagagaagagagccatggcgagcgcgggcgaacggcggcggcggaggcggagtccgggcgctgaagcggtccatgggcccgctgcggctgcagtactacatcgtgatgggcgcggtggcggcggcggtggtgctagccacgctgcggtacatgccgggcccggcgatccccgcgaccgccaccgccgctgctagcaccaccaccagcacctcttgcaccgccggcgccggcgccgctgcggtgcgctccgccccccctgccgcccctggcgcggagggcgtccccctggcgctgctggggtcgacgacgccgtcgagggggtgcacgaggacggggcccgggcgggcgcggttcatcggccgcgacccctgcgccgcctcccgcggcggcgcgccgggccgggggatccccaccgccgcctccgccggctcggccgcctcgccgccatctaccacctccgcgcggggcgcgcttctcgaccgggtcgtcttc

SEQ ID NO: 7607 - DNA, 827 bp, Sorghum bicolor
  Clone ID: SORBI-28MAY03-CLUS953_1
tgtgttctccagaaaggaactgatgatgataagattagccatgaaaaagaggttattgctgcagccgatgaggttgtgggcagtattgataaagaggaactggccaagtatttatctctaaattcagatcccgaagatgaagaagcacagaaattcaagaaaaaaatggaagaaacacgggatcagttggttgatgcactatatcaaaaatgccttgcattggcagagatagagtcactgaagtctgatgagtcaattgagacatctgctaaagacatttttgaggagaattacaaagaattgatcaaatgggttgatgccaaatctgcaaaatatggcactctgactgttttgcgtgaaaaacgctgtggaagacctggtacagcattgaaggttctaaatgatttgattcagaatgaatctgaaccaaagaaaaagctttacgatttgaagatccagttgattgaggagatgggatggacccatgtctcaacctacgaaaagcagtggatgcaagtccgctttcccccaagtctgccaccgttttgatcgtgaactcatatgtttacaaccattctatcatcctgggttcagtagtggtcattttcattgttgggtgcgtcagttcattatttcgatggtcatttgcttacacttcagttttctcgtataaataataatataaaaaagtcaactaggcaagctactggatttgtgcgttattttttttttttcttttgtcatctttcgatcgcaattgactcatttatgtttgtgagagagcatacattatattatgggacgagtaaaaaatgattacgccttat

SEQ ID NO: 7608 - DNA, 758 bp, Sorghum bicolor
  Clone ID: SORBI-28MAY03-CLUS95501_1
ccaagatggagctcggccacggcactgccgccgacacgccccccgccacggcggcgccgggtggcggaggaggcacctttggcagcctgctgtgcggcgccgccgtcgacgagcagccgccgttctggccgtgggccgacggccaccacaccttccagtgaacaaacgaacccattcaattcaagctagctatgtatgcgcctttgcgaatgaatgatcttgggcgacagtacaggctttgatatatgatccaacagcacgtcgaccgacctggctcttcttcgtttcttggcatcatcccatcaatctagcttacgcggtgcgccggaccaccggaggagatcgccgacgccgaccgatcgacgtatgtggccatcatcaatgcgttgttgaaacaagcaaattgatcaaagaagcagctaggacatttgaggtgatgagatgatccaatttgagttcaagatcaggacaggtgtggacgatggatggatcatgtttatgtcagtcgtctactaggtagattttggagttgagtagtaagtttttttttctctccttttttttctattattattattattattattattattattattattattatttattttcccctccctctttgctgctatttttctgttttgattaaatattatatagtgattacaattgtgagaggcagtggtgatattattgttgcattgtgtataggattatatatggtgtcttgtgatcgagtaccaagttatttcttc

SEQ ID NO: 7609 - DNA, 593 bp, Sorghum bicolor
  Clone ID: SORBI-28MAY03-CLUS95712_1
gctggtcctctgctggctgacacttatgtaactctcctaaaaggtcgcaatgcatggtatgggcaaatgcttgccaagggagagttgagtcctgacatgggcgatagtatcaagggaaagggaatgattcagggtgtctctgccgttggtgcattttttgagctgcttagtcaacccagcttaagtgtgcagcacccggaagaaaacaagctggtcgctccagctgagctatgcccaattctgaagaggctttatagaatactgataaaaagggagctcccagcaagggacatcctccaagcactgagggatgaaacgatgaatgatcctcgggaaaggattgagatggcacaaagccatgcattctaccgcccgtctctccttggaaaaccatgatctagttaatcctgtaaattagtagaatataaacagacgctgtgcttcgagcaggtgtctcccctgtgcttgctgtcctgtgtccgacctgcatggggctttgtgagttgtctaattctttgtgcttcctcattgctataatgtacaagagattactgaatcaataaatgttctaagtgcatattatatgaacaccc

SEQ ID NO: 7610 - DNA, 741 bp, Sorghum bicolor
  Clone ID: SORBI-28MAY03-CLUS95821_1
gagcaatcccaaatatttcgcttgcctgctcacatggttgaagcaggttaccgcgtaaaggagtgcacaaaacgacttcgccgtaagctaagaagacgacccaccaatgaagaaattgcactggacactggtatgccaattaaacgagttgaggcagcagtaaacctccccaagtatagtgtatcccttgatagtaaaattggttccaccgacatgacatatcaggaggtcacagctgatcccagtgctgagacagctgaagaaatgctcaacagaatgtccatgaagaaggatgtacacaaggcactagatactctcaccacacgcgagaagcaagttgttgttctgagatttgggctcgaggatgatcggataagaaccctgcaggagattggtaatatcatgggtgtgagcagggagagaattcggcaaattgagtctggtgcgtttcggaaactaaggagcaagaagagggtgaaggctttgaaggattacctggtgccagtaggcaattggtaaaccgtttgtttgcacaaaatttgttttcctttctggactcctcagatttttcttttttgaggattctttacttgtaccattttacgtgggtcctcatgtaaaacacactatcagaaaatttgcattacaagagggaataacagtttatttccgtggaaatgatgtaattcacaatttcttagctgcttgttatctcagattctagaaatgaaatatgtggtc

SEQ ID NO: 7611 - DNA, 713 bp, Sorghum bicolor
  Clone ID: SORBI-28MAY03-CLUS9589_1
ataggctccccgcacccggataacttttgccgaccaccgccgttcctctcttctccaaatccaaattggtaaatttcccgaatccggcgcccccacacccgcatcctcacctcgtcagcgccggcagccgtcctgttctccatctccgctcagtcgggtggggggaaattctgttcggactgattcgtcttgtcggcatgtctcattatcacagcggcgattttgaagagatggaggatgagtacgacatgaacgagccagtcgagggggaggatgagtaccaagagctcgtggttagggactctgatgcggaggaggaagacgacgcggaccaattgcataagctctccgacacatcagcagcagacgcaagaagtgggaaagatattcaaggaataccttgggagacgatagaagtcacaagagaaacatacaggcaggcccgactagagcagtacaagaactacgagaacatacctaattctggagaagcagcaatgatggcatgcaaatctaccgagaaaggaagaacatattacgaattcagacgaaatactagatccgtgaaatccactatctctcactttcagctgagaaatttagtatgggcgacatcgaagcacgatgtgtacctgttgttgcattactctgtacttcactggtcggccttaaatggcgttgatacagaaattatggatgtacatggacatgtt

SEQ ID NO: 7612 - DNA, 922 bp, Sorghum bicolor
  Clone ID: SORBI-28MAY03-CLUS95982_1
gatgggcttttggaatgaacatttttgacttgatagcttggaggaaggaaaacgccacgtcattgtatcattattggcaagagcaaaattctgacctattgctctggagaacaggaactcttcctgcaggtcttttgacattttatggcctgatggagcccctagaccgcagatggcatgtcttgggtcttgggtatgatgtagacatagatgatcgtttgattgagagtgctgctgttgtgcactataatgggaacatgaaaccctggctgaagctggcaattcgccgttacaagtatatatgggagcggtatgtgaatatctcacacccgtatgttagagagtgtatgttgcattagaaagtatgcaaatctctgtatgttcttgcatggcattgaagctggatgcttcagtttcttcacatgaggctgctttcgagcaccttatgtgagggaaagtttcagaggtagaatatatactcaagggacagcatcaaagaagtcaactgttaagttttctttttgggttgggggaagattcattttgggatgaaaataattcctttgcagagtttacatacaatttggactggaaattttagcagtctaaccagatacatctggatagatattgtaaaagagatacagttggaccaatgggcaattttttttttgagatttaggaaatgcaaattgtgagctcaactgtgcagggtcagtggtgttgcattcttttggtagtatcttgttttataccggcgaagaaggttctgcctccctccttgtataagtagctgttttaatttgtgctcattcgtacagtatgaactcagttgaacctgagaaaggattctgaaatcatatatgatgtgcttaagttgagttgctgataatgtatcactgatacaacagaaattcaggtc

SEQ ID NO: 7613 - DNA, 527 bp, Sorghum bicolor
  Clone ID: SORBI-28MAY03-CLUS101918_1
gcacgaggctcatcatgatcatgtctacgaaataacacctcttagtacagataactccaaatgtcttttcttcaagcgaatctttggctccgaacatatatggcacgaggatttggaagacatttccagtgaaatcctggaaaaatgcagtggttcaccactggccattgttacaatggctagcttattggctaacaaagcctgtacaaagcaggaatgggatagggtatgtaattcaattggttcaacactggaaaaggatcctgatgtggaagaaatgagaaggatattatcccttagctttgatgacctcccccatcatttgaagacatgtttattgtatttaagtatatttccagaagattatgagattgaaagggatcaactagtaaaaagatggattgctgaaggattcattaatatggagggtggacaagatttggaggagataggagagaattatttcaatgatcttatcaacagaagcatgattcaaccaatgaaaatcaaatgtgatggtcgagtgg

SEQ ID NO: 7614 - DNA, 650 bp, Sorghum bicolor
  Clone ID: SORBI-28MAY03-CLUS97734_1
agagggaaaggaaggcaaagagagcgggggtggcaagagcagcagcggtcatgcaggctacggcggcggtggccactaccaggcgatgcagccggtctcgtaccctgcctatcagcagtacaaccccatgccgtcctaccccgccgtctactcctaccctgcagcttacccgcagcaagaacatgacccaggatgcagcatcatgtgaaaaactgtaaatcaacatcgcacaagataatcagctggagagttgattatattgaaggtggccaaacaaatggagattaacttggttgggttcgccaggacaagatgctgccttaacctgtttgtgcaaggctgctggatgatgatccaggatggatgtgatgcttagctgtgactgcgaccatcatcatccgtgtaattatgtacagggttggacagcaaaggtgggaacagagtttgaagtctggaggtgttcatggaaggggaggccgagctgtgacggcagcctagctagtcgtacgcaagattgtgatgcaagtgcagattgagtagcagccagcagtgttttcttttcctttctttcgtttttgttaaagaagttgctgtgtttgttgaagaaaatgaggcaataaaatgagtatatatatatacagagagagaga

SEQ ID NO: 7615 - DNA, 646 bp, Sorghum bicolor
  Clone ID: SORBI-28MAY03-CLUS9754_1
agaagaattgtgctccagcagtttatacaccagaattaagatatgtgtgcattgctggaaggtacattcaaggtgctcctcttctggggaactccgcagctgcttctgatgagatccttgcagttgacactccttcagaaggaggtgaggctgttattacgggtagcaatgacaaatctactcggtcaagtgtcacgtggagagcccggttcgtcgggcaagggtacaaacaggtttgtggccaagcggatgtgtggggcgacggcgtcgtacctgaaatggcagcgcatctggaaggagcactgaacataagctttgacggcgtgtaccactctcctgtaggctctgatgatgaacaaaggccctggtatggctctccagcaatcctcaagcagtgggtgcatcaccttctcagttgagatggcatacaaaagctagctgccggaacagaaactggaatgtgtcctacatctggcatgccaccaggcccaccgaagggaaactttttctcggcctgaaatagtgaaattgaggggcatgatatagcatcgtaaatcctgtagggggcaattgtgtgttgtcagcttctgtagacaattcaacctgaggtctttttgtctaatatataatagacgtggtatatctc

SEQ ID NO: 7616 - DNA, 273 bp, Sorghum bicolor
  Clone ID: LIB3480-033-P1-K1-H7
atagaacatacatttttctgattttgatgttttaagaaatgagataggtgcatattccagcatgtccttgtcttatgaccacataccttcatgtgtgataccatctcttcattgtatcacaggtacattcaaggtgctcctcttctggggaactccgcagctgcttctgatgagatcctagcagttgacactccttcagaaggaggtgaggctgttattacgggtagcaatgacaaatctactctgtcaagtgtcacgtggagagcccggttc

SEQ ID NO: 7617 - DNA, 603 bp, Sorghum bicolor
  Clone ID: SORBI-28MAY03-CLUS97749_1
ctgaagagatccactgatccagaagctgctgctgcttcagatgcaccaagaccttcgtctcaagaactaaaggatgagatacttgaggtggctggcaaaatatacaaggcaggaatgtcccttcttgtcatcgacactgagaacaagtttgtatccacgggatttgccaaggaaattgcaagggttgcccaagggaaatattattatctgcccaatgcttcagatgctgtgatttctgctgccaccaagaccgctctgactgacttgaagagctcgtgattttggagcagcggcacccgttttctctaccttctgatatggatggtgaacctacattcatgcagtaatttgcagtgtgttcatacaatgcttgtgtagaggtgagcgttttggctcgtttgaccaattttggtgtaggtctccaccacgagagaggaaaaaagaaataccgagcatggcatattggcatcgtgtaaagtgtaaaggtccaatggcttccagtctctaatgtttggcgatgtaaatccgctggccgcggcccgcggcagctgtgtactctgtatatcttgagtgtcaataatgccatgcttagcacttagcagt

SEQ ID NO: 7618 - DNA, 1030 bp, Sorghum bicolor
  Clone ID: SORBI-28MAY03-CLUS97769_1
gcacgaggttaacattagcacagagcagctcaaatatcttgtcatggaagctatacgaggtggctgtcaggggcatcgtgctgagttgtatgctgctcgagttgcaaaatgccttgctgctatggaaggacgtgaaaaagtatttgtggatgacctcaagaaagctgtagagctagtcattctacctcgctcgagcccgtcggataacccacaggatcagcagcaagagcaaccacccccacccccgccgccaccacctccagaaaatcaagattcctcagaagaccaagacgaggaagacgatgaccaagaggatgatgatgaagaaaatgaacaacaagaccagcagatacctgaggagttcatctttgatgctgaaggtggtttagtagatgataaactccttttctttgctcagcaagcacaaagacgacgtggaaaagctgggcgagcaaagaatgtcatcttctcagaagataggggccgttacataaagcctatgcttccaaagggtccagtaaggaggttagctgttgatgccacgcttagagcagctgcaccataccaaaaactgcgcagagagaaagaacgtgacaaggcaagaaaggtttttgttgaaaagactgacatgagagccaaaagaatggctcgaaaagcaggtcatatttgttgtggacgctagtggtagcatggctctgaatcgtatgcagaacgcgaaaggtgcggcattgaagttgcttgcagaaagctacaccagcagagatcaggtttcaattattccttttcgtggagattatgctgaggttttacttccaccatcaagatctatagcaatggcccggaaacgtcttgagaagctaccatgtggtggtggttctcctttagctcatggcctcagtacagctgtcagagtgggttcgaatgctgaaaagagtggtgatgtcgggcgtatcatgattgttgcaatcaccgatggaagagctaatgtatcactgaagagatccactgatccagaagctgctgctgcttc

SEQ ID NO: 7619 - DNA, 497 bp, Sorghum bicolor
  Clone ID: SORBI-28MAY03-CLUS10874_1
gcacgaggaacagagcagcacctggcactggcagcggcgctcaagagcaccagcaaaacgttcatcctgctccgactccgagacgaaaaaaatgcaggcgttcctctcttcgtcgatcccggccacttcctactcgaggtcgtccttattcctgccgcagccgcctcatcaggctcccgtgaagctcgtcttcccgtcgtcggcgccgcagaggggcagcggtgccgtcgccgccgacgccgccgctaggactaggagaacagcttcggaggctgctggtcggtcggggcggtgcgtggcggcgtcctcgtcctcgtcgtccccggccacggccgcggtggcgacgacggaggtgccccggggtgatgaaggcctgggtgtacgacgcgtacggggacgccagcgtgctcaagctcgacgaggccgcggctgtgccggccctggccgacgaccaggtgctcgtcaaggtcgtcgccggcgcgcctcaaccccgtcga

SEQ ID NO: 7620 - DNA, 590 bp, Sorghum bicolor
  Clone ID: SORBI-28MAY03-CLUS109208_1
gcacgaggcgagcaccacccccagagctagcaacaatggcggagagactggtgccgagcacgaagaaggcgatggagcaccgggaggagaagcccaaggtgccgtcgagcgacccggagcctgacctggtgacgctggtggcggagcagcagccgcagctgcagcgggagcaccagccgcccaacatctcggagatgaagccgctgacgcgggaggcatacggcggcgggatgtacgggaccgatgagaacgcgcggagggatcccgcgcggccgcgcgccagcgccacgcagagcgccgacgggccggaggagcagcgcgccgctacgtggcccacccacccgccgccgccgtccaccggcgaccgcgacctcgacatcaccggacagtcctacatccagtagtagccgcctgtgcggctgcgccgagcgccgcgcttggccttgggtgcacgctttgttattgttgtttttttttttgcctgtttattacacaagtactacttgcttttttattacttggctctgtacgtgccaagttgtacacgtcgctttgttaccatgtacagtagtatagtactagtagttttt

SEQ ID NO: 7621 - DNA, 750 bp, Sorghum bicolor
  Clone ID: SORBI-28MAY03-CLUS10890_1
ggcgtcggtgcggcggagcccttgagcctgcggcggcgacggccgccggggcgccggcggaggaggccgcggcgggcggcaaggaggacaaggccgcggcggtgtcctgctcgatctgcctcgacgccgtgctcgccggcgccgggcacggggccaccgccaggctgcactgcggccacgagttccacctagattgcattggatcagcatttaatgccaaaggggttatgcaatgccccaactgccgcaaaattgagaaagggaattggctttatgcaaatggttcccgatctgcacatgatgttagcatggatgagtgggcccatgatgaagacctttatgatgttagctactcagaaatgccacttcgcttccattggtgtccatttggtcgcttagcacaacttccatctttattcgaggaaggagaatcatcacctccaattacatttcatgacttcatgggacaacatgtatttacggagcaagtagctgtatctgctgcaccagggacaactcatccttgcccctatgtggcatacttgcatcctcttccaccactgacgtcatcgtcaagctcccatgtccctgagaggactatggatcgtcctgcataccatgatcattggaaccccatggctgggccatcagatgttaggcccatgcaaacaatgcaacctgctgatttccatcatagccattgggcacacgtgccccattcttatgctcaacccaacagtaataacgagc

SEQ ID NO: 7622 - DNA, 915 bp, Sorghum bicolor
  Clone ID: SORBI-28MAY03-CLUS10939_1
gcacaccaattcgattccccatcgagagcctgtttgcctgccgctgatcgccatggccgccgccgccgcgctgaggtccccgtcctccgtcagggtcgtctcgggcccttcctccgccgcaggggcggggctcgccaaggcgcgtcgtcagcaggcgcccagggtcgccatccgcggcgccgccggggccgggcagcagccgcggagtccccgtggcgccgccgccgccgtcgtccgggcgtcgctgttctcgcccaagcccgcggcggccaaggacgcgcggccgaccaaggtgcaggagctctacgtgtacgagatcaacgagcgggaccgcgagagccccgcctacctccgcctcagcgccaagcagtccgagaacgcgctcggcgacctcgtccccttcaccaacaaggtgtacagcggcagcctggacaagcggctggggatcacggcggggatctgcgtgctgatccagcacgtcccggaccggaacggcgaccggtacgaggccatctacagcttctacttcggcgactacggccacatctcggtgcagggcccgtacctgacctacgaggagtcgtacctggcggtcaccggcgggtcgggcgtcttcgagggcgcctacggccaggtcaagctcaaccagatcgtcttccccttcaagatcttctacaccttctacctcaagggcatcccggacctgcccagggacctgctctgcacgcccgtcccgccgtcacccaccgtcgagcccacccccgccgccaaggccgccgagccgcacgcctccatcaacaactacaccaactgatgaccccagtttctttcgattcggtgcttgcttgcgttgcgttctactagttagtagtaccaataaattaaagatgcagagggagggatcgatccacttgt

SEQ ID NO: 7623 - DNA, 743 bp, Sorghum bicolor
  Clone ID: SORBI-28MAY03-CLUS109434_1
ccttggggtagctcgtctccctgcccttctgcgtactctgcccctggtgggcttggatttcctggcgtagatagagcgctcccgacgcaagcctccatcggtttcggtcgccggacatgcccctagggccccttaccggttttcacccgtgctattccagcctctgcatatcggccccctcctggccctacacttcccctccgccgtttttgcccaccctccgtgtttggtgcgaccttgcattcaccggccaacgtggccctgaattcaggtaaggctgcattgatcactgtcgggggacttgcagctggtgcaactgtcggatctgcagtggagaatttcctgcaggttgatatcgtgccctttctaggcatccactcccctgccgtcgttgtcagtgaatttattctgttctcccaattgttggtatcactgtttgttaggtaggatctgaaatcaagctgccaacttggcatgtaattaactgaaatggatcgtgttcaaacttcaaaagggtcagggaaatgcttattttccgctcaagatgaaagcagctgtgtatagcaaacaatacatggacatctctgtccctgataaagatcacctgtatctagttctctcactctcactctcaatctttcaggaagaagcttgtatggattgcagaatgtggaatgtaaattctttggattaatattaatactctgaagtctggaatttactgattcctggctggagacttt

SEQ ID NO: 7624 - DNA, 882 bp, Sorghum bicolor
  unsure (1)..(882): unsure at all n locations
  Clone ID: SORBI-28MAY03-CLUS10969_1
gnggagtggtggagactactaacaccaatgtgcctgcactctggtttcttacatatagcccttggttgttgggcattgcttttatttggacctcgagtatgccgggcatatggtcaaatgacattttttctgatatacatacttggaggaatctgtggtaatttgagcagtttcgttcacactcctgagataaccgtttgtggcacaggcccagtattttctttaattggagcgtggctggtgtatcagagtcaaaacaagcaagtcattgacaaggacgtttcagaaagcatgttctggcaggctgtgatagctgcagctttgagcttcttattgagcatttttgggagaattgacaactgggcacatcttggggcaaccatttctggacttttctttggttatctgacatgcccaagtgtagaatttgacaattctgcaaagaacggtcaaaaggaagccgtggttcttattagacgacaagctcatccatgcaaatccactgcagtcttcttcataaccatacttgcatttgctgtagtcgccttcgcttatggcacacaattcaacaatatggatctggaataggtgaatagctaagtgtttgtcatggttcatttttatatatttaggtagcccgacaagtatatattccagaatgtgaaagagcacgcgatgcaaggaatgtgaatgagcacgcgatgtaaggacttgattttgtagtatggatcagttttatatatgtaactacactgcaatagtctagtacagttggtttttggattgactagagcttgtcagtgtccgcaggcaggtaatacagccatggaggcataactatttgtataattggtttgaataagaactgactgcacagctgca

SEQ ID NO: 7625 - DNA, 394 bp, Sorghum bicolor
  Clone ID: SORBI-28MAY03-CLUS98678_1
tcacgaccatatcaccgattggggtgatgcaaccatctcaaagatcagcccctgttcccacccaaacaggaataacagctgacgatctgagcaacaccacctcgaaacttacttttaatcattgcattagagcataacaacaaaagacaccaaaacaaaagcagtgcgcattggctgtctttctcaccgtcttctcctgacgacggtgtttcgggcatcgaaggaaaaccgcatgaaatgatttgaaacgccacgacatgtgtggtttggaatatagcatattgaatttagcgactgtcttgaggagttttgcatatcattttggtcgtgcactggggcaaatagaccaagaggcgttggattgaatagaccaataaaagtctacttgttttac

SEQ ID NO: 7626 - DNA, 129 bp, Sorghum bicolor
  Clone ID: SORBI-28MAY03-CLUS98747_1
ttctgttcatgttaatgattgtatttggacatgtattgctaacaaacttgggatggcgaacatggcgttatgggaatcagttatgagccaactgaagggttatgaatgaaatcatgattgcttcccccc

SEQ ID NO: 7627 - DNA, 949 bp, Sorghum bicolor
  Clone ID: SORBI-28MAY03-CLUS98777_1
gcacgaggaacgaccagcctctccacaccgaccgctttgccgacaactgtgcccaagccctgagtgatggcgccaaagctatcttcagcttcaacgagcctgacaacgctggccaggctttcatgactgctgcctacgctgccaaggcccatgtcaagtggctcaacccatatgctggaaaggccctcatcggtgccccttccatcagcaacagtggtcttgctggcgagggtgtcgagtggctcaagagctgggtctccgagtgcgagaagctcgacgagcagtgccactatgacttctgcaacgtccactggtactccgaggttgagtacggtagcactctcttcgaccacctcaaggcttcccacgaggcttgcggcggaaagcccatctggctcactgagttcgctcctactggttccgatgaggccattgcctcctggctcaaagatgccatcccccagcttgaggacctttcttaccttgatgcttactcctacttcaaggtcgatactggcatgcttatgaccagcgagactgagctcagctcgtacggtagcgtttatgcctccgcttaaactcgcgaaggctcaaggcagacggccactcggttcgttttataacttcttgtacactcgctagggaaatacccaaccattcaaaataggctttcgggagggaggataaacattttcggttcaaggatggcgcctgttgacttatgtacatattctgcatttaggtgaccaggatctggctcacagtatccaagtttatatcgcgcggtcaacctccttaccttttttcttatcatcaattccgggatattacaaaaagggaggactttgcaaatagaacaattcctgattttagcagtttgatagacttctttcagcgtgtagatacatctacgagctacgatgacaatgaacagcgatttcactgctcc

SEQ ID NO: 7628 - DNA, 628 bp, Sorghum bicolor
  Clone ID: SORBI-28MAY03-CLUS9660_1
agagaaggcagcgtggaagtttgcagaggagaacgggctagatgtggttgtggttaaccctgggactgtgctgggcccgatgattccaccagccatcaacgctagcatggccatgttttgtcgcctccttcaaggctgcacagaggagtatgccgatttcttcataggaccagtacacgtggaagacgttgccatggcgcatatcatggtgttcgagaacccatcggcgtcggggaggcatatgtgcgtccagtccatctgtcactggagcgacttcgcggtcaaggtcgccgagctctaccccaactacaaagtgcccaagttccctaaggacacccagcctgggctggtgagacaagaggtaggctccaagaagctcatcgcgctggggcttcagatcactcccatggagaagatcatcagggatgccgtggagagcctcgagagcagaggccacatctcctgaatcctgatggatggatggcaggatgggcagtccttgtgaagttgtgatgtgaggccgtcatatggaccttgctaagttgccagcgtggcttgtaactagtagtaataatgatgtcaccagatgatgattataataagttcccgttggaaccgtgcctcgtgc

SEQ ID NO: 7629 - DNA, 844 bp, Sorghum bicolor
  Clone ID: SORBI-28MAY03-CLUS96618_1
tactggaacgctgataggaggagctctttctattctgcatctgctactcctcacctcatagatcgattgccgtgggcaccggtttctccgacctcgcctcgcctatggcgcacgacctgtgcgacgacttggagctcgtcgccgactgcggctacgacgacgactacttggacgacttccatttccatgacgacgacggcttcccctcccctgccaccaccaccgctgctgcgtccggctccggcctgcagcagcatgagcagatggataatacttcagctttggactataaagaagggaaagacatgcaaggaataccctgggaaagactgaactacactagggagcagtatcgtcagatgaggttgaaagaatacaagagctatcagaacctcacgagatcacgcagcgggctacagcaggaatgcaaacaagtggagaggaaggatactttctatgatttccatttgaacacgagagctgtcaaatcaacaatagttcattttcagctgaggaacctcctgtggcctacttcgaagcacgacgtgtacctggtgcagaactactccgtgatgcactggtctgccctgctccagagaggaacggaagtgctcaatgtggccggccgattggccccgacacagaatgtgaagggggctagaccattgtcgagggttcagatcagcaccatggctgtgaaggacaacctcattgttgccggcggcttccagggagaactcatctgcaagtatgttgataaacccggggtggcattctgcacgaacctgaccggcgacgacaactccaccaccaacgccgtcgacatctaccaggcacccaacgg

SEQ ID NO: 7630 - DNA, 722 bp, Sorghum bicolor
  Clone ID: SORBI-28MAY03-CLUS96625_1
gcacgaggcaaccgtgttttaagctcgtcgaggtgccgtacggtgttggaccggccatgtggaggctaaagatcggagagggaggagggccatggatgcagacggcgagtgacttccatggccggcaggtttgggagttcgacccggatgccggcacctacgaggagcgcagcaaggtggagcagcttcgccggaggttcacagagaaccgcttccgaaggagggaaccgcaggacctcctcatgcgtatgcagttcactggagaagaacatctgcatgccgatatgcccccggccaccaagatagaggatggcgacgaggtgacgccagaaattttgcaggagtcgctgaggcgagcgctgggttggatgtctgctctccaagctgaagatggtcactggcctggtgattacagcgggattatgtacctgctgccgttctggattttcgccctgcacatcacaggatcgatcgatgctgtcctgtcgaaagagcatatacgtgagatatgccgccatatctacaaccatcagaacgaggacggcggatggggtttcaatattttggacgagagcgctatgttttccacgtgcttgaactacaccaccttgaggcttctcggtgaggtgcaaaaggaggaaaacgatggactagctaaaggtcgagcatggatcctatcccatggaactgcaactgcagcaccacagtgggcaaagatacta

SEQ ID NO: 7631 - DNA, 784 bp, Sorghum bicolor
  Clone ID: SORBI-28MAY03-CLUS9745_1
tcggtgtggtcgtgcgggggcggtgctgcgctcctctctctgttcggcaggactcctcatcgccgcctcactactccaatccccatcgccattgccggcgcaagcaaagcaagagggggcggagcagcatggcggggcgctacgacagcaaccccttcgaggaggaggacgtgaaccctttctcggaacaagcacgcggcaaggctggtgggcagtccaacttcggtggtggcgcgttttacatgcctaacccaagaaacgtgcctcctgcatccaattcacgcctttcaccacttcctcctgaaccggcagacttcagtgctacagtggatataccccttgactcgtcaaaagacctgaagagaagagagaaggagctgcaagctagggaagctgaattgaacaagagggagaaggagctaaaacggagagaggaggctgcagcaagagctggcattgtcattgaggagaaaaactggcctccttttctgccactcatccatcatgatatcaccaatgagataccgagtcaccttcaaagaatgcaatatgttgcatttgcgtcctttcttggattgatttgctgcctcttctggaatgtcatagcagttactacagcttggatcaagggggaaggtgccaagatctggttattggcaataatatacttcatatctggtgctactggtgcatatgtaccgtggtatcgtgctctgcataatgcaatgaggactgatagtgcatcgaagtttggattggccttcttgctttactagatggacat

SEQ ID NO: 7632 - DNA, 619 bp, Sorghum bicolor
  Clone ID: SORBI-28MAY03-CLUS97507_1
gcacgaggcaatgtcgctctcctcttgcttgctcgccggcacccgggcggcagcctccccttccttcccatcctccgctgccatccgccggcgggaccaccgcccgctgaccgtttccgtggtcccgctctcgccctctcagcaatggcgccacggcctccgcttctgctgcgcctcctccacctcttcctcacctccgccgccggcaccgcccgaggagcccgacgactatgagctattggacacgactgggaattgtgaccctctatgctcggttgatgaagttagctcacagtactttgaagctaactacaaaccgaaaaatgaccttctaaaagctttaactatcattggcacagccttggctggggcagccgcaataaaccattcctgggttgctgctaatcaggacattgcaatggtgttggtctttgctattggctatgcaggtatcatttttgaggaatcactagcatttaacaaaagtggagttgcgttattgatggctgtctgcctatgggttatcagaagcattggggctccctcgactgatgtagctgttcaagagttgagtcacacaacttctgaagttagtgaaattgtgtttttcttgcttggt

SEQ ID NO: 7633 - DNA, 554 bp, Sorghum bicolor
  Clone ID: SORBI-28MAY03-CLUS9752_1
cacaaatacttgaagcgtcatcagtgtgtccacagtgagatgaggccatttaaatgcccctgggaaggatgtaaaatgactttcaagtggctatgggctcagactgaacatatcagggtgcacacgggagagcggccatataagtgctcagcccctgactgtgggcagacattcagatacgtctcggattacagccgccacagaaagaaatttaaccattattgacagggtctagttttcgagttcctggccgcagcttgaggcaaatctccagctgcttgtgttggtgggccttgtttgttgtagtagctcacatatttaacaacctgacagctgataggcctagtgaatgttcccggttaacaatgtgctaataatttagtgtaggagttagaatttgttgggggtgaaaggcaacccctcctgttgtagatttgcataagctgatcacctcacctcactgacacatggccattcattatttgtttctcagctcagtgatgtatttaatctctgacaaacttcatgaacactgaaatcatatgctcgatttc

SEQ ID NO: 7634 - DNA, 841 bp, Sorghum bicolor
  unsure (1)..(841): unsure at all n locations
  Clone ID: SORBI-28MAY03-CLUS9758_1
ctgagatctgatttctgggggacaaacttcaaaatatacgatagcaagccaccatatgatggtgctaaagcatcaagtagtcgatctagtcgtcgtttcggaagcagaaggatcagtccccaagtatcagctggcaactatgaagttggacaggtttcatacaaatacaacttgctcaaatccagaggccccaggagaatgtattgcactcttgaatgcccttcagcccaagagacttgggaaaactcactcaagacaaagttcaggaggcccttggggcccacgactttacgaaataaagcaccccgctggcatgagcacctgcagtgctggtgcttaaacttccatgggcgggtaacagttgcatcagtcaagaatttccagcttgtggctgctgccgaccccagtgaccctactagcagcgtggatgatgaaacggttctgctgcagtttggtaaggtcgacgacgatatgttcacaatggattaccggcaaccactctccgcgttccaagcctttgccatcagcctcagcagctttgggaccaagctagcctgtgaatagtgatacagttcgatgctcttcgtgtggctatatggtctgtggcggtggttgcttgcatgcttgttgttgttactatactacgtcatcttttttttttagttgagtatcgatgtaccatttgtaccatgctgttgtacaagagatgtactgtactgttatgtcgtcaaaaggacttgttcaagaaggaaattctgtgttatgaacttttgctctggttccatgcaaaaagacattccaatgtacatatgttcatggtgaactgaactttttccccttn

SEQ ID NO: 7635 - DNA, 742 bp, Sorghum bicolor
  Clone ID: SORBI-28MAY03-CLUS99243_1
gcggcgcgtactactacagcagccacccgacgagcgccaacaccctctactaccacgagggccccttcgccgggcgcaggatgggccggagcagcaggccgctgtcgctgcagacggtggagctgaaggtgcggatgtgctgctcgggctgcgagcgggtggtgaagcacgcggtgagtcggctgcgcggtgtggactcggtggaggtggacgtggagatggagaaggtgacggtgacggggtacgtagaccggcaccgggtgctcaaggaggtccggcgcgccggcaagaaggcggagttctggcccaacccggacctgccgctgcacttcacctccgccaaggactacttccacgacgaggagtcgtaccgccgcacctacaactactaccgccacggctacaacggcgacaagcacggccagctccacgagccgcaccgcggcgccgaccccgtcagcaacatgttcaacgacgacgacgtcaacgcctgctccatcatgtagctactaatagctagtagccgccgttcttccttggatcggccgggctgctgctcgccaccctgctgatgggagacctgcagccccgttgtggcgttgtgtgatcattgtgtgtgtatgtgttctcacttctcagagaattagcagggtagtcaagtgtgacagagaggcggtgtgtgcctctgtgctcatcagctcatgcgtgtgtaacaaatataatggatgctgcgagtcgttgc

SEQ ID NO: 7636 - DNA, 669 bp, Sorghum bicolor
  Clone ID: SORBI-28MAY03-CLUS9924_1
gcacgagggttcctatggatctgccataacttgcccactgatggttaagggccatcctggaggaagaaagactcataacctgctttctgctgctgaccacattcagtcaggagacagcagtgttctatcaagatcaaaaggttgcatagctgtgccagagaatattaaggatgaatatttcttgtcaggctcggatgaaactggtgtccccccccatgcgcatcctggtctacaagtggcaccaagtagggctctcagaaggttgaacacaagcacatcagatggaatgtcatcatcctcgtatatcactggaagggacgacattctgcgtggcagctgtgagtttggatcttcagactgggagcatgtgctgaaggaagaaatcggctcaacctaagggctcaagggatctggctggaagtatatactagtagtgtacatgtacgggcaaccacgaacctaggaattcgaggcctcttgattttgcttgacaaggctgatgaatgggcactgcttgatatggtgccgctctagcctacggaaaaacccttatttattttgtgttgggaacaatgtttataaatcataacttggttgactatgctaattttctagtatgccaaatgcagatgctattttggcacacgattaagaagtccagcgtgccat

SEQ ID NO: 7637 - DNA, 463 bp, Sorghum bicolor
  Clone ID: SORBI-28MAY03-CLUS99323_1
actatgactatgaacagatacaggtttcataattgctcgtaacatgtatcacaaatttcctacttttgggacgattgcatttctgctgctttacacaagcgaaacacggttccctaccgttcttggggcttgaacgggtttagggaacggagggttggctctctataagaacgaggcttggagttaggatcgaattggaagcgggcggaattggaggccctttcgcatagcaggctacaaaaggaatttcttttgccctttttgaattgcagagttaaaaacacaaaggacggcctggcacggcctggcgctggtggttatgaagaaggaagcctagttaatgaggcgacgaaagctcatgatgatgcaaacaaaactaggaaatggagcttgacacatatcagaagcacaactcaaagaggaatgaggcatctgacatgaatacaaccaacgattcaagctc

SEQ ID NO: 7638 - DNA, 430 bp, Sorghum bicolor
  Clone ID: SORBI-28MAY03-CLUS99371_1
gcccctttgtgatcaagtaatggcatggccccttgcaggtggcgaaccaaactgctgatgctgaacttgcaatgggagccttggacattatgaggattttgcttgcacaagtcaggccttttgtctcagtacgtgactctacttaaaaagagactttagaagatatgatctctgactaacagaggcgggccatctatagacggcagctatcatagagctcgagcgatctacatctatgcagtagacaagtttttgtttcaaaaattcattttaagttcccagttttaaaatctaaattttagaactgtggaacaacattggatgttggcatggtctgtagtaaagttgtacttctctatgtgatatatgagtctgtggtttgaagctatccgagtcccaaaatatgagtttggagttcttagattttgag

SEQ ID NO: 7639 - DNA, 882 bp, Sorghum bicolor
  Clone ID: SORBI-28MAY03-CLUS978_1
cttggattaagacatgttcttctggtagtgagatgccttctgattgaaccatttcctgaatctgcacttaatgaacaagctgggaagatgttacttgaaaattatgaggaatatgcacggcatgcaaggttatacactggcatccatgcccttaaacctaaaaataagtccaagactggagctatatctgagtcgaccacagctctgaatgtcgacaagtcgagtactgcttccagcgagaacacaccatcgatgccaccggccgtatcgacctccactgcatccagagcatttggtacaaatttgcaggatcagaaccctactgtttctgatcctgctgtaggagccgcggcggcgcgaaagaaggatggcccaatggcctccaaagttcctgttgataagaaaaagatggatgcgcggaagaagagcctgaagagattataggcggaactctccttggaagaagagggttcatagctcgaaattcatcagatgcttagtgaagctgggagagaaacaatagttgagaagcatctgatgacctggctttcgggagaaagggacccggggcggggccaagagtgaataatgtgaactgctggtccttcgggacaactgtatgagcaatatccagtcattgggaagaacacttgcctacttccttttgttgtttccccttgtctcatctgatgcattcaatcaacattcaggtttcagtgcgtactccgcgtacatgtgcttccgacctacctgaccaattgtgcgtcagatgctcagtgctggctgcaaaactatgcctgtatacgtggtggtttgatgtgctgcctttacctctttggatcgtgggcagcggttaagcctggttaagccttgtttagatgc

SEQ ID NO: 7640 - DNA, 666 bp, Sorghum bicolor
  Clone ID: SORBI-28MAY03-CLUS97877_1
gtgttcatggtgaaggtgagcgacccgacggtggtgatccgggtggtacagagcggcgacgacctcggcgggcacgtgaaccacccggtgttcagcccggacggccggagcatcgccatgacggcggacctcgccgccgtgtcggcggatcccatctcgctgccgctcttcatccactcggtgaggccctacggcgacatcttcgtggtggacatcgacccggacgacgcgaggaagaacaaggacgtgaagaagttccaccgggtgacgcacagccggtacgagtactcgacgccggcgtggaccatgttcgccacggacgaccccaacgcgcagtggaacatgctggtgaacaaggactcgtacacgccggcgtgcccctacgcgtacccggacggcggcgagagctggcacatgaccggacacctctgcatccccaggaggtgctgctgatttctgtgattgcaggatttcgatcgattgcatcccttgattcgtcgtcgtcagtcgtcaccagctaccagctattccctgcctttttaatttgttcatcatccatgagtcagtaataataaatatgggcacatgataaagctatggcaatttgtgtcaaaagcttaatctgtttgggagttctttttttttttgtatggaatagattactct

SEQ ID NO: 7641 - DNA, 1323 bp, Sorghum bicolor
  Clone ID: SORBI-28MAY03-CLUS98479_1
cctactgtccactactgctacttcaagattgtgggacagcagttcacaagggaaggatggggatttgcattccagaaagagtccccccttgctgcagatatgtcaaccgccatccttcagctttcagagagtggcaagcttcagagcatccatgacgagtggttcacaaagccgagctgcgccaccgacgatgagagcaatctgggagcaaccaggcttggcctcggaagcttctggggccttttcctcatctgtgccctgatctgtctcttagctctggtgatgttcttcatacaagtctgctggcagtacaagcagtactccaattctgaagatgctgatgagtccagtgcagctggcgctgatggtgctggcaaaagacagcggaggctgtcaggccttggcagcttcaaagagatagtaaagtttgtcgacatgaaggaggaggaaatcatgaagaagtcgacgaaacgccggtcaggcgagaaagataaccatgctgcaggattgtcatatgctcaatcggtggcttcagcatagaacatgcattcttgctgatcgacttcaatacttcagaaggcaaagcaaggaagcacaagaccaacgacatatatattgaattgggttctcgcccaaaagaaaagtagtacgatgatctaacttttttccaggacaaaaggctttggtttaggcctctaacaataagctacaggttggtcattccttaatccgaaggggttggaaaggggatggcaaatgttgtatctgtggtgttttggagaactgttaaccatactttcttctgttgtgccctagccaaagtgatttgggcaatcttaaaggaagtgtttgaactggagtttgttcctagatctttacaagagttttcagaaaagtggttacatggcaagggaccattgccgtctcggctttttctgtttttgtttgctggctttgcctggacgctttgggtgactagaaataagatggctattgaaaaagtttttcctaaggcgccaactgatgttttgtatgctgctttatctctgctacagaagtggatcatgctgctcaaggaaaacgacagatggagaatgtcccaggtgaaggatatggtggtctgctggatgcgaagttttaagacaaacttgatgccgacagatgtttacgaaatttgatcagcttgtctagttcttgttgttggtttgttatcaacttagcagtttttgctctcttttgtcactggtaatccctaccagttttgtatccaaactacttgctttcttaaaagcagaggtttttcctccttaaaaaaaaggcttt

SEQ ID NO: 7642 - DNA, 1015 bp, Sorghum bicolor
  Clone ID: SORBI-28MAY03-CLUS9806_1
tcaagactttctagcatcattacctgtgaagaagatgaaacagcttggtggtaagcttggaagttccttgcaggatgatcttggggttgagaccattggtgatctcctaagttttacagaggataagttacaagagcagtatggagtaaatacaggcacatggttatggaagactgctaggggcattagtggggaagaagttgaggatcgtcttttacccaagagtcatgggtgtggaaagacatttcctggcccaagagcactgaagaacagcgcttctgtcaaaggctggctggatcaactctgtgaagaattaagtgaacggatccaatctgacctgaaccagaacaagagaattgctcaaacgctaactcttcatgccagagcatctaaggaaaatgaacgtgattcaacgaagaaattcccttccaaatcctgtcctttgcgctatgggactcggaaaattcaggaagatgcaatgaagctatttgaatctggtcttcacgagtttttagaatctcagaacactggatggagcataacatccctttctgttactgcaagcaaaatatttgatatacctagtggaacaagctcaatcttgagatacattaaaggtcctaattctgctgcacctccggctatacctgattcttcgtctgtacctgaggatccatctcttgacaacgatgtatttgtgaagccaattcatgaagaacaatgccagccatctacgtctgagaaagaagacaataatacgcattctgtgtctgcgatttcagctaaacaatgccaagcaaataaagaaaaaagaatatcaaagaagttgcctgaagttaagggaacttcctcaatattgaagtttctttcacggggtcaatctaccttccatgagaaaagaaaatctgatggactaatttgcagccatcaaggtttggtggactgtaagatgctgatgcagatattgatttaaccactgccacaattgacaattattcatttgctgaatattcat

SEQ ID NO: 7643 - DNA, 442 bp, Sorghum bicolor
  Clone ID: SORBI-28MAY03-CLUS98557_1
aaaaataccctactatggtgcctcgaatgacttgatgactatgggctatagaacgatagaaagagttggcgtttctggcatgggattggaaatggaaacagtcattccccacaggatttgacacatggttttattttactttccttttttattgatttcacctgttctttgtgttcgatttgggtttcttttcaaagcaggactggatgggatcctacacggataggatggccaaaggatattatagacatcaccactttcccaggcggataaaaattttgttccgtttctcagcttttgtttttttattgtttcacatttggggggttcaataaagtggaggcttactatgaaatactataattggatttgacgggtgcatgctgcatcagcagcagcacaggggcagacctgaaaaaaatcggaaaagatatttattact

SEQ ID NO: 7644 - DNA, 522 bp, Sorghum bicolor
  Clone ID: SORBI-28MAY03-CLUS98566_1
taactttatcttcttttgctcttagtacccagaccttagtcgcattgttttagtggtgttatccctacctttacagatgagtgcaacacctttctttttttatggaactggaggggcctcggcccctacaggtgattttattaacacattaagaaaagtttacaaacagacacgcacgcacacacccaagggcgagaaggaagaggaggaacaagaagttcaagaggaacagtagcctaagaataagactaagactaaggctcagactaactaaggaacaaaggagacaaagaaaaccaacagcagaagccaattgccacagggcttatccaagaaatgaaaaggttccacgaagcaaattccggacctttcattctattgcatatctattcagtggtaaacgtatgtaattgctatatatatatatatatatatacataggaggatgggtatatatatatgtgttctggcacatgtaaaaataaataaagtattttgattcctttgtatgatatatctcta

SEQ ID NO: 7645 - DNA, 427 bp, Sorghum bicolor
  Clone ID: SORBI-28MAY03-CLUS98634_1
aatcaatcagatccaagaagaatattgtacaagacaatgatgaattcattgcttcagaatctgatcagcagattctcctgataaagcgacaagatgaggagttggatgctcttagtgctagtgtacagcgaattggaggtgtaggtctcactattcatgatgagcttgttgggcaggagaagcttctgggcgagcttagcctcgatatggaaactactacaaatcgtcttgactttgtgcagaaaagagtggctatggtcatgaagaaagccagctggaaagggcagatcatgatgatcgcgttccttgttattcttttcatcattcttttcgttttggtgtttttgacttgagatatgtgtgtggcttgtaattttgtaacttgttgagttcagaacggtattggaagagcagaatctcagtcatt

SEQ ID NO: 7646 - DNA, 899 bp, Sorghum bicolor
  Clone ID: SORBI-28MAY03-CLUS10038_1
gttttaatgacggatatcagctgcaacaacaacactgtggttatgtttctgtgttattcttttaggaattctgcaagacatgcagaggaaacaaagttgtgcctggaacgaaatcagtccaccttgacatactggctggttcggataatgaggatactataaaggttgttagatcaggtggagaagacccagacggccgtccaggtgatctttatgtgaccctcaaggttcgtgaggatcctgtattccgtagagaaaaaggtgatattcatgttgatgctgttctgaatgtgactcaggcaattttgggagggacagttcaagtcccaactcttagtggagacgttgttctaaaggtcaaacctggtactcaacctggtcagaaggtagttctgagaggaaaagggatcaaggcaagaaactcaccatactatggagatcaatatgtccatttcaacgtcaccatccctgtgaatttgacaccaagacagcgggtgctgatcgaggaattcgcgaaggaagagcaaggcgaagatgagaaggacgcgaaggcagccggggcatcaggatagcctatttttaggagccaatccacattccaatagtgccttagctgatctttataccgtgaggtagaataggctgctgcctgacattcgcaggcaacatatagctggttgcatggaatactggaatttccaccgcaacatatagatctttgtttgggagtttgtagctggaataatactagatcgcccgtgcctgatatgttcaatcctaagcctaatgctagcagggcgtgcaaggactcttgtacaattttgttgatcagggtgaccagatgtaaaaacacacggtaccaatgccaattcatgttttctgtcgaggttttggctttt

SEQ ID NO: 7647 - DNA, 745 bp, Sorghum bicolor
  Clone ID: SORBI-28MAY03-CLUS108479_1
gcacgaggcaatcgctttctgcacgactgtgtacagcataaatggaccaaggctcgtggggttcatgttcatgtccaccctgtacagcccatgccttcgcacctgtgtcacaaatatgtgatctgcaccaagaaggaaaggttgcatgtcttactatccttgcttgagagggatgcaccaaagtctggaatcatatttgttgctgaacagtctgagagatcaaagaaggctggaaatcctccttcaaccaccgtcgtcgctgagttcttgagaaatgcatataagggaagcctagatgtgctgctgctggaagaagatatgaacttcaacgctcgagctgcctcgttctctgaagtcaagggaagaggattcctgctggtttcaacagacatagcaagcagggggtttgaccttcctcaaaccagccacatatacaacttcgaccttcctaagacggcgacagactatctgcaccgtgctggaagaactgggagagaacctttctccaggttggaatgcggcgtgacaacccttataacagaggatgagcacttcgtgctgcagaggtttcagaatgagctcaagttccactgtgaagagctgccccttgaatccatgttcacgttctcttgaactcggatgtgaatactagcctttttttttaatttcctttttttgggtactgctacaggagaatgatttttttgctctcgctgtgagcatcaatatagggaaattcttcagc

SEQ ID NO: 7648 - DNA, 817 bp, Sorghum bicolor
  Clone ID: SORBI-28MAY03-CLUS10853_1
gttccccttcggcccttccctcgtcaccccgcccccccccccgccactctcactctgccgcggcgcgcctgcgcccgccacacacgaggggcctatggacacggtggctccccgtctgagccgctcctcgacgcgatacgggcccatcagcagcagcgctgcctccttcagcgggcccgtccggaagtggcgcaaggcctgggtgcccctcaccggcgccggcaccgccgggtccgggggagggagctcacgaggtgacaataaggtggttctctttaggtggacacctgtgaatggcggctcaggaggaggggcaggggccgacgggggcatggagcccgctgcagcgggggcctccacctccaggcggcgctacgtcccggctgcaggggaggcacaaagcactagcaaaaagggcaccagcagtgagctcaacttgaacctcgagctggaagagcctgacgatgatactgatgccgacatgagcacggacgagccgcgcgacatagaaggtaacaatgcccgtccagaaagccggttgaaacggaaagcattttagccactggtcacctagagatgtggatcggagcatcagcttcatctcccacctgaatcgtccgcctccgaggcagactttgtgtaccataatgtagcatttagcttgtatcagccagcccatcgtcctttgtctactccattccagtctagaacagtggtcatcgtcaatgactgtccaagtccaagtgctcatgttacagtttatagatgaggtgagctgttagttatgacttgtcattctgtcatgtaagcctcgtgc

SEQ ID NO: 7649 - DNA, 547 bp, Sorghum bicolor
  Clone ID: SORBI-28MAY03-CLUS108703_1
gcacgaggcgacctccggcgaccacgaccactacgacgagctggcgaggcgcctgtacgcctacaacagccgctaccaccgcggccggctcggcgtcacgctgacggcgacggtgcggtgcgcgtacccggaccggccgggcgtgcaggcggcgctcgcgacggggctcttctcgcgcgtccacgtccggctctacggcgacctcaagtgcacctggtccgacagggaggcgtgggagaagtgggcggcggcgtacccggccagccgcgcgttcgtcggcgtcgtggcgtcgccggaggcggacaaggacgcgtacatgttccagaaggacctgtattacaacgtgctgcagttcgcgcagaaggtgcccaactatggaggactgatgatctgggataggtactacgacaagatgaaccactacatcagcagcagctaattaattaatcttcccgatctctacccggtttatgatcagttgatcacctaataataagcttcatgcttgtttttttaaactgtaatataataagggggggccccggta

SEQ ID NO: 7650 - DNA, 636 bp, Sorghum bicolor
  Clone ID: SORBI-28MAY03-CLUS10865_1
ccttgatcagcacaggcagagagcactgtgctatcgcctaagaatggaggtccaccgaccactacgtgtggcattggtgaaccgaggtcctgacacagagctgcttgtagcaaacccagttgaggtttctggaaagggtagaccgctggtgttttatgacatcacccttgctctcaagaatcttcagaaacgaatcttcttggctgagattgggaggcacgttgtggaagatagggagtgggaagtctacagattacactttggtgaggagcatgagctctcgtctgccctgcggagcaggattgtggatgcagtcaccaacatgctgatggggtgggactcatgacactgctgccgtgcctctgaaacattatcattagtgttcctgcagaaactaacttatttggtgcaagtaaaaagcagcaactgatctctacttgtctcttaaatacaacggttttgaactaatccagagacacaatagtatttaatttcattatcttaacatacactaggacaccgggtcctatagtctgcaccaaacctcagttcggcccatcccagatgtatatacatgtattgaatcatgatcaagaattatgtgtgacaatataccactttgtctttgttggaaat

SEQ ID NO: 7651 - DNA, 819 bp, Sorghum bicolor
  Clone ID: SORBI-28MAY03-CLUS9879_1
ttcttgagggcaagagcagaaggcattcttaaagaatattatcctacaagaaccgaacgggtggacaagccacttctagaccagattgtaagagcgtcatatgatcctggtgctgcaacagtccttgagagtgtattcaactttaatctttcaattcctcttaactttttatttgattcttttggaggaaagatattggttatccagggtatgaaagatccccttacaaaatctgaggcgtttgttaccatgctccgagagcattgcagcaaggttcaaatcagagagttgaatgcagggcatgctccacatgatgaagttccagatgaagtaaatgccatactatgtaaatgggtggaacagatggaagttaagccagccctagagaagaccaaggcaatatagccatatataggtaaaaatgagaattatggagaccctatccattggttgattgtttaacattattttcaggagcacgagcactttggtaacatgttttcagcgtcctacaaaaaaaattaaagcattgtgatttgtgaattgttagaccctatacaaaattgtgtatgtataccacttttgacttctgagctccataccattttctggtagcagatgttgagatgaaacatacatgatgcatgagatcaaaagggttaaagggaaaaagaactagcatctgggcatgtttctgggtaactttgcttcataccattttctagaattgcagataacatgtatggttcttacttcttagggctgatccctgtttattgggatgaaaaggttgggtcagatccctgcgaattcagacaa

SEQ ID NO: 7652 - DNA, 464 bp, Sorghum bicolor
  Clone ID: SORBI-28MAY03-CLUS98875_1
gcgaggccacgccagaagcacgtgtcattggtggagaagatctggatctgctgagccagattactggccgccccttcaacagcagcaaccgcaaacgcagcttgggtagcgcaggcgtgctgaccggcggcgaagacgatgacattgacgaagtggaagacgatgttggcttttgatactttttccgggctgtttttgtttgttcatcagcatcatggcgcggcgctcggaactttcttccttcttttctcttctcttcttttgttctttgggaaaaggtagcaaaggaaagcgggcgtttctaatggtgtcggtatacattgcattctttggaaaggcacatccccaatgattatcacgatgatgggcgtttttttttgtagctcgatttgggtactcttttttttctctttaacttttctaccaagcatcggctactcacgataatataaatgacaactccg

SEQ ID NO: 7653 - DNA, 658 bp, Sorghum bicolor
  Clone ID: SORBI-28MAY03-CLUS99139_1
aagatcatgttgtgaaagtggctgattttggtgtagctcggttccaggatcaaggaggtatcatgacagctgaaactggaacatacagatggatggcgcctgaggttataaatcatcaaccctatgataacaaagcagatgtgttcagctttgctattgttctctgggagctgataacgtctaagatcccatatgataccatgacccctctccaagcggctgtaggtgtgagacagggattgcgcccaggacttccaaaaaagacgcatccaaagctattggacttaatgcagagatgctgggaagcagatccatccaaccggcctgctttctcggacattttagccgaactagaggatcttttggcacaagttcagggaacttcaggaaagacggcccaagatccatcaaataactcgaacaagaaagattaacccccatgcacatacctgacatttttctcaattcagtgatttgccatatttaggattcgggtcgctaattatgaggaatgtagcatatcatttttttttacctggatggttttgcctttgtgtacatttgaacaatcttcttggtgcctattttttatggtcacctcattgttcttacatagaggaaaatggctcgagcgcttgggactacctattatgaacaa

SEQ ID NO: 7654 - DNA, 554 bp, Sorghum bicolor
  Clone ID: SORBI-28MAY03-CLUS99117_1
caacgccgtcatgttccaggtccagctgatgatcaacggcgaggagcaggaaaagattgctcgtgagcgcatggttcgtttccgcaagaccatgaagcagtacagcatcgaccagggcgctgctgtcgactgggaatatctcaactacgccgactttacccaggatcctctctctacttatggacctgagaatgttgacttcattcgcaaggttgccaacaagtacgatcccaagggagtgttccaaaccagattgcctggtggattcaagatctccaaggtcgcttgagcatactgtagtcttcaataagaatataaatatagatatggcacgtcattcgtgttaattgatttctgagctctaactactatgccgtcggtatgcgcctcacctcggcaatgcgtctcgacagggtcctagcaccagtcgtgatagtgcaatacagggtaagaaatactctctagataaaaaccactacgcttaaagacagcagttatatagttctaagtgtagtgataattatttttattagaaaatttaagttcttactttt

SEQ ID NO: 7655 - DNA, 532 bp, Sorghum bicolor
  Clone ID: SORBI-28MAY03-CLUS99158_1
ccttggtctgctcagctatagaggttattggactagagtgcttctagaaattctaaagaaacataagggcaacatatctataaaggaactgagcgacatgacggcgataaaagcagatgacatcttgagcacgctgcagagcctcgacctaatccagtaccgcaaagggcagcacgtcatctgtgctgacccgaaggtcctcgaccgccacctcaaggcggcaggccggggcggcctggacgtcgacgttagcaagctgatctggactccctacaaggagcaaggctaatactgagcagctgcccccagccccagattagacgccctgaccgatgcagtccctgtacataacatttgctactaggatctcccctcatctcactaaacttgtgtaccgtcaaaccgtactagtatgtgacttgtaacttccacattgttgtgtttgtgctgcgctagtctctgaaagcgaaagaaccataacccaactcttgattccccttgcatcaataatgccatcttttttttttctttg

SEQ ID NO: 7656 - DNA, 657 bp, Sorghum bicolor
  unsure (1)..(657): unsure at all n locations
  Clone ID: SORBI-28MAY03-CLUS9922_1
gcacgagggcctgatgtagagaagcaaaaggaaccaattctagagcatgtcacagctgctcttgccaatcgttatcacctaaaatttacaactcaggatgtttcttccctctggtttctttgtaagcaggaagcatctttgttgaatataaccaatcaagcttgtgggcttttcaatgaagccgaggttcgttttctagagtggacagatgatttggagggttttgtcctaaaaggctatggtgagtcaattaactacaggatgggactgccattgctcaaggatgttgtccagtcaatggaagaagcaataatagctagagaagaaaaccaccctgatggtacgtatgaaaaggcaaggcttcgatttgcacatgcagaaactgttgttccttttagctgtcttctcggtctttttcttgaaggtccagactttgagaagatacagagggaggaagcgttggacctaccccctttgccgccacagggaagaaactggaagggcagtgttgttgcgccttttgctggtaacaacatgctggctttataccaatgcccaagcaaaatttcggatggcagcgcaacctctggaggccaaagtaactcatacttcattcaagttctacacaacgaagccccaatttcaatgcctgngtgc

SEQ ID NO: 7657 - DNA, 868 bp, Sorghum bicolor
  Clone ID: SORBI-28MAY03-CLUS99220_1
gcacgaggccaccatcagctaagcaaagcaggccatctgccaaagtctacctgtgtccatctaacaaagccagccgggtggtccgtgttcttgattaagctgtctgcaatcatcatggctgccgccatcatggcaggtctgctgatactcctcgctgccgtcgccgctccggcgcacgccaaggattacaccgtcggcgactcgtccgggtggaccagcggcgtcgactacaccacctgggcgagcggcaaaaccttcgctgttggcgacaacctagtgttccagtacagcatgatgcacacggtggcggaggtgagctccgcggacttcaacgcgtgctcggccagcaacgccatccagtcctacagcgaccagaacaccaagatcgcgctcacggcgcccggcacgcgctacttcatctgcggcacggcgggccactgcggcaacggcatgaagctcgccgtcacggtccccgctgcggccgccaccaccccgccggcgtcgtcatccccgcccaccacgccggcggcgcccggcgccgacacgcctccggagacgaccacgccgtccacgtccacgcccaccgcgacgtcgccgcccaccgcgaccaagcccacatcgagcagcgctgccgctgcctgcggtggggaggcccggctcgctatgggcatgttggccggcgccgcgggcctcgctgggctccccctgatgggctaggcaagaggcagtgctgtttccatgcttttcccgttggttgttggaggcttgtgggcttctggcccattgtgtttatttactatttattacgccctctgaatttcacgtttatgctcgcgaatggcttgttcaagactccggctgtataaat

SEQ ID NO: 7658 - DNA, 859 bp, Sorghum bicolor
  Clone ID: SORBI-28MAY03-CLUS10790_1
gcacgaggcgattttgttaggattggttctggtcgggagagctgcatttgttttcccattgtcgtttttgtccaacttgacaaagaagtctccattggagaaaataacattgagacaacaagttgtattttggtgggctggtccgtgccgtggcgccgtgtccaccgccctcgcctccagctcgttctcttgccctcgtcacactctgctgctcgccgatgcgtttttgaccacctgcacgttcccggtagtccgctttggccctctggtgtgtcggctggtgccgatgcccctgttccgccttctgccccctgccccgggcgcctccccccgccccgacccgtcggcaccctcgcccctgcactccccgccccccacgcgcctgcgcccctcccccctcggcgtcccggccgcgctgtctctccgcccgtcccgcctccggtggctccgcagcaagccgacccacacggtgcactactactggcgcaagttcgatgacgcgctgatgcggcccatgtttggcggccgtgggttcgtgcccttctcccccggatcgcccactgatcatgccggacggtgaacactgccaaaagaagcaaagagtttggcaccaagagacgaacaagacgtggttttggtgagtggagttttttggctgctaatggtcagatgatgatgtttttgtgttgccgacaacttctgatgatgcgttagcaatggcgaggaggggtcaattggttatgaagaagagcaaaccctgtgtaactgggggtattgagtttgtgtatgacaaggctgtaaaattttgtagataaaaacaccctttggtaatgtatcttcattattgcatgtaagctag

SEQ ID NO: 7659 - DNA, 409 bp, Sorghum bicolor
  unsure (1)..(409): unsure at all n locations
  Clone ID: LIB3478-018-P1-K1-E7
attggagaaaataacattgagacaacaagttgtaatatggtggctggactgatgagaggcgccgtgtccatcgctcttgctgacaacaagttcacaagatctggacacactcagctgcacggcaatgcgataatgatcaccagcacaatcactgtagtcctgtttagcactatggtgtttgggatgatgacgaagccattgatccacctactgctccctgcctcgagcaacacggcccactccgagccttcgtcacccaagtccgtgcactcccctctcctgacgagcatgcagggctccgaccttgaggggccgtctgcgcagattgtcaggccgtccagccttgtgatgctgctcancaagtgcgcccagacggggcactactactggcgcaagttcgatgacccgc

SEQ ID NO: 7660 - DNA, 771 bp, Sorghum bicolor
  Clone ID: SORBI-28MAY03-CLUS10824_1
ccgcttacgccagcaatcaccattggcttccaccgagcagggagagggtagaaatcttgcaacaccacaagtgtcaggagccagtgaggaggccctacgctttgctagcatggtcagacaaattatgccatttatctcccaagttgaaacacagaatctaaatgccccaccagacagcagcagcacacctgcacaggctgcatctgggagctcagacagagctagggatgtcccagatgattcgagttctcgtcaacataaccgcgaccaaattgatgagcctaattctaaaaggcaaagaactagcgactgattcaaatctacttgtgagctgagaatcttgccagttcttgcttacccccagcggattatcaaatcaggacttgaggcaaatggtgacagtattgagacaaatggattagctgtagtatatagttggcactgaggtcactagacgaggcacccatgccttttttttggcgcatcttataaactgttattttcgagtgcaaccattcatcctgctggcatccaattcccaatctgtacaagtttaatttatttgggatgtaatcatttatgcgacgaatcaaagcctctgctctagtcattgccgtagcatgtggaggactcctgccatcaataatattattatgaaaatgtatagcttaagtttgtatgcttttttgaacattgtgtgattagctattgcttacacacacaactgttacttttgtctttgttcataatgcagtgcgacgctgttggaat

SEQ ID NO: 7661 - DNA, 488 bp, Sorghum bicolor
  Clone ID: SORBI-28MAY03-CLUS108466_1
gcacgagggacgagcagagagcggaggcgctccagagcgccgtccctgcggtggagacgttggaacgggcgttcgcggagtgctccagggggaaggcgttcttcggcggcgacgccgtcgggatcgtggacatcgcgctcgggagccacctgatttggatcagagtggtagacgaggtgggaggcaccgaccttctggacggggccaagttcccgggcttggcggcgtgggcggagcggttcgtggccgtggacgccgtgaagaaggtgacgccggacgcggggaaggtcctggagcagtacaaggggtttcgggctaaatggattgcggccgctggttctacctgaacgtactgaatatgactatatgtatctgtaaatctacttgattgtggatgcactatgctggatagtggatacgttcagtgcttcagtgagttggtcagttggaaccaaataaataaataagatcccgccagttaaaagttc

SEQ ID NO: 7662 - DNA, 530 bp, Sorghum bicolor
  Clone ID: SORBI-28MAY03-CLUS9955_1
gcacgaggcttgctcggccattcccaatcccatggcctccctcgccatcaccaagctcgccagcaccatcacacccacgaatccctggaagcccgcttgccaatgcgcttgcgtttccggtggccatggcagggagtcgtcggctctggccgcggaggctgagactgagcaggcggcggtgagcgaggccaggccaaggtttaggtgggacgcattcgggtccgaaatgagcgagtcgcagcagcgggcggtccggggcctgtctccgaagctgcccaaccgctgcaaggccctggtggcgcgcgtggtgtgcctgtgccccggcgacgagagccttggcgcgttgctcgcgtactgggtgaaggcgatgaagcccaagagggcggattggttgctggttctcaaggaactcaaagctgaggatgcatttgccgccatgaaaggcagaggtttcccttgcgatcaggtcatgctgactgcactgatggacatgtacagtaaagctggagatctgacccgcgcaaaggaaa

SEQ ID NO: 7663 - DNA, 647 bp, Sorghum bicolor
  Clone ID: SORBI-28MAY03-CLUS99748_1
gcgaagacggtggtggtttcagggatgctaccaatcggctgtgagccgcagcagctggcgctgttccctggcggtccgggcgactacgacccgaccaccggctgcatcacccggttcaacgtgctcgccgagcaccacaaccacatgctgaggacgatgctgagggagctccggcggagcaactatggcaggacgtccctgacgaccctcctctacgccgacatctaccgccccgtgatcaaggccgtcgcgtccccggcgctgtacggtttcggcgacaggccgctggcggcgtgctgcggcggcggtggcggccccaacaacttcgacttcctcgcgttctgcggcacgccggcgtcgatggcgtgcgccgacccgtccaagttcatctcctgggacggcatccacttcaccgaggctgccaataggttcatcgcgcgtaacatgatcaagggactgctgccgctaagccgtgcggcggcgtacgttgcaacaagttaatttttctatgttaagttttgcgagtcatattatgaacgtatattatattcatgaagtgtgaaaattctcgtgtaataaggatggtctgattgctcccttgcgaagagaatatatataatatagaccaacgctgtttttagcattta

SEQ ID NO: 7664 - DNA, 652 bp, Sorghum bicolor
  Clone ID: SORBI-28MAY03-CLUS99598_1
gatgtccgagatgggttttccgaagattgttgtgcctgctgccatttcttgtagtgtttgctgcagtgcagtgggatttgtgtatcagactcgaggcctcaagcatgggagggcaattgttgtatctacgtgtacatcagtggcatctatagtgtctggtgttgtagctggcatgattgcacttgatgaacatctgcctaaagctcccacagctcgatttctcctcttactgggatggttcttcatcatctctggagtaatactgcttgttagttcaacccgattgattgcacgtctgcctaggcctgttcagaagtttttgaagagcaacatagagcgaacccacagcataaggaggcctggttcagcacgagggaaggatgccatcccaacaacaacaatccatacgtcgtcactacacttgcttacttctccaacaaaggagaaggcctagaaaaatgttgccactagagcaactttgtttcggcacctcacgtttgtcatgtcattatttgattgaatggttccgtgaacgtagtctagagtagcatcttaaaagtttgggctggttattcaccatactgccctttataggtctaacagaaacttggaaaaatattgctgagtttttatcaggtctcgtcctttgttt

SEQ ID NO: 7665 - DNA, 894 bp, Sorghum bicolor
  Clone ID: SORBI-28MAY03-CLUS99760_1
ctctccggcacgagccgtccagtccacttcacctcggtccgacaccgcgactacaccggcggcgcccagccgacgccgagccaatggtggctcccgcgacactcgccctccgccccagcgcggcccccgcgcagcctcgtgccgcgctgccccgcgcccgggccagctggttcgcgcccgccatcatccgcacctcccctcccgtcgccgcctcctacccgccgcggcgcttcagcggcgtccgccgcgccgtggccgtcgatgcagaccagcaaggctctcccgagcctccagagcaggagaagaggcccaagacgtactacttcctggtggcgaacgccaagttcatgctggacgaggaggagcacttccaggagcagctcgccgagaagctgcgcaactacggcgagcgggacaaggagcaggacttctggctcgtcgtggagcccaagttcctcgacaggttccccgacatcaccaagcgcctcaagcgccccgccgtcgcgcttgtctccaccgacggcaactggatcacattcatgaagttaaggctagacagggtcttacaagaccagttcgattcagaatcagttgaagaggcattggcttctaaccctgttgagttgaaatttgagaagcctgagaaatggacagctccataccctaagtatgaatttggatggtgggaacccttcttgcctccaaagtccagcaatggcacagcatagagataagcagcaatgcgtacgaggcatgtaagattactcccatgtaagtgatgaatgtaattttaattttgatgatgaggatgtagtacttgaggttgtacgattacagttagttgaattagttgcagaggtttgggtaataccaaattaaccagctggttttgtt

SEQ ID NO: 7666 - DNA, 1089 bp, Sorghum bicolor
  Clone ID: SORBI-28MAY03-CLUS99873_1
gcacgaggccttgatgacgttcctaaccgtggccttgacactcaggctgatatcatgctcaacggtgtgccgtacactcagacaattgctgatatcaccgagatggtggagccgccaaagaaacagcccgtcatccactttgagcctggtctgtggatgcacgttcccgccagtgagcagatgcctgttcttgccgcttccctgtcccgcatggcctctatccctcatggaacttccatcaacgcccagtctttcacggcaaccatcactaccaagggcgcacctgtcttctcgccagttgacatcacccctactcttattgccaacggaacgaagattccgttcaggagtcagaccctcaccaataagaacactcaccgacttccccaggatcttacaagctttgacaaggccggtaccatcacgcaggctatcttgactgatcctaacactatcctccgcaacgccaatatcggaaagaacattattgagaacacaacctttgaggtatcctcagaggctcagaaccccaaccttggtggcggaaccagcaacatcggtttcctcatcggtgccgacgctggtgtcacctctgcttcagtcgcagcccgaagcggcaacgcgaatgcagtcagagtcacggcccagtactggctctccagagtccgggcccagatcgaccttccggcgtgcaagagcgcagacaagaagactgtttctcctgcctctcacggtccacgtgatgccgtccccaggttcctggttgacattgacgttcccgctgccaagacagtcaacattgagtacatccagattcagtactcccagaatgtcgcccttgacttcaatggtctttcatggcctcacgtgacggttggaactttggcgccaaccatccgtcacaagctgtcccaagttcttgtatctcactagatagtagtatgtcccacgtagctgggactgtctttggaggatgtgtagcgttactgtgggcgccctaaggctctttggcccactattatatagcgagtctacactcgagctctaatacaacatcctatgtcttgacaagtttcttcaagttcgccg

SEQ ID NO: 7667 - DNA, 782 bp, Sorghum bicolor
  Clone ID: SORBI-28MAY03-CLUS10017_1
acagatctcacaaaatgcggtaacaattgcatgaatatctttgcaaaaaaaaaactgacatccactctagttacatttctcattgagccctagttgcagttacaatggctctatgcgctacaaaattctttcaacagctgctcctatgaaccagccacaaagaagcagagggcctatcttaaaaggtacagtcaaacacaaaaggaaacttctatttcctccttgtattattgtatacaccttctatctcctcgtattgcatacaccttctatctccatatataccaactctaccattgtgcagtatacatctgtgcaaagggatttctcaacagagatgataggtttggtatcaaaggatacaaaatgggtcagccttgtgagatgagggcagcaggactggatggagtgtcaagaggataaacggagtgctatctcgtggagaagcaatctcttctgagacgcatcaatcacaccattgcactctgcattcacgaggacctcactcatggttgcggcagcatgcccagtaggttcttcagatgtcctccgcagcatgaacatctgtccacgatgagatatctcaagacacccaggtggctggatccatggttcaccatcaacctggacagggaatgaactgtggaagtgcaatcttataacttttccttgggctaaccggtgtgcccttgaaagtccgacctgcagtttgcctaaatgccatgtccccgatatacaaaccacctcaagtattttgtcatggattgattgcaaactgaaat

SEQ ID NO: 7668 - DNA, 404 bp, Sorghum bicolor
  Clone ID: LIB3478-009-P1-K1-B7
gttctagatcgcgagcggccgtcctttttttttttttttaaatgcggtaacaattgcatgaatatctttgcaaaaaagacactgacatccactctagttacatttctcattgagccctagttgcagttacaatggctctatgcgctacaaaattctttcaacagctgctcctatgaaccagccacaaagaagcagagggcctatcttaaaaggtacagtcaaacacaaaaggaaacttctatttcctccttgtattattgtatacaccttctatctcctcgtattgtatacaccttctatctccatatattgcggagacggagtgctaggggtgctagctaccggcgggcgggcgggcggccgggatggcgtcgggctccggcggcggcgggagcgacttctcc

SEQ ID NO: 7669 - DNA, 627 bp, Sorghum bicolor
  Clone ID: SORBI-28MAY03-CLUS10573_1
ttcattcccctctcctccgctgcgtgcctccgactccaccgattccaccgcgtcatctcgtgcttcccaattcccatagcccccggttgatccccgtccatggtttcctccgccgccgcgtcgcctctcgtagccaccgccgctgactctgcttcctcctgcgtcgcccacctccgctgctgctcctgtcgcgttggttgttgctgttgttgttgttgttgaagacgcgtagctctctagggttcgttatttctcgccgatcgattcgggaattggtaagctatggatctctcgcggcccgcatcgtcggacctctcgctcgggctccactctcacggtcacgcccgcggccacgcccacgccgctcgcgtgcacgcggtagccgcgccgctgcgcctgttcgacggcgcggaggacgcgaagccggagcgcgtcgtggcaggggaggccgacgcggagagggatgacgaggacgggggcgaccagcacttctccctcctcgggcactccctctgcgtcaagcgcccgcgtcgcgtcgtcaacggcggtgggtgcgggggcggagacacgtcatcctgctcgtccacgtccgcggcgctgcgccccgccaagcggcaggcgacgggg

SEQ ID NO: 7670 - DNA, 660 bp, Sorghum bicolor
  Clone ID: SORBI-28MAY03-CLUS10603_1
caagaactcctccgatcccacctgtccatcgatcgatcgacttccgttcccctcggaatcgaggcggccccgagaatcccaacgcacgagaagaggaacaagggaaccaggcggagcgaagagagcccggggtgatgaattgttacggtttatggacggagcaagcaaggagcctctccgcaaggactactacaaagttctggaggttgattatgacgcttctgatgacaccatcaagttgagttatagaagattagctttgatgtggcatccagacaagcataagggtgataatgatgtcacagctaaatttcaggagattaatgaagcatacaaggttttaagtgacccagctaagcgactagaatacgatgtttctggttgttatgagattgatcaatatactttgcgtgagtaccttgcaaaatttaagggtatgatacttacctgtaatggccttggcatagatcatccttctagtaaatgggcccgacatttgagggaactgaagccccattgatcgacggcaaattattgtaatattgttgactctcgttggatttactcagcacagtaagacacaattgtgttgtatcacaaacaatgattcccttgtcacttctgggcaataatgcatgtatagtaagggtctattttgtt

SEQ ID NO: 7671 - DNA, 1105 bp, Sorghum bicolor
  Clone ID: SORBI-28MAY03-CLUS106115_1
gcacgaggcaccacaccaccctgttctccacgctgctgttcgcccgagcctgatccccaattctccatcctatccccttgctaccttccccaaattccctgctgctaacaattggtatcagcaccgttcctcagacgattccgctgtcttctcgcatcccatcgattgctttagcaacggatccggttggcttgatttcgaattcgcgcagtgagctgctgttcggattcggggtcgctgtaattcccttccacgctagagtgatttgtggagagtcggcagtctggaacgccccgatccactaccccacgaccactttacccgccgccaacatcgcctcggcgtcatgaatcctgaaaccaaactcatcctcgatgagctccacaagagcttctccgaggtggggtcaacgtttctcagatcaggaagcccgcttcaaacgccaaaaccaggagttggagtcggcacaggaagcccacttctcctccctggagcatctcgcccagtccttcgacgagcacgaggcgggtatcgagggcaccatcgatgccgtgcgcctggaggtgaagaagctctcgttgggctaggagcgcgccagcgttgaaaaccctgtcgatatgacgggcatcttcgcaccatctcctgctgcggcgacatctcctgctacgacaacatctcctgctgcggtgattcgcccgacttcggcggctttggctgcccactcacccgtgatggggcccgacgttgaacatcggaaccgggagaatggatttggggttgtctcaactctgattcattccccgatcaagggtgagcactccaactccccatcgccaatcattcctgttcatctgtccaatgggatgcttgcgcacgtttctactcatactgctagtggggatttgggctcctacaatacaaaaattcctaaagtcgattttcccaaattcgatggtgaacacccaaaattatggctcagtgactgtgtcgattattttagtctgtataatgttgagtcctcagcttgggttcgtatagctcgcatgcattttgtgggggcagcaaagcgctggtacaatgctgtagagtcccagcttcgtgggtg

SEQ ID NO: 7672 - DNA, 650 bp, Sorghum bicolor
  Clone ID: SORBI-28MAY03-CLUS10638_1
gtcaggccaaactttctagatttccaagggctggactttgaggcagcatttgggatgaggagagcttacagtgaaggagacattcagaaccttggagccaacacgcctcgaccagcggcgcacgcagcaaatgctcaaacgtcttgtgagaggcttgtaaccatcagtgacctcaagactgaagaaaggaagcaaaagctttccaggtataggaagaagaagatcaagcggaattttggcaggaagatcaagtatgcttgcaggaaggctttagcagacagccagccaagagtgcgagggaggtttgccaagatcgaagaatgcgacctgctgaaaccaagcgtttagatggtggcaaaaacatgaaaggaatccagtcgagagcgagcttcatggagctttggcttctagaagcttttaggcgctcccccttttgcgatggaggtggagaggcaccgcgtagcccgtcggaattcatttagctgttcaattgacctcttctgtttcactcgggctgcgttctattctatttcccctgtgtaataatatccggtcctttggtgcaagggagtgaagagctgaaagtggtagtctagcccctgtacaaaggcatggcaataaaactcagctcccctcttgcttggcatgtt

SEQ ID NO: 7673 - DNA, 1000 bp, Sorghum bicolor
  Clone ID: SORBI-28MAY03-CLUS10710_1
cggacgcgtgggcaaaaactaatgcatttatatccccaatgtggggaggtgttcttatctggaacccaccggactgctgcgacttgattccaagactcatggtacccgtaagaaaatgtcatctcaggaacttatggagaccctcgaaatcttcattggacaactaaggcagttgtttggtctaaaaccatcttatctctcacaagatatggacgtgccaactaaatttgtagttagtgaaaaggggttcacagaatgggagttagatttattatatcgacaccatgcacattccaatctgctgtcatgcctcaccacgttggagtctctatccactctggtccgctctctccctagaatgattgtcatggatgaaattggaagacaggttgagctttctcttgaagctgcaaatttagctcagggaaatgcaactctaggaataagtgactcttcagcagtatatgcaacaagagccagggcattggctgaggatgcatttttccatccatccattatgtcaatcagttatgcttcagttgagcactatttcgccatttacatgccattttttgcaccagtttccttgcatgtgcttctggcggcaatcaaagagctaaaacgttacaaggcagagcgagcaaaatattttgcatttcttgcttcccaggcgacatcctcctgatctggtggtgattagcatggatttgcatcagagaagtctgaacatttatatgaagctgatggccgctattggtactgcacatagcagcgtcacttgttccgatgctcacgaaaatggttaggatgtccagctgatgtcaggcagagagctatacttatcatggggtttagtgcttgtaaagctagctgcatgctgttaacatagtcaaattttctaccacttgaaaagttcttgtaacccaaaattttgtaaattagtatctcatacggtcatgcctactaactaaacatatcaaaggattttatttttcgattt

SEQ ID NO: 7674 - DNA, 591 bp, Sorghum bicolor
  Clone ID: SORBI-28MAY03-CLUS107178_1
gtgcgagctagtagttctacgactacaccactgcagtgcaccgttgtcgtcctgctgctctcccctacgctacgacgaaagctaggctatggaggaggagcaagcagcagccatccaggtggtggttccccgagtcaagctcggcgcccagggattagaggtgtccaagctgggtttcgggtgcttcggcctcaccggcgcttacggatcggcggcgctcgacgacgaggcggcggccgcagtcatcgcgcacgccttccgtcgcggggtcaccttcttcgacacctccgacatctacgggcctctcaccaacgagatcctgctcgggaagcagctcaagcagctgccgcgggagcaggtgcaggtggccaccaagttcgggcttgcgcgggacgacgccagcggcgcctggaccgtctgcggccggcccgagtacgtgcgcgcctgctgcgaggccagcctccgccgccttggcgtccactgcatcgacctctactacctgcaccgcgtcgacaccaccgtccccatcgaggacacgattggcgagctcaagaaactggtggaggaggggaaggtcaagtacatcggatt

SEQ ID NO: 7675 - DNA, 331 bp, Sorghum bicolor
  Clone ID: SORBI-28MAY03-CLUS107232_1
gcacgaggctccgtccccctccgtgcagcctcctcggctcgtcgctcccgcctggatctcccaccaccgccgccaccaccgcgcgctaccgagcaccagcggcgacctgcgaccagcaggcccatgacgatgagggggctcctccggtgcgtgtccacgggggcgtgcagggtggcgccgggcgccgtggcggagccggtcccgacttcgccggggtctaccggcgggaaggtccccgcggggcacgtacccgtggaggtcggcgcggagggggaggagacgcatcggttcgtcggacccgacgagctgctgggccgcccgcccatcgccg

SEQ ID NO: 7676 - DNA, 1122 bp, Sorghum bicolor
  Clone ID: SORBI-28MAY03-CLUS107192_1
tcggaacatttgccgatgtctcctgtcgaaggctgccccactgtatttcaggctatttgcagcctgtctccagggattcacgagtacaagttctttgtggatggggagtggcggcatgatgagcgccaacctactatatctggggagtttggaatagttaacacattatacttgacaagggaatttaaccaactaaacgccttattaagtccaagcacacctggaagcaggatgaacatggatgtggataatgaaaattttcaacgtacggttacgttgtcggatggtaccgttccggaaggtactccgagagtttcagaggctgcaatacaaatctctaggtgccgcggcacgaggtatctgaatttgcatacatgctatgatttactcccggattcgggcaaggttattgctctggacattaatttacctgtgaagcaatcttttcatattctgcatgaacaggggattcctgtagctcctctctgggactcatttagaggtcaatttgttggtcttctgagcccattggatttcatacttatattgcgggagctagaaactcatggctcgaacttgacagaagagcagcttgaaacacatacgatatctgcatggaaagaggctaagcggcaaacttatggaagaaatgatggtcaatggcgaccacatcagcatctagtgcatgctaccccttatgagtctttgagggacattgcagtaaaacttttgcaaaatggcatttctacagtgccagttatttattcatcatcatcggatggatcattcccgcagttgttgcatcttgcatccctctctggaattttgaaatgtatttgtagatatttcaaaaactcgacttgtaatttgcctattctgaaccaaccagtgtgctccattccactgggttcctgggttccgaaaattggtgatcctaacagtcgtccattggctatgttgcgacctaatgcatcacttagctctgcccttaacatgttggttcaagctggagtgagctcagtaccaattgtagatgaaaatgacgccctgcttgacacttattctagaagtgacatcacagccctagcaaaagacaaggtctacacacatgttcggctggat

SEQ ID NO: 7677 - DNA, 834 bp, Sorghum bicolor
  Clone ID: SORBI-28MAY03-CLUS107436_1
cccgcgcggattggaacaaccaagtacgtcatggcgagaacaagggtgtcttcccacttgtctatcttcttactactggtctcactgtgcgcgcacagcgccgccagcgacgacggcagcggcagcggcagcggcagcgcggacgcggacgccggccgccacgcgcgcgccgcggccaccgtcgccgagctcctgctggttcacaacgcggcgcggcaggtggtcggcgtgccgccgctgacatggagcgcacagatcgcggcgtacgccaaggcctacgcgcggtcgcggcgcggtgactgcgcgccgcgtcggtcgccgctgttctacttcggcgagaacgtgttcgtggggagaggtcggcactggaacgccacggcgatggtggcgtcgtgggtggcggaagggcggtggtacgactacgggagcagctcctgtgccgcgccgtccgggtcgtcgtgcctgcggtacacgcaggtggtgtggcgcagcaccacgcagctcgggtgcgccaggatcgtgtgcgactccggcgatactttcctcgtctgcgactacttcccgccagggaactacggcaagggaaggccctactgaccgaccgtcgttgtcagtcgttgatcaaatgatcatgtcgacatctcatctgcgcaaacactggtttttccatgtgttatgaagctatacattattactgtgtgtggggtgttcgtttatgcgtaaggagtgtctttcagttgtcatcgttcctttcctcgggtggttcttcagccctgccatgttcccccgatacgctaaaagtaaaacgataattataatataatgatttgcttg

SEQ ID NO: 7678 - DNA, 882 bp, Sorghum bicolor
  Clone ID: SORBI-28MAY03-CLUS107994_1
gcacgaggcacaagctcaacgagttctacatcgagagggaggagtggtacgtcatccgcctccaggtgctcaaggagaggattgagcgtgtcaaagctaagaagaatgatgcttttacatccaggagtgaatttactgaagaaatgttagagatacgcaaggattttgtgatcatacatggtgaaatgattcttctgcagacctacagctccctgaattttgctggactagtgaagatactgaagaagtatgacaagagaacaggcggcgtgcttagcttgcctttcactcagcgtgtccgtcaccagccttttttcaccaccgaacctttgacaaggcttgttcgagaatgcgaggctaatcttgaacttcttttcccggttgaagcagaagttcttgagcctagttcatcctcaaatctggaaccacatgatgtggctaggtgtgacccaacatcatcccgcgatgtggaaaccgtcgatgtttaccgaagcacactcgcagctatgaaggcaatacagggccttcggaaagccagctctacttacaacccactgtctctgtctaggttcttccatggcgaggacggcgaagcctgctctggtgccatcacttctgagagttcactgtcagattcctcaacagactcccagattcaggatgctggaaaggatgataaagaggtgcaatcaaattcgagggagcaaaatgctgcccaagggggacagaattgcagaaggccgactgatgaataaatagttttttttgttttcacacgttgctcaataagacaataaccattgataagtgtacatgctaataatcttgatgtttaacctcttttgaagtgacacatacgcgaaggatttcctaatggtgcag

SEQ ID NO: 7679 - DNA, 974 bp, Sorghum bicolor
  Clone ID: SORBI-28MAY03-CLUS103883_1
ccgcggggcagacacccgcaggagggtgatcaccaacagtccccttccatccatccatggcatgcatcaacagcaccttccagagttgctccattgccagaggagcaaagatcagcacaagggctagtaggggcagtagtggggggaaggggtcaccgacctttcagtgcaaggcgtcgactttcgtgaacgctgccagcctccggcttgagctcgacgaaaaccctgaggcaatcatctccagggtgtggcctgagaacgtctcccttctgagctacgacgatctccgcgcctacctcgagtcgcaggagacggtccaagtagaagatgatcagcacgtggcgctcttgggtgaggccatgtcaacacctgtgctaatggccacagcagatcagacactggaggaggttgaatgccactttgaggccgtgtcagggcttccagttgtagacagcagcctcagatgtgttggggtggtcgtcaagaatgaccgggccagagcttctcatgggtcaaagacaaaggtctcagaagtgatgacctctccagccatcacactatcttctgacaaaactgtgatggatgctgcggttctgatgctcaagatgaagatccacagactaccagttgtaaatcaggacgaacaagtaataggtatagttacccgtgctgatgttcttcgtgtgttggaaggcatgctgaaggtttaggagcgcagcaatccatgcttggaagtcagagcttcttgtaaatatgtagatgtgtccatggtgtttttgagtagcagcatggagatctatagtctataggagtgtgctgtgccatcagtaacaataagtccggaagggttgagagtttttccttgtaaataaaagtagcacgccaggagactccatctctgttttgtactgctcgcgcaaccaaatgctgtaaactagccaaatacttccacagcaatataaatggatatacct

SEQ ID NO: 7680 - DNA, 1060 bp, Sorghum bicolor
  Clone ID: SORBI-28MAY03-CLUS103920_1
gcacgaggcggggttcgattcccatccccgtgccatattttcttttcctcccagagaaaaccatcaacccacctggcgatcgcatctccgctcgtaggggaggccgtggtcggtatcgctctgcacgggctcacgctggaggagctcttgacggcagtatggcacggaggacgaggagcctccagacttgccgcccgcagctgtcggccttccaatccctccagatctgtcgccgaggagaccgctgaccatagaggccacggaggaggtgtcggatctcgccgagtttatgcaccgcgcggggcccctccccgcccgcgggggcccccccggccgcgcccgcccggcccgcccccccgccggccgcgccctggccccctgccgggctccgtcgtcggggtgcctcctcccccgccccccccccccgtcgcccttcctgtcccgcccctgctgccgccgtcctgcccgccggccgctccggccaccggggcggtgtcggatctcgccgagtttatgcaccaggcggtgtcacttcgagccgacggtgccccctccgtcgtcgccgcgatgtgccaccccgcccccctcctcatcgtggctccctgccgtgattttgttgcctctgaaataaacaactctgctctgtcgcaagaaggaattgtttcgatactaaaaggcaaagatttacatcgatgcactcagatatgcaatgaaactgtgtgaaggtgatgattggtatggaaatggtgaaaattaggttgtaccggttagcttgcgagatatgctgatcaggtgatggcttgggggaaagtcatgcttggacaggaagggagtggccattgccttttgcacaaccaaaaaacagcttttagtcaacgaaggattgttcctaaccatccttgtactgaactttctcaacctgacatgtgattgcagctaatgtcaatcatttgcctatcgtttggtattagagaatgaataggattccaccattcttgtattgcagttaatttgaccttaaggcatggataatattgtttggccctgaaacacattatat

SEQ ID NO: 7681 - DNA, 953 bp, Sorghum bicolor
  unsure (1)..(953): unsure at all n locations
  Clone ID: SORBI-28MAY03-CLUS10393_1
gtccttcatgccaagattcgcccactgacagtttcccccagcaaatcttttattggattcttccagcccgaaggcaatgatgatatgagtggttttgactttcttaatggtgccatgtcatttgacaacatctgggatgagattgcccaggcggcagagttctcatctagtgagaaccctaacttatacatagtacctggggaaaagaaaccttctagccctgactcaagtgatccattgaaggattcttcaggatctgagagctcttcaactgaccaggacagtgagaatgatactgaagaggacgtgcttgtgtcgaagggcaaggaatcatgtaaagaattcatcaagagtttcttggcagccataccaatccgggaactacaggtggacatcaagaaaggactgatggcatcaaccccattgcaccaccgcctccaaattgagttccagtacactcagtcatccccaaaagagactgcatcagccaatcagcttcttaccatggatgccccgtttgagttctcatggcctgagccaccaccaacaatggaagttgcactaacacctgccgtctctgttgtatagcttgtcaaccatggtggccaagaacccaagacatgacgacggtctgccctgatgttcaacatcgagaacccctttttccttggttccctgcatcaagaggaacctagatgaagattttggttcttcggtttgtactaatttgtttaatatgaactgactactatgggttatcccccctccaggacataggagcattctacctgctttttgtatagaggttgtatgatcctatcttccctcacctgctgggttgtaatctactaatcttttggaaccgtgtatgactaatcgaggaggaatttccctttgttataatgaactagagaccgngattatctgcagatgtaacacgataatacgttccc

SEQ ID NO: 7682 - DNA, 758 bp, Sorghum bicolor
  Clone ID: SORBI-28MAY03-CLUS10490_1
gtcatgtgaatagactgtgatacctacctgcaccatcacggccacaatgacaagcttccatggtaccgaggaaaggaatggacctatcttcggggtggcctgacgacgctcgaccgggactacggatggatcaacaacatccaccatgacattgggactcatgtcatccaccatctcttcccgcagatcccacattaccatctcatagaggcaacagaggcagccaagccggtgctgggaaagtactacagagagccgcaaaagtctggtcctctcccctttcatctacttggtgatctggttcggagtttgagacgtgaccactatgtcagcgacacaggggatgtggtctactaccaaactgacccaaaactccattagctgctccattcaaccgagggaggctgggagttatgcgaatcgcaaggatcagaggctgctagagacatcaatgaggcaacacactgcatttaatataataagaataagtcaactcattctttgggcaaaacaaagctacaatacaatttccaagcagggaagaccaatgccagttccctctaaaaagtagacaaactatgatgcaccattgctttactatctgatagatctcagggctcgttagaagattggcacatacttagggtctgttcgtttgaggtagtttgcccccaggaattgttccggttaatgaaagcttatgtaaatttgagtaacgattcctcccggattttttcctggcgcccattccggaggaa

SEQ ID NO: 7683 - DNA, 1497 bp, Sorghum bicolor
  Clone ID: SORBI-28MAY03-CLUS10475_1
tactgggtgcagaatacaactgtggctgctagaagggttgcttccttaatgagattccgtgagaagagaaaggaaagatgtttcgataaaaggattagatacagtgtgcgcaaggaggtcgcccaaaagatgaaacggcgtaaaggtcaatttgctgggagatcagattttggtgatggtgccacttcttctgcagcttgtgtctgtccaactaacggcgaggatgatcatttgcgagaaacccattgccaaaattgtggcatcagctcaaggcttactccagccatgcgccggggcccagctggtccaaggtcgctctgcaacgcttgcggcttaatgtgggcaaataaggtacatgtttctctatgccaatcatagcacctcttttcctgtttagctgtttggtacctttttcctcctcatgtcaaagaaaaacatcattcttcttaatttgacaaactttccagtaagatactatgattggtcaacaaattacctgattaacttgtgcttgtgggccctattagcaacattcctactagttaacctttggatttttcagggtactctaagaagtcctctgaatgcacccaaaatgactcagcagcagcttgccaatccaagtaaaatggtgcactaagtttgtaatacaaacttgtttatctgaacaccttttcttgtaacagagtttatctgtacactgcacttctgatttacttgtgcagggagatactgatgtcaaaaactcaattgttcttcctgtggagtataatcaagccacagtcaaaactgactcgatgtaagcatgctctttactgtatgtgaaatcattgtctggaactggaagctgtgtgatgtagtatggtcggctgtgcaaatcagcaaatctgaacttcaagttctcttgagataagttcagactgggagggacaaactctcatgacacggtttagctggaattttctacatctgctttatcatcgcatatagctgcctagggagcttttattttttaagaggtctctccaaaaatttcttcgtatataatgaaatacccgatcactgaaccttaatttattggtcaggatgccaaaacaggagcagaaactggacacacgcccgcccaccgaagaagatatcaaggcagtttcatgacaaatgctcaaacgtgtatataaattgagacataggtttctgtcagaaattcccaagtttaggatgacttataaggcagagaaactaacaaaggctgcaccattgcgaaaaaaatgcatgcattgtgttgccacatttatctgattatctccctacccgattcatattgtattgctgacagtaatgcagttcttactccttaccctgtttcaaccagactggttaactgggcagcaactcaaaatgttttccagaatactatggcattcttgggaaatgtttgtttattgttgtacaaaccacttcaatagtaatttgcatcaacttcaatgcaattgtttt

SEQ ID NO: 7684 - DNA, 822 bp, Sorghum bicolor
  Clone ID: SORBI-28MAY03-CLUS104981_1
gctagcaagttcagaggtgctaccatccacattgtggaaattgatccagtggttgtttcagcttcaattgaatccatgggtttccccatgtcatctgttaaaggcttatcgcctgggtccatgctacctgcgcacgaggatgatctactgtggggaggtatacataaccgcattttcctgcacatagctgacgccgaggatttcattgccaacgacagcaacgaatatgacattgtcttcatcgatgcctacgacggagacgacgtatttcctcgcaagctctgggacgtcgacggcgcattcatgaagaacctggagaagaaagtgcaccccgtccatggcaccgtggtcgtgaacttgcactccgattcagagttgccagactcagaggcagaaggcaacgcccgtttccagagcatacttcccatgggcaggcacgtctcccaggtctgccaggcctacaagcagcacttcgggctggccttcacagccgccgtcccgtggctctgcaacatcactctcgtcgcctgccgcgacaaggggatagcgagcggcgcacgcctggggctgagccacagggatttcgtccttggcaagctcctgtcgaaatccgacacagtggagcgtgcgctagacctgccgttcccatgtctgccgtacatcaagaacggtttcacgctggttcactgatatgcatgcgttttcctgtggaattttattatctgaatgataagttttttgatctgtttctcctctaaaatgtcttttcgtttggctgataaaccatggctaaaatactgttcactgatttgttgtgagctg

SEQ ID NO: 7685 - DNA, 515 bp, Sorghum bicolor
  Clone ID: SORBI-28MAY03-CLUS105106_1
gcgcgcgccagcaccgggcccacccgctgccccacaaccccgcccgaggccccgaccggccgaccccagagctggtgcggcggcggcggcacgaccccctcccgcagtcggcctgggcacgcggcaggtggacgaggagaagctccggggcggcgcccacctccaccgggatcccgccgtctgcccaggcctcggctcgccccggtgcccgcgatgcctctccctcctcgaccccaccgcgggagagcgggactgggccctcacctccgtcctgcacgacgccgccgccgcggctggctccggggacgccgtttcactgactgcgccgcacggtctgaacgcagggctcccttttgcccacgagcatgcgaggtttattggtcccatgtacatggtatataagtacgtttactgctgattttgccatgttgcagtacagtactagttttactgtgttccagacagcacgcaccacgcagtgaataaaattaaatttcttggagggggggcccggg

SEQ ID NO: 7686 - DNA, 1172 bp, Sorghum bicolor
  Clone ID: SORBI-28MAY03-CLUS10443_1
gcacgaggaattgtgaagcaaaattaccagaaacctaatctactgctagaagataagaattcatcgaaagaagctactaggcatccatgttcagaacctgaaaaaaactactttacctgttgattctattgcaacacctggatcaatacatactcagcatgaagtctcagaggcttctaggattttgcaggagttcttgtttggtgctggcagttagagaagatggcacatgtttactatttctctagtcttcaaaggatgactttcgtggactccgtgaacaagttcaacccacactgtagttacatggagcaaatagttggatgagcttactgatgtcatggaaaagttgaacctcaagtcacgaggtagcacaatgggacttgatgtgtcattattcggttcctaacaagggactgttttgtgaggcacctcccctcctgtcaggccagggaactcggattcctattcctccatgcaagagcttttacgtccgtttgccacatgagaatggcaggcagctatcggggctggagtttagtcttggatcatcatcatgattcgggacacatctgtggcagacttgttgggtacctttgctggcgaccaacattagcctggtgcagtgcatggtctgggctttgcatgcatgcatgcaatgcccccgggatctccgttccgatctcttgggttcagaattacttgtgaagtattatagctgaaaagattgtggtacgccatagcagatgctgaaggccccagctttgccatggaagcaggcatgtgagctgtgtccctctacgcctgaccgtcgtcacatgaccaggtgactgtgacgctgtttctcactactacaacagccaagtttgttctgtccatcatatgatggtgtccaatccaattcctttgaacaaattaccctcaaggtctccgcagtaaaatccacggctccatgctctgttgtttctttgtgtgtgtgtttgcgctttgcgctttgcatcggcgcgtgtgggaggagttcacaacttcacatgcaactgtcattttccatttaccaagaatccgggctgaggtgtgtgtgtggttgttatcctgatttgctaagtattactgtcactgtcactcccgaaaggaaagcaagcaactgagtcgaaattatggtctgagcgact

SEQ ID NO: 7687 - DNA, 556 bp, Sorghum bicolor
  Clone ID: LIB3478-023-P1-K1-D9
tgatactctgccagtttccttgctgtaactgcatatcaaagtttgttttctattttggcttcttgcaaggtcaacaggaaaatttcactgtagacgaatgtatatagttgttttggtactaataaagttgaccgaggacttaattttgcagaagatggcacatgtttactatttctctagtcttcaaaggatgactttcgtggactccgtgaacaagttcaacccacactgtagttacatggagcaaatagttggatgagcttactgatgtcatggaaaagttgaacctcaagtcacgaggtagcacaatgggacttgatgtgtcattattcggttcctaacaagggactgttttgtgaggcacctcccctcctgtcaggtgggtttccgtacattactttctgttgagctgtctattgaaagatgctttcccatgaaaacaatactgtatgtgggccgatttcttcagctgctttggtatcaagcttctgccttgcctttagaaagagtttgatgaaagaaaagtgatcttatcaactttttttcatgccaggga

SEQ ID NO: 7688 - DNA, 1041 bp, Sorghum bicolor
  Clone ID: SORBI-28MAY03-CLUS10527_1
gccgtctcggcgcctcgagctcgtgtcctcgctgccgtggtcaccacggggaagcatgaggaggaggcctgggatcgctggcttgcagaatgcggcggctactcgcgaccaattccggctggtcggggagaatgtggccaaggtcaggaccgatgtcatgaaggagcagcttgcgacgttccggtcacagctcgaggaatttgctcgcaagcataagagtgacatccgtaaaaacccggtatttagacagcagtttcatgagatgtgcgcaaaagttggagtagatccattggcatccaataaaggagtctgggcagaacttctagggattggtgacttctactatgaacttggagttcagatagttgacatatgcattgcaaccagatcgcataatggtggcctgattgatttattggatctccgcaaactgcttggtcagaagagaaaagctaccctggaatcattatctgaagatgactgtttacgtgctataagcaagctaaaagtccttggcagtggttttgaagtaatttctgtcgggaggaggaagcttgtgcgttcggttcctaccgaattaaataaagaccacagtgggatacttgggctagctcaggctgagggctatgtcacggtagaacaagtcgaaagggaattctcatggtctactgggcgtgcaattgatgctcttgaaactttgctgaaggaggggcttgctatgatcgatgatggccatagggacggcaaacgaagatattggttcccatgcgttactgtcagctccgacacagctgctgttgaagccaagtcatgacccccaatatgtcaattccacaatgtgtccatgtctccatgaggtggaacaactagtagcactgaaaagtgaagaatgacattctttttgctttttttgttttgcctctggcacttgcaatattgtgtgtaaatgtttggtatgtccagtacacctgtgtgtatgaattcaggtgctaagatctcactttttgaatatgaaaggttacaggattcttattcagaatt

SEQ ID NO: 7689 - DNA, 635 bp, Sorghum bicolor
  Clone ID: SORBI-28MAY03-CLUS10548_1
accaccacaccaggcgcacgcggaacacaacctctgagattccccatggctgctttctggttgctgctgctgttcgtcgctagtgcagtccttgttcttcgtacatggagagctcgaagtatcatcagcaaggcgcggcaggcagggccgacgtacccgccggggctggagccgtacccgctgatcgggcacctgccacagttcttggctaaccggcaccgcgtgctcgactggatgaccgagttcctcgagcgccagaccacgtgcaccttcgtgctgcgccggccgggcggcgtgcggggcgcgatcaccgccaacccggcgaacgtggagcacttcctgcgcaccagcttcgaccgctaccccaaggggccccggttctcgttgcttctgaacgacttcctcggccggggcatcttcaacgccgacggagaggcctggcgcgcgcagcggaaggtcgccagccacgagttcaacacgcgctcgctccgcgccttcgtggcgcgctgcgtgcacaccgagctacacggccgcctcctcccgctgctgcgccgcgccgcggcgtccggctccccgctcgacctccaggacgcgctcgagcggttcgcgttcgacaatatctgccgcgtcgcctt

SEQ ID NO: 7690 - DNA, 707 bp, Sorghum bicolor
  Clone ID: SORBI-28MAY03-CLUS102151_1
gcacgaggctggatacctggaggtgacgtggggccgaagccagagaagatgcttcaaccgagctttggggagcctggacaatgctttgccatgcagggtagcagtgggtttgttgagatcaagctcaagtcgggaataattcctgaggcagtaacacttgagcatgtgtctaaggatgtggcgtatgataggtctacagctccaaaagactgtctggtgtctggatggtacgaggagacgcctggtgagacccaattgggtcatgctgcaaagatggctttggtagagttcacgtacgacttggagaagaacaatgtgcagacatttgatgcgccagccccagatgtaggcgtgatcaatatgatccggttggatttcaattcgaatcacggaagctcgcagctgacatgcatctaccgcctccgggtccatggccatgaaccggtctctccaggaaccgcaggttctcaggcctgagttgtgtggaagccttgtgtttctatatgctacgtgattcacttgacggtccgctctttgtgctcaatctagttttggtctagggctgtcatgtacacacactgtaaatctaacaattgtttgctggtagcctggcgtcttcctaggtcctagtccagtaacatgtggtaggtgtttagttcgtgctatgaaaacatggaagttcaacagtaaaaaaaaaaaaaaaaaaa

SEQ ID NO: 7691 - DNA, 491 bp, Sorghum bicolor
  Clone ID: SORBI-28MAY03-CLUS102474_1
gcacgaggctcgccttggtgacgaagcttcttctctgtctcgttgcctgatcgatttcagcgttcatcaattacagattccagtggacaccgcccatcatcgacgtcgcaattatcttttctcgtctcataatcgaatcttttccagcaacatacataccaatcgtagagaccatatcattagctgtgattcatacctgcctaggtagctagccaaccatgcccgcgattccttctacactccctccttccgtggaggaggcctatcgtcgaaaatgtgttcaactcaagaaccgcaccaatgaagttgaagacgccaatgatgccgcccgacttcgtcttgcccgtatcaagcgccaggttgaaaagttgcgaatagagcgcgcgtttctactcgaacagctcgcaaagcgcacgagcgcaaacgtcgaggactcagacggcagcccaagcccaccccctacggtatgctattattttcttcccatccct

SEQ ID NO: 7692 - DNA, 1040 bp, Sorghum bicolor
  Clone ID: SORBI-28MAY03-CLUS10248_1
gaaccggaagagcctgaagacgcaactaagggtagagatgttttcaatgaaaaaccacctccagaagagcttttgtctgtatcagacctaggaaaaactgctacaacatcattgcctgataatttggtgctacatacttctatgggtgacattcacttgagactatacccagaagagtgtccaaaaactgtggaaaacttcactacccattgccggaatggttattatgacaatcttatatttcaccgtgtgattaaaggattcatgattcagactggagatcctttgggggatggcactggtgggcaatcaatctggggcactgaatttgaagatgaatttcacaagagcttgaggcatgataggccttttacactttccatggccaatgctggacctaataccaatggttctcaattctttatcactactgtggcaactccatggctagataacaaacacacagtgttcggtagagttgtgaaagggatggatgttgtccagcaaattgagaaggtcaagactgacaagaatgacaaaccatatcaagatgtaaagatcttgaatgttacagttcccaagacataagctcctacctgatcagttggggttggacattgtacctgcactccttggttggacatatttctaacctgtggaagattgtgctggagtcttagagatcagctatatgctgtggtgaatagagcacacctttcgctgctgttgacgctgtcttattggaaccttgcaattttcaggattgatggtacctgaggaattttaggtttagctttggattccagaatcgtggggtcgatttgtgacgttgggttaatctttcaggtttaaatgaaaggaaaaaaagagtgaaaacacgcagtagctgtttaatttttgagaatggtgccaggaagatgtgcccagttgtccaatgtataatcatatatcggaacgtatttgtacgcatcattgtcctatacgttcgggtcatgtttggatacctcgtacatagatcgtggaacctcacttgtaaaagc

SEQ ID NO: 7693 - DNA, 816 bp, Sorghum bicolor
  Clone ID: SORBI-28MAY03-CLUS10259_1
gcgggtcttgatgtggctcaaatttggttggatggagatgaaactcttgtcaacactattgatcgtgatgggaatgtgctaccaataaatatgatccaagggcattcgttaacgcatgaccctcttgttgtgcttgtcaatgaaggaagtgcaagtgcaagtgaaatcttagcaggggcattacatgacaatggacgagctattctggttggccatagaacctttggtaaaggaaaaattcagagtgtgactgagctggatgatggctctgctctgtttatcacagttgcaaagtatctatctccagcgctgcatgaaattgatcaagtaggaatccaacctgacatacaatgcagccctgatgtcctatctttgccaagagcgccttcgctaaaagaaaacagcgaggccacaaatttggagatggattcatgtatcatggtcgccgaacaagcgttggaaattgagcaaacaaagggttctgcttcttagatgtgctacttctgggctctttatatgttgcattgtagagtagattggtagcttaccgtagaggcttaaagttctgtatatgtagtggtgtatatatatggctgatcctcacatgtttcattttaggcattatctattcggtggttcatgggaatgcatataagttgaccctgtgtcggtttgattcttggcatatgccatcacatattcagaactacagcatgcaattttttggtaattaggcctgttggttcttgtgtaatctttaaggttcatcagcatccaaaggtcagggaaggtcaggggatcgattaagagagaatt

SEQ ID NO: 7694 - DNA, 702 bp, Sorghum bicolor
  Clone ID: SORBI-28MAY03-CLUS1028_1
ttggtgctcgatcttgcctgaatatagttcatttcctctgtctgactcttctttgttaatcggccttgctagctagctatctatctagctatctatctagctcggccaagtaataaccgccaaccgggcgtcgtcgcgcgaagtagagcgcacgcagcaacaatggcggacgccggggaggggcggcgggtgtgcggcatgccggagaaggcgcagctgcacgtggcgatgctggcgctgcagttcggctacgcggggttccacgtggtgtcgcggctggcgctcaacatgggcatcagcaagctcgtcttccccgtctaccgcaacatcatcgcgctctgcctcctcgtccccttcgcctactttctcgagaagaaggacaggccgcagctgaccctcaacttcgtcatccagttcttcctcctcgcgctctgcggcatcacggcgaaccaagggttctacctgctggggctggacaacacgtcgccgacgttcgcgtcggcgatccagaactcggtgccggcaatcaccttcgccatggcggcggcgctgcggatcgagaaggtccggctggaccggcgcgacggcgtggccaaggtggccgggacgctggcgtgcgtggcgggtgcgtccgtcatcacgctctacaagggccccaccatcttcggccccagcggcggcggcggcggcggcgacaagctc

SEQ ID NO: 7695 - DNA, 1472 bp, Sorghum bicolor
  Clone ID: SORBI-28MAY03-CLUS10297_1
gcacgaggcttacttagtggagcctctttggtggataggcatgatttcgatgattgtaggtgaaattgctaattttgctgcttatgcatttgctcctgctattcttgtcactcctcttggtgcactcagtataatcatcagcgctgcacttgcacatgccattctacaggagaaactgcacacgtttggtatacttggttgtgttctctgtgttgttggatccatcacaattgtgctccatgctccacaagagcgtgacattgattctgtaaaggaagtttgggatcttgcaactgaaccagctttcctttgctatgcggctatagtagttgcagcagccttagtgcttatatattttgttgtcccccatcatggacaaacaaacataatggtgtacattggagtgtgttctcttctgggatcactcacggttatgagtgtaagagctcttggaattgccttgaagctaacattctcaggaacaaaccaattattctatcctcagacttgggcctttgcactaattgtagctacctgcgtgagcacccagattaactatctaaataaggcattggatacatttaatacagctgtagtctcaccgatatattacgtgatgtttacatcactaacaattatagccagtgtgataatgttcaaggattgggaccatcaaaatccaacacaaattgttacagagatgtgtggcttcatgactatcctatctgggacgtttcttcttcacaagacaaaagatatgactgatagtcctggacaatgtttgtccacacgacggccaaagcatgctagtcagagtgcgtttgcaattgaagtcatgccactaaaatgtcaagattctgtagatgatgagaccttgacgttgtcacttcccaaggttgaaaatggttacctaaaggaagagcatcttcttagatacaaggactcaagtattgtctgatagacaattcttcgccaacatttggcaggaagctgttgagaatcatttgctctcagacatgattgatttgatgtaaaactggagctggtagttttacatcaacctggcctgggatagattgatactacggattataagttgtcaactgtggttcgcctgtatcttgatgatgattttagcgaaggagcaagccagaaggatgccacattcaggccaattaagttctagtcatcaaggaacattggttccagaaaagcattcgaagtgtacttagatacagtggtgtcaccaactatactattttttcccctcattttaggacgtcatgtgttagctgcagtgtgatcttatctgatttctactaggacgacgccatatagaaatgtcaggcttcagttttacctgtaattacctcaaattgctgcccagttgtcattgtgtatacttagtctgtgtaagtatatcaattcagactttctgataagggacccctttggataaactgttgatcatt

SEQ ID NO: 7696 - DNA, 535 bp, Sorghum bicolor
  Clone ID: SORBI-28MAY03-CLUS103247_1
gcacgaggacggtatcgagtatggtgacatgcagttgatctgtgaggcatacgacatcatgaagcgtggtctaggaatgaagaacaaggaaatcggtgacgttttcgccgagtggaacaagggcgtacttgactccttcctcatcgagatcacccgcgacatcatgtacaagaacgacgacaaggacggaacccccatcgttgagaagattctcgactctgctggtcagaagggcactggcaagtggaccgccatcaacgccttggaccttggtatgcccgttacgttgatcggagaggctgtctttgcccgatgcctttcttccctcaaggccgagcgtggccgtgccgcctctcttctcgatggtcctagccccagcttcagcggcgacaagaagcaattcatcgcaaaccttgagcaggccttgtacgcgtctaagattatctcgtatgcccagggtttcatgttgattcagaacgccgccaaggagtataagtggaagttgaacaagcccgagattgctctcatgtggcgt

SEQ ID NO: 7697 - DNA, 1115 bp, Sorghum bicolor
  Clone ID: SORBI-28MAY03-CLUS103418_1
gcacgaggttcttctgttggctgttgctgcttctcctctcctcttctccccgtggccacaagacagggctgaggatcctcctccgatcctcctccgtatccatgagagagggatgatctatagcaaaccatagcttactactcggattcgattcgtccttgtcttgttcgtttcagcacgagagaggaggtgaaggaaagatcagaggcgacgccggcatataatttgttgcttgtgatcgatgatgaactcccagaaccttcagctgcagctgcccgttcaggatctgagtctcagagggagatcattcatcagcaagcccaccaataacaaggtgatgcaccaccaccaccagtgccctgcagcttcgtcgtcttcaccaccagctgctgctagaggaggcctgcaggttgcccatcccagcaccagcaggaggcgtcctcgtgccctcgtcgccgtcagagcggccggcggcagtgacgacgcatcaggaggtgagtcgtcgtcaagcggcggaggggaagaagatgacgatggcggtaggtcgtcgtggtcgtcgggcggcggcggcggcttgtcccgagacgatttggagcgcctggttgggaccgacgacgacgccaagttcaatgggttggatcttgcaaacctcatcaggaagaagtacggcagatcgtacgatgtcacattgataaagaaggagttcatgggaaggaatctgctggccatgaatgtgatgtggaagtacagggagcaaagatcgttcccgctgagcgaggaggagtacctactgcggctggacgacgtggccaacacgctcaagtgctggggagccgtggcgcacgtgcgcaacacgctggagaagctcaaggagaggccgcgcatcggcaaggccgtcagcatcttcatcgacatggaccagaccggaggacgctccaacgagtggatctacaagtagctacctacctacctacagtacctactagccaattcaaagagattattactatatatatatatggagtacagtagttattaactcatgaattccactccaacattcaacgagtcatatactactatacatgctgtatatataagcagattgaagattc

SEQ ID NO: 7698 - DNA, 1051 bp, Sorghum bicolor
  Clone ID: SORBI-28MAY03-CLUS103518_1
gcacgagggtggtatggtgcagccttcatcttccaggggacagatagatctttttgattctattccaagagaaggttctgccgcaatgaagaatgttgcattcaacttgcaagggtcagatgacaaaagcatgacagaaagtagagcaacttttggacgtgtttcaggtgtagacaatatctccaggggtgcttcagtatctgttcatcccaagtcaagtgaaacagctttcaaaatacttaagcaacttgacagaactattccttcccctacatcaaagccactagggctgagacagacattagccaagagaaatacttcttctgttgccaccaacagacagatcaatgggcctgatttcagtatcggtaatggtaatagacagagcagcattaatgagagtggcagtgctaactcggagactacatatggaaagaaggttcagcaacctcaaagcagtcctattgcagaagagtcaagtgaaaaagtccagagaagcagagctaactcagatgtttctgaagcaggcacttctcagcagcctcggaaatcaaatttagcacccacttcagttgcggaggtcttgaataataaaaacactagcagaggtttcagcttcacatttcctattcctaaagctccaagttctctacttgaaccgccacctacaccaactatggcttcaccaccaccgaccctgccaatcactaatgaagatattcccaagttcacttttggctcacccagtactgccaacaaactcgttttctccttcaactccacaagcagttctcttggtgctgggggaacagacccaaccttcaaatttggatctgataataagcgagagcttgtgttttgatatagttggcaaaggtgcagtttgtttttgatagatgccatgccagcggatctgtattctacctctctttctatttttggcgtgttgttgaaagacgtctttagaaagaccgttggatgcgctacttgaactatacatgaggacattcgtttcatttatcagtaattcagtatattcaaactttttttt

SEQ ID NO: 7699 - DNA, 1731 bp, Sorghum bicolor
  Clone ID: SORBI-28MAY03-CLUS10377_1
gcacgagggacaaaagtcgcgggctcgcggcggcatcagggcactcgccacaggtaaaagaaagctgctgcctttcctcctgctccttcctactagtgcgtggaggtggagcagtggggcgctacagcagctaccttgccgtgtcctcctcttcctcctctcctcctgtcggtggcaatctctgcggaaaccgagctccatccatggccgtccaaaccgagcagtagcgccgcctgggcgtaactatggattcttgtgagggctctgatgattatataactcaaagcaagattgtttctgcaaaatctgctgcattggttgatggcaagattgaacctgctggagaggggttgcctgatggttggttgaaagaatacagcccgtgcctcaaccgttacccgtctggtcgcttcggtcccccgttctatattgatccaatcaatggatataaatttcactctctcaaggatgtgcaccgctatcttgaatctggagacatcaatcaatgttttagattgccaaacaagagaaaaattggggacctgcatactgaaggggaccaatctcatcatacaggaaaactatcggatcatacaccactggatactgctgacaagtctaatcgatatgatctactgaaaggtaccaatacgctgggacatgctctgctaaatccaaaaagtggagagaatgctgaaaatgttacattgtgtaagcctgatgatataaactcaatccagagggaagctgatcaggttgaagcttcagaaggtaagagcatccaatcaggcttcatagaagagactccaggggaagctaaatttgtcactaggaaaggagcaaatgtgaaggagaaaccaaaggaaaacccacgcgtccgcaaacctgtcaaagggattgctgtacctctgagatcatcacctcgtttagctgcactgaagattagccaggaagcaaataacacacccagagatggacatagtggcacacagacagacatcactaatgatccacaaccaaagcaaatccaaaaacctaggcgaaagacaaattcttctgtacttcctgagaggaaagatggagaatctaccaggagttcagcagaaaaccttccttcagttcccaatcaaacacagggagcatccttcccacactcttcaggagatgctggatgccagaatgcaccagctgaggctcctgttctgcgacaacaagcaggacaaggtgaaacatctgatggtttatctggatctgccctgtcgtcactatttcaacatgtctggtcagacccatgccttgtgtttgcattcaggactcttctgggtgatattcctgttcttgatgacgctcgagcatatcgatcttcagcttatgatggtaatagagactactaccttccaccacagagcatgaataaaaacactgcagccaactggtctgcttcggcttatgatggtaacagaaaccacgcacaagtcaatcatgttatgccaaggtcatcagataagttctgcggcagtggttggttccctccccagtgaattcattctggaaatacgaaaacaggttcttacctggcatggacagagcacaagcaaactcaagtcctagtcctaatcctagttttagctctctttggcccttgcctcaacaaggatgcatgctgcaagcaagactccagctcgttgtaactgtgtagaggatccataactaatagtctaatatagtgtc

SEQ ID NO: 7700 - DNA, 674 bp, Sorghum bicolor
  Clone ID: SORBI-28MAY03-CLUS115528_1
gcacgagggatggttccggctacaacaacgccaacttcgccacgcctcccgacggtcagcgcccgcgcatgaggatgtacctctgggactggtccgtgcccatgaaggatggagatctggactctggcatcatcgtccacgagtacggtcacggcatttcgaccaggttgactggcggtcctgccaactccaactgtctggtcaacggtcagcccggcggcatgggtgagggctggggtgatttctgggccaccatgttcattcagaggaaggagtacggtcctggtgacgccttccccatgggttcctacgccgctggccgtggaatcagggccttcccttacagcgctgatttcaagattgaccctcagaccttcggttacctcaaccaggcgggctacaacctcagcactaacgtccacgccaagggttccgtgtggtgcaccatccttatcgacgtctactggaacttggtaacaaagcacggcttcgatcccgattggtatgctggaagcggcggcaacaatgccctcttccgcaacgttgtggacggcctcaagctccagccctgcagcccgacctttgcggatgccagagatgccatcattttggccgatgtacataactacaagggacgtcacgtgtgtgatatgtgggagtcattcgcccgtcga

SEQ ID NO: 7701 - DNA, 814 bp, Sorghum bicolor
  Clone ID: SORBI-28MAY03-CLUS115547_1
gcacgaggtggaaatctgacacagcaagcctctctgctcatcgacctctacttgaagcccgaatacgagcaatacaagaagaggattgtggaactatcacacatggaccccaaggactctgatcgcgaactccagggtttcgtatacgaaggtatgcgtcatgttggtgtcgtacccggtctccctcgtgttgcaacacgcgatgtgacggttcaagatggcgtccgtggccctgtaacggtcaagaagggccacacagtgctcatcgctacttccaaagctgcaatggaccctgttgctttccccaacccggaaatcctcaaccctcaccgctcgttcaaggaatatactctccttggtcacggtctgcacttttgcttcggagcccgcctcgtcggcccctctctcgcagccacactacgcgaggtcttcaagcttcctaatgtgcgtcgagcacctggtaggcaaggccattttatcacaacggagcatcagctcgcaggtatcaccatgcgtcactacctcgacgcatcgagcaaggagagccctatcccgacatccctgcgcctgcactatgacagtgtggatgctgccgtgaacggtgtcaatgggcatcttaccaatggtcatgccaataccggcaggaacaatgcctacacgttcgcgccataattgagtcaggtgttgtagtgcgcgtctacgttgagtcgacggaccgttcgaatttttccgaaatgtgtaatgcttttgttatgcagcagggttggaaagtaatgagaagcacgtgttagtctgcagagaaggaagaaggaaa

SEQ ID NO: 7702 - DNA, 507 bp, Sorghum bicolor
  Clone ID: SORBI-28MAY03-CLUS115601_1
gcacgaggggaggaggctggttccttattgcgtattcggaactctcacttagcaagcatatatactcatcaaacagtggcctccaggcagaggatcgaaatggcgaagctgcaccggctcatctccgccgtgctgaggctggctgcagcgggagccgccgcggccgcagccatcatcatggtgaccagccacgagaccaccagcttcttcggcatagagatggaggccaagtactcctacactccatcattcgtcttcttcgtggtggcattcgctgtggctttcgcctacagcctgcttgcgctcctcgcgcggccggggagcaccgcctccagattactgctcctaagcgacgtgatggtagggatgctgctgaccggcgccgtggcggccaccggcgcgatctctcaagtcgggaagagcggcaacgagcacgccgggtggctgcccatctgcgcgcaggtgcaggcctactgcagccacgtgatgggggcgctcatcgccggc

SEQ ID NO: 7703 - DNA, 590 bp, Sorghum bicolor
  Clone ID: SORBI-28MAY03-CLUS115640_1
ggtgttcctgatattccaagcatcggtcccaaggagtttgccttccaatatactcaagataagcacccttggttgagcaaggtacctccacaaactgatattcttatcactcattgccctccgaaacatcatcttgatcttggtctcggagacagcaatctcctccgggaagtttggcgcgtaaagcctcgtcttcatgtcttcggccacgtccactttggctacggtacagaatcagcctttttcgataccttccaggagacttacgaacgtatcatgtcacggcctcgtcgcggtctgatcagagacttcatccctaacgaggcgtggctcgattatctgcgtcttgtagctcaaggccttcatagcgtggcttggaagtggctcatgtcaggtcctggaagtaacaatggtagtctcatggtaaatgctgcgcagatgaatggcaactcgggcaaagtcaagagtagggcagttgttgttgaaatttgaaagaccaagcaagcaagtttaaatatatataaggcatgttttcatctccgagtcacctacagcctccgagaacttggtggaaaatatttgaaaatata

SEQ ID NO: 7704 - DNA, 594 bp, Sorghum bicolor
  Clone ID: SORBI-28MAY03-CLUS12721_1
actgaccggtgctgctgggaggcgcggcttcagcttcagctgctgccgcttgcctgatacctcgacgtgtcattcaccaaatgccataagctgatgggcttctcaacaggcccgaggtcaaaagccactcactggaagcaaactgttctttacctcgaggatgtaataactatctgccagggggaaaccctgacgggtagcatgacagtcacacccaataagaacaaccctcgagatatcgacattaagctcaagtactccatagatgggcataggtgtcaggtatcaagaactcaattctacaagatgcggtgaccaacaaacaagagatgcttcaaagctcattaaattttgtttgactgagtatcttgtttgacagaaatgatgctttttttcatgatcatgtattgttatacatcagttagattctttggaatctagcgaaagtagggagtagattaaactggcctgctgagatgagattgatgtagtgcaaaacttatgtcatattgccacaaggttgttggtggttgtatgcatttgaagtctgttgcaaattatcgttttatgcattccaccactaatcattccttt

SEQ ID NO: 7705 - DNA, 756 bp, Sorghum bicolor
  unsure (1)..(756): unsure at all n locations
  Clone ID: SORBI-28MAY03-CLUS12765_1
gcgaagcacgccatggccaccacgatccctacagtccttctcgcttctgccatcctcgttgctgcagcgacctacttgcgccatgacacacgcagcagcggcggcagcgtcaccgccggaacgcacctccacttctacatgcacgaccagtacaccggcgagaacccgacggccgcgctcatcatgcagggaaggccgccgctgtccaactccaacgccaccaccaccggcagcagcgacgacgacgacccgcgccggttcggcgacatcgccgtgatgaacaacgcgctcacagaagggcccgagcgcggcagcgcgcgcgtaggcacggcgcaggggttcacggtgcgcgtggcggagcgcggctccgttaacgccctgagcatgcacctgngtgatggaggccggcgagcacgccggcatctcgctggtggtcagcggcagggtcgacaccgacctggcggtgcgcgagtcggtcatcgtcggcggcaccggccggttccgcgccgcgcgggggtatgcgctcagccggagctacgactacgacttggccaagggaggcgttgtagaggtcgatgtgtacctgtactaggtgtgcatggctacgagctgaaaattcgatgcttggtgatgtatgaggctagggctgaaaatttgatcgagtaataaggaacttgcggattcacagtgtcgtcacaacttggctttgtatggttctttcaanggtgtactgtaaatctggtttcacggacgttt

SEQ ID NO: 7706 - DNA, 1766 bp, Sorghum bicolor
  Clone ID: SORBI-28MAY03-CLUS12777_1
gcacgagggagagagtagtcgctcgactaaggaaggacttgtttagtcatctcataaaccaggaaatagcgttttttgatgtgactagaacaggagagctcttaagcaggctttctgaagatacacagataataaagaatgctgctacaaccaatctatcagaggcactgcgcaatctcactactacagctattggtcttggttttatgttttcaacttcatggaagttaacattgctggcacttgtaattgtcccagttatatcagttgctgtgcccacgcgtgggcgctttcttcgtgagctttcacatcagacacaagctgctgcagctgtagcttcatccatagctgaggaatcctttggtgccatccgtacagtaagatcctttgctcaggaatctcatgagatttcacgctatggtggaaaagttgaggagacacttaaacttggtctcaaacaagctaaagttgttggcttgttttctggagggcttaatgcagcgtcaaccttgtcagtggttattgttgttatttatggagccaacttaaccatcaatggctacatgacaactggttctcttacatcattcatcttatacagccttacagttggttcgtcagtatctgccttgtcaggactatacacaactgtaatgaaagcctctggtgcaagccgtagagtttttcaacttctggaccgtgtttcctcaatgacaaactctgggaacaaatgtccaataaatgaaaaggatggggaagttgagcttgatgatgtctggttcgcatatccttctcgcccttctcatatgattcttaagggaataacgctgaagttagctccaggttcaaaggttgcacttgttgggccaagtggtggtggtaaaaccacaatagcaaatttgattgagcggttttatgaccctctaaagggaaggatattgcttaatggagtaccattggtagaaatttcacatcaatatcttcacagcaaggtaagcattgtcagtcaggagcctacactctttaactgcaccatcgaagagaatattgcttatggattagagggcaaagcgaactttgctgacgttgagagtgcggctaaaatggcgaatgcacacaacttcatatgcacctttcccgaccaatataagactgtcgttggcgagcgagggatcaggttatccggcgggcagaagcagaggatcgccattgcgagagctttgcttatgaacccacgagtgcttctcttggacgaagctaccagtgccctggatgctgaaagcgaatatcttgtccaggatgcaatggactccttgatgaaagggcggactgtccttgtgatagctcaccggctgtcgaccgtcaagagtgccgacaccgtcgccgtcatctctgacggcctaatcgtggagagtggcacgcacgacgaactcctggaccacaacggcatatacacagccttggtgaagaggcagctgcaagggccgaagtttgaggccaccagcagcatcaacgacgccagcgaaattgaagccgagcccagccgtaatgggcaatagcgccccgctccttaggaagagtggcagacaacagttcatttgaatccactgaagtgtatgtaaccctgattttgatgtatgccactgcgaatcacgcgaaaccattgatatcacacacgatgctacagttgggtgcaggaggacctaattggctagccctactacacatatggtccaggtttgtgtttatggtgtgctaatttttgc

SEQ ID NO: 7707 - DNA, 597 bp, Sorghum bicolor
  Clone ID: SORBI-28MAY03-CLUS127791_1
ccgcatcttccgggagaacgggctcaccatccgccgcgccgagatctcgtcgtcgggcggcgaggccgtggacacgttctacctgtcggacccgcagggcctccccgtggaggccaagaccatcgaggccatccgcgcgcagatcggcgaggccacgctgcgggtgaagaacaacccgttcgccgcgggcggcgacgtcgccggcggcgctggcaccacggcgttcatcttcgggaacctgttcaagttctaccggccgttccagagcttcagcctcgtcaagctctactcgtgatgccgatgcgcactttggtagtaaattttttcacgtgttttggatgctcgtggctgcagttattagcttgctgctcctttgagatttcccagttcccagtagtgtaaatatggctgtggatgatgatgatggcgatatacacagtacagtgtaaatatgtagttaggttaaggttaagtagctgcaaggttacgttgggaagaatgataattttattgtagacccaacaaattagtgcagactggaattgaaggctattccatatttccatctttgtaaatattctggtttaaaaaaaaaaa

SEQ ID NO: 7708 - DNA, 914 bp, Sorghum bicolor
  Clone ID: SORBI-28MAY03-CLUS12867_1
tgtgcggcgctcgacgcggcccgcctgggcgacgaaacgggacaagataacgagacagcaagggggagcagggagccagggtacccagaaacatagaagatggcggcgaggcgcgacaccgagttggacggcgaagagctcggcggcgagggctccaaccccgtcggtggtggcgcgactccaccgcccctaggcgcagcccctgtcgtatgcgtcctccgctccgctggggacttcgctggcggcgccttcattggatccgtcttcggatatggacaaggcttgctcactaagaagggttttaagggctcattcagcaatgcagggtcctctgccaagacttttgcagttctctctggagttcagagtttggtcgtgtgcttgttgcgaaggctacgtgggaaagatgacattgtcaatgctggtatagctggttgttgtactggtgttgctttgagctttccaggagcgccacaagcgttgcttcaaagctgtgccacctttgcagcattctcatgcatcatggaggggctcaataagcagcaggctgcaatggctcgcacacttggtgggactgccgtgacggtcgtgcatgagaaaggcggtgttctgcccccgttcacgctgccaccaattcttgatgcatctgatgctttagcttcatgctgcttagcgttagtaaagcctaagcactagattgcagaatagagggcgtgagagatggtgaagacttcggttctttattgtgttgaccccagcttatgtaaattttgtttttggacaagatgtgtaacgtgcctaaaatccagatttgcttcatctagccagttttcccttggaatgtgttaacgtttgtagcatgcccttgcggattccgctgggtcagtcatatttatagggataaggtcataaat

SEQ ID NO: 7709 - DNA, 732 bp, Sorghum bicolor
  Clone ID: SORBI-28MAY03-CLUS117077_1
gcacgaggccaagaatcgccactccgctaccttcactcgctcactcagaatgcggcgccatggcgaggtatgcgtgatctttgctgtggccgccgccgccctcttggcggccgccgcgaccccagccgcggctggtcgggaggatcggcagacctacatcgtccacatgtcccattccgccatgccgagtgatttcgtggagcatgaggagtggtacgccgcgtcgcttcaggcggtgtcggacgccgccaccgtgctgtacacctacaacaccctcctccacggctactcggcgcggctgacgcgcgcggaggccgcggcgctggcacgagggcccggcgtgctcgtcgtcaacccggaggtgcggtacgagctgcacaccacccggacgtgggagttcctggggctggacggcacggacgcgctgttcccgcagtcgggcaccgggtccgacgtcatcgtcggggtgctcgacaccggcgtgtggccggagaggccgagctatgacgacacggggttcggccccgttccggcgggctggaagggcaagtgcgaggacggcaacgacttcaacgccaccgcgtgcaacaagaagctcatcggcgcgaggttcttcctgacgggctacgaggcggccaagggccccgtggacacgtccaaggaatcccggtcgccgagggacaacgacggccacgggacgcacacgtcgagcaccgcggcgggcggcgccgt

SEQ ID NO: 7710 - DNA, 743 bp, Sorghum bicolor
  Clone ID: SORBI-28MAY03-CLUS117318_1
cgtttgcgctgcgagtgaagcttgcgctaagcttcaaaggcttgagctacgagtacatcgaggaggcacgaggccacaacagcaagagcgagctcctcctcaagtccaaccctgtgcacaagaaggtgcccgtactcttccacaacggcaagcctgtatgtgagtccatgatcatcattcagtacctcgaggaggcgtttgctgacgccgggccctccctcctcccttctgatccccacgaacgcgctgttgctcgggtctgggccgcctacattgatgagaagctcttcagctcgtggatgatggtgttcaggggcaagacggatgaggagaaggcggagggcacgaagcagtcgttcgccgtggcggcaacgctggagggagccctgagcgagtgttccaaggggaagcccttcttcggaggcgaaaccatcgggtacctcgacgtcgcgcttggagggtttgtcgcctggattcacgccatcgagaagctatatggactgaagctgttcttcgacgctgggaagaccccgctcttggcggcgtggctggagcgcttctgcgagctggatgctgccaaggcggtcttgccggacgttgagaagcttgtcgagctcgctaagatgaggcaagcccaagctgctgctgctgccgccgccgccgccgttgcccaagacaattgaagaggttgaagtcaatttgggttcagtactggtgtccaaaaataaacatatgtagtttga

SEQ ID NO: 7711 - DNA, 770 bp, Sorghum bicolor
  Clone ID: SORBI-28MAY03-CLUS11692_1
tctcaaagggctgcagcaatgtaaaggaagggactggtttgactacatttctgcacttcttctttcagacttaggacttccatttatgtccattgatgaggttatcaccgtcaacagtgatgatctaatcttagaagctttcaagtgcatgaaggataacaagattggtggtgtaccagtagtagaaggccccaaaagaaaacttgttggcagtgttagcataagggacatccgctttctgttgcttagacccaatttattttcaaatttcaggcaacttacggtcattgaattcatgaagactctaggctccactcttcctgattcagggaacaattgcctggtgaagccaccacccacctgcactcctgacgcttcccttggtagtgttattgacagcattgcatcaagaataacccacaggatatatgtagtggatgttgaccttgaggttgttggtgttgtgactctgcgtgatgtgatctcgtgttttatccacgagccacccggttattgcgacagctatttgacttcagcaatggagaagcttgacggtaaaggagtcggatcagtggagaaacgttgagcttttgtgtagcgtgaatgttgaataacaggtgagtatgtgaggaaggtagttggaaggaatggtgcattcatgccgtgttatcccagcaaattctgtattagattaattaagaaggcttctgttatgtttatactatgccatttctttggaagtttggatagtttgctgatcaaatgcgggt

SEQ ID NO: 7712 - DNA, 533 bp, Sorghum bicolor
  Clone ID: LIB3478-032-P1-K1-F10
gagcccgaaaaacctatcatcaagaacttcattactcagactggtgttctcaaagggctgcagcaatgtaaaggaagggactggtttgactacatttctgcacttcctctttcagacttaggacttccatttatgtccattgatgaggttattttgtctccctcttaatgctgtttcagttgaattccacccttttaatggaagagccagtttcctatgttctatgatattcttttaatttacttgtgcagcctgcaaagcactacattataatgtgtttgcctcttcaacagacactggtaaatgttgatatgacaattttgtgttttttcaggttatcaccgtcaacagtgatgatctaatcttagaagctttcaagtgcatgaaggataacaagattggtggtgtaccagtagtagaaggccccaaaagaaaacttgttggcagtgtttgcataagggaccatcgctttctgttgcttagacccaatttattttcaaatttcaagcaacttacggtcattgaattcatga

SEQ ID NO: 7713 - DNA, 658 bp, Sorghum bicolor
  Clone ID: SORBI-28MAY03-CLUS117673_1
cgtcgaggagctggacggcgtcatcggccatggccgtctcgtcaccgagcaggacattcggagcctgccgtacgtggaggccatcgtgaaggagaccatgcgcctgcaccccgtgacgccgctgctggcgccgcggctgtgccgcgaggacgcgtccacgggcagctacgacatcccgcggggcacgctcgtgttcgtgaacgtctgggccatcggccgcgaccccgccgtgtggggcggcgacgcggaggagttccgcccggagaggttcgccggcagcgccgtggacgtgaaggggcaggacctggagctgctcccgttcgggtccggccgccggatgtgcccgggctacgtcctcgggctcaagatggtgcaggtgaccctggccaacctgctgcacgccttcgcgtggcggctgccggacggcgtggcgccggagaagctgagcatgcaggagaagttcgggctggccgttccgcgcgtggtccctctcgaggccgtcgccgtgcccaggctgcctgcacacctctacgccgggccctgatggacgtcgatctgcctgtgatccgggtcatgcataccgtcgtccatggccgtgctgtcttttactgtactctaatcgtcaaaaaaatatataatgctcttttatacaaggagt

SEQ ID NO: 7714 - DNA, 690 bp, Sorghum bicolor
  Clone ID: SORBI-28MAY03-CLUS11437_1
aatgatcatgcagaattccgtcagcgtggtacccctgtaagatgtcactattatatctttaacttttgcctaatttcgtgggttgtgatcttgcacttttccgtccgcgtggtcccccgtcagtagcgcctcccattctcgacggtgatatgcttgtgcaattcttggagctcactggtgaacaacagcaagccatccttgctcatactttgccagggaaggggccacagaagtccctctcggttttcgaggttttgagaacattagagcgtgtccattatgctcttaactgagggtttcttcaatcacagttactaaaaggtttcgatatcagagcgggttgaccttcactggttgagatacggtcagagctgaggttcgagtgacctttgtggtttcccaagtctgccatgatatttaccagaatgtttttgattgacgatgcaactggagcttaatggtggaaaatctcatggtggcgagtatcctgtggaggcaacggatttgtccaaccccttgtgtatatacacaatcggcagctttaggtggactgttgtaacggtgcattctgcatagaaatgatattctttttgtttgtttcgtagatgatgtaagttttttaggtctcttgtgccagctggtcggatgctcaacgaaaaataaggaaaacaatgaattgcattggtgtcc

SEQ ID NO: 7715 - DNA, 435 bp, Sorghum bicolor
  unsure (1)..(435): unsure at all n locations
  Clone ID: LIB3478-029-P1-K1-C12
gagcattcagaaggctgcattcaggtatcggcttccatttgacgatgatactgacccggtgcttgagacagtttacgactgtattgtggctagtaccatgctggggagtctctttgttatgattccacttacaagtgaggagcatcagcttttgcaagatgtccaagaaagactctcagtacacccattaactgcaccagtcttgggaaatgatcatgcagaattccgtcagcgtggtaccccttcagtagcgcctcccattctcgacggtgatatgcttgtgcaattcttggagctcactgnggaacaacagcaagccatctctgctcataccttgccagggaaggggccacagaagtccctctcggttttcgaggttttgagaacattagagcgtgtccattatgctcttaactgagggtttcttcaatcaca

SEQ ID NO: 7716 - DNA, 707 bp, Sorghum bicolor
  Clone ID: SORBI-28MAY03-CLUS11486_1
cggacgcgtgggttctgctccttcccctactcgcgctcaggctcggtcccagggatcggatcttctgcgcgtcggcggctccccctcggcggcgtccagcgacggaggggcagtcccaggctcggcggcggcggcggcggcgtcggcggctccccctcccgcctctcgccagtcgcctcgcgccctcgcctccgtcctccgcgcacctgccggcgaccctgcgataatggctcatcgtggtcacctagatggactgactgcccaagctccagctctgatgcaccatggttccttcgctgctggcaaactctctagccactcacctttgcagtcttcatccacactggagatgctggagaacaagcttgccatgcaaactgcagaagtagaaaagcttatcatggagaatcagcggttagcatcaagccatgtggtcttgaggcaggacattgttgatacggagaaagagatgcaaatgatccgcacccacctaggtgaagttcagacagagactgatttgcagattagagatttgttggagagaatcagattaatggaggcagacatacatagtggtgatgcagtgaagaaggagcttcaccaagtgcatatggaggcaaagagacttattactgaaaggcagatgctaacccttgacatagagaatgtgattaaagaattacagaaactctctgcctctggtgacg

SEQ ID NO: 7717 - DNA, 768 bp, Sorghum bicolor
  Clone ID: SORBI-28MAY03-CLUS114886_1
gcacgaggggttcttctgctgccgtgccttgggatatgtatgcaggtggcgctcatcggcggcaccaccgccgccgccgcgctctacgccggcctcatctccaactactccgccgccgtgacggagctctacacgctgggcgcccggaagttcgccgtcatcaacgtctggccgctcggatgcgtgccggggcagcgcgtgctgagcccgacgggcgcgtgctcggacaccctcaacgaggtcgccgccggcttcaacgcggcgctgggttccctgctcgtcgacctcgccgcgaggctgccgggcctcgtctactccctcggcgacgccttcggattcacggaggacgtgttggcggacccggcggcgtcagggtacaccgacgtcgcgggcacgtgctgcggcggcgggcggctgggcgccgaggcgtggtgctcgcgcaactccacgctctgcgtcaaccgtgaccagcatgtcttctgggaccgcgtccatccgtcccagcggacggcgtttctcatcgccagagcgctctatgatggaccgtccaagtacaccactcctatcaacttcatgcaactcgccaagtcaaattaattagtgatactgctgatacgtactgtcaaggaccctagaacaaatttgacagtgcatctcttttgtaaaagcatgttgtcgcctactaacgggaacgaaattagtcattcgcaaaaaggaaggacgataattagtcattgtttagatgcttttaaaattctaaaagtttac

SEQ ID NO: 7718 - DNA, 841 bp, Sorghum bicolor
  Clone ID: SORBI-28MAY03-CLUS115282_1
gcacgaggctcccgcctcctctccccctccagtcctccctcgctcgctcgacctcctcctcacgacgcgaggcgtggagccggtcaccgggtcacggccaccgccgcgcccgcccgccggagacccggccggtccgcagccatggccacttcctcctcgtcgctcacgacgctccactcccgcttcctctcttccactccttcctcgccctacatggcggcgctgctgccccgacggcgaagtgccggggcgcggcggtaccctcgcatccgggccattgacctcgaccagaacacgattgtggccatttcggtgggcgtcgtcagcatcgccgtgggaataggtgtcccagtgttctacgagactcaaatcgacaatgccgcaaagagggagaatacacagccgtgcttcccctgcagtggttctggcgcgcaggtatgcaggttttgcactggaaagggcattgttactgtagtgcttggtgcaggcgagactgaagagtcacagtgcgtcaactgcgagggcatcggctctttgacatgcactacatgccaaggcactggaatccaaccacgctatcttgaccgcagggagttcaaggatgacgactgatgaaggctttattaccatctttggtagtatgtcaaagatgtaacatcacggtctagtttgaggatttgaggagagcattgcatacgcagaagagatgtacctacataggatccatctgattgttttgtgttgtattatatatgttccagtttggtaaatatagatgacatatgccctccagcagagaagataatgtctcaaatttaagtgctcaacgttttgcggaaag

SEQ ID NO: 7719 - DNA, 989 bp, Sorghum bicolor
  Clone ID: SORBI-28MAY03-CLUS115517_1
tcgaggctggtgagccgactacgctctcctggaagcctaccaccagcggcaccgtctccctgaagctccaatggggcgctgtgatgacttcgaacacgggtactaccattgcccagaacattcccaactcgggcagctacacatggactcctcctgccaacctcgcggctcagcctgactacaccattgagatcttcaacgacgatgacaccagtgaggtcaactatctcccgcggttcaccgtggccggtgctactgccgccgcgtctaccaccgcgtctgccaccactaccgctgagactacctctgccaccgagtcttccacgactgagacgaccactaacaccaagtccgccaccgagactcataccaccttgactaaggcgactgctagcactgcctcgagcacttcggctactgcctctggcaccagcaccgagtccactagcgcctccgccagcgccagcgccaccggcacctcgaccggcacctctactggttctgcctcgacctccactgaggcttccagcaccacctccgccagtgcatcggcctcgaccactagcgttgtcaacgtcaatggcggtatggttaaccgcgtctctggcggcatgctggcgatcgttctgggtgccattgccgtcctgtgagcttcctccggactctagtcggcgatctgaccatacttcattaattagatagttcttaactactcttctatcgcttctttggttttctttttcctctttttcttttttcgttcactgagcggacctgttttatacccttgggtattgaagttgtttgtctcggacgtgagtaaagtcacgcttcttatctcttctttgcctgggcaatgttttggcctaaatattgttattacgtcgtgattacccggacggattgagccccggggccttgtacggtatgtactagtatgtagatatgtgtatcctgtaatgaaggaccagtccagcatgcgagcaatc

SEQ ID NO: 7720 - DNA, 760 bp, Sorghum bicolor
  Clone ID: SORBI-28MAY03-CLUS1187_1
gccggccgggccgggaaggatttctcgcagcgcaccgctacagtccaaaaccaaaaccccaatcgcacagaagaggcagagagagagagagagagagaggtccatccatggcttccgccgtcgcttccatggtggccgcgccgaagcccgtcttcctcatggacctcctcgcctcaccctccgcgtcctcccgccacctcttccgcaccggagacgcgcggccacgctcctcctccgacggcgtcaaggactccaccggcaaggacgacgccgccgccgccgacggccgccctgagcgggacccctccatccccaagctcttcaccggagacgtgctggacctgttccccgaggctgcgaagcgggacctgctgctggcgctggcggaggacggcggcggcgcggggtccatgatcaccggcttggccccgcgcggttggtggatctccaagaaggatggcgacgcgttgcagctgaaggtggcgatgccggggctggggaaggagcacgtgaagatgcgggcggagaagaacgtcctggtgatcaagggggagggcgacaaggatgccgagggcgacaaggacgccgagggcgacgacgacaaggtcccggtcccggtcccggtcccggcacggtacatctaccgcatcggcctcccctccaggctttcaagatggaccagatcaaggcggagatgaagaacggcgtgctcatcctgaccatgcccaagatcagggcgaggggcgcaaaggacgtgttc

SEQ ID NO: 7721 - DNA, 819 bp, Sorghum bicolor
  unsure (1)..(819): unsure at all n locations
  Clone ID: SORBI-28MAY03-CLUS119_1
ccacaccttacgccaccgaagcagccgcagccatgcccgacgccgcaacgacgacctccctgctgagcacgctgccgcagctctcgtcgttctcggggaagagctcgcctccgtccgtggtgcacgtggcgcgccgggcgccgacggcggtggtggctgccaaggggtacaatgtgcagatcctggtggacgagaacgagggggaggagtccatcttccgccggttccggcgggaggtgatgcgcgccggcgtgctgcaggagatcaagcgccgccggaggtacgagagtaagacggacgagaagaagcgcaaggcgcgcgaggccggacgccgcaaccgccgcaggcgtatgatggatgagccaaggttcccagaagaagacgctgacgcaacctcaaaggctcgggacgaggacgatgacaactgggagatcgatggcatcctgtgaaacaaaaacaacgcaatgtccataagctcacaacgtccagatgcacagacccggcaaatttgagttctttttggccccagtacgtaagacgcaaaccgtatgagcgtgttcaattccacctcaattgttacaaacagttgcaatgtacaactaaattttagcaaatgcagcatcctccgggcggttcagcataccacaggttaagtgctacatgagacaactccttatgggtctacactattgtcatatcaatcaagttctgcatcgagatattaaaggatctaatctcttgatagacaatcatggtatcttaaagcttgctgattntggccctggcgagatcattttcaaaatgatcanccatgcaaac

SEQ ID NO: 7722 - DNA, 614 bp, Sorghum bicolor
  unsure (1)..(614): unsure at all n locations
  Clone ID: SORBI-28MAY03-CLUS1189_1
gtgaacatttacaatccacaaaatttgctgggtgctccatcactatgaacaaaaaagatataggctagctaattaggtacttacatgttcacctgatgcaatactggtgccgacgtgcttgcctgaactgaggtcctgactcagctctctgatgctntgatattcacctgaaaaaagaaattggtcgctcttccttcacagaacatcaaggatcaaaacacagtgacccagtggctttcttctttagtctctatggaatagaaaactcaggtttgaccatgtcaaccacaagaatgcaagatgagcagagccagccaggagagagagccaaaggaatgcaagtgtgaaagcctcttttccatcctaagtgacaaccataccttactgttttctacttttccatggctttttttaagttcttgcttaagatattcatataaccacaaatggtctacttaagagttcgacattagtggactgatgacggggagcagattgaaattggacaaccaatcaaaatcctcgtgcagcaggaaaggagaagagttggtatacctgcttggaaataaaaaaatccttacacaacatgaagggagaagaggtggccctcgtgc

SEQ ID NO: 7723 - DNA, 479 bp, Sorghum bicolor
  Clone ID: LIB3476-038-P1-K1-G8
aaaaacaaattgtacatttttcattcataaaatataatcacgtgtaacattggagcttgtttggtaactcttcatttcatgattctcgaccggagcgagcattcgggtgaggagctgaaaatatcaagcacacacaacacacattctctcaattttcgctcatcacccgcagctctctccacggccatcccttctcaacagcatggctgcccttctcaatagccaacatcaccacaacatgttcacctgatgcaatactggtgccgacgtgcttgcctgaaccgaggtcctgactcagctctctcttgctttgatattcacctgaaaaaagaaattggtcgctctttcttcacagaacatcaacgatcaaaacacagtgaccaggggctttcttctttagtctctatggaataggaaaatcaggtttaaccatgttaaccacaagaatgcaaaatgagcagagtcagccaggagagaga

SEQ ID NO: 7724 - DNA, 604 bp, Sorghum bicolor
  Clone ID: SORBI-28MAY03-CLUS11909_1
gcacgaggctgccatccgtcgtcgtcctcgtccacacacgccacgcgggtgaacagtgaccgctggactcgccaccgccctcagcttagctcaatgattgggagcgccaagccgctcgcggcgccgctgcagccgccgtcccccaccgctcgctgcctcgccccctcgtcctgcgcccctgactcccccccacctctcacccgcgccgtcaagagcccagctgcccagtctcagtctcagtctcagtctgacgccgccccggccccgccaccaccacgcccggctgaggccgccgcctcgtcccacgtgctgcgcgcgagcccgcagctcagccggtggtcccgggcgcgggcgctgcggtcgggccgccggccggggtcggagtcgtcggaccgcgccaagctgtcctcggcctcggtgctgccggcgaccaagtcgccgcggcccgaggacgctgcggtggcggtggaggatggcggggacgacgacgtgtgcgtggccgagagggacgccgcgcccgggaaggccatctacatcgtgtcggacgggaccgggtggaccgcggagcacgcggtgaacgccgcgctcggacagttcgagcact

SEQ ID NO: 7725 - DNA, 698 bp, Sorghum bicolor
  Clone ID: SORBI-28MAY03-CLUS126574_1
agttgcccacccccaattattgtatatgcacagtagcattattcatttattcatggcctagtctccccatccattactatctttcagtcaattcatgtctgcgtcactacaatgatccaatccagagttgttcaactgattccatcagatgagctacagtgaatggagtaaattaatgtactgcacgttcccttgaagcgcgtggatttgactctctgtatgactaattctttttactcatgttgccaattaaacaatgaggtctgcaggattgctagtttcctcaagtaacaaacttccaagacaaggtccttcaagtaacttgttgtaaatgatgttatgccagttccatcagcatcacataataatctattatagtagagtaaattaatgtactgaacattcccttgaaaaggatgagctctccagctcactgattctttacttcaaattgccaaatatttgtatggttgcttattcctcaattaaccaactcaagaaaatggaactattcaacgcagctttacaaagggtggttatgttcattgcatcaatattatgtatcacatcagtccactgaattcagaaatattttagccctacctaggataaggattttactggatccggcaaagatgtcttcatttttcaactgggtatttacgttcaaaaaaaaaatccgagggggggcccggtac

SEQ ID NO: 7726 - DNA, 635 bp, Sorghum bicolor
  Clone ID: SORBI-28MAY03-CLUS115794_1
gtgtcctcggacgcgcagccgccgccgccggggatgatgtacggtggccagctctaccacccggccgacgtggccggctacatggggatgggccacatgcacgtcgccgtcgccatggacaaggtggcctcgctcgggaccatcctcagacaggcggacgagctgaggatgcaggcgttgcacgcactccggcagatcctgacggcgaggcaggcggcgcgctgcttcatcgccgccgacgactacttctgccgcctccgaacgctcagcacgctctggaccaccagccggacggccaatctggctagaggcccggccgggtagacgtacaactgatctacggcatgggatggaaatggaatacatacgcggccggctagctactagcttagctatatagcctatatgacgtagtaacatagaaagcgttaaactatatacatcacatgcaaatgtatcggtgatatttatagatacaaaatagtatcatatagaagtgcaccagtggttctcttttcaaagttgcaacaattccaaagcagattaattattagtgaggtatacatatgtgtttgaactttgaagggagaaccatcgcttctgaatgaaaatgattgtgatatgatagtcatata

SEQ ID NO: 7727 - DNA, 892 bp, Sorghum bicolor
  Clone ID: SORBI-28MAY03-CLUS11591_1
cctactggtcttctctatccacaccaacagaagcagaactgcggtctgcagaagcacgttggcgctggcgctggcgctggcgcggctgtaactcggccccgtcaccttcctcgccagtgccctttccctccgttgccgacgagcaggagcaggagcccggttccgttcgtgctttgccagaattggagatgccgtctgccacgggtgtactccactgatttggaccgagttgagcaaattctgattcaactgtccaagtgtcaagcccatacaatgcagggcatctctatatgcggctcagttgcttctccccatggagcaaactgcagaagggcttgcattgcaaggaacaatgtgaagctgccttgtgaggttaactcagtaagccagggattatactctttgcattggtgtgtgcataaaccacaaatgaggaccaatggaagaagaatgaaggctgcagtaagaactaatgctagatggttgtttggaggagatggacgtagcaatgatgctaggctggagcgcagcgagtctgctaatgaagatatcttgatcttctacttccagatggatctacagacccggatacaatatgcattgaatatagaacaatttgatgtggcaaagcaattgagggaaaaactaactgagattgaaacagagattattaggcagcgtgaagctaaatccgggattttgtggacagggagtgattacggaactgtaaatcttgatccgtgtgcctgctgacctgcagatagcttttgacagtggaaactatgcttaaggaactaatctctctgacgacattgtcaaactagaagcctagtctcttggcagctcatgctaagctgttgcttaataaaacgtgcaatatgcattttcatta

SEQ ID NO: 7728 - DNA, 581 bp, Sorghum bicolor
  Clone ID: SORBI-28MAY03-CLUS11611_1
ctactggacccaccaccaccgcccccatgccccttcctcctctcctccccgccatggcttccaccttctcccccacttccgccgcgagggccctcctcccggcctccacctcccgcccactcttcctcgccgcagcttcctcaggtcgcattcaaccatccaggaaggggctggacttccgccgcggccggttcaccgtctgcaatgtcgccgcccccaccgccgccgagcaggaggcgacggcgtcgtcggccgcgaaggagagccagcggcccgtgtacccgttcgcggccatcgtggggcaggacgagatgaagctctgcctgctgctcaacgtcatcgaccccaagatcggcggcgtgatgatcatgggcgacaggggcacgggcaagtccaccaccgtgcgctccctcgtcgacctgctcccggacatccgcgtcgtcgtcggcgaccccttcaactccgacccggacgaccccgaggtgatggggcccgaggtccgcgagcgggtgctgcgtggggacgccggcctccccgtcaccaccgccaagatcaccatggtcgacctgcccctcggcgcc

SEQ ID NO: 7729 - DNA, 627 bp, Sorghum bicolor
  Clone ID: SORBI-28MAY03-CLUS11612_1
ggacgtatggaaagcataaggacgatgactcctgaagatttggatgctgcacgagaagagaggcagcttgttgactcactgtggatcacatgctaccatgaaccctccatgctccgcaatgaaggcctccttgttctgcctggggaggaatctttcgaacaacctcctgatgtggctggtagattctttgagccaatgcgccgagcttctgctaggaggacaccccctgttgatagatcagatccaggggatgaaactgggggaggtatggttttgcttttgggtccagcaccagatggtagatcaaattccccccgtcactgatctttctgggtggtgagaccgtgcgtgaggaatggagaaaggaagcagaccgtgctgctgccttgtaattatataagttgcttcgagtattatgtaatgttattaggatctagggacctagtatccattctcaaataagtaaatactatgttgttgtttatgcttgtatagtactagtgactccccaattatgttattatgatgctttaatccttacagatgtgttgtgtcagacgttgagtaaacggtgtgaatactaaacatttcatctaccaaatctcagtagcacaacatttctatttc

SEQ ID NO: 7730 - DNA, 780 bp, Sorghum bicolor
  Clone ID: SORBI-28MAY03-CLUS116519_1
gcacgaggctgcagctggtgtgaccaccgtccctgccaagattctagttttgccggcacacctgtgccgccagttctcgtttgcagagatgaaggctgcaacaaacaattttcattggcggctcattgttggcgagggtgcatttggtagagtttaccgtggcaagatcgatggaggaaaaaccaaggtggccatcaaacgtcacagcccgaactctcggcaaggtgagcatgagtttcgtactgagatagagatgtcatcaaaggtccgccactgtaatgttgcgcaactgatcggctactgcgatgagatgggcgagatgatcctcgtctacgagtatatgccacgcggttgtctgcgcaaccacttgtaccgaacaaagcagccacctctgacctggaaccggcgtctggagatctgcattggtgcagctcgcggcctgcactgccttcatgcgtcacaggtcatctaccgcaacctgaggacggaagacattctgctggatcatgcatgggtcgccaagcttacagatcttgctctctgcaagactgctggtccatcaatggacgagatcacaagagtcattggcagtggatgcctcctcgatcatgaatatgtcaccactggtcgactaactgagaaactagacgtctattcttttggtggtgttttgttgcaggtcctatgtgctcggcctatcctagacataagtcttctaaacgaagaaggtagtacattggtagactgggacattgcactgcaagcaggagtgcaggcttg

SEQ ID NO: 7731 - DNA, 1034 bp, Sorghum bicolor
  Clone ID: SORBI-28MAY03-CLUS11649_1
caaaaacctcctaagttttcgtggatattgtgccgatggacccgaacgcattctggtgtatgactttatggcaaactcaagtctctatgcacatcttcacggaccacattctgcagagtgtctccttgactggcggaggagggcatctattgccatcggcactgctcgggctctcttgtaccttcatcaccatgcaacacctaagataatccatggaagcatcaagaccaccaatgtgttactggattcaaacttccaggcacatgttggtgatttcggtctgataaagcttattcctgatggaatggaccaggaaaagataaccagcgaaagccaacgaggctatcttgctcctgaatacattatgttcgggaaaccaacagaaggttgtgatgtatacagtttcggaataatactattggagcttgcgagtggcaaaaggccaatagaaaagtcgggttctgtcaagacatatggtattcgaaactgggtgctcccactggctaggcagggtagatatgatgaaattgcagactcaaaactcagtgacaagttctctgaatctgaactgagaagaatggtgttagttgggctagcatgtacacattcagaatctgaaaagaggccaacaatgcttgaagttgtgccattgctgaaaggcgaatcaaaagagacccttcttaagcttgaaagagatgagctattcagctcggactcgatggtgagttcgcagggaacaccaaccccagatgggagcacagactctgtgccaaagaaagatcaagaactggctggggcgtgaactgtgaattgctactgtaggctatggtaggatgcatatttgtggtattgatgattggtttgtgcggtttgacatgaatggaaattgtataggcattgttttctgtaaggagtttttttccttcccttttgagagagtaaggaagagcgagggggttggagatagttgttatgcgaagtgctttttgtatgctccgccttgaaaatgcacatgttttccagatgtttgtaat

SEQ ID NO: 7732 - DNA, 1162 bp, Sorghum bicolor
  unsure (1)..(1162): unsure at all n locations
  Clone ID: SORBI-28MAY03-CLUS11667_1
tatggccccttatttcaacgtaaacgtggcttgaattctccgattctcctccacacaaaattcgaacacggatggtacactggtctgtcctgtactactgttcgtctcccggcctcacggtccttatcgcgtcgtcccgtctcggccacctctgtctagatctccctcgtcgacgtctggcgtgcgtcggtgcgtgtacgcgtcacgtcgtcaacctcgagcttgggcatgcaaacctccggcatcggttgtgtcgcggtgaaccggtgattaaccctccttgttttataaggtgcaggcgcgcagccatctaagctaagctaccgagaaaacagaggctaggactaggagttggacagtcacagaggcagccaatggcggagcttcacttcgtgctcgtcccgctggtggcgcagggccacatcatcccgatggtggacctggcgcgcctcctcgccggccgnncggcgcgcgcgtcagcngtggtcaccacngcccgtcaacgccgcngcgcaaccgggnccgtcgtcgacagcgcgcggcgggcggggctcgacgtcgagctcgcggaggtcgcgttccccggcccgggcctcgggctgccggacgggatggagaacgtcgacatggttgtggagaaagaccacttcatgcccttcttccaggccttgtggaagatggacgagccgctggacgagtacgtgcggtcgctgccccggcgtcccgactgcctcatcgccgactggtgcaacccgtggacggcagcggtgtgcgcccgccacggcatccctcgcctggtgatgcactgcccgtccgcctactacctcctcgccacgcacagcctgtccaagcacggcgtgtacgaccgcgtcgccgacgagctggagacgttcgaggtgccggacttccccgtgcgcgccgtcgggaacagggccacgttccgcggcttcttccagtggccaggaatggagaactacgagcgcgacatcgtcgaggccgaggccaccgccgacggcctgctgatcaacacgttccgcgacctcgagggcgtcttcgtcgaccactacgaggcggcgctcggcaggaagacgtgggccgtccggccgacgtgcgccttccgcgggttggacgcggacgcaatggccgggcggggcaaacgcgc

SEQ ID NO: 7733 - DNA, 989 bp, Sorghum bicolor
  Clone ID: SORBI-28MAY03-CLUS119823_1
gccaaagccaaaactacacagacgcgcatgcacgcggcgccggtcagatcatgaccttcccgctggtctgctactgcaacgcggtgccgcgccccgtggccgcgctgttcaagctcctccacgccgtggcgctggtgttcgtgctggtgctctgcttcctcggcctctacgagttcccctacgaccccgaggaccacgcgccggtcatcaacggcccgccccgccgcccgcgtggggacgccccgaggccggaggcggtgaagcagcgcctcccgctcgtcgagttcctggagctgtcgtcgtcatcgtcgtcgtcgggggcggcggagccgacgtgccgggtgtgcctggagaggctggaggcgacggacgaggtgcggcggctgggcaactgcacccacgcgttccacacgcgctgcatcgaccgctggatcgacctgggcgaggtgacgtgcccgctgtgccgctcccacctgctgccgcgtcgacgcgccggcatacttggcatgggcatggcacgcctcggctagtcgtccgtccgtgttcgtccctgattcattctcttgccacgtaagatacgtgcccgcgtggttggcttcaggccgcgcggccggtacgcgtacagatgccactggtgccggataggggcggaccaaccgcgaactgattgcgcgcgattaggacgacgatcgactaaccaccaccctgatgttgttgtgtcgatggatgggcgcaagacaaattaactggaggttggcataaagcatacttgacgcgatatattattgtgtgccggcgttggacgggcaacgctcttgtattattatatatcagaagaaaatcaagttacaaactgttttggcttcggggcgcaaccgtgcaaatgatgtccacgccggccagtaatttggtgcctgctctggtgtgtggagcgttcagcttcagagtattgtttaaatcattatttggaaaatcattcaaataaaaat

SEQ ID NO: 7734 - DNA, 1050 bp, Sorghum bicolor
  Clone ID: SORBI-28MAY03-CLUS120078_1
gcacgaggctccggtttgcttgccttggctgctcagctccattccgcggctcgtggctctctgtcagtcagtcttttgtgtgtgcgtgctcaattcgggatggatagatagatcgatagtgtcactctcactcaactctcagtcgcagccatgtcgccttccttccttttttttttaatttggtttccttttcctttcttctagtgttatgttggccacccgaattgggtggccttcaagtaagcaatcaagcaaagcagctgcaacagattatcatcactcatcacttgctcaatttcactacaacgagaaaggaaacgcatgcaggcttgctctgctatgctctgttgttcccatttggggcggcggcggcattggaggtccagccgcttggttgcttgtcactagtcactactgggtctcttgtgtcagtccacccctgcttgcatcgcagcatccactgtagcaaagctcctgaaggaaggatcctggcaggtttgctgttggggactgtcacaactcaaaacaggaatgtggtttatccttgctttctttgtgagctgtttcttgcaacagaacaagaacaaagcagcaggtccagtcttctcctagttgcaagaaacaaagaggagtgaatacctacagctgcatcagctctcccatcctgtccgatgattgtgttgtgtctgtcagtctcggagggaagggaagacaggctgaggctggccctggctgtaagttgtccacatgtatgttcctcctctcccttgcttgccctgctctgctgcgtctgcttgctgtgattttacttagcaattaagttggtttccttttgagctcttatctggattggattagtgcttgagaataatataagtactgctggtagtctaagtacttatttattagtcatcatcagttgttggtagtagctcagttcaggccctgtcctgtatgtatgtatgagtgtacaccatgtatgtaaccacgtacggatattgtttgatgatgtgtttgttgatcaattaatggacaaaaaataagaatggg

SEQ ID NO: 7735 - DNA, 660 bp, Sorghum bicolor
  Clone ID: SORBI-28MAY03-CLUS1199_1
acgcgtccgatttcaggcatcgcagccgcacgtgctttgtccaatgcttcatttaaggtcacactcttggagtcgagggaccgagttggtggccgtgtgcacactgactattcttttggttgccccattgacatgggagcttcatggttgcatggtgtttgcaacgagaattctttggcgccattgattaggatgcttgggcttagattatatcgcacaagcggtgataactctgttctgtatgaccatgatttggaaagttatgctctatttgataagcatggtcagcaagttccccaggagatagttagcaaagttggagagacatttgagaaaattcttaaggagactgtcaaagtaagagatgaacatgcaaatgacatgcctcttattcaagccatggcaattgtgcttaacaggaatccacatatgaagttggagggcctggaatatgacgtactgcagtggtgtatatgtagactggaagcatggttcgctactgacatggacaatatatctctgaagaattgggatcaggaacatgtgcttaccggtggacatggtcttatggtgaatggctatgatcctgtcatcaaagctctagctcaaggtcttgacattcatctcaaccacagggtcacaaagatcatacaacgttat

SEQ ID NO: 7736 - DNA, 943 bp, Sorghum bicolor
  Clone ID: SORBI-28MAY03-CLUS120357_1
gcacgagggataactatgccgagtctgacattgttatcatcggtgctggttcgtgcggtttgagcgctgcctacatccttggcaagaagcgtcccgatctcaagatcgccattattgaggcttctgtatctcctggtggtggtgcttggctcggtggacagctcttctcggccatgatcatgcgcaagcctgctgatgctttcctccgtgaagtcggtgttccttatgaagatgagggtaactacgtcgttgtcaagcacgccgccctcttcacctcgaccatcatgtccaaggttcttcagatgcctaacatcaagctcttcaatgccacttgtgttgaggatctcatcacccgaccttccgaggagggggtccgcattgccggtgttgtcaccaactggactcttgtttccatgcaccacgatgaccagtcttgcatggaccccaacactattaacgctcctttgatcatctccaccaccggccacgatggccccatgggagctttctgtgtcaagcgtcttgtcagcatgcagcgcatcgagaagcttggtggtatgcgtggtcttgacatgaacctcgccgaggatgccattgtcaagggaacccgcgagattgttccggggcttattgttggtggaatggaactttccgaggttgacggtgccaaccgcatgggtcctaccttcggtgctatggctctcagtggtctcaaggctgccgaggaagctctcaagatcttcgatactcgcaagaagcagaacgatctgtaagcgaggccatggaagaaggtcatttctgagaaacggaacatgtgaattcaggatcctagaccacatctctcattcaaggcatggaaccttgtcatcatttagtatgaggaactcaagtggaaaacagaaacccaaagccgaagtacctacaaaagagagtaaagtaaagc

SEQ ID NO: 7737 - DNA, 908 bp, Sorghum bicolor
  Clone ID: SORBI-28MAY03-CLUS1177_1
cgcacgacggagcgccgggttttttgatattaacttgagaggtcttgatggcatccaaggaccagtttatgtgggaactggttgtgttttcaacagaacagctctatatggttatgagcccccaattaagcaaaagaagaagggtggtttcttgtcatcactatgtggtggcaggaagaagacaaacaaatcaaagaagaagggctcagacaagaaaaagtcacagaagcatgtggacagttctgtgccagtattcaatctcgaagatatagaggagggagttgaaggcgctggatttgatgatgagaaatcacttcttatgtctcaaatgagcttggagaagagatttggtcaatctgcagcttttgttgcctccactctgatggaatatggtggtgttcctcagtctgcaactccggaatctcttctgaaagaagctatccatgttataagttgtggctatgaggacaagactgaatggggaactgagattgggtggatctatggttctgtgacagaagatattcttactggattcaagatgcacgcacgaggctggcggtcgatttactgcatgcctaagcggccagctttcaagggatctgctcccatcaatctttcagatcgtctgaaccaagtgctccggtgggctcttggttctgtggaaattcttttcagccggcattgccccttatggtatggctatggaggacgcctgaagttcttggagagatttgcttacatcaacaccaccatttacccgctcacatctatcccacttctcatttattgtattctgcctgccatctgtctgctcactggaaaattcatcattccagagattagcaacttcgctagtatttggttcatttctctctttatttcaatttttgccattggtatcctcg

SEQ ID NO: 7738 - DNA, 624 bp, Sorghum bicolor
  Clone ID: SORBI-28MAY03-CLUS11741_1
gcacgaggattgatgaagctgctccaggagctgaaaatgaaaaggctagtattgtaaatcaacaaaagttggaaaagaaatttggtcagtcttctgtctttgttacatccacactgctcgagaatggtggaaccttgaagagtgccagtcgagcttctcttctgaaggaagctatacatgtcatcagttgcggctatgaagacaagacagattggggaaaagatattggttggatttatggatcagttacagaagatattcttactgggtttaagatgcactgccatggttggcggtcaatttactgcatacctaaacgggccgctttcaaaggttctgcacctctcaatctttccgatcgtcttcaccaggttcttcggtgggctcttgggtcaattgaaattttcttcagcaatcattggcctctttggtttgggtattagtgtggataaagtgcctgggaaaggttttcatacattaactccatcgtatacccttggacatctatcccgctcttggcctattgcacattgcctgccatctgcttgctgacagggcaatttatcacgccagagcttaacaatgttgccagcccttggttcatgtcactttttatctgcattt

SEQ ID NO: 7739 - DNA, 711 bp, Sorghum bicolor
  Clone ID: SORBI-28MAY03-CLUS11781_1
ctgggaccgtaatattgacgatgaaaatcggcagacaaaggacttcttgattcttgaaagtcatgaagaggctgcagaagaattgccgagcaaagcaaagtttttcttcagtgctgcagttgaaacctgggatgcagaattctatgtcaaagttgaggataacattaatcttgacttagctgggttaatcgagatgctcgaaggccgtcgaggtagccaaggattgtatatgggttgtatgaaatcaggggttgtcataagtgaagagggtcaacaatggtatgaacctgactggtggaaatttggagattcaaaaacgtattttcgacatgcttctggttctttgtttatcctctcaaaaaatttggctcgctacatcaacataaatagtgcatcgctccagagttatgcacacgacgacatatcagtaggttcatggatgatgggactgaatgcaacttacgtcgacgatgaccggttgtgctgcagcagctccagacaagagaaagtctgttctaatgcttgaggtgagcggaaggcgtgactgttggcctgttgctgcacatcctgatgaagattttgtacatctgtcattttgtatacatagaatgcttttgtgaatcggaaaaaggctactatccagatagaattgtcttgccctatcatacatagtactgcctcaccatattttaggagaacaagtttttacca

SEQ ID NO: 7740 - DNA, 708 bp, Sorghum bicolor
  Clone ID: SORBI-28MAY03-CLUS117977_1
ttccagtacgggcgggcgcggcgggacacggtggtggagagccacgacgcggcgtacgaggtgaagaagggcgagctgctgttcgggtaccagccgctggcgacgcgcgacgagcgcgtgttcggccaccgcggccgcgagttcgtcccggaccggttcgccgcctgctccgacgacgacgagcggcggcggctgctggagcacgtggtgtggtccaacgggccggagaccggcgcggccacggaagggaacaaacagtgccccgggaaagacgcggtggtggcggtggggaggctgatggtggcggagctgttccgtcggtacgacacgttcgtcgccaccgtcgaggagtcccccgtggagccggtcgtcacgttcacttcgctgacgagggcggcggcggcttcctccgccgctgccgcgggggaccatgacagcgtcgtcgtcgtcaagccctgatctgatcgatcatgcacagtgctgtgtactgtactgctgtgtgtacagtgtactttgtcttttgtgtgtgatacgtactgcacgtacgtagtcccgtcatgtgcttttcttatgattttgggtggcattagatcaatggtggacaacgacaaaatgtttgatgggggcaataagagcatttctaaattatctgttgtaaatgttacgaattcaaaacatttgctactgtgtgtcatgattttttttttg

SEQ ID NO: 7741 - DNA, 794 bp, Sorghum bicolor
  Clone ID: SORBI-28MAY03-CLUS118041_1
gcacgagggccttctccgtcgtccgccgcatggccgctgcgggcaccccgccgcgcctccgctcctacggcccggccctcttcgcctactgcgacgccaaagacgccgacggcgccaagcaggtcgaggcccacatggacgcctctggcgtcgtgcccgaggagcccgagctcgccgcgttgctccgcgtcaatgcggacaagggcaaggccgatgaggtttacaggctcctgcacaggacgcgcgccctcgtcaggcaggtctgcgacacgaccgcccaggtcgtcgaggcctggttccggtcggacgcagcgtcccaggcgggggtggacaagtgggatcccagcaaggtcaaggagggcgtcgtcaagggcggcggcggctggcatggccagggatggcttggcaagggggcatggagcgttggctggaccgagatggacaaggatgggacatgccaacgctgtggggagaagcttgtctgcatagacattgatccatcggagactgacaactttgcaaattcgctcaccgaacttgccatcaagcgtgaggtcaaggaagacttcctcgggttccagaactggctacgtcgccatggaccattcgatgctgttatagacgctgctaatgtaggcctttacaatagtaaagctttcagtttttcacaggttaactctgttgtaaatgctatacagagagtaactaagtcaaagaagttgccactgatcattttgcataggaaccgtgtaaatggtggtcctgcaaaggctccatacaaccagaagattctg

SEQ ID NO: 7742 - DNA, 1039 bp, Sorghum bicolor
  Clone ID: SORBI-28MAY03-CLUS118386_1
gcacgaggaattcggctgtccgaggaaaacccaggttccaagttctctgatggaatggatggtgatggaagtgagtgatcggatgctcatcaatccccaccctctgattattcttggttaggaatttgtatttactatcttggttggtctgtgaattcaattcaggcgtcatgaacaatgccagtagggattttggccagcggtatccaatgaaccaagaacaagttagaaggcctccaccaatgggccagcgctatgatccagagccatactggaggcaagaacaatctgccccgaggcagtctcggccacaggaactgagcaacgggcagacaaaagagcagtttgttgcggagatgcttgctagaccctcaaatgtcgagtcaggacctgggagaccgcaagcgaggcctaggcagcatcaggacgcctcaccagctcaggggaggtcgcagtcggctgtgtctgagaaacctgcggctcaacttgatgcaaattctgtccgagcaaagctagaactcgcaaagaatgcaaagctagaggcgaccaagagaaagcttcaggaaggctaccaagaatttgataacgcaaagaagcagagaaacatacaaatggtggatccacaaaatctgcccaagcaagggaacaacaaccggaatttccagcctagtggcaagccaaggaataacagcaacgtcaatactagcaacaggaattggtcgagatgaggcaccaattccaattcctttgagcaccagggatcatagattgtaaccttcaaatccctttcaaaaacttgattcttctctctttttttctctctttttgtcggctactaaaatttttatagtccaggccagtacataaacagcaataaggcgtaaggcttgtttcggaattgctcacagtgccccctgggtggcactgagtgaggtgcatgcatgtcctcacaatggctggtcctgctagtggttgtcaatcaaacttgtaaagatacaatgctgagtcgaataccaattctgatcttgagctgctttcg

SEQ ID NO: 7743 - DNA, 1358 bp, Sorghum bicolor
  Clone ID: SORBI-28MAY03-CLUS11465_1
cccacgcgtccgaggacctgcttgaggagttcgaggaggaggccggcgacggcgacagcattcagagcctcgcgcttggggcgcttgacaacagcttcttggtcggtggcgcggggatacaggtggtcaagaacttccgccacggcttgcacgggaagggcgcgtcagtgaagatctcgggagggcgtggcggcagtgggagcgcctattcgacgccgaagaaggcgctgctgatgcgcggtgagactaacatgctgctgatgagcccaggagaggctgtgcgttccaatggtgtccaccatgtcgatatcgagactgggaaggttgtcgctgaatggcggtttgagaaggatggagctgatattacaatgcgagacattgccaacgacagtaagggagcgcagttggaaccctccgggtcgacattcttgggcctggattgcaacaggttgtgtagatgggatatgcgcgagtactggggatggatctattgttgttggttctgtggatggcaaaatcaggctctattctaagagctcgatgcgtatggcgaagacagcattcccagggcttgggtccccaattacacacgtggatgttacttatgatgggaaatggattttgggaacaactgacacatacttgatcttgatctgcactatcttcaaggacaaagatgggaaagaaaaaactgggtttagtggccgtatgggaaataagattgctgcaccaaggctgctgaagctgactccacttgattcaattttagcaggaactgacaacaaattccatggtgggcaattctcatgggtaacggagaacggaaagcaggaaaagcaccttgttgctacagtcggcaaattcagtgtcatttggaatttccagcaagtcaaggacagcaaccatgagtgctaccgtgatcagcagggcctcaagagctgctactgctacaaagttttcctcaaggatgaatcgattgtcgacagccgtttcatgcacgagaagtttgcaagcagcgattctccagaagctccgcttgttgtcgctacaccaatgaaagtcagctccttcagtatagcaaatcgacgctgactctgaagctctttttcccccgctgtgcaaaatagttttgagtagttgcaggttcttgttcagtttgttccttctttagacggtttggctggttggttggttggttttatagttttcttggatcgaggtttcttccggaaagaactggttcgtctgtatggccatttgcagtggctcagtaaaattgtatgtctatgtttgttggacatgtaatgtgatggtgtacaagcaaagtaatgttgatctgagactgatgcttgctctcc

SEQ ID NO: 7744 - DNA, 546 bp, Sorghum bicolor
  unsure (1)..(546): unsure at all n locations
  Clone ID: SORBI-28MAY03-CLUS11483_1
atcatgtaacaaaccttcaaattcaagaaatggcggcaaggtcatccatgctcgtcgttgttgccatcaccttcctcctcgccgctcctccgccggccttctcggcacgaagaagcttccgtgccaccatgacccgcaccgaaccggccatcaacttgacgcgggccgcgcacaagtcccaccaacggctgtccatgctcgccgcccggcttgacgacgctgcctcagggagcgcgcagaccccgctccagctcgacagcggcggcggcgcatacgacatgacgttctccatcggcacgccaccgcaggagctgtcggccctcgccgacaccggcagcgacctcatctgggccaagtgcggcgcgtgcacgcggtgcgttccccagggctccccttcctactacccaaacaagtcgtcgtctttctccaagctgccgtgctccggcagcctctgcagcgacctgccgtcgccccagtgcagcgccggcggcgccgagtgcgactacnagtactcctacgggcttgccagtgatccgcatcgctaca

SEQ ID NO: 7745 - DNA, 699 bp, Sorghum bicolor
  Clone ID: SORBI-28MAY03-CLUS120571_1
cttcgtgctcccgcacgccgtgcacgaggacacgacgctagatgggtaccgcgtgcccgccggcgcgcccgtgaacttcgcggtgggggacatcgggatggacgaggaggtgtggaaggcccccgcggagttccggccggagcggttcctgcccggcggcgagggggaggacgtggacctcaccggcagcaaggagatcaagatgatgccgttcggcgccgggcgccgggtctgcccggggatggcgctggcgatgctgcacctcgagtacttcgtggccaacctcgtgagggagttcgagtggcgcgaggccgacggcgaggaggtggacctcaccgagaagcttgagttcaccgtcgtcatgaagcggccgctcagggccagggccgtgccgctgcggtcaccgccgcccgccgtcgcagctgcttgatgcagggttgctagtacgtactgtacgtagcatcatggcaacgaattggcagttgagtctgcttctcattgctcgtgtgctatatatatatttatatataacgaaatacagtattaggtacgagtaatcacatttctcttgttcttttgggcgctttggtacagacagtagtaaggtaatggcgtaatgctgcagctgcactagtgtgattgtgtgtacatataaaataataagtactgtaagtaaatattttactccattattgaatt

SEQ ID NO: 7746 - DNA, 811 bp, Sorghum bicolor
  Clone ID: SORBI-28MAY03-CLUS12074_1
cacatgattataggtgggcttcctctgcttgttatatctgttcttaatcatgatcctgctctgagtggccatattcaagatcttacattgagcgacatattagcacttggctatacatctatatttggcagtgctgtcagctacggtgtatatttctacaatgctactaggggtagcttaaccacacttagttctctcactttcttgacccccatgtttgcatccgttttcgggtacctctacctgggtgagaccttctcaccagtacagcttggtggtgcgcttctcacactggttgccatctacatggtcaactacaaaagcattataggtgagaaataagaggctaccacatacctgtgtggtttctatcccataagggtggttgggtgctgcatgcagcacctattcccacttattgggttcaggaatctgaagactaaggacaatcgtgaagactcaggcaaattatcggattggagagagatgtgctctgtttcaggtctacaatgaaaatgcagtataaagtgacacaaaaccaaacaggttccatcagttccttcgacattactattagatttcctggttatgtcatcgcatgcttctaggttagccagcagccttttcctctgttacgtggagctgagaaaaaaattataatttataggatgcttccacattgtagttgatatgcattatcagatagggagcattgtgcagtgatcagagcatggaaatagttggaaggaaggctcatttgtatatatgaattcactccattttcaaatatatgctagaatttttgtgggcc

SEQ ID NO: 7747 - DNA, 862 bp, Sorghum bicolor
  Clone ID: SORBI-28MAY03-CLUS120943_1
ctgcttttcagttactgtgggcttgcctgtattgcttgtgtagctattgggaagtggttaaaccgaaggcatgcacttcaacagagagcacaacaaggaattccagtccccgaggatggggttttggttgatatgatccgtgttccggactgggcatttgaggctgttggcctggaaatgagagtgggccaagatactgcatatcatcctggtctttatttaactgcagctcagagagaagcagttgaggcactgattcaagagcttccaaaattcaggctgaaagctgttccaacggactgcagtgaatgtcccatctgccttgaagaatttcatgttggcaatgaggtccgtgggctcccatgcgcgcacaatttccatgtagagtgcatcgaccagtggctccggttgaatgtcaagtgcccacggtgcaggtgctccgtcttccccaacctggacctgagtgcgttgaacaatcttcggtcgaccagtgagccggaccatccatctgccagtgccagtgatgtaacaacggcaactgcagcgacaagatacgtgaggtcgcagccggcagggcaaagctatttggtgcggttgcaggggctgctgctccgccctgtccggcacgagagcgtggagagtgacggtgagccggcggtggccaacagtcgcttggttggcactgaagagctgcctagcatagttgtagatgatggccatcagctgccagatcgctgactgatttgatgacctgaatgattatgagtagggaacattagtaagggaatcaaattatgcagcggtttttcttttgctgtgtattttgcgagtaaataatactgctatataatgttcacgactc

SEQ ID NO: 7748 - DNA, 1362 bp, Sorghum bicolor
  Clone ID: SORBI-28MAY03-CLUS119488_1
gcacgaggcttctcagagccattccttaaagccagaaacatcgccggcgcccttttcagcgttcgacaacaccttcttttagcacctacagcagcaaaaaggcttccttcgcgcatctagtcgcccaccgctccttcagccaactaccgccgcgcaagccgtattctgggcacgccgaagacgatcgaccactcctttggatatatatcagatacaaagcatcttcaagcttcgacagcaaacaccgacatcatgaagttctccaccacctctgttctcctggctgccgccctcggcgtctctgcccaccccagcggccacgttcaccagcgcgcccacaactctgtccaggcccgcggcgacttcgtcatggccaacaagcccgccgccgctcccacctcgaccgccgctcctgtcgccactcctgctccttcttccgctgcccctgccaaggacgccacctctggcagccagggcaccggtgttgcgacctacaccaagttctgccagggcggcaacagcaagcgtgctaccgccgccgagattgcttataagggcaatgttggtggaagcggtcagtacggatgcaacatcatggccgtccagaaccacctcgtcgaccagtacgagtacaccatggttttcaacaatgctggcggcgacgctgagtgcgcttgctggaacaagatcggacccgatggcggtatcaacggcttcttcaacggcaacgaggccctgaagttctccctgcccgctggtggcaagcagaccatcgccatcgacagcaactcccagatcggctgcacttgcggcgtcggcagcattcctctgacccccattggccagttcgccggtacctggatcgagggtgatgttggcaacctctccaacggcggttggtctggttgggacgcctcttccctcgtcgccgccgctgccggcatggacatcccaggcctcaatgtttgcggaactggtgcccaggagggcatctgctctaccatcaaccccggtggcagcggcaagaacgccttcgttgccggcactgcggctatggatggcctgggcctcaactgcccccctggcaaccagtccgtcatggtcaccgttggataccagggttaagttctcgattctcactggacgatgatgggagaagtgggatagagaaaattagttgggctaggttttgggatttattatacatgatttcggcttgagaatttcttacgtggagaatatctacggtgtttttggtgtgtggcttttacggattccccccgatatccatcgagtgtatgggacaaaaaaccactcaaagttgctggaatccgtgttttatatatatattacggttctttt

SEQ ID NO: 7749 - DNA, 820 bp, Sorghum bicolor
  Clone ID: SORBI-28MAY03-CLUS11917_1
gcacgaggcaccggactccctatcccttcgccccctttatccgcgtgctgcaaccccgggcccggcccctgcgcccccgagccgctgccggcgccgcggcacgttgcccgcccgggtgcgccccctcccgcggcccaccctgcggttcacgcgcgctgcccagccgccctgcgggggcccacctcgcgctccacgcgcgccggccgccgcacccacggcgctggtgcggcttccggctcccgcggtgagattgcccttgtatggaccatggagcatttttggagtaaaaggtgagaacctgagtaagcggtgctacacaaccttgaaggtcaaacctagctgtgatatggaagaatcgcagatagctatcaaggatgctacacagagaaatgtggtgggcacaggtactaaggatgctacagagagccctccgatcggggcaaccattaaggatgttataaaggacaataaaactgctattgatgttatatggcctgcaacaatcgatccgaacagtagccatcgtgatggcactatatacaagcaagggaagctttactggacaggttactacaatattgatgtcactgaccgtgatgagactcgggtggagccaatgaggtttgcagcggccacaaattgccatcctgatcccgacaattgctactaccatgagccatgtctaatgatgcagattttctcactgaagttggctaaagcttctataaacagtgggttgatacagttatatggatacatagcagcacgagatgatatcgattcaaagcttaactatgttttcaatcgaagcagagatgat

SEQ ID NO: 7750 - DNA, 350 bp, Sorghum bicolor
  Clone ID: LIB3478-036-P1-K1-B3
ggtttccagctctggctcaacgagattctgcggcagcatcgactattctaaatcggcatctggatcacgtttttagattgcccttgtatggaccatggagcatttttggagtaaaaggtgagaacctgagtaagcggtgctacacaaccttgaaggtcaaacctagctgtgatatggaagaatcgcagatagctatcaaggatgctacacagagaaatgtggtgggcacaggtactaaggatgctacagagagccctccgatcggggcaaccattaaggatgttataaaggacaataaaactgctattgatgttattatggcctgcaacaatcgatccgaacagtagcca

SEQ ID NO: 7751 - DNA, 1154 bp, Sorghum bicolor
  Clone ID: SORBI-28MAY03-CLUS11951_1
cacgattaagcagggatctgtagaggttggcaaggaagtagatgcttgtgttgatgccaaattgaggcagggggctaaggcccatcacactgcaacacatctactacagtctgctcttaaaagtgtggttggttcggaaacttcacaggctggttcccttgtggcgtttgaccgtcttcgatttgacttcaatttccatcgcccactttctgaaggggaattaacaagaattgaattgcttgtaaaccaatggattagcaatgcagcacatcttgagacaaaagtcatggctttgcaagatgcaaaaaatgctggtgctattgcaatgttcggagaaaaatatggtgaacaggtcagagtcgtagaggtccctggggtctcattggaactctgtggtgggactcatgtcagtaatactgctgagattcgtggtttcaagataatttcagaacaaggaatagcttctgggatcagaagaatagaagcagttgcaggtgatgcttttattgactatgtttgtgctcgggacaactacatgcggcgcttatgctcatcccttaaggttaaggctgaagatgtgaacggtagagtagaaacaattcttgaggagctaagagcaaccagaaacgaagtatcatctctacgcagcaaaattgcagtgctaaaagcagcttctcttgcaagtaaagctacaactgtggaaccccagaatgtcaggattgtggtcgagaacatgggcgatgtagatgcagatgggctgaaaagcgctgcggagtacctcataggtaccctccaagaccctgctgcggtgattttaggatcaagcccaggggatggtaaagtcagcctggttgctgccttcagccctgcagtcgtcaagatggggctgcaggcagggaagttcgtgggtggcatagccaagctctgcggcggaggcggtggaggcaagcccaactttgcccaggctggggggcggaagccggagaacttgccggacgcccttgagaaggcccgagctgagattgtggcaggggtatcaagttcgagctgattctctgctgcctcacctgtgatgctagaagtgtagggataggattcatagggaaaatgtattagatatgactgccattggcattccaagcaaaaacagtttg

SEQ ID NO: 7752 - DNA, 567 bp, Sorghum bicolor
  Clone ID: SORBI-28MAY03-CLUS119748_1
ctcgccagcagccacagccacagaacaacacagcaagcaagcagcaaccacacggtcttcgacccgttagccagccagcgccccagtttctgcctcgttttgctagctcctgccgtgcctcaccttgatcaatcggttgatatggcgttcgctgaggaggagacgaagacgacgacggcggcggcggcggcgcaccgcggcaagaacctgatcgagagctcctgcgactcggaggacggctgcctcgccggctgggctccgtccggctcgtgcacgctatccgcgcacgccgaggacgcgccgcttccttcgctggcagccacattggctgccgccgccgccgacgacgactctgacgacgaggaagtccagcagcagcgtgcgcggaagcccagcgggcggtacgtcgtggccgcgcaccgcgcgagcgacacggacgggctctgccgcgctctctcgcgcgcgccgaggcccaaggtgacgtaccgggtggccgggtggggtcggcgtgggcaccgccgtggagggctcccacgccgttcacgtcgaggtccgcgtggacgacga

SEQ ID NO: 7753 - DNA, 675 bp, Sorghum bicolor
  Clone ID: SORBI-28MAY03-CLUS119801_1
atccgagccggggggcagtgcgcgttcccggagctgcggcgctttcagacgagggggtgcccgcggctgaagaggattccgatgcgcccggcgcgcgggcagcagggtaccgtgcggatcgagtgcgacaagcactggtggaacgcgctacagtgggcgggcgaggacaccaaggcctgcttcgtccccgtgctctgagccacttcacttcagtaggcggacggagctgcaattttggcgccagttgatatgttcgacgaccgctgggttgctccacggttcaaggcaagatgagcgatgaaatcggcagtatctgtcgaacggcaataagacggtttacttttggatttcttctgagaacaattcaaactatggcttgattcccgctatgttgtgagctggtgacttggttttagtttaagaactccaagtggacatgggactcttttgatctcataggctaacaaccagtactacccaaaaattagctttagtttatccaaatagaagagctaatggatgaactaattttcagttaacctattggctacttgttacttcttttattttaaaccctaagtcgttttgcttttttacatacatttatttcttgtcatgtatcttaaacatagcatgtaactgatgtatagcaaaagtcaaagccaaaaaacttaa

SEQ ID NO: 7754 - DNA, 889 bp, Sorghum bicolor
  Clone ID: SORBI-28MAY03-CLUS119832_1
gcacgaggccgccaccgctacctttatagctctggcttccttcctccattccctccccatgccttcgtcgcccgggggtcgtgcagccccagcagtcgtcagctactcagcttagagcatcgcacctcatcgttccaccgttcgttcgttcgttcgttcgcgtgatctgcttgggagttggggaagaatggaggcctacgtcctgttcgcgcgcggcaaggaggaggaggaggaggtgatcagcaggttcgaggagcaggaggaggacatcggctgcccgtccgagccctccgcgttgcattccacgtcatcgtcgtcggacggggtggacctcgccgacgacgctagctcgtccgggtccaactcccacttcgagatggcctccctcatgacgcacctcccgatcaagaggggcctgtccaagttcttcgacggcaagtcgcagtcgttcgcgtcgctggcggccgtggccggcctcgaggacctgcccaagccgccgctggcgaagcggctcaagacgtcgcggagctgcggcgtcggcctcaaggacgcgcaccgcggccctccctctgcggccggcaagaagcaggcgtccagagcgcggctgacgacgccgccggcgctcgtctcggcacccagaagactggtgcgagcgcggacgcttgtaacggcgagaccggcggcggccgggaagtccctgttatttgcataggggattcgcccgcctaccagtaaaatcactgccacataatacggttgttacttgttagtttacgtcgaacttgaaaatgaaatggcgactatgcatgcgtgtgtaaatattttgcaagagagctaacatgttacaaaggcgggttttttttcttctaaatttgatccagcttgcatc

SEQ ID NO: 7755 - DNA, 558 bp, Sorghum bicolor
  Clone ID: SORBI-28MAY03-CLUS112282_1
ttcccctggggcggcgccgtggtccgcacctggcagggcctcccgcgccgcttctccggctgcgcctcgggtatcggaggaggtttcggcggcgccaccggaggagcgttccctggagctgtcaggctgtggggcgccagcacggccagcggcggcgagccgtggtgggccgccgtctgcagcgccgatgaaggcggctgccgtcgcgacggcggcgcggccgcggccgcggaggcgggcccgggcgtcgtcgggtggcggcgcgagcacgcgtcgcagcagcagcagcagcggcggcgccggcggcgtgccgttcccctcgctcacacgggccagtgaaacggaacggcacggcaacgggggtggtgggtgtcggatgtgaatatgccacaggggcgaccagctggagatgccgatcccgtgctgggggcccacctgtaagtgggtgggagggagggacgagggggcgggggtgatttattagtgtgggggatgggggaagactggttaggcgccgcgccggcttggttggtgacaacattaattttttttattagt

SEQ ID NO: 7756 - DNA, 744 bp, Sorghum bicolor
  Clone ID: SORBI-28MAY03-CLUS112355_1
catggacaacatcagcctcgaaggttcagttgcagacccaaatgaagctccggagcaggagccagcgctgacccgcaacttcacagtcaggacggtagccggaagcgcccatgagaaggcactgtcgggcgcggtagatgcagttgttgccggcgcagcccacgatcagaattggtcaggccttgatggagtgacgcgggtgaactcactcgtccagcttcccaggttctccgaggagaaggcgattggctgatgaactgcaattctttggtttttaattaacttattttctcctgtttgaaaatttagtttagttgcctgttgtttgagaggaaaggtagaaatgaaacatggtcttgtgatttgcatcgggcgcgtagctagtgtgtttgagccacactgtggttagagtgtttgtgagctgcgacttttaacacagcaaaattgtgcttttctgaagtacaaagggttgatcctgtcctgtgttctaccttcaggtatgataagcatgcctgaaaggtgaaacagcaagcagcaagggcacctttgttcagagcttgcagttttgctgtgtttaaacgaacagctcgtgctctcacagtgggcgcaaacgcatgctaggcgccagtcatctgggatgatgacgctgtcgggtgacctgtaaattccaccatcgtccaccggcacttggcttttgtaaagagatgcgtcggtttgggcttttcccgggcgtagcttttgttg

SEQ ID NO: 7757 - DNA, 814 bp, Sorghum bicolor
  Clone ID: SORBI-28MAY03-CLUS11246_1
tggatattcctgatgcaaaggaaagtggtttatttcacttatgtgaattcatagaagactgtgaattcacctatttgtccacccagatacttcactttttgggaaatgaaggcccaaaaacatcagatcccagtaaatacatacgttatatatacaatagggtgatacttgaaaatgctacagttcgagctagtgcagtcagcacattggcaaagtttggtgccttggttgactcactcaagcctcgcatatttgtgctcctgagacgctgcctgtttgatggggatgatgaggtccgtgacagagcgaccctttacctcaaattgttaggtggggaagctacagttggtgagacagagaaggatgtgaatgaatttctctttggctcacttgatgttccactagcaaacttggagacgagtctgcggaattatgaaccttcggatgtaccttttgatatttcatctgtttcaagggagacaaaatcccaaccccttgctgagaaaaagtctgcaggcaagaaatcagctggtccggcatctgctgtcagtggccctgtttctactgttgatgcttcgtatgagaagcttctttcatccattccggaatttgctgattttggaaagctatttaagtcatctgcacctgtagaattgactgaagctgagactgaatactcagtaaatgttgtgaagcatatttttgatggacatgttgtgcttcaatacaactgtaccaatacaattcctgaacaattgcttgaacaggtggttgtttttgttgatgcttctgaggctgatgaatttttagaagt

SEQ ID NO: 7758 - DNA, 565 bp, Sorghum bicolor
  Clone ID: SORBI-28MAY03-CLUS113055_1
ggtgctggaagggtgggctaagcggatggggctcgcggcggggcccgcgcgccggcgcgccgcggcggccgccgccgcgctccgcgcgctgggccggggcgtggccgccgcccgcgtcccgctccgcgtcgcgatggccgccgcgctctggtccgaggtcgcccccgccgggtgccgcgtcaatggaggcgacgccgccgcgctactccgccgcctggaggccgccgcgcacgtgccggcgaggctggtgctcaccgtcgcgtcgtggatggcgcgcgcggggagccgcccggccgccggccccgcggcggacgcggacggccaggaccaggaccaggaggagggatgggccgagtgctcatgagttcctttctgatccagccgggcccactgctcatccgctgctgcagctgcactgtaccgagcccaaccaagaaaatgtagcaacagcatgtgggcgacgtttgtttgttcttttcctcgctaattattataactgattaattaattaataggagaatgtacgagcgaggggatcgtgtggttggctgcctctcgtgcgatt

SEQ ID NO: 7759 - DNA, 817 bp, Sorghum bicolor
  Clone ID: SORBI-28MAY03-CLUS113127_1
gcacgagggcccctggccgcgggccggagtcggcccgcgccggctgttgcccgcgcctggcgacgggcggggcttcagctcgcgcggctcgcgcagcccctgacgtggagcagcggagacggcgcggctcggcccggcaggcgaccggccttggtcccgcgcgtgcacgcggcacggaggtggccacgcgcacagacggcggctcggctcggcctcgcctcctcgcgcggcgcgcgcgctcgcccaggcggtggccgcccgaaggcacgcaccgcggcctgttcggcgcgggtgggctcggcgcggccggcgtggaggcgcgagcggcaggcggcccgcctgcgcgcgacttagccccggcgggcgaccggcagcggccggcgctgaggtcccgcgggcggctcggcctcgcgtccccgcgcggcgcgcgcgtggctcgtggagcccctgcggctgctgccctggctcgcgtcttcgcacagcgctcgacgcggacgggtgttattttccagctcttcggattgggcattgcttacttcagttcattctagtagtggacagtgcaggttgactactacaaggttagaagtggtttattttctagggatgatggaaaggaaggacctggtattgctactttggtttatgcatagttgaataatgatttctctgtaaccattaataacatttatagtacgtgttgtcattgcaagctgtataaattgcttcattttgtcaaatgttattcatagtattttaatcagagtgttatagctgcaaacaccattatacatatactatttgattattgtaattt

SEQ ID NO: 7760 - DNA, 755 bp, Sorghum bicolor
  Clone ID: SORBI-28MAY03-CLUS113147_1
gcacgaggcaggtctggccacagtgaacaatatcagccagattggtggctcccttggctacacgaccaaggagaccagcacacttgtgtcactctggagcatttggaacttctcagggcggtttggtgcaggcttcatatctgaccatttcccgtcgcctgcgaggagttggcaggccattctttataggtgttacgctgctgatcatgcgcgtcggtcatgccatcatctcctccggtctccctgcatcactctacattgggtcggtgctcatcggcatgtgctacggttgtcagtgggccctgatgccgagcataacatctgagatctttgggctgaaccattttgggaccatattcaacacggtggctgttgcaagccctgttgggtcttacatcctctcggtgcgcattgtgggctacatatacgatattgagtcgtcaccagatgagcactcctgtgtaggtaagcaatgctttgcgctctctttcatgatcatggctggggtctgtatgttcgggtctgctgttgcgtttgtgttgtttatcagaacaaggaagttctataggcgtgtcatatacgcgaggttgcaatctttcctagactagtgagaagtcttcatgaaagatgacgatataacttgcaataatgcttgtacatgtatggtgtatattatgtgagtatttgtataagcgtgaatatataacttttggagattattacatagatggaacatatcttcaactcatggcctg

SEQ ID NO: 7761 - DNA, 838 bp, Sorghum bicolor
  Clone ID: SORBI-28MAY03-CLUS11357_1
gcacgagggttgtttttccttatggctgatgcatgcggccgtcaagagaacaatattttggacctgaaaaggcagatcccattttcctacaggttctggaatctggttgctaccatagtaggctttgttgttccatttgccctgttttttgcaactcgtaggggcactctacagccacaactaccattcattccatttgcagtgttgcttggaccatatcttttactcctatctgtacagatgttgactgagatgcttacatggcactggaaatcgccggtatggttggtagctcctgtggtttatgaaggctatcgagtactacagctgatgaggggtctccagttagctgacgaaattagtgcgcctggctggatggtgcagagtcttcgtggcctggtatcatggtgggtactcgtccttggagtccaattgatgcgcgttgcctggttcgctggactcagttttgctagaaattcaaggtatggagaaagtgatgatatgaaccagtaagtcgtacaagaaaaacttgaggtgtcttctttttggggggctcatggtacttcaacctgcaacaatgctcttcgtgttgatggtggtgcgattttagttgctggacgtacagaaaggccgaacatccttgaaaacctgcaatgcttgggcaatagttttgtaagtgtttttcttttttgtttgcctgtggtaaattgggcagctactcttatgctggagcagagcaggagccaggctgctagatacttcatattatgaacagtgtaattattgtagtatatatatatatatacaggaacatgatcatttgactgagcaccaaaaa

SEQ ID NO: 7762 - DNA, 630 bp, Sorghum bicolor
  Clone ID: SORBI-28MAY03-CLUS1138_1
ctactgggtcgtcctccgcgccggcactgccatacccaaaccataaaccccgcgccgcccgcctcgttccgcgccgccgcacgcgagcaaccttctgaatccacacgcgcagctcggacaggcagctcagagctcgcgaaccagacatggcgaacggggacgcggccgtggaggccggcgggaacgggaaggaggagcccgcggcgcgccaggcttcgacgttcgcggagctgggtatctgcgcggagctcgtggaggcgtgcgacgccatggggtggaaggagcccaccaggattcaggccgaggccatcccccacgcgctccaagggaaggacctgatcgcgctggcgcagacggggtccgggaagacgggcgcgttcgcgctgcccatcctgcaggagctgctcagcaaccgccaggctgagcagtctttcttcgcttgcgtgctctcgccaacgagagagctggcgattcagatcgcggagcagtttgaggcgctcggatcagctattggtttgcgttgctcagtgcttgttggaggagtggatcgggtgcaacaagtgttatccattggaaaacgtccgcacattgtggttggaactcctggccgtcttttggaccatttgacag

SEQ ID NO: 7763 - DNA, 702 bp, Sorghum bicolor
  Clone ID: SORBI-28MAY03-CLUS113994_1
taagcctgggcgccaaggccctgtccgagggcggcttcgacaagctgtacaagcagaccttctcctccagccccgaggagcacctgaagaagacgttcgcttgctacctgtcgacggccaccggccccgtcgccggcacgctctacctgaccaacatgaacgtcgccttctgcagcgaccgcccgctctccttcaccgcgccgtctggccagaccgcttggagctactacaaggttattatccctcttggcaagatcgcgacggtggagccggtgacgatgaaggagaacccgccggagaagtacgtgcacatcgtcaccgtggactcccacgacttctggttcatgggcttcgtcagctacgacaaggccgtgcacaacctcgtcgaggccgtctcccagcgctcccagtcccagcacggcgccggcgtcaccgctgccggcaccaagtgatgagccaccaccgctcgtgagtcttgggcgttttgcacccgcgtcgtgtatagctccgcctgtgcattacttgtgtgacagggacgaagcctgaaaaaaatttagagaaggctgaacaaaaattctacatcgacctagctctactattatccctcgtaataaaaaaatatattagtttaaagtagtcttagattaaaaatatagaccaataataaaattcacaaaatattttaaaaaaaaaaaaaaaaaa

SEQ ID NO: 7764 - DNA, 743 bp, Sorghum bicolor
  Clone ID: SORBI-28MAY03-CLUS11463_1
ggacgcgcgaggtgcgagacaagttcgacgcgctcatggagatcatgatcacggccaaagaggagaagcggcggagtcagggggacgacggggccgagacccccaccaaggacctgctggacatcctcatggacgccgccgcagacgagaacgccgaggtcaggctcaccagggagaacatcaaggcgttcgtgctggacatcttcacggcgggctccgacaccacggcgacgagcgtggagtgggcgctggcgctgctcatcaaccaccgttcctgcatggacaagctgcgcgcggagctggacgccgtggtgggcgcgtcgcggctggtcggtgagcaggacgtggcgcggctgccctacctgcaggccgtcttcaaggagacgctgcgtcttcagccgccggccgtgatcgcgcatcgggagaccatcgagccggtgcacgtccgcggctacgtgatcccgcgcaagaccaccgtcttcttcaacatcttctccatcggccgcgacccgggtggtgggaggaccccctcgagttccgcccggagcgtttcatgcccggcggcgccggagcagccgtcgaccccaaggggcagcacatgcacttcttgccgttcgggagcggccgccgcgcaatgccccggcatgggcccccccatgcaggccgtgccggccttcctcgccgcgctggtgcagtgcttccactgggcggtgcccatcccgcagggccagtccacggcgccg

SEQ ID NO: 7765 - DNA, 918 bp, Sorghum bicolor
  Clone ID: SORBI-28MAY03-CLUS110865_1
gcacgaggcagcaatggccaacaccacatccttccgctcccgcctgctcgtcctcccaccgccaccggcgccccgcaccgccgtgtcctttcgtctccgcccatgcgctaccacggtctcctcgtcctcccagaggaggaggaggccccgcctcgcggcacgggcggcgcagcccggcggcgctgtggccccggcgtcggccgcgtcgaaggaggatgagcaggaggagattggcagcggcgggggtctgtctgcggctgacgcagagaggctgtgtgagttcctgcgggccgacctgccgcacctgttcgacgacgtcggcatcgaccggtctgcatacgacgaccgcgtgcggttccgggaccctatcacccgccacgacaccatcgacggctacctcttcaacatccgcctcctcaagctgctcttccgccccgacttctacctccacgccgtcaagcaggttcggcgcgctcgctactctggcgaggaggactcgcgcgtgcgcagcggaatttgtgggcttgtggcagctattgactgtgctgaatttggttctagacagggccgtacgagctcaccacgaggtggaccatggtgatgaagtttatgctcttgccctggaagccggagctggtcttcactggcctgtcgatcatgggcgtcaacccgcagaatctcaagttcaacagccatgtggttaacactcttgcttatcaggcgacccctccattagtgtggttcgcgtcgggcaggcataagacattgtgttcagttcccctatttggtaccacattgagatgaaacatataagaacacatgcaaatgaggacaatagcacatgtaaagagataaagtagttacaagttgtcaggtgaactagttcagcacacagcaaaaattttcagaggttctctg

SEQ ID NO: 7766 - DNA, 1215 bp, Sorghum bicolor
  Clone ID: SORBI-28MAY03-CLUS11087_1
ctccaacgggttggacgccagagaccacttcgatctgcaccagctcggtgcgaggatgctgcagcactcgcacagcgcgaacgagatgctgctgaggaggaagctggaggagcagcagcagcaggcagccgagctgcagcaggccatggagctccagagccgccgcctcatgggtctgcagctgctggacctcaagactcgctcgtcgccgagccccatcggcatgcccttcagccccacgcgagctgtcgcctctgccaccgtcgagtcaccgcccgattccgcaggggaacacggccccaagggcagcagcggcttctttcttcctcagaggggggagaggccggcggtcaacggaggcgataaggaggaatctgccggcgatgcgagcccgaacgcagacggtgaccaaagtgccgagcacaacctgccggacagcccgtttgcgtcaccgaccaaaaagtccgccgccgcggcgttctctcgcgatcctttcgcgcccagcgactcggagatcgcagccacagcagctgcctcgcccggtcgtaacgccacggccgcctcctttgctggcatcaacaatggcggcggtctcaccggccatctcaggccctctgctctggacataccttcgccaaagccctacttcttccccatgtccaggctgtcctccgatcacggcgccggcgcgatcgggatgtaaagtttagccctcaatgggagggagtatgatactactgcctaatcatagaatactagaagcaaagaaagaagatagtggaatataggtgaaacaaaaaagaatggagaagtcgaagcatagtgttagttcagttcctttttccttttctttcctttccttttttttcatgaaaccaaacctcagtaggagcagatccacaccaagctgagaagcagctcgcagtaacagattagtgcttgctctcctattacattacaacatgcctttaccactaattactaccattagtacttactattaccacccacccaagcattgatgtaatactacctagctagctccatgtccatgatatgatactactgctacaacagccactagttcatataacactctgatagcactaggtgtgatgcttaccaaccacaagaagatactactgctaccacatgtaaccccggactcctacagcactgctctgcttgctgaatgcaaacagccattgcaaagcc
